United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 229

SEQ ID NO: 9477655 - DNA, 22 bp, Homo sapiens
acaaattctctaggcaaggaag

SEQ ID NO: 9477656 - DNA, 22 bp, Homo sapiens
acaaggaacaagcatgtagttt

SEQ ID NO: 9477657 - DNA, 22 bp, Homo sapiens
acaaggaacaagcatgtagttt

SEQ ID NO: 9477658 - DNA, 22 bp, Homo sapiens
acaaggaacaagcatgtagttt

SEQ ID NO: 9477659 - DNA, 22 bp, Homo sapiens
acaattcactccagtgacccca

SEQ ID NO: 9477660 - DNA, 22 bp, Homo sapiens
acaattcaagcaagagagacaa

SEQ ID NO: 9477661 - DNA, 22 bp, Homo sapiens
acaattccacatggcatgcagg

SEQ ID NO: 9477662 - DNA, 22 bp, Homo sapiens
acaattcattaatgtgaggtag

SEQ ID NO: 9477663 - DNA, 22 bp, Homo sapiens
acaattctgatggtttcccagt

SEQ ID NO: 9477664 - DNA, 22 bp, Homo sapiens
acaattagcaaggggaagattt

SEQ ID NO: 9477665 - DNA, 22 bp, Homo sapiens
acaattagctgtgtgtctatct

SEQ ID NO: 9477666 - DNA, 22 bp, Homo sapiens
acaattactcaactttgctgct

SEQ ID NO: 9477667 - DNA, 22 bp, Homo sapiens
acaattaccctggcttgataaa

SEQ ID NO: 9477668 - DNA, 22 bp, Homo sapiens
acaattcaagatgagattcagg

SEQ ID NO: 9477669 - DNA, 22 bp, Homo sapiens
acaattcaagatgagattcagg

SEQ ID NO: 9477670 - DNA, 22 bp, Homo sapiens
acaattagtgatcagtgatgcc

SEQ ID NO: 9477671 - DNA, 22 bp, Homo sapiens
acaattagtgatcagtgatgcc

SEQ ID NO: 9477672 - DNA, 22 bp, Homo sapiens
acaattcaagaagagagatgaa

SEQ ID NO: 9477673 - DNA, 22 bp, Homo sapiens
agatggggctgaaagttccaat

SEQ ID NO: 9477674 - DNA, 22 bp, Homo sapiens
agatgggtaactggagtctgct

SEQ ID NO: 9477675 - DNA, 22 bp, Homo sapiens
agatggggtttcatcatgttgg

SEQ ID NO: 9477676 - DNA, 22 bp, Homo sapiens
agatggggctcagtgtggaggc

SEQ ID NO: 9477677 - DNA, 22 bp, Homo sapiens
agatggggctcagtgtggaggc

SEQ ID NO: 9477678 - DNA, 22 bp, Homo sapiens
agatggggctcagtgtggaggc

SEQ ID NO: 9477679 - DNA, 22 bp, Homo sapiens
agatggggctcagtgtggaggc

SEQ ID NO: 9477680 - DNA, 22 bp, Homo sapiens
agatggggctcagtgtggaggc

SEQ ID NO: 9477681 - DNA, 22 bp, Homo sapiens
agatggggctgaaagttccaat

SEQ ID NO: 9477682 - DNA, 22 bp, Homo sapiens
acaatgttttgaaacatctagg

SEQ ID NO: 9477683 - DNA, 22 bp, Homo sapiens
acaatgtttttgttcaaagagt

SEQ ID NO: 9477684 - DNA, 22 bp, Homo sapiens
acaatgtttttgttcaaagagt

SEQ ID NO: 9477685 - DNA, 22 bp, Homo sapiens
agatgggtaactggagtctgct

SEQ ID NO: 9477686 - DNA, 22 bp, Homo sapiens
acaatgctgttgagacattctt

SEQ ID NO: 9477687 - DNA, 22 bp, Homo sapiens
acaatggcatgctagcaaatgg

SEQ ID NO: 9477688 - DNA, 22 bp, Homo sapiens
acaatgtagaggctgaaagcaa

SEQ ID NO: 9477689 - DNA, 22 bp, Homo sapiens
acaatggcatgctagcaaatgg

SEQ ID NO: 9477690 - DNA, 22 bp, Homo sapiens
agcacaggtacggagatgctac

SEQ ID NO: 9477691 - DNA, 21 bp, Homo sapiens
agcaaggcagcctctcagcct

SEQ ID NO: 9477692 - DNA, 22 bp, Homo sapiens
agcaaggcagctttcactgctt

SEQ ID NO: 9477693 - DNA, 22 bp, Homo sapiens
agcaaggcagctttcactgctt

SEQ ID NO: 9477694 - DNA, 22 bp, Homo sapiens
agcaaggcagctttcactgctt

SEQ ID NO: 9477695 - DNA, 22 bp, Homo sapiens
agcaaggagtagaacaagagtg

SEQ ID NO: 9477696 - DNA, 22 bp, Homo sapiens
agcaaggaaactatggagagat

SEQ ID NO: 9477697 - DNA, 22 bp, Homo sapiens
agcaaggaaagtaggcacggaa

SEQ ID NO: 9477698 - DNA, 22 bp, Homo sapiens
agcaaggattatcctgggaagg

SEQ ID NO: 9477699 - DNA, 22 bp, Homo sapiens
agcacaggtacggagatgctac

SEQ ID NO: 9477700 - DNA, 20 bp, Homo sapiens
agcaccagtgggggcagccc

SEQ ID NO: 9477701 - DNA, 20 bp, Homo sapiens
agcaccagtgggggcagccc

SEQ ID NO: 9477702 - DNA, 20 bp, Homo sapiens
agcaccagtgggggcagccc

SEQ ID NO: 9477703 - DNA, 20 bp, Homo sapiens
agcaccagtgggggcagccc

SEQ ID NO: 9477704 - DNA, 21 bp, Homo sapiens
agcaccagttttatgccaggc

SEQ ID NO: 9477705 - DNA, 22 bp, Homo sapiens
agcaccagtttcgtcgtgacaa

SEQ ID NO: 9477706 - DNA, 21 bp, Homo sapiens
agcaccagttttatgccaggc

SEQ ID NO: 9477707 - DNA, 21 bp, Homo sapiens
agcaccagttttatgccaggc

SEQ ID NO: 9477708 - DNA, 22 bp, Homo sapiens
agcaagattgaggcttcctcag

SEQ ID NO: 9477709 - DNA, 21 bp, Homo sapiens
agcaagcagaatccatctaga

SEQ ID NO: 9477710 - DNA, 22 bp, Homo sapiens
agcaagcacacttcatgtgaac

SEQ ID NO: 9477711 - DNA, 22 bp, Homo sapiens
agcaagcagaaatgccatggca

SEQ ID NO: 9477712 - DNA, 22 bp, Homo sapiens
agcaagcacacttcatgtgaac

SEQ ID NO: 9477713 - DNA, 22 bp, Homo sapiens
agcaagcaggatggtcaaacta

SEQ ID NO: 9477714 - DNA, 22 bp, Homo sapiens
agcaagcagtgaagttgaatgt

SEQ ID NO: 9477715 - DNA, 18 bp, Homo sapiens
agcaagcagttttcatgt

SEQ ID NO: 9477716 - DNA, 18 bp, Homo sapiens
agcaagcagttttcatgt

SEQ ID NO: 9477717 - DNA, 18 bp, Homo sapiens
agcaagcagttttcatgt

SEQ ID NO: 9477718 - DNA, 22 bp, Homo sapiens
agcaagctaacataggagattg

SEQ ID NO: 9477719 - DNA, 22 bp, Homo sapiens
agcaagcattgctggttaggtc

SEQ ID NO: 9477720 - DNA, 22 bp, Homo sapiens
agcaagctgtcaagagagctga

SEQ ID NO: 9477721 - DNA, 22 bp, Homo sapiens
agcaagctgttcttggagagta

SEQ ID NO: 9477722 - DNA, 22 bp, Homo sapiens
agcaaggaaactatggagagat

SEQ ID NO: 9477723 - DNA, 22 bp, Homo sapiens
agacaggctgctgtctgctagg

SEQ ID NO: 9477724 - DNA, 22 bp, Homo sapiens
agacaggccactctggtctggt

SEQ ID NO: 9477725 - DNA, 22 bp, Homo sapiens
agacaggccactctggtctggt

SEQ ID NO: 9477726 - DNA, 22 bp, Homo sapiens
agacaggccactctggtctggt

SEQ ID NO: 9477727 - DNA, 22 bp, Homo sapiens
agacaggcatgaggctggattg

SEQ ID NO: 9477728 - DNA, 22 bp, Homo sapiens
agacagcagaaactagagcact

SEQ ID NO: 9477729 - DNA, 22 bp, Homo sapiens
agacagcaatatgggagacgga

SEQ ID NO: 9477730 - DNA, 22 bp, Homo sapiens
agacagcacttttgtatggggg

SEQ ID NO: 9477731 - DNA, 22 bp, Homo sapiens
agacagcacttttgtatggggg

SEQ ID NO: 9477732 - DNA, 21 bp, Homo sapiens
agacagagtgcagtctacata

SEQ ID NO: 9477733 - DNA, 23 bp, Homo sapiens
agacagaggctgaggctggccgc

SEQ ID NO: 9477734 - DNA, 19 bp, Homo sapiens
agacagagctcagtgggtt

SEQ ID NO: 9477735 - DNA, 23 bp, Homo sapiens
agacagaggctgaggctggccgc

SEQ ID NO: 9477736 - DNA, 19 bp, Homo sapiens
agacagagctcagtgggtt

SEQ ID NO: 9477737 - DNA, 19 bp, Homo sapiens
agacagagctcagtgggtt

SEQ ID NO: 9477738 - DNA, 19 bp, Homo sapiens
agacagagctcagtgggtt

SEQ ID NO: 9477739 - DNA, 19 bp, Homo sapiens
agacagagctcagtgggtt

SEQ ID NO: 9477740 - DNA, 22 bp, Homo sapiens
agacagagatactatgttgtca

SEQ ID NO: 9477741 - DNA, 22 bp, Homo sapiens
agacagagatactatgttgtca

SEQ ID NO: 9477742 - DNA, 23 bp, Homo sapiens
agacactgtaaagaattgcagtt

SEQ ID NO: 9477743 - DNA, 23 bp, Homo sapiens
agacactgtaaagaattgcagtt

SEQ ID NO: 9477744 - DNA, 21 bp, Homo sapiens
agacactggtttagcattcat

SEQ ID NO: 9477745 - DNA, 22 bp, Homo sapiens
aatgcaatgcagcacctccttg

SEQ ID NO: 9477746 - DNA, 22 bp, Homo sapiens
aatgcaatgcagcacctccttg

SEQ ID NO: 9477747 - DNA, 22 bp, Homo sapiens
aatgcaagtcaatgctataccc

SEQ ID NO: 9477748 - DNA, 22 bp, Homo sapiens
aatgcaaggcctgtatctgatt

SEQ ID NO: 9477749 - DNA, 22 bp, Homo sapiens
aatgcaaggcctgtatctgatt

SEQ ID NO: 9477750 - DNA, 22 bp, Homo sapiens
aatgcaaggcctgtatctgatt

SEQ ID NO: 9477751 - DNA, 22 bp, Homo sapiens
aatgcaaagcaagcagagattt

SEQ ID NO: 9477752 - DNA, 22 bp, Homo sapiens
aatgcaaagcaagcagagattt

SEQ ID NO: 9477753 - DNA, 22 bp, Homo sapiens
aatgcaaagctctttaatcctt

SEQ ID NO: 9477754 - DNA, 22 bp, Homo sapiens
aatgcaaagcaagcagagattt

SEQ ID NO: 9477755 - DNA, 22 bp, Homo sapiens
aatgcaaagctctttaatcctt

SEQ ID NO: 9477756 - DNA, 22 bp, Homo sapiens
aatgcaaagctctttaatcctt

SEQ ID NO: 9477757 - DNA, 22 bp, Homo sapiens
aatgcaaagtgaggtgagtggc

SEQ ID NO: 9477758 - DNA, 22 bp, Homo sapiens
aatgcaaagtgaggtgagtggc

SEQ ID NO: 9477759 - DNA, 22 bp, Homo sapiens
aatgcaaagtgaggtgagtggc

SEQ ID NO: 9477760 - DNA, 22 bp, Homo sapiens
aatgcaaatgtaagggtgggat

SEQ ID NO: 9477761 - DNA, 22 bp, Homo sapiens
aatgcaaattatcaggcttctc

SEQ ID NO: 9477762 - DNA, 22 bp, Homo sapiens
aatgcaaattctagggccctat

SEQ ID NO: 9477763 - DNA, 22 bp, Homo sapiens
aatgcaacctgctgatctgaca

SEQ ID NO: 9477764 - DNA, 22 bp, Homo sapiens
aatgcaaattctagggccctat

SEQ ID NO: 9477765 - DNA, 22 bp, Homo sapiens
aatgcaaattatcaggcttctc

SEQ ID NO: 9477766 - DNA, 22 bp, Homo sapiens
aatgcaagatcaaatctaacac

SEQ ID NO: 9477767 - DNA, 22 bp, Homo sapiens
aatgcaaagagttgcttatcaa

SEQ ID NO: 9477768 - DNA, 22 bp, Homo sapiens
aatgcaaagagttgcttatcaa

SEQ ID NO: 9477769 - DNA, 22 bp, Homo sapiens
aatgcaaagcaagcagagattt

SEQ ID NO: 9477770 - DNA, 22 bp, Homo sapiens
aatgcaaagcaagcagagattt

SEQ ID NO: 9477771 - DNA, 22 bp, Homo sapiens
aatgcaaacttcttgttacttg

SEQ ID NO: 9477772 - DNA, 22 bp, Homo sapiens
aatgcaaacttcttgttacttg

SEQ ID NO: 9477773 - DNA, 22 bp, Homo sapiens
aatgcaaacttcttgttacttg

SEQ ID NO: 9477774 - DNA, 22 bp, Homo sapiens
aatgcaaacttcttgttacttg

SEQ ID NO: 9477775 - DNA, 22 bp, Homo sapiens
aatgcaaacttcttgttacttg

SEQ ID NO: 9477776 - DNA, 22 bp, Homo sapiens
aatgcaaacagcccagaatcca

SEQ ID NO: 9477777 - DNA, 22 bp, Homo sapiens
aatgcaaacagcccagaatcca

SEQ ID NO: 9477778 - DNA, 22 bp, Homo sapiens
aatgcaaacagcccagaatcca

SEQ ID NO: 9477779 - DNA, 22 bp, Homo sapiens
aatgcaaacagcccagaatcca

SEQ ID NO: 9477780 - DNA, 22 bp, Homo sapiens
aatgcaaacttcttgttacttg

SEQ ID NO: 9477781 - DNA, 22 bp, Homo sapiens
aatgcaaactccactggagcag

SEQ ID NO: 9477782 - DNA, 22 bp, Homo sapiens
aatgcaaactccactggagcag

SEQ ID NO: 9477783 - DNA, 22 bp, Homo sapiens
agaaggtggctactcagtcatc

SEQ ID NO: 9477784 - DNA, 22 bp, Homo sapiens
agaaggtggctactcagtcatc

SEQ ID NO: 9477785 - DNA, 23 bp, Homo sapiens
agaaggtgggcctgctgagttat

SEQ ID NO: 9477786 - DNA, 22 bp, Homo sapiens
agaagtatgtgagaaattatcc

SEQ ID NO: 9477787 - DNA, 22 bp, Homo sapiens
agaagtatgtgagaaattatcc

SEQ ID NO: 9477788 - DNA, 22 bp, Homo sapiens
agaagtagtccagtggaaagta

SEQ ID NO: 9477789 - DNA, 22 bp, Homo sapiens
agaagggccagctggacacctg

SEQ ID NO: 9477790 - DNA, 22 bp, Homo sapiens
agaagggccagctggacacctg

SEQ ID NO: 9477791 - DNA, 22 bp, Homo sapiens
agaagggtagttgtaagagtga

SEQ ID NO: 9477792 - DNA, 22 bp, Homo sapiens
agaaggggagaagctaccagga

SEQ ID NO: 9477793 - DNA, 22 bp, Homo sapiens
agaaggggcccaaggatgtcag

SEQ ID NO: 9477794 - DNA, 22 bp, Homo sapiens
agacagggtgatcgcttgagcc

SEQ ID NO: 9477795 - DNA, 22 bp, Homo sapiens
agacagggtgatcgcttgagcc

SEQ ID NO: 9477796 - DNA, 22 bp, Homo sapiens
aatgtattcctcatgcaagagt

SEQ ID NO: 9477797 - DNA, 22 bp, Homo sapiens
aatgtattcctcatgcaagagt

SEQ ID NO: 9477798 - DNA, 22 bp, Homo sapiens
aatgtattcctcatgcaagagt

SEQ ID NO: 9477799 - DNA, 22 bp, Homo sapiens
agacagggtgatcgcttgagcc

SEQ ID NO: 9477800 - DNA, 22 bp, Homo sapiens
agacagggtgatcgcttgagcc

SEQ ID NO: 9477801 - DNA, 22 bp, Homo sapiens
agacagggtgatcgcttgagcc

SEQ ID NO: 9477802 - DNA, 22 bp, Homo sapiens
agacagggtcttgatcagagct

SEQ ID NO: 9477803 - DNA, 22 bp, Homo sapiens
agacagggtcttgatcagagct

SEQ ID NO: 9477804 - DNA, 22 bp, Homo sapiens
agacagggtcttgatcagagct

SEQ ID NO: 9477805 - DNA, 22 bp, Homo sapiens
agacagggtcttgatcagagct

SEQ ID NO: 9477806 - DNA, 22 bp, Homo sapiens
agacagggtcttgatcagagct

SEQ ID NO: 9477807 - DNA, 22 bp, Homo sapiens
agacagggagggagcgcggctg

SEQ ID NO: 9477808 - DNA, 22 bp, Homo sapiens
agacagggagggagcgcggctg

SEQ ID NO: 9477809 - DNA, 22 bp, Homo sapiens
agacagggccactcatcctcac

SEQ ID NO: 9477810 - DNA, 22 bp, Homo sapiens
agacagggccactcatcctcac

SEQ ID NO: 9477811 - DNA, 22 bp, Homo sapiens
aatgtcatagcatttcttcaat

SEQ ID NO: 9477812 - DNA, 22 bp, Homo sapiens
aatgtcattgagctccaatcct

SEQ ID NO: 9477813 - DNA, 22 bp, Homo sapiens
aatgtcattggtaaagattagg

SEQ ID NO: 9477814 - DNA, 22 bp, Homo sapiens
aatgtcattgagctccaatcct

SEQ ID NO: 9477815 - DNA, 22 bp, Homo sapiens
aatgtcatgggaatttattcat

SEQ ID NO: 9477816 - DNA, 21 bp, Homo sapiens
aatgtcattgaatggtgagac

SEQ ID NO: 9477817 - DNA, 22 bp, Homo sapiens
aatgtcactctgtttcctctgc

SEQ ID NO: 9477818 - DNA, 22 bp, Homo sapiens
aatgtcactctgtttcctctgc

SEQ ID NO: 9477819 - DNA, 22 bp, Homo sapiens
aatgtcagcctgaaagctattc

SEQ ID NO: 9477820 - DNA, 22 bp, Homo sapiens
aatgtcatagcaaagagagtga

SEQ ID NO: 9477821 - DNA, 22 bp, Homo sapiens
aatgtcaatctcagagaacaca

SEQ ID NO: 9477822 - DNA, 22 bp, Homo sapiens
aatgtattctctttataagata

SEQ ID NO: 9477823 - DNA, 22 bp, Homo sapiens
aatgtcaattaccagaacagaa

SEQ ID NO: 9477824 - DNA, 22 bp, Homo sapiens
aatgtcaattaccagaacagaa

SEQ ID NO: 9477825 - DNA, 22 bp, Homo sapiens
aatgtcctcagaggtgtgtaga

SEQ ID NO: 9477826 - DNA, 22 bp, Homo sapiens
aatgtcctaggcatgattttgt

SEQ ID NO: 9477827 - DNA, 19 bp, Homo sapiens
aatgtcctcctctcttttc

SEQ ID NO: 9477828 - DNA, 22 bp, Homo sapiens
aatgtcctggagggcggccgct

SEQ ID NO: 9477829 - DNA, 22 bp, Homo sapiens
aatgtcctctttagagggttac

SEQ ID NO: 9477830 - DNA, 18 bp, Homo sapiens
aatgtccagtgttcatat

SEQ ID NO: 9477831 - DNA, 17 bp, Homo sapiens
aatgtccttggaccaca

SEQ ID NO: 9477832 - DNA, 17 bp, Homo sapiens
aatgtccttggaccaca

SEQ ID NO: 9477833 - DNA, 22 bp, Homo sapiens
aatgtcctgttaaattttccca

SEQ ID NO: 9477834 - DNA, 22 bp, Homo sapiens
aatgtctacaccgtatgttgtt

SEQ ID NO: 9477835 - DNA, 17 bp, Homo sapiens
aatgtccttggaccaca

SEQ ID NO: 9477836 - DNA, 22 bp, Homo sapiens
aatgtctatgatcctttaagtt

SEQ ID NO: 9477837 - DNA, 22 bp, Homo sapiens
aatgtctatgaaatgaaaggga

SEQ ID NO: 9477838 - DNA, 22 bp, Homo sapiens
aatgtctagagttttaagctta

SEQ ID NO: 9477839 - DNA, 22 bp, Homo sapiens
aatgtctatttgctacaaagcc

SEQ ID NO: 9477840 - DNA, 22 bp, Homo sapiens
aatgtctagacatgttaatgca

SEQ ID NO: 9477841 - DNA, 22 bp, Homo sapiens
aatgtctacattctgaattcgt

SEQ ID NO: 9477842 - DNA, 22 bp, Homo sapiens
aatgtctacattctgaattcgt

SEQ ID NO: 9477843 - DNA, 22 bp, Homo sapiens
aatgtcatttaaaataattctg

SEQ ID NO: 9477844 - DNA, 22 bp, Homo sapiens
aatgtcatttaaaataattctg

SEQ ID NO: 9477845 - DNA, 22 bp, Homo sapiens
aatgtcattggtaaagattagg

SEQ ID NO: 9477846 - DNA, 22 bp, Homo sapiens
aatgtcatttaggattatgttt

SEQ ID NO: 9477847 - DNA, 22 bp, Homo sapiens
aatgtctgctctactcaggagg

SEQ ID NO: 9477848 - DNA, 22 bp, Homo sapiens
aatgtctgcctgaactttatat

SEQ ID NO: 9477849 - DNA, 22 bp, Homo sapiens
aatgtctgaggctcatctgagg

SEQ ID NO: 9477850 - DNA, 22 bp, Homo sapiens
aatgtcttaaagtcgtgttaca

SEQ ID NO: 9477851 - DNA, 22 bp, Homo sapiens
aatgtcttcagtgtatacatgg

SEQ ID NO: 9477852 - DNA, 22 bp, Homo sapiens
aattatatgttaatcttcaatt

SEQ ID NO: 9477853 - DNA, 22 bp, Homo sapiens
aattatatgttaatcttcaatt

SEQ ID NO: 9477854 - DNA, 22 bp, Homo sapiens
aattatatgttaatcttcaatt

SEQ ID NO: 9477855 - DNA, 22 bp, Homo sapiens
aattatattgaagttgaatgtc

SEQ ID NO: 9477856 - DNA, 22 bp, Homo sapiens
aattatattgaagttgaatgtc

SEQ ID NO: 9477857 - DNA, 22 bp, Homo sapiens
aattatattgaagttgaatgtc

SEQ ID NO: 9477858 - DNA, 22 bp, Homo sapiens
aattatatgttaatcttcaatt

SEQ ID NO: 9477859 - DNA, 22 bp, Homo sapiens
aattatatgttaatcttcaatt

SEQ ID NO: 9477860 - DNA, 22 bp, Homo sapiens
aattatatgttaatcttcaatt

SEQ ID NO: 9477861 - DNA, 20 bp, Homo sapiens
aattatataactccaacatt

SEQ ID NO: 9477862 - DNA, 20 bp, Homo sapiens
aattatataactccaacatt

SEQ ID NO: 9477863 - DNA, 22 bp, Homo sapiens
aattatacattgaacaatctag

SEQ ID NO: 9477864 - DNA, 20 bp, Homo sapiens
aattatataactccaacatt

SEQ ID NO: 9477865 - DNA, 20 bp, Homo sapiens
aattatataactccaacatt

SEQ ID NO: 9477866 - DNA, 22 bp, Homo sapiens
aattatacattgaacaatctag

SEQ ID NO: 9477867 - DNA, 22 bp, Homo sapiens
aattagtattgcgattcattag

SEQ ID NO: 9477868 - DNA, 22 bp, Homo sapiens
aattatacaattgtcaagttct

SEQ ID NO: 9477869 - DNA, 22 bp, Homo sapiens
aattatacaattgtcaagttct

SEQ ID NO: 9477870 - DNA, 22 bp, Homo sapiens
aattatattgtggtgtgaatgt

SEQ ID NO: 9477871 - DNA, 22 bp, Homo sapiens
aattatattgtggtgtgaatgt

SEQ ID NO: 9477872 - DNA, 22 bp, Homo sapiens
aattatattgtggtgtgaatgt

SEQ ID NO: 9477873 - DNA, 23 bp, Homo sapiens
aattatctatttcaaatttagca

SEQ ID NO: 9477874 - DNA, 23 bp, Homo sapiens
aattatctatttcaaatttagca

SEQ ID NO: 9477875 - DNA, 22 bp, Homo sapiens
aattatccacctttgcatgatt

SEQ ID NO: 9477876 - DNA, 22 bp, Homo sapiens
aattatcagatataaaactgca

SEQ ID NO: 9477877 - DNA, 22 bp, Homo sapiens
aattggaaaaagacttaattgc

SEQ ID NO: 9477878 - DNA, 22 bp, Homo sapiens
aattatggtggatcccagtggg

SEQ ID NO: 9477879 - DNA, 22 bp, Homo sapiens
aattatggtgtgtggttaaggg

SEQ ID NO: 9477880 - DNA, 22 bp, Homo sapiens
aattatgaggtagatatcacat

SEQ ID NO: 9477881 - DNA, 22 bp, Homo sapiens
aattatggaatttttagagaag

SEQ ID NO: 9477882 - DNA, 22 bp, Homo sapiens
aattatgcaaccaatgaccacg

SEQ ID NO: 9477883 - DNA, 22 bp, Homo sapiens
aattatggtcactgttcctggg

SEQ ID NO: 9477884 - DNA, 22 bp, Homo sapiens
aattatggtatgttcaacaact

SEQ ID NO: 9477885 - DNA, 21 bp, Homo sapiens
aatttagtcaacagactgtgg

SEQ ID NO: 9477886 - DNA, 22 bp, Homo sapiens
aatttagtccttacagtgcaga

SEQ ID NO: 9477887 - DNA, 19 bp, Homo sapiens
aatttagttcttgtttaga

SEQ ID NO: 9477888 - DNA, 22 bp, Homo sapiens
aatttagtgtaaagctactgga

SEQ ID NO: 9477889 - DNA, 22 bp, Homo sapiens
aatttagtgtaaagctactgga

SEQ ID NO: 9477890 - DNA, 23 bp, Homo sapiens
aatttagtttgagacattagcct

SEQ ID NO: 9477891 - DNA, 22 bp, Homo sapiens
aatttataataaatagggcttt

SEQ ID NO: 9477892 - DNA, 22 bp, Homo sapiens
agagctgggacttggactcaat

SEQ ID NO: 9477893 - DNA, 22 bp, Homo sapiens
aatttatatgtaattaggcaca

SEQ ID NO: 9477894 - DNA, 22 bp, Homo sapiens
agagctggggccagagtcaagg

SEQ ID NO: 9477895 - DNA, 22 bp, Homo sapiens
agagctggggccagagtcaagg

SEQ ID NO: 9477896 - DNA, 22 bp, Homo sapiens
agagctggggcataaatgccac

SEQ ID NO: 9477897 - DNA, 22 bp, Homo sapiens
agagctggggcataaatgccac

SEQ ID NO: 9477898 - DNA, 22 bp, Homo sapiens
agagctgggacttggactcaat

SEQ ID NO: 9477899 - DNA, 22 bp, Homo sapiens
aatttacagttgctgatggtac

SEQ ID NO: 9477900 - DNA, 22 bp, Homo sapiens
aatttacagttgctgatggtac

SEQ ID NO: 9477901 - DNA, 22 bp, Homo sapiens
aatttacagttgctgatggtac

SEQ ID NO: 9477902 - DNA, 22 bp, Homo sapiens
aatttacagttgctgatggtac

SEQ ID NO: 9477903 - DNA, 20 bp, Homo sapiens
aatttactcacagaatgaat

SEQ ID NO: 9477904 - DNA, 22 bp, Homo sapiens
aatttagaattcgctagctaat

SEQ ID NO: 9477905 - DNA, 20 bp, Homo sapiens
aatttactcacagaatgaat

SEQ ID NO: 9477906 - DNA, 20 bp, Homo sapiens
aatttactcacagaatgaat

SEQ ID NO: 9477907 - DNA, 22 bp, Homo sapiens
aatttacaggtgcactcgccat

SEQ ID NO: 9477908 - DNA, 22 bp, Homo sapiens
aatttacaggtgcactcgccat

SEQ ID NO: 9477909 - DNA, 22 bp, Homo sapiens
aatttacaggtgcactcgccat

SEQ ID NO: 9477910 - DNA, 22 bp, Homo sapiens
aatttacagttgctgatggtac

SEQ ID NO: 9477911 - DNA, 22 bp, Homo sapiens
aatttacacttcatttggaggg

SEQ ID NO: 9477912 - DNA, 22 bp, Homo sapiens
aatttacacttcatttggaggg

SEQ ID NO: 9477913 - DNA, 22 bp, Homo sapiens
aatttacacttcatttggaggg

SEQ ID NO: 9477914 - DNA, 22 bp, Homo sapiens
aattagtaacctaattccatct

SEQ ID NO: 9477915 - DNA, 22 bp, Homo sapiens
aattagtaacctaattccatct

SEQ ID NO: 9477916 - DNA, 22 bp, Homo sapiens
aattagtattgcgattcattag

SEQ ID NO: 9477917 - DNA, 22 bp, Homo sapiens
aattagtattgcgattcattag

SEQ ID NO: 9477918 - DNA, 22 bp, Homo sapiens
aattagtattgcgattcattag

SEQ ID NO: 9477919 - DNA, 22 bp, Homo sapiens
aattagtaacctaattccatct

SEQ ID NO: 9477920 - DNA, 22 bp, Homo sapiens
aattaggaaattcagccatttt

SEQ ID NO: 9477921 - DNA, 22 bp, Homo sapiens
aattagggaaaatttacttgta

SEQ ID NO: 9477922 - DNA, 22 bp, Homo sapiens
aattaccatcgtcaaatcatat

SEQ ID NO: 9477923 - DNA, 22 bp, Homo sapiens
aattacctgtcatacatcaagc

SEQ ID NO: 9477924 - DNA, 20 bp, Homo sapiens
aattagcttaagtcaatcag

SEQ ID NO: 9477925 - DNA, 22 bp, Homo sapiens
aatgttgtgcatgtattttgta

SEQ ID NO: 9477926 - DNA, 19 bp, Homo sapiens
aatgtttaagagaaaaagg

SEQ ID NO: 9477927 - DNA, 19 bp, Homo sapiens
aatgtttaagagaaaaagg

SEQ ID NO: 9477928 - DNA, 19 bp, Homo sapiens
aatgtttaagagaaaaagg

SEQ ID NO: 9477929 - DNA, 19 bp, Homo sapiens
aatgtttaagagaaaaagg

SEQ ID NO: 9477930 - DNA, 22 bp, Homo sapiens
aatgtttaatgttagtggtaat

SEQ ID NO: 9477931 - DNA, 22 bp, Homo sapiens
aatgtttgaactttgcatattt

SEQ ID NO: 9477932 - DNA, 22 bp, Homo sapiens
aatgtttaatgttagtggtaat

SEQ ID NO: 9477933 - DNA, 22 bp, Homo sapiens
aatgtttaatgttagtggtaat

SEQ ID NO: 9477934 - DNA, 22 bp, Homo sapiens
aatgtttcgtaaattgtctatg

SEQ ID NO: 9477935 - DNA, 22 bp, Homo sapiens
aatgtttcattcttgcccattg

SEQ ID NO: 9477936 - DNA, 22 bp, Homo sapiens
aatgtttcatttagttgtctcc

SEQ ID NO: 9477937 - DNA, 22 bp, Homo sapiens
aatgttcaaacagatcacttag

SEQ ID NO: 9477938 - DNA, 22 bp, Homo sapiens
aatgttatttctgcatagtagt

SEQ ID NO: 9477939 - DNA, 22 bp, Homo sapiens
aatgttcaaacagatcacttag

SEQ ID NO: 9477940 - DNA, 22 bp, Homo sapiens
aatgttcaacagatggatattt

SEQ ID NO: 9477941 - DNA, 22 bp, Homo sapiens
aatgttcagaggacaatataaa

SEQ ID NO: 9477942 - DNA, 22 bp, Homo sapiens
aatgttcagctttcttacttaa

SEQ ID NO: 9477943 - DNA, 20 bp, Homo sapiens
aatgttcagtaattgtttta

SEQ ID NO: 9477944 - DNA, 22 bp, Homo sapiens
aatgttgcagagtgattgtcca

SEQ ID NO: 9477945 - DNA, 22 bp, Homo sapiens
aatgttgtaaatattctttgag

SEQ ID NO: 9477946 - DNA, 22 bp, Homo sapiens
aatgttcagtatctggtccacc

SEQ ID NO: 9477947 - DNA, 22 bp, Homo sapiens
aatgttcagtgcctttaaacat

SEQ ID NO: 9477948 - DNA, 22 bp, Homo sapiens
aatgttcagtgcctttaaacat

SEQ ID NO: 9477949 - DNA, 22 bp, Homo sapiens
aatgttcagtgcctttaaacat

SEQ ID NO: 9477950 - DNA, 22 bp, Homo sapiens
aatgttcagtgcctttaaacat

SEQ ID NO: 9477951 - DNA, 22 bp, Homo sapiens
aatgttcattgttttccatatg

SEQ ID NO: 9477952 - DNA, 22 bp, Homo sapiens
aatgttcattagcattgttgac

SEQ ID NO: 9477953 - DNA, 22 bp, Homo sapiens
aatgttcattgattaaatgaat

SEQ ID NO: 9477954 - DNA, 22 bp, Homo sapiens
aatgttcattgttttccatatg

SEQ ID NO: 9477955 - DNA, 22 bp, Homo sapiens
aatgttctcaacaaaaggaagc

SEQ ID NO: 9477956 - DNA, 22 bp, Homo sapiens
gccagccacaagggaggcttgt

SEQ ID NO: 9477957 - DNA, 22 bp, Homo sapiens
gccagccacaagggaggcttgt

SEQ ID NO: 9477958 - DNA, 22 bp, Homo sapiens
gccagccaagattgagaaggta

SEQ ID NO: 9477959 - DNA, 22 bp, Homo sapiens
gccagccaagattgagaaggta

SEQ ID NO: 9477960 - DNA, 22 bp, Homo sapiens
gccagagttgaggcagtttatt

SEQ ID NO: 9477961 - DNA, 22 bp, Homo sapiens
gccagagtcttctgaccctgtg

SEQ ID NO: 9477962 - DNA, 22 bp, Homo sapiens
attgtacatgcagtgagtcatc

SEQ ID NO: 9477963 - DNA, 22 bp, Homo sapiens
attgtacatgcagtgagtcatc

SEQ ID NO: 9477964 - DNA, 19 bp, Homo sapiens
attgtacattgagtttggc

SEQ ID NO: 9477965 - DNA, 22 bp, Homo sapiens
attgtactacaccatagtactg

SEQ ID NO: 9477966 - DNA, 22 bp, Homo sapiens
attgtactagaaattgtattca

SEQ ID NO: 9477967 - DNA, 22 bp, Homo sapiens
attgtacatgcagtgagtcatc

SEQ ID NO: 9477968 - DNA, 22 bp, Homo sapiens
attgtacatatgatgtatgtaa

SEQ ID NO: 9477969 - DNA, 22 bp, Homo sapiens
attgtacataaaatgtatgtct

SEQ ID NO: 9477970 - DNA, 22 bp, Homo sapiens
attgtacaggttggaggaagtg

SEQ ID NO: 9477971 - DNA, 22 bp, Homo sapiens
attgtacagctctgagaggggg

SEQ ID NO: 9477972 - DNA, 22 bp, Homo sapiens
attgtacagatgaggtaagtga

SEQ ID NO: 9477973 - DNA, 22 bp, Homo sapiens
attgtacagacatgggaaacaa

SEQ ID NO: 9477974 - DNA, 20 bp, Homo sapiens
gcatggcatgtagtgaagtg

SEQ ID NO: 9477975 - DNA, 22 bp, Homo sapiens
gcatggcagtgaggatggtgct

SEQ ID NO: 9477976 - DNA, 22 bp, Homo sapiens
gccagccacttcccagactggc

SEQ ID NO: 9477977 - DNA, 22 bp, Homo sapiens
gccagccacttcagctatggct

SEQ ID NO: 9477978 - DNA, 22 bp, Homo sapiens
gccagccacttcagctatggct

SEQ ID NO: 9477979 - DNA, 22 bp, Homo sapiens
gccagccacgttagactggccc

SEQ ID NO: 9477980 - DNA, 22 bp, Homo sapiens
gccagccacttcccagactggc

SEQ ID NO: 9477981 - DNA, 22 bp, Homo sapiens
gccagccagaaacgtcacactg

SEQ ID NO: 9477982 - DNA, 23 bp, Homo sapiens
gccagccagaatttctccactgt

SEQ ID NO: 9477983 - DNA, 22 bp, Homo sapiens
gccagccagagaggcatggtta

SEQ ID NO: 9477984 - DNA, 22 bp, Homo sapiens
gccagccagagaggcatggtta

SEQ ID NO: 9477985 - DNA, 22 bp, Homo sapiens
gccagccagagaggcatggtta

SEQ ID NO: 9477986 - DNA, 18 bp, Homo sapiens
gccagccaggcgttgctc

SEQ ID NO: 9477987 - DNA, 22 bp, Homo sapiens
gccagccagagtggctgtgtgt

SEQ ID NO: 9477988 - DNA, 22 bp, Homo sapiens
gccagccagagtggctgtgtgt

SEQ ID NO: 9477989 - DNA, 22 bp, Homo sapiens
gccagctgctggaacagcgcga

SEQ ID NO: 9477990 - DNA, 22 bp, Homo sapiens
gccagctgctcgcgtagggtag

SEQ ID NO: 9477991 - DNA, 20 bp, Homo sapiens
gccagctgcccttccaccct

SEQ ID NO: 9477992 - DNA, 22 bp, Homo sapiens
gccagctgcatctcctgggctg

SEQ ID NO: 9477993 - DNA, 22 bp, Homo sapiens
gccagctgcatctcctgggctg

SEQ ID NO: 9477994 - DNA, 21 bp, Homo sapiens
gccagctgcagggcttccttg

SEQ ID NO: 9477995 - DNA, 18 bp, Homo sapiens
gccagctgcacggccctc

SEQ ID NO: 9477996 - DNA, 21 bp, Homo sapiens
gccagctgcagggcttccttg

SEQ ID NO: 9477997 - DNA, 22 bp, Homo sapiens
gccagccataggccagcactgg

SEQ ID NO: 9477998 - DNA, 22 bp, Homo sapiens
gccagccataggccagcactgg

SEQ ID NO: 9477999 - DNA, 18 bp, Homo sapiens
gccagctgcacggccctc

SEQ ID NO: 9478000 - DNA, 22 bp, Homo sapiens
gccagccagtttgctgatggct

SEQ ID NO: 9478001 - DNA, 22 bp, Homo sapiens
gccagccagtttgctgatggct

SEQ ID NO: 9478002 - DNA, 22 bp, Homo sapiens
gccagccagtttgctgatggct

SEQ ID NO: 9478003 - DNA, 22 bp, Homo sapiens
gccagctggaaatctgcttgaa

SEQ ID NO: 9478004 - DNA, 22 bp, Homo sapiens
gccagctggagactggcagggg

SEQ ID NO: 9478005 - DNA, 22 bp, Homo sapiens
gccagctgcttctccagaattt

SEQ ID NO: 9478006 - DNA, 22 bp, Homo sapiens
gccagctgctggaacagcgcga

SEQ ID NO: 9478007 - DNA, 22 bp, Homo sapiens
gccagctggaaatctgcttgaa

SEQ ID NO: 9478008 - DNA, 21 bp, Homo sapiens
atttagaaggaaattttgcaa

SEQ ID NO: 9478009 - DNA, 21 bp, Homo sapiens
atttagaaggaaattttgcaa

SEQ ID NO: 9478010 - DNA, 22 bp, Homo sapiens
atttagtttaggaaaagtaggt

SEQ ID NO: 9478011 - DNA, 22 bp, Homo sapiens
atttagtttaggaaaagtaggt

SEQ ID NO: 9478012 - DNA, 22 bp, Homo sapiens
atttatctctggaaactaagca

SEQ ID NO: 9478013 - DNA, 22 bp, Homo sapiens
atttatctctggaaactaagca

SEQ ID NO: 9478014 - DNA, 18 bp, Homo sapiens
atttatcctttgtattac

SEQ ID NO: 9478015 - DNA, 22 bp, Homo sapiens
atttatgacaaccaaagagtga

SEQ ID NO: 9478016 - DNA, 22 bp, Homo sapiens
atttatgacaaccaaagagtga

SEQ ID NO: 9478017 - DNA, 18 bp, Homo sapiens
atttatcctttgtattac

SEQ ID NO: 9478018 - DNA, 22 bp, Homo sapiens
atttatgacgtgttcggtcaat

SEQ ID NO: 9478019 - DNA, 22 bp, Homo sapiens
atttatgacagaagatatgctg

SEQ ID NO: 9478020 - DNA, 22 bp, Homo sapiens
atttatgacagaagatatgctg

SEQ ID NO: 9478021 - DNA, 22 bp, Homo sapiens
atttatgacagaagatatgctg

SEQ ID NO: 9478022 - DNA, 18 bp, Homo sapiens
atttatcctttgtattac

SEQ ID NO: 9478023 - DNA, 22 bp, Homo sapiens
atttatgactggtgaatagaac

SEQ ID NO: 9478024 - DNA, 22 bp, Homo sapiens
atttatgactggtgaatagaac

SEQ ID NO: 9478025 - DNA, 22 bp, Homo sapiens
atttatgagctgaaccatgaaa

SEQ ID NO: 9478026 - DNA, 22 bp, Homo sapiens
atttatgagctgaaccatgaaa

SEQ ID NO: 9478027 - DNA, 22 bp, Homo sapiens
atttatgcatcccagcatgtga

SEQ ID NO: 9478028 - DNA, 22 bp, Homo sapiens
atttatgattagcctattgttg

SEQ ID NO: 9478029 - DNA, 22 bp, Homo sapiens
atttatgatagctgcattaaag

SEQ ID NO: 9478030 - DNA, 22 bp, Homo sapiens
atttatgattagcctattgttg

SEQ ID NO: 9478031 - DNA, 22 bp, Homo sapiens
atttattaagcatctgctatgt

SEQ ID NO: 9478032 - DNA, 22 bp, Homo sapiens
atttatgtatctgtgtagatca

SEQ ID NO: 9478033 - DNA, 22 bp, Homo sapiens
atttatgtatctgtgtagatca

SEQ ID NO: 9478034 - DNA, 20 bp, Homo sapiens
atttatgtatagcttgttgt

SEQ ID NO: 9478035 - DNA, 22 bp, Homo sapiens
gccatcatatcccctgtgacct

SEQ ID NO: 9478036 - DNA, 22 bp, Homo sapiens
gccaggtggctgagcagctgca

SEQ ID NO: 9478037 - DNA, 22 bp, Homo sapiens
gccatcatatcccctgtgacct

SEQ ID NO: 9478038 - DNA, 22 bp, Homo sapiens
gccatcatatcccctgtgacct

SEQ ID NO: 9478039 - DNA, 22 bp, Homo sapiens
atttattacctcggagtttctg

SEQ ID NO: 9478040 - DNA, 22 bp, Homo sapiens
atttattaagcatctgctatgt

SEQ ID NO: 9478041 - DNA, 22 bp, Homo sapiens
atttattatgggatttggcaca

SEQ ID NO: 9478042 - DNA, 22 bp, Homo sapiens
atttattatgggatttggcaca

SEQ ID NO: 9478043 - DNA, 22 bp, Homo sapiens
atttattacctcggagtttctg

SEQ ID NO: 9478044 - DNA, 22 bp, Homo sapiens
atttcttcaggtcagaaataga

SEQ ID NO: 9478045 - DNA, 22 bp, Homo sapiens
atttcttatgaatattgactgt

SEQ ID NO: 9478046 - DNA, 22 bp, Homo sapiens
atttcttatgaatattgactgt

SEQ ID NO: 9478047 - DNA, 22 bp, Homo sapiens
atttcttatgaatattgactgt

SEQ ID NO: 9478048 - DNA, 22 bp, Homo sapiens
atttcttatgaatattgactgt

SEQ ID NO: 9478049 - DNA, 22 bp, Homo sapiens
atttctgtttgctactataagt

SEQ ID NO: 9478050 - DNA, 22 bp, Homo sapiens
atttcttacataacaaattgtt

SEQ ID NO: 9478051 - DNA, 22 bp, Homo sapiens
atttcttatctgaggtctacat

SEQ ID NO: 9478052 - DNA, 22 bp, Homo sapiens
atttcttacataacaaattgtt

SEQ ID NO: 9478053 - DNA, 22 bp, Homo sapiens
atttcttacataacaaattgtt

SEQ ID NO: 9478054 - DNA, 22 bp, Homo sapiens
atttcttacataacaaattgtt

SEQ ID NO: 9478055 - DNA, 22 bp, Homo sapiens
gccctgtgcaggtgtgcagcag

SEQ ID NO: 9478056 - DNA, 22 bp, Homo sapiens
gccctgtgcaggtgtgcagcag

SEQ ID NO: 9478057 - DNA, 22 bp, Homo sapiens
gccctgtgccagtcacgctgtg

SEQ ID NO: 9478058 - DNA, 22 bp, Homo sapiens
gccctgtgccagtcacgctgtg

SEQ ID NO: 9478059 - DNA, 22 bp, Homo sapiens
atttctgtttgctactataagt

SEQ ID NO: 9478060 - DNA, 20 bp, Homo sapiens
gccctgtgatgtcttgacct

SEQ ID NO: 9478061 - DNA, 22 bp, Homo sapiens
gccctgtgatggagactagagg

SEQ ID NO: 9478062 - DNA, 22 bp, Homo sapiens
gccctgtgatggagactagagg

SEQ ID NO: 9478063 - DNA, 20 bp, Homo sapiens
gccctgtgatgtcttgacct

SEQ ID NO: 9478064 - DNA, 22 bp, Homo sapiens
gccctgtgagtcatgcggcaga

SEQ ID NO: 9478065 - DNA, 22 bp, Homo sapiens
gccctgtgagtcatgcggcaga

SEQ ID NO: 9478066 - DNA, 22 bp, Homo sapiens
gccctgtgatggagactagagg

SEQ ID NO: 9478067 - DNA, 22 bp, Homo sapiens
gccctgtgagtcatgcggcaga

SEQ ID NO: 9478068 - DNA, 22 bp, Homo sapiens
gccctggttttagaggagcagg

SEQ ID NO: 9478069 - DNA, 22 bp, Homo sapiens
gccctggtgtgcccagcatggg

SEQ ID NO: 9478070 - DNA, 22 bp, Homo sapiens
gccctggtgtgcccagcatggg

SEQ ID NO: 9478071 - DNA, 18 bp, Homo sapiens
gccctggtggagctggtg

SEQ ID NO: 9478072 - DNA, 22 bp, Homo sapiens
gccctgtgagattagaacagca

SEQ ID NO: 9478073 - DNA, 22 bp, Homo sapiens
atttcccactctactacatgct

SEQ ID NO: 9478074 - DNA, 22 bp, Homo sapiens
atttcccagctttgatcagttt

SEQ ID NO: 9478075 - DNA, 22 bp, Homo sapiens
atttcccagataaacagctgga

SEQ ID NO: 9478076 - DNA, 22 bp, Homo sapiens
atttcccagggccctcatagtt

SEQ ID NO: 9478077 - DNA, 22 bp, Homo sapiens
atttcccatgtgaatcaattgg

SEQ ID NO: 9478078 - DNA, 22 bp, Homo sapiens
atttcctaatttatgcaggagt

SEQ ID NO: 9478079 - DNA, 23 bp, Homo sapiens
atttcctactataaaagaggtaa

SEQ ID NO: 9478080 - DNA, 22 bp, Homo sapiens
atttccctccagggaaagctta

SEQ ID NO: 9478081 - DNA, 23 bp, Homo sapiens
atttcctaaaagataatcattac

SEQ ID NO: 9478082 - DNA, 23 bp, Homo sapiens
atttcctaaaagataatcattac

SEQ ID NO: 9478083 - DNA, 17 bp, Homo sapiens
gccctgcctgctgccct

SEQ ID NO: 9478084 - DNA, 22 bp, Homo sapiens
gccctgggctccctgctccaca

SEQ ID NO: 9478085 - DNA, 22 bp, Homo sapiens
gccctgggctccctgctccaca

SEQ ID NO: 9478086 - DNA, 22 bp, Homo sapiens
gccctggggaaggtgtctccaa

SEQ ID NO: 9478087 - DNA, 22 bp, Homo sapiens
gccctggggaaggtgtctccaa

SEQ ID NO: 9478088 - DNA, 22 bp, Homo sapiens
gcccaggtttcatctgctccgt

SEQ ID NO: 9478089 - DNA, 22 bp, Homo sapiens
gcccaggtgccctctgccttac

SEQ ID NO: 9478090 - DNA, 22 bp, Homo sapiens
gcccagggtgaagtgcagttgt

SEQ ID NO: 9478091 - DNA, 22 bp, Homo sapiens
gcccagggtgaagtgcagttgt

SEQ ID NO: 9478092 - DNA, 22 bp, Homo sapiens
gcccagggtgaagtgcagttgt

SEQ ID NO: 9478093 - DNA, 22 bp, Homo sapiens
gcccagtctccaggagactctc

SEQ ID NO: 9478094 - DNA, 22 bp, Homo sapiens
gcccagtctcttctggccctgt

SEQ ID NO: 9478095 - DNA, 22 bp, Homo sapiens
gcccagtagttcaaggttgcag

SEQ ID NO: 9478096 - DNA, 22 bp, Homo sapiens
gcccagtagttcaaggttgcag

SEQ ID NO: 9478097 - DNA, 22 bp, Homo sapiens
gcccagtagttcaaggttgcag

SEQ ID NO: 9478098 - DNA, 22 bp, Homo sapiens
gcccagtctcttctggccctgt

SEQ ID NO: 9478099 - DNA, 22 bp, Homo sapiens
gcccagtctcttctggccctgt

SEQ ID NO: 9478100 - DNA, 22 bp, Homo sapiens
gcccagtgccctagaatgcact

SEQ ID NO: 9478101 - DNA, 22 bp, Homo sapiens
atttcaaggctacagaaacctt

SEQ ID NO: 9478102 - DNA, 22 bp, Homo sapiens
atttcaaggctattaatataaa

SEQ ID NO: 9478103 - DNA, 22 bp, Homo sapiens
atttcaaggctattaatataaa

SEQ ID NO: 9478104 - DNA, 22 bp, Homo sapiens
atttcaacgttagatgtaatag

SEQ ID NO: 9478105 - DNA, 19 bp, Homo sapiens
atttcaagaggtttattgg

SEQ ID NO: 9478106 - DNA, 22 bp, Homo sapiens
atttcaagtgttgagctcataa

SEQ ID NO: 9478107 - DNA, 22 bp, Homo sapiens
gcccaggagttgaagggctgac

SEQ ID NO: 9478108 - DNA, 22 bp, Homo sapiens
gcccaggagttgaagggctgac

SEQ ID NO: 9478109 - DNA, 22 bp, Homo sapiens
gcccaggagttgaatgcagcag

SEQ ID NO: 9478110 - DNA, 19 bp, Homo sapiens
gcccaggggcccgatgctg

SEQ ID NO: 9478111 - DNA, 19 bp, Homo sapiens
gcccaggggcccgatgctg

SEQ ID NO: 9478112 - DNA, 22 bp, Homo sapiens
atttattggtttgcatggtgaa

SEQ ID NO: 9478113 - DNA, 22 bp, Homo sapiens
atttattggtttgcatggtgaa

SEQ ID NO: 9478114 - DNA, 22 bp, Homo sapiens
gccatggcccataccaggtgca

SEQ ID NO: 9478115 - DNA, 19 bp, Homo sapiens
atttattgtatgattccat

SEQ ID NO: 9478116 - DNA, 19 bp, Homo sapiens
atttattgtatgattccat

SEQ ID NO: 9478117 - DNA, 22 bp, Homo sapiens
atttattggtttgcatggtgaa

SEQ ID NO: 9478118 - DNA, 19 bp, Homo sapiens
atttattgtatgattccat

SEQ ID NO: 9478119 - DNA, 19 bp, Homo sapiens
atttattgtatgattccat

SEQ ID NO: 9478120 - DNA, 22 bp, Homo sapiens
gccatctggcattgcagcacct

SEQ ID NO: 9478121 - DNA, 22 bp, Homo sapiens
gccatctgctgctctccagtgt

SEQ ID NO: 9478122 - DNA, 22 bp, Homo sapiens
gccatctgctgctctccagtgt

SEQ ID NO: 9478123 - DNA, 22 bp, Homo sapiens
gccatctcggagctatcaaagg

SEQ ID NO: 9478124 - DNA, 22 bp, Homo sapiens
gccatcctgtatcacaagatgt

SEQ ID NO: 9478125 - DNA, 22 bp, Homo sapiens
gccatctgcgcggtgtccagct

SEQ ID NO: 9478126 - DNA, 22 bp, Homo sapiens
gccatcctgatgacaggccact

SEQ ID NO: 9478127 - DNA, 20 bp, Homo sapiens
gccatccagcctcccaggag

SEQ ID NO: 9478128 - DNA, 22 bp, Homo sapiens
gccatgaggctccgagaagtca

SEQ ID NO: 9478129 - DNA, 22 bp, Homo sapiens
gccatgagaagaaatgaagggc

SEQ ID NO: 9478130 - DNA, 22 bp, Homo sapiens
gccatcttgagccaggaagtga

SEQ ID NO: 9478131 - DNA, 23 bp, Homo sapiens
gccatctggtatttcctgacttc

SEQ ID NO: 9478132 - DNA, 22 bp, Homo sapiens
gccatctggcattgcagcacct

SEQ ID NO: 9478133 - DNA, 23 bp, Homo sapiens
gccatctggtatttcctgacttc

SEQ ID NO: 9478134 - DNA, 21 bp, Homo sapiens
gccatcttgcaagatgagaaa

SEQ ID NO: 9478135 - DNA, 22 bp, Homo sapiens
atttgtctaatgagtgtgtact

SEQ ID NO: 9478136 - DNA, 22 bp, Homo sapiens
atttgtcatgtatgtaaagttg

SEQ ID NO: 9478137 - DNA, 22 bp, Homo sapiens
atttgtcagtggaagtgattca

SEQ ID NO: 9478138 - DNA, 22 bp, Homo sapiens
atttgtcactgagagagttaga

SEQ ID NO: 9478139 - DNA, 22 bp, Homo sapiens
atttgtcactgagagagttaga

SEQ ID NO: 9478140 - DNA, 22 bp, Homo sapiens
atttgtcaataagatgaacata

SEQ ID NO: 9478141 - DNA, 22 bp, Homo sapiens
attttcagtgatcatagcacac

SEQ ID NO: 9478142 - DNA, 22 bp, Homo sapiens
attttcagtgatcatagcacac

SEQ ID NO: 9478143 - DNA, 22 bp, Homo sapiens
attttcagtgatcatagcacac

SEQ ID NO: 9478144 - DNA, 22 bp, Homo sapiens
attttagatttaagaataaggt

SEQ ID NO: 9478145 - DNA, 22 bp, Homo sapiens
attttagagctccaagtacagc

SEQ ID NO: 9478146 - DNA, 22 bp, Homo sapiens
attttagagctccaagtacagc

SEQ ID NO: 9478147 - DNA, 22 bp, Homo sapiens
attttagatttaagaataaggt

SEQ ID NO: 9478148 - DNA, 22 bp, Homo sapiens
atttgtctctctgggtttactt

SEQ ID NO: 9478149 - DNA, 22 bp, Homo sapiens
atttgtctctgcactttactca

SEQ ID NO: 9478150 - DNA, 22 bp, Homo sapiens
atttgtatcttctaatattatc

SEQ ID NO: 9478151 - DNA, 22 bp, Homo sapiens
atttgtatcttctaatattatc

SEQ ID NO: 9478152 - DNA, 22 bp, Homo sapiens
atttgtatcttctaatattatc

SEQ ID NO: 9478153 - DNA, 22 bp, Homo sapiens
atttgtatcttctaatattatc

SEQ ID NO: 9478154 - DNA, 22 bp, Homo sapiens
atttgtatcttctaatattatc

SEQ ID NO: 9478155 - DNA, 22 bp, Homo sapiens
atttgtcaataagatgaacata

SEQ ID NO: 9478156 - DNA, 22 bp, Homo sapiens
atttgtcaaaacacagagaaca

SEQ ID NO: 9478157 - DNA, 22 bp, Homo sapiens
atttgtatcaatctcaatatat

SEQ ID NO: 9478158 - DNA, 22 bp, Homo sapiens
atttgtatcaatctcaatatat

SEQ ID NO: 9478159 - DNA, 22 bp, Homo sapiens
atttgtatcaatctcaatatat

SEQ ID NO: 9478160 - DNA, 22 bp, Homo sapiens
atttgtagtgaagtgaaaataa

SEQ ID NO: 9478161 - DNA, 22 bp, Homo sapiens
atttgtagtgaagtgaaaataa

SEQ ID NO: 9478162 - DNA, 22 bp, Homo sapiens
atttgtagtgaagtgaaaataa

SEQ ID NO: 9478163 - DNA, 22 bp, Homo sapiens
atttgtaccatactgtttatta

SEQ ID NO: 9478164 - DNA, 22 bp, Homo sapiens
atttgtactcaggaattctgct

SEQ ID NO: 9478165 - DNA, 22 bp, Homo sapiens
atttgtaagctagagccatgat

SEQ ID NO: 9478166 - DNA, 17 bp, Homo sapiens
atttgtaactagctctt

SEQ ID NO: 9478167 - DNA, 17 bp, Homo sapiens
atttgtaactagctctt

SEQ ID NO: 9478168 - DNA, 22 bp, Homo sapiens
atttgtaacacgtgacaggttg

SEQ ID NO: 9478169 - DNA, 22 bp, Homo sapiens
atttgtaaagtgcttaaaagta

SEQ ID NO: 9478170 - DNA, 22 bp, Homo sapiens
atttgtaatttcttatctgtgt

SEQ ID NO: 9478171 - DNA, 22 bp, Homo sapiens
atttgtaatttcttatctgtgt

SEQ ID NO: 9478172 - DNA, 22 bp, Homo sapiens
atttgtacaaatttatgttagt

SEQ ID NO: 9478173 - DNA, 22 bp, Homo sapiens
atttgtacaaatttatgttagt

SEQ ID NO: 9478174 - DNA, 22 bp, Homo sapiens
atttgtaagctagagccatgat

SEQ ID NO: 9478175 - DNA, 22 bp, Homo sapiens
atttgtaagctagagccatgat

SEQ ID NO: 9478176 - DNA, 22 bp, Homo sapiens
atttgtaaagtgcttaaaagta

SEQ ID NO: 9478177 - DNA, 22 bp, Homo sapiens
atttgtaaagtgcttaaaagta

SEQ ID NO: 9478178 - DNA, 22 bp, Homo sapiens
atttgtaaagtgcttaaaagta

SEQ ID NO: 9478179 - DNA, 22 bp, Homo sapiens
atttggtttcaggattctcagg

SEQ ID NO: 9478180 - DNA, 22 bp, Homo sapiens
atttcttcctctgtcagtaact

SEQ ID NO: 9478181 - DNA, 22 bp, Homo sapiens
attttcatggcttctgctcagt

SEQ ID NO: 9478182 - DNA, 22 bp, Homo sapiens
attttcatggcttctgctcagt

SEQ ID NO: 9478183 - DNA, 22 bp, Homo sapiens
attttcatggcttctgctcagt

SEQ ID NO: 9478184 - DNA, 21 bp, Homo sapiens
attttcattaattcagtgtgg

SEQ ID NO: 9478185 - DNA, 22 bp, Homo sapiens
attttcatggcttctgctcagt

SEQ ID NO: 9478186 - DNA, 22 bp, Homo sapiens
attttcatggcttctgctcagt

SEQ ID NO: 9478187 - DNA, 22 bp, Homo sapiens
attttcatgactaccttaaata

SEQ ID NO: 9478188 - DNA, 22 bp, Homo sapiens
attttcatcgctaggttggcct

SEQ ID NO: 9478189 - DNA, 22 bp, Homo sapiens
attttcatgactaccttaaata

SEQ ID NO: 9478190 - DNA, 22 bp, Homo sapiens
attttcatggcttctgctcagt

SEQ ID NO: 9478191 - DNA, 22 bp, Homo sapiens
attttcatgactaccttaaata

SEQ ID NO: 9478192 - DNA, 22 bp, Homo sapiens
attttcatgactaccttaaata

SEQ ID NO: 9478193 - DNA, 22 bp, Homo sapiens
attttcatcgctaggttggcct

SEQ ID NO: 9478194 - DNA, 22 bp, Homo sapiens
attttcatcatgggtttaacat

SEQ ID NO: 9478195 - DNA, 22 bp, Homo sapiens
attttcagtgtaaatgttttat

SEQ ID NO: 9478196 - DNA, 22 bp, Homo sapiens
attttcatcatgggtttaacat

SEQ ID NO: 9478197 - DNA, 22 bp, Homo sapiens
attttccaaaataattgttact

SEQ ID NO: 9478198 - DNA, 22 bp, Homo sapiens
attttccaaaataattgttact

SEQ ID NO: 9478199 - DNA, 22 bp, Homo sapiens
attttcattttgcagggtgaga

SEQ ID NO: 9478200 - DNA, 22 bp, Homo sapiens
attttcccttctaaagggctga

SEQ ID NO: 9478201 - DNA, 22 bp, Homo sapiens
attttccagcctttctagaact

SEQ ID NO: 9478202 - DNA, 22 bp, Homo sapiens
attttccagcctttctagaact

SEQ ID NO: 9478203 - DNA, 21 bp, Homo sapiens
attttcattaattcagtgtgg

SEQ ID NO: 9478204 - DNA, 21 bp, Homo sapiens
attttcattaattcagtgtgg

SEQ ID NO: 9478205 - DNA, 21 bp, Homo sapiens
attttcatttccaggggagga

SEQ ID NO: 9478206 - DNA, 21 bp, Homo sapiens
attttcatttccaggggagga

SEQ ID NO: 9478207 - DNA, 21 bp, Homo sapiens
attttcattaattcagtgtgg

SEQ ID NO: 9478208 - DNA, 22 bp, Homo sapiens
attttcattttgcagggtgaga

SEQ ID NO: 9478209 - DNA, 21 bp, Homo sapiens
attttcatttccaggggagga

SEQ ID NO: 9478210 - DNA, 22 bp, Homo sapiens
attttcattttgcagggtgaga

SEQ ID NO: 9478211 - DNA, 22 bp, Homo sapiens
gccttcccaagacgcctgagtt

SEQ ID NO: 9478212 - DNA, 22 bp, Homo sapiens
gccttcccaagacgcctgagtt

SEQ ID NO: 9478213 - DNA, 22 bp, Homo sapiens
gccttccaggcagggggagcag

SEQ ID NO: 9478214 - DNA, 22 bp, Homo sapiens
gccttcccaagacgcctgagtt

SEQ ID NO: 9478215 - DNA, 19 bp, Homo sapiens
gccttcccaccacccgtcc

SEQ ID NO: 9478216 - DNA, 19 bp, Homo sapiens
gccttcccaccacccgtcc

SEQ ID NO: 9478217 - DNA, 22 bp, Homo sapiens
gccttcccaccctgcgaggctg

SEQ ID NO: 9478218 - DNA, 22 bp, Homo sapiens
gccttccttacacctgctcagc

SEQ ID NO: 9478219 - DNA, 17 bp, Homo sapiens
gccttccttcctccaca

SEQ ID NO: 9478220 - DNA, 22 bp, Homo sapiens
gccttccctctcatcctgctgg

SEQ ID NO: 9478221 - DNA, 22 bp, Homo sapiens
gccttccctctcatcctgctgg

SEQ ID NO: 9478222 - DNA, 22 bp, Homo sapiens
gccttccctggctaggcaagca

SEQ ID NO: 9478223 - DNA, 22 bp, Homo sapiens
attttcctagtcatgtgcttct

SEQ ID NO: 9478224 - DNA, 22 bp, Homo sapiens
attttcccttctaaagggctga

SEQ ID NO: 9478225 - DNA, 22 bp, Homo sapiens
attttcctagtcatgtgcttct

SEQ ID NO: 9478226 - DNA, 22 bp, Homo sapiens
attttcctcaagcctctggaag

SEQ ID NO: 9478227 - DNA, 22 bp, Homo sapiens
attttcctcaagcctctggaag

SEQ ID NO: 9478228 - DNA, 22 bp, Homo sapiens
attttcctcaagcctctggaag

SEQ ID NO: 9478229 - DNA, 22 bp, Homo sapiens
attttcctccatgtgagcagtt

SEQ ID NO: 9478230 - DNA, 22 bp, Homo sapiens
attttcctctggtttccccaga

SEQ ID NO: 9478231 - DNA, 22 bp, Homo sapiens
attttcctccatgtgagcagtt

SEQ ID NO: 9478232 - DNA, 22 bp, Homo sapiens
attttcctccatgtgagcagtt

SEQ ID NO: 9478233 - DNA, 22 bp, Homo sapiens
attttcctctggtttccccaga

SEQ ID NO: 9478234 - DNA, 22 bp, Homo sapiens
attttcctctggtttccccaga

SEQ ID NO: 9478235 - DNA, 17 bp, Homo sapiens
gccttccagcatgtggg

SEQ ID NO: 9478236 - DNA, 17 bp, Homo sapiens
gccttccagcatgtggg

SEQ ID NO: 9478237 - DNA, 17 bp, Homo sapiens
gccttccagcatgtggg

SEQ ID NO: 9478238 - DNA, 22 bp, Homo sapiens
gccttccagaatacacatagca

SEQ ID NO: 9478239 - DNA, 22 bp, Homo sapiens
gcctgtgcttaactgacgtgag

SEQ ID NO: 9478240 - DNA, 22 bp, Homo sapiens
gcctgtgctgttccctctgcca

SEQ ID NO: 9478241 - DNA, 22 bp, Homo sapiens
gcctgtgctgttccctctgcca

SEQ ID NO: 9478242 - DNA, 22 bp, Homo sapiens
attttctagatagatgatgcat

SEQ ID NO: 9478243 - DNA, 22 bp, Homo sapiens
attttccttctaagaggaaggt

SEQ ID NO: 9478244 - DNA, 22 bp, Homo sapiens
attttccttctaagaggaaggt

SEQ ID NO: 9478245 - DNA, 22 bp, Homo sapiens
attttccttgtgggttagcgaa

SEQ ID NO: 9478246 - DNA, 22 bp, Homo sapiens
attttccttgtgggttagcgaa

SEQ ID NO: 9478247 - DNA, 20 bp, Homo sapiens
caaaagcaatgaagttatga

SEQ ID NO: 9478248 - DNA, 20 bp, Homo sapiens
caaaagcaatgaagttatga

SEQ ID NO: 9478249 - DNA, 22 bp, Homo sapiens
caaaagcaaagtccctgaatgt

SEQ ID NO: 9478250 - DNA, 22 bp, Homo sapiens
caaaagcagcaagtttatatgt

SEQ ID NO: 9478251 - DNA, 20 bp, Homo sapiens
caaaagcaatgaagttatga

SEQ ID NO: 9478252 - DNA, 20 bp, Homo sapiens
caaaagcaatgaagttatga

SEQ ID NO: 9478253 - DNA, 20 bp, Homo sapiens
caaaagcaatgaagttatga

SEQ ID NO: 9478254 - DNA, 20 bp, Homo sapiens
caaaagcaatgaagttatga

SEQ ID NO: 9478255 - DNA, 22 bp, Homo sapiens
caaaagaagctcttggggctag

SEQ ID NO: 9478256 - DNA, 22 bp, Homo sapiens
caaaagaagctcttggggctag

SEQ ID NO: 9478257 - DNA, 21 bp, Homo sapiens
caaaagagactgattcttgga

SEQ ID NO: 9478258 - DNA, 21 bp, Homo sapiens
caaaagagactgattcttgga

SEQ ID NO: 9478259 - DNA, 21 bp, Homo sapiens
caaaagagactgattcttgga

SEQ ID NO: 9478260 - DNA, 22 bp, Homo sapiens
caaaagcaaagtccctgaatgt

SEQ ID NO: 9478261 - DNA, 22 bp, Homo sapiens
caaaagcaaagtccctgaatgt

SEQ ID NO: 9478262 - DNA, 22 bp, Homo sapiens
caaaagatacttgcatctaact

SEQ ID NO: 9478263 - DNA, 22 bp, Homo sapiens
caaaagatacttgcatctaact

SEQ ID NO: 9478264 - DNA, 22 bp, Homo sapiens
gctcagagagtttcacaagttt

SEQ ID NO: 9478265 - DNA, 22 bp, Homo sapiens
caaaagaagctcttggggctag

SEQ ID NO: 9478266 - DNA, 22 bp, Homo sapiens
gctcagagagaggctcaccatt

SEQ ID NO: 9478267 - DNA, 22 bp, Homo sapiens
gctcagagagtttcacaagttt

SEQ ID NO: 9478268 - DNA, 22 bp, Homo sapiens
gctcagagaagttaaggaattt

SEQ ID NO: 9478269 - DNA, 22 bp, Homo sapiens
gctcagagaatcagcagacacc

SEQ ID NO: 9478270 - DNA, 22 bp, Homo sapiens
attttgataatcatgttagaga

SEQ ID NO: 9478271 - DNA, 22 bp, Homo sapiens
attttgataatcatgttagaga

SEQ ID NO: 9478272 - DNA, 22 bp, Homo sapiens
attttgataatcatgttagaga

SEQ ID NO: 9478273 - DNA, 22 bp, Homo sapiens
attttgataatcatgttagaga

SEQ ID NO: 9478274 - DNA, 22 bp, Homo sapiens
attttgactgcattacagaaca

SEQ ID NO: 9478275 - DNA, 17 bp, Homo sapiens
gccttccttcctccaca

SEQ ID NO: 9478276 - DNA, 22 bp, Homo sapiens
gccttccttttaccaccagcca

SEQ ID NO: 9478277 - DNA, 22 bp, Homo sapiens
gccttccttttaccaccagcca

SEQ ID NO: 9478278 - DNA, 22 bp, Homo sapiens
gccttctccctaaccaaatcct

SEQ ID NO: 9478279 - DNA, 22 bp, Homo sapiens
attttgcacactatgcagcttt

SEQ ID NO: 9478280 - DNA, 22 bp, Homo sapiens
attttgcacactatgcagcttt

SEQ ID NO: 9478281 - DNA, 22 bp, Homo sapiens
attttgcacactatgcagcttt

SEQ ID NO: 9478282 - DNA, 22 bp, Homo sapiens
attttgctgtggtacattagga

SEQ ID NO: 9478283 - DNA, 22 bp, Homo sapiens
attttgctggtctgaattactt

SEQ ID NO: 9478284 - DNA, 22 bp, Homo sapiens
gctcagactgcacaccctggtc

SEQ ID NO: 9478285 - DNA, 22 bp, Homo sapiens
gctcagactgcacaccctggtc

SEQ ID NO: 9478286 - DNA, 22 bp, Homo sapiens
gctcagagaaaactggggcttg

SEQ ID NO: 9478287 - DNA, 22 bp, Homo sapiens
gctctgagatcattcactgtaa

SEQ ID NO: 9478288 - DNA, 22 bp, Homo sapiens
caaagaggttttgagggcagct

SEQ ID NO: 9478289 - DNA, 22 bp, Homo sapiens
gctctgagataaacgttgccct

SEQ ID NO: 9478290 - DNA, 22 bp, Homo sapiens
gctctgctgtcttcttgcaggc

SEQ ID NO: 9478291 - DNA, 22 bp, Homo sapiens
caaagaggtgagaggagccttt

SEQ ID NO: 9478292 - DNA, 22 bp, Homo sapiens
gctctgagagtgggtgattctg

SEQ ID NO: 9478293 - DNA, 22 bp, Homo sapiens
caaagactgcataacacatgaa

SEQ ID NO: 9478294 - DNA, 22 bp, Homo sapiens
caaagaccatgtggcctgaaaa

SEQ ID NO: 9478295 - DNA, 20 bp, Homo sapiens
caaagacatgctaggggtgg

SEQ ID NO: 9478296 - DNA, 20 bp, Homo sapiens
caaagacatgctaggggtgg

SEQ ID NO: 9478297 - DNA, 22 bp, Homo sapiens
caaagacacgggaaacaacgtt

SEQ ID NO: 9478298 - DNA, 22 bp, Homo sapiens
caaagaatgagtgagtacataa

SEQ ID NO: 9478299 - DNA, 22 bp, Homo sapiens
caaagaatcactcatctttagc

SEQ ID NO: 9478300 - DNA, 22 bp, Homo sapiens
caaagaagagatttacagagct

SEQ ID NO: 9478301 - DNA, 22 bp, Homo sapiens
caaagaaggaactataatccca

SEQ ID NO: 9478302 - DNA, 22 bp, Homo sapiens
caaagaatcactcatctttagc

SEQ ID NO: 9478303 - DNA, 22 bp, Homo sapiens
gctcccaggttcttgggccttg

SEQ ID NO: 9478304 - DNA, 22 bp, Homo sapiens
gctcccagggaccgcagggcag

SEQ ID NO: 9478305 - DNA, 22 bp, Homo sapiens
gctcccagggaccgcagggcag

SEQ ID NO: 9478306 - DNA, 22 bp, Homo sapiens
gctcccagggaccgcagggcag

SEQ ID NO: 9478307 - DNA, 22 bp, Homo sapiens
gctcccagggcagcgcagaaga

SEQ ID NO: 9478308 - DNA, 22 bp, Homo sapiens
gctccccaaaagctccaggaaa

SEQ ID NO: 9478309 - DNA, 22 bp, Homo sapiens
gctccccagcttagccctggct

SEQ ID NO: 9478310 - DNA, 22 bp, Homo sapiens
gctccccagcttagccctggct

SEQ ID NO: 9478311 - DNA, 22 bp, Homo sapiens
gctccccagcttagccctggct

SEQ ID NO: 9478312 - DNA, 22 bp, Homo sapiens
gctcccagtctgatggaggaga

SEQ ID NO: 9478313 - DNA, 22 bp, Homo sapiens
gctcccaggcatggaggtaatt

SEQ ID NO: 9478314 - DNA, 22 bp, Homo sapiens
gctcccaggcatggaggtaatt

SEQ ID NO: 9478315 - DNA, 22 bp, Homo sapiens
gctcccagggacactggccact

SEQ ID NO: 9478316 - DNA, 22 bp, Homo sapiens
gctcccagggaccgcagggcag

SEQ ID NO: 9478317 - DNA, 22 bp, Homo sapiens
gctcccagggacactggccact

SEQ ID NO: 9478318 - DNA, 22 bp, Homo sapiens
gctccagggaacagaatgtact

SEQ ID NO: 9478319 - DNA, 22 bp, Homo sapiens
gctccagggaacagaatgtact

SEQ ID NO: 9478320 - DNA, 22 bp, Homo sapiens
gctcccaggatgaggagccagg

SEQ ID NO: 9478321 - DNA, 22 bp, Homo sapiens
gctcccaggatgaggagccagg

SEQ ID NO: 9478322 - DNA, 22 bp, Homo sapiens
gctcccaggatgaggagccagg

SEQ ID NO: 9478323 - DNA, 22 bp, Homo sapiens
caaaagcagttctatctgagtt

SEQ ID NO: 9478324 - DNA, 22 bp, Homo sapiens
caaaagcagcaagtttatatgt

SEQ ID NO: 9478325 - DNA, 22 bp, Homo sapiens
caaaagcagcaagtttatatgt

SEQ ID NO: 9478326 - DNA, 22 bp, Homo sapiens
caaaagcagcaagtttatatgt

SEQ ID NO: 9478327 - DNA, 22 bp, Homo sapiens
attctggaagcaagcttttaaa

SEQ ID NO: 9478328 - DNA, 22 bp, Homo sapiens
gcagggattgtgcagggggcta

SEQ ID NO: 9478329 - DNA, 22 bp, Homo sapiens
gcagggcagtaagagctagagt

SEQ ID NO: 9478330 - DNA, 22 bp, Homo sapiens
gcagggcagtaagagctagagt

SEQ ID NO: 9478331 - DNA, 22 bp, Homo sapiens
gcagggcagtgtgtctgtgggg

SEQ ID NO: 9478332 - DNA, 20 bp, Homo sapiens
attctgctttctgatagagc

SEQ ID NO: 9478333 - DNA, 22 bp, Homo sapiens
attctgcttcttatttcacgtg

SEQ ID NO: 9478334 - DNA, 20 bp, Homo sapiens
attctgctttgaaaataagg

SEQ ID NO: 9478335 - DNA, 22 bp, Homo sapiens
attctgctggtaactctataaa

SEQ ID NO: 9478336 - DNA, 22 bp, Homo sapiens
attctgcttaagggaggctgtc

SEQ ID NO: 9478337 - DNA, 22 bp, Homo sapiens
attctggaaagctattctctct

SEQ ID NO: 9478338 - DNA, 22 bp, Homo sapiens
attctggaaagctattctctct

SEQ ID NO: 9478339 - DNA, 22 bp, Homo sapiens
attctgcttttgctgacctacc

SEQ ID NO: 9478340 - DNA, 22 bp, Homo sapiens
attctgctgcctagtttatgaa

SEQ ID NO: 9478341 - DNA, 16 bp, Homo sapiens
attctgctgcctgctc

SEQ ID NO: 9478342 - DNA, 22 bp, Homo sapiens
attctgctgcacaccttccccc

SEQ ID NO: 9478343 - DNA, 22 bp, Homo sapiens
attctgctcatgagctcccggg

SEQ ID NO: 9478344 - DNA, 22 bp, Homo sapiens
attctgctcccaggtgatgctg

SEQ ID NO: 9478345 - DNA, 22 bp, Homo sapiens
attctgctcattttatttccag

SEQ ID NO: 9478346 - DNA, 22 bp, Homo sapiens
attctgctccacactgattcat

SEQ ID NO: 9478347 - DNA, 22 bp, Homo sapiens
attctgatgcctgggtactgcc

SEQ ID NO: 9478348 - DNA, 22 bp, Homo sapiens
gcaggcaggtggcatcttgtga

SEQ ID NO: 9478349 - DNA, 20 bp, Homo sapiens
gcaggcagggaatgggggtg

SEQ ID NO: 9478350 - DNA, 22 bp, Homo sapiens
attctgcatggtggtgtctctg

SEQ ID NO: 9478351 - DNA, 22 bp, Homo sapiens
attctgcacttcctttgcttcc

SEQ ID NO: 9478352 - DNA, 22 bp, Homo sapiens
attctgcattgctcacaaagat

SEQ ID NO: 9478353 - DNA, 22 bp, Homo sapiens
attctgcatgtaggtttgctca

SEQ ID NO: 9478354 - DNA, 22 bp, Homo sapiens
attctgctagttaatatctctc

SEQ ID NO: 9478355 - DNA, 22 bp, Homo sapiens
attctgctagtaacagatgaag

SEQ ID NO: 9478356 - DNA, 22 bp, Homo sapiens
attctgcattgctcacaaagat

SEQ ID NO: 9478357 - DNA, 22 bp, Homo sapiens
attctgctagtaacagatgaag

SEQ ID NO: 9478358 - DNA, 22 bp, Homo sapiens
attcttttcccaactgctttaa

SEQ ID NO: 9478359 - DNA, 22 bp, Homo sapiens
attcttttaagccccagggatt

SEQ ID NO: 9478360 - DNA, 20 bp, Homo sapiens
gcagggcatcttggccccca

SEQ ID NO: 9478361 - DNA, 22 bp, Homo sapiens
attctttccagacactgattgc

SEQ ID NO: 9478362 - DNA, 22 bp, Homo sapiens
attctttccagacactgattgc

SEQ ID NO: 9478363 - DNA, 20 bp, Homo sapiens
gcagggcatcttggccccca

SEQ ID NO: 9478364 - DNA, 22 bp, Homo sapiens
gcagggcagtgtgtctgtgggg

SEQ ID NO: 9478365 - DNA, 22 bp, Homo sapiens
gcagggcagtgtgtctgtgggg

SEQ ID NO: 9478366 - DNA, 22 bp, Homo sapiens
gcagggcagtgtgtctgtgggg

SEQ ID NO: 9478367 - DNA, 22 bp, Homo sapiens
gcagggcatagaggcacggagg

SEQ ID NO: 9478368 - DNA, 22 bp, Homo sapiens
gcagggcagtgtgtctgtgggg

SEQ ID NO: 9478369 - DNA, 22 bp, Homo sapiens
gcagggcatccctgagcgggtg

SEQ ID NO: 9478370 - DNA, 22 bp, Homo sapiens
gcagggcatagaggcacggagg

SEQ ID NO: 9478371 - DNA, 22 bp, Homo sapiens
gcaggttagatttaatccattc

SEQ ID NO: 9478372 - DNA, 22 bp, Homo sapiens
gcaggttatccaactacaatgt

SEQ ID NO: 9478373 - DNA, 22 bp, Homo sapiens
gcagtaaaaaaggatatgtgca

SEQ ID NO: 9478374 - DNA, 22 bp, Homo sapiens
gcaggttatccaactacaatgt

SEQ ID NO: 9478375 - DNA, 22 bp, Homo sapiens
gcaggtgttttaagacattgaa

SEQ ID NO: 9478376 - DNA, 21 bp, Homo sapiens
gcaggtgtggtatcagcttcc

SEQ ID NO: 9478377 - DNA, 22 bp, Homo sapiens
gcaggtgtggatttgcatccag

SEQ ID NO: 9478378 - DNA, 22 bp, Homo sapiens
gcaggtgtgctgaattacgtga

SEQ ID NO: 9478379 - DNA, 18 bp, Homo sapiens
gcaggtgtggagaagggg

SEQ ID NO: 9478380 - DNA, 22 bp, Homo sapiens
attgaaaaatgactattgctta

SEQ ID NO: 9478381 - DNA, 22 bp, Homo sapiens
attgcaaataactgtactgaat

SEQ ID NO: 9478382 - DNA, 22 bp, Homo sapiens
attgcaaataactgtactgaat

SEQ ID NO: 9478383 - DNA, 22 bp, Homo sapiens
attgcaaaggtcccattcaaga

SEQ ID NO: 9478384 - DNA, 22 bp, Homo sapiens
attgcaaaggtcccattcaaga

SEQ ID NO: 9478385 - DNA, 22 bp, Homo sapiens
attgcaaaggtcccattcaaga

SEQ ID NO: 9478386 - DNA, 22 bp, Homo sapiens
attgcaaagcgtagactctaaa

SEQ ID NO: 9478387 - DNA, 22 bp, Homo sapiens
attgcaaaggtcccattcaaga

SEQ ID NO: 9478388 - DNA, 22 bp, Homo sapiens
attgcaaatgagtcttaatata

SEQ ID NO: 9478389 - DNA, 22 bp, Homo sapiens
attgcaaataatgcgagccagt

SEQ ID NO: 9478390 - DNA, 22 bp, Homo sapiens
attgcaaataactgtactgaat

SEQ ID NO: 9478391 - DNA, 22 bp, Homo sapiens
gcagtaagatgtttcccagagc

SEQ ID NO: 9478392 - DNA, 22 bp, Homo sapiens
gcatggatgggagtggacagat

SEQ ID NO: 9478393 - DNA, 22 bp, Homo sapiens
gcatggatctaagaggtcaagg

SEQ ID NO: 9478394 - DNA, 22 bp, Homo sapiens
gcatggaattcccttatgggcc

SEQ ID NO: 9478395 - DNA, 22 bp, Homo sapiens
gcatggcaagaccctgtctcta

SEQ ID NO: 9478396 - DNA, 22 bp, Homo sapiens
gcatggcaaatatcgagggcag

SEQ ID NO: 9478397 - DNA, 21 bp, Homo sapiens
gcatggcaggtcactggggca

SEQ ID NO: 9478398 - DNA, 22 bp, Homo sapiens
gcatggcagccagtacatggtg

SEQ ID NO: 9478399 - DNA, 22 bp, Homo sapiens
gcatggcaagatcaggagacca

SEQ ID NO: 9478400 - DNA, 22 bp, Homo sapiens
gcatggcagaacacctcgcccg

SEQ ID NO: 9478401 - DNA, 20 bp, Homo sapiens
gcatgcttggagagagagaa

SEQ ID NO: 9478402 - DNA, 22 bp, Homo sapiens
attgcactccggcctgggtgac

SEQ ID NO: 9478403 - DNA, 22 bp, Homo sapiens
attgcactccagcctgggtgac

SEQ ID NO: 9478404 - DNA, 22 bp, Homo sapiens
attgcactccagcctgggggac

SEQ ID NO: 9478405 - DNA, 18 bp, Homo sapiens
attgcacaccagcctggg

SEQ ID NO: 9478406 - DNA, 22 bp, Homo sapiens
attgcaatctggtgaaaacagt

SEQ ID NO: 9478407 - DNA, 22 bp, Homo sapiens
attgcacaaagagggaaactga

SEQ ID NO: 9478408 - DNA, 22 bp, Homo sapiens
attcacaactgatccttgctca

SEQ ID NO: 9478409 - DNA, 22 bp, Homo sapiens
attcacaaataacaggtgcaga

SEQ ID NO: 9478410 - DNA, 22 bp, Homo sapiens
attcaatcccagaaagaaactg

SEQ ID NO: 9478411 - DNA, 22 bp, Homo sapiens
attcaataagtcactgtggaat

SEQ ID NO: 9478412 - DNA, 22 bp, Homo sapiens
attccaaacagtgctgcagact

SEQ ID NO: 9478413 - DNA, 22 bp, Homo sapiens
attccaaacagtgctgcagact

SEQ ID NO: 9478414 - DNA, 22 bp, Homo sapiens
attccaaaaggatgttagaatg

SEQ ID NO: 9478415 - DNA, 22 bp, Homo sapiens
attccaaagacagaagcagctg

SEQ ID NO: 9478416 - DNA, 22 bp, Homo sapiens
attccaaacttaccccagagga

SEQ ID NO: 9478417 - DNA, 22 bp, Homo sapiens
attccaaactctttccctgtcg

SEQ ID NO: 9478418 - DNA, 19 bp, Homo sapiens
attcatttttgccttctaa

SEQ ID NO: 9478419 - DNA, 19 bp, Homo sapiens
attcatttttgccttctaa

SEQ ID NO: 9478420 - DNA, 22 bp, Homo sapiens
attcacaagttgatggatattt

SEQ ID NO: 9478421 - DNA, 17 bp, Homo sapiens
attcatgaacatgtcct

SEQ ID NO: 9478422 - DNA, 22 bp, Homo sapiens
attcatgaatctacattgtggt

SEQ ID NO: 9478423 - DNA, 19 bp, Homo sapiens
attcatgaaggcttgaagg

SEQ ID NO: 9478424 - DNA, 22 bp, Homo sapiens
attcatgaccccatggttgatt

SEQ ID NO: 9478425 - DNA, 22 bp, Homo sapiens
attccaaggtctttctagattg

SEQ ID NO: 9478426 - DNA, 22 bp, Homo sapiens
attccaaaggttaatgcccatt

SEQ ID NO: 9478427 - DNA, 22 bp, Homo sapiens
attccaattgtacttgctttta

SEQ ID NO: 9478428 - DNA, 22 bp, Homo sapiens
attccacacagtaatactcaat

SEQ ID NO: 9478429 - DNA, 22 bp, Homo sapiens
attccacacagtaatactcaat

SEQ ID NO: 9478430 - DNA, 22 bp, Homo sapiens
attccacacagtaatactcaat

SEQ ID NO: 9478431 - DNA, 22 bp, Homo sapiens
attccacacagtaatactcaat

SEQ ID NO: 9478432 - DNA, 22 bp, Homo sapiens
attccaaagcacatcagaacta

SEQ ID NO: 9478433 - DNA, 22 bp, Homo sapiens
attccaaagcacatcagaacta

SEQ ID NO: 9478434 - DNA, 22 bp, Homo sapiens
attccaaagcacatcagaacta

SEQ ID NO: 9478435 - DNA, 22 bp, Homo sapiens
attccaaagcacatcagaacta

SEQ ID NO: 9478436 - DNA, 22 bp, Homo sapiens
attccaaagcctgaataatgga

SEQ ID NO: 9478437 - DNA, 22 bp, Homo sapiens
attccaaagcctgaataatgga

SEQ ID NO: 9478438 - DNA, 22 bp, Homo sapiens
attccaaagcctgaataatgga

SEQ ID NO: 9478439 - DNA, 22 bp, Homo sapiens
attccaaagcctgaataatgga

SEQ ID NO: 9478440 - DNA, 22 bp, Homo sapiens
attccaaaggctggcctggagg

SEQ ID NO: 9478441 - DNA, 22 bp, Homo sapiens
attccacaggactaccaatgtg

SEQ ID NO: 9478442 - DNA, 22 bp, Homo sapiens
attccacagctacatcaatcta

SEQ ID NO: 9478443 - DNA, 22 bp, Homo sapiens
attccacagctacatcaatcta

SEQ ID NO: 9478444 - DNA, 22 bp, Homo sapiens
attccacagccgataccatgac

SEQ ID NO: 9478445 - DNA, 22 bp, Homo sapiens
attccacagccgataccatgac

SEQ ID NO: 9478446 - DNA, 22 bp, Homo sapiens
attccacagctacatcaatcta

SEQ ID NO: 9478447 - DNA, 22 bp, Homo sapiens
attccactgccgaatgatacat

SEQ ID NO: 9478448 - DNA, 22 bp, Homo sapiens
attccacgagtgtctgtcaagt

SEQ ID NO: 9478449 - DNA, 22 bp, Homo sapiens
attccacataggccttcatgac

SEQ ID NO: 9478450 - DNA, 22 bp, Homo sapiens
attctctgtttccaagatgaaa

SEQ ID NO: 9478451 - DNA, 22 bp, Homo sapiens
attctctgtttccaagatgaaa

SEQ ID NO: 9478452 - DNA, 22 bp, Homo sapiens
attctccacacatccagacctt

SEQ ID NO: 9478453 - DNA, 22 bp, Homo sapiens
attctctttgtataacatcttg

SEQ ID NO: 9478454 - DNA, 22 bp, Homo sapiens
attctctttgtataacatcttg

SEQ ID NO: 9478455 - DNA, 22 bp, Homo sapiens
attctcatttgctggctatatg

SEQ ID NO: 9478456 - DNA, 22 bp, Homo sapiens
attctcatttttatagatgaga

SEQ ID NO: 9478457 - DNA, 22 bp, Homo sapiens
attctcatttgctggctatatg

SEQ ID NO: 9478458 - DNA, 22 bp, Homo sapiens
attctgaggacagagtctagca

SEQ ID NO: 9478459 - DNA, 22 bp, Homo sapiens
attctgaggacagagtctagca

SEQ ID NO: 9478460 - DNA, 22 bp, Homo sapiens
attctgagtacaacaagatgtt

SEQ ID NO: 9478461 - DNA, 22 bp, Homo sapiens
attctgagtacaacaagatgtt

SEQ ID NO: 9478462 - DNA, 22 bp, Homo sapiens
attctgagacaattgccgtcag

SEQ ID NO: 9478463 - DNA, 22 bp, Homo sapiens
attctgagaggcacaatgtgga

SEQ ID NO: 9478464 - DNA, 22 bp, Homo sapiens
attctgagctactaattaggca

SEQ ID NO: 9478465 - DNA, 22 bp, Homo sapiens
attctgagaaatgcattgtcag

SEQ ID NO: 9478466 - DNA, 22 bp, Homo sapiens
attctgactttcatctgccttt

SEQ ID NO: 9478467 - DNA, 22 bp, Homo sapiens
attctgagaaatgcattgtcag

SEQ ID NO: 9478468 - DNA, 22 bp, Homo sapiens
attctgagtagaaattattctt

SEQ ID NO: 9478469 - DNA, 22 bp, Homo sapiens
attctgagtacaacaagatgtt

SEQ ID NO: 9478470 - DNA, 23 bp, Homo sapiens
attctgagtcagaaagtttgggg

SEQ ID NO: 9478471 - DNA, 22 bp, Homo sapiens
attctgagtccatgggggcagg

SEQ ID NO: 9478472 - DNA, 22 bp, Homo sapiens
attctgagtggaaactatcaat

SEQ ID NO: 9478473 - DNA, 21 bp, Homo sapiens
attctgagtcttggggtctca

SEQ ID NO: 9478474 - DNA, 22 bp, Homo sapiens
attctgagttagagtcagccag

SEQ ID NO: 9478475 - DNA, 21 bp, Homo sapiens
attctgagttgtcagtcttca

SEQ ID NO: 9478476 - DNA, 22 bp, Homo sapiens
attctgagtttatttgggaggt

SEQ ID NO: 9478477 - DNA, 21 bp, Homo sapiens
attctgagttgtcagtcttca

SEQ ID NO: 9478478 - DNA, 21 bp, Homo sapiens
attctgagttgtcagtcttca

SEQ ID NO: 9478479 - DNA, 22 bp, Homo sapiens
attctgataaataagcagcaag

SEQ ID NO: 9478480 - DNA, 22 bp, Homo sapiens
attctgataaataagcagcaag

SEQ ID NO: 9478481 - DNA, 22 bp, Homo sapiens
attctgatatgaacacacatat

SEQ ID NO: 9478482 - DNA, 22 bp, Homo sapiens
gcagctgtgggttccaagtcta

SEQ ID NO: 9478483 - DNA, 22 bp, Homo sapiens
gcagctgtgggcctcggagagc

SEQ ID NO: 9478484 - DNA, 19 bp, Homo sapiens
gcagctgtgggaagagcca

SEQ ID NO: 9478485 - DNA, 19 bp, Homo sapiens
gcagctgtgggaagagcca

SEQ ID NO: 9478486 - DNA, 19 bp, Homo sapiens
gcagctgtgggaagagcca

SEQ ID NO: 9478487 - DNA, 19 bp, Homo sapiens
gcagctgtgggaagagcca

SEQ ID NO: 9478488 - DNA, 22 bp, Homo sapiens
attctgatcattcaagatgtca

SEQ ID NO: 9478489 - DNA, 22 bp, Homo sapiens
gcagctgtggtgctgagatagg

SEQ ID NO: 9478490 - DNA, 22 bp, Homo sapiens
gcagctgtgtaatgagcccaca

SEQ ID NO: 9478491 - DNA, 22 bp, Homo sapiens
gcagctgtgtaatgagcccaca

SEQ ID NO: 9478492 - DNA, 22 bp, Homo sapiens
gcagctgttcagctggccagat

SEQ ID NO: 9478493 - DNA, 22 bp, Homo sapiens
gcagctgttcagctggccagat

SEQ ID NO: 9478494 - DNA, 22 bp, Homo sapiens
gcagcttcagtaggtgaagaca

SEQ ID NO: 9478495 - DNA, 19 bp, Homo sapiens
gcaggcagctggggtatcc

SEQ ID NO: 9478496 - DNA, 22 bp, Homo sapiens
gcaggcaaggtagacagaggaa

SEQ ID NO: 9478497 - DNA, 22 bp, Homo sapiens
gcaggattgggctgaaggagtg

SEQ ID NO: 9478498 - DNA, 22 bp, Homo sapiens
gcaggcaggaaggactaagtaa

SEQ ID NO: 9478499 - DNA, 22 bp, Homo sapiens
gcaggcaggaaggactaagtaa

SEQ ID NO: 9478500 - DNA, 22 bp, Homo sapiens
gcaggcaggagcccaactgcct

SEQ ID NO: 9478501 - DNA, 22 bp, Homo sapiens
gcaggcaggagcccaactgcct

SEQ ID NO: 9478502 - DNA, 22 bp, Homo sapiens
gcaggcaggagcccaactgcct

SEQ ID NO: 9478503 - DNA, 22 bp, Homo sapiens
gcaggcaggagcccaactgcct

SEQ ID NO: 9478504 - DNA, 22 bp, Homo sapiens
gcaggcaggcttccttgaactg

SEQ ID NO: 9478505 - DNA, 22 bp, Homo sapiens
gcaggcaggcttccttgaactg

SEQ ID NO: 9478506 - DNA, 22 bp, Homo sapiens
gcaggcaggcttccttgaactg

SEQ ID NO: 9478507 - DNA, 20 bp, Homo sapiens
gcaggcagggaatgggggtg

SEQ ID NO: 9478508 - DNA, 20 bp, Homo sapiens
gcaggcagggaatgggggtg

SEQ ID NO: 9478509 - DNA, 22 bp, Homo sapiens
atgttatttcaaaattcccttg

SEQ ID NO: 9478510 - DNA, 22 bp, Homo sapiens
gatgatggacaaagcattggtg

SEQ ID NO: 9478511 - DNA, 22 bp, Homo sapiens
atgttatttctgaaagatcatt

SEQ ID NO: 9478512 - DNA, 22 bp, Homo sapiens
atgttatttattgaaacacttt

SEQ ID NO: 9478513 - DNA, 22 bp, Homo sapiens
atgttatttattgaaacacttt

SEQ ID NO: 9478514 - DNA, 22 bp, Homo sapiens
atgttatttattgaaacacttt

SEQ ID NO: 9478515 - DNA, 22 bp, Homo sapiens
atgttatttattgaaacacttt

SEQ ID NO: 9478516 - DNA, 22 bp, Homo sapiens
atgttatttattatcctcggtt

SEQ ID NO: 9478517 - DNA, 22 bp, Homo sapiens
atgttattgatgcctgaggctt

SEQ ID NO: 9478518 - DNA, 22 bp, Homo sapiens
gatggcacacagacatccccgc

SEQ ID NO: 9478519 - DNA, 20 bp, Homo sapiens
gatggatttcaacacctttc

SEQ ID NO: 9478520 - DNA, 22 bp, Homo sapiens
gatggaggagatggcagggtgc

SEQ ID NO: 9478521 - DNA, 22 bp, Homo sapiens
gatggaggagatggcagggtgc

SEQ ID NO: 9478522 - DNA, 22 bp, Homo sapiens
gatggaggagatggcagggtgc

SEQ ID NO: 9478523 - DNA, 22 bp, Homo sapiens
gatggcaggcaggtgagtagag

SEQ ID NO: 9478524 - DNA, 22 bp, Homo sapiens
gatggcagcagcagccagggat

SEQ ID NO: 9478525 - DNA, 22 bp, Homo sapiens
gatggcagcatattgacagcat

SEQ ID NO: 9478526 - DNA, 22 bp, Homo sapiens
gatggccaaggaccacgcatcg

SEQ ID NO: 9478527 - DNA, 22 bp, Homo sapiens
gatggcagtcaaccaggtgagg

SEQ ID NO: 9478528 - DNA, 22 bp, Homo sapiens
gatggcagtcaaccaggtgagg

SEQ ID NO: 9478529 - DNA, 22 bp, Homo sapiens
gagtggggaaagccaggacaga

SEQ ID NO: 9478530 - DNA, 22 bp, Homo sapiens
gagtggggaaagccaggacaga

SEQ ID NO: 9478531 - DNA, 22 bp, Homo sapiens
gagtggggaaagccaggacaga

SEQ ID NO: 9478532 - DNA, 22 bp, Homo sapiens
gagtgggcaccgtgggcacact

SEQ ID NO: 9478533 - DNA, 22 bp, Homo sapiens
gagtggggcccactgctgggtg

SEQ ID NO: 9478534 - DNA, 22 bp, Homo sapiens
gagtggggcccactgctgggtg

SEQ ID NO: 9478535 - DNA, 22 bp, Homo sapiens
gagtggggcccactgctgggtg

SEQ ID NO: 9478536 - DNA, 22 bp, Homo sapiens
gagtggggcccactgctgggtg

SEQ ID NO: 9478537 - DNA, 23 bp, Homo sapiens
gagtggggagaaattggttaaac

SEQ ID NO: 9478538 - DNA, 22 bp, Homo sapiens
gagtggggaaagccaggacaga

SEQ ID NO: 9478539 - DNA, 22 bp, Homo sapiens
gagtggggaaagccaggacaga

SEQ ID NO: 9478540 - DNA, 23 bp, Homo sapiens
atgttattattagcagtcttgcc

SEQ ID NO: 9478541 - DNA, 21 bp, Homo sapiens
atgttattctgttcctccagc

SEQ ID NO: 9478542 - DNA, 22 bp, Homo sapiens
atgttattcaatttgaatccaa

SEQ ID NO: 9478543 - DNA, 22 bp, Homo sapiens
atgttattaaagtacagattct

SEQ ID NO: 9478544 - DNA, 22 bp, Homo sapiens
atgttatgtgcaagatacataa

SEQ ID NO: 9478545 - DNA, 22 bp, Homo sapiens
atgttatgtgcaagatacataa

SEQ ID NO: 9478546 - DNA, 22 bp, Homo sapiens
gagtggggcgaagtcggcgagt

SEQ ID NO: 9478547 - DNA, 22 bp, Homo sapiens
gagtggggcgaagtcggcgagt

SEQ ID NO: 9478548 - DNA, 22 bp, Homo sapiens
gagtggggcgtggatccagcgt

SEQ ID NO: 9478549 - DNA, 22 bp, Homo sapiens
gagtggggcgaagtcggcgagt

SEQ ID NO: 9478550 - DNA, 22 bp, Homo sapiens
gagtggggcccactgctgggtg

SEQ ID NO: 9478551 - DNA, 22 bp, Homo sapiens
gagtggggcgtggatccagcgt

SEQ ID NO: 9478552 - DNA, 22 bp, Homo sapiens
gagtggggcgtggatccagcgt

SEQ ID NO: 9478553 - DNA, 22 bp, Homo sapiens
attaacatgagttggagatagg

SEQ ID NO: 9478554 - DNA, 22 bp, Homo sapiens
attaacatgcagccagacacac

SEQ ID NO: 9478555 - DNA, 19 bp, Homo sapiens
attaacatcagtgttggcc

SEQ ID NO: 9478556 - DNA, 22 bp, Homo sapiens
attaacagaattttacatgctt

SEQ ID NO: 9478557 - DNA, 22 bp, Homo sapiens
attaacagcagcatccccagcc

SEQ ID NO: 9478558 - DNA, 22 bp, Homo sapiens
attaaattggatctgcatagtt

SEQ ID NO: 9478559 - DNA, 22 bp, Homo sapiens
gattccagaaaccagtgaagat

SEQ ID NO: 9478560 - DNA, 22 bp, Homo sapiens
gattcctgctattcacagggct

SEQ ID NO: 9478561 - DNA, 22 bp, Homo sapiens
gattcctgctattcacagggct

SEQ ID NO: 9478562 - DNA, 22 bp, Homo sapiens
gattcctgattccagcacaacc

SEQ ID NO: 9478563 - DNA, 22 bp, Homo sapiens
gattcctttcgcctgccgagct

SEQ ID NO: 9478564 - DNA, 22 bp, Homo sapiens
gattctctctggatcccatgga

SEQ ID NO: 9478565 - DNA, 22 bp, Homo sapiens
gattctcttggatgtaggcata

SEQ ID NO: 9478566 - DNA, 22 bp, Homo sapiens
gattctgagctggtgttttacg

SEQ ID NO: 9478567 - DNA, 22 bp, Homo sapiens
gattctgagctggtgttttacg

SEQ ID NO: 9478568 - DNA, 22 bp, Homo sapiens
gattctgagctggtgttttacg

SEQ ID NO: 9478569 - DNA, 22 bp, Homo sapiens
gattctgatctatagtgttata

SEQ ID NO: 9478570 - DNA, 22 bp, Homo sapiens
gattctggattgtctgcttgaa

SEQ ID NO: 9478571 - DNA, 22 bp, Homo sapiens
gatgtgagtggtagctgggatt

SEQ ID NO: 9478572 - DNA, 22 bp, Homo sapiens
gatgtctttctgtgtgcctaga

SEQ ID NO: 9478573 - DNA, 22 bp, Homo sapiens
gatgtctttctaatactggctt

SEQ ID NO: 9478574 - DNA, 22 bp, Homo sapiens
gatgtctttgaggctcactgct

SEQ ID NO: 9478575 - DNA, 22 bp, Homo sapiens
gatgtctttctgtgtgcctaga

SEQ ID NO: 9478576 - DNA, 22 bp, Homo sapiens
gatgtctttttccaggctcttt

SEQ ID NO: 9478577 - DNA, 22 bp, Homo sapiens
gatgtctttgctgttatccact

SEQ ID NO: 9478578 - DNA, 22 bp, Homo sapiens
gatgtctttgccatgcatgtgt

SEQ ID NO: 9478579 - DNA, 22 bp, Homo sapiens
gatggccacatacatggctggg

SEQ ID NO: 9478580 - DNA, 22 bp, Homo sapiens
gatgtcttcccatgttcatgtg

SEQ ID NO: 9478581 - DNA, 22 bp, Homo sapiens
gatgtcttggcttgctctctgt

SEQ ID NO: 9478582 - DNA, 22 bp, Homo sapiens
gatgtcttctcaactgtagacc

SEQ ID NO: 9478583 - DNA, 22 bp, Homo sapiens
gatgtcttggtcaacttgggct

SEQ ID NO: 9478584 - DNA, 20 bp, Homo sapiens
gatgtcttggtcacagtggc

SEQ ID NO: 9478585 - DNA, 20 bp, Homo sapiens
gatgtcttggtcacagtggc

SEQ ID NO: 9478586 - DNA, 22 bp, Homo sapiens
gattcactcatattttacgttt

SEQ ID NO: 9478587 - DNA, 22 bp, Homo sapiens
gattcactcatattttacgttt

SEQ ID NO: 9478588 - DNA, 22 bp, Homo sapiens
gattcagcttctgagcagtaat

SEQ ID NO: 9478589 - DNA, 22 bp, Homo sapiens
gattcactcatattttacgttt

SEQ ID NO: 9478590 - DNA, 22 bp, Homo sapiens
gatgtgtcatttggtcatctgc

SEQ ID NO: 9478591 - DNA, 22 bp, Homo sapiens
gattcattctcagtttctagag

SEQ ID NO: 9478592 - DNA, 22 bp, Homo sapiens
gattcagtgagggtgagaagaa

SEQ ID NO: 9478593 - DNA, 22 bp, Homo sapiens
gatgtggggttgagggaccagc

SEQ ID NO: 9478594 - DNA, 22 bp, Homo sapiens
gatgtgtaacatgctgtgacat

SEQ ID NO: 9478595 - DNA, 22 bp, Homo sapiens
gatgtgggtgtcttcagctggt

SEQ ID NO: 9478596 - DNA, 22 bp, Homo sapiens
gatgtggatgatcttagatggt

SEQ ID NO: 9478597 - DNA, 19 bp, Homo sapiens
gcagagatgtggtagcttg

SEQ ID NO: 9478598 - DNA, 22 bp, Homo sapiens
gcagagatggctgcctctgagt

SEQ ID NO: 9478599 - DNA, 22 bp, Homo sapiens
gcagagatccttgctggatgac

SEQ ID NO: 9478600 - DNA, 22 bp, Homo sapiens
gcagagatctgagaaggctgcc

SEQ ID NO: 9478601 - DNA, 22 bp, Homo sapiens
gcagagatctgagaaggctgcc

SEQ ID NO: 9478602 - DNA, 22 bp, Homo sapiens
attcaataaatatgctacatgg

SEQ ID NO: 9478603 - DNA, 22 bp, Homo sapiens
attcaataaatatgctacatgg

SEQ ID NO: 9478604 - DNA, 22 bp, Homo sapiens
attcaagttcttctgtctttgc

SEQ ID NO: 9478605 - DNA, 22 bp, Homo sapiens
attcaagttcttctgtctttgc

SEQ ID NO: 9478606 - DNA, 22 bp, Homo sapiens
attcaagtggctgctatgttaa

SEQ ID NO: 9478607 - DNA, 22 bp, Homo sapiens
attcaagtggctgctatgttaa

SEQ ID NO: 9478608 - DNA, 22 bp, Homo sapiens
attcaagtggctgctatgttaa

SEQ ID NO: 9478609 - DNA, 22 bp, Homo sapiens
attcaagtccagcttctctaca

SEQ ID NO: 9478610 - DNA, 22 bp, Homo sapiens
attcaagtacagttttcttctt

SEQ ID NO: 9478611 - DNA, 22 bp, Homo sapiens
gcagagaggaatgaagccatcc

SEQ ID NO: 9478612 - DNA, 22 bp, Homo sapiens
gcagagaggaatgaagccatcc

SEQ ID NO: 9478613 - DNA, 22 bp, Homo sapiens
gcagagactccactgtcttgtg

SEQ ID NO: 9478614 - DNA, 22 bp, Homo sapiens
gcagagagttgggctgcgccag

SEQ ID NO: 9478615 - DNA, 22 bp, Homo sapiens
gcagagacagactaatgaaaag

SEQ ID NO: 9478616 - DNA, 21 bp, Homo sapiens
gcagagaatgaactttggctt

SEQ ID NO: 9478617 - DNA, 21 bp, Homo sapiens
gcagagaatgaactttggctt

SEQ ID NO: 9478618 - DNA, 22 bp, Homo sapiens
gcagagactagtagtgcagact

SEQ ID NO: 9478619 - DNA, 22 bp, Homo sapiens
attatgtaggttaggtggttgt

SEQ ID NO: 9478620 - DNA, 22 bp, Homo sapiens
attatgtatttggtatagtttg

SEQ ID NO: 9478621 - DNA, 22 bp, Homo sapiens
attatgtagctaaaaattgtgt

SEQ ID NO: 9478622 - DNA, 22 bp, Homo sapiens
attatgtagctaaaaattgtgt

SEQ ID NO: 9478623 - DNA, 22 bp, Homo sapiens
attatgggtataacacagttat

SEQ ID NO: 9478624 - DNA, 22 bp, Homo sapiens
attatgggtataacacagttat

SEQ ID NO: 9478625 - DNA, 22 bp, Homo sapiens
attatgtaactgtggttcagca

SEQ ID NO: 9478626 - DNA, 22 bp, Homo sapiens
attatggacatcaaataactct

SEQ ID NO: 9478627 - DNA, 22 bp, Homo sapiens
attatggacgttaattttggaa

SEQ ID NO: 9478628 - DNA, 22 bp, Homo sapiens
attatggacatcaaataactct

SEQ ID NO: 9478629 - DNA, 22 bp, Homo sapiens
attatggagaaatatgtacagg

SEQ ID NO: 9478630 - DNA, 22 bp, Homo sapiens
attatggagaaatatgtacagg

SEQ ID NO: 9478631 - DNA, 22 bp, Homo sapiens
attatggatggaggcattagtc

SEQ ID NO: 9478632 - DNA, 22 bp, Homo sapiens
attatggatggaggcattagtc

SEQ ID NO: 9478633 - DNA, 22 bp, Homo sapiens
gcagagaaggattgaaaccaga

SEQ ID NO: 9478634 - DNA, 22 bp, Homo sapiens
gcagacaaagcagcatgcctat

SEQ ID NO: 9478635 - DNA, 22 bp, Homo sapiens
gcagaattttctgttttctaga

SEQ ID NO: 9478636 - DNA, 22 bp, Homo sapiens
gcagaattttctgttttctaga

SEQ ID NO: 9478637 - DNA, 22 bp, Homo sapiens
attatgtatttggtatagtttg

SEQ ID NO: 9478638 - DNA, 22 bp, Homo sapiens
attatgtctttagatatttggt

SEQ ID NO: 9478639 - DNA, 21 bp, Homo sapiens
attatgttcccatctgtttgg

SEQ ID NO: 9478640 - DNA, 22 bp, Homo sapiens
gcacccagaataaggacaggac

SEQ ID NO: 9478641 - DNA, 22 bp, Homo sapiens
gcacccagaataaggacaggac

SEQ ID NO: 9478642 - DNA, 22 bp, Homo sapiens
gcacccagaataaggacaggac

SEQ ID NO: 9478643 - DNA, 22 bp, Homo sapiens
gcaccatgacagtgaggagaac

SEQ ID NO: 9478644 - DNA, 22 bp, Homo sapiens
gcaccattgctgggctagttcc

SEQ ID NO: 9478645 - DNA, 22 bp, Homo sapiens
gcacccacttaggccagtcaat

SEQ ID NO: 9478646 - DNA, 22 bp, Homo sapiens
attatctaggaattgacagaag

SEQ ID NO: 9478647 - DNA, 22 bp, Homo sapiens
gcacccagagggcagggtctcc

SEQ ID NO: 9478648 - DNA, 22 bp, Homo sapiens
gcacccagagggcagggtctcc

SEQ ID NO: 9478649 - DNA, 22 bp, Homo sapiens
gcacccagaataaggacaggac

SEQ ID NO: 9478650 - DNA, 22 bp, Homo sapiens
gcacccagaataaggacaggac

SEQ ID NO: 9478651 - DNA, 22 bp, Homo sapiens
attatcttgataaaatggcagt

SEQ ID NO: 9478652 - DNA, 22 bp, Homo sapiens
attatgaagttgagggaccctg

SEQ ID NO: 9478653 - DNA, 22 bp, Homo sapiens
attatctatgtagaatgatttt

SEQ ID NO: 9478654 - DNA, 22 bp, Homo sapiens
attatctatgtagaatgatttt

SEQ ID NO: 9478655 - DNA, 22 bp, Homo sapiens
attatctatgtagaatgatttt

SEQ ID NO: 9478656 - DNA, 22 bp, Homo sapiens
attatctatgtagaatgatttt

SEQ ID NO: 9478657 - DNA, 22 bp, Homo sapiens
attatgcatttgttagtattaa

SEQ ID NO: 9478658 - DNA, 22 bp, Homo sapiens
attatgaagttgagggaccctg

SEQ ID NO: 9478659 - DNA, 22 bp, Homo sapiens
attatgccaggacatttcccta

SEQ ID NO: 9478660 - DNA, 22 bp, Homo sapiens
gcaccagggagggtgtgcttca

SEQ ID NO: 9478661 - DNA, 22 bp, Homo sapiens
gcaccagggtgctgtgttctgg

SEQ ID NO: 9478662 - DNA, 22 bp, Homo sapiens
gcaccagggagggtgtgcttca

SEQ ID NO: 9478663 - DNA, 22 bp, Homo sapiens
gcaccaggtgcagccgggcccc

SEQ ID NO: 9478664 - DNA, 22 bp, Homo sapiens
gcaccaggcttagagccccagg

SEQ ID NO: 9478665 - DNA, 22 bp, Homo sapiens
gcaccaggcagctgagcaggcc

SEQ ID NO: 9478666 - DNA, 22 bp, Homo sapiens
gcaccaggcagctgagcaggcc

SEQ ID NO: 9478667 - DNA, 22 bp, Homo sapiens
gcaccaggcagctgagcaggcc

SEQ ID NO: 9478668 - DNA, 22 bp, Homo sapiens
gcaccaggcttagagccccagg

SEQ ID NO: 9478669 - DNA, 22 bp, Homo sapiens
gcaccaggcagctgagcaggcc

SEQ ID NO: 9478670 - DNA, 22 bp, Homo sapiens
gcaccaggcagctgagcaggcc

SEQ ID NO: 9478671 - DNA, 22 bp, Homo sapiens
gcaccaggcagctgagcaggcc

SEQ ID NO: 9478672 - DNA, 22 bp, Homo sapiens
gcaccaggcagctgagcaggcc

SEQ ID NO: 9478673 - DNA, 22 bp, Homo sapiens
gcaccaggaggcccttctcatc

SEQ ID NO: 9478674 - DNA, 22 bp, Homo sapiens
gcacagggctgccaggcggctt

SEQ ID NO: 9478675 - DNA, 22 bp, Homo sapiens
gcacacaggcagtttccagcca

SEQ ID NO: 9478676 - DNA, 22 bp, Homo sapiens
gcacacagccagctgagggcta

SEQ ID NO: 9478677 - DNA, 22 bp, Homo sapiens
gcacacagagaggtggtatgtc

SEQ ID NO: 9478678 - DNA, 22 bp, Homo sapiens
gcacacagattaggaaacagaa

SEQ ID NO: 9478679 - DNA, 22 bp, Homo sapiens
attataggcttgagccaccgtg

SEQ ID NO: 9478680 - DNA, 22 bp, Homo sapiens
attagtttggtgcaaaagtaat

SEQ ID NO: 9478681 - DNA, 22 bp, Homo sapiens
attataggcttgagccaccgtg

SEQ ID NO: 9478682 - DNA, 22 bp, Homo sapiens
attataggcttgagccaccgtg

SEQ ID NO: 9478683 - DNA, 22 bp, Homo sapiens
attataggcttgagccaccgtg

SEQ ID NO: 9478684 - DNA, 22 bp, Homo sapiens
attataggcttgagccaccgtg

SEQ ID NO: 9478685 - DNA, 22 bp, Homo sapiens
attataggcttgagccaccgtg

SEQ ID NO: 9478686 - DNA, 22 bp, Homo sapiens
attataggcttgagccaccgtg

SEQ ID NO: 9478687 - DNA, 22 bp, Homo sapiens
attaagatcattgtagaagatt

SEQ ID NO: 9478688 - DNA, 22 bp, Homo sapiens
attagttggggtggagaaggat

SEQ ID NO: 9478689 - DNA, 21 bp, Homo sapiens
attaacttgttaacctaaagt

SEQ ID NO: 9478690 - DNA, 22 bp, Homo sapiens
attaacttttgatcagtgtggt

SEQ ID NO: 9478691 - DNA, 21 bp, Homo sapiens
attaacttgttaacctaaagt

SEQ ID NO: 9478692 - DNA, 22 bp, Homo sapiens
attaagactgcccatgttttta

SEQ ID NO: 9478693 - DNA, 22 bp, Homo sapiens
attaagactattgatatttaca

SEQ ID NO: 9478694 - DNA, 22 bp, Homo sapiens
attatattgagtataaccagag

SEQ ID NO: 9478695 - DNA, 22 bp, Homo sapiens
attatatttgaaaggttggaag

SEQ ID NO: 9478696 - DNA, 22 bp, Homo sapiens
attatattgagtataaccagag

SEQ ID NO: 9478697 - DNA, 22 bp, Homo sapiens
attatattgagtataaccagag

SEQ ID NO: 9478698 - DNA, 22 bp, Homo sapiens
attatattgagtataaccagag

SEQ ID NO: 9478699 - DNA, 22 bp, Homo sapiens
attatatgtgggatagaattta

SEQ ID NO: 9478700 - DNA, 22 bp, Homo sapiens
attatataggacttgcccttcc

SEQ ID NO: 9478701 - DNA, 22 bp, Homo sapiens
attatcagccgtcccactacat

SEQ ID NO: 9478702 - DNA, 22 bp, Homo sapiens
attatcagaaattcaaagggtg

SEQ ID NO: 9478703 - DNA, 22 bp, Homo sapiens
attatcagccgtcccactacat

SEQ ID NO: 9478704 - DNA, 22 bp, Homo sapiens
attatcacatggactttgcttt

SEQ ID NO: 9478705 - DNA, 22 bp, Homo sapiens
gcacacagaattgattcactgt

SEQ ID NO: 9478706 - DNA, 22 bp, Homo sapiens
gcacacagaattgattcactgt

SEQ ID NO: 9478707 - DNA, 22 bp, Homo sapiens
gcacacagaatcagtgggcata

SEQ ID NO: 9478708 - DNA, 22 bp, Homo sapiens
attatccagcaccaatgtcaga

SEQ ID NO: 9478709 - DNA, 22 bp, Homo sapiens
attatccaacacccagttacat

SEQ ID NO: 9478710 - DNA, 22 bp, Homo sapiens
gaagcctggtccagagctccca

SEQ ID NO: 9478711 - DNA, 22 bp, Homo sapiens
gaagcctggtccagagctccca

SEQ ID NO: 9478712 - DNA, 22 bp, Homo sapiens
gaagcctggagaccagatgttg

SEQ ID NO: 9478713 - DNA, 22 bp, Homo sapiens
gaagcctgtcacttcccttgct

SEQ ID NO: 9478714 - DNA, 22 bp, Homo sapiens
gaagcctggttcgctggccacc

SEQ ID NO: 9478715 - DNA, 22 bp, Homo sapiens
gaagcctggtccagagctccca

SEQ ID NO: 9478716 - DNA, 22 bp, Homo sapiens
gaagcctgctgtgcagccaaat

SEQ ID NO: 9478717 - DNA, 22 bp, Homo sapiens
gaagcctgacactggccatcag

SEQ ID NO: 9478718 - DNA, 22 bp, Homo sapiens
gaagcagcaagtataggacagg

SEQ ID NO: 9478719 - DNA, 22 bp, Homo sapiens
gaagcagcaagtataggacagg

SEQ ID NO: 9478720 - DNA, 22 bp, Homo sapiens
gaagctaatgatttattttctg

SEQ ID NO: 9478721 - DNA, 22 bp, Homo sapiens
gaagccttgaactgcaaacccc

SEQ ID NO: 9478722 - DNA, 22 bp, Homo sapiens
gaagccttgaactgcaaacccc

SEQ ID NO: 9478723 - DNA, 22 bp, Homo sapiens
gaaggaggcgttagccctagga

SEQ ID NO: 9478724 - DNA, 22 bp, Homo sapiens
gaaggaggcgttagccctagga

SEQ ID NO: 9478725 - DNA, 22 bp, Homo sapiens
gaagctgtgctgggggatctgt

SEQ ID NO: 9478726 - DNA, 22 bp, Homo sapiens
gaagctggggtgctgagggcaa

SEQ ID NO: 9478727 - DNA, 22 bp, Homo sapiens
gaagctgggtcgctgggatcct

SEQ ID NO: 9478728 - DNA, 22 bp, Homo sapiens
gaagctgcgtgtagccatactt

SEQ ID NO: 9478729 - DNA, 22 bp, Homo sapiens
gaagctccgtactatgactttt

SEQ ID NO: 9478730 - DNA, 22 bp, Homo sapiens
gaaggaggtctgcattctacag

SEQ ID NO: 9478731 - DNA, 22 bp, Homo sapiens
gaaggatttgagattatcctag

SEQ ID NO: 9478732 - DNA, 22 bp, Homo sapiens
gaaggatttcctatcagttttc

SEQ ID NO: 9478733 - DNA, 22 bp, Homo sapiens
atgcaggagagcatgtttaaga

SEQ ID NO: 9478734 - DNA, 22 bp, Homo sapiens
atgcaggttgggcaagtgtggg

SEQ ID NO: 9478735 - DNA, 22 bp, Homo sapiens
atgcagtgtttggaagcttaag

SEQ ID NO: 9478736 - DNA, 22 bp, Homo sapiens
atgcagttagcagtagctcccc

SEQ ID NO: 9478737 - DNA, 22 bp, Homo sapiens
atgcagttagcactacagaaga

SEQ ID NO: 9478738 - DNA, 22 bp, Homo sapiens
atgcagttagcactacagaaga

SEQ ID NO: 9478739 - DNA, 22 bp, Homo sapiens
atgcagttagtatacttccagt

SEQ ID NO: 9478740 - DNA, 22 bp, Homo sapiens
atgcagttaggtaatagtctca

SEQ ID NO: 9478741 - DNA, 22 bp, Homo sapiens
atgcagttccacaggcgcatgg

SEQ ID NO: 9478742 - DNA, 22 bp, Homo sapiens
atgcagttatgtgagggcatga

SEQ ID NO: 9478743 - DNA, 22 bp, Homo sapiens
atgcagtggcagctcctggtgt

SEQ ID NO: 9478744 - DNA, 22 bp, Homo sapiens
atgcagtctaagcatgtaaggg

SEQ ID NO: 9478745 - DNA, 20 bp, Homo sapiens
atgcagtcttgtggcaacta

SEQ ID NO: 9478746 - DNA, 22 bp, Homo sapiens
atgcagtggcagctcctggtgt

SEQ ID NO: 9478747 - DNA, 22 bp, Homo sapiens
atgcagtaaaataggaggtaat

SEQ ID NO: 9478748 - DNA, 22 bp, Homo sapiens
atgcagtaaatgttaagaaaaa

SEQ ID NO: 9478749 - DNA, 22 bp, Homo sapiens
atgcagtaaatgttctagtttg

SEQ ID NO: 9478750 - DNA, 22 bp, Homo sapiens
atgcagtacatacaaacactga

SEQ ID NO: 9478751 - DNA, 22 bp, Homo sapiens
atgcagtacagataattctaca

SEQ ID NO: 9478752 - DNA, 22 bp, Homo sapiens
atgcagtccacaggccacagtg

SEQ ID NO: 9478753 - DNA, 22 bp, Homo sapiens
atgcagtcatggaatgctctca

SEQ ID NO: 9478754 - DNA, 23 bp, Homo sapiens
atgcagtatatgtcagtagttta

SEQ ID NO: 9478755 - DNA, 22 bp, Homo sapiens
atgcagtataaatcatttctgg

SEQ ID NO: 9478756 - DNA, 22 bp, Homo sapiens
atgcagtagataggcactttta

SEQ ID NO: 9478757 - DNA, 22 bp, Homo sapiens
atgcagtactgatacatgccac

SEQ ID NO: 9478758 - DNA, 22 bp, Homo sapiens
gaagagcatatgaagagcatat

SEQ ID NO: 9478759 - DNA, 22 bp, Homo sapiens
gaagagcatatgaagagcatat

SEQ ID NO: 9478760 - DNA, 22 bp, Homo sapiens
gaagagatgacaaaggagcatg

SEQ ID NO: 9478761 - DNA, 21 bp, Homo sapiens
gaagagagtcctcatcctgag

SEQ ID NO: 9478762 - DNA, 22 bp, Homo sapiens
gaagagatgacaaaggagcatg

SEQ ID NO: 9478763 - DNA, 22 bp, Homo sapiens
gaagagatgacaaaggagcatg

SEQ ID NO: 9478764 - DNA, 19 bp, Homo sapiens
atgatggattaacggaagt

SEQ ID NO: 9478765 - DNA, 22 bp, Homo sapiens
atgatggatgtcacagtctgta

SEQ ID NO: 9478766 - DNA, 22 bp, Homo sapiens
atgatggctaggctggttttga

SEQ ID NO: 9478767 - DNA, 22 bp, Homo sapiens
atgatggctaggctggttttga

SEQ ID NO: 9478768 - DNA, 22 bp, Homo sapiens
atgatgtaaaataagttgtgag

SEQ ID NO: 9478769 - DNA, 22 bp, Homo sapiens
atgatggtgggtaatgtgtaaa

SEQ ID NO: 9478770 - DNA, 22 bp, Homo sapiens
gaagagctaaaggcacaggctt

SEQ ID NO: 9478771 - DNA, 22 bp, Homo sapiens
gaagagccaggtgtcgctgtgg

SEQ ID NO: 9478772 - DNA, 22 bp, Homo sapiens
atgatggaggccgtgatggacg

SEQ ID NO: 9478773 - DNA, 22 bp, Homo sapiens
atgatggaggtgtcctggattt

SEQ ID NO: 9478774 - DNA, 22 bp, Homo sapiens
atgatggatgtcacagtctgta

SEQ ID NO: 9478775 - DNA, 22 bp, Homo sapiens
atgatggatatgtaaagtgttg

SEQ ID NO: 9478776 - DNA, 22 bp, Homo sapiens
atgatggatatgtaaagtgttg

SEQ ID NO: 9478777 - DNA, 22 bp, Homo sapiens
atgatggaggggtggctttaga

SEQ ID NO: 9478778 - DNA, 22 bp, Homo sapiens
atgatgtaacataaagatgtct

SEQ ID NO: 9478779 - DNA, 22 bp, Homo sapiens
atgatgtaagggtaattgtcta

SEQ ID NO: 9478780 - DNA, 22 bp, Homo sapiens
atgatgtaagggtaattgtcta

SEQ ID NO: 9478781 - DNA, 22 bp, Homo sapiens
atgatgtacagaaagttggcgg

SEQ ID NO: 9478782 - DNA, 22 bp, Homo sapiens
atgatgtagacaaaaatatgct

SEQ ID NO: 9478783 - DNA, 22 bp, Homo sapiens
atgatgtatgactgtgttcaaa

SEQ ID NO: 9478784 - DNA, 22 bp, Homo sapiens
atgatgtactagttaaatatta

SEQ ID NO: 9478785 - DNA, 22 bp, Homo sapiens
atgatgtactagttaaatatta

SEQ ID NO: 9478786 - DNA, 22 bp, Homo sapiens
atgatgtaccactttctcagtt

SEQ ID NO: 9478787 - DNA, 22 bp, Homo sapiens
atgatgtccacaggggtgttca

SEQ ID NO: 9478788 - DNA, 23 bp, Homo sapiens
gaagcagatgtctgagtaggcag

SEQ ID NO: 9478789 - DNA, 22 bp, Homo sapiens
atgatgttgataaattacttta

SEQ ID NO: 9478790 - DNA, 22 bp, Homo sapiens
atgagcaggtttaagagaggcc

SEQ ID NO: 9478791 - DNA, 22 bp, Homo sapiens
atgagcaggtttaagagaggcc

SEQ ID NO: 9478792 - DNA, 22 bp, Homo sapiens
atgagcagtaggttcatggctg

SEQ ID NO: 9478793 - DNA, 19 bp, Homo sapiens
atgagcaggcaagacaagc

SEQ ID NO: 9478794 - DNA, 19 bp, Homo sapiens
atgagcaggcaagacaagc

SEQ ID NO: 9478795 - DNA, 22 bp, Homo sapiens
atgagctgggccatccagtgat

SEQ ID NO: 9478796 - DNA, 22 bp, Homo sapiens
gaagagagagtggggttctgcg

SEQ ID NO: 9478797 - DNA, 22 bp, Homo sapiens
gaagagagagtggggttctgcg

SEQ ID NO: 9478798 - DNA, 22 bp, Homo sapiens
gaagagagagtggggttctgcg

SEQ ID NO: 9478799 - DNA, 22 bp, Homo sapiens
gaagagagcagcaaactggagt

SEQ ID NO: 9478800 - DNA, 21 bp, Homo sapiens
gaagagagtcctcatcctgag

SEQ ID NO: 9478801 - DNA, 22 bp, Homo sapiens
gaagagagccgcgggacatcag

SEQ ID NO: 9478802 - DNA, 22 bp, Homo sapiens
gaagagagccgcgggacatcag

SEQ ID NO: 9478803 - DNA, 22 bp, Homo sapiens
gaagagagccgcgggacatcag

SEQ ID NO: 9478804 - DNA, 22 bp, Homo sapiens
gaagagagccgcgggacatcag

SEQ ID NO: 9478805 - DNA, 22 bp, Homo sapiens
gaagagagaacattacataaac

SEQ ID NO: 9478806 - DNA, 22 bp, Homo sapiens
gaagagagagccctggggtccg

SEQ ID NO: 9478807 - DNA, 22 bp, Homo sapiens
gaagagagagccctggggtccg

SEQ ID NO: 9478808 - DNA, 22 bp, Homo sapiens
gaagagagagccctggggtccg

SEQ ID NO: 9478809 - DNA, 22 bp, Homo sapiens
gaagagagagccctggggtccg

SEQ ID NO: 9478810 - DNA, 22 bp, Homo sapiens
gaagaaagggaattaacttgag

SEQ ID NO: 9478811 - DNA, 22 bp, Homo sapiens
gaagaaagggaattaacttgag

SEQ ID NO: 9478812 - DNA, 22 bp, Homo sapiens
gaagagagaacattacataaac

SEQ ID NO: 9478813 - DNA, 22 bp, Homo sapiens
gaagagaaggtgtaggccatcc

SEQ ID NO: 9478814 - DNA, 22 bp, Homo sapiens
gaagtctgacaggtctgaatca

SEQ ID NO: 9478815 - DNA, 22 bp, Homo sapiens
atgcatttgacgggatatattt

SEQ ID NO: 9478816 - DNA, 22 bp, Homo sapiens
atgcatttgacgggatatattt

SEQ ID NO: 9478817 - DNA, 22 bp, Homo sapiens
gaagtctgctgctcaggagttt

SEQ ID NO: 9478818 - DNA, 22 bp, Homo sapiens
gaagtctggctgacgagagtta

SEQ ID NO: 9478819 - DNA, 22 bp, Homo sapiens
gaagtcagtcatctcctgtctc

SEQ ID NO: 9478820 - DNA, 22 bp, Homo sapiens
gaagtcagtcatctcctgtctc

SEQ ID NO: 9478821 - DNA, 22 bp, Homo sapiens
gaagtatagcagatgttattta

SEQ ID NO: 9478822 - DNA, 22 bp, Homo sapiens
gaagtacattctgatagggaag

SEQ ID NO: 9478823 - DNA, 22 bp, Homo sapiens
gaagtcagaaaagaattaggga

SEQ ID NO: 9478824 - DNA, 22 bp, Homo sapiens
gaagtatttctgagttgcccag

SEQ ID NO: 9478825 - DNA, 22 bp, Homo sapiens
gaagtattatagcatattagcc

SEQ ID NO: 9478826 - DNA, 22 bp, Homo sapiens
gaagtattactctgaatgtatt

SEQ ID NO: 9478827 - DNA, 22 bp, Homo sapiens
gaagtattactctgaatgtatt

SEQ ID NO: 9478828 - DNA, 22 bp, Homo sapiens
gaagtatatgtctttaatctat

SEQ ID NO: 9478829 - DNA, 22 bp, Homo sapiens
gaagtataggagacaaacaaga

SEQ ID NO: 9478830 - DNA, 22 bp, Homo sapiens
atgcagttttaaatcatttcag

SEQ ID NO: 9478831 - DNA, 22 bp, Homo sapiens
atgcagtttgcttcgcagcagt

SEQ ID NO: 9478832 - DNA, 22 bp, Homo sapiens
atgcagttttaggggaagggtt

SEQ ID NO: 9478833 - DNA, 22 bp, Homo sapiens
atgcagttttcaaagactattc

SEQ ID NO: 9478834 - DNA, 22 bp, Homo sapiens
atgcagtttatctccaaatcat

SEQ ID NO: 9478835 - DNA, 22 bp, Homo sapiens
atgcagtttaaggcacaattag

SEQ ID NO: 9478836 - DNA, 18 bp, Homo sapiens
atgcagttggtactctca

SEQ ID NO: 9478837 - DNA, 22 bp, Homo sapiens
atgcagttgcaatggaggactc

SEQ ID NO: 9478838 - DNA, 22 bp, Homo sapiens
atgccactgcactccagcctgg

SEQ ID NO: 9478839 - DNA, 22 bp, Homo sapiens
atgccactgcacttcagcctgg

SEQ ID NO: 9478840 - DNA, 22 bp, Homo sapiens
atgccactgcacttcagcttgg

SEQ ID NO: 9478841 - DNA, 22 bp, Homo sapiens
gaatttatctacgttaagtatg

SEQ ID NO: 9478842 - DNA, 22 bp, Homo sapiens
atgccactgcacttcagcctgg

SEQ ID NO: 9478843 - DNA, 22 bp, Homo sapiens
atgccactgcacttcagcctgg

SEQ ID NO: 9478844 - DNA, 22 bp, Homo sapiens
gaatttatctacgttaagtatg

SEQ ID NO: 9478845 - DNA, 22 bp, Homo sapiens
gaatttcaaagaggttaagagg

SEQ ID NO: 9478846 - DNA, 22 bp, Homo sapiens
gaatttcaagcagtgcaatgtt

SEQ ID NO: 9478847 - DNA, 22 bp, Homo sapiens
gaatttcagaggtaacatcatc

SEQ ID NO: 9478848 - DNA, 22 bp, Homo sapiens
gaatttcagaggtaacatcatc

SEQ ID NO: 9478849 - DNA, 22 bp, Homo sapiens
gaatttcagaggtaacatcatc

SEQ ID NO: 9478850 - DNA, 22 bp, Homo sapiens
atgccactgcactccagcctgg

SEQ ID NO: 9478851 - DNA, 22 bp, Homo sapiens
atgccactgcactccagcctgg

SEQ ID NO: 9478852 - DNA, 22 bp, Homo sapiens
atgccactgcactccagcctgg

SEQ ID NO: 9478853 - DNA, 22 bp, Homo sapiens
atgccactgcactccagcctgg

SEQ ID NO: 9478854 - DNA, 22 bp, Homo sapiens
atgccactgcactccagcctgg

SEQ ID NO: 9478855 - DNA, 22 bp, Homo sapiens
atgccactgcactccagcctgg

SEQ ID NO: 9478856 - DNA, 22 bp, Homo sapiens
atgccactgcactccagcctgg

SEQ ID NO: 9478857 - DNA, 22 bp, Homo sapiens
atgccactgcactccagcctgg

SEQ ID NO: 9478858 - DNA, 22 bp, Homo sapiens
atgccactgcactccagcctag

SEQ ID NO: 9478859 - DNA, 22 bp, Homo sapiens
atgccactgcactccagcctag

SEQ ID NO: 9478860 - DNA, 22 bp, Homo sapiens
atgccactgcactccagcctag

SEQ ID NO: 9478861 - DNA, 22 bp, Homo sapiens
atgccactgcactccagcctag

SEQ ID NO: 9478862 - DNA, 22 bp, Homo sapiens
atgccactgcactccagcctag

SEQ ID NO: 9478863 - DNA, 22 bp, Homo sapiens
atgccactgcactccagcctag

SEQ ID NO: 9478864 - DNA, 22 bp, Homo sapiens
atgccactgcactccagcctag

SEQ ID NO: 9478865 - DNA, 22 bp, Homo sapiens
atgccactgcactccagcctag

SEQ ID NO: 9478866 - DNA, 22 bp, Homo sapiens
gacaggaaacaagaaggcagga

SEQ ID NO: 9478867 - DNA, 22 bp, Homo sapiens
gacaggaaacaagaaggcagga

SEQ ID NO: 9478868 - DNA, 22 bp, Homo sapiens
gacaggaaacaagaaggcagga

SEQ ID NO: 9478869 - DNA, 20 bp, Homo sapiens
gacagcttggggtgtcacct

SEQ ID NO: 9478870 - DNA, 22 bp, Homo sapiens
gacagcttgcctggtactgcaa

SEQ ID NO: 9478871 - DNA, 22 bp, Homo sapiens
gacagcttcttgggccgggcct

SEQ ID NO: 9478872 - DNA, 22 bp, Homo sapiens
gacagcttctagaggaattggt

SEQ ID NO: 9478873 - DNA, 22 bp, Homo sapiens
gacagcttctatgtgacgagca

SEQ ID NO: 9478874 - DNA, 22 bp, Homo sapiens
gacagcttctagaaatggtcac

SEQ ID NO: 9478875 - DNA, 16 bp, Homo sapiens
atgctgctattagagg

SEQ ID NO: 9478876 - DNA, 18 bp, Homo sapiens
atgctgccctctgagggt

SEQ ID NO: 9478877 - DNA, 18 bp, Homo sapiens
atgctgccctctgagggt

SEQ ID NO: 9478878 - DNA, 22 bp, Homo sapiens
atgctcttgaggctaaagacat

SEQ ID NO: 9478879 - DNA, 16 bp, Homo sapiens
atgctgctattagagg

SEQ ID NO: 9478880 - DNA, 22 bp, Homo sapiens
gacaggaaaggggtctgttttc

SEQ ID NO: 9478881 - DNA, 22 bp, Homo sapiens
atgctcttgaggctaaagacat

SEQ ID NO: 9478882 - DNA, 22 bp, Homo sapiens
atgctctgggcttttgaagtgg

SEQ ID NO: 9478883 - DNA, 22 bp, Homo sapiens
atgctataaactctaggtcatt

SEQ ID NO: 9478884 - DNA, 22 bp, Homo sapiens
atgctataaactctaggtcatt

SEQ ID NO: 9478885 - DNA, 22 bp, Homo sapiens
atgctactatccttctgcttaa

SEQ ID NO: 9478886 - DNA, 22 bp, Homo sapiens
atgctatactcaaagaaattca

SEQ ID NO: 9478887 - DNA, 22 bp, Homo sapiens
atgctatacatatgacatcaca

SEQ ID NO: 9478888 - DNA, 22 bp, Homo sapiens
gacagcttcgaggaggtgagct

SEQ ID NO: 9478889 - DNA, 22 bp, Homo sapiens
gacagcttagtgaaaatgtaaa

SEQ ID NO: 9478890 - DNA, 22 bp, Homo sapiens
gacagcttagtgaaaatgtaaa

SEQ ID NO: 9478891 - DNA, 22 bp, Homo sapiens
gacagcttaggaagtttctatt

SEQ ID NO: 9478892 - DNA, 22 bp, Homo sapiens
atgcctggatttgggactcaaa

SEQ ID NO: 9478893 - DNA, 22 bp, Homo sapiens
atgctaaactatgatcattttc

SEQ ID NO: 9478894 - DNA, 22 bp, Homo sapiens
atgctaaactatgatcattttc

SEQ ID NO: 9478895 - DNA, 22 bp, Homo sapiens
atgctacactccgcgaaaatgt

SEQ ID NO: 9478896 - DNA, 22 bp, Homo sapiens
gaatttgctttcgtgacagggt

SEQ ID NO: 9478897 - DNA, 22 bp, Homo sapiens
gaatttggatctttgatagagt

SEQ ID NO: 9478898 - DNA, 22 bp, Homo sapiens
gaatttcctctaaacccctgag

SEQ ID NO: 9478899 - DNA, 22 bp, Homo sapiens
gaatttcatttgtttcctacca

SEQ ID NO: 9478900 - DNA, 22 bp, Homo sapiens
gaatttgtcccttgatataaaa

SEQ ID NO: 9478901 - DNA, 22 bp, Homo sapiens
gaatttgtgctcaggaagatta

SEQ ID NO: 9478902 - DNA, 22 bp, Homo sapiens
gaatttgtgctcaggaagatta

SEQ ID NO: 9478903 - DNA, 22 bp, Homo sapiens
gaattttaagtgttcgcctctt

SEQ ID NO: 9478904 - DNA, 22 bp, Homo sapiens
gaattttaataaaggtttatca

SEQ ID NO: 9478905 - DNA, 22 bp, Homo sapiens
atgcctggactgtatcccagat

SEQ ID NO: 9478906 - DNA, 19 bp, Homo sapiens
gaattttaggacttcagca

SEQ ID NO: 9478907 - DNA, 22 bp, Homo sapiens
atgacagaggagtgcaggtgat

SEQ ID NO: 9478908 - DNA, 22 bp, Homo sapiens
ctttttataccgtgccagttga

SEQ ID NO: 9478909 - DNA, 18 bp, Homo sapiens
cttttgttttccctcctc

SEQ ID NO: 9478910 - DNA, 22 bp, Homo sapiens
ctttttactctgttgtctcagc

SEQ ID NO: 9478911 - DNA, 22 bp, Homo sapiens
ctttttacaaagcctgtcttct

SEQ ID NO: 9478912 - DNA, 22 bp, Homo sapiens
ctttttatctcttaatgatgtt

SEQ ID NO: 9478913 - DNA, 22 bp, Homo sapiens
ctttttatctcttaatgatgtt

SEQ ID NO: 9478914 - DNA, 19 bp, Homo sapiens
ctttttcaccttctagaag

SEQ ID NO: 9478915 - DNA, 19 bp, Homo sapiens
ctttttcaccttctagaag

SEQ ID NO: 9478916 - DNA, 22 bp, Homo sapiens
atgagataattcatgtggaatg

SEQ ID NO: 9478917 - DNA, 22 bp, Homo sapiens
atgagagtctcagagtctcttc

SEQ ID NO: 9478918 - DNA, 21 bp, Homo sapiens
atgagagtaatgctataaatt

SEQ ID NO: 9478919 - DNA, 22 bp, Homo sapiens
atgagagtactagaaacttcct

SEQ ID NO: 9478920 - DNA, 22 bp, Homo sapiens
atgagatagactatgtcataca

SEQ ID NO: 9478921 - DNA, 22 bp, Homo sapiens
atgagaggtttcgtcagaggaa

SEQ ID NO: 9478922 - DNA, 22 bp, Homo sapiens
atgagaggtttcgtcagaggaa

SEQ ID NO: 9478923 - DNA, 22 bp, Homo sapiens
atgagagctctatatatagtaa

SEQ ID NO: 9478924 - DNA, 22 bp, Homo sapiens
atgagagctctatgatctgttt

SEQ ID NO: 9478925 - DNA, 22 bp, Homo sapiens
atgagatgttcaggagtctgag

SEQ ID NO: 9478926 - DNA, 22 bp, Homo sapiens
atgagatgtgtctaatggaacc

SEQ ID NO: 9478927 - DNA, 22 bp, Homo sapiens
atgagcaagagctatgtacaga

SEQ ID NO: 9478928 - DNA, 22 bp, Homo sapiens
atgagcaaccttctcctccagc

SEQ ID NO: 9478929 - DNA, 22 bp, Homo sapiens
atgagcaaccttctcctccagc

SEQ ID NO: 9478930 - DNA, 22 bp, Homo sapiens
atgagcaattaaattgcaccag

SEQ ID NO: 9478931 - DNA, 22 bp, Homo sapiens
atgagcaagagctatgtacaga

SEQ ID NO: 9478932 - DNA, 22 bp, Homo sapiens
atgagcaagccagttccagagt

SEQ ID NO: 9478933 - DNA, 22 bp, Homo sapiens
atgagcagatgctcctgcctct

SEQ ID NO: 9478934 - DNA, 22 bp, Homo sapiens
atgagaaatttattacaagcta

SEQ ID NO: 9478935 - DNA, 22 bp, Homo sapiens
atgagaaagttaatcatcatga

SEQ ID NO: 9478936 - DNA, 22 bp, Homo sapiens
atgacattgaatatgttaacta

SEQ ID NO: 9478937 - DNA, 22 bp, Homo sapiens
atgacattgaatatgttaacta

SEQ ID NO: 9478938 - DNA, 22 bp, Homo sapiens
atgagaaagttaatcatcatga

SEQ ID NO: 9478939 - DNA, 22 bp, Homo sapiens
atgagaaagttaatcatcatga

SEQ ID NO: 9478940 - DNA, 22 bp, Homo sapiens
atgagacatgacttcaggcctt

SEQ ID NO: 9478941 - DNA, 22 bp, Homo sapiens
atgagacattgcaagtccagaa

SEQ ID NO: 9478942 - DNA, 22 bp, Homo sapiens
atgagagccaccatgcttctgt

SEQ ID NO: 9478943 - DNA, 22 bp, Homo sapiens
atgagaaggacataaattatag

SEQ ID NO: 9478944 - DNA, 22 bp, Homo sapiens
atgagaatgcattcatgttttg

SEQ ID NO: 9478945 - DNA, 22 bp, Homo sapiens
atgagacaagagtctaaattca

SEQ ID NO: 9478946 - DNA, 22 bp, Homo sapiens
atgacacataaaacaaggactg

SEQ ID NO: 9478947 - DNA, 22 bp, Homo sapiens
atgacacaattttagagctgaa

SEQ ID NO: 9478948 - DNA, 22 bp, Homo sapiens
atgacacaattttagagctgaa

SEQ ID NO: 9478949 - DNA, 22 bp, Homo sapiens
atgacacaattttagagctgaa

SEQ ID NO: 9478950 - DNA, 22 bp, Homo sapiens
atgacaccatattagcctagag

SEQ ID NO: 9478951 - DNA, 22 bp, Homo sapiens
atgacacatttgtgctgttgaa

SEQ ID NO: 9478952 - DNA, 22 bp, Homo sapiens
atgacacatttgtgctgttgaa

SEQ ID NO: 9478953 - DNA, 22 bp, Homo sapiens
atgacacataaaacaaggactg

SEQ ID NO: 9478954 - DNA, 22 bp, Homo sapiens
atgacacataaaacaaggactg

SEQ ID NO: 9478955 - DNA, 22 bp, Homo sapiens
atgacaatggacatagttaaaa

SEQ ID NO: 9478956 - DNA, 22 bp, Homo sapiens
atgacacaagcagaggctctaa

SEQ ID NO: 9478957 - DNA, 22 bp, Homo sapiens
atgacacaagcagaggctctaa

SEQ ID NO: 9478958 - DNA, 22 bp, Homo sapiens
atgacactcgaaaaattgatgc

SEQ ID NO: 9478959 - DNA, 23 bp, Homo sapiens
atgacactcctgtgcgcaccctg

SEQ ID NO: 9478960 - DNA, 22 bp, Homo sapiens
atgacactgtcctagtaaggaa

SEQ ID NO: 9478961 - DNA, 22 bp, Homo sapiens
atgacacccccacagcattgtt

SEQ ID NO: 9478962 - DNA, 22 bp, Homo sapiens
atgacacatttgtgctgttgaa

SEQ ID NO: 9478963 - DNA, 22 bp, Homo sapiens
atgacacccaaaaccagtgcag

SEQ ID NO: 9478964 - DNA, 22 bp, Homo sapiens
atgacacccaaaaccagtgcag

SEQ ID NO: 9478965 - DNA, 22 bp, Homo sapiens
atgacaccatattagcctagag

SEQ ID NO: 9478966 - DNA, 23 bp, Homo sapiens
atgacactcctgtgcgcaccctg

SEQ ID NO: 9478967 - DNA, 22 bp, Homo sapiens
atgacacccccacagcattgtt

SEQ ID NO: 9478968 - DNA, 22 bp, Homo sapiens
atgacacttggtgatactttgt

SEQ ID NO: 9478969 - DNA, 22 bp, Homo sapiens
atgacacttggtgatactttgt

SEQ ID NO: 9478970 - DNA, 22 bp, Homo sapiens
ctttgggatttcatgagagcta

SEQ ID NO: 9478971 - DNA, 22 bp, Homo sapiens
ctttgggatttcatgagagcta

SEQ ID NO: 9478972 - DNA, 22 bp, Homo sapiens
ctttggcttgccctggcagtac

SEQ ID NO: 9478973 - DNA, 22 bp, Homo sapiens
ctttggcttgccctggcagtac

SEQ ID NO: 9478974 - DNA, 22 bp, Homo sapiens
ctttggcttttagatatccatt

SEQ ID NO: 9478975 - DNA, 22 bp, Homo sapiens
ctttggcttgccctggcagtac

SEQ ID NO: 9478976 - DNA, 22 bp, Homo sapiens
ctttggctgtcctcttggctgg

SEQ ID NO: 9478977 - DNA, 22 bp, Homo sapiens
ctttggctgggcaaagggaggt

SEQ ID NO: 9478978 - DNA, 22 bp, Homo sapiens
ctttggctgcattcgagttgct

SEQ ID NO: 9478979 - DNA, 22 bp, Homo sapiens
ctttggctgacgaggaggaggc

SEQ ID NO: 9478980 - DNA, 19 bp, Homo sapiens
ctttgccaaaagaggccat

SEQ ID NO: 9478981 - DNA, 22 bp, Homo sapiens
ctttctttcgaagacgtgatta

SEQ ID NO: 9478982 - DNA, 22 bp, Homo sapiens
ctttcaaaacgctctgtatgca

SEQ ID NO: 9478983 - DNA, 22 bp, Homo sapiens
ctttcaaaacgctctgtatgca

SEQ ID NO: 9478984 - DNA, 23 bp, Homo sapiens
ctttgccacccagagcctgacag

SEQ ID NO: 9478985 - DNA, 20 bp, Homo sapiens
ctttgcctattctctgcctg

SEQ ID NO: 9478986 - DNA, 22 bp, Homo sapiens
ctttgccatgttgcctgcagaa

SEQ ID NO: 9478987 - DNA, 22 bp, Homo sapiens
ctttgccagagaggctggcaca

SEQ ID NO: 9478988 - DNA, 20 bp, Homo sapiens
ctttgcctattctctgcctg

SEQ ID NO: 9478989 - DNA, 20 bp, Homo sapiens
ctttgcctattctctgcctg

SEQ ID NO: 9478990 - DNA, 22 bp, Homo sapiens
ctttgcctcctagagcacgttc

SEQ ID NO: 9478991 - DNA, 18 bp, Homo sapiens
ctttgctataaattgtat

SEQ ID NO: 9478992 - DNA, 22 bp, Homo sapiens
ctttgctagtgtttcagtagac

SEQ ID NO: 9478993 - DNA, 22 bp, Homo sapiens
ctttgcttactggtgtctgcat

SEQ ID NO: 9478994 - DNA, 22 bp, Homo sapiens
ctttgcttctccaacctgctca

SEQ ID NO: 9478995 - DNA, 22 bp, Homo sapiens
ctttgcttactggtgtctgcat

SEQ ID NO: 9478996 - DNA, 22 bp, Homo sapiens
ctttgcttactggtgtctgcat

SEQ ID NO: 9478997 - DNA, 22 bp, Homo sapiens
ctttgctgttataatgatagct

SEQ ID NO: 9478998 - DNA, 22 bp, Homo sapiens
ctttgcttgacactgtgattgt

SEQ ID NO: 9478999 - DNA, 22 bp, Homo sapiens
ctttgcttgacactgtgattgt

SEQ ID NO: 9479000 - DNA, 19 bp, Homo sapiens
ctttgcttgtttctgtgtc

SEQ ID NO: 9479001 - DNA, 22 bp, Homo sapiens
ctttgctttactcccactgtgt

SEQ ID NO: 9479002 - DNA, 22 bp, Homo sapiens
ctttgcttctccaacctgctca

SEQ ID NO: 9479003 - DNA, 22 bp, Homo sapiens
ctttgcttctccaacctgctca

SEQ ID NO: 9479004 - DNA, 22 bp, Homo sapiens
ctttggaaaaatacctggcata

SEQ ID NO: 9479005 - DNA, 22 bp, Homo sapiens
ctttgctttactcccactgtgt

SEQ ID NO: 9479006 - DNA, 22 bp, Homo sapiens
ctttggaaaaatacctggcata

SEQ ID NO: 9479007 - DNA, 22 bp, Homo sapiens
ctttggctcatggttttatcca

SEQ ID NO: 9479008 - DNA, 22 bp, Homo sapiens
ctttggctacaagcgctgcaat

SEQ ID NO: 9479009 - DNA, 22 bp, Homo sapiens
ctttggctgacaggtttctggt

SEQ ID NO: 9479010 - DNA, 22 bp, Homo sapiens
ctttggctgacaggtttctggt

SEQ ID NO: 9479011 - DNA, 22 bp, Homo sapiens
ctttggctaacaaatcagcttg

SEQ ID NO: 9479012 - DNA, 22 bp, Homo sapiens
ctttggaaagtggttcaggtga

SEQ ID NO: 9479013 - DNA, 22 bp, Homo sapiens
ctttggaaagtaagcagctaga

SEQ ID NO: 9479014 - DNA, 22 bp, Homo sapiens
ctttggaaaagcataccaagga

SEQ ID NO: 9479015 - DNA, 18 bp, Homo sapiens
atctttccatagcatgtt

SEQ ID NO: 9479016 - DNA, 22 bp, Homo sapiens
atctttctatttctaaaaacta

SEQ ID NO: 9479017 - DNA, 22 bp, Homo sapiens
atctttctatggtactttctcc

SEQ ID NO: 9479018 - DNA, 22 bp, Homo sapiens
atctttctatggtactttctcc

SEQ ID NO: 9479019 - DNA, 22 bp, Homo sapiens
atctttctatggtactttctcc

SEQ ID NO: 9479020 - DNA, 22 bp, Homo sapiens
atctttctctgcactatacaat

SEQ ID NO: 9479021 - DNA, 22 bp, Homo sapiens
atctttctctgcactatacaat

SEQ ID NO: 9479022 - DNA, 22 bp, Homo sapiens
atctttcttatttgaagaaaga

SEQ ID NO: 9479023 - DNA, 22 bp, Homo sapiens
atctttctctgcactatacaat

SEQ ID NO: 9479024 - DNA, 22 bp, Homo sapiens
atctttctccatatacatcttt

SEQ ID NO: 9479025 - DNA, 22 bp, Homo sapiens
atctttctccatatacatcttt

SEQ ID NO: 9479026 - DNA, 22 bp, Homo sapiens
atctttctccatatacatcttt

SEQ ID NO: 9479027 - DNA, 22 bp, Homo sapiens
atcttgggaattttccaggagt

SEQ ID NO: 9479028 - DNA, 19 bp, Homo sapiens
atcttgggaaatggtaact

SEQ ID NO: 9479029 - DNA, 22 bp, Homo sapiens
atcttgggacatgtgctctggg

SEQ ID NO: 9479030 - DNA, 20 bp, Homo sapiens
atcttgggacagggcacatg

SEQ ID NO: 9479031 - DNA, 21 bp, Homo sapiens
atctttattacgcagagaaga

SEQ ID NO: 9479032 - DNA, 21 bp, Homo sapiens
atctttattacgcagagaaga

SEQ ID NO: 9479033 - DNA, 22 bp, Homo sapiens
atctttcagggccatttgtatt

SEQ ID NO: 9479034 - DNA, 22 bp, Homo sapiens
atctttcagtttcataccaatt

SEQ ID NO: 9479035 - DNA, 22 bp, Homo sapiens
atctttcagtttcataccaatt

SEQ ID NO: 9479036 - DNA, 22 bp, Homo sapiens
atctttcagagctccatcaggg

SEQ ID NO: 9479037 - DNA, 22 bp, Homo sapiens
atctttcactttttgtggatga

SEQ ID NO: 9479038 - DNA, 22 bp, Homo sapiens
atctttcactttttgtggatga

SEQ ID NO: 9479039 - DNA, 22 bp, Homo sapiens
atctttcaatcaggaaaaatct

SEQ ID NO: 9479040 - DNA, 22 bp, Homo sapiens
atctttcaatcaggaaaaatct

SEQ ID NO: 9479041 - DNA, 17 bp, Homo sapiens
atctggaagctagctga

SEQ ID NO: 9479042 - DNA, 22 bp, Homo sapiens
atctggaattaagagaaagtga

SEQ ID NO: 9479043 - DNA, 22 bp, Homo sapiens
atctggaattaagagaaagtga

SEQ ID NO: 9479044 - DNA, 22 bp, Homo sapiens
cttctccagccacgcccactcc

SEQ ID NO: 9479045 - DNA, 19 bp, Homo sapiens
cttctccagcttctagaag

SEQ ID NO: 9479046 - DNA, 22 bp, Homo sapiens
cttctccagccacgcccactcc

SEQ ID NO: 9479047 - DNA, 22 bp, Homo sapiens
atctggagaataaatgtccaag

SEQ ID NO: 9479048 - DNA, 22 bp, Homo sapiens
atctggagaaaccgccaaggga

SEQ ID NO: 9479049 - DNA, 22 bp, Homo sapiens
cttctccagccacgcccactcc

SEQ ID NO: 9479050 - DNA, 22 bp, Homo sapiens
cttctcctctgagtcctgggag

SEQ ID NO: 9479051 - DNA, 22 bp, Homo sapiens
cttctcctctgagtcctgggag

SEQ ID NO: 9479052 - DNA, 22 bp, Homo sapiens
cttctcctgtaagaagatcaaa

SEQ ID NO: 9479053 - DNA, 22 bp, Homo sapiens
cttctccctgggggctctttat

SEQ ID NO: 9479054 - DNA, 22 bp, Homo sapiens
cttctcctaaggtcagaattgc

SEQ ID NO: 9479055 - DNA, 18 bp, Homo sapiens
cttctcccatcttggcca

SEQ ID NO: 9479056 - DNA, 22 bp, Homo sapiens
cttctccctggcttctgcacac

SEQ ID NO: 9479057 - DNA, 22 bp, Homo sapiens
cttctccctggcttctgcacac

SEQ ID NO: 9479058 - DNA, 22 bp, Homo sapiens
cttctccctggcttctgcacac

SEQ ID NO: 9479059 - DNA, 22 bp, Homo sapiens
ctttattagatgtagactttct

SEQ ID NO: 9479060 - DNA, 22 bp, Homo sapiens
ctttattagatgtagactttct

SEQ ID NO: 9479061 - DNA, 22 bp, Homo sapiens
ctttattagatgtagactttct

SEQ ID NO: 9479062 - DNA, 22 bp, Homo sapiens
ctttattcctacaagattttct

SEQ ID NO: 9479063 - DNA, 22 bp, Homo sapiens
ctttattcctacaagattttct

SEQ ID NO: 9479064 - DNA, 22 bp, Homo sapiens
ctttattctgcaaattgccttg

SEQ ID NO: 9479065 - DNA, 22 bp, Homo sapiens
ctttattgtccttcttaggtgg

SEQ ID NO: 9479066 - DNA, 22 bp, Homo sapiens
ctttattgtccttcttaggtgg

SEQ ID NO: 9479067 - DNA, 22 bp, Homo sapiens
ctttattgtccttcttaggtgg

SEQ ID NO: 9479068 - DNA, 22 bp, Homo sapiens
ctttattagatgtagactttct

SEQ ID NO: 9479069 - DNA, 22 bp, Homo sapiens
ctttatgttggggtgtcttagt

SEQ ID NO: 9479070 - DNA, 22 bp, Homo sapiens
ctttacttgctttgttacaaaa

SEQ ID NO: 9479071 - DNA, 22 bp, Homo sapiens
ctttacttgctttgttacaaaa

SEQ ID NO: 9479072 - DNA, 22 bp, Homo sapiens
ctttatgtgtactttccatttt

SEQ ID NO: 9479073 - DNA, 22 bp, Homo sapiens
ctttacttctcaaaataaagca

SEQ ID NO: 9479074 - DNA, 22 bp, Homo sapiens
ctttactgtttggtgctctatt

SEQ ID NO: 9479075 - DNA, 22 bp, Homo sapiens
ctttactgttcttctgtgggaa

SEQ ID NO: 9479076 - DNA, 22 bp, Homo sapiens
ctttactgccatgcatttataa

SEQ ID NO: 9479077 - DNA, 22 bp, Homo sapiens
ctttactgaagtgaagacctgg

SEQ ID NO: 9479078 - DNA, 22 bp, Homo sapiens
ctttactatcaggaataaacaa

SEQ ID NO: 9479079 - DNA, 22 bp, Homo sapiens
ctttacattaatttctactgat

SEQ ID NO: 9479080 - DNA, 22 bp, Homo sapiens
ctttacataaggataaacctgg

SEQ ID NO: 9479081 - DNA, 22 bp, Homo sapiens
ctttacacttggacccacactt

SEQ ID NO: 9479082 - DNA, 22 bp, Homo sapiens
ctttacaccaagcagatctttc

SEQ ID NO: 9479083 - DNA, 22 bp, Homo sapiens
cttgttttctaaaacatcattt

SEQ ID NO: 9479084 - DNA, 22 bp, Homo sapiens
cttgttttaaactgttgtggct

SEQ ID NO: 9479085 - DNA, 22 bp, Homo sapiens
atctttgcccagagactcagcc

SEQ ID NO: 9479086 - DNA, 22 bp, Homo sapiens
atctttgctattgtaaatcacg

SEQ ID NO: 9479087 - DNA, 22 bp, Homo sapiens
atctttggaaagccaagcacag

SEQ ID NO: 9479088 - DNA, 22 bp, Homo sapiens
atctttggacggtcccaactga

SEQ ID NO: 9479089 - DNA, 22 bp, Homo sapiens
atctttgaatcaatgaatcagt

SEQ ID NO: 9479090 - DNA, 22 bp, Homo sapiens
cttgtttattatgcactgtaga

SEQ ID NO: 9479091 - DNA, 22 bp, Homo sapiens
atctttgggatatttgtgatta

SEQ ID NO: 9479092 - DNA, 22 bp, Homo sapiens
atctttggatcgctcccccttc

SEQ ID NO: 9479093 - DNA, 22 bp, Homo sapiens
atctttggccacttgtgctgca

SEQ ID NO: 9479094 - DNA, 20 bp, Homo sapiens
atctttggctcagaagcctt

SEQ ID NO: 9479095 - DNA, 22 bp, Homo sapiens
gagcacagctggaggtagcatt

SEQ ID NO: 9479096 - DNA, 22 bp, Homo sapiens
gagcacagctggaggtagcatt

SEQ ID NO: 9479097 - DNA, 22 bp, Homo sapiens
gagcacagctggaggtagcatt

SEQ ID NO: 9479098 - DNA, 22 bp, Homo sapiens
gagcacaggctgctgtgaactg

SEQ ID NO: 9479099 - DNA, 22 bp, Homo sapiens
gagcacaggctgctgtgaactg

SEQ ID NO: 9479100 - DNA, 22 bp, Homo sapiens
gagcacaggctgctgtgaactg

SEQ ID NO: 9479101 - DNA, 22 bp, Homo sapiens
gagcacagcagggctctgggtg

SEQ ID NO: 9479102 - DNA, 19 bp, Homo sapiens
gagcacagcggcatttggt

SEQ ID NO: 9479103 - DNA, 22 bp, Homo sapiens
gagcacagcgcagtttgtaatt

SEQ ID NO: 9479104 - DNA, 22 bp, Homo sapiens
gagcacaggctttggtggacac

SEQ ID NO: 9479105 - DNA, 22 bp, Homo sapiens
gagcacaggctttggtggacac

SEQ ID NO: 9479106 - DNA, 22 bp, Homo sapiens
gagcacaggctttggtggacac

SEQ ID NO: 9479107 - DNA, 22 bp, Homo sapiens
gagcacaggctttggtggacac

SEQ ID NO: 9479108 - DNA, 22 bp, Homo sapiens
atgggaggaagagaagatgtct

SEQ ID NO: 9479109 - DNA, 22 bp, Homo sapiens
atgggaggaagagaagatgtct

SEQ ID NO: 9479110 - DNA, 22 bp, Homo sapiens
gagcacagggaatagacagata

SEQ ID NO: 9479111 - DNA, 22 bp, Homo sapiens
atgggagtccaacatcaaggac

SEQ ID NO: 9479112 - DNA, 22 bp, Homo sapiens
atgggagggtggaaaggctctg

SEQ ID NO: 9479113 - DNA, 22 bp, Homo sapiens
atgggagtgtgcttgaggagtt

SEQ ID NO: 9479114 - DNA, 22 bp, Homo sapiens
atgggagtgtgcttgaggagtt

SEQ ID NO: 9479115 - DNA, 22 bp, Homo sapiens
atgggagggtggaaaggctctg

SEQ ID NO: 9479116 - DNA, 22 bp, Homo sapiens
atggctgcagagacctgaagaa

SEQ ID NO: 9479117 - DNA, 22 bp, Homo sapiens
atggctgcagccggccctgcgc

SEQ ID NO: 9479118 - DNA, 22 bp, Homo sapiens
atggctgcagtccgtgccctgg

SEQ ID NO: 9479119 - DNA, 22 bp, Homo sapiens
atggctctcttgacctaggcac

SEQ ID NO: 9479120 - DNA, 22 bp, Homo sapiens
atggctctgagaacctgagcta

SEQ ID NO: 9479121 - DNA, 20 bp, Homo sapiens
atggctctgtttggcagtga

SEQ ID NO: 9479122 - DNA, 20 bp, Homo sapiens
atggctctgtttggcagtga

SEQ ID NO: 9479123 - DNA, 19 bp, Homo sapiens
atggctctgggatcactgc

SEQ ID NO: 9479124 - DNA, 22 bp, Homo sapiens
atggccctgtttatggtaaggc

SEQ ID NO: 9479125 - DNA, 22 bp, Homo sapiens
atggcagagggattgaacagct

SEQ ID NO: 9479126 - DNA, 22 bp, Homo sapiens
atggccctttattccttcttcc

SEQ ID NO: 9479127 - DNA, 22 bp, Homo sapiens
atggcagagaacaaagcaacaa

SEQ ID NO: 9479128 - DNA, 22 bp, Homo sapiens
atggcagacctgggctggagaa

SEQ ID NO: 9479129 - DNA, 22 bp, Homo sapiens
atggcagacctgggctggagaa

SEQ ID NO: 9479130 - DNA, 22 bp, Homo sapiens
atggcagacgaggcagcagggg

SEQ ID NO: 9479131 - DNA, 22 bp, Homo sapiens
atggcagacgaggcagcagggg

SEQ ID NO: 9479132 - DNA, 22 bp, Homo sapiens
atggcagacgaggcagcagggg

SEQ ID NO: 9479133 - DNA, 22 bp, Homo sapiens
atggctctagaatacccctcag

SEQ ID NO: 9479134 - DNA, 22 bp, Homo sapiens
atggctctaggttgggcagttt

SEQ ID NO: 9479135 - DNA, 22 bp, Homo sapiens
atggctcatttatcttgcagcc

SEQ ID NO: 9479136 - DNA, 22 bp, Homo sapiens
atggctcatttatcttgcagcc

SEQ ID NO: 9479137 - DNA, 21 bp, Homo sapiens
atggctcaggccatcaatgga

SEQ ID NO: 9479138 - DNA, 22 bp, Homo sapiens
atggccgcctgtccttcccgcc

SEQ ID NO: 9479139 - DNA, 21 bp, Homo sapiens
atggctcaggccatcaatgga

SEQ ID NO: 9479140 - DNA, 21 bp, Homo sapiens
atggctcaggccatcaatgga

SEQ ID NO: 9479141 - DNA, 21 bp, Homo sapiens
atgggcagaggcagagaggct

SEQ ID NO: 9479142 - DNA, 21 bp, Homo sapiens
atgggcagaggcagagaggct

SEQ ID NO: 9479143 - DNA, 22 bp, Homo sapiens
atgggcagagctggtgggaggc

SEQ ID NO: 9479144 - DNA, 22 bp, Homo sapiens
atgggcagagctggtgggaggc

SEQ ID NO: 9479145 - DNA, 22 bp, Homo sapiens
atgggcagagctggtgggaggc

SEQ ID NO: 9479146 - DNA, 22 bp, Homo sapiens
atgggcagagctggtgggaggc

SEQ ID NO: 9479147 - DNA, 22 bp, Homo sapiens
gagcccagtctgctcctgcgcc

SEQ ID NO: 9479148 - DNA, 22 bp, Homo sapiens
gagcccagtctgctcctgcgcc

SEQ ID NO: 9479149 - DNA, 22 bp, Homo sapiens
atgggatcttgccctgagggct

SEQ ID NO: 9479150 - DNA, 22 bp, Homo sapiens
atgggatgaacttgatctgctt

SEQ ID NO: 9479151 - DNA, 22 bp, Homo sapiens
atgggatgcatggctgtggcca

SEQ ID NO: 9479152 - DNA, 22 bp, Homo sapiens
atgggatgaacttgatctgctt

SEQ ID NO: 9479153 - DNA, 22 bp, Homo sapiens
atgggatgatcacctgagctca

SEQ ID NO: 9479154 - DNA, 22 bp, Homo sapiens
atgggatgcatggctgtggcca

SEQ ID NO: 9479155 - DNA, 22 bp, Homo sapiens
atgggcagacagggagctcacg

SEQ ID NO: 9479156 - DNA, 22 bp, Homo sapiens
atgggcagacagggagctcacg

SEQ ID NO: 9479157 - DNA, 22 bp, Homo sapiens
gagccctcaccgcctgaccagg

SEQ ID NO: 9479158 - DNA, 22 bp, Homo sapiens
gagccctcaatgaatctgcatt

SEQ ID NO: 9479159 - DNA, 22 bp, Homo sapiens
gagccctcaatgaatctgcatt

SEQ ID NO: 9479160 - DNA, 22 bp, Homo sapiens
gagccctcattgaatctgcatt

SEQ ID NO: 9479161 - DNA, 22 bp, Homo sapiens
gagccctcattgaatctgcatt

SEQ ID NO: 9479162 - DNA, 22 bp, Homo sapiens
gagccctccatggagccaggca

SEQ ID NO: 9479163 - DNA, 22 bp, Homo sapiens
gagccctccatggagccaggca

SEQ ID NO: 9479164 - DNA, 22 bp, Homo sapiens
gagccctcgggcgagcccgcgc

SEQ ID NO: 9479165 - DNA, 22 bp, Homo sapiens
gagccctctctgtaggcaagta

SEQ ID NO: 9479166 - DNA, 19 bp, Homo sapiens
gagccctctccatggccac

SEQ ID NO: 9479167 - DNA, 22 bp, Homo sapiens
gagcccgagcgcgtacccggcg

SEQ ID NO: 9479168 - DNA, 22 bp, Homo sapiens
gagccccttctgcagtcaggtt

SEQ ID NO: 9479169 - DNA, 22 bp, Homo sapiens
gagccccaggacagctctagtt

SEQ ID NO: 9479170 - DNA, 22 bp, Homo sapiens
gagccccaggacagctctagtt

SEQ ID NO: 9479171 - DNA, 22 bp, Homo sapiens
gagccccagccctgcttctata

SEQ ID NO: 9479172 - DNA, 22 bp, Homo sapiens
gagccccaggacagctctagtt

SEQ ID NO: 9479173 - DNA, 17 bp, Homo sapiens
gagctctgtggcacaag

SEQ ID NO: 9479174 - DNA, 22 bp, Homo sapiens
gagccctctctgtaggcaagta

SEQ ID NO: 9479175 - DNA, 22 bp, Homo sapiens
gagccctctctgtaggcaagta

SEQ ID NO: 9479176 - DNA, 22 bp, Homo sapiens
gagctgcagagctcgaaggaac

SEQ ID NO: 9479177 - DNA, 22 bp, Homo sapiens
gagctgcagagctcgaaggaac

SEQ ID NO: 9479178 - DNA, 22 bp, Homo sapiens
gagctgcagacttgatacagga

SEQ ID NO: 9479179 - DNA, 22 bp, Homo sapiens
gagctgcagacatagataagcg

SEQ ID NO: 9479180 - DNA, 22 bp, Homo sapiens
gagctgcagacatagataagcg

SEQ ID NO: 9479181 - DNA, 22 bp, Homo sapiens
gagctgcactgggggtggaatg

SEQ ID NO: 9479182 - DNA, 22 bp, Homo sapiens
gagctgcagaaggggttttcct

SEQ ID NO: 9479183 - DNA, 22 bp, Homo sapiens
gagctgcacatctgaggctaat

SEQ ID NO: 9479184 - DNA, 22 bp, Homo sapiens
gagctgcacgcagcatccaaga

SEQ ID NO: 9479185 - DNA, 21 bp, Homo sapiens
gagctgcaccttgacctgttt

SEQ ID NO: 9479186 - DNA, 22 bp, Homo sapiens
gagctgcacgcagcatccaaga

SEQ ID NO: 9479187 - DNA, 21 bp, Homo sapiens
gagctgcaccttgacctgttt

SEQ ID NO: 9479188 - DNA, 22 bp, Homo sapiens
gagctgcacatctgaggctaat

SEQ ID NO: 9479189 - DNA, 22 bp, Homo sapiens
gagctgcacatctgaggctaat

SEQ ID NO: 9479190 - DNA, 22 bp, Homo sapiens
gagctgagttacctccagatca

SEQ ID NO: 9479191 - DNA, 22 bp, Homo sapiens
gagctgagttacctccagatca

SEQ ID NO: 9479192 - DNA, 20 bp, Homo sapiens
gagctgagtgtggtcatggg

SEQ ID NO: 9479193 - DNA, 22 bp, Homo sapiens
gagctgagttacctccagatca

SEQ ID NO: 9479194 - DNA, 22 bp, Homo sapiens
gagctgcagcggctgacgcaac

SEQ ID NO: 9479195 - DNA, 22 bp, Homo sapiens
gagctgcagagtaacctttgca

SEQ ID NO: 9479196 - DNA, 22 bp, Homo sapiens
gagctgcagagtaacctttgca

SEQ ID NO: 9479197 - DNA, 22 bp, Homo sapiens
gagctgcagcggctgacgcaac

SEQ ID NO: 9479198 - DNA, 22 bp, Homo sapiens
gagctgcagcggctgacgcaac

SEQ ID NO: 9479199 - DNA, 22 bp, Homo sapiens
gagctgcatgcaactgtttaaa

SEQ ID NO: 9479200 - DNA, 22 bp, Homo sapiens
gagctgcatgcaactcgaaaat

SEQ ID NO: 9479201 - DNA, 22 bp, Homo sapiens
gagctgcatagctgggatcctc

SEQ ID NO: 9479202 - DNA, 22 bp, Homo sapiens
gagctgccaagattacaatcag

SEQ ID NO: 9479203 - DNA, 22 bp, Homo sapiens
gagctgcatgcggaaacctgtt

SEQ ID NO: 9479204 - DNA, 22 bp, Homo sapiens
gagctgcatgcggaaacctgtt

SEQ ID NO: 9479205 - DNA, 22 bp, Homo sapiens
gagctgcatgcaactgtttaaa

SEQ ID NO: 9479206 - DNA, 22 bp, Homo sapiens
gagctgccagacatgggaatga

SEQ ID NO: 9479207 - DNA, 22 bp, Homo sapiens
atgggcagagtggggacaggaa

SEQ ID NO: 9479208 - DNA, 22 bp, Homo sapiens
atgggcagagtggggacaggaa

SEQ ID NO: 9479209 - DNA, 21 bp, Homo sapiens
atgggcagaggcagagaggct

SEQ ID NO: 9479210 - DNA, 22 bp, Homo sapiens
gagctgccctgagctttgcatg

SEQ ID NO: 9479211 - DNA, 21 bp, Homo sapiens
atgggcagaggcagagaggct

SEQ ID NO: 9479212 - DNA, 22 bp, Homo sapiens
gagctgccctgagctttgcatg

SEQ ID NO: 9479213 - DNA, 22 bp, Homo sapiens
gagctgccagtgtatgaattct

SEQ ID NO: 9479214 - DNA, 22 bp, Homo sapiens
atggatctgtatccaaaaatac

SEQ ID NO: 9479215 - DNA, 22 bp, Homo sapiens
atggatctaccttcaggctctg

SEQ ID NO: 9479216 - DNA, 22 bp, Homo sapiens
atggatctcagccaaccagtgt

SEQ ID NO: 9479217 - DNA, 22 bp, Homo sapiens
atggatagtggtgaaggctgta

SEQ ID NO: 9479218 - DNA, 22 bp, Homo sapiens
atggagggtgtcagagagcgaa

SEQ ID NO: 9479219 - DNA, 22 bp, Homo sapiens
atggataatgtctctgtttccc

SEQ ID NO: 9479220 - DNA, 22 bp, Homo sapiens
atggataatggtgatagttgca

SEQ ID NO: 9479221 - DNA, 22 bp, Homo sapiens
gagacaggcagctagtgggtca

SEQ ID NO: 9479222 - DNA, 22 bp, Homo sapiens
gagacaggcagctagtgggtca

SEQ ID NO: 9479223 - DNA, 22 bp, Homo sapiens
gagacaggccaggtggtactta

SEQ ID NO: 9479224 - DNA, 22 bp, Homo sapiens
gagacaggccaggtggtactta

SEQ ID NO: 9479225 - DNA, 22 bp, Homo sapiens
gagacaggcagctagtgggtca

SEQ ID NO: 9479226 - DNA, 21 bp, Homo sapiens
gagaatcaggaaggattgatg

SEQ ID NO: 9479227 - DNA, 21 bp, Homo sapiens
gagaatcaggaaggattgatg

SEQ ID NO: 9479228 - DNA, 22 bp, Homo sapiens
gagaatcatggcaacagaatga

SEQ ID NO: 9479229 - DNA, 22 bp, Homo sapiens
gagaatcatttacagaatgatt

SEQ ID NO: 9479230 - DNA, 22 bp, Homo sapiens
gagaatcatttacagaatgatt

SEQ ID NO: 9479231 - DNA, 20 bp, Homo sapiens
gagacagcaaaagcctctcc

SEQ ID NO: 9479232 - DNA, 22 bp, Homo sapiens
gagacaggatttaaccaaagct

SEQ ID NO: 9479233 - DNA, 22 bp, Homo sapiens
gagacaggatttaaccaaagct

SEQ ID NO: 9479234 - DNA, 21 bp, Homo sapiens
gagacagcccagtgccagggc

SEQ ID NO: 9479235 - DNA, 22 bp, Homo sapiens
gagacagcctactccagtctca

SEQ ID NO: 9479236 - DNA, 17 bp, Homo sapiens
gagacagcaggagcccc

SEQ ID NO: 9479237 - DNA, 22 bp, Homo sapiens
gagacagcacaggccactggga

SEQ ID NO: 9479238 - DNA, 22 bp, Homo sapiens
gagacagcacaggccactggga

SEQ ID NO: 9479239 - DNA, 22 bp, Homo sapiens
gagacagcagggccagggcctg

SEQ ID NO: 9479240 - DNA, 22 bp, Homo sapiens
atggcagaaagaatagaggcta

SEQ ID NO: 9479241 - DNA, 22 bp, Homo sapiens
atggcactaagagggagctgga

SEQ ID NO: 9479242 - DNA, 22 bp, Homo sapiens
atggcagaaaggcatgtgggcc

SEQ ID NO: 9479243 - DNA, 22 bp, Homo sapiens
atggcagaagtcaagatgagtt

SEQ ID NO: 9479244 - DNA, 22 bp, Homo sapiens
atggcaccttccccagagctca

SEQ ID NO: 9479245 - DNA, 22 bp, Homo sapiens
atggcagacacaggcaggcaga

SEQ ID NO: 9479246 - DNA, 22 bp, Homo sapiens
atggcagacacaggcaggcaga

SEQ ID NO: 9479247 - DNA, 22 bp, Homo sapiens
atggcagacacaggcaggcaga

SEQ ID NO: 9479248 - DNA, 22 bp, Homo sapiens
atggcagacctgggctggagaa

SEQ ID NO: 9479249 - DNA, 22 bp, Homo sapiens
atggcagaatatctgcatcgca

SEQ ID NO: 9479250 - DNA, 22 bp, Homo sapiens
atggcagaatccatagtaggtg

SEQ ID NO: 9479251 - DNA, 22 bp, Homo sapiens
atggcagacacaggcaggcaga

SEQ ID NO: 9479252 - DNA, 22 bp, Homo sapiens
atggcagaattaggatttcaag

SEQ ID NO: 9479253 - DNA, 22 bp, Homo sapiens
atggcaagcaagctgaagagat

SEQ ID NO: 9479254 - DNA, 22 bp, Homo sapiens
atggcaaaaattaacagatcaa

SEQ ID NO: 9479255 - DNA, 22 bp, Homo sapiens
atggcaaaaattaacagatcaa

SEQ ID NO: 9479256 - DNA, 22 bp, Homo sapiens
atggcaaaaactgcagttacct

SEQ ID NO: 9479257 - DNA, 22 bp, Homo sapiens
atggcacacaggtctgcaaggg

SEQ ID NO: 9479258 - DNA, 22 bp, Homo sapiens
atggatcttccctcatttctga

SEQ ID NO: 9479259 - DNA, 22 bp, Homo sapiens
atggatgcttctttctagtttt

SEQ ID NO: 9479260 - DNA, 19 bp, Homo sapiens
atggatgcctcatgcctca

SEQ ID NO: 9479261 - DNA, 22 bp, Homo sapiens
atggatttggatgagattactt

SEQ ID NO: 9479262 - DNA, 21 bp, Homo sapiens
atggatttaaacaggccacaa

SEQ ID NO: 9479263 - DNA, 22 bp, Homo sapiens
atgctgtggccagagttcaact

SEQ ID NO: 9479264 - DNA, 22 bp, Homo sapiens
atgctgtcagtattatgtgcag

SEQ ID NO: 9479265 - DNA, 22 bp, Homo sapiens
atgctgtccactcttggtgttt

SEQ ID NO: 9479266 - DNA, 22 bp, Homo sapiens
atgctgtcgaaaccaaacatct

SEQ ID NO: 9479267 - DNA, 22 bp, Homo sapiens
atgctggtgctagaaactggaa

SEQ ID NO: 9479268 - DNA, 22 bp, Homo sapiens
atgctggggcctcagaccagaa

SEQ ID NO: 9479269 - DNA, 22 bp, Homo sapiens
atgctggtaagttgcaaatgtt

SEQ ID NO: 9479270 - DNA, 22 bp, Homo sapiens
atgctggggcctcagaccagaa

SEQ ID NO: 9479271 - DNA, 22 bp, Homo sapiens
atgctgggaagacaaggtggag

SEQ ID NO: 9479272 - DNA, 22 bp, Homo sapiens
atgctgggaagtcctaaccaca

SEQ ID NO: 9479273 - DNA, 22 bp, Homo sapiens
atgctgggaaactgaaaggaat

SEQ ID NO: 9479274 - DNA, 22 bp, Homo sapiens
atgctgggaagacaaggtggag

SEQ ID NO: 9479275 - DNA, 22 bp, Homo sapiens
atgctggattgagagcaagggg

SEQ ID NO: 9479276 - DNA, 22 bp, Homo sapiens
atgctggcagccgagtgctcca

SEQ ID NO: 9479277 - DNA, 16 bp, Homo sapiens
atgctgctattagagg

SEQ ID NO: 9479278 - DNA, 22 bp, Homo sapiens
atgctgtgtcctagtgaaagaa

SEQ ID NO: 9479279 - DNA, 22 bp, Homo sapiens
atgctgttaagataatgggttc

SEQ ID NO: 9479280 - DNA, 22 bp, Homo sapiens
atgctgttattctaatgtgtga

SEQ ID NO: 9479281 - DNA, 22 bp, Homo sapiens
atgcttaactctgtacatagtt

SEQ ID NO: 9479282 - DNA, 22 bp, Homo sapiens
atgcttaaccttggtgtacaat

SEQ ID NO: 9479283 - DNA, 22 bp, Homo sapiens
atgcttaactctgtacatagtt

SEQ ID NO: 9479284 - DNA, 23 bp, Homo sapiens
gagaacagccacagagagctgtg

SEQ ID NO: 9479285 - DNA, 23 bp, Homo sapiens
gagaacagccacagagagctgtg

SEQ ID NO: 9479286 - DNA, 23 bp, Homo sapiens
gagaacagccacagagagctgtg

SEQ ID NO: 9479287 - DNA, 22 bp, Homo sapiens
atgcttaacttcctagtctata

SEQ ID NO: 9479288 - DNA, 22 bp, Homo sapiens
gagaagttgtgtggatttaaag

SEQ ID NO: 9479289 - DNA, 22 bp, Homo sapiens
gagaagtttctggtttgcatag

SEQ ID NO: 9479290 - DNA, 22 bp, Homo sapiens
gagaataaatctaaagtttctt

SEQ ID NO: 9479291 - DNA, 22 bp, Homo sapiens
gagaataaatctaaagtttctt

SEQ ID NO: 9479292 - DNA, 22 bp, Homo sapiens
gagaaggtggacctgaaggagc

SEQ ID NO: 9479293 - DNA, 22 bp, Homo sapiens
gagaaggggtgatgtgggtaat

SEQ ID NO: 9479294 - DNA, 22 bp, Homo sapiens
gagaaggggtgatgtgggtaat

SEQ ID NO: 9479295 - DNA, 22 bp, Homo sapiens
gagaacaggctctggagtcaga

SEQ ID NO: 9479296 - DNA, 22 bp, Homo sapiens
gagaagttcattactctgccca

SEQ ID NO: 9479297 - DNA, 22 bp, Homo sapiens
gagaaggtggatttcgtatccc

SEQ ID NO: 9479298 - DNA, 22 bp, Homo sapiens
gaggctcttcaataggtcaatg

SEQ ID NO: 9479299 - DNA, 22 bp, Homo sapiens
gaggctcctcattcagtatgct

SEQ ID NO: 9479300 - DNA, 22 bp, Homo sapiens
gaggctcctccttacatttacc

SEQ ID NO: 9479301 - DNA, 22 bp, Homo sapiens
gaggctccttgaaagggggact

SEQ ID NO: 9479302 - DNA, 22 bp, Homo sapiens
gaggctctggagtaggtacaca

SEQ ID NO: 9479303 - DNA, 22 bp, Homo sapiens
gaggctccggtagtagccttga

SEQ ID NO: 9479304 - DNA, 22 bp, Homo sapiens
gaggctccgtgctgctgccctg

SEQ ID NO: 9479305 - DNA, 22 bp, Homo sapiens
gaggctccctttaggtccagat

SEQ ID NO: 9479306 - DNA, 22 bp, Homo sapiens
gaggctccctttaggtccagat

SEQ ID NO: 9479307 - DNA, 22 bp, Homo sapiens
gaggctcccaaggggctaggcc

SEQ ID NO: 9479308 - DNA, 22 bp, Homo sapiens
gaggctcccaaggggctaggcc

SEQ ID NO: 9479309 - DNA, 22 bp, Homo sapiens
gaggctccctcaactctgggtg

SEQ ID NO: 9479310 - DNA, 22 bp, Homo sapiens
gaggctccctcaactctgggtg

SEQ ID NO: 9479311 - DNA, 22 bp, Homo sapiens
gaggctccccatgaggccccag

SEQ ID NO: 9479312 - DNA, 23 bp, Homo sapiens
atgtatttaaatttcagtgatga

SEQ ID NO: 9479313 - DNA, 23 bp, Homo sapiens
atgtatttaaatttcagtgatga

SEQ ID NO: 9479314 - DNA, 22 bp, Homo sapiens
atgtattgtctcttttccttaa

SEQ ID NO: 9479315 - DNA, 22 bp, Homo sapiens
atgtatttactgagaaggaaac

SEQ ID NO: 9479316 - DNA, 23 bp, Homo sapiens
atgtatttaaatttcagtgatga

SEQ ID NO: 9479317 - DNA, 23 bp, Homo sapiens
atgtatttaaatttcagtgatga

SEQ ID NO: 9479318 - DNA, 22 bp, Homo sapiens
atgtatttactgagaaggaaac

SEQ ID NO: 9479319 - DNA, 22 bp, Homo sapiens
atgtatttactgagaaggaaac

SEQ ID NO: 9479320 - DNA, 22 bp, Homo sapiens
gaggcctgggttggaggtgcat

SEQ ID NO: 9479321 - DNA, 22 bp, Homo sapiens
gaggcctgggttacctactcgt

SEQ ID NO: 9479322 - DNA, 22 bp, Homo sapiens
atgtatttctatgtagtgaaga

SEQ ID NO: 9479323 - DNA, 22 bp, Homo sapiens
gaggctccagcgacacctaggc

SEQ ID NO: 9479324 - DNA, 22 bp, Homo sapiens
gaggctccatggaggagtatgg

SEQ ID NO: 9479325 - DNA, 22 bp, Homo sapiens
gaggctccagcgacacctaggc

SEQ ID NO: 9479326 - DNA, 22 bp, Homo sapiens
gaggcctgggttggaggtgcat

SEQ ID NO: 9479327 - DNA, 22 bp, Homo sapiens
atgtatgtgttgcaattatgtt

SEQ ID NO: 9479328 - DNA, 22 bp, Homo sapiens
atgtatgttagtgtattatcta

SEQ ID NO: 9479329 - DNA, 22 bp, Homo sapiens
atgtatgtctgatgcacatgca

SEQ ID NO: 9479330 - DNA, 22 bp, Homo sapiens
atgtatgtgagctttgagatca

SEQ ID NO: 9479331 - DNA, 22 bp, Homo sapiens
atgtatgtctgcatacacatac

SEQ ID NO: 9479332 - DNA, 22 bp, Homo sapiens
atgtatgttcaagcaatgatta

SEQ ID NO: 9479333 - DNA, 22 bp, Homo sapiens
atgtatgttcaagcaatgatta

SEQ ID NO: 9479334 - DNA, 22 bp, Homo sapiens
atgtatgttcaagcaatgatta

SEQ ID NO: 9479335 - DNA, 22 bp, Homo sapiens
atgtatgtttcatatcttcatt

SEQ ID NO: 9479336 - DNA, 22 bp, Homo sapiens
atgtatgtttctatatatgaca

SEQ ID NO: 9479337 - DNA, 22 bp, Homo sapiens
atgtatgtttctatatatgaca

SEQ ID NO: 9479338 - DNA, 23 bp, Homo sapiens
atgtatgtttctgcatcttcaac

SEQ ID NO: 9479339 - DNA, 22 bp, Homo sapiens
atgtatgtttttgcagatacat

SEQ ID NO: 9479340 - DNA, 22 bp, Homo sapiens
atgtattcaagccacatacatt

SEQ ID NO: 9479341 - DNA, 22 bp, Homo sapiens
atgtattcaagccacatacatt

SEQ ID NO: 9479342 - DNA, 22 bp, Homo sapiens
atgtattcaagccacatacatt

SEQ ID NO: 9479343 - DNA, 22 bp, Homo sapiens
atgtatgtatacaccccacata

SEQ ID NO: 9479344 - DNA, 22 bp, Homo sapiens
atgtatgtatgtacttttgtat

SEQ ID NO: 9479345 - DNA, 20 bp, Homo sapiens
atgtatgcaaatgtcttcca

SEQ ID NO: 9479346 - DNA, 22 bp, Homo sapiens
atgtatggggtgtatgggatca

SEQ ID NO: 9479347 - DNA, 22 bp, Homo sapiens
atgtatcagaaatagcattggc

SEQ ID NO: 9479348 - DNA, 22 bp, Homo sapiens
atgtatcagataaagcatgtgg

SEQ ID NO: 9479349 - DNA, 22 bp, Homo sapiens
atgtatcagaaatagcattggc

SEQ ID NO: 9479350 - DNA, 22 bp, Homo sapiens
atgtatcacagcaatgtagtca

SEQ ID NO: 9479351 - DNA, 22 bp, Homo sapiens
atgtatcacagcaatgtagtca

SEQ ID NO: 9479352 - DNA, 22 bp, Homo sapiens
atgtatcagataaagcatgtgg

SEQ ID NO: 9479353 - DNA, 22 bp, Homo sapiens
atgtatcagataaagcatgtgg

SEQ ID NO: 9479354 - DNA, 23 bp, Homo sapiens
atgtatctcatccaaggaagctc

SEQ ID NO: 9479355 - DNA, 23 bp, Homo sapiens
atgtatctcatccaaggaagctc

SEQ ID NO: 9479356 - DNA, 22 bp, Homo sapiens
gaggcacagtcccgaggcaagg

SEQ ID NO: 9479357 - DNA, 22 bp, Homo sapiens
gaggcacagagtaggtgcacac

SEQ ID NO: 9479358 - DNA, 22 bp, Homo sapiens
gaggcacagtgtttggtcagtg

SEQ ID NO: 9479359 - DNA, 22 bp, Homo sapiens
gaggcacagttcttcctccaga

SEQ ID NO: 9479360 - DNA, 18 bp, Homo sapiens
gaggcacatagttggggc

SEQ ID NO: 9479361 - DNA, 20 bp, Homo sapiens
atgtatattactggctgtga

SEQ ID NO: 9479362 - DNA, 22 bp, Homo sapiens
atgtatcaactgcaggcaagtt

SEQ ID NO: 9479363 - DNA, 22 bp, Homo sapiens
atgtatcaattatctgtctgca

SEQ ID NO: 9479364 - DNA, 22 bp, Homo sapiens
gaggcacatatatacagagccc

SEQ ID NO: 9479365 - DNA, 22 bp, Homo sapiens
gaggcacatatatacagagccc

SEQ ID NO: 9479366 - DNA, 22 bp, Homo sapiens
atgtagctgcagatgataatgc

SEQ ID NO: 9479367 - DNA, 21 bp, Homo sapiens
atgtagcttacaagataaagg

SEQ ID NO: 9479368 - DNA, 22 bp, Homo sapiens
gaggcacagagtaggtgcacac

SEQ ID NO: 9479369 - DNA, 22 bp, Homo sapiens
gaggcacagagccctaggagct

SEQ ID NO: 9479370 - DNA, 22 bp, Homo sapiens
gaggcacagagccctaggagct

SEQ ID NO: 9479371 - DNA, 22 bp, Homo sapiens
gaggcacagagccctaggagct

SEQ ID NO: 9479372 - DNA, 22 bp, Homo sapiens
gaggcacagagccctaggagct

SEQ ID NO: 9479373 - DNA, 22 bp, Homo sapiens
gaggcacaccagggagtcttgt

SEQ ID NO: 9479374 - DNA, 22 bp, Homo sapiens
gaggaggggacagtacttgtgc

SEQ ID NO: 9479375 - DNA, 22 bp, Homo sapiens
gaggaggggcacttgtctccta

SEQ ID NO: 9479376 - DNA, 22 bp, Homo sapiens
gaggaggggcacttgtctccta

SEQ ID NO: 9479377 - DNA, 22 bp, Homo sapiens
gaggaggggcacttgtctccta

SEQ ID NO: 9479378 - DNA, 22 bp, Homo sapiens
gaggaggggcacttgtctccta

SEQ ID NO: 9479379 - DNA, 23 bp, Homo sapiens
gaggagggtcgtgctgtgttcct

SEQ ID NO: 9479380 - DNA, 22 bp, Homo sapiens
gaggagctgggtcagggagaca

SEQ ID NO: 9479381 - DNA, 22 bp, Homo sapiens
atgggcagctgcagcagtggtg

SEQ ID NO: 9479382 - DNA, 22 bp, Homo sapiens
atgggcagctgcagcagtggtg

SEQ ID NO: 9479383 - DNA, 22 bp, Homo sapiens
atgggcagctgcagcagtggtg

SEQ ID NO: 9479384 - DNA, 22 bp, Homo sapiens
atgggcaggcaaggtggcgagt

SEQ ID NO: 9479385 - DNA, 22 bp, Homo sapiens
atgggcaggcaaggtggcgagt

SEQ ID NO: 9479386 - DNA, 22 bp, Homo sapiens
atgggcagcagctgccattcat

SEQ ID NO: 9479387 - DNA, 22 bp, Homo sapiens
atgggcagagtggggacaggaa

SEQ ID NO: 9479388 - DNA, 22 bp, Homo sapiens
atgggcagagtggggacaggaa

SEQ ID NO: 9479389 - DNA, 22 bp, Homo sapiens
atgggcagagtggggacaggaa

SEQ ID NO: 9479390 - DNA, 22 bp, Homo sapiens
atgggcagctgcagcagtggtg

SEQ ID NO: 9479391 - DNA, 22 bp, Homo sapiens
atgggcagctgcagcagtggtg

SEQ ID NO: 9479392 - DNA, 22 bp, Homo sapiens
atgggcagctgcagcagtggtg

SEQ ID NO: 9479393 - DNA, 22 bp, Homo sapiens
gaggagggcctggtgtcccttc

SEQ ID NO: 9479394 - DNA, 22 bp, Homo sapiens
gaggagggcctggtgtcccttc

SEQ ID NO: 9479395 - DNA, 22 bp, Homo sapiens
gaggagggcctggtgtcccttc

SEQ ID NO: 9479396 - DNA, 22 bp, Homo sapiens
gaggagggcagttcctctttta

SEQ ID NO: 9479397 - DNA, 22 bp, Homo sapiens
gaggagggcagttcctctttta

SEQ ID NO: 9479398 - DNA, 22 bp, Homo sapiens
gaggagggcagttcctctttta

SEQ ID NO: 9479399 - DNA, 22 bp, Homo sapiens
gaggagggagctggaagctctt

SEQ ID NO: 9479400 - DNA, 22 bp, Homo sapiens
gaggagggagctggaagctctt

SEQ ID NO: 9479401 - DNA, 22 bp, Homo sapiens
gaggagggagctggaagctctt

SEQ ID NO: 9479402 - DNA, 22 bp, Homo sapiens
gaggagggagctggaagctctt

SEQ ID NO: 9479403 - DNA, 22 bp, Homo sapiens
gaggagggagctggaagctctt

SEQ ID NO: 9479404 - DNA, 22 bp, Homo sapiens
gaggttccccattgtactggct

SEQ ID NO: 9479405 - DNA, 22 bp, Homo sapiens
gaggttccccattgtactggct

SEQ ID NO: 9479406 - DNA, 22 bp, Homo sapiens
gaggttccagacagcttaggga

SEQ ID NO: 9479407 - DNA, 22 bp, Homo sapiens
gaggttgccatgcatcctggtt

SEQ ID NO: 9479408 - DNA, 22 bp, Homo sapiens
gaggttctgggggtctgcctgg

SEQ ID NO: 9479409 - DNA, 22 bp, Homo sapiens
gaggttggagggctggcctgca

SEQ ID NO: 9479410 - DNA, 22 bp, Homo sapiens
gaggttggcgccctgcctggcc

SEQ ID NO: 9479411 - DNA, 22 bp, Homo sapiens
gaggttggcgccctgcctggcc

SEQ ID NO: 9479412 - DNA, 22 bp, Homo sapiens
gaggttgggaagtccaagctgg

SEQ ID NO: 9479413 - DNA, 22 bp, Homo sapiens
gaggttgggaagtccaagctgg

SEQ ID NO: 9479414 - DNA, 22 bp, Homo sapiens
gagtgggcaccgtgggcacact

SEQ ID NO: 9479415 - DNA, 22 bp, Homo sapiens
gagtgcagtatcttctgtgtcc

SEQ ID NO: 9479416 - DNA, 21 bp, Homo sapiens
gagtgcaggtctgatgccatc

SEQ ID NO: 9479417 - DNA, 21 bp, Homo sapiens
gagtgcaggtctgatgccatc

SEQ ID NO: 9479418 - DNA, 22 bp, Homo sapiens
atgttatgacaagcatgacaga

SEQ ID NO: 9479419 - DNA, 22 bp, Homo sapiens
atgttatggctcaaacatttgg

SEQ ID NO: 9479420 - DNA, 22 bp, Homo sapiens
atgttatgacaagcatgacaga

SEQ ID NO: 9479421 - DNA, 22 bp, Homo sapiens
atgttatagttataaaatgagg

SEQ ID NO: 9479422 - DNA, 22 bp, Homo sapiens
atgttagttttatatttgtggg

SEQ ID NO: 9479423 - DNA, 22 bp, Homo sapiens
atgttagtgtcactttgtacaa

SEQ ID NO: 9479424 - DNA, 22 bp, Homo sapiens
gaggtgtgaggaatgaatgggg

SEQ ID NO: 9479425 - DNA, 22 bp, Homo sapiens
gaggtgtgatgcagagtggtgg

SEQ ID NO: 9479426 - DNA, 22 bp, Homo sapiens
atgtggctccttactcatcagc

SEQ ID NO: 9479427 - DNA, 22 bp, Homo sapiens
atgtggctgccacctgcctgaa

SEQ ID NO: 9479428 - DNA, 22 bp, Homo sapiens
atgtggctgatcgcagagctct

SEQ ID NO: 9479429 - DNA, 23 bp, Homo sapiens
atgttaaacataactgaagagcc

SEQ ID NO: 9479430 - DNA, 22 bp, Homo sapiens
atgtggctggtgactgccgtac

SEQ ID NO: 9479431 - DNA, 22 bp, Homo sapiens
atgtggctggtagttgacaact

SEQ ID NO: 9479432 - DNA, 18 bp, Homo sapiens
atgtggctagtgcaactg

SEQ ID NO: 9479433 - DNA, 22 bp, Homo sapiens
atgtggctagtgcagatgaata

SEQ ID NO: 9479434 - DNA, 23 bp, Homo sapiens
atgttaccaatggaggaaattgg

SEQ ID NO: 9479435 - DNA, 22 bp, Homo sapiens
atgttacatagtccttatttgt

SEQ ID NO: 9479436 - DNA, 22 bp, Homo sapiens
atgttacagttgagtaaattaa

SEQ ID NO: 9479437 - DNA, 23 bp, Homo sapiens
atgttaaacataactgaagagcc

SEQ ID NO: 9479438 - DNA, 22 bp, Homo sapiens
atgttacctctattagaatatt

SEQ ID NO: 9479439 - DNA, 22 bp, Homo sapiens
atgttaccatcttttatctaca

SEQ ID NO: 9479440 - DNA, 22 bp, Homo sapiens
atgttactgtgatcatgatact

SEQ ID NO: 9479441 - DNA, 22 bp, Homo sapiens
atgttaccttgttctccaaaaa

SEQ ID NO: 9479442 - DNA, 22 bp, Homo sapiens
atgttactgtgatcatgatact

SEQ ID NO: 9479443 - DNA, 22 bp, Homo sapiens
atgttactgtgatcatgatact

SEQ ID NO: 9479444 - DNA, 23 bp, Homo sapiens
atgttacttaacctctctgtgcc

SEQ ID NO: 9479445 - DNA, 22 bp, Homo sapiens
atgttagtgaccaaatctttct

SEQ ID NO: 9479446 - DNA, 22 bp, Homo sapiens
atgttaggcaatctttcttgtt

SEQ ID NO: 9479447 - DNA, 22 bp, Homo sapiens
atgttagcttgtgtgaaaatgc

SEQ ID NO: 9479448 - DNA, 22 bp, Homo sapiens
atgttagaatctctgaatgtgg

SEQ ID NO: 9479449 - DNA, 22 bp, Homo sapiens
atgttagcattgagcacttact

SEQ ID NO: 9479450 - DNA, 22 bp, Homo sapiens
atgttacttagaataattctgg

SEQ ID NO: 9479451 - DNA, 22 bp, Homo sapiens
atgttacttagaataattctgg

SEQ ID NO: 9479452 - DNA, 22 bp, Homo sapiens
atgttagaaggaatgttaaaag

SEQ ID NO: 9479453 - DNA, 22 bp, Homo sapiens
atgtcactccagggacacaggt

SEQ ID NO: 9479454 - DNA, 22 bp, Homo sapiens
atgtcagatcctcagaaagtct

SEQ ID NO: 9479455 - DNA, 22 bp, Homo sapiens
atgtcagatcctcagaaagtct

SEQ ID NO: 9479456 - DNA, 22 bp, Homo sapiens
atgtcagatattttttggttgc

SEQ ID NO: 9479457 - DNA, 22 bp, Homo sapiens
atgtcagatgtttatctgattt

SEQ ID NO: 9479458 - DNA, 22 bp, Homo sapiens
atgtcagattcctaaatatctt

SEQ ID NO: 9479459 - DNA, 22 bp, Homo sapiens
atgtcagaagaacaatgagata

SEQ ID NO: 9479460 - DNA, 22 bp, Homo sapiens
atgtcagaatctacattctact

SEQ ID NO: 9479461 - DNA, 22 bp, Homo sapiens
atgtcagagcttccacaatagt

SEQ ID NO: 9479462 - DNA, 20 bp, Homo sapiens
atgtcaggaagggagtcagg

SEQ ID NO: 9479463 - DNA, 22 bp, Homo sapiens
atgtcaggaccctactgcattg

SEQ ID NO: 9479464 - DNA, 22 bp, Homo sapiens
atgtcaggaccctactgcattg

SEQ ID NO: 9479465 - DNA, 22 bp, Homo sapiens
atgtgaggtagataggatgcag

SEQ ID NO: 9479466 - DNA, 22 bp, Homo sapiens
atgtcatattactaatgctggc

SEQ ID NO: 9479467 - DNA, 22 bp, Homo sapiens
atgtgaggtatctaggtcttcg

SEQ ID NO: 9479468 - DNA, 22 bp, Homo sapiens
atgtgccagtgccaggtctcta

SEQ ID NO: 9479469 - DNA, 22 bp, Homo sapiens
atgtgccatctactgtcccaag

SEQ ID NO: 9479470 - DNA, 22 bp, Homo sapiens
atgtgcgtgtgtacatatatat

SEQ ID NO: 9479471 - DNA, 19 bp, Homo sapiens
atgtgcccaggggaaagaa

SEQ ID NO: 9479472 - DNA, 22 bp, Homo sapiens
atgtgccttcatcctccctgtc

SEQ ID NO: 9479473 - DNA, 22 bp, Homo sapiens
atgtgcccctgttttgaattgt

SEQ ID NO: 9479474 - DNA, 22 bp, Homo sapiens
atgtgccctttctgctttgcag

SEQ ID NO: 9479475 - DNA, 22 bp, Homo sapiens
atgtgccctcttagagtctctg

SEQ ID NO: 9479476 - DNA, 22 bp, Homo sapiens
atgtggccagtcatgtagtaac

SEQ ID NO: 9479477 - DNA, 22 bp, Homo sapiens
atgtggcattcttggtcatttc

SEQ ID NO: 9479478 - DNA, 22 bp, Homo sapiens
atgtggcaccgatctttagcca

SEQ ID NO: 9479479 - DNA, 22 bp, Homo sapiens
atgtgcttttactccccagagt

SEQ ID NO: 9479480 - DNA, 22 bp, Homo sapiens
atgtggaatgaacaaaggaggc

SEQ ID NO: 9479481 - DNA, 22 bp, Homo sapiens
atgtgctttgctggaaatgtca

SEQ ID NO: 9479482 - DNA, 22 bp, Homo sapiens
atgtgcttttactccccagagt

SEQ ID NO: 9479483 - DNA, 22 bp, Homo sapiens
atgtgctttctttgtttcataa

SEQ ID NO: 9479484 - DNA, 22 bp, Homo sapiens
atgtgctttccaatgctgtagg

SEQ ID NO: 9479485 - DNA, 22 bp, Homo sapiens
atgtgctttaggtttgtttaca

SEQ ID NO: 9479486 - DNA, 22 bp, Homo sapiens
atgtgcttgtaatgttaaatgt

SEQ ID NO: 9479487 - DNA, 19 bp, Homo sapiens
atgtgcttgggccatgcta

SEQ ID NO: 9479488 - DNA, 22 bp, Homo sapiens
atgtgcttgactactctctatt

SEQ ID NO: 9479489 - DNA, 22 bp, Homo sapiens
atgtgcttgagggaaatcagtt

SEQ ID NO: 9479490 - DNA, 22 bp, Homo sapiens
atgtgcttgagggaaatcagtt

SEQ ID NO: 9479491 - DNA, 22 bp, Homo sapiens
atgtgcttgcagatgagcctca

SEQ ID NO: 9479492 - DNA, 22 bp, Homo sapiens
atgtgctgagtgtgtatataca

SEQ ID NO: 9479493 - DNA, 22 bp, Homo sapiens
atgtgctgagtgtgtatataca

SEQ ID NO: 9479494 - DNA, 20 bp, Homo sapiens
atgtgctgggcaatatgtta

SEQ ID NO: 9479495 - DNA, 22 bp, Homo sapiens
atgtgctgtaatccattgaagg

SEQ ID NO: 9479496 - DNA, 21 bp, Homo sapiens
atgtgcttagctgctggtagt

SEQ ID NO: 9479497 - DNA, 22 bp, Homo sapiens
atgtgcttcaggatgtcagtgt

SEQ ID NO: 9479498 - DNA, 22 bp, Homo sapiens
atgtgcttcataatcttctcat

SEQ ID NO: 9479499 - DNA, 22 bp, Homo sapiens
atgtgcttcattctacatgaca

SEQ ID NO: 9479500 - DNA, 22 bp, Homo sapiens
atgtgcttcgccagggcgttgc

SEQ ID NO: 9479501 - DNA, 22 bp, Homo sapiens
atgtgcttcattctacatgaca

SEQ ID NO: 9479502 - DNA, 22 bp, Homo sapiens
ggcaattaaagtactgtgaatg

SEQ ID NO: 9479503 - DNA, 22 bp, Homo sapiens
ggcaatgtttcgatgggagctg

SEQ ID NO: 9479504 - DNA, 22 bp, Homo sapiens
ggcaatttcatgtggtttaaac

SEQ ID NO: 9479505 - DNA, 22 bp, Homo sapiens
cacatgaagagagtctagtaat

SEQ ID NO: 9479506 - DNA, 16 bp, Homo sapiens
cacatatatttatatg

SEQ ID NO: 9479507 - DNA, 22 bp, Homo sapiens
cacatatatgggcccctgaggg

SEQ ID NO: 9479508 - DNA, 22 bp, Homo sapiens
cacatatatgaaatgaggaatt

SEQ ID NO: 9479509 - DNA, 22 bp, Homo sapiens
ggcaatatggtgaaaccccatc

SEQ ID NO: 9479510 - DNA, 20 bp, Homo sapiens
ggcaatgccagatgacagga

SEQ ID NO: 9479511 - DNA, 22 bp, Homo sapiens
ggcaatgtctcttgcttccagg

SEQ ID NO: 9479512 - DNA, 22 bp, Homo sapiens
ggcaatgtccatggaacaggac

SEQ ID NO: 9479513 - DNA, 22 bp, Homo sapiens
ggcaatgtagattctgtagatt

SEQ ID NO: 9479514 - DNA, 22 bp, Homo sapiens
ggcaataatgacattttaaaaa

SEQ ID NO: 9479515 - DNA, 22 bp, Homo sapiens
ggcaataatctactctgccact

SEQ ID NO: 9479516 - DNA, 22 bp, Homo sapiens
ggcaatagttgtgggttcttta

SEQ ID NO: 9479517 - DNA, 22 bp, Homo sapiens
ggcaatagttgtgggttcttta

SEQ ID NO: 9479518 - DNA, 22 bp, Homo sapiens
ggcaataatctactctgccact

SEQ ID NO: 9479519 - DNA, 22 bp, Homo sapiens
cacatgaaggctggggtcgtga

SEQ ID NO: 9479520 - DNA, 22 bp, Homo sapiens
cacatgaaggctggggtcgtga

SEQ ID NO: 9479521 - DNA, 22 bp, Homo sapiens
cacatgaattgatgccaagtgc

SEQ ID NO: 9479522 - DNA, 22 bp, Homo sapiens
cacatgagagcccccaagagca

SEQ ID NO: 9479523 - DNA, 22 bp, Homo sapiens
cacatgactctggctacccaga

SEQ ID NO: 9479524 - DNA, 19 bp, Homo sapiens
cacatgagggctgagggac

SEQ ID NO: 9479525 - DNA, 22 bp, Homo sapiens
cacatgaggtgacttccaagct

SEQ ID NO: 9479526 - DNA, 22 bp, Homo sapiens
ggcagaggtgacagtgtctttt

SEQ ID NO: 9479527 - DNA, 22 bp, Homo sapiens
ggcagaggtgacagtgtctttt

SEQ ID NO: 9479528 - DNA, 22 bp, Homo sapiens
cacatgcaggagccaatgtaca

SEQ ID NO: 9479529 - DNA, 22 bp, Homo sapiens
ggcagaggtgacagtgtctttt

SEQ ID NO: 9479530 - DNA, 22 bp, Homo sapiens
cacatgagtcctgccaggtatg

SEQ ID NO: 9479531 - DNA, 22 bp, Homo sapiens
cacatgcaccagaaatcaacat

SEQ ID NO: 9479532 - DNA, 22 bp, Homo sapiens
cacatgcaccagaaatcaacat

SEQ ID NO: 9479533 - DNA, 22 bp, Homo sapiens
cacatgcaagtcctcagttcta

SEQ ID NO: 9479534 - DNA, 22 bp, Homo sapiens
ggcagagtgctctgggcagggg

SEQ ID NO: 9479535 - DNA, 22 bp, Homo sapiens
ggcagagttggtggagtcagtt

SEQ ID NO: 9479536 - DNA, 22 bp, Homo sapiens
ggcagatgacagaccagtatgt

SEQ ID NO: 9479537 - DNA, 22 bp, Homo sapiens
ggcagatatattcgtgaaatag

SEQ ID NO: 9479538 - DNA, 22 bp, Homo sapiens
ggcagatggaagaggctgggtc

SEQ ID NO: 9479539 - DNA, 22 bp, Homo sapiens
cacatgctccatacagaatggg

SEQ ID NO: 9479540 - DNA, 20 bp, Homo sapiens
cacatgctgtgtgtttctct

SEQ ID NO: 9479541 - DNA, 18 bp, Homo sapiens
ggcagatgacaggagaga

SEQ ID NO: 9479542 - DNA, 20 bp, Homo sapiens
ggcagatgcagagctatgca

SEQ ID NO: 9479543 - DNA, 18 bp, Homo sapiens
ggcagatgacaggagaga

SEQ ID NO: 9479544 - DNA, 20 bp, Homo sapiens
ggcagatgcagagctatgca

SEQ ID NO: 9479545 - DNA, 22 bp, Homo sapiens
cacattaaaatcctaacttcca

SEQ ID NO: 9479546 - DNA, 22 bp, Homo sapiens
cacattaaaatcctaacttcca

SEQ ID NO: 9479547 - DNA, 20 bp, Homo sapiens
cacattaaggaaaacaactg

SEQ ID NO: 9479548 - DNA, 20 bp, Homo sapiens
cacattaaggaaaacaactg

SEQ ID NO: 9479549 - DNA, 22 bp, Homo sapiens
cacattaagaataatgagacta

SEQ ID NO: 9479550 - DNA, 22 bp, Homo sapiens
cacatgtttttggccatcatgg

SEQ ID NO: 9479551 - DNA, 22 bp, Homo sapiens
cacatgtttggcatgtcaccaa

SEQ ID NO: 9479552 - DNA, 22 bp, Homo sapiens
cacatgtttggcatgtcaccaa

SEQ ID NO: 9479553 - DNA, 22 bp, Homo sapiens
cacattaaaatcctaacttcca

SEQ ID NO: 9479554 - DNA, 22 bp, Homo sapiens
cacattcaattacacagatagg

SEQ ID NO: 9479555 - DNA, 22 bp, Homo sapiens
cacattcaattacacagatagg

SEQ ID NO: 9479556 - DNA, 22 bp, Homo sapiens
cacattcacatttttccctcta

SEQ ID NO: 9479557 - DNA, 22 bp, Homo sapiens
cacattcaattacacagatagg

SEQ ID NO: 9479558 - DNA, 22 bp, Homo sapiens
cacattcacttctctgtccacc

SEQ ID NO: 9479559 - DNA, 22 bp, Homo sapiens
cacattcacttctctgtccacc

SEQ ID NO: 9479560 - DNA, 22 bp, Homo sapiens
cacattcacatttttccctcta

SEQ ID NO: 9479561 - DNA, 22 bp, Homo sapiens
cacattcaggattttccatgtc

SEQ ID NO: 9479562 - DNA, 22 bp, Homo sapiens
cacattcaggattttccatgtc

SEQ ID NO: 9479563 - DNA, 22 bp, Homo sapiens
cacattcagctcattaatggtc

SEQ ID NO: 9479564 - DNA, 22 bp, Homo sapiens
cacatgcttagatttcagtgga

SEQ ID NO: 9479565 - DNA, 22 bp, Homo sapiens
cacatgctccatacagaatggg

SEQ ID NO: 9479566 - DNA, 22 bp, Homo sapiens
cacatgtgcaaatactgaggct

SEQ ID NO: 9479567 - DNA, 22 bp, Homo sapiens
cacattcctgagcttcgacctg

SEQ ID NO: 9479568 - DNA, 22 bp, Homo sapiens
cacattccccagagctggggct

SEQ ID NO: 9479569 - DNA, 22 bp, Homo sapiens
cacattcatcagtgttgtactg

SEQ ID NO: 9479570 - DNA, 22 bp, Homo sapiens
cacattcatggagtttgcctgt

SEQ ID NO: 9479571 - DNA, 22 bp, Homo sapiens
cacattcatggagtttgcctgt

SEQ ID NO: 9479572 - DNA, 22 bp, Homo sapiens
cacattcatggagtttgcctgt

SEQ ID NO: 9479573 - DNA, 22 bp, Homo sapiens
cacattcatcagtgttgtactg

SEQ ID NO: 9479574 - DNA, 22 bp, Homo sapiens
cacattcaggtggcatgttaga

SEQ ID NO: 9479575 - DNA, 22 bp, Homo sapiens
cacattcagggcagaccactca

SEQ ID NO: 9479576 - DNA, 22 bp, Homo sapiens
cacattcaggtggcatgttaga

SEQ ID NO: 9479577 - DNA, 22 bp, Homo sapiens
cacattcagggaacattggagg

SEQ ID NO: 9479578 - DNA, 22 bp, Homo sapiens
caccagctactcgggtttcctg

SEQ ID NO: 9479579 - DNA, 22 bp, Homo sapiens
caccagctactccagggccgtg

SEQ ID NO: 9479580 - DNA, 22 bp, Homo sapiens
caccagctccaccagggcaggt

SEQ ID NO: 9479581 - DNA, 22 bp, Homo sapiens
caccagctactccagggccgtg

SEQ ID NO: 9479582 - DNA, 22 bp, Homo sapiens
caccactgtatccctagcactt

SEQ ID NO: 9479583 - DNA, 22 bp, Homo sapiens
caccagctacagactactgtgt

SEQ ID NO: 9479584 - DNA, 22 bp, Homo sapiens
caccactggaggtcttggcttt

SEQ ID NO: 9479585 - DNA, 22 bp, Homo sapiens
caccactggaggtcttggcttt

SEQ ID NO: 9479586 - DNA, 22 bp, Homo sapiens
caccactgcttcctgccatctg

SEQ ID NO: 9479587 - DNA, 22 bp, Homo sapiens
caccagctccaccagggcaggt

SEQ ID NO: 9479588 - DNA, 22 bp, Homo sapiens
caccagctctccaccaggtttc

SEQ ID NO: 9479589 - DNA, 22 bp, Homo sapiens
caccagctccaccagggcaggt

SEQ ID NO: 9479590 - DNA, 22 bp, Homo sapiens
caccagcttacagtctcacccc

SEQ ID NO: 9479591 - DNA, 22 bp, Homo sapiens
caccagctgcaacaccatctcc

SEQ ID NO: 9479592 - DNA, 22 bp, Homo sapiens
caccagcttgcagtcttaaccc

SEQ ID NO: 9479593 - DNA, 22 bp, Homo sapiens
caccagcttgcagtcttaaccc

SEQ ID NO: 9479594 - DNA, 22 bp, Homo sapiens
caccagcttgggctgtggaaat

SEQ ID NO: 9479595 - DNA, 22 bp, Homo sapiens
caccagcttctcattgcgggtc

SEQ ID NO: 9479596 - DNA, 22 bp, Homo sapiens
caccagcttacagtctcacccc

SEQ ID NO: 9479597 - DNA, 22 bp, Homo sapiens
caccagcttcccatcgcgggtc

SEQ ID NO: 9479598 - DNA, 22 bp, Homo sapiens
caccagctttgcccactgccca

SEQ ID NO: 9479599 - DNA, 22 bp, Homo sapiens
caccaggagccatcaggagtcc

SEQ ID NO: 9479600 - DNA, 22 bp, Homo sapiens
cacaggtatatgtgtatatact

SEQ ID NO: 9479601 - DNA, 22 bp, Homo sapiens
cacaggggcaaactgtagggga

SEQ ID NO: 9479602 - DNA, 22 bp, Homo sapiens
cacagggttgttctgaggattc

SEQ ID NO: 9479603 - DNA, 22 bp, Homo sapiens
cacaggtaatagcctaggctat

SEQ ID NO: 9479604 - DNA, 22 bp, Homo sapiens
cacaggtaatagcctaggctat

SEQ ID NO: 9479605 - DNA, 22 bp, Homo sapiens
cacagggctttgatggctgagt

SEQ ID NO: 9479606 - DNA, 22 bp, Homo sapiens
cacagggctttgatggctgagt

SEQ ID NO: 9479607 - DNA, 22 bp, Homo sapiens
cacagggcaggtactctcagag

SEQ ID NO: 9479608 - DNA, 22 bp, Homo sapiens
cacagggcaggtactctcagag

SEQ ID NO: 9479609 - DNA, 22 bp, Homo sapiens
cacagggctttgatggctgagt

SEQ ID NO: 9479610 - DNA, 22 bp, Homo sapiens
cacaggggcaaactgtagggga

SEQ ID NO: 9479611 - DNA, 22 bp, Homo sapiens
cacaggccagtaagactgtgtt

SEQ ID NO: 9479612 - DNA, 22 bp, Homo sapiens
cacaggccagtaagactgtgtt

SEQ ID NO: 9479613 - DNA, 22 bp, Homo sapiens
cacaggccagtaagactgtgtt

SEQ ID NO: 9479614 - DNA, 22 bp, Homo sapiens
cacaggccagtaagactgtgtt

SEQ ID NO: 9479615 - DNA, 20 bp, Homo sapiens
cacaggccccaagacctgta

SEQ ID NO: 9479616 - DNA, 20 bp, Homo sapiens
cacaggccccaagacctgta

SEQ ID NO: 9479617 - DNA, 22 bp, Homo sapiens
cacaggccagtaagactgtgtt

SEQ ID NO: 9479618 - DNA, 22 bp, Homo sapiens
cacaggccagtaagactgtgtt

SEQ ID NO: 9479619 - DNA, 18 bp, Homo sapiens
cacaggcaggtgataggt

SEQ ID NO: 9479620 - DNA, 20 bp, Homo sapiens
cacaggccttgtgagcagac

SEQ ID NO: 9479621 - DNA, 22 bp, Homo sapiens
cacagggcaggccccaggcctc

SEQ ID NO: 9479622 - DNA, 22 bp, Homo sapiens
cacaggcctggggttgagcggg

SEQ ID NO: 9479623 - DNA, 20 bp, Homo sapiens
cacaggccttgtgagcagac

SEQ ID NO: 9479624 - DNA, 20 bp, Homo sapiens
cacaggccttgtgagcagac

SEQ ID NO: 9479625 - DNA, 22 bp, Homo sapiens
cacaggagttaacataattaag

SEQ ID NO: 9479626 - DNA, 22 bp, Homo sapiens
cacaggagtgctgctattgttg

SEQ ID NO: 9479627 - DNA, 22 bp, Homo sapiens
cacaggagtgctgctattgttg

SEQ ID NO: 9479628 - DNA, 22 bp, Homo sapiens
cacaggaggttaggaagtggtc

SEQ ID NO: 9479629 - DNA, 22 bp, Homo sapiens
cacaggaggttaggaagtggtc

SEQ ID NO: 9479630 - DNA, 22 bp, Homo sapiens
cacaggaggttaggaagtggtc

SEQ ID NO: 9479631 - DNA, 22 bp, Homo sapiens
cacaggaggttaggaagtggtc

SEQ ID NO: 9479632 - DNA, 22 bp, Homo sapiens
cacaggaggttaggaagtggtc

SEQ ID NO: 9479633 - DNA, 22 bp, Homo sapiens
cacaggagattgatctattggt

SEQ ID NO: 9479634 - DNA, 22 bp, Homo sapiens
cacaggagattgatctattggt

SEQ ID NO: 9479635 - DNA, 22 bp, Homo sapiens
ggagagctagtgcctgccagta

SEQ ID NO: 9479636 - DNA, 23 bp, Homo sapiens
ggagagctcctcgtgactcactg

SEQ ID NO: 9479637 - DNA, 22 bp, Homo sapiens
ggagagctctgggtctccgaca

SEQ ID NO: 9479638 - DNA, 22 bp, Homo sapiens
ggagagcctgtgcagccgggtt

SEQ ID NO: 9479639 - DNA, 22 bp, Homo sapiens
ggagagctagtgcctgccagta

SEQ ID NO: 9479640 - DNA, 22 bp, Homo sapiens
ggagagcctccacggcttctgt

SEQ ID NO: 9479641 - DNA, 20 bp, Homo sapiens
ggagagccacatagtctccc

SEQ ID NO: 9479642 - DNA, 22 bp, Homo sapiens
cacaggcacgcctctggccagg

SEQ ID NO: 9479643 - DNA, 22 bp, Homo sapiens
cacaggcacccctgactgctca

SEQ ID NO: 9479644 - DNA, 23 bp, Homo sapiens
cacaggcagaaatcaagacggta

SEQ ID NO: 9479645 - DNA, 22 bp, Homo sapiens
cacaggcacgcctctggccagg

SEQ ID NO: 9479646 - DNA, 22 bp, Homo sapiens
cacaggcaggaggttctccagt

SEQ ID NO: 9479647 - DNA, 22 bp, Homo sapiens
cacaggcagccttgtagaagaa

SEQ ID NO: 9479648 - DNA, 22 bp, Homo sapiens
cacaggcagccttgtagaagaa

SEQ ID NO: 9479649 - DNA, 22 bp, Homo sapiens
cacaggtttcaaggataagatg

SEQ ID NO: 9479650 - DNA, 22 bp, Homo sapiens
cacaggtttcaaggataagatg

SEQ ID NO: 9479651 - DNA, 22 bp, Homo sapiens
cacaggttagcagcttgaaact

SEQ ID NO: 9479652 - DNA, 22 bp, Homo sapiens
cacaggttaggtattatactat

SEQ ID NO: 9479653 - DNA, 22 bp, Homo sapiens
cacagtgaattacatagacgtg

SEQ ID NO: 9479654 - DNA, 22 bp, Homo sapiens
cacagtgaagcatgcagacatc

SEQ ID NO: 9479655 - DNA, 22 bp, Homo sapiens
cacagtgaagcatgcagacatc

SEQ ID NO: 9479656 - DNA, 22 bp, Homo sapiens
cacagtaaggtatcccagtgaa

SEQ ID NO: 9479657 - DNA, 22 bp, Homo sapiens
cacaggtgtgtcctggtcttgt

SEQ ID NO: 9479658 - DNA, 22 bp, Homo sapiens
cacaggtgttcttgcagtgaaa

SEQ ID NO: 9479659 - DNA, 22 bp, Homo sapiens
cacaggtgtatgaatatgtcca

SEQ ID NO: 9479660 - DNA, 21 bp, Homo sapiens
cacaggtgggtcagtgaggcc

SEQ ID NO: 9479661 - DNA, 21 bp, Homo sapiens
cacaggtgggtcagtgaggcc

SEQ ID NO: 9479662 - DNA, 21 bp, Homo sapiens
cacaggtgggtcagtgaggcc

SEQ ID NO: 9479663 - DNA, 22 bp, Homo sapiens
cacagtgagctgggcatcagtt

SEQ ID NO: 9479664 - DNA, 22 bp, Homo sapiens
cacagtgactggcacctagtat

SEQ ID NO: 9479665 - DNA, 22 bp, Homo sapiens
cacagtgattgatttttacttt

SEQ ID NO: 9479666 - DNA, 22 bp, Homo sapiens
cacagtgagctgggcatcagtt

SEQ ID NO: 9479667 - DNA, 22 bp, Homo sapiens
cacagtgattgatttttacttt

SEQ ID NO: 9479668 - DNA, 22 bp, Homo sapiens
cacagtgacattagtgagaaaa

SEQ ID NO: 9479669 - DNA, 22 bp, Homo sapiens
cacagtgacattagtgagaaaa

SEQ ID NO: 9479670 - DNA, 22 bp, Homo sapiens
cacagtgacagctatacagaga

SEQ ID NO: 9479671 - DNA, 22 bp, Homo sapiens
cacagtgacagctatacagaga

SEQ ID NO: 9479672 - DNA, 22 bp, Homo sapiens
cacagtgaatttcaagtgttgt

SEQ ID NO: 9479673 - DNA, 22 bp, Homo sapiens
cacagtgaatttcaagtgttgt

SEQ ID NO: 9479674 - DNA, 22 bp, Homo sapiens
cacagtgaatttcaagtgttgt

SEQ ID NO: 9479675 - DNA, 22 bp, Homo sapiens
cacagtgaatttcaagtgttgt

SEQ ID NO: 9479676 - DNA, 22 bp, Homo sapiens
cacagtgacctctttaaaaggg

SEQ ID NO: 9479677 - DNA, 22 bp, Homo sapiens
cacagtgacctctttaaaaggg

SEQ ID NO: 9479678 - DNA, 22 bp, Homo sapiens
cacagtgacctctttaaaaggg

SEQ ID NO: 9479679 - DNA, 22 bp, Homo sapiens
cacagtgacattagtgagaaaa

SEQ ID NO: 9479680 - DNA, 22 bp, Homo sapiens
cacagtgactggcacatagtaa

SEQ ID NO: 9479681 - DNA, 22 bp, Homo sapiens
cacagtgactggcacatagtaa

SEQ ID NO: 9479682 - DNA, 22 bp, Homo sapiens
cacagtgactggcacatagtaa

SEQ ID NO: 9479683 - DNA, 22 bp, Homo sapiens
ggcaagtggaggtgttcatcag

SEQ ID NO: 9479684 - DNA, 22 bp, Homo sapiens
ggcaagtggaggtgttcatcag

SEQ ID NO: 9479685 - DNA, 22 bp, Homo sapiens
ggcaagtggtagaacatctgag

SEQ ID NO: 9479686 - DNA, 22 bp, Homo sapiens
ggcaagtcaggaagttgacatt

SEQ ID NO: 9479687 - DNA, 22 bp, Homo sapiens
ggcaagtgatcctggagcaccg

SEQ ID NO: 9479688 - DNA, 22 bp, Homo sapiens
ggcaagggttgaagataaggta

SEQ ID NO: 9479689 - DNA, 22 bp, Homo sapiens
ggcaagggttgaagataaggta

SEQ ID NO: 9479690 - DNA, 22 bp, Homo sapiens
ggcaagggacggccgtgagaca

SEQ ID NO: 9479691 - DNA, 22 bp, Homo sapiens
ggcaaggggtcaggctgagaca

SEQ ID NO: 9479692 - DNA, 22 bp, Homo sapiens
ggcaaggggtcaggctgagaca

SEQ ID NO: 9479693 - DNA, 22 bp, Homo sapiens
ggcaaggggtcaggctgagaca

SEQ ID NO: 9479694 - DNA, 22 bp, Homo sapiens
cacttgttggtggtgaaatcac

SEQ ID NO: 9479695 - DNA, 22 bp, Homo sapiens
cacttgttggtggtgaaatcac

SEQ ID NO: 9479696 - DNA, 22 bp, Homo sapiens
cacttgggattaggggctaggt

SEQ ID NO: 9479697 - DNA, 22 bp, Homo sapiens
cacttgttggtggtgaaatcac

SEQ ID NO: 9479698 - DNA, 17 bp, Homo sapiens
ggctgctgtgctggtgc

SEQ ID NO: 9479699 - DNA, 22 bp, Homo sapiens
cactttaaaactgacagccctt

SEQ ID NO: 9479700 - DNA, 21 bp, Homo sapiens
cactttaaaaatatctttata

SEQ ID NO: 9479701 - DNA, 21 bp, Homo sapiens
cacttgaatggtgttttacaa

SEQ ID NO: 9479702 - DNA, 22 bp, Homo sapiens
cacttgcttaccggagaggtgc

SEQ ID NO: 9479703 - DNA, 22 bp, Homo sapiens
cacttgcagactttgcctggtt

SEQ ID NO: 9479704 - DNA, 23 bp, Homo sapiens
cacttcccctgtggcgagcctgc

SEQ ID NO: 9479705 - DNA, 22 bp, Homo sapiens
cacttgaacccgggaggctgag

SEQ ID NO: 9479706 - DNA, 22 bp, Homo sapiens
cacttgaaaatcagaggaaatt

SEQ ID NO: 9479707 - DNA, 22 bp, Homo sapiens
ggctctggaaagtgtccttgat

SEQ ID NO: 9479708 - DNA, 22 bp, Homo sapiens
ggctctggaaagtgtccttgat

SEQ ID NO: 9479709 - DNA, 20 bp, Homo sapiens
ggctctggaatctggtgggc

SEQ ID NO: 9479710 - DNA, 22 bp, Homo sapiens
ggctctggaaagtgtccttgat

SEQ ID NO: 9479711 - DNA, 22 bp, Homo sapiens
ggctctggaaagtgtccttgat

SEQ ID NO: 9479712 - DNA, 22 bp, Homo sapiens
cacttaaatctgttgagaaaaa

SEQ ID NO: 9479713 - DNA, 22 bp, Homo sapiens
cacttaaagtcttagcttacag

SEQ ID NO: 9479714 - DNA, 22 bp, Homo sapiens
cacttaaatctgttgagaaaaa

SEQ ID NO: 9479715 - DNA, 22 bp, Homo sapiens
cactgtggcaacctgtgcccaa

SEQ ID NO: 9479716 - DNA, 22 bp, Homo sapiens
cacttaaatctgttgagaaaaa

SEQ ID NO: 9479717 - DNA, 22 bp, Homo sapiens
cacttaaagtcttagcttacag

SEQ ID NO: 9479718 - DNA, 20 bp, Homo sapiens
ggctctggaatctggtgggc

SEQ ID NO: 9479719 - DNA, 22 bp, Homo sapiens
cactgtggcaacctgtgcccaa

SEQ ID NO: 9479720 - DNA, 22 bp, Homo sapiens
cacttcaccactaggctatact

SEQ ID NO: 9479721 - DNA, 22 bp, Homo sapiens
cacttcattgggaccagggctg

SEQ ID NO: 9479722 - DNA, 22 bp, Homo sapiens
cacttcattgggaccagggctg

SEQ ID NO: 9479723 - DNA, 22 bp, Homo sapiens
cacttcaatctctgcctccatc

SEQ ID NO: 9479724 - DNA, 22 bp, Homo sapiens
cacttcaattaacttcagcatt

SEQ ID NO: 9479725 - DNA, 19 bp, Homo sapiens
cacttcaatcctttatcaa

SEQ ID NO: 9479726 - DNA, 22 bp, Homo sapiens
cacttcaaggaatatctagaaa

SEQ ID NO: 9479727 - DNA, 22 bp, Homo sapiens
cacttcaaggaatatctagaaa

SEQ ID NO: 9479728 - DNA, 22 bp, Homo sapiens
cacttcaaataagctcttctca

SEQ ID NO: 9479729 - DNA, 22 bp, Homo sapiens
cacttcaaataagctcttctca

SEQ ID NO: 9479730 - DNA, 22 bp, Homo sapiens
cacttcaaatatggcttcatga

SEQ ID NO: 9479731 - DNA, 22 bp, Homo sapiens
cacttcaacctctgagtcctgg

SEQ ID NO: 9479732 - DNA, 22 bp, Homo sapiens
cacttcaacctctgagtcctgg

SEQ ID NO: 9479733 - DNA, 22 bp, Homo sapiens
cacttcaagagcaagggtgcca

SEQ ID NO: 9479734 - DNA, 22 bp, Homo sapiens
cacttcaagagcaagggtgcca

SEQ ID NO: 9479735 - DNA, 22 bp, Homo sapiens
cacttcaaatatggcttcatga

SEQ ID NO: 9479736 - DNA, 22 bp, Homo sapiens
cacttcaacagttatttcttag

SEQ ID NO: 9479737 - DNA, 22 bp, Homo sapiens
cacttacacttctgaaagccta

SEQ ID NO: 9479738 - DNA, 22 bp, Homo sapiens
cacttacacttctgaaagccta

SEQ ID NO: 9479739 - DNA, 22 bp, Homo sapiens
cacttaaatgttcctacagcag

SEQ ID NO: 9479740 - DNA, 22 bp, Homo sapiens
cacttagatactagatcacaaa

SEQ ID NO: 9479741 - DNA, 22 bp, Homo sapiens
cactggtgatgaggcagttagg

SEQ ID NO: 9479742 - DNA, 22 bp, Homo sapiens
cactggtgagtccagaagtcat

SEQ ID NO: 9479743 - DNA, 22 bp, Homo sapiens
cactgggatttggggtgtctta

SEQ ID NO: 9479744 - DNA, 22 bp, Homo sapiens
cactgggagtcgtaagacacgg

SEQ ID NO: 9479745 - DNA, 22 bp, Homo sapiens
cactggtgtctgagcagggtga

SEQ ID NO: 9479746 - DNA, 22 bp, Homo sapiens
cactggtgtattagagctagaa

SEQ ID NO: 9479747 - DNA, 22 bp, Homo sapiens
cactgtaagatgagctttttta

SEQ ID NO: 9479748 - DNA, 22 bp, Homo sapiens
cactgtaatagcattataagtg

SEQ ID NO: 9479749 - DNA, 22 bp, Homo sapiens
cactgtaatggaattttcttta

SEQ ID NO: 9479750 - DNA, 22 bp, Homo sapiens
cactgtccaatagatacataat

SEQ ID NO: 9479751 - DNA, 22 bp, Homo sapiens
cactgtcacgttctgaaactgt

SEQ ID NO: 9479752 - DNA, 22 bp, Homo sapiens
cactgtattattaggaatgaca

SEQ ID NO: 9479753 - DNA, 22 bp, Homo sapiens
cactgtcacgttctgaaactgt

SEQ ID NO: 9479754 - DNA, 22 bp, Homo sapiens
cactgtcacgttctgaaactgt

SEQ ID NO: 9479755 - DNA, 22 bp, Homo sapiens
cactgtattattaggaatgaca

SEQ ID NO: 9479756 - DNA, 21 bp, Homo sapiens
cactgtatagcaggagaaaac

SEQ ID NO: 9479757 - DNA, 21 bp, Homo sapiens
cactgtatagcaggagaaaac

SEQ ID NO: 9479758 - DNA, 22 bp, Homo sapiens
cactgtactgtgaataaggagg

SEQ ID NO: 9479759 - DNA, 22 bp, Homo sapiens
cactgtactgtgaataaggagg

SEQ ID NO: 9479760 - DNA, 22 bp, Homo sapiens
ggctctgcttgaggccagcctg

SEQ ID NO: 9479761 - DNA, 22 bp, Homo sapiens
cactgcactccagcttgggcaa

SEQ ID NO: 9479762 - DNA, 22 bp, Homo sapiens
cactgcactccagcttgggtga

SEQ ID NO: 9479763 - DNA, 22 bp, Homo sapiens
cactgcactccagcttgggtga

SEQ ID NO: 9479764 - DNA, 22 bp, Homo sapiens
cactgcactccagcttgggtga

SEQ ID NO: 9479765 - DNA, 22 bp, Homo sapiens
cactgcactccagcttgggtga

SEQ ID NO: 9479766 - DNA, 22 bp, Homo sapiens
cactgcactccagcctgggtga

SEQ ID NO: 9479767 - DNA, 22 bp, Homo sapiens
cactgcactccagcctgggtga

SEQ ID NO: 9479768 - DNA, 22 bp, Homo sapiens
cactgcactccagcctgggtga

SEQ ID NO: 9479769 - DNA, 22 bp, Homo sapiens
cactgcactccagcctgggtga

SEQ ID NO: 9479770 - DNA, 22 bp, Homo sapiens
cactgcactccagcctgggtga

SEQ ID NO: 9479771 - DNA, 22 bp, Homo sapiens
cactgcactccagcctgggtga

SEQ ID NO: 9479772 - DNA, 22 bp, Homo sapiens
cactgcactccagcctgggtga

SEQ ID NO: 9479773 - DNA, 22 bp, Homo sapiens
cactgcactccagcctgggtga

SEQ ID NO: 9479774 - DNA, 22 bp, Homo sapiens
cactgcactccagcctgggtca

SEQ ID NO: 9479775 - DNA, 22 bp, Homo sapiens
cactgcactccagcctgggtca

SEQ ID NO: 9479776 - DNA, 22 bp, Homo sapiens
cactgcactccagcctgggtca

SEQ ID NO: 9479777 - DNA, 22 bp, Homo sapiens
cactgcactccagcctgggtca

SEQ ID NO: 9479778 - DNA, 22 bp, Homo sapiens
cactgcactccagcctgggtca

SEQ ID NO: 9479779 - DNA, 22 bp, Homo sapiens
cactgcactccagcctgggtca

SEQ ID NO: 9479780 - DNA, 22 bp, Homo sapiens
cactgcactccagcctgggtca

SEQ ID NO: 9479781 - DNA, 22 bp, Homo sapiens
cactgcactccagcctgggtca

SEQ ID NO: 9479782 - DNA, 22 bp, Homo sapiens
cactgcactccagcctgggcaa

SEQ ID NO: 9479783 - DNA, 22 bp, Homo sapiens
cactgcactccagcctgggcaa

SEQ ID NO: 9479784 - DNA, 22 bp, Homo sapiens
cactgcactccagcctgggaga

SEQ ID NO: 9479785 - DNA, 22 bp, Homo sapiens
cactgcactccagcctgggaga

SEQ ID NO: 9479786 - DNA, 22 bp, Homo sapiens
cactgcactccagcctgggaga

SEQ ID NO: 9479787 - DNA, 22 bp, Homo sapiens
cactgcactccagcctgggaga

SEQ ID NO: 9479788 - DNA, 22 bp, Homo sapiens
cactgcactccagcctgggaga

SEQ ID NO: 9479789 - DNA, 22 bp, Homo sapiens
cactgcactccagcctgggaga

SEQ ID NO: 9479790 - DNA, 22 bp, Homo sapiens
cactgcactccagcctgcgcaa

SEQ ID NO: 9479791 - DNA, 22 bp, Homo sapiens
cactgcaacctccacctcctgg

SEQ ID NO: 9479792 - DNA, 22 bp, Homo sapiens
cactgcaacctccacctcctgg

SEQ ID NO: 9479793 - DNA, 22 bp, Homo sapiens
cactgcaacctccacctcctgg

SEQ ID NO: 9479794 - DNA, 22 bp, Homo sapiens
cactccagcctcagtgacagag

SEQ ID NO: 9479795 - DNA, 22 bp, Homo sapiens
cactccagcctcagtgacagag

SEQ ID NO: 9479796 - DNA, 22 bp, Homo sapiens
cactccaggtcccagttcctgg

SEQ ID NO: 9479797 - DNA, 22 bp, Homo sapiens
cactccagccatttgtccccag

SEQ ID NO: 9479798 - DNA, 22 bp, Homo sapiens
cactccctctagttgcattctg

SEQ ID NO: 9479799 - DNA, 22 bp, Homo sapiens
cactccctctagttgcattctg

SEQ ID NO: 9479800 - DNA, 22 bp, Homo sapiens
cactcccttcaggagcctagga

SEQ ID NO: 9479801 - DNA, 22 bp, Homo sapiens
cactcctataattaaagatgca

SEQ ID NO: 9479802 - DNA, 22 bp, Homo sapiens
cactcccttcaggagcctagga

SEQ ID NO: 9479803 - DNA, 22 bp, Homo sapiens
cactcctgttccactaaatgag

SEQ ID NO: 9479804 - DNA, 22 bp, Homo sapiens
cactctcacatgccctgtcagt

SEQ ID NO: 9479805 - DNA, 22 bp, Homo sapiens
cactctaacctccatcttccat

SEQ ID NO: 9479806 - DNA, 23 bp, Homo sapiens
cactcctgtttctaagccagcat

SEQ ID NO: 9479807 - DNA, 20 bp, Homo sapiens
cactctaaccatatttcctc

SEQ ID NO: 9479808 - DNA, 22 bp, Homo sapiens
cactctccagcacaccccattt

SEQ ID NO: 9479809 - DNA, 22 bp, Homo sapiens
cactctaagaacacaaaggccc

SEQ ID NO: 9479810 - DNA, 22 bp, Homo sapiens
cactctcactgagctcatgcca

SEQ ID NO: 9479811 - DNA, 22 bp, Homo sapiens
cactcatattggaacaagcttg

SEQ ID NO: 9479812 - DNA, 21 bp, Homo sapiens
cactcagtacctgcccgctgc

SEQ ID NO: 9479813 - DNA, 22 bp, Homo sapiens
cactccaagacctactttctct

SEQ ID NO: 9479814 - DNA, 21 bp, Homo sapiens
cactccacttagaacagggtt

SEQ ID NO: 9479815 - DNA, 21 bp, Homo sapiens
cactccacttagaacagggtt

SEQ ID NO: 9479816 - DNA, 22 bp, Homo sapiens
cactcacttatttctaacagaa

SEQ ID NO: 9479817 - DNA, 22 bp, Homo sapiens
cactcaggctgtgtcaggagga

SEQ ID NO: 9479818 - DNA, 22 bp, Homo sapiens
cactcagctgagccctcagccc

SEQ ID NO: 9479819 - DNA, 22 bp, Homo sapiens
cactattttctcttcagatggc

SEQ ID NO: 9479820 - DNA, 22 bp, Homo sapiens
cactatttttcacttaggctta

SEQ ID NO: 9479821 - DNA, 22 bp, Homo sapiens
cactatttcctggattttgacg

SEQ ID NO: 9479822 - DNA, 22 bp, Homo sapiens
cactatatgcctttgaaataca

SEQ ID NO: 9479823 - DNA, 22 bp, Homo sapiens
cactatgcagtgagaaaatggc

SEQ ID NO: 9479824 - DNA, 22 bp, Homo sapiens
cactatatctctttcatctttt

SEQ ID NO: 9479825 - DNA, 21 bp, Homo sapiens
cactatttatatatgccagct

SEQ ID NO: 9479826 - DNA, 22 bp, Homo sapiens
cactatttcagtgattctgcag

SEQ ID NO: 9479827 - DNA, 22 bp, Homo sapiens
cactagtggccccatgtggttg

SEQ ID NO: 9479828 - DNA, 19 bp, Homo sapiens
cactagtctagatgggatg

SEQ ID NO: 9479829 - DNA, 23 bp, Homo sapiens
cacggcagcctccgagggtgctg

SEQ ID NO: 9479830 - DNA, 22 bp, Homo sapiens
ggccagggaggagaggcccctg

SEQ ID NO: 9479831 - DNA, 22 bp, Homo sapiens
caccctgggagtggaagtcagt

SEQ ID NO: 9479832 - DNA, 22 bp, Homo sapiens
caccaggctggagtgcagaggt

SEQ ID NO: 9479833 - DNA, 22 bp, Homo sapiens
cacctgcctgcaggggctccac

SEQ ID NO: 9479834 - DNA, 22 bp, Homo sapiens
cacctgcctcatttgtccctgc

SEQ ID NO: 9479835 - DNA, 22 bp, Homo sapiens
cacctgcctgctagagcctgac

SEQ ID NO: 9479836 - DNA, 22 bp, Homo sapiens
cacctgcctgctagagcctgac

SEQ ID NO: 9479837 - DNA, 22 bp, Homo sapiens
cacctgcctgcaggggctccac

SEQ ID NO: 9479838 - DNA, 22 bp, Homo sapiens
caccaggctgcccaggacaggg

SEQ ID NO: 9479839 - DNA, 22 bp, Homo sapiens
caccaggctgcccaggacaggg

SEQ ID NO: 9479840 - DNA, 20 bp, Homo sapiens
caccaggcgctctgagaaca

SEQ ID NO: 9479841 - DNA, 22 bp, Homo sapiens
caccaggctgaaccagagggga

SEQ ID NO: 9479842 - DNA, 22 bp, Homo sapiens
caccaggaggacaggcccctac

SEQ ID NO: 9479843 - DNA, 22 bp, Homo sapiens
caccaggagtgagaatgaaggg

SEQ ID NO: 9479844 - DNA, 22 bp, Homo sapiens
caccaggctgaaccagagggga

SEQ ID NO: 9479845 - DNA, 22 bp, Homo sapiens
caccaggcacatagtaggcact

SEQ ID NO: 9479846 - DNA, 20 bp, Homo sapiens
cacctggctgactgtctcca

SEQ ID NO: 9479847 - DNA, 22 bp, Homo sapiens
cacctggcctacagggaccagc

SEQ ID NO: 9479848 - DNA, 22 bp, Homo sapiens
cacctggcccagctccagtgct

SEQ ID NO: 9479849 - DNA, 22 bp, Homo sapiens
cacctggctgtgaagcctgggt

SEQ ID NO: 9479850 - DNA, 23 bp, Homo sapiens
cacctggcttgagttggtgggtc

SEQ ID NO: 9479851 - DNA, 22 bp, Homo sapiens
cacctgggctaaactatgcagg

SEQ ID NO: 9479852 - DNA, 22 bp, Homo sapiens
cacctggcccagctccagtgct

SEQ ID NO: 9479853 - DNA, 22 bp, Homo sapiens
cacctggcccagctccagtgct

SEQ ID NO: 9479854 - DNA, 22 bp, Homo sapiens
cacctggatgccacaaagccac

SEQ ID NO: 9479855 - DNA, 22 bp, Homo sapiens
cacctggagtagcaaggtaatt

SEQ ID NO: 9479856 - DNA, 22 bp, Homo sapiens
cacctgctgagctgctgggggt

SEQ ID NO: 9479857 - DNA, 22 bp, Homo sapiens
cacctggaccctgggaggaggg

SEQ ID NO: 9479858 - DNA, 22 bp, Homo sapiens
cacctggaccctgggaggaggg

SEQ ID NO: 9479859 - DNA, 22 bp, Homo sapiens
cacctgctgagctgctgggggt

SEQ ID NO: 9479860 - DNA, 22 bp, Homo sapiens
ggccaggctggttccttgacct

SEQ ID NO: 9479861 - DNA, 22 bp, Homo sapiens
ggccaggctggttccttgacct

SEQ ID NO: 9479862 - DNA, 22 bp, Homo sapiens
ggccagggaggagaggcccctg

SEQ ID NO: 9479863 - DNA, 22 bp, Homo sapiens
ggccaggctggtctcagacttc

SEQ ID NO: 9479864 - DNA, 22 bp, Homo sapiens
ggccaggctgctgggaccccgc

SEQ ID NO: 9479865 - DNA, 22 bp, Homo sapiens
ggccaggctgccctgggagcag

SEQ ID NO: 9479866 - DNA, 22 bp, Homo sapiens
ggccaggctgccctgggagcag

SEQ ID NO: 9479867 - DNA, 22 bp, Homo sapiens
ggccaggctggtctcagacttc

SEQ ID NO: 9479868 - DNA, 22 bp, Homo sapiens
ggccaggctgctgggaccccgc

SEQ ID NO: 9479869 - DNA, 22 bp, Homo sapiens
ggccaggctgccctgggagcag

SEQ ID NO: 9479870 - DNA, 22 bp, Homo sapiens
ggccaggctgccctgggagcag

SEQ ID NO: 9479871 - DNA, 22 bp, Homo sapiens
caagaaatgggatttgactgcc

SEQ ID NO: 9479872 - DNA, 22 bp, Homo sapiens
caagaaatgggatttgactgcc

SEQ ID NO: 9479873 - DNA, 22 bp, Homo sapiens
caagaaactttattctgccata

SEQ ID NO: 9479874 - DNA, 22 bp, Homo sapiens
caagaaactttattctgccata

SEQ ID NO: 9479875 - DNA, 22 bp, Homo sapiens
caagaaatgtttactgagcatc

SEQ ID NO: 9479876 - DNA, 22 bp, Homo sapiens
caagaaacaccaatgactgctg

SEQ ID NO: 9479877 - DNA, 22 bp, Homo sapiens
caacttttctgtgaatttaagt

SEQ ID NO: 9479878 - DNA, 22 bp, Homo sapiens
caacttttctgtgaatttaagt

SEQ ID NO: 9479879 - DNA, 23 bp, Homo sapiens
caacttttggctacatgcttagc

SEQ ID NO: 9479880 - DNA, 22 bp, Homo sapiens
caacttttgacacgtgtgctaa

SEQ ID NO: 9479881 - DNA, 22 bp, Homo sapiens
caactttatgattggtttgtca

SEQ ID NO: 9479882 - DNA, 22 bp, Homo sapiens
caactttgtgtgacctagatag

SEQ ID NO: 9479883 - DNA, 22 bp, Homo sapiens
caactttggccccttcctagct

SEQ ID NO: 9479884 - DNA, 22 bp, Homo sapiens
gctgcctgatttacatagtgaa

SEQ ID NO: 9479885 - DNA, 17 bp, Homo sapiens
gctgcctgcaactgact

SEQ ID NO: 9479886 - DNA, 17 bp, Homo sapiens
gctgcctgcaactgact

SEQ ID NO: 9479887 - DNA, 17 bp, Homo sapiens
gctgcctgcaactgact

SEQ ID NO: 9479888 - DNA, 22 bp, Homo sapiens
gctgcctgcacagagctgcttt

SEQ ID NO: 9479889 - DNA, 22 bp, Homo sapiens
gctgcctgatgtccagcaggac

SEQ ID NO: 9479890 - DNA, 22 bp, Homo sapiens
gctgcctgatgtccagcaggac

SEQ ID NO: 9479891 - DNA, 22 bp, Homo sapiens
gctgcctgatgtccagcaggac

SEQ ID NO: 9479892 - DNA, 22 bp, Homo sapiens
gctgcctgatgtccagcaggac

SEQ ID NO: 9479893 - DNA, 22 bp, Homo sapiens
gctgcctgatgtccagcaggac

SEQ ID NO: 9479894 - DNA, 22 bp, Homo sapiens
gctgcctgatttacatagtgaa

SEQ ID NO: 9479895 - DNA, 22 bp, Homo sapiens
caagaacattgtgatcacttca

SEQ ID NO: 9479896 - DNA, 22 bp, Homo sapiens
caagaacattgtgatcacttca

SEQ ID NO: 9479897 - DNA, 22 bp, Homo sapiens
caagaaccgcaattacttttgc

SEQ ID NO: 9479898 - DNA, 22 bp, Homo sapiens
caagaacagtttgccaaattgg

SEQ ID NO: 9479899 - DNA, 22 bp, Homo sapiens
caagaaattctgttcagatagc

SEQ ID NO: 9479900 - DNA, 22 bp, Homo sapiens
caagaaatttcttaagaactaa

SEQ ID NO: 9479901 - DNA, 22 bp, Homo sapiens
caacaatttcccagtttcccat

SEQ ID NO: 9479902 - DNA, 22 bp, Homo sapiens
caacacaggggttatgccatgg

SEQ ID NO: 9479903 - DNA, 22 bp, Homo sapiens
caacacattgaagctatgatga

SEQ ID NO: 9479904 - DNA, 22 bp, Homo sapiens
caacacaggttctgcaaaggaa

SEQ ID NO: 9479905 - DNA, 22 bp, Homo sapiens
caacacaggttctgcaaaggaa

SEQ ID NO: 9479906 - DNA, 22 bp, Homo sapiens
caactttagcaatgttagtata

SEQ ID NO: 9479907 - DNA, 22 bp, Homo sapiens
caactatagatcaaatgagttt

SEQ ID NO: 9479908 - DNA, 22 bp, Homo sapiens
caactttagaccccaagtagct

SEQ ID NO: 9479909 - DNA, 22 bp, Homo sapiens
caactttagaccccaagtagct

SEQ ID NO: 9479910 - DNA, 22 bp, Homo sapiens
caactacatccacactttgtta

SEQ ID NO: 9479911 - DNA, 22 bp, Homo sapiens
caacacattgaagctatgatga

SEQ ID NO: 9479912 - DNA, 22 bp, Homo sapiens
caacactgacaatggactgatt

SEQ ID NO: 9479913 - DNA, 22 bp, Homo sapiens
caacacattgaagctatgatga

SEQ ID NO: 9479914 - DNA, 22 bp, Homo sapiens
caacaccttgatcttggacttc

SEQ ID NO: 9479915 - DNA, 22 bp, Homo sapiens
caacaccttgatcttggacttc

SEQ ID NO: 9479916 - DNA, 22 bp, Homo sapiens
caacaagcgctcagagcaaagc

SEQ ID NO: 9479917 - DNA, 22 bp, Homo sapiens
caacaagtgggtactttacagg

SEQ ID NO: 9479918 - DNA, 22 bp, Homo sapiens
caacaagtgttcgtaaagtgcc

SEQ ID NO: 9479919 - DNA, 22 bp, Homo sapiens
caacaatatgctgagtttttca

SEQ ID NO: 9479920 - DNA, 22 bp, Homo sapiens
caaattttgtgtgttctctagt

SEQ ID NO: 9479921 - DNA, 22 bp, Homo sapiens
caacaagcgctcagagcaaagc

SEQ ID NO: 9479922 - DNA, 22 bp, Homo sapiens
caacaagcgctcagagcaaagc

SEQ ID NO: 9479923 - DNA, 22 bp, Homo sapiens
caaattttgtgtgttctctagt

SEQ ID NO: 9479924 - DNA, 22 bp, Homo sapiens
gctgccctgtctgcagcaggac

SEQ ID NO: 9479925 - DNA, 22 bp, Homo sapiens
caaatttaggtaacagtctgta

SEQ ID NO: 9479926 - DNA, 21 bp, Homo sapiens
gctgccctggctcagcattca

SEQ ID NO: 9479927 - DNA, 22 bp, Homo sapiens
gctgccctgtccggctctcctg

SEQ ID NO: 9479928 - DNA, 22 bp, Homo sapiens
gctctggactggggcctgagaa

SEQ ID NO: 9479929 - DNA, 22 bp, Homo sapiens
gctctggaccctggagtggctg

SEQ ID NO: 9479930 - DNA, 22 bp, Homo sapiens
gctctggaccctggagtggctg

SEQ ID NO: 9479931 - DNA, 22 bp, Homo sapiens
gctctggaccctgccagcctta

SEQ ID NO: 9479932 - DNA, 22 bp, Homo sapiens
gctctggagagccataggccct

SEQ ID NO: 9479933 - DNA, 22 bp, Homo sapiens
gctctggagagccataggccct

SEQ ID NO: 9479934 - DNA, 22 bp, Homo sapiens
gctctggagcactggaaacact

SEQ ID NO: 9479935 - DNA, 23 bp, Homo sapiens
gctctggagctgggcctggcagg

SEQ ID NO: 9479936 - DNA, 22 bp, Homo sapiens
gctctggagatggagccttgag

SEQ ID NO: 9479937 - DNA, 22 bp, Homo sapiens
gctctgcttgcatcatgactgc

SEQ ID NO: 9479938 - DNA, 22 bp, Homo sapiens
gctctgcttgcatcatgactgc

SEQ ID NO: 9479939 - DNA, 22 bp, Homo sapiens
gctctggaacctgccaggatgc

SEQ ID NO: 9479940 - DNA, 22 bp, Homo sapiens
gctctggaagcatctgagagga

SEQ ID NO: 9479941 - DNA, 22 bp, Homo sapiens
gctctggaagcatctgagagga

SEQ ID NO: 9479942 - DNA, 22 bp, Homo sapiens
gctctggaccctgccagcctta

SEQ ID NO: 9479943 - DNA, 22 bp, Homo sapiens
gctctggaagcatctgagagga

SEQ ID NO: 9479944 - DNA, 23 bp, Homo sapiens
gctctggagctgggcctggcagg

SEQ ID NO: 9479945 - DNA, 23 bp, Homo sapiens
gctctggagctgggcctggcagg

SEQ ID NO: 9479946 - DNA, 22 bp, Homo sapiens
gctctggagatggagccttgag

SEQ ID NO: 9479947 - DNA, 23 bp, Homo sapiens
gctctggagctgggcctggcagg

SEQ ID NO: 9479948 - DNA, 22 bp, Homo sapiens
gctctggatccggctgggtctg

SEQ ID NO: 9479949 - DNA, 22 bp, Homo sapiens
gctctggatccggctgggtctg

SEQ ID NO: 9479950 - DNA, 22 bp, Homo sapiens
gctctggatccggctgggtctg

SEQ ID NO: 9479951 - DNA, 17 bp, Homo sapiens
gctctggcacaggattg

SEQ ID NO: 9479952 - DNA, 22 bp, Homo sapiens
caaagtcagccagctagtaggt

SEQ ID NO: 9479953 - DNA, 22 bp, Homo sapiens
caaagtcataaaacttgtaagt

SEQ ID NO: 9479954 - DNA, 22 bp, Homo sapiens
caaagtcatggggatgcaggtc

SEQ ID NO: 9479955 - DNA, 22 bp, Homo sapiens
caaagtcataaaacttgtaagt

SEQ ID NO: 9479956 - DNA, 22 bp, Homo sapiens
caaagtcatggggatgcaggtc

SEQ ID NO: 9479957 - DNA, 22 bp, Homo sapiens
caaagtcatggggatgcaggtc

SEQ ID NO: 9479958 - DNA, 22 bp, Homo sapiens
caaagtcagccagctagtaggt

SEQ ID NO: 9479959 - DNA, 22 bp, Homo sapiens
caaagtcttcagttgattctga

SEQ ID NO: 9479960 - DNA, 22 bp, Homo sapiens
caaagtcctagaacagtgcttg

SEQ ID NO: 9479961 - DNA, 22 bp, Homo sapiens
caaagtcctagaacagtgcttg

SEQ ID NO: 9479962 - DNA, 22 bp, Homo sapiens
caaagtcccagctgcttagaga

SEQ ID NO: 9479963 - DNA, 21 bp, Homo sapiens
gctgccctggctcagcattca

SEQ ID NO: 9479964 - DNA, 22 bp, Homo sapiens
gctgccctgcctcagactcctc

SEQ ID NO: 9479965 - DNA, 22 bp, Homo sapiens
gctgccctgtccggctctcctg

SEQ ID NO: 9479966 - DNA, 22 bp, Homo sapiens
gctgccctgcctcagactcctc

SEQ ID NO: 9479967 - DNA, 22 bp, Homo sapiens
gctgccctgactccagcagcct

SEQ ID NO: 9479968 - DNA, 22 bp, Homo sapiens
gctgccctgacaagctactccc

SEQ ID NO: 9479969 - DNA, 22 bp, Homo sapiens
gctgccctgactccagcagcct

SEQ ID NO: 9479970 - DNA, 22 bp, Homo sapiens
gctgccctgactccagcagcct

SEQ ID NO: 9479971 - DNA, 22 bp, Homo sapiens
gctgccctgactccagcagcct

SEQ ID NO: 9479972 - DNA, 22 bp, Homo sapiens
gctgccctgcatctgtgccttc

SEQ ID NO: 9479973 - DNA, 22 bp, Homo sapiens
gctgccctctctggccccacac

SEQ ID NO: 9479974 - DNA, 22 bp, Homo sapiens
gctgccctcccagggcaagctt

SEQ ID NO: 9479975 - DNA, 22 bp, Homo sapiens
gctgccctctgtgtttgtcctt

SEQ ID NO: 9479976 - DNA, 22 bp, Homo sapiens
gctgccctctgtgacccggccc

SEQ ID NO: 9479977 - DNA, 22 bp, Homo sapiens
gctgccctgacaagctactccc

SEQ ID NO: 9479978 - DNA, 22 bp, Homo sapiens
gctgccctgacaagctactccc

SEQ ID NO: 9479979 - DNA, 22 bp, Homo sapiens
gctgccacgatctctgctgtag

SEQ ID NO: 9479980 - DNA, 22 bp, Homo sapiens
gctgccctccagttcccacagt

SEQ ID NO: 9479981 - DNA, 22 bp, Homo sapiens
caaagtgctaggattacaggcg

SEQ ID NO: 9479982 - DNA, 22 bp, Homo sapiens
caaagtgctaggattacaggcg

SEQ ID NO: 9479983 - DNA, 22 bp, Homo sapiens
caaagtgctaggattataggtg

SEQ ID NO: 9479984 - DNA, 22 bp, Homo sapiens
caaagtgctaggattacaggcg

SEQ ID NO: 9479985 - DNA, 22 bp, Homo sapiens
caaagtgctaggattataggtg

SEQ ID NO: 9479986 - DNA, 22 bp, Homo sapiens
caaagtgctaggattacaggcc

SEQ ID NO: 9479987 - DNA, 22 bp, Homo sapiens
caaagtgctaggattacaggcc

SEQ ID NO: 9479988 - DNA, 22 bp, Homo sapiens
caaagtgcctgtaccactttgc

SEQ ID NO: 9479989 - DNA, 22 bp, Homo sapiens
caaagtgctaggattacaggcg

SEQ ID NO: 9479990 - DNA, 22 bp, Homo sapiens
caaagtgctaggattacaggcc

SEQ ID NO: 9479991 - DNA, 22 bp, Homo sapiens
caaagtgctaggattacaggcc

SEQ ID NO: 9479992 - DNA, 22 bp, Homo sapiens
caaagtgagagaatggcagaaa

SEQ ID NO: 9479993 - DNA, 22 bp, Homo sapiens
caaagtgagagaatggcagaaa

SEQ ID NO: 9479994 - DNA, 22 bp, Homo sapiens
caaagtgcctgtaccactttgc

SEQ ID NO: 9479995 - DNA, 22 bp, Homo sapiens
caaagtgcagaaggaactgggt

SEQ ID NO: 9479996 - DNA, 22 bp, Homo sapiens
caaagtgcagaaggaactgggt

SEQ ID NO: 9479997 - DNA, 22 bp, Homo sapiens
caaagtgagttataaacatctt

SEQ ID NO: 9479998 - DNA, 22 bp, Homo sapiens
caaagtgcagaaggaactgggt

SEQ ID NO: 9479999 - DNA, 22 bp, Homo sapiens
gctggaaatgaatggagaggtg

SEQ ID NO: 9480000 - DNA, 22 bp, Homo sapiens
gctgctttgtgaaaatcattca

SEQ ID NO: 9480001 - DNA, 22 bp, Homo sapiens
gctggaaaaggaggcaaaatat

SEQ ID NO: 9480002 - DNA, 22 bp, Homo sapiens
gctgctttttggatttggcaca

SEQ ID NO: 9480003 - DNA, 22 bp, Homo sapiens
gctgctttgtctgtaaaatgga

SEQ ID NO: 9480004 - DNA, 22 bp, Homo sapiens
gctgctttgtctgtaaaatgga

SEQ ID NO: 9480005 - DNA, 22 bp, Homo sapiens
gctgctttgcagtagagtaata

SEQ ID NO: 9480006 - DNA, 22 bp, Homo sapiens
gctgctttgacagtgggaacag

SEQ ID NO: 9480007 - DNA, 22 bp, Homo sapiens
gctgctttctgttaggaattgg

SEQ ID NO: 9480008 - DNA, 22 bp, Homo sapiens
gctgctggccccacatgctcca

SEQ ID NO: 9480009 - DNA, 22 bp, Homo sapiens
gctgcctgccttgcctggagga

SEQ ID NO: 9480010 - DNA, 22 bp, Homo sapiens
gctgcctgcctagttccacagt

SEQ ID NO: 9480011 - DNA, 22 bp, Homo sapiens
gctgcctgcctgcatttaatcc

SEQ ID NO: 9480012 - DNA, 22 bp, Homo sapiens
gctgcctgcctagttccacagt

SEQ ID NO: 9480013 - DNA, 22 bp, Homo sapiens
gctgcctgcctagttccacagt

SEQ ID NO: 9480014 - DNA, 22 bp, Homo sapiens
gctgcctgccctgggtcatctg

SEQ ID NO: 9480015 - DNA, 21 bp, Homo sapiens
gctgcctgcccctcgggggct

SEQ ID NO: 9480016 - DNA, 21 bp, Homo sapiens
gctgcctgcccctcgggggct

SEQ ID NO: 9480017 - DNA, 18 bp, Homo sapiens
gctgcctgcattcctcac

SEQ ID NO: 9480018 - DNA, 18 bp, Homo sapiens
gctgcctgcattcctcac

SEQ ID NO: 9480019 - DNA, 22 bp, Homo sapiens
gctgcctgcagtgttttcccag

SEQ ID NO: 9480020 - DNA, 22 bp, Homo sapiens
gctgcctgcacagagctgcttt

SEQ ID NO: 9480021 - DNA, 22 bp, Homo sapiens
gctgcctgcagtgttttcccag

SEQ ID NO: 9480022 - DNA, 22 bp, Homo sapiens
gctgcctgcacagagctgcttt

SEQ ID NO: 9480023 - DNA, 22 bp, Homo sapiens
caagaatagctacctcccatat

SEQ ID NO: 9480024 - DNA, 22 bp, Homo sapiens
caagaatataaatactttcaaa

SEQ ID NO: 9480025 - DNA, 22 bp, Homo sapiens
caagaataaccagacaatagca

SEQ ID NO: 9480026 - DNA, 22 bp, Homo sapiens
caagaataaccagacaatagca

SEQ ID NO: 9480027 - DNA, 22 bp, Homo sapiens
caagaataaaatacatgttgat

SEQ ID NO: 9480028 - DNA, 22 bp, Homo sapiens
caagaataaaatacatgttgat

SEQ ID NO: 9480029 - DNA, 22 bp, Homo sapiens
caagaataaaatacatgttgat

SEQ ID NO: 9480030 - DNA, 22 bp, Homo sapiens
caagaattaagaattttgatgt

SEQ ID NO: 9480031 - DNA, 22 bp, Homo sapiens
caagaattaagaattttgatgt

SEQ ID NO: 9480032 - DNA, 19 bp, Homo sapiens
caagacaaagcccatcttc

SEQ ID NO: 9480033 - DNA, 22 bp, Homo sapiens
gctggcccagcgtggggccgtg

SEQ ID NO: 9480034 - DNA, 22 bp, Homo sapiens
gctggactagaagcagggctca

SEQ ID NO: 9480035 - DNA, 22 bp, Homo sapiens
gctggacccggcccctcacctc

SEQ ID NO: 9480036 - DNA, 22 bp, Homo sapiens
gctggacccggcccctcacctc

SEQ ID NO: 9480037 - DNA, 20 bp, Homo sapiens
gctggaagggctagagggct

SEQ ID NO: 9480038 - DNA, 22 bp, Homo sapiens
gctggaagtaaaaacttactag

SEQ ID NO: 9480039 - DNA, 22 bp, Homo sapiens
caagaagaggtgattggtaagt

SEQ ID NO: 9480040 - DNA, 17 bp, Homo sapiens
gctggctgacccatgcc

SEQ ID NO: 9480041 - DNA, 17 bp, Homo sapiens
gctggctgacccatgcc

SEQ ID NO: 9480042 - DNA, 22 bp, Homo sapiens
gctggctgagcactggtttata

SEQ ID NO: 9480043 - DNA, 22 bp, Homo sapiens
gctggctgagatctgttttcct

SEQ ID NO: 9480044 - DNA, 22 bp, Homo sapiens
gctggctgagcactggtttata

SEQ ID NO: 9480045 - DNA, 17 bp, Homo sapiens
gctggctgacccatgcc

SEQ ID NO: 9480046 - DNA, 22 bp, Homo sapiens
gctggctgaatcttctgcaata

SEQ ID NO: 9480047 - DNA, 22 bp, Homo sapiens
gctggctgaatcttctgcaata

SEQ ID NO: 9480048 - DNA, 22 bp, Homo sapiens
gctggctgaatcttctgcaata

SEQ ID NO: 9480049 - DNA, 22 bp, Homo sapiens
gctggctctttttgccgggctc

SEQ ID NO: 9480050 - DNA, 22 bp, Homo sapiens
gctggctcttcagtggagatag

SEQ ID NO: 9480051 - DNA, 22 bp, Homo sapiens
gctggcccagggtcacctagga

SEQ ID NO: 9480052 - DNA, 22 bp, Homo sapiens
gctggctctttttgccgggctc

SEQ ID NO: 9480053 - DNA, 22 bp, Homo sapiens
gctggctctttttgccgggctc

SEQ ID NO: 9480054 - DNA, 22 bp, Homo sapiens
caagccattctcctgcctcagc

SEQ ID NO: 9480055 - DNA, 22 bp, Homo sapiens
caagcccttccgggaacagttg

SEQ ID NO: 9480056 - DNA, 22 bp, Homo sapiens
caagccgacacacttccctttg

SEQ ID NO: 9480057 - DNA, 22 bp, Homo sapiens
caagccctgttaggggtctcta

SEQ ID NO: 9480058 - DNA, 20 bp, Homo sapiens
caagccctctttagcctgcc

SEQ ID NO: 9480059 - DNA, 22 bp, Homo sapiens
gctggctgaggtctagctcttt

SEQ ID NO: 9480060 - DNA, 22 bp, Homo sapiens
gctggctgaggtctagctcttt

SEQ ID NO: 9480061 - DNA, 22 bp, Homo sapiens
gctggctgaggtctagctcttt

SEQ ID NO: 9480062 - DNA, 22 bp, Homo sapiens
gctggctgaggtctagctcttt

SEQ ID NO: 9480063 - DNA, 22 bp, Homo sapiens
caagctctgcgggctccaagat

SEQ ID NO: 9480064 - DNA, 22 bp, Homo sapiens
caagctacttagaaagcacagt

SEQ ID NO: 9480065 - DNA, 22 bp, Homo sapiens
caagcctgtctcaccagtgcta

SEQ ID NO: 9480066 - DNA, 22 bp, Homo sapiens
caagcctgtctcaccagtgcta

SEQ ID NO: 9480067 - DNA, 22 bp, Homo sapiens
gctgggcttggtttccctgctt

SEQ ID NO: 9480068 - DNA, 22 bp, Homo sapiens
gctgggctcagacctagtgaac

SEQ ID NO: 9480069 - DNA, 22 bp, Homo sapiens
caagctctgggatgcagacatc

SEQ ID NO: 9480070 - DNA, 22 bp, Homo sapiens
caagctctgcgggctccaagat

SEQ ID NO: 9480071 - DNA, 22 bp, Homo sapiens
caagctctttaaacttatgtca

SEQ ID NO: 9480072 - DNA, 22 bp, Homo sapiens
gctgggctcaccaggccactag

SEQ ID NO: 9480073 - DNA, 22 bp, Homo sapiens
gctggggagaattgggttatct

SEQ ID NO: 9480074 - DNA, 22 bp, Homo sapiens
gctggggagcaagagtagtgag

SEQ ID NO: 9480075 - DNA, 22 bp, Homo sapiens
gctggggagcaagagtagtgag

SEQ ID NO: 9480076 - DNA, 22 bp, Homo sapiens
gctggggagcaagagtagtgag

SEQ ID NO: 9480077 - DNA, 22 bp, Homo sapiens
gctggggaccagctgtctctga

SEQ ID NO: 9480078 - DNA, 22 bp, Homo sapiens
gctggggaccagctgtctctga

SEQ ID NO: 9480079 - DNA, 20 bp, Homo sapiens
gctgggctttgactgacaca

SEQ ID NO: 9480080 - DNA, 22 bp, Homo sapiens
gctgggcttgtggccagctggg

SEQ ID NO: 9480081 - DNA, 22 bp, Homo sapiens
ggagaagggtatgtgtggcgga

SEQ ID NO: 9480082 - DNA, 22 bp, Homo sapiens
ggagaagggtatgtgtggcgga

SEQ ID NO: 9480083 - DNA, 22 bp, Homo sapiens
ggagaagggccaattccatgta

SEQ ID NO: 9480084 - DNA, 22 bp, Homo sapiens
ggagaagggtatgtgtggcgga

SEQ ID NO: 9480085 - DNA, 22 bp, Homo sapiens
ggagaaggtgctggtcactgtg

SEQ ID NO: 9480086 - DNA, 22 bp, Homo sapiens
ggagaaggtgctggtcactgtg

SEQ ID NO: 9480087 - DNA, 22 bp, Homo sapiens
ggagaaggtgctggtcactgtg

SEQ ID NO: 9480088 - DNA, 22 bp, Homo sapiens
ggagaagggacagactcagctt

SEQ ID NO: 9480089 - DNA, 22 bp, Homo sapiens
ggagaagggacagactcagctt

SEQ ID NO: 9480090 - DNA, 22 bp, Homo sapiens
ggagaagggacagactcagctt

SEQ ID NO: 9480091 - DNA, 22 bp, Homo sapiens
ggagaagggacagactcagctt

SEQ ID NO: 9480092 - DNA, 22 bp, Homo sapiens
ggagaagggacagactcagctt

SEQ ID NO: 9480093 - DNA, 22 bp, Homo sapiens
ggagaagggcatggtagtttta

SEQ ID NO: 9480094 - DNA, 22 bp, Homo sapiens
ggagaagggccaattccatgta

SEQ ID NO: 9480095 - DNA, 22 bp, Homo sapiens
ggagaagggccaattccatgta

SEQ ID NO: 9480096 - DNA, 22 bp, Homo sapiens
ggagagcagggtcctgagatac

SEQ ID NO: 9480097 - DNA, 22 bp, Homo sapiens
ggagagcagggtcctgagatac

SEQ ID NO: 9480098 - DNA, 22 bp, Homo sapiens
ggagagcagggaggctgctctg

SEQ ID NO: 9480099 - DNA, 22 bp, Homo sapiens
ggagagcagggaggctgctctg

SEQ ID NO: 9480100 - DNA, 22 bp, Homo sapiens
ggagagcagggaggctgctctg

SEQ ID NO: 9480101 - DNA, 22 bp, Homo sapiens
ggagagaggctggccgtgatga

SEQ ID NO: 9480102 - DNA, 22 bp, Homo sapiens
ggagagaggagcccactgctgt

SEQ ID NO: 9480103 - DNA, 22 bp, Homo sapiens
ggagagaggagcccactgctgt

SEQ ID NO: 9480104 - DNA, 22 bp, Homo sapiens
ggagaaggtggctcagcaaagg

SEQ ID NO: 9480105 - DNA, 22 bp, Homo sapiens
ggaccagagctcgggcttctca

SEQ ID NO: 9480106 - DNA, 22 bp, Homo sapiens
ggaccagctatcaatgccaggg

SEQ ID NO: 9480107 - DNA, 22 bp, Homo sapiens
ggaccagagctcgggcttctca

SEQ ID NO: 9480108 - DNA, 22 bp, Homo sapiens
ggaccagatgaagagttggagg

SEQ ID NO: 9480109 - DNA, 22 bp, Homo sapiens
ggaccagagggatgacatttgg

SEQ ID NO: 9480110 - DNA, 22 bp, Homo sapiens
ggaccagctatcaatgccaggg

SEQ ID NO: 9480111 - DNA, 22 bp, Homo sapiens
ggagaaggcgaagtcattcttt

SEQ ID NO: 9480112 - DNA, 22 bp, Homo sapiens
ggagaagggaactgagtttttg

SEQ ID NO: 9480113 - DNA, 22 bp, Homo sapiens
ggagaaggcgaagtcattcttt

SEQ ID NO: 9480114 - DNA, 22 bp, Homo sapiens
ggactgggtaggagcccagggc

SEQ ID NO: 9480115 - DNA, 22 bp, Homo sapiens
ggactgggtaggagcccagggc

SEQ ID NO: 9480116 - DNA, 22 bp, Homo sapiens
ggagaaggcacacccacctctg

SEQ ID NO: 9480117 - DNA, 22 bp, Homo sapiens
ggactgggtaggagcccagggc

SEQ ID NO: 9480118 - DNA, 21 bp, Homo sapiens
cacacagtggagtgcccttgc

SEQ ID NO: 9480119 - DNA, 22 bp, Homo sapiens
cacacagtggagtattactcag

SEQ ID NO: 9480120 - DNA, 22 bp, Homo sapiens
cacacagtggagtattactcag

SEQ ID NO: 9480121 - DNA, 22 bp, Homo sapiens
cacacagtggagtattactcag

SEQ ID NO: 9480122 - DNA, 22 bp, Homo sapiens
cacacaggtatatatatgtaca

SEQ ID NO: 9480123 - DNA, 22 bp, Homo sapiens
cacacagtaggcactcattaat

SEQ ID NO: 9480124 - DNA, 22 bp, Homo sapiens
cacacagtaggcactcattaat

SEQ ID NO: 9480125 - DNA, 22 bp, Homo sapiens
cacacagtagtatgaggcaaaa

SEQ ID NO: 9480126 - DNA, 22 bp, Homo sapiens
cacacagtagtatgaggcaaaa

SEQ ID NO: 9480127 - DNA, 22 bp, Homo sapiens
cacacagtagtatgaggcaaaa

SEQ ID NO: 9480128 - DNA, 22 bp, Homo sapiens
cacaaatgtagtagcttaaaac

SEQ ID NO: 9480129 - DNA, 23 bp, Homo sapiens
cacaactaatcagaatctctagg

SEQ ID NO: 9480130 - DNA, 23 bp, Homo sapiens
cacaactaatcagaatctctagg

SEQ ID NO: 9480131 - DNA, 22 bp, Homo sapiens
cacaaatggttgtagacattaa

SEQ ID NO: 9480132 - DNA, 22 bp, Homo sapiens
cacaaatggttgtagacattaa

SEQ ID NO: 9480133 - DNA, 20 bp, Homo sapiens
ggacaggaagacaacctacc

SEQ ID NO: 9480134 - DNA, 20 bp, Homo sapiens
ggacaggaagacaacctacc

SEQ ID NO: 9480135 - DNA, 22 bp, Homo sapiens
cacaacttagcagcttgaaaca

SEQ ID NO: 9480136 - DNA, 22 bp, Homo sapiens
cacaactgccatctgagcagca

SEQ ID NO: 9480137 - DNA, 23 bp, Homo sapiens
cacaactaatcagaatctctagg

SEQ ID NO: 9480138 - DNA, 22 bp, Homo sapiens
ggaccagagaagtgagcacctg

SEQ ID NO: 9480139 - DNA, 22 bp, Homo sapiens
ggacatttttcttcctacaatg

SEQ ID NO: 9480140 - DNA, 19 bp, Homo sapiens
ggacatttgagttgtttat

SEQ ID NO: 9480141 - DNA, 22 bp, Homo sapiens
ggacatttagtttcattgggca

SEQ ID NO: 9480142 - DNA, 22 bp, Homo sapiens
ggacatttcataagaccattct

SEQ ID NO: 9480143 - DNA, 22 bp, Homo sapiens
ggacatttagaacagagtattt

SEQ ID NO: 9480144 - DNA, 22 bp, Homo sapiens
ggacatggagcatgtagagaaa

SEQ ID NO: 9480145 - DNA, 22 bp, Homo sapiens
ggacatggaagtatggagtgga

SEQ ID NO: 9480146 - DNA, 22 bp, Homo sapiens
ggacatggagctccatggaggc

SEQ ID NO: 9480147 - DNA, 22 bp, Homo sapiens
ggacatggagctccatggaggc

SEQ ID NO: 9480148 - DNA, 22 bp, Homo sapiens
ggaagctccccaagcctgccct

SEQ ID NO: 9480149 - DNA, 22 bp, Homo sapiens
ggaagctccccaagcctgccct

SEQ ID NO: 9480150 - DNA, 22 bp, Homo sapiens
ggaagctgaacttagcaaggaa

SEQ ID NO: 9480151 - DNA, 22 bp, Homo sapiens
ggaagcctaaagcccaggtctc

SEQ ID NO: 9480152 - DNA, 23 bp, Homo sapiens
ggaagctcacgtagtcctgcact

SEQ ID NO: 9480153 - DNA, 22 bp, Homo sapiens
ggaagctgaacttagcaaggaa

SEQ ID NO: 9480154 - DNA, 22 bp, Homo sapiens
ggaagctgaatccagagacagg

SEQ ID NO: 9480155 - DNA, 22 bp, Homo sapiens
ggaagctggacaggctttgagt

SEQ ID NO: 9480156 - DNA, 22 bp, Homo sapiens
ggaagctgcataactagcgtgg

SEQ ID NO: 9480157 - DNA, 22 bp, Homo sapiens
ggaagctgcataactagcgtgg

SEQ ID NO: 9480158 - DNA, 22 bp, Homo sapiens
cacaaatccaatttaattctgg

SEQ ID NO: 9480159 - DNA, 22 bp, Homo sapiens
cacaaataccagtttcctaaca

SEQ ID NO: 9480160 - DNA, 22 bp, Homo sapiens
cacaaagttggacaacgcaccc

SEQ ID NO: 9480161 - DNA, 22 bp, Homo sapiens
cacaaataccagtttcctaaca

SEQ ID NO: 9480162 - DNA, 22 bp, Homo sapiens
cacaaataccagtttcctaaca

SEQ ID NO: 9480163 - DNA, 22 bp, Homo sapiens
cacaaataccagtttcctaaca

SEQ ID NO: 9480164 - DNA, 22 bp, Homo sapiens
ggaagctggcatatgtaatcct

SEQ ID NO: 9480165 - DNA, 22 bp, Homo sapiens
caatttcaggtggataggtttt

SEQ ID NO: 9480166 - DNA, 22 bp, Homo sapiens
caatttcactaataatatttac

SEQ ID NO: 9480167 - DNA, 22 bp, Homo sapiens
caatttcaatgaggccacaggg

SEQ ID NO: 9480168 - DNA, 22 bp, Homo sapiens
caatttcaatacaaaatacatt

SEQ ID NO: 9480169 - DNA, 22 bp, Homo sapiens
caatttcaatacaaaatacatt

SEQ ID NO: 9480170 - DNA, 18 bp, Homo sapiens
caatttcatccttaagcc

SEQ ID NO: 9480171 - DNA, 22 bp, Homo sapiens
caatttcattaatagatataga

SEQ ID NO: 9480172 - DNA, 22 bp, Homo sapiens
ggaagagcctggggtgtcaggc

SEQ ID NO: 9480173 - DNA, 22 bp, Homo sapiens
caatttcattaatagatataga

SEQ ID NO: 9480174 - DNA, 21 bp, Homo sapiens
caatttcatgggaagatggga

SEQ ID NO: 9480175 - DNA, 22 bp, Homo sapiens
caatccatcaattacacaggct

SEQ ID NO: 9480176 - DNA, 22 bp, Homo sapiens
caatgttttcaactgacaagta

SEQ ID NO: 9480177 - DNA, 22 bp, Homo sapiens
caatccatcaattacacaggct

SEQ ID NO: 9480178 - DNA, 22 bp, Homo sapiens
caatccatcaattacacaggct

SEQ ID NO: 9480179 - DNA, 22 bp, Homo sapiens
caatgttttgttgaatgaatag

SEQ ID NO: 9480180 - DNA, 22 bp, Homo sapiens
caattcatgttaaacagaagca

SEQ ID NO: 9480181 - DNA, 22 bp, Homo sapiens
caattcatgtgagcggactctt

SEQ ID NO: 9480182 - DNA, 22 bp, Homo sapiens
caattcatctgggtaggtagcc

SEQ ID NO: 9480183 - DNA, 22 bp, Homo sapiens
caattcaatggcaaagtattgt

SEQ ID NO: 9480184 - DNA, 22 bp, Homo sapiens
caattcatgggctgaggaaggg

SEQ ID NO: 9480185 - DNA, 22 bp, Homo sapiens
caatcacaaagagacaagtgtc

SEQ ID NO: 9480186 - DNA, 22 bp, Homo sapiens
caatcagatatgtgacatattt

SEQ ID NO: 9480187 - DNA, 22 bp, Homo sapiens
caatcagatatgtgacatattt

SEQ ID NO: 9480188 - DNA, 22 bp, Homo sapiens
caatcacaaagagacaagtgtc

SEQ ID NO: 9480189 - DNA, 22 bp, Homo sapiens
caattcccagctgccgggctgc

SEQ ID NO: 9480190 - DNA, 22 bp, Homo sapiens
caattcattacattgcaaagac

SEQ ID NO: 9480191 - DNA, 22 bp, Homo sapiens
caattcatgttaaacagaagca

SEQ ID NO: 9480192 - DNA, 19 bp, Homo sapiens
caattctattatcattcca

SEQ ID NO: 9480193 - DNA, 22 bp, Homo sapiens
caattctttcagctgcatttgt

SEQ ID NO: 9480194 - DNA, 19 bp, Homo sapiens
caattctgcaacactgtcc

SEQ ID NO: 9480195 - DNA, 19 bp, Homo sapiens
caattctgcaacactgtcc

SEQ ID NO: 9480196 - DNA, 22 bp, Homo sapiens
caattctgcaagtgactgacct

SEQ ID NO: 9480197 - DNA, 22 bp, Homo sapiens
caattgtattactgagcttata

SEQ ID NO: 9480198 - DNA, 22 bp, Homo sapiens
caattgtcagtgctgtttaaat

SEQ ID NO: 9480199 - DNA, 22 bp, Homo sapiens
caattgtcagtgctgtttaaat

SEQ ID NO: 9480200 - DNA, 22 bp, Homo sapiens
caattgacaatgacagtgtcaa

SEQ ID NO: 9480201 - DNA, 22 bp, Homo sapiens
caattgaacagatgagttaaat

SEQ ID NO: 9480202 - DNA, 22 bp, Homo sapiens
caataagatgtattgagcagag

SEQ ID NO: 9480203 - DNA, 22 bp, Homo sapiens
caataagtaataggcatctaat

SEQ ID NO: 9480204 - DNA, 22 bp, Homo sapiens
caatactgcatctttgcccttt

SEQ ID NO: 9480205 - DNA, 22 bp, Homo sapiens
caaggctgctggcttctgagct

SEQ ID NO: 9480206 - DNA, 22 bp, Homo sapiens
caaggctgcttcagactagtga

SEQ ID NO: 9480207 - DNA, 22 bp, Homo sapiens
caaggctggctcacaataatga

SEQ ID NO: 9480208 - DNA, 22 bp, Homo sapiens
caaggctgtgcagggtccatat

SEQ ID NO: 9480209 - DNA, 22 bp, Homo sapiens
caaggctgtctccagcttccaa

SEQ ID NO: 9480210 - DNA, 22 bp, Homo sapiens
caaggctctggaccaaatccca

SEQ ID NO: 9480211 - DNA, 22 bp, Homo sapiens
caaggccttcttgggagagatt

SEQ ID NO: 9480212 - DNA, 22 bp, Homo sapiens
caaggctaagctttggctttct

SEQ ID NO: 9480213 - DNA, 22 bp, Homo sapiens
caaggctagaagtccaacatca

SEQ ID NO: 9480214 - DNA, 22 bp, Homo sapiens
caaggctaccctttcaccaaaa

SEQ ID NO: 9480215 - DNA, 22 bp, Homo sapiens
caaggctaagctttggctttct

SEQ ID NO: 9480216 - DNA, 22 bp, Homo sapiens
caaggctataatgttgctggaa

SEQ ID NO: 9480217 - DNA, 22 bp, Homo sapiens
caaggctagcaagcagtagtca

SEQ ID NO: 9480218 - DNA, 22 bp, Homo sapiens
caaggctagaagtccaacatca

SEQ ID NO: 9480219 - DNA, 22 bp, Homo sapiens
gctggggagctagacctcagca

SEQ ID NO: 9480220 - DNA, 18 bp, Homo sapiens
caatagaaacagtaggaa

SEQ ID NO: 9480221 - DNA, 18 bp, Homo sapiens
caatagaaacagtaggaa

SEQ ID NO: 9480222 - DNA, 22 bp, Homo sapiens
caatagaaaactcaatacttaa

SEQ ID NO: 9480223 - DNA, 22 bp, Homo sapiens
caatagaaaactcaatacttaa

SEQ ID NO: 9480224 - DNA, 22 bp, Homo sapiens
caatagaaaactcaatacttaa

SEQ ID NO: 9480225 - DNA, 22 bp, Homo sapiens
caatagaaaactcaatacttaa

SEQ ID NO: 9480226 - DNA, 22 bp, Homo sapiens
caatactttagtaaaatggccc

SEQ ID NO: 9480227 - DNA, 22 bp, Homo sapiens
caatagagacctggattctccc

SEQ ID NO: 9480228 - DNA, 22 bp, Homo sapiens
caatagcagacctagaaagcaa

SEQ ID NO: 9480229 - DNA, 22 bp, Homo sapiens
caatagcagacctagaaagcaa

SEQ ID NO: 9480230 - DNA, 22 bp, Homo sapiens
caatagcagacctagaaagcaa

SEQ ID NO: 9480231 - DNA, 22 bp, Homo sapiens
caatagcagcttctgaatgcaa

SEQ ID NO: 9480232 - DNA, 22 bp, Homo sapiens
caatagcagcttctgaatgcaa

SEQ ID NO: 9480233 - DNA, 22 bp, Homo sapiens
caatagcaggtctacagagaga

SEQ ID NO: 9480234 - DNA, 20 bp, Homo sapiens
caatagaatgtggagataag

SEQ ID NO: 9480235 - DNA, 20 bp, Homo sapiens
caatagaatgtggagataag

SEQ ID NO: 9480236 - DNA, 22 bp, Homo sapiens
caatagaaggcacagataggta

SEQ ID NO: 9480237 - DNA, 22 bp, Homo sapiens
caatagtaaattacggaggaga

SEQ ID NO: 9480238 - DNA, 22 bp, Homo sapiens
caatagtaaattacggaggaga

SEQ ID NO: 9480239 - DNA, 22 bp, Homo sapiens
caatagcaggtctacagagaga

SEQ ID NO: 9480240 - DNA, 22 bp, Homo sapiens
caatagctaggctggtaaagga

SEQ ID NO: 9480241 - DNA, 22 bp, Homo sapiens
caatagttcggtcctgaaggcc

SEQ ID NO: 9480242 - DNA, 22 bp, Homo sapiens
caatagtgtctgcttgtttcta

SEQ ID NO: 9480243 - DNA, 22 bp, Homo sapiens
caatatataggaacaacttagg

SEQ ID NO: 9480244 - DNA, 19 bp, Homo sapiens
caatatatagtgagtggat

SEQ ID NO: 9480245 - DNA, 19 bp, Homo sapiens
caatatatagtgagtggat

SEQ ID NO: 9480246 - DNA, 22 bp, Homo sapiens
caatatataggaacaacttagg

SEQ ID NO: 9480247 - DNA, 22 bp, Homo sapiens
caatatataggaacaacttagg

SEQ ID NO: 9480248 - DNA, 22 bp, Homo sapiens
caatatataggaacaacttagg

SEQ ID NO: 9480249 - DNA, 22 bp, Homo sapiens
caatatataatgagtactttcc

SEQ ID NO: 9480250 - DNA, 22 bp, Homo sapiens
caatatataatgagtactttcc

SEQ ID NO: 9480251 - DNA, 18 bp, Homo sapiens
cagagcagaggtggagcg

SEQ ID NO: 9480252 - DNA, 17 bp, Homo sapiens
gggcagggactcctggg

SEQ ID NO: 9480253 - DNA, 22 bp, Homo sapiens
gggcaggggtagcattccaagt

SEQ ID NO: 9480254 - DNA, 22 bp, Homo sapiens
gggcaggggtagcattccaagt

SEQ ID NO: 9480255 - DNA, 22 bp, Homo sapiens
gggcaggggtagcattccaagt

SEQ ID NO: 9480256 - DNA, 22 bp, Homo sapiens
gggcaggggtcagtggccccaa

SEQ ID NO: 9480257 - DNA, 22 bp, Homo sapiens
gggcaggggtcagtggccccaa

SEQ ID NO: 9480258 - DNA, 22 bp, Homo sapiens
cagagcagacgttgagattaag

SEQ ID NO: 9480259 - DNA, 22 bp, Homo sapiens
cagagcagaaggtccaagcctg

SEQ ID NO: 9480260 - DNA, 18 bp, Homo sapiens
cagagcagaggtggagcg

SEQ ID NO: 9480261 - DNA, 22 bp, Homo sapiens
cagagcagaagcggtcctcaca

SEQ ID NO: 9480262 - DNA, 22 bp, Homo sapiens
cagagcagaagcggtcctcaca

SEQ ID NO: 9480263 - DNA, 22 bp, Homo sapiens
cagagcagaagcggtcctcaca

SEQ ID NO: 9480264 - DNA, 22 bp, Homo sapiens
cagagcagaaggtccaagcctg

SEQ ID NO: 9480265 - DNA, 22 bp, Homo sapiens
cagagcagaaggtccaagcctg

SEQ ID NO: 9480266 - DNA, 22 bp, Homo sapiens
cagagcagtgaggagttgtgta

SEQ ID NO: 9480267 - DNA, 22 bp, Homo sapiens
cagagcaggcccactgccctcc

SEQ ID NO: 9480268 - DNA, 22 bp, Homo sapiens
gggcaggtactgggtggtgagc

SEQ ID NO: 9480269 - DNA, 22 bp, Homo sapiens
gggcaggtacaagatgcttctt

SEQ ID NO: 9480270 - DNA, 22 bp, Homo sapiens
gggcaggtacaagatgcttctt

SEQ ID NO: 9480271 - DNA, 22 bp, Homo sapiens
gggcaggtacaagatgcttctt

SEQ ID NO: 9480272 - DNA, 22 bp, Homo sapiens
gggcaggtactgggtggtgagc

SEQ ID NO: 9480273 - DNA, 22 bp, Homo sapiens
gggcaggggtcagtggccccaa

SEQ ID NO: 9480274 - DNA, 22 bp, Homo sapiens
gggcaggggtcagtggccccaa

SEQ ID NO: 9480275 - DNA, 22 bp, Homo sapiens
gggcaggggtcagtggccccaa

SEQ ID NO: 9480276 - DNA, 22 bp, Homo sapiens
cagagccaaatgctgtggttat

SEQ ID NO: 9480277 - DNA, 20 bp, Homo sapiens
cagagccaagagcagcatct

SEQ ID NO: 9480278 - DNA, 22 bp, Homo sapiens
cagagccactgtctgccaggca

SEQ ID NO: 9480279 - DNA, 22 bp, Homo sapiens
cagagccactgcattttacagc

SEQ ID NO: 9480280 - DNA, 22 bp, Homo sapiens
cagagccacagcctccagattt

SEQ ID NO: 9480281 - DNA, 22 bp, Homo sapiens
cagagccacagcctccagattt

SEQ ID NO: 9480282 - DNA, 20 bp, Homo sapiens
cagagccaagagcagcatct

SEQ ID NO: 9480283 - DNA, 22 bp, Homo sapiens
cagagccaaaaccgtaacagcc

SEQ ID NO: 9480284 - DNA, 22 bp, Homo sapiens
cagagccaaaaccgtaacagcc

SEQ ID NO: 9480285 - DNA, 22 bp, Homo sapiens
cagagccaaacctcagggcccg

SEQ ID NO: 9480286 - DNA, 22 bp, Homo sapiens
cagagccaaacctcagggcccg

SEQ ID NO: 9480287 - DNA, 19 bp, Homo sapiens
cagagcagtggttcctgaa

SEQ ID NO: 9480288 - DNA, 22 bp, Homo sapiens
cagagcagtggagagtaggtct

SEQ ID NO: 9480289 - DNA, 22 bp, Homo sapiens
cagagcagtggggttggtcaga

SEQ ID NO: 9480290 - DNA, 22 bp, Homo sapiens
cagagcagtgaggagttgtgta

SEQ ID NO: 9480291 - DNA, 22 bp, Homo sapiens
cagagcagtgaggagttgtgta

SEQ ID NO: 9480292 - DNA, 20 bp, Homo sapiens
cagagcagtgcccaggcggc

SEQ ID NO: 9480293 - DNA, 22 bp, Homo sapiens
cagagcagtggagagtaggtct

SEQ ID NO: 9480294 - DNA, 20 bp, Homo sapiens
cagagcagtgcccaggcggc

SEQ ID NO: 9480295 - DNA, 20 bp, Homo sapiens
cagagcagtgcccaggcggc

SEQ ID NO: 9480296 - DNA, 22 bp, Homo sapiens
cagagaagagtctggcctctct

SEQ ID NO: 9480297 - DNA, 22 bp, Homo sapiens
cagagaagagtctggcctctct

SEQ ID NO: 9480298 - DNA, 22 bp, Homo sapiens
cagagaagaaagtgactataat

SEQ ID NO: 9480299 - DNA, 22 bp, Homo sapiens
cagagaagaaagtgactataat

SEQ ID NO: 9480300 - DNA, 22 bp, Homo sapiens
cagagaacttagctagttttcc

SEQ ID NO: 9480301 - DNA, 22 bp, Homo sapiens
cagagaagaaagtgactataat

SEQ ID NO: 9480302 - DNA, 22 bp, Homo sapiens
cagagaagagtctggcctctct

SEQ ID NO: 9480303 - DNA, 22 bp, Homo sapiens
cagagaagagtctggcctctct

SEQ ID NO: 9480304 - DNA, 20 bp, Homo sapiens
gggaggcattggtccctcac

SEQ ID NO: 9480305 - DNA, 20 bp, Homo sapiens
gggaggcattggtccctcac

SEQ ID NO: 9480306 - DNA, 20 bp, Homo sapiens
gggaggcattggtccctcac

SEQ ID NO: 9480307 - DNA, 22 bp, Homo sapiens
cagagaactccagtggctggcg

SEQ ID NO: 9480308 - DNA, 22 bp, Homo sapiens
cagagaactccagtggctggcg

SEQ ID NO: 9480309 - DNA, 22 bp, Homo sapiens
cagactgtgtctgaacctggtc

SEQ ID NO: 9480310 - DNA, 22 bp, Homo sapiens
cagactgtggcttcttggaggg

SEQ ID NO: 9480311 - DNA, 22 bp, Homo sapiens
cagagacacttaacaggaatgg

SEQ ID NO: 9480312 - DNA, 22 bp, Homo sapiens
cagagacacttaacaggaatgg

SEQ ID NO: 9480313 - DNA, 22 bp, Homo sapiens
cagagacacttaacaggaatgg

SEQ ID NO: 9480314 - DNA, 22 bp, Homo sapiens
cagagacacttaacaggaatgg

SEQ ID NO: 9480315 - DNA, 22 bp, Homo sapiens
gggatctgatttaggatgggag

SEQ ID NO: 9480316 - DNA, 22 bp, Homo sapiens
gggatctgctccagagggaaaa

SEQ ID NO: 9480317 - DNA, 22 bp, Homo sapiens
cagagacacttaacaggaatgg

SEQ ID NO: 9480318 - DNA, 22 bp, Homo sapiens
cagagacaatgtctctgcttgt

SEQ ID NO: 9480319 - DNA, 22 bp, Homo sapiens
cagagacaacctggtagagaaa

SEQ ID NO: 9480320 - DNA, 22 bp, Homo sapiens
cagagacaacctggtagagaaa

SEQ ID NO: 9480321 - DNA, 22 bp, Homo sapiens
cagagacaacctggtagagaaa

SEQ ID NO: 9480322 - DNA, 22 bp, Homo sapiens
cagagcacctgctcattgccag

SEQ ID NO: 9480323 - DNA, 22 bp, Homo sapiens
cagagcacctgctcattgccag

SEQ ID NO: 9480324 - DNA, 22 bp, Homo sapiens
cagagaggaggctatatgcaaa

SEQ ID NO: 9480325 - DNA, 22 bp, Homo sapiens
gggatgagagtagggtgtgaaa

SEQ ID NO: 9480326 - DNA, 22 bp, Homo sapiens
gggatgagagtagggtgtgaaa

SEQ ID NO: 9480327 - DNA, 22 bp, Homo sapiens
cagagaggaggctatatgcaaa

SEQ ID NO: 9480328 - DNA, 22 bp, Homo sapiens
cagagcagaaacctgggtgatt

SEQ ID NO: 9480329 - DNA, 22 bp, Homo sapiens
cagagcagaaacctgggtgatt

SEQ ID NO: 9480330 - DNA, 22 bp, Homo sapiens
cagagcagaagcggtcctcaca

SEQ ID NO: 9480331 - DNA, 22 bp, Homo sapiens
cagagcagaagcggtcctcaca

SEQ ID NO: 9480332 - DNA, 22 bp, Homo sapiens
cagagcagaagcggtcctcaca

SEQ ID NO: 9480333 - DNA, 22 bp, Homo sapiens
cagagcagaagcggtcctcaca

SEQ ID NO: 9480334 - DNA, 22 bp, Homo sapiens
gggatgagagtagggtgtgaaa

SEQ ID NO: 9480335 - DNA, 22 bp, Homo sapiens
gggatgagagctgggacagaag

SEQ ID NO: 9480336 - DNA, 22 bp, Homo sapiens
gggatgacaaagtgtctgtccc

SEQ ID NO: 9480337 - DNA, 22 bp, Homo sapiens
gggatgagagctgggacagaag

SEQ ID NO: 9480338 - DNA, 22 bp, Homo sapiens
gggatctgctccagagggaaaa

SEQ ID NO: 9480339 - DNA, 22 bp, Homo sapiens
gggatctggaattttggtatgt

SEQ ID NO: 9480340 - DNA, 22 bp, Homo sapiens
gggatctgggacaacaggtggt

SEQ ID NO: 9480341 - DNA, 23 bp, Homo sapiens
gggatctgtaaacctggagaacc

SEQ ID NO: 9480342 - DNA, 23 bp, Homo sapiens
gggatctgtaaacctggagaacc

SEQ ID NO: 9480343 - DNA, 23 bp, Homo sapiens
gggatctgtaagttgaagacaaa

SEQ ID NO: 9480344 - DNA, 23 bp, Homo sapiens
gggatctgtaagttgaagacaaa

SEQ ID NO: 9480345 - DNA, 22 bp, Homo sapiens
gggatctgtgttgcgatggatt

SEQ ID NO: 9480346 - DNA, 22 bp, Homo sapiens
gggatgaattgagtcagaaggg

SEQ ID NO: 9480347 - DNA, 22 bp, Homo sapiens
gggatgaattgagtcagaaggg

SEQ ID NO: 9480348 - DNA, 22 bp, Homo sapiens
gggagctgccttagaccggagg

SEQ ID NO: 9480349 - DNA, 22 bp, Homo sapiens
gggagctgccttagaccggagg

SEQ ID NO: 9480350 - DNA, 22 bp, Homo sapiens
gggagctgccaccacccctggg

SEQ ID NO: 9480351 - DNA, 22 bp, Homo sapiens
gggagctgccaccacccctggg

SEQ ID NO: 9480352 - DNA, 22 bp, Homo sapiens
gggagctgcggtcttgcgaaga

SEQ ID NO: 9480353 - DNA, 22 bp, Homo sapiens
gggagctgctgaacacaagggt

SEQ ID NO: 9480354 - DNA, 22 bp, Homo sapiens
gggagctgctgaacacaagggt

SEQ ID NO: 9480355 - DNA, 22 bp, Homo sapiens
gggagctgctgaacacaagggt

SEQ ID NO: 9480356 - DNA, 20 bp, Homo sapiens
gggagctggaattgtcttag

SEQ ID NO: 9480357 - DNA, 20 bp, Homo sapiens
gggagctggaattgtcttag

SEQ ID NO: 9480358 - DNA, 20 bp, Homo sapiens
gggagctggaattgtcttag

SEQ ID NO: 9480359 - DNA, 21 bp, Homo sapiens
gggagctggaaactgggtgac

SEQ ID NO: 9480360 - DNA, 21 bp, Homo sapiens
gggagctggaaactgggtgac

SEQ ID NO: 9480361 - DNA, 21 bp, Homo sapiens
gggagctggaaactgggtgac

SEQ ID NO: 9480362 - DNA, 21 bp, Homo sapiens
gggagctggaaactgggtgac

SEQ ID NO: 9480363 - DNA, 21 bp, Homo sapiens
gggagctggaaactgggtgac

SEQ ID NO: 9480364 - DNA, 22 bp, Homo sapiens
gggagctgctgaacacaagggt

SEQ ID NO: 9480365 - DNA, 22 bp, Homo sapiens
gggagctgctgaacacaagggt

SEQ ID NO: 9480366 - DNA, 22 bp, Homo sapiens
gggagctgctgaacacaagggt

SEQ ID NO: 9480367 - DNA, 22 bp, Homo sapiens
gggaggagtgaagattcacctg

SEQ ID NO: 9480368 - DNA, 22 bp, Homo sapiens
gggaggagggtgctggctaaac

SEQ ID NO: 9480369 - DNA, 22 bp, Homo sapiens
gggaggagtgaagattcacctg

SEQ ID NO: 9480370 - DNA, 22 bp, Homo sapiens
gggaggagggtgctggctaaac

SEQ ID NO: 9480371 - DNA, 22 bp, Homo sapiens
gggaggcacgaggcgcgcagtg

SEQ ID NO: 9480372 - DNA, 22 bp, Homo sapiens
gggaggcacgaggcgcgcagtg

SEQ ID NO: 9480373 - DNA, 22 bp, Homo sapiens
gggaggcatgtgttatccactt

SEQ ID NO: 9480374 - DNA, 22 bp, Homo sapiens
gggaggcagtgctggaggctgg

SEQ ID NO: 9480375 - DNA, 22 bp, Homo sapiens
gggaggcagtgctggaggctgg

SEQ ID NO: 9480376 - DNA, 22 bp, Homo sapiens
gggaggcagtgctggaggctgg

SEQ ID NO: 9480377 - DNA, 22 bp, Homo sapiens
gggaggcagtgctggaggctgg

SEQ ID NO: 9480378 - DNA, 22 bp, Homo sapiens
cagacacacaccctggcctagc

SEQ ID NO: 9480379 - DNA, 22 bp, Homo sapiens
cagacacacaccctggcctagc

SEQ ID NO: 9480380 - DNA, 22 bp, Homo sapiens
cagacacagatatgcatatggc

SEQ ID NO: 9480381 - DNA, 22 bp, Homo sapiens
cagacactattgtgtataaatc

SEQ ID NO: 9480382 - DNA, 22 bp, Homo sapiens
cagacactattgtgtataaatc

SEQ ID NO: 9480383 - DNA, 22 bp, Homo sapiens
cagacactatgctaaggtacta

SEQ ID NO: 9480384 - DNA, 18 bp, Homo sapiens
cagacactctgctctgca

SEQ ID NO: 9480385 - DNA, 18 bp, Homo sapiens
cagacactctgctctgca

SEQ ID NO: 9480386 - DNA, 22 bp, Homo sapiens
cagacactaggtgacagagtgc

SEQ ID NO: 9480387 - DNA, 22 bp, Homo sapiens
cagacactgcagcagtctccca

SEQ ID NO: 9480388 - DNA, 22 bp, Homo sapiens
cagacactgcagcagtctccca

SEQ ID NO: 9480389 - DNA, 22 bp, Homo sapiens
cagacacttattgagcaagtac

SEQ ID NO: 9480390 - DNA, 22 bp, Homo sapiens
cagacacttattgagcaagtac

SEQ ID NO: 9480391 - DNA, 22 bp, Homo sapiens
cagacagaaggaaggccaacat

SEQ ID NO: 9480392 - DNA, 22 bp, Homo sapiens
gggagctgcacacgccccggaa

SEQ ID NO: 9480393 - DNA, 22 bp, Homo sapiens
gggagctgatgatgtaagtccc

SEQ ID NO: 9480394 - DNA, 22 bp, Homo sapiens
gggagctgatgatgtaagtccc

SEQ ID NO: 9480395 - DNA, 22 bp, Homo sapiens
gggagctgatcaggtggattca

SEQ ID NO: 9480396 - DNA, 22 bp, Homo sapiens
gggagccaaggagagaggcctt

SEQ ID NO: 9480397 - DNA, 22 bp, Homo sapiens
gggagctgatcaggtggattca

SEQ ID NO: 9480398 - DNA, 22 bp, Homo sapiens
ggctggcaagtcagtgctgatg

SEQ ID NO: 9480399 - DNA, 22 bp, Homo sapiens
ggctggcaagtgtctgctcatg

SEQ ID NO: 9480400 - DNA, 22 bp, Homo sapiens
ggctggcaagtgtctgctcatg

SEQ ID NO: 9480401 - DNA, 22 bp, Homo sapiens
ggctggcacagagggctggtgt

SEQ ID NO: 9480402 - DNA, 22 bp, Homo sapiens
ggctggcacctgccctccgctg

SEQ ID NO: 9480403 - DNA, 22 bp, Homo sapiens
ggctggcacctgccctccgctg

SEQ ID NO: 9480404 - DNA, 22 bp, Homo sapiens
ggctggcactctgtccagtgtc

SEQ ID NO: 9480405 - DNA, 22 bp, Homo sapiens
ggctggcacgaagccctgctgg

SEQ ID NO: 9480406 - DNA, 22 bp, Homo sapiens
ggctggcacgaagccctgctgg

SEQ ID NO: 9480407 - DNA, 22 bp, Homo sapiens
ggctggcactgaggagagctct

SEQ ID NO: 9480408 - DNA, 22 bp, Homo sapiens
cagaaaatagagtttctctgag

SEQ ID NO: 9480409 - DNA, 22 bp, Homo sapiens
cagaaacactgtatttagggaa

SEQ ID NO: 9480410 - DNA, 22 bp, Homo sapiens
cagaaacactgtatttagggaa

SEQ ID NO: 9480411 - DNA, 22 bp, Homo sapiens
cagaaaatagagtttctctgag

SEQ ID NO: 9480412 - DNA, 22 bp, Homo sapiens
cagaaacacttgtagagaagtt

SEQ ID NO: 9480413 - DNA, 22 bp, Homo sapiens
cagaaacactgtatttagggaa

SEQ ID NO: 9480414 - DNA, 22 bp, Homo sapiens
cagaaacacttgtagagaagtt

SEQ ID NO: 9480415 - DNA, 22 bp, Homo sapiens
cagaaacacttgtagagaagtt

SEQ ID NO: 9480416 - DNA, 22 bp, Homo sapiens
cagaaacacttgtagagaagtt

SEQ ID NO: 9480417 - DNA, 22 bp, Homo sapiens
cagaaacacttgtagagaagtt

SEQ ID NO: 9480418 - DNA, 22 bp, Homo sapiens
cagaaacacttgtagagaagtt

SEQ ID NO: 9480419 - DNA, 22 bp, Homo sapiens
cagaaacacttgtagagaagtt

SEQ ID NO: 9480420 - DNA, 22 bp, Homo sapiens
cagaaacagacatgacgcagta

SEQ ID NO: 9480421 - DNA, 22 bp, Homo sapiens
cagaaacagacatgacgcagta

SEQ ID NO: 9480422 - DNA, 22 bp, Homo sapiens
cagaaacagacatgacgcagta

SEQ ID NO: 9480423 - DNA, 22 bp, Homo sapiens
cagaaacacttgtagagaagtt

SEQ ID NO: 9480424 - DNA, 22 bp, Homo sapiens
cagaaacagacatgacgcagta

SEQ ID NO: 9480425 - DNA, 22 bp, Homo sapiens
cagaaacagagaaatattggct

SEQ ID NO: 9480426 - DNA, 22 bp, Homo sapiens
cagaaacagacatgacgcagta

SEQ ID NO: 9480427 - DNA, 22 bp, Homo sapiens
cagaaacaggcaacgtgtgcac

SEQ ID NO: 9480428 - DNA, 22 bp, Homo sapiens
cagaaacaggcaacgtgtgcac

SEQ ID NO: 9480429 - DNA, 22 bp, Homo sapiens
cagaaacaggcaacgtgtgcac

SEQ ID NO: 9480430 - DNA, 22 bp, Homo sapiens
cagaataaaagtcccaaggcat

SEQ ID NO: 9480431 - DNA, 22 bp, Homo sapiens
cagaaacagagaaatattggct

SEQ ID NO: 9480432 - DNA, 22 bp, Homo sapiens
cagaaacagagaaatattggct

SEQ ID NO: 9480433 - DNA, 22 bp, Homo sapiens
cagaaacagagaaatattggct

SEQ ID NO: 9480434 - DNA, 22 bp, Homo sapiens
cagaataaaggtacaattgagt

SEQ ID NO: 9480435 - DNA, 22 bp, Homo sapiens
cagaatttaagtggattattct

SEQ ID NO: 9480436 - DNA, 22 bp, Homo sapiens
cagaatttaagtggattattct

SEQ ID NO: 9480437 - DNA, 22 bp, Homo sapiens
cagaatttaagtggattattct

SEQ ID NO: 9480438 - DNA, 22 bp, Homo sapiens
cagaatttaagtggattattct

SEQ ID NO: 9480439 - DNA, 22 bp, Homo sapiens
cagaattcgaatgagcagaatc

SEQ ID NO: 9480440 - DNA, 22 bp, Homo sapiens
cagaattatagttgctttttaa

SEQ ID NO: 9480441 - DNA, 22 bp, Homo sapiens
cagaattatagttgctttttaa

SEQ ID NO: 9480442 - DNA, 22 bp, Homo sapiens
cagaatttcagtgatgttttct

SEQ ID NO: 9480443 - DNA, 22 bp, Homo sapiens
cagaatttagcacaatgtatgg

SEQ ID NO: 9480444 - DNA, 22 bp, Homo sapiens
cagaatttagcacaatgtatgg

SEQ ID NO: 9480445 - DNA, 22 bp, Homo sapiens
cagaatttagaaaacaacataa

SEQ ID NO: 9480446 - DNA, 22 bp, Homo sapiens
cagaatttagaaaacaacataa

SEQ ID NO: 9480447 - DNA, 22 bp, Homo sapiens
cagaatttagaaaacaacataa

SEQ ID NO: 9480448 - DNA, 22 bp, Homo sapiens
cagaatttagaaaacaacataa

SEQ ID NO: 9480449 - DNA, 22 bp, Homo sapiens
cagaatttgaagtaatattcca

SEQ ID NO: 9480450 - DNA, 22 bp, Homo sapiens
cagaatttttcactcaatcttc

SEQ ID NO: 9480451 - DNA, 22 bp, Homo sapiens
cagaatttgaagtaatattcca

SEQ ID NO: 9480452 - DNA, 22 bp, Homo sapiens
cagaatttcagtgatgttttct

SEQ ID NO: 9480453 - DNA, 22 bp, Homo sapiens
cagacaaagcggaaactgttta

SEQ ID NO: 9480454 - DNA, 22 bp, Homo sapiens
cagacaaagcggaaactgttta

SEQ ID NO: 9480455 - DNA, 22 bp, Homo sapiens
cagacaaagcggaaactgttta

SEQ ID NO: 9480456 - DNA, 22 bp, Homo sapiens
cagacaactggactaagatcac

SEQ ID NO: 9480457 - DNA, 22 bp, Homo sapiens
cagacaaggccatctttcattt

SEQ ID NO: 9480458 - DNA, 22 bp, Homo sapiens
gggctgtgtactatgaggaggg

SEQ ID NO: 9480459 - DNA, 22 bp, Homo sapiens
gggctgtgtactatgaggaggg

SEQ ID NO: 9480460 - DNA, 22 bp, Homo sapiens
ggggagcttggttattcatgca

SEQ ID NO: 9480461 - DNA, 22 bp, Homo sapiens
gggctgtgtaatgtgctctttt

SEQ ID NO: 9480462 - DNA, 22 bp, Homo sapiens
gggctgtggagccgcgagggct

SEQ ID NO: 9480463 - DNA, 22 bp, Homo sapiens
gggctgtggagccgcgagggct

SEQ ID NO: 9480464 - DNA, 22 bp, Homo sapiens
gggctgtgctgagtaggaggtg

SEQ ID NO: 9480465 - DNA, 22 bp, Homo sapiens
gggctgtggagccgcgagggct

SEQ ID NO: 9480466 - DNA, 18 bp, Homo sapiens
gggctgtgagatgggaag

SEQ ID NO: 9480467 - DNA, 22 bp, Homo sapiens
gggctgtgaggtgagaacttac

SEQ ID NO: 9480468 - DNA, 22 bp, Homo sapiens
gggctgtgaggtgagaacttac

SEQ ID NO: 9480469 - DNA, 22 bp, Homo sapiens
gggctgtgcctcaggtggggtc

SEQ ID NO: 9480470 - DNA, 22 bp, Homo sapiens
gggctgtgcctcaggtggggtc

SEQ ID NO: 9480471 - DNA, 22 bp, Homo sapiens
gggctgtgcctcaggtggggtc

SEQ ID NO: 9480472 - DNA, 22 bp, Homo sapiens
gggctgtgcctcaggtggggtc

SEQ ID NO: 9480473 - DNA, 20 bp, Homo sapiens
gggctgtgcctcctcgtggt

SEQ ID NO: 9480474 - DNA, 22 bp, Homo sapiens
gggctgtccgcacatctggaat

SEQ ID NO: 9480475 - DNA, 22 bp, Homo sapiens
gggctgtcacgcccctgcacct

SEQ ID NO: 9480476 - DNA, 22 bp, Homo sapiens
gggctgtaggagctggaatggg

SEQ ID NO: 9480477 - DNA, 22 bp, Homo sapiens
gggctgtgagagtggggctgct

SEQ ID NO: 9480478 - DNA, 21 bp, Homo sapiens
gggctggatattggaaagagg

SEQ ID NO: 9480479 - DNA, 21 bp, Homo sapiens
gggctggatattggaaagagg

SEQ ID NO: 9480480 - DNA, 22 bp, Homo sapiens
gggctggagttgggaagacaaa

SEQ ID NO: 9480481 - DNA, 22 bp, Homo sapiens
gggctggagttgggaagacaaa

SEQ ID NO: 9480482 - DNA, 22 bp, Homo sapiens
gggctgtaggagctggaatggg

SEQ ID NO: 9480483 - DNA, 22 bp, Homo sapiens
gggctgtaggagctggaatggg

SEQ ID NO: 9480484 - DNA, 22 bp, Homo sapiens
gggctggatctcctgcaggcag

SEQ ID NO: 9480485 - DNA, 22 bp, Homo sapiens
gggctggatctcacgtgagacc

SEQ ID NO: 9480486 - DNA, 21 bp, Homo sapiens
cagagccagactgctgaattt

SEQ ID NO: 9480487 - DNA, 22 bp, Homo sapiens
cagagccacttggagatgagaa

SEQ ID NO: 9480488 - DNA, 22 bp, Homo sapiens
cagagccactgtctgccaggca

SEQ ID NO: 9480489 - DNA, 22 bp, Homo sapiens
cagagccactgtctgccaggca

SEQ ID NO: 9480490 - DNA, 22 bp, Homo sapiens
gggctgagtgggcctcttactt

SEQ ID NO: 9480491 - DNA, 22 bp, Homo sapiens
cagagccagcagtggggacagg

SEQ ID NO: 9480492 - DNA, 22 bp, Homo sapiens
cagagccagagacctgctgtgc

SEQ ID NO: 9480493 - DNA, 22 bp, Homo sapiens
gggctggaggaccggcctcgga

SEQ ID NO: 9480494 - DNA, 22 bp, Homo sapiens
gggctggaggaccggcctcgga

SEQ ID NO: 9480495 - DNA, 22 bp, Homo sapiens
gggctgagtgggcctcttactt

SEQ ID NO: 9480496 - DNA, 22 bp, Homo sapiens
gggctggagtcttctgaaagcc

SEQ ID NO: 9480497 - DNA, 22 bp, Homo sapiens
gggctggagtcttctgaaagcc

SEQ ID NO: 9480498 - DNA, 22 bp, Homo sapiens
gggctggaggtgagcaggacag

SEQ ID NO: 9480499 - DNA, 22 bp, Homo sapiens
gggctggaggtgagcaggacag

SEQ ID NO: 9480500 - DNA, 19 bp, Homo sapiens
gggctggagggatagagcc

SEQ ID NO: 9480501 - DNA, 22 bp, Homo sapiens
gggctggaggtgagcaggacag

SEQ ID NO: 9480502 - DNA, 22 bp, Homo sapiens
gggctggaggtgagcaggacag

SEQ ID NO: 9480503 - DNA, 22 bp, Homo sapiens
gggctggaggtgagcaggacag

SEQ ID NO: 9480504 - DNA, 19 bp, Homo sapiens
gggctggagggatagagcc

SEQ ID NO: 9480505 - DNA, 21 bp, Homo sapiens
gggctggaggatgggaagccc

SEQ ID NO: 9480506 - DNA, 21 bp, Homo sapiens
gggctggaggatgggaagccc

SEQ ID NO: 9480507 - DNA, 22 bp, Homo sapiens
gggctggaggcctgcctggtta

SEQ ID NO: 9480508 - DNA, 22 bp, Homo sapiens
gggctggaggagatccagaggc

SEQ ID NO: 9480509 - DNA, 21 bp, Homo sapiens
gggctggaggatgggaagccc

SEQ ID NO: 9480510 - DNA, 22 bp, Homo sapiens
ggggcagagtagctggggtgtg

SEQ ID NO: 9480511 - DNA, 22 bp, Homo sapiens
ggggcagagtagctggggtgtg

SEQ ID NO: 9480512 - DNA, 22 bp, Homo sapiens
ggggcagagtagctggggtgtg

SEQ ID NO: 9480513 - DNA, 22 bp, Homo sapiens
ggggcagagtagctggggtgtg

SEQ ID NO: 9480514 - DNA, 22 bp, Homo sapiens
ggggcagagcatagctccaatt

SEQ ID NO: 9480515 - DNA, 22 bp, Homo sapiens
ggggcagagcatagctccaatt

SEQ ID NO: 9480516 - DNA, 21 bp, Homo sapiens
ggggcagagctaggccctgca

SEQ ID NO: 9480517 - DNA, 21 bp, Homo sapiens
ggggcagagctaggccctgca

SEQ ID NO: 9480518 - DNA, 22 bp, Homo sapiens
ggggaggaagctctcagttcca

SEQ ID NO: 9480519 - DNA, 22 bp, Homo sapiens
ggggaggaagctctcagttcca

SEQ ID NO: 9480520 - DNA, 22 bp, Homo sapiens
ggggcagaagtagtgcccctga

SEQ ID NO: 9480521 - DNA, 22 bp, Homo sapiens
ggggcagagaataaaaacctaa

SEQ ID NO: 9480522 - DNA, 22 bp, Homo sapiens
ggggcagagagaaggaagcttg

SEQ ID NO: 9480523 - DNA, 22 bp, Homo sapiens
ggggcagagaataaaaacctaa

SEQ ID NO: 9480524 - DNA, 22 bp, Homo sapiens
ggggcagaagtagtgcccctga

SEQ ID NO: 9480525 - DNA, 22 bp, Homo sapiens
ggggcagagagaaggaagcttg

SEQ ID NO: 9480526 - DNA, 22 bp, Homo sapiens
ggggcagagagaaggaagcttg

SEQ ID NO: 9480527 - DNA, 22 bp, Homo sapiens
ggggcagctaccggaagtaggg

SEQ ID NO: 9480528 - DNA, 22 bp, Homo sapiens
ggggcagctaccggaagtaggg

SEQ ID NO: 9480529 - DNA, 22 bp, Homo sapiens
ggggcagatggaacagagcaca

SEQ ID NO: 9480530 - DNA, 22 bp, Homo sapiens
ggggcagatggaacagagcaca

SEQ ID NO: 9480531 - DNA, 22 bp, Homo sapiens
ggggcagatggaacagagcaca

SEQ ID NO: 9480532 - DNA, 22 bp, Homo sapiens
ggggcagagtctggactgttgt

SEQ ID NO: 9480533 - DNA, 22 bp, Homo sapiens
ggggcagagtctggactgttgt

SEQ ID NO: 9480534 - DNA, 22 bp, Homo sapiens
ggggcagagtctggactgttgt

SEQ ID NO: 9480535 - DNA, 23 bp, Homo sapiens
ggggcctgcaccggtctgcgcgg

SEQ ID NO: 9480536 - DNA, 22 bp, Homo sapiens
ggggcctcgccgccgcctctgc

SEQ ID NO: 9480537 - DNA, 21 bp, Homo sapiens
ggggttggcaagagcagagac

SEQ ID NO: 9480538 - DNA, 20 bp, Homo sapiens
ggggttggctggcacaggga

SEQ ID NO: 9480539 - DNA, 20 bp, Homo sapiens
ggggttggctggcacaggga

SEQ ID NO: 9480540 - DNA, 20 bp, Homo sapiens
ggggttggctggcacaggga

SEQ ID NO: 9480541 - DNA, 22 bp, Homo sapiens
gggtaatgtgcactgaagggtg

SEQ ID NO: 9480542 - DNA, 22 bp, Homo sapiens
gggtaatgaacaggtggcagag

SEQ ID NO: 9480543 - DNA, 22 bp, Homo sapiens
gggtacagccgttggttgccgg

SEQ ID NO: 9480544 - DNA, 22 bp, Homo sapiens
ggggcctgtagagcttcaggga

SEQ ID NO: 9480545 - DNA, 22 bp, Homo sapiens
ggggcctgcgaggttcaacttc

SEQ ID NO: 9480546 - DNA, 22 bp, Homo sapiens
ggggccttggatctgtgccccg

SEQ ID NO: 9480547 - DNA, 19 bp, Homo sapiens
ggggcctgtgatggtcaca

SEQ ID NO: 9480548 - DNA, 22 bp, Homo sapiens
ggggtgagctgggcctgtgcct

SEQ ID NO: 9480549 - DNA, 22 bp, Homo sapiens
ggggtgaggtttatgttctggg

SEQ ID NO: 9480550 - DNA, 22 bp, Homo sapiens
ggggccttttctgaatgtggaa

SEQ ID NO: 9480551 - DNA, 22 bp, Homo sapiens
ggggtgagctgggcctgtgcct

SEQ ID NO: 9480552 - DNA, 22 bp, Homo sapiens
ggggccttggatctgtgccccg

SEQ ID NO: 9480553 - DNA, 22 bp, Homo sapiens
cagatgcaggtctgctcacctg

SEQ ID NO: 9480554 - DNA, 22 bp, Homo sapiens
cagatgcagcaaaatgacaggc

SEQ ID NO: 9480555 - DNA, 22 bp, Homo sapiens
cagatgcagcaaaatgacaggc

SEQ ID NO: 9480556 - DNA, 19 bp, Homo sapiens
ggtcctcagcagagcatgc

SEQ ID NO: 9480557 - DNA, 22 bp, Homo sapiens
ggtcctcaatcccaacaaggca

SEQ ID NO: 9480558 - DNA, 22 bp, Homo sapiens
ggtcctgaggggagctgaaggt

SEQ ID NO: 9480559 - DNA, 22 bp, Homo sapiens
ggtcctggaagtgtaagtggca

SEQ ID NO: 9480560 - DNA, 22 bp, Homo sapiens
ggtcctggaagtgtaagtggca

SEQ ID NO: 9480561 - DNA, 22 bp, Homo sapiens
ggtcctggatgagacaggtagt

SEQ ID NO: 9480562 - DNA, 22 bp, Homo sapiens
ggtcctggcagctctgtgtcca

SEQ ID NO: 9480563 - DNA, 22 bp, Homo sapiens
ggtcctggcagctctgtgtcca

SEQ ID NO: 9480564 - DNA, 22 bp, Homo sapiens
ggtcctggaaattgacggaaag

SEQ ID NO: 9480565 - DNA, 22 bp, Homo sapiens
ggtcctggaagtgtaagtggca

SEQ ID NO: 9480566 - DNA, 22 bp, Homo sapiens
ggtcctgctggctcagctgagc

SEQ ID NO: 9480567 - DNA, 22 bp, Homo sapiens
cagatgtggaatgcagcaggct

SEQ ID NO: 9480568 - DNA, 22 bp, Homo sapiens
cagattaacacggagcttaaca

SEQ ID NO: 9480569 - DNA, 22 bp, Homo sapiens
cagatggcacagatttagagtg

SEQ ID NO: 9480570 - DNA, 22 bp, Homo sapiens
cagatggcacagatttagagtg

SEQ ID NO: 9480571 - DNA, 22 bp, Homo sapiens
cagatggcaacagctctgtgac

SEQ ID NO: 9480572 - DNA, 22 bp, Homo sapiens
ggtcctggcagtctttggttgt

SEQ ID NO: 9480573 - DNA, 22 bp, Homo sapiens
ggtatttactgagagccactct

SEQ ID NO: 9480574 - DNA, 22 bp, Homo sapiens
ggtatttatagtggtgcttagt

SEQ ID NO: 9480575 - DNA, 22 bp, Homo sapiens
ggtatttatatgtctgaagctg

SEQ ID NO: 9480576 - DNA, 22 bp, Homo sapiens
ggtcaacagaggtaatggtaac

SEQ ID NO: 9480577 - DNA, 22 bp, Homo sapiens
ggtcaaagggtgagatggcagg

SEQ ID NO: 9480578 - DNA, 22 bp, Homo sapiens
ggtcaaagttgaagaagggcat

SEQ ID NO: 9480579 - DNA, 18 bp, Homo sapiens
ggtcaagaaagtaaggca

SEQ ID NO: 9480580 - DNA, 22 bp, Homo sapiens
ggtcaagtaacaaatcaggagc

SEQ ID NO: 9480581 - DNA, 19 bp, Homo sapiens
ggtcacaaggagttgtgaa

SEQ ID NO: 9480582 - DNA, 22 bp, Homo sapiens
cagatatgctgagactcctgtg

SEQ ID NO: 9480583 - DNA, 22 bp, Homo sapiens
cagatatattttccttattagg

SEQ ID NO: 9480584 - DNA, 22 bp, Homo sapiens
ggtcacagctttttcagcagca

SEQ ID NO: 9480585 - DNA, 22 bp, Homo sapiens
cagatgagggctggaggtgagc

SEQ ID NO: 9480586 - DNA, 23 bp, Homo sapiens
cagatgaggttggcagcatggtc

SEQ ID NO: 9480587 - DNA, 22 bp, Homo sapiens
cagatgaggacagatgactggg

SEQ ID NO: 9480588 - DNA, 22 bp, Homo sapiens
cagatgagagtggccagggttc

SEQ ID NO: 9480589 - DNA, 22 bp, Homo sapiens
cagatgagcatgggcacaagca

SEQ ID NO: 9480590 - DNA, 19 bp, Homo sapiens
cagatgagaaaagtgaggt

SEQ ID NO: 9480591 - DNA, 19 bp, Homo sapiens
cagatgagaaaagtgaggt

SEQ ID NO: 9480592 - DNA, 19 bp, Homo sapiens
cagatgagaaaagtgaggt

SEQ ID NO: 9480593 - DNA, 22 bp, Homo sapiens
cagatgaccgtcttccagccag

SEQ ID NO: 9480594 - DNA, 22 bp, Homo sapiens
cagatgaagtttgcctagagct

SEQ ID NO: 9480595 - DNA, 22 bp, Homo sapiens
cagatgaagtattacagacatt

SEQ ID NO: 9480596 - DNA, 22 bp, Homo sapiens
gggtacagttcttccagtgtca

SEQ ID NO: 9480597 - DNA, 22 bp, Homo sapiens
gggtagcatgtgtcagagtttg

SEQ ID NO: 9480598 - DNA, 22 bp, Homo sapiens
gggtaggaaatccagaggtggc

SEQ ID NO: 9480599 - DNA, 22 bp, Homo sapiens
gggtccaggtcttcaggcagag

SEQ ID NO: 9480600 - DNA, 22 bp, Homo sapiens
gggtccaggtcttcaggcagag

SEQ ID NO: 9480601 - DNA, 22 bp, Homo sapiens
gggtccaggtcttcaggcagag

SEQ ID NO: 9480602 - DNA, 22 bp, Homo sapiens
gggtccagtttcatctgaggtt

SEQ ID NO: 9480603 - DNA, 22 bp, Homo sapiens
gggtccagtttcatctgaggtt

SEQ ID NO: 9480604 - DNA, 20 bp, Homo sapiens
gggtcctgacttggtctcct

SEQ ID NO: 9480605 - DNA, 22 bp, Homo sapiens
gggtccctggaattacttgaca

SEQ ID NO: 9480606 - DNA, 18 bp, Homo sapiens
gggtccccagctgcaggg

SEQ ID NO: 9480607 - DNA, 20 bp, Homo sapiens
gggtccctccggcctgctat

SEQ ID NO: 9480608 - DNA, 20 bp, Homo sapiens
gggtccctccggcctgctat

SEQ ID NO: 9480609 - DNA, 20 bp, Homo sapiens
gggtccctccggcctgctat

SEQ ID NO: 9480610 - DNA, 22 bp, Homo sapiens
gggtccctcgttctgggatctg

SEQ ID NO: 9480611 - DNA, 22 bp, Homo sapiens
gggtccctcgcaggcgtcgccg

SEQ ID NO: 9480612 - DNA, 18 bp, Homo sapiens
gggtcctgttcttggaag

SEQ ID NO: 9480613 - DNA, 18 bp, Homo sapiens
gggtcctgtgggagacag

SEQ ID NO: 9480614 - DNA, 18 bp, Homo sapiens
gggtcctgtgggagacag

SEQ ID NO: 9480615 - DNA, 22 bp, Homo sapiens
gggtcctggaatctgcatttta

SEQ ID NO: 9480616 - DNA, 22 bp, Homo sapiens
gggtcctgcgtgggcccaggac

SEQ ID NO: 9480617 - DNA, 21 bp, Homo sapiens
gggtcctgggatgggatccag

SEQ ID NO: 9480618 - DNA, 22 bp, Homo sapiens
gggttaggtccctcccttctgg

SEQ ID NO: 9480619 - DNA, 18 bp, Homo sapiens
gggttcacctgcctttgg

SEQ ID NO: 9480620 - DNA, 22 bp, Homo sapiens
gggtgtgttcctaaggaaacca

SEQ ID NO: 9480621 - DNA, 22 bp, Homo sapiens
gggtgtttatgtattatgatgt

SEQ ID NO: 9480622 - DNA, 22 bp, Homo sapiens
gggtgtttatgtattatgatgt

SEQ ID NO: 9480623 - DNA, 22 bp, Homo sapiens
gggtgttgattttacactaaaa

SEQ ID NO: 9480624 - DNA, 20 bp, Homo sapiens
gggtgtgggcccggccaggc

SEQ ID NO: 9480625 - DNA, 20 bp, Homo sapiens
gggtgtgtgcagggcctggt

SEQ ID NO: 9480626 - DNA, 20 bp, Homo sapiens
gggtgtgggcccggccaggc

SEQ ID NO: 9480627 - DNA, 22 bp, Homo sapiens
gggtgtgtcttttgctcctgga

SEQ ID NO: 9480628 - DNA, 22 bp, Homo sapiens
gggtgtgcaggtcatggcgtct

SEQ ID NO: 9480629 - DNA, 22 bp, Homo sapiens
ggtataaatgatcagatcgctg

SEQ ID NO: 9480630 - DNA, 22 bp, Homo sapiens
ggtatagtattatttgaaagag

SEQ ID NO: 9480631 - DNA, 22 bp, Homo sapiens
ggtatggagtctgagtttctag

SEQ ID NO: 9480632 - DNA, 22 bp, Homo sapiens
ggtatggatcagatgggctcaa

SEQ ID NO: 9480633 - DNA, 22 bp, Homo sapiens
ggtatggatcagatgggctcaa

SEQ ID NO: 9480634 - DNA, 22 bp, Homo sapiens
gggttccctgcctggccactct

SEQ ID NO: 9480635 - DNA, 22 bp, Homo sapiens
gggttcttatagtatcagagct

SEQ ID NO: 9480636 - DNA, 22 bp, Homo sapiens
gggttccctgcctggccactct

SEQ ID NO: 9480637 - DNA, 22 bp, Homo sapiens
gggttccagtctgaaactacag

SEQ ID NO: 9480638 - DNA, 22 bp, Homo sapiens
gggttccaatgatgagcaagag

SEQ ID NO: 9480639 - DNA, 22 bp, Homo sapiens
gggttccaaacatagtcttcct

SEQ ID NO: 9480640 - DNA, 22 bp, Homo sapiens
gggttcagtccctcttgctact

SEQ ID NO: 9480641 - DNA, 22 bp, Homo sapiens
cagccctcctaccctgccaggc

SEQ ID NO: 9480642 - DNA, 20 bp, Homo sapiens
cagccctccagtggaggcag

SEQ ID NO: 9480643 - DNA, 22 bp, Homo sapiens
cagccctcctaccctgccaggc

SEQ ID NO: 9480644 - DNA, 22 bp, Homo sapiens
cagccctcctaccctgccaggc

SEQ ID NO: 9480645 - DNA, 22 bp, Homo sapiens
cagccctcctttcactcccagg

SEQ ID NO: 9480646 - DNA, 22 bp, Homo sapiens
cagccctctgaagaggcgcttg

SEQ ID NO: 9480647 - DNA, 22 bp, Homo sapiens
cagccctcctttcactcccagg

SEQ ID NO: 9480648 - DNA, 22 bp, Homo sapiens
cagccctctctgggccccaagg

SEQ ID NO: 9480649 - DNA, 22 bp, Homo sapiens
cagccctgaaacaacctcctct

SEQ ID NO: 9480650 - DNA, 19 bp, Homo sapiens
cagccctcttaccactgtg

SEQ ID NO: 9480651 - DNA, 19 bp, Homo sapiens
cagccctcttaccactgtg

SEQ ID NO: 9480652 - DNA, 22 bp, Homo sapiens
gtgagcagagatcgcgtgattg

SEQ ID NO: 9480653 - DNA, 23 bp, Homo sapiens
gtgagcagcaccatgaggctaga

SEQ ID NO: 9480654 - DNA, 23 bp, Homo sapiens
gtgagcagcaccatgaggctaga

SEQ ID NO: 9480655 - DNA, 23 bp, Homo sapiens
gtgagcagcaccatgaggctaga

SEQ ID NO: 9480656 - DNA, 22 bp, Homo sapiens
cagccctcatcccgcctgcgtt

SEQ ID NO: 9480657 - DNA, 22 bp, Homo sapiens
cagccctcatcccgcctgcgtt

SEQ ID NO: 9480658 - DNA, 22 bp, Homo sapiens
cagccctcatcccgcctgcgtt

SEQ ID NO: 9480659 - DNA, 22 bp, Homo sapiens
cagccctcatctcagcttcttt

SEQ ID NO: 9480660 - DNA, 22 bp, Homo sapiens
cagccctcatcccgcctgcgtt

SEQ ID NO: 9480661 - DNA, 22 bp, Homo sapiens
cagccctcatctcagcttcttt

SEQ ID NO: 9480662 - DNA, 18 bp, Homo sapiens
gtgagcagagagcatcac

SEQ ID NO: 9480663 - DNA, 22 bp, Homo sapiens
gtgagcagacatcaaaggctgc

SEQ ID NO: 9480664 - DNA, 18 bp, Homo sapiens
gtgagcagagagcatcac

SEQ ID NO: 9480665 - DNA, 22 bp, Homo sapiens
gtgagcagaataagggttgaga

SEQ ID NO: 9480666 - DNA, 22 bp, Homo sapiens
gtgagcagaacaggtggcttct

SEQ ID NO: 9480667 - DNA, 22 bp, Homo sapiens
gtgagattccttagattcatgg

SEQ ID NO: 9480668 - DNA, 22 bp, Homo sapiens
gtgagcaaaggttaaacattta

SEQ ID NO: 9480669 - DNA, 22 bp, Homo sapiens
gtgagagtgtttggaaatagaa

SEQ ID NO: 9480670 - DNA, 22 bp, Homo sapiens
gtgagagtggtttatgtccatg

SEQ ID NO: 9480671 - DNA, 22 bp, Homo sapiens
gtgagagtaccacctcaacatc

SEQ ID NO: 9480672 - DNA, 22 bp, Homo sapiens
gtgagatggagttggtgtcttt

SEQ ID NO: 9480673 - DNA, 22 bp, Homo sapiens
gtgagagtgtttggaaatagaa

SEQ ID NO: 9480674 - DNA, 22 bp, Homo sapiens
gtgaattaggctatggcagagg

SEQ ID NO: 9480675 - DNA, 22 bp, Homo sapiens
gtgaattaggacaaaagggctt

SEQ ID NO: 9480676 - DNA, 22 bp, Homo sapiens
gtgaattacatgtatttttaag

SEQ ID NO: 9480677 - DNA, 22 bp, Homo sapiens
gtcctgtgcctggccaaaagct

SEQ ID NO: 9480678 - DNA, 22 bp, Homo sapiens
gtcctgtgccctgggtggcgct

SEQ ID NO: 9480679 - DNA, 22 bp, Homo sapiens
gtcctgtgccctgggtggcgct

SEQ ID NO: 9480680 - DNA, 22 bp, Homo sapiens
gtcctgtgcaccgtgggatgtt

SEQ ID NO: 9480681 - DNA, 22 bp, Homo sapiens
gtcctgtgcccagaccctctgt

SEQ ID NO: 9480682 - DNA, 22 bp, Homo sapiens
gtgagagatgctttcttaacgc

SEQ ID NO: 9480683 - DNA, 22 bp, Homo sapiens
gtgaatttctgactaaaagtgc

SEQ ID NO: 9480684 - DNA, 22 bp, Homo sapiens
gtgagagatcccccactcatct

SEQ ID NO: 9480685 - DNA, 22 bp, Homo sapiens
gtgagagcctgtctggatgtcg

SEQ ID NO: 9480686 - DNA, 22 bp, Homo sapiens
gtgagagctcagctgccctggg

SEQ ID NO: 9480687 - DNA, 22 bp, Homo sapiens
gtgagagctgctagactgttat

SEQ ID NO: 9480688 - DNA, 22 bp, Homo sapiens
gtgagagggctgggctcatgat

SEQ ID NO: 9480689 - DNA, 22 bp, Homo sapiens
gtgagagctcagctgccctggg

SEQ ID NO: 9480690 - DNA, 22 bp, Homo sapiens
gtgagagggctgggctcatgat

SEQ ID NO: 9480691 - DNA, 22 bp, Homo sapiens
gtcctggtagggctctgtgtct

SEQ ID NO: 9480692 - DNA, 22 bp, Homo sapiens
gtcctggtataattgtttaaaa

SEQ ID NO: 9480693 - DNA, 22 bp, Homo sapiens
gtcctggtataattgtttaaaa

SEQ ID NO: 9480694 - DNA, 22 bp, Homo sapiens
gtcctggtgaggtagtgggagg

SEQ ID NO: 9480695 - DNA, 22 bp, Homo sapiens
gtcctggtcctgcctccccatg

SEQ ID NO: 9480696 - DNA, 17 bp, Homo sapiens
gtcctggtgtgtgagga

SEQ ID NO: 9480697 - DNA, 22 bp, Homo sapiens
gtcctggtgccacctgcgggat

SEQ ID NO: 9480698 - DNA, 22 bp, Homo sapiens
gtcctggtgctggtcattgtcg

SEQ ID NO: 9480699 - DNA, 22 bp, Homo sapiens
gtcctgtgatgagtaccaggtg

SEQ ID NO: 9480700 - DNA, 22 bp, Homo sapiens
gtcctgtgagattcatgctcaa

SEQ ID NO: 9480701 - DNA, 22 bp, Homo sapiens
gtcctgtgacctgcatcctgag

SEQ ID NO: 9480702 - DNA, 22 bp, Homo sapiens
gtcctgtgacctgcatcctgag

SEQ ID NO: 9480703 - DNA, 22 bp, Homo sapiens
gtcctgtgacctgcatcctgag

SEQ ID NO: 9480704 - DNA, 21 bp, Homo sapiens
gtcctgtagctgtctggtctt

SEQ ID NO: 9480705 - DNA, 22 bp, Homo sapiens
gtcctggttttcacagaccttt

SEQ ID NO: 9480706 - DNA, 22 bp, Homo sapiens
gtcctgtgacctgcatcctgag

SEQ ID NO: 9480707 - DNA, 22 bp, Homo sapiens
gtcctgtgacctgcatcctgag

SEQ ID NO: 9480708 - DNA, 22 bp, Homo sapiens
cagccctgtctatgactgatga

SEQ ID NO: 9480709 - DNA, 22 bp, Homo sapiens
cagccctgtccctgagggacct

SEQ ID NO: 9480710 - DNA, 22 bp, Homo sapiens
cagccctgtccctgagggacct

SEQ ID NO: 9480711 - DNA, 22 bp, Homo sapiens
cagccctgtccctgagggacct

SEQ ID NO: 9480712 - DNA, 22 bp, Homo sapiens
cagccctgtccctgagggacct

SEQ ID NO: 9480713 - DNA, 22 bp, Homo sapiens
cagccctgtccagcagagggtg

SEQ ID NO: 9480714 - DNA, 22 bp, Homo sapiens
cagccctgtccagcagagggtg

SEQ ID NO: 9480715 - DNA, 22 bp, Homo sapiens
cagccctgtccagcagagggtg

SEQ ID NO: 9480716 - DNA, 22 bp, Homo sapiens
cagccctgtccagcagagggtg

SEQ ID NO: 9480717 - DNA, 22 bp, Homo sapiens
cagccctgtccaatgtctgctc

SEQ ID NO: 9480718 - DNA, 22 bp, Homo sapiens
cagccctgtccaatgtctgctc

SEQ ID NO: 9480719 - DNA, 22 bp, Homo sapiens
cagccctggtgccaaggttccc

SEQ ID NO: 9480720 - DNA, 22 bp, Homo sapiens
cagccctggtgccaaggttccc

SEQ ID NO: 9480721 - DNA, 22 bp, Homo sapiens
cagccctggcccaggtgcctta

SEQ ID NO: 9480722 - DNA, 22 bp, Homo sapiens
cagccctggccccaggtggtct

SEQ ID NO: 9480723 - DNA, 22 bp, Homo sapiens
cagccctggcccaggtgcctta

SEQ ID NO: 9480724 - DNA, 22 bp, Homo sapiens
cagccagaaagtatgttaggga

SEQ ID NO: 9480725 - DNA, 22 bp, Homo sapiens
gtccagcatttaggcttgctga

SEQ ID NO: 9480726 - DNA, 22 bp, Homo sapiens
gtccagcatttaggcttgctga

SEQ ID NO: 9480727 - DNA, 22 bp, Homo sapiens
cagccagaaagtctgttaggga

SEQ ID NO: 9480728 - DNA, 22 bp, Homo sapiens
cagccagaacctaggatgagct

SEQ ID NO: 9480729 - DNA, 22 bp, Homo sapiens
gtccagagtagtcgagtattct

SEQ ID NO: 9480730 - DNA, 22 bp, Homo sapiens
gtccagcaggatgcaagtgcca

SEQ ID NO: 9480731 - DNA, 22 bp, Homo sapiens
gtccagcatttaggcttgctga

SEQ ID NO: 9480732 - DNA, 22 bp, Homo sapiens
gtccagcaggatgcaagtgcca

SEQ ID NO: 9480733 - DNA, 22 bp, Homo sapiens
gtccagcaggatgcaagtgcca

SEQ ID NO: 9480734 - DNA, 22 bp, Homo sapiens
cagccagctgtcccaagtgcct

SEQ ID NO: 9480735 - DNA, 22 bp, Homo sapiens
cagccagctgtcccaagtgcct

SEQ ID NO: 9480736 - DNA, 22 bp, Homo sapiens
cagccagctgtcccaagtgcct

SEQ ID NO: 9480737 - DNA, 22 bp, Homo sapiens
cagccagctggtgcggcagagc

SEQ ID NO: 9480738 - DNA, 22 bp, Homo sapiens
cagccaggacagggaaactagt

SEQ ID NO: 9480739 - DNA, 22 bp, Homo sapiens
cagccaggacagggaaactagt

SEQ ID NO: 9480740 - DNA, 22 bp, Homo sapiens
cagccagcttcagatccaagcc

SEQ ID NO: 9480741 - DNA, 22 bp, Homo sapiens
cagccaggatggagaactgttg

SEQ ID NO: 9480742 - DNA, 22 bp, Homo sapiens
cagccaggcccagatcatgctg

SEQ ID NO: 9480743 - DNA, 22 bp, Homo sapiens
cagccaggatggagaactgttg

SEQ ID NO: 9480744 - DNA, 22 bp, Homo sapiens
cagccaggcccagatcatgctg

SEQ ID NO: 9480745 - DNA, 22 bp, Homo sapiens
cagccaggcccagatcatgctg

SEQ ID NO: 9480746 - DNA, 22 bp, Homo sapiens
cagccaggagcctctgcaacta

SEQ ID NO: 9480747 - DNA, 22 bp, Homo sapiens
cagccaggagcctctgcaacta

SEQ ID NO: 9480748 - DNA, 22 bp, Homo sapiens
cagccaggagctccccctgctc

SEQ ID NO: 9480749 - DNA, 22 bp, Homo sapiens
cagccaggagctccccctgctc

SEQ ID NO: 9480750 - DNA, 22 bp, Homo sapiens
cagccaggagctccccctgctc

SEQ ID NO: 9480751 - DNA, 22 bp, Homo sapiens
cagccaggactcccatttagga

SEQ ID NO: 9480752 - DNA, 22 bp, Homo sapiens
cagccaggactcccatttagga

SEQ ID NO: 9480753 - DNA, 22 bp, Homo sapiens
cagccaggactcccatttagga

SEQ ID NO: 9480754 - DNA, 22 bp, Homo sapiens
cagccaggagcctctgcaacta

SEQ ID NO: 9480755 - DNA, 22 bp, Homo sapiens
cagccaggagcctctgcaacta

SEQ ID NO: 9480756 - DNA, 22 bp, Homo sapiens
cagcatctctgcctgcctgcaa

SEQ ID NO: 9480757 - DNA, 22 bp, Homo sapiens
cagcatctctgcaccctccccc

SEQ ID NO: 9480758 - DNA, 22 bp, Homo sapiens
cagcatctctgcctgcctgcaa

SEQ ID NO: 9480759 - DNA, 22 bp, Homo sapiens
cagcatctcctgtgcagaggga

SEQ ID NO: 9480760 - DNA, 22 bp, Homo sapiens
cagcatctgaccaatatctaca

SEQ ID NO: 9480761 - DNA, 22 bp, Homo sapiens
cagcatctctgggagaagcatc

SEQ ID NO: 9480762 - DNA, 22 bp, Homo sapiens
cagcatctggatttcctccact

SEQ ID NO: 9480763 - DNA, 19 bp, Homo sapiens
cagcatctgagccgtgtcc

SEQ ID NO: 9480764 - DNA, 22 bp, Homo sapiens
cagcatctgtatcctaggctga

SEQ ID NO: 9480765 - DNA, 22 bp, Homo sapiens
cagcatctgtaggactcctctt

SEQ ID NO: 9480766 - DNA, 22 bp, Homo sapiens
gtccagagaggcaggaggctac

SEQ ID NO: 9480767 - DNA, 22 bp, Homo sapiens
cagcatctgtttttctgaccca

SEQ ID NO: 9480768 - DNA, 22 bp, Homo sapiens
cagcatctgttggatggataag

SEQ ID NO: 9480769 - DNA, 22 bp, Homo sapiens
cagcatctgtatcctaggctga

SEQ ID NO: 9480770 - DNA, 22 bp, Homo sapiens
gtccagagaggcaggaggctac

SEQ ID NO: 9480771 - DNA, 22 bp, Homo sapiens
gtccagagccggaagagtgaca

SEQ ID NO: 9480772 - DNA, 22 bp, Homo sapiens
gtccagagccggaagagtgaca

SEQ ID NO: 9480773 - DNA, 20 bp, Homo sapiens
gtccagagtaatgtgctgac

SEQ ID NO: 9480774 - DNA, 22 bp, Homo sapiens
gtccagagggctgcaggatgct

SEQ ID NO: 9480775 - DNA, 22 bp, Homo sapiens
gtccagaggtccaggatcaagg

SEQ ID NO: 9480776 - DNA, 22 bp, Homo sapiens
gtccagagctggcacactgtca

SEQ ID NO: 9480777 - DNA, 22 bp, Homo sapiens
gtccagagggctgcaggatgct

SEQ ID NO: 9480778 - DNA, 22 bp, Homo sapiens
gtagggagcccagagcccagtg

SEQ ID NO: 9480779 - DNA, 22 bp, Homo sapiens
gtattttacttacgcatgactt

SEQ ID NO: 9480780 - DNA, 22 bp, Homo sapiens
gtagggacatgccattatctca

SEQ ID NO: 9480781 - DNA, 20 bp, Homo sapiens
gtagggaaggaatctgcagg

SEQ ID NO: 9480782 - DNA, 22 bp, Homo sapiens
gtaggctgtgtgaggctagaga

SEQ ID NO: 9480783 - DNA, 22 bp, Homo sapiens
gtcacacaatagtaagtggtcc

SEQ ID NO: 9480784 - DNA, 22 bp, Homo sapiens
gtcacacagagccctgtgctca

SEQ ID NO: 9480785 - DNA, 21 bp, Homo sapiens
gtcacacaggcctggagctga

SEQ ID NO: 9480786 - DNA, 22 bp, Homo sapiens
gtcacacagggcctccaaatca

SEQ ID NO: 9480787 - DNA, 22 bp, Homo sapiens
gtcacacaggttgaaatgcagt

SEQ ID NO: 9480788 - DNA, 22 bp, Homo sapiens
gtcacacaggttgaaatgcagt

SEQ ID NO: 9480789 - DNA, 22 bp, Homo sapiens
gtcacactagggccaagtggag

SEQ ID NO: 9480790 - DNA, 22 bp, Homo sapiens
gtcacactagggccaagtggag

SEQ ID NO: 9480791 - DNA, 22 bp, Homo sapiens
gtcacactcaaaagctaggatg

SEQ ID NO: 9480792 - DNA, 22 bp, Homo sapiens
gtcacactcagaatgactagag

SEQ ID NO: 9480793 - DNA, 22 bp, Homo sapiens
gtcacactcttccctccacatg

SEQ ID NO: 9480794 - DNA, 22 bp, Homo sapiens
gtcacactcttccctccacatg

SEQ ID NO: 9480795 - DNA, 22 bp, Homo sapiens
gtcacacttctttctgtgtctc

SEQ ID NO: 9480796 - DNA, 18 bp, Homo sapiens
gtcacagcagagaactgc

SEQ ID NO: 9480797 - DNA, 22 bp, Homo sapiens
gtcacaggaaagggtgtaaggg

SEQ ID NO: 9480798 - DNA, 22 bp, Homo sapiens
gtcacaggaaagggtgtaaggg

SEQ ID NO: 9480799 - DNA, 18 bp, Homo sapiens
gtcacagcagagaactgc

SEQ ID NO: 9480800 - DNA, 22 bp, Homo sapiens
gtcacagatctcttgagtcaag

SEQ ID NO: 9480801 - DNA, 22 bp, Homo sapiens
gtcacagatctcttgagtcaag

SEQ ID NO: 9480802 - DNA, 22 bp, Homo sapiens
gtcacaggaagcagcaggcact

SEQ ID NO: 9480803 - DNA, 22 bp, Homo sapiens
gtcacaggcagtaactaggacc

SEQ ID NO: 9480804 - DNA, 22 bp, Homo sapiens
gtcacaggcctggatgaggggc

SEQ ID NO: 9480805 - DNA, 22 bp, Homo sapiens
gtcagatctttggggatgctgt

SEQ ID NO: 9480806 - DNA, 22 bp, Homo sapiens
gtcagagttccaaattaatcaa

SEQ ID NO: 9480807 - DNA, 22 bp, Homo sapiens
gtcacagggtccccatatggag

SEQ ID NO: 9480808 - DNA, 22 bp, Homo sapiens
cagcatctcatttgacttctgc

SEQ ID NO: 9480809 - DNA, 22 bp, Homo sapiens
cagcatctccatggctttggag

SEQ ID NO: 9480810 - DNA, 22 bp, Homo sapiens
cagcatctcatttgacttctgc

SEQ ID NO: 9480811 - DNA, 22 bp, Homo sapiens
cagcatctcattcattcatgtt

SEQ ID NO: 9480812 - DNA, 22 bp, Homo sapiens
cagcatctcacttcccagaagg

SEQ ID NO: 9480813 - DNA, 22 bp, Homo sapiens
cagcatctaatcttcatgccgg

SEQ ID NO: 9480814 - DNA, 22 bp, Homo sapiens
cagcatcctttgctggtttccc

SEQ ID NO: 9480815 - DNA, 22 bp, Homo sapiens
cagcatccctcaggggcctctg

SEQ ID NO: 9480816 - DNA, 22 bp, Homo sapiens
cagcatccctcaggggcctctg

SEQ ID NO: 9480817 - DNA, 22 bp, Homo sapiens
cagcatccgttctcaggactga

SEQ ID NO: 9480818 - DNA, 22 bp, Homo sapiens
cagcatccctcaggggcctctg

SEQ ID NO: 9480819 - DNA, 22 bp, Homo sapiens
cagcatcccagagcccagagct

SEQ ID NO: 9480820 - DNA, 22 bp, Homo sapiens
cagcatcccagagcccagagct

SEQ ID NO: 9480821 - DNA, 22 bp, Homo sapiens
cagcagtgtctccagcatcaca

SEQ ID NO: 9480822 - DNA, 22 bp, Homo sapiens
gtcagcagtgtcagctctgggg

SEQ ID NO: 9480823 - DNA, 22 bp, Homo sapiens
cagcagtgtacaaggtgtcaga

SEQ ID NO: 9480824 - DNA, 22 bp, Homo sapiens
cagcagtgtacaaggtgtcaga

SEQ ID NO: 9480825 - DNA, 22 bp, Homo sapiens
gtcagattaatagcaataataa

SEQ ID NO: 9480826 - DNA, 22 bp, Homo sapiens
gtcagattttcaagacgagagg

SEQ ID NO: 9480827 - DNA, 22 bp, Homo sapiens
gtcagattttctctggtttgtt

SEQ ID NO: 9480828 - DNA, 19 bp, Homo sapiens
gtcagcaccatggacaggg

SEQ ID NO: 9480829 - DNA, 22 bp, Homo sapiens
gtcagcaattcaagagctctta

SEQ ID NO: 9480830 - DNA, 22 bp, Homo sapiens
gtcagcacttttccgaggcaga

SEQ ID NO: 9480831 - DNA, 22 bp, Homo sapiens
gtcagcacctctttggggagct

SEQ ID NO: 9480832 - DNA, 21 bp, Homo sapiens
gtcagcagatccagcacttgt

SEQ ID NO: 9480833 - DNA, 22 bp, Homo sapiens
gtcagcagcatgtttaatcaaa

SEQ ID NO: 9480834 - DNA, 17 bp, Homo sapiens
gtcagcagcttgcttgt

SEQ ID NO: 9480835 - DNA, 17 bp, Homo sapiens
gtcagcagcttgcttgt

SEQ ID NO: 9480836 - DNA, 22 bp, Homo sapiens
gtcagcagggtccccttgagtg

SEQ ID NO: 9480837 - DNA, 22 bp, Homo sapiens
gtacacactgtttgatcatttc

SEQ ID NO: 9480838 - DNA, 22 bp, Homo sapiens
gtacacactatttaaagtgttt

SEQ ID NO: 9480839 - DNA, 22 bp, Homo sapiens
gtacacactatgtattgtacac

SEQ ID NO: 9480840 - DNA, 22 bp, Homo sapiens
cagcagcctagaagctctacca

SEQ ID NO: 9480841 - DNA, 22 bp, Homo sapiens
cagcagcctagaagctctacca

SEQ ID NO: 9480842 - DNA, 22 bp, Homo sapiens
gtacacagatgcttgagaatct

SEQ ID NO: 9480843 - DNA, 22 bp, Homo sapiens
gtacacagagtggtggaagaaa

SEQ ID NO: 9480844 - DNA, 20 bp, Homo sapiens
gtacacttcatgtttcacct

SEQ ID NO: 9480845 - DNA, 22 bp, Homo sapiens
gtacacttgactcataggaaat

SEQ ID NO: 9480846 - DNA, 22 bp, Homo sapiens
gtactaagtcaggagaagaatt

SEQ ID NO: 9480847 - DNA, 22 bp, Homo sapiens
gtactacagtttctcattaaat

SEQ ID NO: 9480848 - DNA, 22 bp, Homo sapiens
gtacacatatattaaaaattgt

SEQ ID NO: 9480849 - DNA, 22 bp, Homo sapiens
gtacacatatttccaagggtaa

SEQ ID NO: 9480850 - DNA, 22 bp, Homo sapiens
gtacactccccctgtgaagttg

SEQ ID NO: 9480851 - DNA, 22 bp, Homo sapiens
gtactgcttaggtcaggtcagt

SEQ ID NO: 9480852 - DNA, 22 bp, Homo sapiens
gtacttctcaaactagaaacta

SEQ ID NO: 9480853 - DNA, 22 bp, Homo sapiens
gtagaaaaagcagtaagtctca

SEQ ID NO: 9480854 - DNA, 22 bp, Homo sapiens
gtagaaaaagcagtaagtctca

SEQ ID NO: 9480855 - DNA, 22 bp, Homo sapiens
gtagaaaaagcagtaagtctca

SEQ ID NO: 9480856 - DNA, 22 bp, Homo sapiens
gtagaaaaagcagtaagtctca

SEQ ID NO: 9480857 - DNA, 22 bp, Homo sapiens
gtagaaatagtggttgacagga

SEQ ID NO: 9480858 - DNA, 22 bp, Homo sapiens
gtagaaaattaggatgaggctt

SEQ ID NO: 9480859 - DNA, 22 bp, Homo sapiens
gtagaaatatttatctctgaga

SEQ ID NO: 9480860 - DNA, 22 bp, Homo sapiens
gtagaaatatttatctctgaga

SEQ ID NO: 9480861 - DNA, 22 bp, Homo sapiens
gtaggccagtgtgaaacctggt

SEQ ID NO: 9480862 - DNA, 22 bp, Homo sapiens
gtaggcagtggttggaagagaa

SEQ ID NO: 9480863 - DNA, 22 bp, Homo sapiens
gtaggctgtgtgaggctagaga

SEQ ID NO: 9480864 - DNA, 22 bp, Homo sapiens
gtaggcagtgcttgattttcca

SEQ ID NO: 9480865 - DNA, 22 bp, Homo sapiens
cagcaaagcaggctcctagaac

SEQ ID NO: 9480866 - DNA, 22 bp, Homo sapiens
cagcaaagcaggctcctagaac

SEQ ID NO: 9480867 - DNA, 19 bp, Homo sapiens
cagcaaacactgtaaatgg

SEQ ID NO: 9480868 - DNA, 22 bp, Homo sapiens
cagcaaaatttgaggattgcct

SEQ ID NO: 9480869 - DNA, 22 bp, Homo sapiens
cagcaaaggggatgcgtcctaa

SEQ ID NO: 9480870 - DNA, 22 bp, Homo sapiens
cagcaaagcttaatttatatct

SEQ ID NO: 9480871 - DNA, 22 bp, Homo sapiens
cagcagcagccccaggaaggtt

SEQ ID NO: 9480872 - DNA, 22 bp, Homo sapiens
cagcaaaggtagaagcacagga

SEQ ID NO: 9480873 - DNA, 22 bp, Homo sapiens
cagcaaaggtagaagcacagga

SEQ ID NO: 9480874 - DNA, 22 bp, Homo sapiens
cagcagcagattcagcgtctgg

SEQ ID NO: 9480875 - DNA, 22 bp, Homo sapiens
cagcagcagattcagcgtctgg

SEQ ID NO: 9480876 - DNA, 22 bp, Homo sapiens
cagcagccactagagggctcac

SEQ ID NO: 9480877 - DNA, 20 bp, Homo sapiens
cagcagccattctagtagta

SEQ ID NO: 9480878 - DNA, 22 bp, Homo sapiens
cagcagccgagagggggctctg

SEQ ID NO: 9480879 - DNA, 22 bp, Homo sapiens
cagcagcccacgcgtgctgtcc

SEQ ID NO: 9480880 - DNA, 22 bp, Homo sapiens
cagatttggggtctcctgttag

SEQ ID NO: 9480881 - DNA, 22 bp, Homo sapiens
cagattttgatgaatgtggaaa

SEQ ID NO: 9480882 - DNA, 22 bp, Homo sapiens
cagcaaaagccagcataagctc

SEQ ID NO: 9480883 - DNA, 20 bp, Homo sapiens
cagcaaaatgaaaatggatt

SEQ ID NO: 9480884 - DNA, 20 bp, Homo sapiens
cagcaaaatgaaaatggatt

SEQ ID NO: 9480885 - DNA, 22 bp, Homo sapiens
cagcaaaagccagcataagctc

SEQ ID NO: 9480886 - DNA, 22 bp, Homo sapiens
cagatttcagctcatatattat

SEQ ID NO: 9480887 - DNA, 22 bp, Homo sapiens
cagatttatgcaaaaaggaaga

SEQ ID NO: 9480888 - DNA, 22 bp, Homo sapiens
cagatttaggtcactagaattt

SEQ ID NO: 9480889 - DNA, 22 bp, Homo sapiens
cagatttaggcttagtccaagc

SEQ ID NO: 9480890 - DNA, 22 bp, Homo sapiens
cagatttaagatatttgtattg

SEQ ID NO: 9480891 - DNA, 22 bp, Homo sapiens
cagatttaagatatttgtattg

SEQ ID NO: 9480892 - DNA, 22 bp, Homo sapiens
cagattctgcagtcaacttgct

SEQ ID NO: 9480893 - DNA, 22 bp, Homo sapiens
cagattctgaagtctagctgct

SEQ ID NO: 9480894 - DNA, 22 bp, Homo sapiens
cagattcttcattcattctaca

SEQ ID NO: 9480895 - DNA, 22 bp, Homo sapiens
cagattcttcattcattctaca

SEQ ID NO: 9480896 - DNA, 22 bp, Homo sapiens
cagattctgggcccagcttgtc

SEQ ID NO: 9480897 - DNA, 22 bp, Homo sapiens
cagattggattaaatagctgcc

SEQ ID NO: 9480898 - DNA, 22 bp, Homo sapiens
cagattggagagagttaaagca

SEQ ID NO: 9480899 - DNA, 22 bp, Homo sapiens
cagattggattaaatagctgcc

SEQ ID NO: 9480900 - DNA, 22 bp, Homo sapiens
cagattgggtgagatgatttca

SEQ ID NO: 9480901 - DNA, 22 bp, Homo sapiens
cagattgggtgagatgatttca

SEQ ID NO: 9480902 - DNA, 22 bp, Homo sapiens
cagattggagagagttaaagca

SEQ ID NO: 9480903 - DNA, 22 bp, Homo sapiens
cagattctcactgtattcaggt

SEQ ID NO: 9480904 - DNA, 22 bp, Homo sapiens
cagattctccaggggctgcaga

SEQ ID NO: 9480905 - DNA, 22 bp, Homo sapiens
cagattccagtttgtggctccc

SEQ ID NO: 9480906 - DNA, 22 bp, Homo sapiens
cagattaagtgctcaacagtgt

SEQ ID NO: 9480907 - DNA, 22 bp, Homo sapiens
cagattaacacggagcttaaca

SEQ ID NO: 9480908 - DNA, 22 bp, Homo sapiens
cagattaacacggagcttaaca

SEQ ID NO: 9480909 - DNA, 22 bp, Homo sapiens
catggggagacacctagggaaa

SEQ ID NO: 9480910 - DNA, 22 bp, Homo sapiens
catgggctttggaggctggagg

SEQ ID NO: 9480911 - DNA, 22 bp, Homo sapiens
catgggctttggaggctggagg

SEQ ID NO: 9480912 - DNA, 22 bp, Homo sapiens
catgggctttggaggctggagg

SEQ ID NO: 9480913 - DNA, 22 bp, Homo sapiens
catgggctgctgacaggggctc

SEQ ID NO: 9480914 - DNA, 22 bp, Homo sapiens
catgggctgtgaacccaggctg

SEQ ID NO: 9480915 - DNA, 22 bp, Homo sapiens
catgggcttgctctctgagctc

SEQ ID NO: 9480916 - DNA, 22 bp, Homo sapiens
catggggatgaggctgagactt

SEQ ID NO: 9480917 - DNA, 22 bp, Homo sapiens
catggggatgaggctgagactt

SEQ ID NO: 9480918 - DNA, 22 bp, Homo sapiens
catggggcccatgtgctccaag

SEQ ID NO: 9480919 - DNA, 23 bp, Homo sapiens
catggggagcagtgctcctgacc

SEQ ID NO: 9480920 - DNA, 23 bp, Homo sapiens
catggggagcagtgctcctgacc

SEQ ID NO: 9480921 - DNA, 22 bp, Homo sapiens
catgggggctgaggctgctgta

SEQ ID NO: 9480922 - DNA, 21 bp, Homo sapiens
aggatttactattaactgtgt

SEQ ID NO: 9480923 - DNA, 21 bp, Homo sapiens
aggatttactattaactgtgt

SEQ ID NO: 9480924 - DNA, 22 bp, Homo sapiens
aggattgtttggcttcaaaggc

SEQ ID NO: 9480925 - DNA, 22 bp, Homo sapiens
aggattgtgcctccagtcagaa

SEQ ID NO: 9480926 - DNA, 22 bp, Homo sapiens
aggatttaatcagttggcattt

SEQ ID NO: 9480927 - DNA, 22 bp, Homo sapiens
catggctgaacactcagtgact

SEQ ID NO: 9480928 - DNA, 22 bp, Homo sapiens
catgggctgaaaatctgcaaac

SEQ ID NO: 9480929 - DNA, 22 bp, Homo sapiens
catggctcggggacaggaggta

SEQ ID NO: 9480930 - DNA, 22 bp, Homo sapiens
aggatttgaaatatttagtaaa

SEQ ID NO: 9480931 - DNA, 22 bp, Homo sapiens
aggatttgaaatatttagtaaa

SEQ ID NO: 9480932 - DNA, 22 bp, Homo sapiens
aggatttctgtgcctggaaaat

SEQ ID NO: 9480933 - DNA, 21 bp, Homo sapiens
aggatttctgtcatttcagat

SEQ ID NO: 9480934 - DNA, 21 bp, Homo sapiens
aggatttctgtcatttcagat

SEQ ID NO: 9480935 - DNA, 19 bp, Homo sapiens
catggtgaaaccccgtctc

SEQ ID NO: 9480936 - DNA, 19 bp, Homo sapiens
catggtgaaaccccgtctc

SEQ ID NO: 9480937 - DNA, 22 bp, Homo sapiens
catgtacatgcctactatcaat

SEQ ID NO: 9480938 - DNA, 22 bp, Homo sapiens
catgtacatgcctactatcaat

SEQ ID NO: 9480939 - DNA, 18 bp, Homo sapiens
catgggtgacaggtggat

SEQ ID NO: 9480940 - DNA, 22 bp, Homo sapiens
catggtcatgctgagctacaaa

SEQ ID NO: 9480941 - DNA, 22 bp, Homo sapiens
catggtactgccacagaagagt

SEQ ID NO: 9480942 - DNA, 22 bp, Homo sapiens
catgtacattctgtagatggag

SEQ ID NO: 9480943 - DNA, 22 bp, Homo sapiens
catgtataagcgctaggagtgc

SEQ ID NO: 9480944 - DNA, 22 bp, Homo sapiens
catgtagtcctaatgctggtga

SEQ ID NO: 9480945 - DNA, 22 bp, Homo sapiens
catgtataggtccatagtgaat

SEQ ID NO: 9480946 - DNA, 22 bp, Homo sapiens
catgtatagacactcatacagt

SEQ ID NO: 9480947 - DNA, 22 bp, Homo sapiens
catgtatagacactcatacagt

SEQ ID NO: 9480948 - DNA, 22 bp, Homo sapiens
catgtatccctaattgtgttaa

SEQ ID NO: 9480949 - DNA, 22 bp, Homo sapiens
catgtatattttatgtggagag

SEQ ID NO: 9480950 - DNA, 22 bp, Homo sapiens
catgtatcttaattgctttgga

SEQ ID NO: 9480951 - DNA, 22 bp, Homo sapiens
catgtatcttaattgctttgga

SEQ ID NO: 9480952 - DNA, 18 bp, Homo sapiens
catgtatgcaaataagca

SEQ ID NO: 9480953 - DNA, 22 bp, Homo sapiens
catgtatagttggaactacatc

SEQ ID NO: 9480954 - DNA, 22 bp, Homo sapiens
catgtcaaccagttgtttgaat

SEQ ID NO: 9480955 - DNA, 22 bp, Homo sapiens
catgtcaagactgaagatccag

SEQ ID NO: 9480956 - DNA, 17 bp, Homo sapiens
catgtatttgaaacaga

SEQ ID NO: 9480957 - DNA, 17 bp, Homo sapiens
catgtatttgaaacaga

SEQ ID NO: 9480958 - DNA, 22 bp, Homo sapiens
catgtcactttaacaaattagt

SEQ ID NO: 9480959 - DNA, 22 bp, Homo sapiens
catgtcacaattcttaatggga

SEQ ID NO: 9480960 - DNA, 22 bp, Homo sapiens
catgtccacagttctgagaggc

SEQ ID NO: 9480961 - DNA, 22 bp, Homo sapiens
catgtcagggaagagagtcagt

SEQ ID NO: 9480962 - DNA, 22 bp, Homo sapiens
aggcactgcagattacaggcgc

SEQ ID NO: 9480963 - DNA, 22 bp, Homo sapiens
aggcactgcagattacaggcgc

SEQ ID NO: 9480964 - DNA, 22 bp, Homo sapiens
aggcactgcagattacaggcgc

SEQ ID NO: 9480965 - DNA, 22 bp, Homo sapiens
catgtccatttatgcacagaaa

SEQ ID NO: 9480966 - DNA, 22 bp, Homo sapiens
aggcactgcagattacaggcgc

SEQ ID NO: 9480967 - DNA, 22 bp, Homo sapiens
aggcactgcagattacaggcgc

SEQ ID NO: 9480968 - DNA, 22 bp, Homo sapiens
aggattgtgcctccagtcagaa

SEQ ID NO: 9480969 - DNA, 22 bp, Homo sapiens
aggattgtgcctccagtcagaa

SEQ ID NO: 9480970 - DNA, 23 bp, Homo sapiens
aggattctgcttttcagaaataa

SEQ ID NO: 9480971 - DNA, 22 bp, Homo sapiens
aggattaaagtatatttttgag

SEQ ID NO: 9480972 - DNA, 22 bp, Homo sapiens
aggattaactgacctagtgttt

SEQ ID NO: 9480973 - DNA, 22 bp, Homo sapiens
catggcagaaacctgagctgct

SEQ ID NO: 9480974 - DNA, 22 bp, Homo sapiens
catggcagaaacctgagctgct

SEQ ID NO: 9480975 - DNA, 22 bp, Homo sapiens
catggcagaaacctgagctgct

SEQ ID NO: 9480976 - DNA, 22 bp, Homo sapiens
catggacttctgaaggtgtgtc

SEQ ID NO: 9480977 - DNA, 22 bp, Homo sapiens
catggacagtgggacagtgtgt

SEQ ID NO: 9480978 - DNA, 22 bp, Homo sapiens
catggacaacctccattcgagt

SEQ ID NO: 9480979 - DNA, 22 bp, Homo sapiens
catggaaggcaaaagacacaga

SEQ ID NO: 9480980 - DNA, 22 bp, Homo sapiens
catggaatgtgagttgtttagt

SEQ ID NO: 9480981 - DNA, 22 bp, Homo sapiens
catggatatattgtacagtagc

SEQ ID NO: 9480982 - DNA, 22 bp, Homo sapiens
catggaggaccctcagggagct

SEQ ID NO: 9480983 - DNA, 22 bp, Homo sapiens
catggatagatgaatgcttaaa

SEQ ID NO: 9480984 - DNA, 22 bp, Homo sapiens
catggaggaggaagggcgttgt

SEQ ID NO: 9480985 - DNA, 22 bp, Homo sapiens
catggaggagttaggtgtgagt

SEQ ID NO: 9480986 - DNA, 22 bp, Homo sapiens
aggaggggcaatgatagtctgg

SEQ ID NO: 9480987 - DNA, 22 bp, Homo sapiens
aggaggggcaatgatagtctgg

SEQ ID NO: 9480988 - DNA, 22 bp, Homo sapiens
aggaggggcaatgatagtctgg

SEQ ID NO: 9480989 - DNA, 22 bp, Homo sapiens
aggaggggcaatgatagtctgg

SEQ ID NO: 9480990 - DNA, 20 bp, Homo sapiens
aggaggggatagaatcaaag

SEQ ID NO: 9480991 - DNA, 20 bp, Homo sapiens
aggaggggatagaatcaaag

SEQ ID NO: 9480992 - DNA, 20 bp, Homo sapiens
aggaggggatagaatcaaag

SEQ ID NO: 9480993 - DNA, 16 bp, Homo sapiens
aggaggggaattagga

SEQ ID NO: 9480994 - DNA, 16 bp, Homo sapiens
aggaggggaattagga

SEQ ID NO: 9480995 - DNA, 22 bp, Homo sapiens
aggagggctaggaaaaccagga

SEQ ID NO: 9480996 - DNA, 16 bp, Homo sapiens
aggaggggaattagga

SEQ ID NO: 9480997 - DNA, 22 bp, Homo sapiens
aggagggcaggctggctgccta

SEQ ID NO: 9480998 - DNA, 22 bp, Homo sapiens
aggagggcaggctggctgccta

SEQ ID NO: 9480999 - DNA, 22 bp, Homo sapiens
aggagggcaggctggctgccta

SEQ ID NO: 9481000 - DNA, 22 bp, Homo sapiens
aggagggcaggctggctgccta

SEQ ID NO: 9481001 - DNA, 22 bp, Homo sapiens
aggagggctaggaaaaccagga

SEQ ID NO: 9481002 - DNA, 22 bp, Homo sapiens
aggagggctaggaaaaccagga

SEQ ID NO: 9481003 - DNA, 22 bp, Homo sapiens
aggagggcaggctggctgccta

SEQ ID NO: 9481004 - DNA, 21 bp, Homo sapiens
aggagggcacaaggccaggaa

SEQ ID NO: 9481005 - DNA, 22 bp, Homo sapiens
aggagggatagaaaaatacttg

SEQ ID NO: 9481006 - DNA, 22 bp, Homo sapiens
aggagggatagaaaaatacttg

SEQ ID NO: 9481007 - DNA, 22 bp, Homo sapiens
aggagggagcttaagccaggca

SEQ ID NO: 9481008 - DNA, 21 bp, Homo sapiens
aggagggcacaaggccaggaa

SEQ ID NO: 9481009 - DNA, 21 bp, Homo sapiens
aggagggcacaaggccaggaa

SEQ ID NO: 9481010 - DNA, 21 bp, Homo sapiens
aggagggcacaaggccaggaa

SEQ ID NO: 9481011 - DNA, 21 bp, Homo sapiens
aggagggcacaaggccaggaa

SEQ ID NO: 9481012 - DNA, 20 bp, Homo sapiens
catttgttagctttctactg

SEQ ID NO: 9481013 - DNA, 18 bp, Homo sapiens
catttgttattgtgtgtg

SEQ ID NO: 9481014 - DNA, 18 bp, Homo sapiens
catttgttattgtgtgtg

SEQ ID NO: 9481015 - DNA, 22 bp, Homo sapiens
catttgttctgatttcaaaagg

SEQ ID NO: 9481016 - DNA, 22 bp, Homo sapiens
catttgttctgatttcaaaagg

SEQ ID NO: 9481017 - DNA, 22 bp, Homo sapiens
catttgttctgatttcaaaagg

SEQ ID NO: 9481018 - DNA, 22 bp, Homo sapiens
catttgttaattactattatct

SEQ ID NO: 9481019 - DNA, 22 bp, Homo sapiens
catttgttaatgctgcttttaa

SEQ ID NO: 9481020 - DNA, 22 bp, Homo sapiens
catttgttaaccagtgtggatt

SEQ ID NO: 9481021 - DNA, 22 bp, Homo sapiens
catttgaaattcttagaacaaa

SEQ ID NO: 9481022 - DNA, 22 bp, Homo sapiens
catttgaaattcttagaacaaa

SEQ ID NO: 9481023 - DNA, 22 bp, Homo sapiens
catttgttaagaaggaaaaagg

SEQ ID NO: 9481024 - DNA, 22 bp, Homo sapiens
catttgaaattcttagaacaaa

SEQ ID NO: 9481025 - DNA, 22 bp, Homo sapiens
cattaacaatgactgcttgact

SEQ ID NO: 9481026 - DNA, 22 bp, Homo sapiens
cattaacaatgactgcttgact

SEQ ID NO: 9481027 - DNA, 22 bp, Homo sapiens
cattaacaattgtttatgctgt

SEQ ID NO: 9481028 - DNA, 21 bp, Homo sapiens
aggcagcaggatccagggaca

SEQ ID NO: 9481029 - DNA, 21 bp, Homo sapiens
aggcagcaggatccagggaca

SEQ ID NO: 9481030 - DNA, 21 bp, Homo sapiens
aggcagcaggatccagggaca

SEQ ID NO: 9481031 - DNA, 21 bp, Homo sapiens
aggcagcaggatccagggaca

SEQ ID NO: 9481032 - DNA, 21 bp, Homo sapiens
aggcagcaggatccagggaca

SEQ ID NO: 9481033 - DNA, 19 bp, Homo sapiens
aggcagcaggccagggatg

SEQ ID NO: 9481034 - DNA, 19 bp, Homo sapiens
aggcagcaggccagggatg

SEQ ID NO: 9481035 - DNA, 19 bp, Homo sapiens
aggcagcaggccagggatg

SEQ ID NO: 9481036 - DNA, 21 bp, Homo sapiens
aggcagcaggatccagggaca

SEQ ID NO: 9481037 - DNA, 19 bp, Homo sapiens
aggcagcaggccagggatg

SEQ ID NO: 9481038 - DNA, 22 bp, Homo sapiens
catttgtttagaagtctttata

SEQ ID NO: 9481039 - DNA, 22 bp, Homo sapiens
catttgttggtcagattgtagt

SEQ ID NO: 9481040 - DNA, 22 bp, Homo sapiens
catttgttggttgctgtcttat

SEQ ID NO: 9481041 - DNA, 22 bp, Homo sapiens
catttgttggttgctgtcttat

SEQ ID NO: 9481042 - DNA, 22 bp, Homo sapiens
catttgttgggacaatgaaaag

SEQ ID NO: 9481043 - DNA, 22 bp, Homo sapiens
cattaaatcttccagacctcac

SEQ ID NO: 9481044 - DNA, 22 bp, Homo sapiens
cattaaatcttccagacctcac

SEQ ID NO: 9481045 - DNA, 22 bp, Homo sapiens
cattaaatatcaacctagacta

SEQ ID NO: 9481046 - DNA, 22 bp, Homo sapiens
cattaaattccttgttctcaaa

SEQ ID NO: 9481047 - DNA, 22 bp, Homo sapiens
cattaacaaatggaagcatgaa

SEQ ID NO: 9481048 - DNA, 22 bp, Homo sapiens
cattaaattccttgttctcaaa

SEQ ID NO: 9481049 - DNA, 22 bp, Homo sapiens
cattaaaatatctcatggtgtt

SEQ ID NO: 9481050 - DNA, 22 bp, Homo sapiens
cattaaaatatctcatggtgtt

SEQ ID NO: 9481051 - DNA, 22 bp, Homo sapiens
cattaaaatatctcatggtgtt

SEQ ID NO: 9481052 - DNA, 22 bp, Homo sapiens
cattaaaatatctcatggtgtt

SEQ ID NO: 9481053 - DNA, 22 bp, Homo sapiens
cattaaaatatctcatggtgtt

SEQ ID NO: 9481054 - DNA, 22 bp, Homo sapiens
cattaaaatatctcatggtgtt

SEQ ID NO: 9481055 - DNA, 23 bp, Homo sapiens
catgtttttctatctcagcgtgt

SEQ ID NO: 9481056 - DNA, 22 bp, Homo sapiens
catgttttgtgtacagaatatt

SEQ ID NO: 9481057 - DNA, 22 bp, Homo sapiens
catgttttgtgtacagaatatt

SEQ ID NO: 9481058 - DNA, 22 bp, Homo sapiens
aggcactgtactaggtacaggg

SEQ ID NO: 9481059 - DNA, 22 bp, Homo sapiens
aggcactgtactaggtacaggg

SEQ ID NO: 9481060 - DNA, 22 bp, Homo sapiens
aggcactgtgcagtcccaagca

SEQ ID NO: 9481061 - DNA, 22 bp, Homo sapiens
aggcactgtgcagtcccaagca

SEQ ID NO: 9481062 - DNA, 22 bp, Homo sapiens
aggcactgtgctgatgtcttat

SEQ ID NO: 9481063 - DNA, 22 bp, Homo sapiens
aggcactgtactaggtacaggg

SEQ ID NO: 9481064 - DNA, 22 bp, Homo sapiens
aggcactgtactaggtacaggg

SEQ ID NO: 9481065 - DNA, 22 bp, Homo sapiens
aggcactggtctaccccttagt

SEQ ID NO: 9481066 - DNA, 22 bp, Homo sapiens
aggcactgtgcttcttatatgt

SEQ ID NO: 9481067 - DNA, 22 bp, Homo sapiens
aggcactgtgctgatgtcttat

SEQ ID NO: 9481068 - DNA, 22 bp, Homo sapiens
aggcactgtgctgatgtcttat

SEQ ID NO: 9481069 - DNA, 22 bp, Homo sapiens
aggcactgtgctgatgtcttat

SEQ ID NO: 9481070 - DNA, 22 bp, Homo sapiens
aggcactgtggaagacatggtt

SEQ ID NO: 9481071 - DNA, 22 bp, Homo sapiens
aggcactgtggaagacatggtt

SEQ ID NO: 9481072 - DNA, 22 bp, Homo sapiens
aggcactgtggaagacatggtt

SEQ ID NO: 9481073 - DNA, 22 bp, Homo sapiens
aggcactgtggaagacatggtt

SEQ ID NO: 9481074 - DNA, 15 bp, Homo sapiens
aggcactgtgggacc

SEQ ID NO: 9481075 - DNA, 22 bp, Homo sapiens
ccaagggctatttacagaacag

SEQ ID NO: 9481076 - DNA, 22 bp, Homo sapiens
ccaaggacgtacaggagataat

SEQ ID NO: 9481077 - DNA, 22 bp, Homo sapiens
ccaagctggatttagctgcaca

SEQ ID NO: 9481078 - DNA, 22 bp, Homo sapiens
ccaaggacccgagcctgcggga

SEQ ID NO: 9481079 - DNA, 22 bp, Homo sapiens
ccaagctttcgatcaaccagaa

SEQ ID NO: 9481080 - DNA, 22 bp, Homo sapiens
ccaaggttagaaaaggtacttt

SEQ ID NO: 9481081 - DNA, 22 bp, Homo sapiens
ccaagggctgctgaggtgtcca

SEQ ID NO: 9481082 - DNA, 22 bp, Homo sapiens
ccaagggctgctgaggtgtcca

SEQ ID NO: 9481083 - DNA, 22 bp, Homo sapiens
ccaagggctctggacagagtgg

SEQ ID NO: 9481084 - DNA, 20 bp, Homo sapiens
ccaataaagctctataggga

SEQ ID NO: 9481085 - DNA, 22 bp, Homo sapiens
ccaatagagtgctgtaagaatt

SEQ ID NO: 9481086 - DNA, 18 bp, Homo sapiens
aggcaggctggagtgact

SEQ ID NO: 9481087 - DNA, 22 bp, Homo sapiens
ccaatcttatctttattttcta

SEQ ID NO: 9481088 - DNA, 22 bp, Homo sapiens
ccaatcctcatgttcaacaacc

SEQ ID NO: 9481089 - DNA, 22 bp, Homo sapiens
ccaagtgatacacccgcctcgg

SEQ ID NO: 9481090 - DNA, 22 bp, Homo sapiens
ccaagtcctgctgccactctac

SEQ ID NO: 9481091 - DNA, 22 bp, Homo sapiens
ccaagtccccaagcatgccagg

SEQ ID NO: 9481092 - DNA, 22 bp, Homo sapiens
ccaagtcctctaccattcctgg

SEQ ID NO: 9481093 - DNA, 22 bp, Homo sapiens
ccaagtcctctaccattcctgg

SEQ ID NO: 9481094 - DNA, 22 bp, Homo sapiens
ccaagtcctctaccattcctgg

SEQ ID NO: 9481095 - DNA, 22 bp, Homo sapiens
ccaaggtttattttgatacatt

SEQ ID NO: 9481096 - DNA, 18 bp, Homo sapiens
ccaagtatggcagaggct

SEQ ID NO: 9481097 - DNA, 22 bp, Homo sapiens
ccaaaggccaagctcaggtaaa

SEQ ID NO: 9481098 - DNA, 23 bp, Homo sapiens
aggcagcaggttgtccagggtga

SEQ ID NO: 9481099 - DNA, 23 bp, Homo sapiens
aggcagcaggttgtccagggtga

SEQ ID NO: 9481100 - DNA, 23 bp, Homo sapiens
aggcagcaggttgtccagggtga

SEQ ID NO: 9481101 - DNA, 22 bp, Homo sapiens
ccaaaggcggaactgagtctct

SEQ ID NO: 9481102 - DNA, 21 bp, Homo sapiens
ccaaaggctatgtatcttctg

SEQ ID NO: 9481103 - DNA, 22 bp, Homo sapiens
aggcagcagggccactggctga

SEQ ID NO: 9481104 - DNA, 19 bp, Homo sapiens
aggcagcaggccagggatg

SEQ ID NO: 9481105 - DNA, 19 bp, Homo sapiens
aggcagcaggccagggatg

SEQ ID NO: 9481106 - DNA, 19 bp, Homo sapiens
aggcagcaggccagggatg

SEQ ID NO: 9481107 - DNA, 22 bp, Homo sapiens
aggcagcagggccactggctga

SEQ ID NO: 9481108 - DNA, 23 bp, Homo sapiens
aggcagcaggttgtccagggtga

SEQ ID NO: 9481109 - DNA, 23 bp, Homo sapiens
aggcagcaggttgtccagggtga

SEQ ID NO: 9481110 - DNA, 22 bp, Homo sapiens
aggcagcagggccactggctga

SEQ ID NO: 9481111 - DNA, 23 bp, Homo sapiens
aggcagcaggttgtccagggtga

SEQ ID NO: 9481112 - DNA, 22 bp, Homo sapiens
ccaagcagaaccattcaggcac

SEQ ID NO: 9481113 - DNA, 22 bp, Homo sapiens
ccaagcagagcagcctctctgg

SEQ ID NO: 9481114 - DNA, 22 bp, Homo sapiens
ccaagcaggatattctgtgtca

SEQ ID NO: 9481115 - DNA, 22 bp, Homo sapiens
ccaagatttatattgaataata

SEQ ID NO: 9481116 - DNA, 22 bp, Homo sapiens
ccaagcaaataatcacccacta

SEQ ID NO: 9481117 - DNA, 22 bp, Homo sapiens
ccaagcaaataatcacccacta

SEQ ID NO: 9481118 - DNA, 22 bp, Homo sapiens
ccaagcaaggctaattcacttg

SEQ ID NO: 9481119 - DNA, 22 bp, Homo sapiens
ccaagctacttaggagtctgag

SEQ ID NO: 9481120 - DNA, 22 bp, Homo sapiens
ccaagctacttaggagtctgag

SEQ ID NO: 9481121 - DNA, 22 bp, Homo sapiens
ccaagctggacagcagcaagga

SEQ ID NO: 9481122 - DNA, 22 bp, Homo sapiens
ccaagcagtctgctaggagttt

SEQ ID NO: 9481123 - DNA, 22 bp, Homo sapiens
ccaagcatttctagccagtcac

SEQ ID NO: 9481124 - DNA, 22 bp, Homo sapiens
ccaagccgcggctcctcctgcg

SEQ ID NO: 9481125 - DNA, 22 bp, Homo sapiens
ccaagctacttaggagtctgag

SEQ ID NO: 9481126 - DNA, 22 bp, Homo sapiens
cagttttaggacatgtggatgt

SEQ ID NO: 9481127 - DNA, 22 bp, Homo sapiens
cagttttaggacatgtggatgt

SEQ ID NO: 9481128 - DNA, 22 bp, Homo sapiens
cagttttagggcaatgtgaaga

SEQ ID NO: 9481129 - DNA, 22 bp, Homo sapiens
cagttttagggcaatgtgaaga

SEQ ID NO: 9481130 - DNA, 22 bp, Homo sapiens
cagttttagggcaatgtgaaga

SEQ ID NO: 9481131 - DNA, 22 bp, Homo sapiens
cagttttagctagagcaaacca

SEQ ID NO: 9481132 - DNA, 22 bp, Homo sapiens
cagttttagctagagcaaacca

SEQ ID NO: 9481133 - DNA, 22 bp, Homo sapiens
cagttttacccaagcttatttt

SEQ ID NO: 9481134 - DNA, 22 bp, Homo sapiens
cagtttctctcaataagcatcg

SEQ ID NO: 9481135 - DNA, 22 bp, Homo sapiens
cagttttaaattgttagataat

SEQ ID NO: 9481136 - DNA, 22 bp, Homo sapiens
cagttttaaattttgaatgtct

SEQ ID NO: 9481137 - DNA, 22 bp, Homo sapiens
cagttttaaattgttagataat

SEQ ID NO: 9481138 - DNA, 22 bp, Homo sapiens
cagttttaaattgttagataat

SEQ ID NO: 9481139 - DNA, 22 bp, Homo sapiens
cagtttctcagacttcccttgt

SEQ ID NO: 9481140 - DNA, 22 bp, Homo sapiens
cagtttctacgaaggtcaaccc

SEQ ID NO: 9481141 - DNA, 22 bp, Homo sapiens
cagtttctacgacttaagcaca

SEQ ID NO: 9481142 - DNA, 22 bp, Homo sapiens
cagtttctacgacttaagcaca

SEQ ID NO: 9481143 - DNA, 19 bp, Homo sapiens
cagtttatgctttggggac

SEQ ID NO: 9481144 - DNA, 22 bp, Homo sapiens
cagtttattgttgcgttcacat

SEQ ID NO: 9481145 - DNA, 22 bp, Homo sapiens
cagtttatttccaagatgacaa

SEQ ID NO: 9481146 - DNA, 22 bp, Homo sapiens
cagtttatttccaagatgacaa

SEQ ID NO: 9481147 - DNA, 22 bp, Homo sapiens
cagtttcagaatcaaaacatca

SEQ ID NO: 9481148 - DNA, 22 bp, Homo sapiens
cagtttcagaatcaaaacatca

SEQ ID NO: 9481149 - DNA, 22 bp, Homo sapiens
cagtttcagaatcaaaacatca

SEQ ID NO: 9481150 - DNA, 22 bp, Homo sapiens
cagtttatgcagctggaataga

SEQ ID NO: 9481151 - DNA, 22 bp, Homo sapiens
cagtttatgcagctggaataga

SEQ ID NO: 9481152 - DNA, 20 bp, Homo sapiens
cagtttatctttccggagct

SEQ ID NO: 9481153 - DNA, 20 bp, Homo sapiens
cagtttatctttccggagct

SEQ ID NO: 9481154 - DNA, 22 bp, Homo sapiens
cagtttatattctagtgctgtt

SEQ ID NO: 9481155 - DNA, 22 bp, Homo sapiens
cagtttatatgtcagagctgta

SEQ ID NO: 9481156 - DNA, 22 bp, Homo sapiens
cagtttatattctagtgctgtt

SEQ ID NO: 9481157 - DNA, 22 bp, Homo sapiens
cagttctggaggctccacatct

SEQ ID NO: 9481158 - DNA, 22 bp, Homo sapiens
cagttctgagctttcccagaag

SEQ ID NO: 9481159 - DNA, 22 bp, Homo sapiens
cagttctgagctttcccagaag

SEQ ID NO: 9481160 - DNA, 22 bp, Homo sapiens
cagtggttatacttactgtttc

SEQ ID NO: 9481161 - DNA, 22 bp, Homo sapiens
cagttctgactttcataatgtc

SEQ ID NO: 9481162 - DNA, 18 bp, Homo sapiens
cagtggtgctgggatgtg

SEQ ID NO: 9481163 - DNA, 18 bp, Homo sapiens
cagtggtgctgggatgtg

SEQ ID NO: 9481164 - DNA, 22 bp, Homo sapiens
cagtggtggaatgaggaattgt

SEQ ID NO: 9481165 - DNA, 18 bp, Homo sapiens
cagtggtgctgggatgtg

SEQ ID NO: 9481166 - DNA, 22 bp, Homo sapiens
cagtggtgaagagcaggggctc

SEQ ID NO: 9481167 - DNA, 22 bp, Homo sapiens
cagtggtgaagagcaggggctc

SEQ ID NO: 9481168 - DNA, 21 bp, Homo sapiens
cagtggtctgtctccattttt

SEQ ID NO: 9481169 - DNA, 22 bp, Homo sapiens
cagtggcgtgatctctgctcac

SEQ ID NO: 9481170 - DNA, 22 bp, Homo sapiens
cagtggcgtgatctctgctcac

SEQ ID NO: 9481171 - DNA, 22 bp, Homo sapiens
cagtgggtgccatcgtgccctt

SEQ ID NO: 9481172 - DNA, 22 bp, Homo sapiens
cagtgggtgccatcgtgccctt

SEQ ID NO: 9481173 - DNA, 22 bp, Homo sapiens
cagtggcgtgatctctgctcac

SEQ ID NO: 9481174 - DNA, 22 bp, Homo sapiens
cagtggtactctcagatgttta

SEQ ID NO: 9481175 - DNA, 22 bp, Homo sapiens
cagtgggtggctaagtggctga

SEQ ID NO: 9481176 - DNA, 22 bp, Homo sapiens
cagtggtatttgagagaatgga

SEQ ID NO: 9481177 - DNA, 22 bp, Homo sapiens
cagtggtagaagccaagtagat

SEQ ID NO: 9481178 - DNA, 23 bp, Homo sapiens
cagtggtcagaacgtgggagggt

SEQ ID NO: 9481179 - DNA, 22 bp, Homo sapiens
catagtgtctggtaacatagta

SEQ ID NO: 9481180 - DNA, 22 bp, Homo sapiens
catagttataaggcaacactgt

SEQ ID NO: 9481181 - DNA, 22 bp, Homo sapiens
catataaatacaacatgtgtta

SEQ ID NO: 9481182 - DNA, 22 bp, Homo sapiens
catagttcctacctaagcataa

SEQ ID NO: 9481183 - DNA, 22 bp, Homo sapiens
catataaatacaacatgtgtta

SEQ ID NO: 9481184 - DNA, 22 bp, Homo sapiens
catataaatacaacatgtgtta

SEQ ID NO: 9481185 - DNA, 22 bp, Homo sapiens
catataaatacaacatgtgtta

SEQ ID NO: 9481186 - DNA, 22 bp, Homo sapiens
cataggtcactgtacaggttaa

SEQ ID NO: 9481187 - DNA, 22 bp, Homo sapiens
catagtaagtgcataataaatg

SEQ ID NO: 9481188 - DNA, 22 bp, Homo sapiens
catagtaagtgcataataaatg

SEQ ID NO: 9481189 - DNA, 20 bp, Homo sapiens
catagtaaagacattttagg

SEQ ID NO: 9481190 - DNA, 22 bp, Homo sapiens
catagcttaggggttaaactca

SEQ ID NO: 9481191 - DNA, 22 bp, Homo sapiens
cataggaagccatctcagtcac

SEQ ID NO: 9481192 - DNA, 22 bp, Homo sapiens
cataggaagccatctcagtcac

SEQ ID NO: 9481193 - DNA, 22 bp, Homo sapiens
cagttttatacactgcagctcc

SEQ ID NO: 9481194 - DNA, 22 bp, Homo sapiens
cagttttatacactgcagctcc

SEQ ID NO: 9481195 - DNA, 22 bp, Homo sapiens
cagttttatacactgcagctcc

SEQ ID NO: 9481196 - DNA, 22 bp, Homo sapiens
cagttttatgaatgcttattag

SEQ ID NO: 9481197 - DNA, 22 bp, Homo sapiens
cagttttatcatctgtgaaatg

SEQ ID NO: 9481198 - DNA, 22 bp, Homo sapiens
catacatatgtggatgtcatat

SEQ ID NO: 9481199 - DNA, 22 bp, Homo sapiens
catagattcttatttccatctt

SEQ ID NO: 9481200 - DNA, 22 bp, Homo sapiens
catagattcttatttccatctt

SEQ ID NO: 9481201 - DNA, 22 bp, Homo sapiens
catagaggctaaaattatttgg

SEQ ID NO: 9481202 - DNA, 22 bp, Homo sapiens
catagaggtgtcagggacatct

SEQ ID NO: 9481203 - DNA, 22 bp, Homo sapiens
catagaggcaaaatggctgtac

SEQ ID NO: 9481204 - DNA, 22 bp, Homo sapiens
catattaaggtctgtaaggggt

SEQ ID NO: 9481205 - DNA, 22 bp, Homo sapiens
catattaaggtctgtaaggggt

SEQ ID NO: 9481206 - DNA, 21 bp, Homo sapiens
catattaaatcggtgccttta

SEQ ID NO: 9481207 - DNA, 22 bp, Homo sapiens
catattcaaggggtaaggcaaa

SEQ ID NO: 9481208 - DNA, 22 bp, Homo sapiens
catattgtgtgatgagtataat

SEQ ID NO: 9481209 - DNA, 22 bp, Homo sapiens
catattgtctattgctgttttt

SEQ ID NO: 9481210 - DNA, 19 bp, Homo sapiens
catattgtgcttgcatttt

SEQ ID NO: 9481211 - DNA, 22 bp, Homo sapiens
catattgtctattgctgttttt

SEQ ID NO: 9481212 - DNA, 19 bp, Homo sapiens
catattgtgcttgcatttt

SEQ ID NO: 9481213 - DNA, 22 bp, Homo sapiens
catatttagtgtttggagatcg

SEQ ID NO: 9481214 - DNA, 22 bp, Homo sapiens
catatttagtgtttggagatcg

SEQ ID NO: 9481215 - DNA, 22 bp, Homo sapiens
catatttatagatctggcattt

SEQ ID NO: 9481216 - DNA, 22 bp, Homo sapiens
catatttcagtctaagatgtgt

SEQ ID NO: 9481217 - DNA, 22 bp, Homo sapiens
catatttggtataacttaagca

SEQ ID NO: 9481218 - DNA, 22 bp, Homo sapiens
catatttattcttctgccagtg

SEQ ID NO: 9481219 - DNA, 22 bp, Homo sapiens
catatttattcttctgccagtg

SEQ ID NO: 9481220 - DNA, 21 bp, Homo sapiens
aggaggctgtctctttcagct

SEQ ID NO: 9481221 - DNA, 22 bp, Homo sapiens
aggagggagcactatatgggga

SEQ ID NO: 9481222 - DNA, 21 bp, Homo sapiens
aggaggctgtctctttcagct

SEQ ID NO: 9481223 - DNA, 21 bp, Homo sapiens
aggaggctgtctctttcagct

SEQ ID NO: 9481224 - DNA, 22 bp, Homo sapiens
catattttagttgctgaacagc

SEQ ID NO: 9481225 - DNA, 22 bp, Homo sapiens
aggagggagcttaagccaggca

SEQ ID NO: 9481226 - DNA, 22 bp, Homo sapiens
aggagggagcttaagccaggca

SEQ ID NO: 9481227 - DNA, 22 bp, Homo sapiens
aggagggagcttaagccaggca

SEQ ID NO: 9481228 - DNA, 22 bp, Homo sapiens
aggagggagcttaagccaggca

SEQ ID NO: 9481229 - DNA, 22 bp, Homo sapiens
aggagggagcttaagccaggca

SEQ ID NO: 9481230 - DNA, 22 bp, Homo sapiens
aggacaggattgagctgaactg

SEQ ID NO: 9481231 - DNA, 22 bp, Homo sapiens
aggacaggattccttgccttgc

SEQ ID NO: 9481232 - DNA, 22 bp, Homo sapiens
aggacatgtaaatggagaggga

SEQ ID NO: 9481233 - DNA, 22 bp, Homo sapiens
aggacaggattgagctgaactg

SEQ ID NO: 9481234 - DNA, 22 bp, Homo sapiens
aggacaggattgagctgaactg

SEQ ID NO: 9481235 - DNA, 22 bp, Homo sapiens
caggtgggagcgaggagctact

SEQ ID NO: 9481236 - DNA, 22 bp, Homo sapiens
caggtgggagcggagactgatt

SEQ ID NO: 9481237 - DNA, 22 bp, Homo sapiens
aggacaggattccttgccttgc

SEQ ID NO: 9481238 - DNA, 22 bp, Homo sapiens
caggtgggagcgaggagctact

SEQ ID NO: 9481239 - DNA, 22 bp, Homo sapiens
caggtgggagcgaggagctact

SEQ ID NO: 9481240 - DNA, 22 bp, Homo sapiens
caggtggcttctctgcagcctt

SEQ ID NO: 9481241 - DNA, 22 bp, Homo sapiens
caggtgggaccatgatagggca

SEQ ID NO: 9481242 - DNA, 22 bp, Homo sapiens
caggtgcaatgagacagctctg

SEQ ID NO: 9481243 - DNA, 22 bp, Homo sapiens
caggtgcacattactgtgttgg

SEQ ID NO: 9481244 - DNA, 22 bp, Homo sapiens
caggtgccatagacgggcctgg

SEQ ID NO: 9481245 - DNA, 22 bp, Homo sapiens
caggtggcttctccctaggcca

SEQ ID NO: 9481246 - DNA, 22 bp, Homo sapiens
aggacccacgcacaggaacccc

SEQ ID NO: 9481247 - DNA, 22 bp, Homo sapiens
aggacccagaaggtgcagcaga

SEQ ID NO: 9481248 - DNA, 22 bp, Homo sapiens
aggaccctgagcgggcatgccg

SEQ ID NO: 9481249 - DNA, 22 bp, Homo sapiens
aggacccagaaggtgcagcaga

SEQ ID NO: 9481250 - DNA, 21 bp, Homo sapiens
aggacctagaaaagtgcctag

SEQ ID NO: 9481251 - DNA, 22 bp, Homo sapiens
aggacctactgatatcttagca

SEQ ID NO: 9481252 - DNA, 22 bp, Homo sapiens
aggaccctgaggtctcctgtga

SEQ ID NO: 9481253 - DNA, 22 bp, Homo sapiens
aggaccctgctcaagcatctcc

SEQ ID NO: 9481254 - DNA, 22 bp, Homo sapiens
aggacctgtgttttccttgaat

SEQ ID NO: 9481255 - DNA, 22 bp, Homo sapiens
aggacctgccaggtgcaaagca

SEQ ID NO: 9481256 - DNA, 22 bp, Homo sapiens
aggacctgactggctcctgctt

SEQ ID NO: 9481257 - DNA, 22 bp, Homo sapiens
aggacctggatcacagagatct

SEQ ID NO: 9481258 - DNA, 22 bp, Homo sapiens
aggaccagaccgaactagctaa

SEQ ID NO: 9481259 - DNA, 22 bp, Homo sapiens
aggaccaccggtccatccaccc

SEQ ID NO: 9481260 - DNA, 22 bp, Homo sapiens
aggaccagaggccagagtcagc

SEQ ID NO: 9481261 - DNA, 22 bp, Homo sapiens
aggaccaggtctaatgaagaca

SEQ ID NO: 9481262 - DNA, 22 bp, Homo sapiens
aggaccagcctccaggtctctt

SEQ ID NO: 9481263 - DNA, 22 bp, Homo sapiens
aggaccagtatgagagcatctg

SEQ ID NO: 9481264 - DNA, 23 bp, Homo sapiens
aggaccaggttcccaaaagtcaa

SEQ ID NO: 9481265 - DNA, 22 bp, Homo sapiens
aggaccagtgagtctggcaagt

SEQ ID NO: 9481266 - DNA, 22 bp, Homo sapiens
aggacccaagcacagttcctgg

SEQ ID NO: 9481267 - DNA, 22 bp, Homo sapiens
aggagaaggaagtgcatcacta

SEQ ID NO: 9481268 - DNA, 21 bp, Homo sapiens
cagtgctcaggaatagagaga

SEQ ID NO: 9481269 - DNA, 22 bp, Homo sapiens
cagtgctatttggacacaggga

SEQ ID NO: 9481270 - DNA, 22 bp, Homo sapiens
cagtgcccttccaggactgcag

SEQ ID NO: 9481271 - DNA, 19 bp, Homo sapiens
aggactctggaggcatgag

SEQ ID NO: 9481272 - DNA, 19 bp, Homo sapiens
cagtgcccgacgcaggtct

SEQ ID NO: 9481273 - DNA, 22 bp, Homo sapiens
cagtgcccttccaggactgcag

SEQ ID NO: 9481274 - DNA, 22 bp, Homo sapiens
aggactccatgtgtcctggaga

SEQ ID NO: 9481275 - DNA, 22 bp, Homo sapiens
cagtgcaggtggcagaggacag

SEQ ID NO: 9481276 - DNA, 22 bp, Homo sapiens
aggactcctgctgggaatggct

SEQ ID NO: 9481277 - DNA, 22 bp, Homo sapiens
cagtggagaggcatgcttggca

SEQ ID NO: 9481278 - DNA, 22 bp, Homo sapiens
cagtggcatggttgactgcagt

SEQ ID NO: 9481279 - DNA, 17 bp, Homo sapiens
cagtggcctatggcttt

SEQ ID NO: 9481280 - DNA, 22 bp, Homo sapiens
cagtggcctgagccaggcttcc

SEQ ID NO: 9481281 - DNA, 19 bp, Homo sapiens
cagtggcctggaggtctct

SEQ ID NO: 9481282 - DNA, 22 bp, Homo sapiens
cagtggcctttcctgctgctca

SEQ ID NO: 9481283 - DNA, 19 bp, Homo sapiens
aggagaagtagcagaaatt

SEQ ID NO: 9481284 - DNA, 19 bp, Homo sapiens
aggagaagtagcagaaatt

SEQ ID NO: 9481285 - DNA, 19 bp, Homo sapiens
aggagaagtagcagaaatt

SEQ ID NO: 9481286 - DNA, 22 bp, Homo sapiens
aggagaagtaaggctagatgat

SEQ ID NO: 9481287 - DNA, 22 bp, Homo sapiens
cagtggagagacttttactctt

SEQ ID NO: 9481288 - DNA, 22 bp, Homo sapiens
cagtggagagacttttactctt

SEQ ID NO: 9481289 - DNA, 19 bp, Homo sapiens
aggagaagtagcagaaatt

SEQ ID NO: 9481290 - DNA, 19 bp, Homo sapiens
aggagaagtagcagaaatt

SEQ ID NO: 9481291 - DNA, 19 bp, Homo sapiens
aggagaagtagcagaaatt

SEQ ID NO: 9481292 - DNA, 19 bp, Homo sapiens
aggagaagtagcagaaatt

SEQ ID NO: 9481293 - DNA, 19 bp, Homo sapiens
aggagaagtagcagaaatt

SEQ ID NO: 9481294 - DNA, 22 bp, Homo sapiens
aggagaaggaggcccctcacac

SEQ ID NO: 9481295 - DNA, 22 bp, Homo sapiens
aggagaaggaggcccctcacac

SEQ ID NO: 9481296 - DNA, 22 bp, Homo sapiens
aggagaaggaagtgcatcacta

SEQ ID NO: 9481297 - DNA, 22 bp, Homo sapiens
aggagaaggaagtgcatcacta

SEQ ID NO: 9481298 - DNA, 22 bp, Homo sapiens
aggagaagtaaggctagatgat

SEQ ID NO: 9481299 - DNA, 22 bp, Homo sapiens
aggagaaggaggcccctcacac

SEQ ID NO: 9481300 - DNA, 22 bp, Homo sapiens
aggagaagtaaggctagatgat

SEQ ID NO: 9481301 - DNA, 22 bp, Homo sapiens
aggagaagtaaggctagatgat

SEQ ID NO: 9481302 - DNA, 22 bp, Homo sapiens
aggagaagtaaggctagatgat

SEQ ID NO: 9481303 - DNA, 22 bp, Homo sapiens
aggagaagtaaggctagatgat

SEQ ID NO: 9481304 - DNA, 22 bp, Homo sapiens
cagggagctggctggctgtgcc

SEQ ID NO: 9481305 - DNA, 22 bp, Homo sapiens
cagggagctggctggcgtgagt

SEQ ID NO: 9481306 - DNA, 22 bp, Homo sapiens
cagggagctggagttggagtac

SEQ ID NO: 9481307 - DNA, 22 bp, Homo sapiens
cagggagctggctggctgtgcc

SEQ ID NO: 9481308 - DNA, 22 bp, Homo sapiens
cagggagctggctggctgtgcc

SEQ ID NO: 9481309 - DNA, 22 bp, Homo sapiens
cagggagctggctggctgtgcc

SEQ ID NO: 9481310 - DNA, 22 bp, Homo sapiens
cagggagctctgggccggactc

SEQ ID NO: 9481311 - DNA, 22 bp, Homo sapiens
cagggagctggagttggagtac

SEQ ID NO: 9481312 - DNA, 22 bp, Homo sapiens
cagggagctgacaaccaaggag

SEQ ID NO: 9481313 - DNA, 22 bp, Homo sapiens
cagggagctctgggccggactc

SEQ ID NO: 9481314 - DNA, 22 bp, Homo sapiens
cagggagctattagggttagtg

SEQ ID NO: 9481315 - DNA, 22 bp, Homo sapiens
cagggagctctgggccggactc

SEQ ID NO: 9481316 - DNA, 22 bp, Homo sapiens
cagggagctggtgccagccgac

SEQ ID NO: 9481317 - DNA, 22 bp, Homo sapiens
cagggatgggatggagtcagtt

SEQ ID NO: 9481318 - DNA, 22 bp, Homo sapiens
cagggatgggatggagtcagtt

SEQ ID NO: 9481319 - DNA, 22 bp, Homo sapiens
cagggatggcgctggctgcccg

SEQ ID NO: 9481320 - DNA, 19 bp, Homo sapiens
cagggatgggtagggactc

SEQ ID NO: 9481321 - DNA, 22 bp, Homo sapiens
cagggatggtaaatatgtaaag

SEQ ID NO: 9481322 - DNA, 19 bp, Homo sapiens
cagggatgggtagggactc

SEQ ID NO: 9481323 - DNA, 19 bp, Homo sapiens
cagggatgggtagggactc

SEQ ID NO: 9481324 - DNA, 19 bp, Homo sapiens
cagggatgggtagggactc

SEQ ID NO: 9481325 - DNA, 22 bp, Homo sapiens
cagggatgggatggagtcagtt

SEQ ID NO: 9481326 - DNA, 22 bp, Homo sapiens
cagggatgggatggagtcagtt

SEQ ID NO: 9481327 - DNA, 22 bp, Homo sapiens
cagggatgggatggagtcagtt

SEQ ID NO: 9481328 - DNA, 22 bp, Homo sapiens
cagggatgggatggagtcagtt

SEQ ID NO: 9481329 - DNA, 22 bp, Homo sapiens
cagggatgggatggagtcagtt

SEQ ID NO: 9481330 - DNA, 22 bp, Homo sapiens
cagggatgggatggagtcagtt

SEQ ID NO: 9481331 - DNA, 19 bp, Homo sapiens
cagggatgggtagggactc

SEQ ID NO: 9481332 - DNA, 22 bp, Homo sapiens
cagggagcggagtcccatgcct

SEQ ID NO: 9481333 - DNA, 22 bp, Homo sapiens
cagggagaaatctccaggaggt

SEQ ID NO: 9481334 - DNA, 22 bp, Homo sapiens
cagggagctattagggttagtg

SEQ ID NO: 9481335 - DNA, 22 bp, Homo sapiens
cagggagaaatctccaggaggt

SEQ ID NO: 9481336 - DNA, 22 bp, Homo sapiens
caggctggagttacctttaggg

SEQ ID NO: 9481337 - DNA, 22 bp, Homo sapiens
caggctggagttacctttaggg

SEQ ID NO: 9481338 - DNA, 22 bp, Homo sapiens
caggctggagtgcagttgtgca

SEQ ID NO: 9481339 - DNA, 22 bp, Homo sapiens
caggctggagtgcagttgtgca

SEQ ID NO: 9481340 - DNA, 22 bp, Homo sapiens
caggctggagttacctttaggg

SEQ ID NO: 9481341 - DNA, 22 bp, Homo sapiens
caggctggagtgcagttgtgca

SEQ ID NO: 9481342 - DNA, 22 bp, Homo sapiens
caggctgctgcctagaatgaca

SEQ ID NO: 9481343 - DNA, 22 bp, Homo sapiens
caggctgctgcctagaatgaca

SEQ ID NO: 9481344 - DNA, 22 bp, Homo sapiens
caggctgctgacaggcttggag

SEQ ID NO: 9481345 - DNA, 22 bp, Homo sapiens
caggctggacattagatacata

SEQ ID NO: 9481346 - DNA, 22 bp, Homo sapiens
caggctggacattagatacata

SEQ ID NO: 9481347 - DNA, 22 bp, Homo sapiens
caggctggagtgcagtgtcgcc

SEQ ID NO: 9481348 - DNA, 22 bp, Homo sapiens
caggctggagtgcagtgtcgcc

SEQ ID NO: 9481349 - DNA, 22 bp, Homo sapiens
caggctggagtacaattgtgtg

SEQ ID NO: 9481350 - DNA, 22 bp, Homo sapiens
caggctggagtgcagtggtgcc

SEQ ID NO: 9481351 - DNA, 22 bp, Homo sapiens
caggctggagtgcagtggtgcc

SEQ ID NO: 9481352 - DNA, 22 bp, Homo sapiens
agctgtgcctattcgtggcaag

SEQ ID NO: 9481353 - DNA, 22 bp, Homo sapiens
agctgtgccttgctgcacggtg

SEQ ID NO: 9481354 - DNA, 22 bp, Homo sapiens
agctgtgctgccaagttgctga

SEQ ID NO: 9481355 - DNA, 22 bp, Homo sapiens
agctgtgattatccactggaat

SEQ ID NO: 9481356 - DNA, 19 bp, Homo sapiens
agctgtgcagacacttcgc

SEQ ID NO: 9481357 - DNA, 22 bp, Homo sapiens
agctgtgctgtggtcatctggg

SEQ ID NO: 9481358 - DNA, 22 bp, Homo sapiens
agctgtggaagactgtcagggt

SEQ ID NO: 9481359 - DNA, 22 bp, Homo sapiens
agctgtggaagactgtcagggt

SEQ ID NO: 9481360 - DNA, 22 bp, Homo sapiens
agctgtggagtagggggttgga

SEQ ID NO: 9481361 - DNA, 19 bp, Homo sapiens
agctgtggatgtgggattt

SEQ ID NO: 9481362 - DNA, 22 bp, Homo sapiens
agctgtggagtagggggttgga

SEQ ID NO: 9481363 - DNA, 22 bp, Homo sapiens
agctgtggaagactgtcagggt

SEQ ID NO: 9481364 - DNA, 22 bp, Homo sapiens
agctgtggaagactgtcagggt

SEQ ID NO: 9481365 - DNA, 22 bp, Homo sapiens
agctgtggcaaccttgtcagac

SEQ ID NO: 9481366 - DNA, 19 bp, Homo sapiens
agctgtggatgtgggattt

SEQ ID NO: 9481367 - DNA, 22 bp, Homo sapiens
agctgtggcaaccttgtcagac

SEQ ID NO: 9481368 - DNA, 22 bp, Homo sapiens
agctgtggattgggtactttct

SEQ ID NO: 9481369 - DNA, 22 bp, Homo sapiens
caggctgctccagggtaggaaa

SEQ ID NO: 9481370 - DNA, 22 bp, Homo sapiens
caggctgctccagggtaggaaa

SEQ ID NO: 9481371 - DNA, 22 bp, Homo sapiens
caggctgcggccgtgtgagcat

SEQ ID NO: 9481372 - DNA, 22 bp, Homo sapiens
caggctgaggcagtagggtttg

SEQ ID NO: 9481373 - DNA, 22 bp, Homo sapiens
caggctgagctctggcctgggc

SEQ ID NO: 9481374 - DNA, 22 bp, Homo sapiens
caggctgcggccgtgtgagcat

SEQ ID NO: 9481375 - DNA, 22 bp, Homo sapiens
caggctgagctctggcctgggc

SEQ ID NO: 9481376 - DNA, 22 bp, Homo sapiens
agctggggcatttatccactaa

SEQ ID NO: 9481377 - DNA, 18 bp, Homo sapiens
agctggggcctctggtcc

SEQ ID NO: 9481378 - DNA, 22 bp, Homo sapiens
caggcctggttgagccctgaga

SEQ ID NO: 9481379 - DNA, 18 bp, Homo sapiens
agctggggcctctggtcc

SEQ ID NO: 9481380 - DNA, 22 bp, Homo sapiens
caggctcactgtaaggtcagct

SEQ ID NO: 9481381 - DNA, 22 bp, Homo sapiens
caggctcactgtaaggtcagct

SEQ ID NO: 9481382 - DNA, 22 bp, Homo sapiens
caggctcactgtaaggtcagct

SEQ ID NO: 9481383 - DNA, 22 bp, Homo sapiens
caggctcactttctcagtcaca

SEQ ID NO: 9481384 - DNA, 22 bp, Homo sapiens
caggctcactttctcagtcaca

SEQ ID NO: 9481385 - DNA, 22 bp, Homo sapiens
caggctcactttctcagtcaca

SEQ ID NO: 9481386 - DNA, 22 bp, Homo sapiens
caggctcagtcagaaaatgtat

SEQ ID NO: 9481387 - DNA, 22 bp, Homo sapiens
caggctccactgtaggcagctc

SEQ ID NO: 9481388 - DNA, 22 bp, Homo sapiens
caggctccaagccctctgatgt

SEQ ID NO: 9481389 - DNA, 22 bp, Homo sapiens
caggctccacaggggaatccgg

SEQ ID NO: 9481390 - DNA, 22 bp, Homo sapiens
agctgtgattatccactggaat

SEQ ID NO: 9481391 - DNA, 22 bp, Homo sapiens
caggctcagctctggccagtgc

SEQ ID NO: 9481392 - DNA, 22 bp, Homo sapiens
caggctcagccacaggggaagg

SEQ ID NO: 9481393 - DNA, 22 bp, Homo sapiens
caggctcagcaggagcctgacc

SEQ ID NO: 9481394 - DNA, 22 bp, Homo sapiens
caggctcagcaggagcctgacc

SEQ ID NO: 9481395 - DNA, 22 bp, Homo sapiens
caggctcagaagccagtggagc

SEQ ID NO: 9481396 - DNA, 22 bp, Homo sapiens
caggctcagatgccctgcgctg

SEQ ID NO: 9481397 - DNA, 22 bp, Homo sapiens
cagggcctctcctccaggaact

SEQ ID NO: 9481398 - DNA, 22 bp, Homo sapiens
cagggcctcgaagcctctgggc

SEQ ID NO: 9481399 - DNA, 22 bp, Homo sapiens
cagggcctgcaagagacctggg

SEQ ID NO: 9481400 - DNA, 22 bp, Homo sapiens
cagggcctgcaagagacctggg

SEQ ID NO: 9481401 - DNA, 22 bp, Homo sapiens
cagggcctgagggctgctctgc

SEQ ID NO: 9481402 - DNA, 22 bp, Homo sapiens
cagggcctgcaagagacctggg

SEQ ID NO: 9481403 - DNA, 22 bp, Homo sapiens
cagggcctctgtgggctctctc

SEQ ID NO: 9481404 - DNA, 22 bp, Homo sapiens
cagggcctctgtgggctctctc

SEQ ID NO: 9481405 - DNA, 22 bp, Homo sapiens
cagggatgtctctggaagggag

SEQ ID NO: 9481406 - DNA, 22 bp, Homo sapiens
cagggatgtctctggaagggag

SEQ ID NO: 9481407 - DNA, 22 bp, Homo sapiens
cagggatgtctctggaagggag

SEQ ID NO: 9481408 - DNA, 22 bp, Homo sapiens
cagggatgtctctggaagggag

SEQ ID NO: 9481409 - DNA, 22 bp, Homo sapiens
cagggcctccccggcagtcttt

SEQ ID NO: 9481410 - DNA, 23 bp, Homo sapiens
cagggccaggcagcagctgtcac

SEQ ID NO: 9481411 - DNA, 22 bp, Homo sapiens
cagggcctccccggcagtcttt

SEQ ID NO: 9481412 - DNA, 22 bp, Homo sapiens
cagggcctcctaaggcatctaa

SEQ ID NO: 9481413 - DNA, 22 bp, Homo sapiens
caggggctccctgggtgccagt

SEQ ID NO: 9481414 - DNA, 22 bp, Homo sapiens
caggggctccctgggtgccagt

SEQ ID NO: 9481415 - DNA, 22 bp, Homo sapiens
cagggctctgccttgagggatg

SEQ ID NO: 9481416 - DNA, 22 bp, Homo sapiens
cagggctcgctcgctcgctcgc

SEQ ID NO: 9481417 - DNA, 22 bp, Homo sapiens
cagggctcgctcttgcccttcg

SEQ ID NO: 9481418 - DNA, 22 bp, Homo sapiens
cagggctcgctgccagcttcag

SEQ ID NO: 9481419 - DNA, 22 bp, Homo sapiens
cagggctcgctgccagcttcag

SEQ ID NO: 9481420 - DNA, 22 bp, Homo sapiens
cagggctcgctgccagcttcag

SEQ ID NO: 9481421 - DNA, 22 bp, Homo sapiens
cagggctcccaaatatctcttc

SEQ ID NO: 9481422 - DNA, 22 bp, Homo sapiens
cagggctccccagagagcctct

SEQ ID NO: 9481423 - DNA, 22 bp, Homo sapiens
cagggctccccagagagcctct

SEQ ID NO: 9481424 - DNA, 22 bp, Homo sapiens
cagggctccctctggctcccag

SEQ ID NO: 9481425 - DNA, 22 bp, Homo sapiens
cagggctccccgcaccgcagcc

SEQ ID NO: 9481426 - DNA, 22 bp, Homo sapiens
cagggctccctgcagcctctgt

SEQ ID NO: 9481427 - DNA, 22 bp, Homo sapiens
cagggctccctgcagcctctgt

SEQ ID NO: 9481428 - DNA, 22 bp, Homo sapiens
cagggctcccttgcaaggaggg

SEQ ID NO: 9481429 - DNA, 22 bp, Homo sapiens
cagggtgagcctctggagccct

SEQ ID NO: 9481430 - DNA, 22 bp, Homo sapiens
cagggtgagcctctggagccct

SEQ ID NO: 9481431 - DNA, 22 bp, Homo sapiens
cagggtgactgccctggccact

SEQ ID NO: 9481432 - DNA, 22 bp, Homo sapiens
cagggtgcagtgtcgctgctag

SEQ ID NO: 9481433 - DNA, 22 bp, Homo sapiens
cagggtgagcctctggagccct

SEQ ID NO: 9481434 - DNA, 22 bp, Homo sapiens
cagggtgcatacccatgcatac

SEQ ID NO: 9481435 - DNA, 22 bp, Homo sapiens
caggggctgtgggcggagcctc

SEQ ID NO: 9481436 - DNA, 22 bp, Homo sapiens
cagggtgacaagtggcaaggag

SEQ ID NO: 9481437 - DNA, 22 bp, Homo sapiens
cagggtcttggcgccatcaccc

SEQ ID NO: 9481438 - DNA, 22 bp, Homo sapiens
caggggctgtggcacatggtgt

SEQ ID NO: 9481439 - DNA, 22 bp, Homo sapiens
caggggctgaaatgttggggtt

SEQ ID NO: 9481440 - DNA, 22 bp, Homo sapiens
caggggctgaaatgttggggtt

SEQ ID NO: 9481441 - DNA, 22 bp, Homo sapiens
caggggctgaaatgttggggtt

SEQ ID NO: 9481442 - DNA, 22 bp, Homo sapiens
caggggctctaatgcatgatca

SEQ ID NO: 9481443 - DNA, 22 bp, Homo sapiens
caggggctctaatgcatgatca

SEQ ID NO: 9481444 - DNA, 22 bp, Homo sapiens
caggggctccctgggtgccagt

SEQ ID NO: 9481445 - DNA, 22 bp, Homo sapiens
caggggctctgggtgatgtgag

SEQ ID NO: 9481446 - DNA, 22 bp, Homo sapiens
cagggtgcctctgctcccacca

SEQ ID NO: 9481447 - DNA, 22 bp, Homo sapiens
cagggtgcctgtcctcagcaaa

SEQ ID NO: 9481448 - DNA, 22 bp, Homo sapiens
cagggtgcctcccgctcgccgg

SEQ ID NO: 9481449 - DNA, 22 bp, Homo sapiens
cagggtgcctcccgctcgccgg

SEQ ID NO: 9481450 - DNA, 22 bp, Homo sapiens
cagggtgcctgtcctcagcaaa

SEQ ID NO: 9481451 - DNA, 22 bp, Homo sapiens
cagggtgcctgtcctcagcaaa

SEQ ID NO: 9481452 - DNA, 22 bp, Homo sapiens
cagggtgcgccactcagatgta

SEQ ID NO: 9481453 - DNA, 22 bp, Homo sapiens
cagggtgcgccactcagatgta

SEQ ID NO: 9481454 - DNA, 22 bp, Homo sapiens
caggtcctttagtgtccagaac

SEQ ID NO: 9481455 - DNA, 22 bp, Homo sapiens
caggtgaccctctcacctgctt

SEQ ID NO: 9481456 - DNA, 22 bp, Homo sapiens
caggtgacctatggtcactaca

SEQ ID NO: 9481457 - DNA, 22 bp, Homo sapiens
caggtgagaggcggtcctgcat

SEQ ID NO: 9481458 - DNA, 22 bp, Homo sapiens
caggtgacctttgtcctaagtt

SEQ ID NO: 9481459 - DNA, 20 bp, Homo sapiens
caggtgagcagatctgggtg

SEQ ID NO: 9481460 - DNA, 20 bp, Homo sapiens
caggtgagcagatctgggtg

SEQ ID NO: 9481461 - DNA, 22 bp, Homo sapiens
caggtgagctctatctagggag

SEQ ID NO: 9481462 - DNA, 22 bp, Homo sapiens
caggtgagctctatctagggag

SEQ ID NO: 9481463 - DNA, 20 bp, Homo sapiens
caggtgagcagatctgggtg

SEQ ID NO: 9481464 - DNA, 22 bp, Homo sapiens
caggtgagctctatctagggag

SEQ ID NO: 9481465 - DNA, 22 bp, Homo sapiens
caggtgaggctgaacagatgaa

SEQ ID NO: 9481466 - DNA, 22 bp, Homo sapiens
caggtgagctctatctagggag

SEQ ID NO: 9481467 - DNA, 22 bp, Homo sapiens
caggtgagtaacaatgggtgat

SEQ ID NO: 9481468 - DNA, 22 bp, Homo sapiens
caggtgagttttcctccttggt

SEQ ID NO: 9481469 - DNA, 22 bp, Homo sapiens
caggtgagtaacaatgggtgat

SEQ ID NO: 9481470 - DNA, 22 bp, Homo sapiens
cagctctgggtgacaggagggc

SEQ ID NO: 9481471 - DNA, 22 bp, Homo sapiens
cagctctgggtgacaggagggc

SEQ ID NO: 9481472 - DNA, 22 bp, Homo sapiens
cagctctgggtgacaggagggc

SEQ ID NO: 9481473 - DNA, 22 bp, Homo sapiens
cagctctgggtgacaggagggc

SEQ ID NO: 9481474 - DNA, 22 bp, Homo sapiens
cagctctggttcctgggcccag

SEQ ID NO: 9481475 - DNA, 22 bp, Homo sapiens
cagctctggttcctgggcccag

SEQ ID NO: 9481476 - DNA, 22 bp, Homo sapiens
cagctctggttcctgggcccag

SEQ ID NO: 9481477 - DNA, 22 bp, Homo sapiens
cagctctggtccagggagggca

SEQ ID NO: 9481478 - DNA, 22 bp, Homo sapiens
cagctctgggtaggaggaatct

SEQ ID NO: 9481479 - DNA, 22 bp, Homo sapiens
cagctctgggtaggaggaatct

SEQ ID NO: 9481480 - DNA, 20 bp, Homo sapiens
cagctctgggcaggtcgagg

SEQ ID NO: 9481481 - DNA, 20 bp, Homo sapiens
cagctctgggcaggtcgagg

SEQ ID NO: 9481482 - DNA, 22 bp, Homo sapiens
cagctctggggcagagtgacta

SEQ ID NO: 9481483 - DNA, 22 bp, Homo sapiens
cagctctggggcagagtgacta

SEQ ID NO: 9481484 - DNA, 22 bp, Homo sapiens
cagctctggggcagagtgacta

SEQ ID NO: 9481485 - DNA, 22 bp, Homo sapiens
cagctgaagctcttgtcaaagg

SEQ ID NO: 9481486 - DNA, 22 bp, Homo sapiens
cagctgaaggtaggaaccagga

SEQ ID NO: 9481487 - DNA, 22 bp, Homo sapiens
cagctgaatcagtgagtggaaa

SEQ ID NO: 9481488 - DNA, 22 bp, Homo sapiens
cagctgacgccagagtggaatt

SEQ ID NO: 9481489 - DNA, 22 bp, Homo sapiens
cagctgacctggctaagggagc

SEQ ID NO: 9481490 - DNA, 22 bp, Homo sapiens
cagctgacgccagagtggaatt

SEQ ID NO: 9481491 - DNA, 22 bp, Homo sapiens
cagctgacttcataggaagaca

SEQ ID NO: 9481492 - DNA, 22 bp, Homo sapiens
cagctgacaagagtccttggag

SEQ ID NO: 9481493 - DNA, 22 bp, Homo sapiens
cagctgacactttgacctagag

SEQ ID NO: 9481494 - DNA, 22 bp, Homo sapiens
cagctgaattcttcagactcca

SEQ ID NO: 9481495 - DNA, 22 bp, Homo sapiens
agctgcactgtgaagttcatag

SEQ ID NO: 9481496 - DNA, 22 bp, Homo sapiens
agctgcaatacccttcttcctt

SEQ ID NO: 9481497 - DNA, 22 bp, Homo sapiens
agctgcaacatctgcttgtccc

SEQ ID NO: 9481498 - DNA, 22 bp, Homo sapiens
agctgcaactgtccttgccttg

SEQ ID NO: 9481499 - DNA, 23 bp, Homo sapiens
agctgcaagactccctgtctgag

SEQ ID NO: 9481500 - DNA, 22 bp, Homo sapiens
agctgcaaagatctgtcagtca

SEQ ID NO: 9481501 - DNA, 22 bp, Homo sapiens
agctgagggcaggatggggtga

SEQ ID NO: 9481502 - DNA, 22 bp, Homo sapiens
cagctgagagacaatgagtcat

SEQ ID NO: 9481503 - DNA, 22 bp, Homo sapiens
cagctgagagacaatgagtcat

SEQ ID NO: 9481504 - DNA, 22 bp, Homo sapiens
cagctgagaccagaatgcaggt

SEQ ID NO: 9481505 - DNA, 22 bp, Homo sapiens
cagctgagaccagaatgcaggt

SEQ ID NO: 9481506 - DNA, 22 bp, Homo sapiens
cagctgagagacaatgagtcat

SEQ ID NO: 9481507 - DNA, 22 bp, Homo sapiens
cagctgagagtagaaatggagg

SEQ ID NO: 9481508 - DNA, 22 bp, Homo sapiens
cagctgagaaggtctgatcagg

SEQ ID NO: 9481509 - DNA, 22 bp, Homo sapiens
cagctgagaagtgatagctgca

SEQ ID NO: 9481510 - DNA, 22 bp, Homo sapiens
cagctgagaaatggggaaaggg

SEQ ID NO: 9481511 - DNA, 22 bp, Homo sapiens
cagctgagaaggtctgatcagg

SEQ ID NO: 9481512 - DNA, 22 bp, Homo sapiens
cagctgagaaaggcaggctcac

SEQ ID NO: 9481513 - DNA, 22 bp, Homo sapiens
cagctgagaaaggcaggctcac

SEQ ID NO: 9481514 - DNA, 22 bp, Homo sapiens
agctgcagtgaattcgctaact

SEQ ID NO: 9481515 - DNA, 22 bp, Homo sapiens
agctgcagttagccccagatga

SEQ ID NO: 9481516 - DNA, 22 bp, Homo sapiens
caggaaggggctcactctggcc

SEQ ID NO: 9481517 - DNA, 22 bp, Homo sapiens
caggaagggggatccttggaag

SEQ ID NO: 9481518 - DNA, 22 bp, Homo sapiens
agctgcagttcgttccagctct

SEQ ID NO: 9481519 - DNA, 22 bp, Homo sapiens
agctgccaagttggagtagcaa

SEQ ID NO: 9481520 - DNA, 22 bp, Homo sapiens
agctgccacatgcccaagggca

SEQ ID NO: 9481521 - DNA, 22 bp, Homo sapiens
agctgccacagagcctggccag

SEQ ID NO: 9481522 - DNA, 22 bp, Homo sapiens
agctgccaagtttctcagttta

SEQ ID NO: 9481523 - DNA, 22 bp, Homo sapiens
caggaaggcccacctgtcctgt

SEQ ID NO: 9481524 - DNA, 22 bp, Homo sapiens
caggaaggcccacctgtcctgt

SEQ ID NO: 9481525 - DNA, 22 bp, Homo sapiens
caggaaggcccacctgtcctgt

SEQ ID NO: 9481526 - DNA, 22 bp, Homo sapiens
caggaaggcgcggctgtgcctg

SEQ ID NO: 9481527 - DNA, 22 bp, Homo sapiens
caggaaggcccacctgtcctgt

SEQ ID NO: 9481528 - DNA, 22 bp, Homo sapiens
caggaaggggctcactctggcc

SEQ ID NO: 9481529 - DNA, 19 bp, Homo sapiens
caggaaggggcgaatctgg

SEQ ID NO: 9481530 - DNA, 22 bp, Homo sapiens
caggaaggcgcggctgtgcctg

SEQ ID NO: 9481531 - DNA, 22 bp, Homo sapiens
caggaaggcgcggctgtgcctg

SEQ ID NO: 9481532 - DNA, 22 bp, Homo sapiens
caggaaggcgcggctgtgcctg

SEQ ID NO: 9481533 - DNA, 19 bp, Homo sapiens
agctgcagaccagaagtgc

SEQ ID NO: 9481534 - DNA, 19 bp, Homo sapiens
agctgcagaccagaagtgc

SEQ ID NO: 9481535 - DNA, 18 bp, Homo sapiens
agctgcagaccaggaggt

SEQ ID NO: 9481536 - DNA, 22 bp, Homo sapiens
agctgcagaaaggacaactaat

SEQ ID NO: 9481537 - DNA, 20 bp, Homo sapiens
agctgcagaacccactggac

SEQ ID NO: 9481538 - DNA, 20 bp, Homo sapiens
agctgcagaacccactggac

SEQ ID NO: 9481539 - DNA, 22 bp, Homo sapiens
agctgcagaggtttgtgcaaca

SEQ ID NO: 9481540 - DNA, 18 bp, Homo sapiens
agctgcagaccaggaggt

SEQ ID NO: 9481541 - DNA, 18 bp, Homo sapiens
agctgcagaccaggaggt

SEQ ID NO: 9481542 - DNA, 22 bp, Homo sapiens
agctgcagagaaaagaggctgg

SEQ ID NO: 9481543 - DNA, 22 bp, Homo sapiens
agctgcagagaaaagaggctgg

SEQ ID NO: 9481544 - DNA, 23 bp, Homo sapiens
agctgcagatgctcagcgggcag

SEQ ID NO: 9481545 - DNA, 22 bp, Homo sapiens
agctgcagattctatctagaag

SEQ ID NO: 9481546 - DNA, 22 bp, Homo sapiens
caggaaggaccgtccagatcag

SEQ ID NO: 9481547 - DNA, 22 bp, Homo sapiens
caggaagagaacatggaggctg

SEQ ID NO: 9481548 - DNA, 22 bp, Homo sapiens
caggaagagaacatggaggctg

SEQ ID NO: 9481549 - DNA, 22 bp, Homo sapiens
caggaagagaacatggaggctg

SEQ ID NO: 9481550 - DNA, 18 bp, Homo sapiens
agctggccctggctgccg

SEQ ID NO: 9481551 - DNA, 22 bp, Homo sapiens
agctggccctcgagagccaatt

SEQ ID NO: 9481552 - DNA, 18 bp, Homo sapiens
agctggccctggctgccg

SEQ ID NO: 9481553 - DNA, 22 bp, Homo sapiens
agctggccggcctccaggtgga

SEQ ID NO: 9481554 - DNA, 22 bp, Homo sapiens
agctggccggcctccaggtgga

SEQ ID NO: 9481555 - DNA, 18 bp, Homo sapiens
agctggccctggctgccg

SEQ ID NO: 9481556 - DNA, 22 bp, Homo sapiens
agctggccggcctccaggtgga

SEQ ID NO: 9481557 - DNA, 22 bp, Homo sapiens
caggccagaggctgttgttgcg

SEQ ID NO: 9481558 - DNA, 22 bp, Homo sapiens
agctggcctccgggtgcctggg

SEQ ID NO: 9481559 - DNA, 22 bp, Homo sapiens
agctggcctccgggtgcctggg

SEQ ID NO: 9481560 - DNA, 22 bp, Homo sapiens
caggcactgtgctgagctctgc

SEQ ID NO: 9481561 - DNA, 22 bp, Homo sapiens
caggcactgtgttaggcactgt

SEQ ID NO: 9481562 - DNA, 22 bp, Homo sapiens
caggcactgtgttaggcactgt

SEQ ID NO: 9481563 - DNA, 22 bp, Homo sapiens
caggcactgtgttaggcactgt

SEQ ID NO: 9481564 - DNA, 22 bp, Homo sapiens
caggcactgtgttaggcactgt

SEQ ID NO: 9481565 - DNA, 22 bp, Homo sapiens
caggcacttctgctgcttgtct

SEQ ID NO: 9481566 - DNA, 22 bp, Homo sapiens
agctggccattgtgagtggcct

SEQ ID NO: 9481567 - DNA, 20 bp, Homo sapiens
agctggcccacaggtgtggg

SEQ ID NO: 9481568 - DNA, 22 bp, Homo sapiens
agctggcccactgtgtggtcca

SEQ ID NO: 9481569 - DNA, 22 bp, Homo sapiens
agctggcccactgtgtggtcca

SEQ ID NO: 9481570 - DNA, 22 bp, Homo sapiens
agctggcccactgtgtggtcca

SEQ ID NO: 9481571 - DNA, 20 bp, Homo sapiens
agctggcccccggtggcctg

SEQ ID NO: 9481572 - DNA, 19 bp, Homo sapiens
agctgggcttactcactcg

SEQ ID NO: 9481573 - DNA, 19 bp, Homo sapiens
agctgggctgtcacagtga

SEQ ID NO: 9481574 - DNA, 22 bp, Homo sapiens
agctgggctgggctgagctgag

SEQ ID NO: 9481575 - DNA, 22 bp, Homo sapiens
agctgggctggagctccaagcg

SEQ ID NO: 9481576 - DNA, 22 bp, Homo sapiens
agctgggctggagctccaagcg

SEQ ID NO: 9481577 - DNA, 22 bp, Homo sapiens
caggccaggctgcatttgcccc

SEQ ID NO: 9481578 - DNA, 22 bp, Homo sapiens
caggccaggctgcatttgcccc

SEQ ID NO: 9481579 - DNA, 22 bp, Homo sapiens
agctgggctggagctccaagcg

SEQ ID NO: 9481580 - DNA, 22 bp, Homo sapiens
caggccagggagaatatgaagc

SEQ ID NO: 9481581 - DNA, 22 bp, Homo sapiens
caggccagggagaatatgaagc

SEQ ID NO: 9481582 - DNA, 22 bp, Homo sapiens
caggccagcttcctgacatcct

SEQ ID NO: 9481583 - DNA, 22 bp, Homo sapiens
caggccagcttcctgacatcct

SEQ ID NO: 9481584 - DNA, 22 bp, Homo sapiens
caggccagcttcctgacatcct

SEQ ID NO: 9481585 - DNA, 22 bp, Homo sapiens
caggccagcttcctgacatcct

SEQ ID NO: 9481586 - DNA, 22 bp, Homo sapiens
caggccagcgtccagaacaagc

SEQ ID NO: 9481587 - DNA, 22 bp, Homo sapiens
caggccagcgtccagaacaagc

SEQ ID NO: 9481588 - DNA, 22 bp, Homo sapiens
caggccagcagggcctccgtgg

SEQ ID NO: 9481589 - DNA, 22 bp, Homo sapiens
caggccagagtccaactccaga

SEQ ID NO: 9481590 - DNA, 22 bp, Homo sapiens
caggccagcagggcctccgtgg

SEQ ID NO: 9481591 - DNA, 22 bp, Homo sapiens
caggccagcagggcctccgtgg

SEQ ID NO: 9481592 - DNA, 19 bp, Homo sapiens
agctgctggcccagggacc

SEQ ID NO: 9481593 - DNA, 19 bp, Homo sapiens
agctgctggcccagggacc

SEQ ID NO: 9481594 - DNA, 20 bp, Homo sapiens
caggcacactcattcctgct

SEQ ID NO: 9481595 - DNA, 22 bp, Homo sapiens
caggcacactgtctacactgag

SEQ ID NO: 9481596 - DNA, 22 bp, Homo sapiens
caggcacactgtctacactgag

SEQ ID NO: 9481597 - DNA, 22 bp, Homo sapiens
agctgctgcaagtggtgctaac

SEQ ID NO: 9481598 - DNA, 22 bp, Homo sapiens
agctgctgcaagtggtgctaac

SEQ ID NO: 9481599 - DNA, 19 bp, Homo sapiens
agctgctgattggtggagg

SEQ ID NO: 9481600 - DNA, 22 bp, Homo sapiens
agctgctgcctcactggtctgt

SEQ ID NO: 9481601 - DNA, 22 bp, Homo sapiens
agctgctgcgcctcaccctggc

SEQ ID NO: 9481602 - DNA, 22 bp, Homo sapiens
agctgctgccggtggccaccct

SEQ ID NO: 9481603 - DNA, 22 bp, Homo sapiens
caggcacactgtctacactgag

SEQ ID NO: 9481604 - DNA, 22 bp, Homo sapiens
caggcactcattcagagaggtg

SEQ ID NO: 9481605 - DNA, 22 bp, Homo sapiens
caggcactggccagtcagcaca

SEQ ID NO: 9481606 - DNA, 22 bp, Homo sapiens
caggcactgcactaccactttt

SEQ ID NO: 9481607 - DNA, 22 bp, Homo sapiens
caggcactgcactaccactttt

SEQ ID NO: 9481608 - DNA, 22 bp, Homo sapiens
caggcactgcactaccactttt

SEQ ID NO: 9481609 - DNA, 22 bp, Homo sapiens
caggcactgtgcctcgctccct

SEQ ID NO: 9481610 - DNA, 22 bp, Homo sapiens
caggcactgtgcaagggtctcg

SEQ ID NO: 9481611 - DNA, 22 bp, Homo sapiens
caggcactgtgctagatccttg

SEQ ID NO: 9481612 - DNA, 22 bp, Homo sapiens
caggcactgtgctgagctctgc

SEQ ID NO: 9481613 - DNA, 22 bp, Homo sapiens
caggcactggccagtcagcaca

SEQ ID NO: 9481614 - DNA, 22 bp, Homo sapiens
caggaggaggtgaggtagaact

SEQ ID NO: 9481615 - DNA, 22 bp, Homo sapiens
caggaggattgcttgaggccag

SEQ ID NO: 9481616 - DNA, 22 bp, Homo sapiens
caggaggattgcttgaggccag

SEQ ID NO: 9481617 - DNA, 22 bp, Homo sapiens
caggaggattgcttgaggccag

SEQ ID NO: 9481618 - DNA, 22 bp, Homo sapiens
caggaggattgcttgaggccag

SEQ ID NO: 9481619 - DNA, 22 bp, Homo sapiens
agctgctgagccatgtcctgct

SEQ ID NO: 9481620 - DNA, 22 bp, Homo sapiens
agctgctgagccatgtcctgct

SEQ ID NO: 9481621 - DNA, 22 bp, Homo sapiens
agctgctgagccatgtcctgct

SEQ ID NO: 9481622 - DNA, 22 bp, Homo sapiens
agctgctgagccatgtcctgct

SEQ ID NO: 9481623 - DNA, 22 bp, Homo sapiens
caggaggagggtacaccatcag

SEQ ID NO: 9481624 - DNA, 22 bp, Homo sapiens
caggaggagggtacaccatcag

SEQ ID NO: 9481625 - DNA, 22 bp, Homo sapiens
caggaggaggtgaggtagaact

SEQ ID NO: 9481626 - DNA, 22 bp, Homo sapiens
caggagccccaggctgacaata

SEQ ID NO: 9481627 - DNA, 22 bp, Homo sapiens
caggaggagcattagcgtctca

SEQ ID NO: 9481628 - DNA, 23 bp, Homo sapiens
caggaggagaaggcttggttggc

SEQ ID NO: 9481629 - DNA, 22 bp, Homo sapiens
caggaggagcattagcgtctca

SEQ ID NO: 9481630 - DNA, 22 bp, Homo sapiens
caggaggacatactggctcaca

SEQ ID NO: 9481631 - DNA, 22 bp, Homo sapiens
caggaggacatactggctcaca

SEQ ID NO: 9481632 - DNA, 22 bp, Homo sapiens
caggaggacatactggctcaca

SEQ ID NO: 9481633 - DNA, 22 bp, Homo sapiens
agggctctgagtgggaaagagg

SEQ ID NO: 9481634 - DNA, 20 bp, Homo sapiens
agggctctgccttgctgatg

SEQ ID NO: 9481635 - DNA, 22 bp, Homo sapiens
cctccccacgggcagccggcgc

SEQ ID NO: 9481636 - DNA, 22 bp, Homo sapiens
agggctcttcctttgcctctca

SEQ ID NO: 9481637 - DNA, 22 bp, Homo sapiens
cctccccacgggcagccggcgc

SEQ ID NO: 9481638 - DNA, 22 bp, Homo sapiens
agggctctgttggggtcagcac

SEQ ID NO: 9481639 - DNA, 22 bp, Homo sapiens
agggctctgttggggtcagcac

SEQ ID NO: 9481640 - DNA, 22 bp, Homo sapiens
agggctctcttcttggtttgca

SEQ ID NO: 9481641 - DNA, 22 bp, Homo sapiens
agggctctcttggacaactgct

SEQ ID NO: 9481642 - DNA, 22 bp, Homo sapiens
agggctcctccccggcctccac

SEQ ID NO: 9481643 - DNA, 22 bp, Homo sapiens
agggctcctatgatgctctgcc

SEQ ID NO: 9481644 - DNA, 22 bp, Homo sapiens
agggctcctatgccccatggac

SEQ ID NO: 9481645 - DNA, 22 bp, Homo sapiens
agggctccgggccaccggcctg

SEQ ID NO: 9481646 - DNA, 22 bp, Homo sapiens
agggctccgggccaccggcctg

SEQ ID NO: 9481647 - DNA, 22 bp, Homo sapiens
agggccctctggcaggccaggc

SEQ ID NO: 9481648 - DNA, 22 bp, Homo sapiens
agggccctccccgctcagggca

SEQ ID NO: 9481649 - DNA, 22 bp, Homo sapiens
agggccctctggcaggccaggc

SEQ ID NO: 9481650 - DNA, 22 bp, Homo sapiens
agggctaggaatggaactggag

SEQ ID NO: 9481651 - DNA, 19 bp, Homo sapiens
agggctaggcacatagggc

SEQ ID NO: 9481652 - DNA, 23 bp, Homo sapiens
agggcctcaggagggctgcatgg

SEQ ID NO: 9481653 - DNA, 18 bp, Homo sapiens
agggccctggtggccatt

SEQ ID NO: 9481654 - DNA, 22 bp, Homo sapiens
agggccctggggtgcactgaca

SEQ ID NO: 9481655 - DNA, 22 bp, Homo sapiens
agggcccttacgcaggcccttc

SEQ ID NO: 9481656 - DNA, 22 bp, Homo sapiens
agggcccttacgcaggcccttc

SEQ ID NO: 9481657 - DNA, 22 bp, Homo sapiens
agggctccaggggaccatcagt

SEQ ID NO: 9481658 - DNA, 22 bp, Homo sapiens
agggctccaaggaagtgtagct

SEQ ID NO: 9481659 - DNA, 22 bp, Homo sapiens
agggctccaaggaagtgtagct

SEQ ID NO: 9481660 - DNA, 22 bp, Homo sapiens
agggctcatctgagactgacat

SEQ ID NO: 9481661 - DNA, 22 bp, Homo sapiens
agggctcagttgcctggagccc

SEQ ID NO: 9481662 - DNA, 22 bp, Homo sapiens
agggctcataattcctgacttc

SEQ ID NO: 9481663 - DNA, 22 bp, Homo sapiens
agggctcataattcctgacttc

SEQ ID NO: 9481664 - DNA, 22 bp, Homo sapiens
agggctcataattcctgacttc

SEQ ID NO: 9481665 - DNA, 22 bp, Homo sapiens
agggccccatagtcactgcccg

SEQ ID NO: 9481666 - DNA, 22 bp, Homo sapiens
agggccctaaggaaggcacaca

SEQ ID NO: 9481667 - DNA, 22 bp, Homo sapiens
agggccctaaggaaggcacaca

SEQ ID NO: 9481668 - DNA, 21 bp, Homo sapiens
ccgccacctctaagctgggtc

SEQ ID NO: 9481669 - DNA, 22 bp, Homo sapiens
ccgcagggaaagccccaggaag

SEQ ID NO: 9481670 - DNA, 22 bp, Homo sapiens
ccgcaaggcagaggttgcagtg

SEQ ID NO: 9481671 - DNA, 21 bp, Homo sapiens
ccgccgctgatagctctgggc

SEQ ID NO: 9481672 - DNA, 22 bp, Homo sapiens
ccgagaacttttcctgaaaagt

SEQ ID NO: 9481673 - DNA, 22 bp, Homo sapiens
cccttttttatgtcaagcattg

SEQ ID NO: 9481674 - DNA, 22 bp, Homo sapiens
ccgaggagcttttccaaggtgt

SEQ ID NO: 9481675 - DNA, 22 bp, Homo sapiens
ccgaggacattgggcttctgtt

SEQ ID NO: 9481676 - DNA, 22 bp, Homo sapiens
ccgaggctggagtgcagtggcg

SEQ ID NO: 9481677 - DNA, 22 bp, Homo sapiens
ccgaggtcctggacttggccct

SEQ ID NO: 9481678 - DNA, 22 bp, Homo sapiens
ccctttctgggacccctgtctc

SEQ ID NO: 9481679 - DNA, 22 bp, Homo sapiens
ccctttctgggacccctgtctc

SEQ ID NO: 9481680 - DNA, 21 bp, Homo sapiens
ccctttctccatacttcatcc

SEQ ID NO: 9481681 - DNA, 22 bp, Homo sapiens
ccctttctgccttctaaaataa

SEQ ID NO: 9481682 - DNA, 20 bp, Homo sapiens
cccttttcacgaaaaggaga

SEQ ID NO: 9481683 - DNA, 22 bp, Homo sapiens
ccctttttcactctaccaaggt

SEQ ID NO: 9481684 - DNA, 22 bp, Homo sapiens
ccctttgcccagtatattctag

SEQ ID NO: 9481685 - DNA, 22 bp, Homo sapiens
ccctttccatggctctcctagg

SEQ ID NO: 9481686 - DNA, 22 bp, Homo sapiens
ccctttcctgaagaatattttt

SEQ ID NO: 9481687 - DNA, 22 bp, Homo sapiens
ccctttcccttctggctcaggg

SEQ ID NO: 9481688 - DNA, 22 bp, Homo sapiens
ccctttcccttctggctcaggg

SEQ ID NO: 9481689 - DNA, 22 bp, Homo sapiens
ccctttcccttctggctcaggg

SEQ ID NO: 9481690 - DNA, 22 bp, Homo sapiens
ccctttccatggctctcctagg

SEQ ID NO: 9481691 - DNA, 22 bp, Homo sapiens
agggccagaatccctcagtcta

SEQ ID NO: 9481692 - DNA, 22 bp, Homo sapiens
agggccagaatccctcagtcta

SEQ ID NO: 9481693 - DNA, 22 bp, Homo sapiens
agggccagaggcaccttgcagc

SEQ ID NO: 9481694 - DNA, 22 bp, Homo sapiens
agggccagaggcaccttgcagc

SEQ ID NO: 9481695 - DNA, 22 bp, Homo sapiens
agggccagaggcaccttgcagc

SEQ ID NO: 9481696 - DNA, 22 bp, Homo sapiens
agggccagaatccctcagtcta

SEQ ID NO: 9481697 - DNA, 22 bp, Homo sapiens
agggccagaatccctcagtcta

SEQ ID NO: 9481698 - DNA, 22 bp, Homo sapiens
agggccagaatccctcagtcta

SEQ ID NO: 9481699 - DNA, 22 bp, Homo sapiens
agggccagaatccctcagtcta

SEQ ID NO: 9481700 - DNA, 22 bp, Homo sapiens
agggccagagtacatcagggct

SEQ ID NO: 9481701 - DNA, 22 bp, Homo sapiens
agggccagagtacatcagggct

SEQ ID NO: 9481702 - DNA, 22 bp, Homo sapiens
agggccagagtctgtgtagata

SEQ ID NO: 9481703 - DNA, 22 bp, Homo sapiens
agggccagagtctgtgtagata

SEQ ID NO: 9481704 - DNA, 22 bp, Homo sapiens
agggccagagtacatcagggct

SEQ ID NO: 9481705 - DNA, 22 bp, Homo sapiens
agggccagagtctgtgtagata

SEQ ID NO: 9481706 - DNA, 22 bp, Homo sapiens
agggccagagtctgtgtagata

SEQ ID NO: 9481707 - DNA, 22 bp, Homo sapiens
ccctggaggcggagcttgcagt

SEQ ID NO: 9481708 - DNA, 22 bp, Homo sapiens
ccctggaggcggagcttgcagt

SEQ ID NO: 9481709 - DNA, 22 bp, Homo sapiens
ccctggaggcaaaggttgcagt

SEQ ID NO: 9481710 - DNA, 22 bp, Homo sapiens
ccctggaggcaaaggttgcagt

SEQ ID NO: 9481711 - DNA, 22 bp, Homo sapiens
ccctggaggcaaaggttgcagt

SEQ ID NO: 9481712 - DNA, 22 bp, Homo sapiens
ccctggaggcggatgttgcagt

SEQ ID NO: 9481713 - DNA, 22 bp, Homo sapiens
ccctggaggctggaggcagtag

SEQ ID NO: 9481714 - DNA, 22 bp, Homo sapiens
ccctggaggctggaggcagtag

SEQ ID NO: 9481715 - DNA, 23 bp, Homo sapiens
agggccactgggaaggattactg

SEQ ID NO: 9481716 - DNA, 21 bp, Homo sapiens
cctctggcttgtgctgtgccc

SEQ ID NO: 9481717 - DNA, 22 bp, Homo sapiens
cctctggcttactgttgggttt

SEQ ID NO: 9481718 - DNA, 22 bp, Homo sapiens
cctctggcttactgttgggttt

SEQ ID NO: 9481719 - DNA, 21 bp, Homo sapiens
cctctggcttgtgctgtgccc

SEQ ID NO: 9481720 - DNA, 21 bp, Homo sapiens
cctctggcttgtgctgtgccc

SEQ ID NO: 9481721 - DNA, 22 bp, Homo sapiens
cctctgggaagccagtcctgct

SEQ ID NO: 9481722 - DNA, 22 bp, Homo sapiens
cctctgggaagccagtcctgct

SEQ ID NO: 9481723 - DNA, 22 bp, Homo sapiens
agggctgcaccggggcttcgcg

SEQ ID NO: 9481724 - DNA, 22 bp, Homo sapiens
agggctgcaccggggcttcgcg

SEQ ID NO: 9481725 - DNA, 22 bp, Homo sapiens
agggctgcaccggggcttcgcg

SEQ ID NO: 9481726 - DNA, 22 bp, Homo sapiens
agggctgcaggcaagatatggc

SEQ ID NO: 9481727 - DNA, 19 bp, Homo sapiens
cctctgccagcccgcctct

SEQ ID NO: 9481728 - DNA, 18 bp, Homo sapiens
cctctgccatagccagca

SEQ ID NO: 9481729 - DNA, 22 bp, Homo sapiens
cctctggcttactgttgggttt

SEQ ID NO: 9481730 - DNA, 18 bp, Homo sapiens
cctctgccatagccagca

SEQ ID NO: 9481731 - DNA, 22 bp, Homo sapiens
cctctgggcggagatctgctgc

SEQ ID NO: 9481732 - DNA, 22 bp, Homo sapiens
cctctgggcggagatctgctgc

SEQ ID NO: 9481733 - DNA, 22 bp, Homo sapiens
cctctgggcctggaagggcagt

SEQ ID NO: 9481734 - DNA, 22 bp, Homo sapiens
cctctgggcctggaagggcagt

SEQ ID NO: 9481735 - DNA, 22 bp, Homo sapiens
cctctgggcctggaagggcagt

SEQ ID NO: 9481736 - DNA, 16 bp, Homo sapiens
cctctgggcctgcaag

SEQ ID NO: 9481737 - DNA, 16 bp, Homo sapiens
cctctgggcctgcaag

SEQ ID NO: 9481738 - DNA, 22 bp, Homo sapiens
cctctgggccagcctggaccct

SEQ ID NO: 9481739 - DNA, 16 bp, Homo sapiens
cctctgggcctgcaag

SEQ ID NO: 9481740 - DNA, 22 bp, Homo sapiens
cctctgggcaggtagcagcagc

SEQ ID NO: 9481741 - DNA, 22 bp, Homo sapiens
cctctgggcaggtagcagcagc

SEQ ID NO: 9481742 - DNA, 22 bp, Homo sapiens
cctctgggccagcctggaccct

SEQ ID NO: 9481743 - DNA, 22 bp, Homo sapiens
cctctgggccagcctggaccct

SEQ ID NO: 9481744 - DNA, 22 bp, Homo sapiens
cctctgggccagcctggaccct

SEQ ID NO: 9481745 - DNA, 22 bp, Homo sapiens
cctctgggagactgctactgag

SEQ ID NO: 9481746 - DNA, 16 bp, Homo sapiens
cctctgggatgtttgc

SEQ ID NO: 9481747 - DNA, 22 bp, Homo sapiens
cctctgggagactgctactgag

SEQ ID NO: 9481748 - DNA, 22 bp, Homo sapiens
cctctgggagactgctactgag

SEQ ID NO: 9481749 - DNA, 22 bp, Homo sapiens
cctctgggcaggtagcagcagc

SEQ ID NO: 9481750 - DNA, 22 bp, Homo sapiens
cctcctggccctgggcctggaa

SEQ ID NO: 9481751 - DNA, 22 bp, Homo sapiens
agggctgagtgggagagagttg

SEQ ID NO: 9481752 - DNA, 22 bp, Homo sapiens
agggctgagtggtgcagtcaaa

SEQ ID NO: 9481753 - DNA, 22 bp, Homo sapiens
cctcctggaggctctagggaaa

SEQ ID NO: 9481754 - DNA, 22 bp, Homo sapiens
cctcctggaggctctagggaaa

SEQ ID NO: 9481755 - DNA, 22 bp, Homo sapiens
cctcctggaggctctagggaaa

SEQ ID NO: 9481756 - DNA, 23 bp, Homo sapiens
agggctgatgccattgcagctct

SEQ ID NO: 9481757 - DNA, 23 bp, Homo sapiens
agggctgatgccattgcagctct

SEQ ID NO: 9481758 - DNA, 22 bp, Homo sapiens
agggctgcaatgggagataact

SEQ ID NO: 9481759 - DNA, 23 bp, Homo sapiens
agggctgatgccattgcagctct

SEQ ID NO: 9481760 - DNA, 22 bp, Homo sapiens
agggctgatgcaccatgtagcc

SEQ ID NO: 9481761 - DNA, 22 bp, Homo sapiens
cctcctggaggctctaagggag

SEQ ID NO: 9481762 - DNA, 22 bp, Homo sapiens
cctcctggagcattggtgagga

SEQ ID NO: 9481763 - DNA, 22 bp, Homo sapiens
cctcctggagcattggtgagga

SEQ ID NO: 9481764 - DNA, 22 bp, Homo sapiens
cctcctggagcattggtgagga

SEQ ID NO: 9481765 - DNA, 22 bp, Homo sapiens
cctcctggaaaaattccctggc

SEQ ID NO: 9481766 - DNA, 22 bp, Homo sapiens
cctcctggaaaaattccctggc

SEQ ID NO: 9481767 - DNA, 22 bp, Homo sapiens
cctcctggaaaaattccctggc

SEQ ID NO: 9481768 - DNA, 22 bp, Homo sapiens
cctcctggagcattggtgagga

SEQ ID NO: 9481769 - DNA, 22 bp, Homo sapiens
cctcctgcacctccaggaactc

SEQ ID NO: 9481770 - DNA, 22 bp, Homo sapiens
cctcctgcacctccaggaactc

SEQ ID NO: 9481771 - DNA, 22 bp, Homo sapiens
aggggagagaacataaggaagt

SEQ ID NO: 9481772 - DNA, 22 bp, Homo sapiens
aggggagagaacataaggaagt

SEQ ID NO: 9481773 - DNA, 22 bp, Homo sapiens
aggggagaggtgagcaacttct

SEQ ID NO: 9481774 - DNA, 22 bp, Homo sapiens
aggggagaaaaatgccttctgt

SEQ ID NO: 9481775 - DNA, 22 bp, Homo sapiens
aggggagaaaaatgccttctgt

SEQ ID NO: 9481776 - DNA, 22 bp, Homo sapiens
aggggagaatttcaactcaggt

SEQ ID NO: 9481777 - DNA, 22 bp, Homo sapiens
aggggagaatttcaactcaggt

SEQ ID NO: 9481778 - DNA, 22 bp, Homo sapiens
aggggacatttagcaatgacta

SEQ ID NO: 9481779 - DNA, 21 bp, Homo sapiens
aggggacagagtagctccagg

SEQ ID NO: 9481780 - DNA, 22 bp, Homo sapiens
aggggacacggcttctccaggg

SEQ ID NO: 9481781 - DNA, 17 bp, Homo sapiens
aggggagagtgggaaga

SEQ ID NO: 9481782 - DNA, 17 bp, Homo sapiens
aggggagagtgggaaga

SEQ ID NO: 9481783 - DNA, 22 bp, Homo sapiens
cctgagagtggtgtacaggaga

SEQ ID NO: 9481784 - DNA, 22 bp, Homo sapiens
cctgagagtggtgtacaggaga

SEQ ID NO: 9481785 - DNA, 22 bp, Homo sapiens
cctgagagtgcgtgcctcctta

SEQ ID NO: 9481786 - DNA, 22 bp, Homo sapiens
cctgaggacacacgctgcagga

SEQ ID NO: 9481787 - DNA, 22 bp, Homo sapiens
cctgaggacacacgctgcagga

SEQ ID NO: 9481788 - DNA, 22 bp, Homo sapiens
cctgaggacatcagcatcacct

SEQ ID NO: 9481789 - DNA, 22 bp, Homo sapiens
cctgaggacagtgtgaccatgg

SEQ ID NO: 9481790 - DNA, 22 bp, Homo sapiens
cctgaggacagtgtgaccatgg

SEQ ID NO: 9481791 - DNA, 22 bp, Homo sapiens
cctgaggacacacgctgcagga

SEQ ID NO: 9481792 - DNA, 22 bp, Homo sapiens
cctgaggacacacgctgcagga

SEQ ID NO: 9481793 - DNA, 22 bp, Homo sapiens
cctgagctttaaaagccatgta

SEQ ID NO: 9481794 - DNA, 19 bp, Homo sapiens
cctgaggaaaagatgattg

SEQ ID NO: 9481795 - DNA, 22 bp, Homo sapiens
cctgagctttaaaagccatgta

SEQ ID NO: 9481796 - DNA, 22 bp, Homo sapiens
aggggctgcctggcttggcact

SEQ ID NO: 9481797 - DNA, 22 bp, Homo sapiens
aggggctgcctggcttggcact

SEQ ID NO: 9481798 - DNA, 22 bp, Homo sapiens
aggggctggagttcgaggttac

SEQ ID NO: 9481799 - DNA, 22 bp, Homo sapiens
aggggctggagttcgaggttac

SEQ ID NO: 9481800 - DNA, 22 bp, Homo sapiens
aggggctgctgggtccgcccct

SEQ ID NO: 9481801 - DNA, 22 bp, Homo sapiens
aggggctgggacagagccaagc

SEQ ID NO: 9481802 - DNA, 22 bp, Homo sapiens
aggggctgggacagagccaagc

SEQ ID NO: 9481803 - DNA, 22 bp, Homo sapiens
aggggctggcttatctgagagt

SEQ ID NO: 9481804 - DNA, 22 bp, Homo sapiens
aggggctggcttatctgagagt

SEQ ID NO: 9481805 - DNA, 22 bp, Homo sapiens
cctgaggccctggctgtgctga

SEQ ID NO: 9481806 - DNA, 22 bp, Homo sapiens
cctgaggcaaggacttggtggc

SEQ ID NO: 9481807 - DNA, 22 bp, Homo sapiens
cctgaggcccctgaggatagca

SEQ ID NO: 9481808 - DNA, 22 bp, Homo sapiens
cctgaggcccctgaggatagca

SEQ ID NO: 9481809 - DNA, 22 bp, Homo sapiens
cctgaggcaaggacttggtggc

SEQ ID NO: 9481810 - DNA, 22 bp, Homo sapiens
cctgaggattgttggtgcttcc

SEQ ID NO: 9481811 - DNA, 22 bp, Homo sapiens
cctgaggattgttggtgcttcc

SEQ ID NO: 9481812 - DNA, 22 bp, Homo sapiens
cctgaggcaaggacttggtggc

SEQ ID NO: 9481813 - DNA, 22 bp, Homo sapiens
cctgaggcaaggacttggtggc

SEQ ID NO: 9481814 - DNA, 22 bp, Homo sapiens
cctgaggcaaggacttggtggc

SEQ ID NO: 9481815 - DNA, 22 bp, Homo sapiens
cctgaggatgccagcatgggtg

SEQ ID NO: 9481816 - DNA, 22 bp, Homo sapiens
cctgaggatgccagcatgggtg

SEQ ID NO: 9481817 - DNA, 22 bp, Homo sapiens
cctgaggatattcaccagcatg

SEQ ID NO: 9481818 - DNA, 22 bp, Homo sapiens
cctgaggatattcaccagcatg

SEQ ID NO: 9481819 - DNA, 22 bp, Homo sapiens
cctgaggatgccagcatgggtg

SEQ ID NO: 9481820 - DNA, 22 bp, Homo sapiens
cctgaggaccagcacccatctg

SEQ ID NO: 9481821 - DNA, 22 bp, Homo sapiens
cctgaggagattgtggctgggg

SEQ ID NO: 9481822 - DNA, 22 bp, Homo sapiens
cctgaggagattgtggctgggg

SEQ ID NO: 9481823 - DNA, 22 bp, Homo sapiens
cctgaggaggtgaagtctccat

SEQ ID NO: 9481824 - DNA, 22 bp, Homo sapiens
ccctctgcctgcgccctggtgt

SEQ ID NO: 9481825 - DNA, 22 bp, Homo sapiens
ccctctgcatacaggcgaggag

SEQ ID NO: 9481826 - DNA, 22 bp, Homo sapiens
ccctctgcatacaggcgaggag

SEQ ID NO: 9481827 - DNA, 22 bp, Homo sapiens
ccctctgcaggctggacctgcc

SEQ ID NO: 9481828 - DNA, 20 bp, Homo sapiens
ccctctgcacatggctgtgg

SEQ ID NO: 9481829 - DNA, 20 bp, Homo sapiens
ccctctgcacatggctgtgg

SEQ ID NO: 9481830 - DNA, 20 bp, Homo sapiens
ccctctgctacactgggagc

SEQ ID NO: 9481831 - DNA, 22 bp, Homo sapiens
ccctctgctcaggtgcataggc

SEQ ID NO: 9481832 - DNA, 22 bp, Homo sapiens
ccctctgctcaggtgcataggc

SEQ ID NO: 9481833 - DNA, 20 bp, Homo sapiens
ccctctgctacactgggagc

SEQ ID NO: 9481834 - DNA, 22 bp, Homo sapiens
ccctctggctcttctcaggccg

SEQ ID NO: 9481835 - DNA, 22 bp, Homo sapiens
ccctctgctgcctggctgggtc

SEQ ID NO: 9481836 - DNA, 22 bp, Homo sapiens
ccctctgctgcctggctgggtc

SEQ ID NO: 9481837 - DNA, 22 bp, Homo sapiens
ccctctggctcttctcaggccg

SEQ ID NO: 9481838 - DNA, 22 bp, Homo sapiens
ccctctggtttgcccttgggtg

SEQ ID NO: 9481839 - DNA, 18 bp, Homo sapiens
ccctcttgcacaaagcaa

SEQ ID NO: 9481840 - DNA, 18 bp, Homo sapiens
ccctcttgcacaaagcaa

SEQ ID NO: 9481841 - DNA, 22 bp, Homo sapiens
ccctctggtttgcccttgggtg

SEQ ID NO: 9481842 - DNA, 22 bp, Homo sapiens
ccctctctgacttctgaacttg

SEQ ID NO: 9481843 - DNA, 22 bp, Homo sapiens
ccctctctctatcgggccccag

SEQ ID NO: 9481844 - DNA, 22 bp, Homo sapiens
ccctctctcggttgctgtggtt

SEQ ID NO: 9481845 - DNA, 22 bp, Homo sapiens
ccctctgaacctggtagcagaa

SEQ ID NO: 9481846 - DNA, 22 bp, Homo sapiens
ccctctgagacaggtagctcac

SEQ ID NO: 9481847 - DNA, 22 bp, Homo sapiens
ccctctgactgggccagttctg

SEQ ID NO: 9481848 - DNA, 22 bp, Homo sapiens
ccctctgacctcctgccacagt

SEQ ID NO: 9481849 - DNA, 22 bp, Homo sapiens
ccctctgactgggccagttctg

SEQ ID NO: 9481850 - DNA, 22 bp, Homo sapiens
agggatgggtctaacccagaac

SEQ ID NO: 9481851 - DNA, 22 bp, Homo sapiens
agggatgggaactcctccagca

SEQ ID NO: 9481852 - DNA, 22 bp, Homo sapiens
agggatgggaactcctccagca

SEQ ID NO: 9481853 - DNA, 22 bp, Homo sapiens
agggatgggaactcctccagca

SEQ ID NO: 9481854 - DNA, 22 bp, Homo sapiens
ccctcccaggagtggccagaga

SEQ ID NO: 9481855 - DNA, 22 bp, Homo sapiens
agggcagagcactgaattggga

SEQ ID NO: 9481856 - DNA, 22 bp, Homo sapiens
agggcagagctgtctaaatggc

SEQ ID NO: 9481857 - DNA, 22 bp, Homo sapiens
agggcagagattaattaagaca

SEQ ID NO: 9481858 - DNA, 22 bp, Homo sapiens
agggcagagcactgaattggga

SEQ ID NO: 9481859 - DNA, 22 bp, Homo sapiens
agggcagagatctgagtgggca

SEQ ID NO: 9481860 - DNA, 22 bp, Homo sapiens
agggcagagattaattaagaca

SEQ ID NO: 9481861 - DNA, 22 bp, Homo sapiens
agggcagagatctgagtgggca

SEQ ID NO: 9481862 - DNA, 22 bp, Homo sapiens
agggcagagatctgagtgggca

SEQ ID NO: 9481863 - DNA, 22 bp, Homo sapiens
agggcagagatctgagtgggca

SEQ ID NO: 9481864 - DNA, 22 bp, Homo sapiens
agggcagagatctgagtgggca

SEQ ID NO: 9481865 - DNA, 22 bp, Homo sapiens
agggcagagagatgaatgggat

SEQ ID NO: 9481866 - DNA, 22 bp, Homo sapiens
agggcagagatctgagtgggca

SEQ ID NO: 9481867 - DNA, 22 bp, Homo sapiens
agggcagagagatgaatgggat

SEQ ID NO: 9481868 - DNA, 22 bp, Homo sapiens
agggcagagaaatgtagttgag

SEQ ID NO: 9481869 - DNA, 22 bp, Homo sapiens
agggcagagacatgcttcctga

SEQ ID NO: 9481870 - DNA, 22 bp, Homo sapiens
agggcagagacatgcttcctga

SEQ ID NO: 9481871 - DNA, 22 bp, Homo sapiens
agggcagagagatgaatgggat

SEQ ID NO: 9481872 - DNA, 22 bp, Homo sapiens
agggcagagacatgcttcctga

SEQ ID NO: 9481873 - DNA, 21 bp, Homo sapiens
ccctggaatcctgagtgccag

SEQ ID NO: 9481874 - DNA, 20 bp, Homo sapiens
agggcagagggattacaggc

SEQ ID NO: 9481875 - DNA, 22 bp, Homo sapiens
agggcagaggcggacacggaag

SEQ ID NO: 9481876 - DNA, 20 bp, Homo sapiens
agggcagagggattacaggc

SEQ ID NO: 9481877 - DNA, 22 bp, Homo sapiens
agggcagaggcggacacggaag

SEQ ID NO: 9481878 - DNA, 22 bp, Homo sapiens
agggcagaggcggacacggaag

SEQ ID NO: 9481879 - DNA, 22 bp, Homo sapiens
agggcagagctgtctaaatggc

SEQ ID NO: 9481880 - DNA, 22 bp, Homo sapiens
ccctggaggaccccaatgtggc

SEQ ID NO: 9481881 - DNA, 22 bp, Homo sapiens
ccctggaggaccccaatgtggc

SEQ ID NO: 9481882 - DNA, 22 bp, Homo sapiens
ccctggaggaccccaatgtggc

SEQ ID NO: 9481883 - DNA, 20 bp, Homo sapiens
ccctggactcctgagcaaac

SEQ ID NO: 9481884 - DNA, 22 bp, Homo sapiens
ccctggacacacacttttattc

SEQ ID NO: 9481885 - DNA, 19 bp, Homo sapiens
ccctggaggagtgttggct

SEQ ID NO: 9481886 - DNA, 22 bp, Homo sapiens
ccctggaggagcttagagcttg

SEQ ID NO: 9481887 - DNA, 22 bp, Homo sapiens
agggatggatcttggccctgga

SEQ ID NO: 9481888 - DNA, 22 bp, Homo sapiens
agggatggagtgcggcccggac

SEQ ID NO: 9481889 - DNA, 22 bp, Homo sapiens
agggatggagcccagctgttct

SEQ ID NO: 9481890 - DNA, 22 bp, Homo sapiens
agggatggaagctcgtctgcaa

SEQ ID NO: 9481891 - DNA, 22 bp, Homo sapiens
agggatggaagacttgaagacc

SEQ ID NO: 9481892 - DNA, 22 bp, Homo sapiens
agggatgatttcagtgtctgcc

SEQ ID NO: 9481893 - DNA, 22 bp, Homo sapiens
agggatgatttcagtgtctgcc

SEQ ID NO: 9481894 - DNA, 22 bp, Homo sapiens
agggatgctgctaagtggtcta

SEQ ID NO: 9481895 - DNA, 18 bp, Homo sapiens
agggagttttagggaagg

SEQ ID NO: 9481896 - DNA, 22 bp, Homo sapiens
agggagtgttacataatgggtt

SEQ ID NO: 9481897 - DNA, 22 bp, Homo sapiens
agggagtgttacataatgggtt

SEQ ID NO: 9481898 - DNA, 22 bp, Homo sapiens
agggagtgttacataatgggtt

SEQ ID NO: 9481899 - DNA, 22 bp, Homo sapiens
agggagtgtaaatggtgctcag

SEQ ID NO: 9481900 - DNA, 22 bp, Homo sapiens
agggatgatcagggtagaggct

SEQ ID NO: 9481901 - DNA, 22 bp, Homo sapiens
agggatgactcttggctgattc

SEQ ID NO: 9481902 - DNA, 22 bp, Homo sapiens
agggagtccattttagaggtgg

SEQ ID NO: 9481903 - DNA, 21 bp, Homo sapiens
agggagtctggaggaagcgtt

SEQ ID NO: 9481904 - DNA, 22 bp, Homo sapiens
agggagtggttaagaaggtgca

SEQ ID NO: 9481905 - DNA, 22 bp, Homo sapiens
agggagtggttaagaaggtgca

SEQ ID NO: 9481906 - DNA, 22 bp, Homo sapiens
agggagaaggtttagctgtgag

SEQ ID NO: 9481907 - DNA, 22 bp, Homo sapiens
agggagaaggtttagctgtgag

SEQ ID NO: 9481908 - DNA, 22 bp, Homo sapiens
agggagaagagaacaaagccct

SEQ ID NO: 9481909 - DNA, 22 bp, Homo sapiens
agggaggagtcctcaaagtcat

SEQ ID NO: 9481910 - DNA, 17 bp, Homo sapiens
agggagtcagaggatcg

SEQ ID NO: 9481911 - DNA, 17 bp, Homo sapiens
agggagtcagaggatcg

SEQ ID NO: 9481912 - DNA, 22 bp, Homo sapiens
agggaggagtcctcaaagtcat

SEQ ID NO: 9481913 - DNA, 22 bp, Homo sapiens
agggagaaggtttagctgtgag

SEQ ID NO: 9481914 - DNA, 22 bp, Homo sapiens
agggaggagtcctcaaagtcat

SEQ ID NO: 9481915 - DNA, 22 bp, Homo sapiens
agggactggctctctgagcagg

SEQ ID NO: 9481916 - DNA, 22 bp, Homo sapiens
agggagaaaattggatgcacaa

SEQ ID NO: 9481917 - DNA, 22 bp, Homo sapiens
agggactcctctgctcggctgc

SEQ ID NO: 9481918 - DNA, 22 bp, Homo sapiens
agggagaaaattggatgcacaa

SEQ ID NO: 9481919 - DNA, 22 bp, Homo sapiens
agggagaacagttgcagcagac

SEQ ID NO: 9481920 - DNA, 22 bp, Homo sapiens
agggagaacagttgcagcagac

SEQ ID NO: 9481921 - DNA, 22 bp, Homo sapiens
agggagaaaattggatgcacaa

SEQ ID NO: 9481922 - DNA, 22 bp, Homo sapiens
agggagaacagttgcagcagac

SEQ ID NO: 9481923 - DNA, 22 bp, Homo sapiens
agggagaagagaacaaagccct

SEQ ID NO: 9481924 - DNA, 22 bp, Homo sapiens
cccaggatggggctgcagttat

SEQ ID NO: 9481925 - DNA, 22 bp, Homo sapiens
cccaggagtttgagttcagcat

SEQ ID NO: 9481926 - DNA, 20 bp, Homo sapiens
cccaggagtttgctcttact

SEQ ID NO: 9481927 - DNA, 23 bp, Homo sapiens
cccaggagtttcactgcaaaggt

SEQ ID NO: 9481928 - DNA, 22 bp, Homo sapiens
cccaggagttggaggctgcagt

SEQ ID NO: 9481929 - DNA, 22 bp, Homo sapiens
cccaggagttggaggctgcagt

SEQ ID NO: 9481930 - DNA, 22 bp, Homo sapiens
cccaggagttggaggctgcagt

SEQ ID NO: 9481931 - DNA, 22 bp, Homo sapiens
cccaggagttggaggctgcagt

SEQ ID NO: 9481932 - DNA, 23 bp, Homo sapiens
cccaggagtttcactgcaaaggt

SEQ ID NO: 9481933 - DNA, 23 bp, Homo sapiens
cccaggagtttcactgcaaaggt

SEQ ID NO: 9481934 - DNA, 23 bp, Homo sapiens
cccaggagtttcactgcaaaggt

SEQ ID NO: 9481935 - DNA, 23 bp, Homo sapiens
cccaggagtttcactgcaaaggt

SEQ ID NO: 9481936 - DNA, 22 bp, Homo sapiens
cccaggagttggaggctgcagt

SEQ ID NO: 9481937 - DNA, 22 bp, Homo sapiens
cccaggagttggaggctgcagt

SEQ ID NO: 9481938 - DNA, 22 bp, Homo sapiens
agggaacagtgaaaggcatcag

SEQ ID NO: 9481939 - DNA, 22 bp, Homo sapiens
agggaacagtgaaaggcatcag

SEQ ID NO: 9481940 - DNA, 22 bp, Homo sapiens
agggaacagtgaaaggcatcag

SEQ ID NO: 9481941 - DNA, 20 bp, Homo sapiens
agggaacaatggacgctgtc

SEQ ID NO: 9481942 - DNA, 22 bp, Homo sapiens
agggaacagtgaaaggcatcag

SEQ ID NO: 9481943 - DNA, 23 bp, Homo sapiens
agggaacaagcaagctgctagtc

SEQ ID NO: 9481944 - DNA, 20 bp, Homo sapiens
agggaacaatggacgctgtc

SEQ ID NO: 9481945 - DNA, 22 bp, Homo sapiens
agggaaattaatgtgagcaatg

SEQ ID NO: 9481946 - DNA, 22 bp, Homo sapiens
agggaaattaatgtgagcaatg

SEQ ID NO: 9481947 - DNA, 22 bp, Homo sapiens
agggaacaaaactctaaaattc

SEQ ID NO: 9481948 - DNA, 23 bp, Homo sapiens
agggaacaagcaagctgctagtc

SEQ ID NO: 9481949 - DNA, 22 bp, Homo sapiens
cccaggatggggctgcagttat

SEQ ID NO: 9481950 - DNA, 22 bp, Homo sapiens
agggaaataatctattctgagg

SEQ ID NO: 9481951 - DNA, 21 bp, Homo sapiens
agggaaatccagtcacttttc

SEQ ID NO: 9481952 - DNA, 23 bp, Homo sapiens
agggaaatactgcaatttttgga

SEQ ID NO: 9481953 - DNA, 21 bp, Homo sapiens
agggaaatccagtcacttttc

SEQ ID NO: 9481954 - DNA, 22 bp, Homo sapiens
agggaaatctcagctctaaaat

SEQ ID NO: 9481955 - DNA, 22 bp, Homo sapiens
agggaaatctttcaacacttca

SEQ ID NO: 9481956 - DNA, 22 bp, Homo sapiens
agggaaatctttcaacacttca

SEQ ID NO: 9481957 - DNA, 22 bp, Homo sapiens
agggaaatggagagtgtagttt

SEQ ID NO: 9481958 - DNA, 22 bp, Homo sapiens
agggaagaagctggtagtaggt

SEQ ID NO: 9481959 - DNA, 22 bp, Homo sapiens
agggaagaagctggtagtaggt

SEQ ID NO: 9481960 - DNA, 23 bp, Homo sapiens
agggaagaaacatgaagggctgt

SEQ ID NO: 9481961 - DNA, 23 bp, Homo sapiens
agggaagaaacatgaagggctgt

SEQ ID NO: 9481962 - DNA, 23 bp, Homo sapiens
agggaagaaacatgaagggctgt

SEQ ID NO: 9481963 - DNA, 22 bp, Homo sapiens
cccagggctgcagatggaggct

SEQ ID NO: 9481964 - DNA, 22 bp, Homo sapiens
cccagggctgcagatggaggct

SEQ ID NO: 9481965 - DNA, 22 bp, Homo sapiens
cccagggctgcagatggaggct

SEQ ID NO: 9481966 - DNA, 22 bp, Homo sapiens
cccagggctgcagatggaggct

SEQ ID NO: 9481967 - DNA, 22 bp, Homo sapiens
cccagggctgcagatggaggct

SEQ ID NO: 9481968 - DNA, 22 bp, Homo sapiens
cccagggccctggacagctaca

SEQ ID NO: 9481969 - DNA, 22 bp, Homo sapiens
cccagggccctggacagctaca

SEQ ID NO: 9481970 - DNA, 22 bp, Homo sapiens
cccagggccctggacagctaca

SEQ ID NO: 9481971 - DNA, 22 bp, Homo sapiens
cccagggccctggacagctaca

SEQ ID NO: 9481972 - DNA, 21 bp, Homo sapiens
cccagggaagccgcagtcacc

SEQ ID NO: 9481973 - DNA, 22 bp, Homo sapiens
cccagggccctggacagctaca

SEQ ID NO: 9481974 - DNA, 22 bp, Homo sapiens
cccaggggtaaggcgcagcgtg

SEQ ID NO: 9481975 - DNA, 22 bp, Homo sapiens
cccaggggaggtcctcagggaa

SEQ ID NO: 9481976 - DNA, 22 bp, Homo sapiens
cccaggggtaaggcgcagcgtg

SEQ ID NO: 9481977 - DNA, 19 bp, Homo sapiens
cccaggggacccagcccta

SEQ ID NO: 9481978 - DNA, 22 bp, Homo sapiens
cccaggggaggtcctcagggaa

SEQ ID NO: 9481979 - DNA, 22 bp, Homo sapiens
cccagggctgtagaatgtccaa

SEQ ID NO: 9481980 - DNA, 22 bp, Homo sapiens
cccagggcttgagtcatccatg

SEQ ID NO: 9481981 - DNA, 22 bp, Homo sapiens
cccagggcttgagtcatccatg

SEQ ID NO: 9481982 - DNA, 22 bp, Homo sapiens
cccagggcttttctcactagac

SEQ ID NO: 9481983 - DNA, 22 bp, Homo sapiens
cccagggcttttctcactagac

SEQ ID NO: 9481984 - DNA, 22 bp, Homo sapiens
cccagggcttttctcactagac

SEQ ID NO: 9481985 - DNA, 22 bp, Homo sapiens
aggcttctggaatccagtttct

SEQ ID NO: 9481986 - DNA, 22 bp, Homo sapiens
aggcttctgctgtattaacact

SEQ ID NO: 9481987 - DNA, 22 bp, Homo sapiens
aggcttctgctgtattaacact

SEQ ID NO: 9481988 - DNA, 22 bp, Homo sapiens
aggcttctggggcaccgagcga

SEQ ID NO: 9481989 - DNA, 22 bp, Homo sapiens
aggcttctgataccatgagaga

SEQ ID NO: 9481990 - DNA, 22 bp, Homo sapiens
aggcttctgataccatgagaga

SEQ ID NO: 9481991 - DNA, 22 bp, Homo sapiens
aggcttctctgcaagatgttaa

SEQ ID NO: 9481992 - DNA, 22 bp, Homo sapiens
aggcttctctccttggcttgca

SEQ ID NO: 9481993 - DNA, 22 bp, Homo sapiens
aggcttctagggttggcagcgg

SEQ ID NO: 9481994 - DNA, 22 bp, Homo sapiens
aggcttctagggttggcagcgg

SEQ ID NO: 9481995 - DNA, 22 bp, Homo sapiens
aggcttctaggaaactttctgg

SEQ ID NO: 9481996 - DNA, 22 bp, Homo sapiens
aggcttctccttcctaccttcc

SEQ ID NO: 9481997 - DNA, 21 bp, Homo sapiens
aggcttctccgtgcaggaaga

SEQ ID NO: 9481998 - DNA, 21 bp, Homo sapiens
aggcttctccgtgcaggaaga

SEQ ID NO: 9481999 - DNA, 22 bp, Homo sapiens
aggcttctacgtggtcccaggg

SEQ ID NO: 9482000 - DNA, 22 bp, Homo sapiens
aggcttctacgtggtcccaggg

SEQ ID NO: 9482001 - DNA, 22 bp, Homo sapiens
aggcttctacgtggtcccaggg

SEQ ID NO: 9482002 - DNA, 19 bp, Homo sapiens
aggcttctaccctgtccag

SEQ ID NO: 9482003 - DNA, 19 bp, Homo sapiens
aggcttctaccctgtccag

SEQ ID NO: 9482004 - DNA, 22 bp, Homo sapiens
aggctggctggcaggggacaca

SEQ ID NO: 9482005 - DNA, 22 bp, Homo sapiens
aggctggctggcaggggacaca

SEQ ID NO: 9482006 - DNA, 22 bp, Homo sapiens
aggctggctgacttctgaagca

SEQ ID NO: 9482007 - DNA, 22 bp, Homo sapiens
aggctggctgacttctgaagca

SEQ ID NO: 9482008 - DNA, 22 bp, Homo sapiens
aggctggctgagctgcagcctg

SEQ ID NO: 9482009 - DNA, 22 bp, Homo sapiens
aggcttctaaatcacaaggaaa

SEQ ID NO: 9482010 - DNA, 22 bp, Homo sapiens
aggcttcctggaggaagaggta

SEQ ID NO: 9482011 - DNA, 22 bp, Homo sapiens
aggcttcacctgcacctgagct

SEQ ID NO: 9482012 - DNA, 21 bp, Homo sapiens
aggcttggatctagacaggcc

SEQ ID NO: 9482013 - DNA, 21 bp, Homo sapiens
aggcttggatctagacaggcc

SEQ ID NO: 9482014 - DNA, 21 bp, Homo sapiens
aggcttggatctagacaggcc

SEQ ID NO: 9482015 - DNA, 19 bp, Homo sapiens
aggcttggattgtggccaa

SEQ ID NO: 9482016 - DNA, 22 bp, Homo sapiens
aggcttggaggttctgtagcca

SEQ ID NO: 9482017 - DNA, 22 bp, Homo sapiens
aggcttggaggttctgtagcca

SEQ ID NO: 9482018 - DNA, 22 bp, Homo sapiens
aggcttggaagtggcagaactg

SEQ ID NO: 9482019 - DNA, 22 bp, Homo sapiens
cccaggagttcgaggctgtagt

SEQ ID NO: 9482020 - DNA, 22 bp, Homo sapiens
cccaggaggtggagcttgcagt

SEQ ID NO: 9482021 - DNA, 22 bp, Homo sapiens
cccaggaggtggagcttgcagt

SEQ ID NO: 9482022 - DNA, 22 bp, Homo sapiens
cccaggagttggaggctacggt

SEQ ID NO: 9482023 - DNA, 22 bp, Homo sapiens
cccaggagttggaggctacggt

SEQ ID NO: 9482024 - DNA, 22 bp, Homo sapiens
cccaggagttggaggctacggt

SEQ ID NO: 9482025 - DNA, 22 bp, Homo sapiens
cccaggagttggaggctacggt

SEQ ID NO: 9482026 - DNA, 22 bp, Homo sapiens
aggcttgaaatgaaatctgtaa

SEQ ID NO: 9482027 - DNA, 22 bp, Homo sapiens
aggcttcttttagaggggatgg

SEQ ID NO: 9482028 - DNA, 18 bp, Homo sapiens
aggcttcttggctcagtc

SEQ ID NO: 9482029 - DNA, 22 bp, Homo sapiens
aggcttcttttagaggggatgg

SEQ ID NO: 9482030 - DNA, 19 bp, Homo sapiens
aggcttggaacagccttat

SEQ ID NO: 9482031 - DNA, 22 bp, Homo sapiens
aggcttcttgagccccacaggc

SEQ ID NO: 9482032 - DNA, 22 bp, Homo sapiens
aggcttcttgagccccacaggc

SEQ ID NO: 9482033 - DNA, 22 bp, Homo sapiens
aggcttcttgataaaatgcaga

SEQ ID NO: 9482034 - DNA, 22 bp, Homo sapiens
aggcttcttgataaaatgcaga

SEQ ID NO: 9482035 - DNA, 22 bp, Homo sapiens
aggcttcttgcttccaaatgca

SEQ ID NO: 9482036 - DNA, 22 bp, Homo sapiens
aggcttcttcttcctatttagt

SEQ ID NO: 9482037 - DNA, 22 bp, Homo sapiens
aggcttcttctctatgtacaag

SEQ ID NO: 9482038 - DNA, 22 bp, Homo sapiens
aggcttcttagattggctggag

SEQ ID NO: 9482039 - DNA, 22 bp, Homo sapiens
aggcttctgtgagctcatacaa

SEQ ID NO: 9482040 - DNA, 22 bp, Homo sapiens
aggcttctgtttcttaaaggtg

SEQ ID NO: 9482041 - DNA, 20 bp, Homo sapiens
ccagctttccctgcagcatc

SEQ ID NO: 9482042 - DNA, 20 bp, Homo sapiens
ccagctttccctgcagcatc

SEQ ID NO: 9482043 - DNA, 22 bp, Homo sapiens
ccagcttttggggtgacaattt

SEQ ID NO: 9482044 - DNA, 22 bp, Homo sapiens
ccagcttttcctctcattgctt

SEQ ID NO: 9482045 - DNA, 22 bp, Homo sapiens
aggccctggcactgcctgggag

SEQ ID NO: 9482046 - DNA, 22 bp, Homo sapiens
ccaggaaaaacacattgaagag

SEQ ID NO: 9482047 - DNA, 22 bp, Homo sapiens
aggccctggcactgcctgggag

SEQ ID NO: 9482048 - DNA, 22 bp, Homo sapiens
aggccctggcactgcctgggag

SEQ ID NO: 9482049 - DNA, 22 bp, Homo sapiens
aggccctggcccccagagattc

SEQ ID NO: 9482050 - DNA, 22 bp, Homo sapiens
aggccctggcccccagagattc

SEQ ID NO: 9482051 - DNA, 22 bp, Homo sapiens
aggccctggcccccagagattc

SEQ ID NO: 9482052 - DNA, 22 bp, Homo sapiens
aggccctggcccccagagattc

SEQ ID NO: 9482053 - DNA, 18 bp, Homo sapiens
aggccctggcctcgaaca

SEQ ID NO: 9482054 - DNA, 18 bp, Homo sapiens
aggccctggcctcgaaca

SEQ ID NO: 9482055 - DNA, 22 bp, Homo sapiens
aggccctggcctgactcaatgt

SEQ ID NO: 9482056 - DNA, 22 bp, Homo sapiens
aggccctgggagcagagatgca

SEQ ID NO: 9482057 - DNA, 22 bp, Homo sapiens
aggccctgggagcagagatgca

SEQ ID NO: 9482058 - DNA, 22 bp, Homo sapiens
aggccctggctgggtttcttta

SEQ ID NO: 9482059 - DNA, 22 bp, Homo sapiens
aggccctgggagcagagatgca

SEQ ID NO: 9482060 - DNA, 22 bp, Homo sapiens
aggccctggggtctgttaaatt

SEQ ID NO: 9482061 - DNA, 22 bp, Homo sapiens
aggccctggggtctgttaaatt

SEQ ID NO: 9482062 - DNA, 22 bp, Homo sapiens
aggccctgggttagggcccact

SEQ ID NO: 9482063 - DNA, 22 bp, Homo sapiens
aggccctgggcagttctgtagc

SEQ ID NO: 9482064 - DNA, 22 bp, Homo sapiens
aggccctgggcagttctgtagc

SEQ ID NO: 9482065 - DNA, 22 bp, Homo sapiens
ccaggacaagtgtggccatggc

SEQ ID NO: 9482066 - DNA, 22 bp, Homo sapiens
ccaggagagctctcgttcagtg

SEQ ID NO: 9482067 - DNA, 22 bp, Homo sapiens
ccaggagagcgccctcccggcc

SEQ ID NO: 9482068 - DNA, 22 bp, Homo sapiens
ccaggagagctctaaatggctg

SEQ ID NO: 9482069 - DNA, 22 bp, Homo sapiens
ccaggagagctctaaatggctg

SEQ ID NO: 9482070 - DNA, 22 bp, Homo sapiens
ccaggagagcattgcacagagg

SEQ ID NO: 9482071 - DNA, 22 bp, Homo sapiens
ccaggagagcattgcacagagg

SEQ ID NO: 9482072 - DNA, 22 bp, Homo sapiens
ccaggagagcattgcacagagg

SEQ ID NO: 9482073 - DNA, 22 bp, Homo sapiens
ccaggagagcagaagcccaggc

SEQ ID NO: 9482074 - DNA, 22 bp, Homo sapiens
ccaggagagcagaagcccaggc

SEQ ID NO: 9482075 - DNA, 22 bp, Homo sapiens
ccaggagagcagaagcccaggc

SEQ ID NO: 9482076 - DNA, 22 bp, Homo sapiens
ccaggagagcagaagcccaggc

SEQ ID NO: 9482077 - DNA, 22 bp, Homo sapiens
ccaggagagcaggcgtgcagct

SEQ ID NO: 9482078 - DNA, 22 bp, Homo sapiens
ccaggagatgggaaagtagcag

SEQ ID NO: 9482079 - DNA, 22 bp, Homo sapiens
ccaggagatgggaaagtagcag

SEQ ID NO: 9482080 - DNA, 22 bp, Homo sapiens
ccaggagatgggagcatctaaa

SEQ ID NO: 9482081 - DNA, 22 bp, Homo sapiens
ccaggagataagctgagtttat

SEQ ID NO: 9482082 - DNA, 19 bp, Homo sapiens
ccaggagagcttggagaag

SEQ ID NO: 9482083 - DNA, 22 bp, Homo sapiens
ccaggagataagctgagtttat

SEQ ID NO: 9482084 - DNA, 19 bp, Homo sapiens
ccaggagagcttggagaag

SEQ ID NO: 9482085 - DNA, 22 bp, Homo sapiens
ccaggagatgatgttggggatt

SEQ ID NO: 9482086 - DNA, 22 bp, Homo sapiens
ccaggagatttttccatagcac

SEQ ID NO: 9482087 - DNA, 22 bp, Homo sapiens
ccaggagcgggaaaaggaagaa

SEQ ID NO: 9482088 - DNA, 22 bp, Homo sapiens
ccaggagcgggaaaaggaagaa

SEQ ID NO: 9482089 - DNA, 22 bp, Homo sapiens
ccaggagcgcgtgaacaggctg

SEQ ID NO: 9482090 - DNA, 22 bp, Homo sapiens
ccaggagcgcgtgaacaggctg

SEQ ID NO: 9482091 - DNA, 22 bp, Homo sapiens
aggcccagagcaggaaagggtt

SEQ ID NO: 9482092 - DNA, 22 bp, Homo sapiens
aggcccagagcaggaaagggtt

SEQ ID NO: 9482093 - DNA, 21 bp, Homo sapiens
aggcccagagtcttgggggga

SEQ ID NO: 9482094 - DNA, 22 bp, Homo sapiens
aggcccagagagccagttagtg

SEQ ID NO: 9482095 - DNA, 22 bp, Homo sapiens
aggcccagagagccagttagtg

SEQ ID NO: 9482096 - DNA, 22 bp, Homo sapiens
aggcccagagagccagttagtg

SEQ ID NO: 9482097 - DNA, 21 bp, Homo sapiens
aggcccagagtcttgggggga

SEQ ID NO: 9482098 - DNA, 22 bp, Homo sapiens
aggcccagcccgtcctcgtgct

SEQ ID NO: 9482099 - DNA, 22 bp, Homo sapiens
aggcccagcccgtcctcgtgct

SEQ ID NO: 9482100 - DNA, 19 bp, Homo sapiens
aggcccagcgctgggggct

SEQ ID NO: 9482101 - DNA, 19 bp, Homo sapiens
aggcccagcgctgggggct

SEQ ID NO: 9482102 - DNA, 22 bp, Homo sapiens
ccagctttatagcttcaaagga

SEQ ID NO: 9482103 - DNA, 22 bp, Homo sapiens
ccagctttcatatcatgaggta

SEQ ID NO: 9482104 - DNA, 22 bp, Homo sapiens
ccagcttggaatatgccattgt

SEQ ID NO: 9482105 - DNA, 22 bp, Homo sapiens
aggcccagctggacaaactgct

SEQ ID NO: 9482106 - DNA, 22 bp, Homo sapiens
ccagctggcccagctgtgctcc

SEQ ID NO: 9482107 - DNA, 22 bp, Homo sapiens
aggcccagctggacaaactgct

SEQ ID NO: 9482108 - DNA, 22 bp, Homo sapiens
ccagctggcccagctgtgctcc

SEQ ID NO: 9482109 - DNA, 22 bp, Homo sapiens
ccagcttctctctgatgcagct

SEQ ID NO: 9482110 - DNA, 22 bp, Homo sapiens
ccagcttctctctgatgcagct

SEQ ID NO: 9482111 - DNA, 22 bp, Homo sapiens
ccagcctcatcgcctgcctgtc

SEQ ID NO: 9482112 - DNA, 22 bp, Homo sapiens
ccagcctccatgtagatagctg

SEQ ID NO: 9482113 - DNA, 22 bp, Homo sapiens
ccagcctccatgtagatagctg

SEQ ID NO: 9482114 - DNA, 22 bp, Homo sapiens
ccagcctccatgtagatagctg

SEQ ID NO: 9482115 - DNA, 22 bp, Homo sapiens
ccagcctccatgtagatagctg

SEQ ID NO: 9482116 - DNA, 22 bp, Homo sapiens
ccagcctccatgtagatagctg

SEQ ID NO: 9482117 - DNA, 19 bp, Homo sapiens
ccagcctctcttccacccc

SEQ ID NO: 9482118 - DNA, 22 bp, Homo sapiens
ccagcctgaaatgcctcatcct

SEQ ID NO: 9482119 - DNA, 22 bp, Homo sapiens
ccagcctgaaatgcctcatcct

SEQ ID NO: 9482120 - DNA, 22 bp, Homo sapiens
ccagcctgaaatgcctcatcct

SEQ ID NO: 9482121 - DNA, 22 bp, Homo sapiens
ccagcctgaaatgcctcatcct

SEQ ID NO: 9482122 - DNA, 22 bp, Homo sapiens
ccagcctgaaatgcctcatcct

SEQ ID NO: 9482123 - DNA, 19 bp, Homo sapiens
ccagcctctcttccacccc

SEQ ID NO: 9482124 - DNA, 23 bp, Homo sapiens
ccagcctctgggtcttcatccag

SEQ ID NO: 9482125 - DNA, 22 bp, Homo sapiens
ccagcctgaaatgcctcatcct

SEQ ID NO: 9482126 - DNA, 22 bp, Homo sapiens
ccagcctcatcgcctgcctgtc

SEQ ID NO: 9482127 - DNA, 22 bp, Homo sapiens
ccagcctcatcgcctgcctgtc

SEQ ID NO: 9482128 - DNA, 22 bp, Homo sapiens
ccagcctcatcgcctgcctgtc

SEQ ID NO: 9482129 - DNA, 22 bp, Homo sapiens
aggccagatgtcgggctagaag

SEQ ID NO: 9482130 - DNA, 22 bp, Homo sapiens
ccagccctgccagagagagctg

SEQ ID NO: 9482131 - DNA, 22 bp, Homo sapiens
ccagccctgccagagagagctg

SEQ ID NO: 9482132 - DNA, 22 bp, Homo sapiens
aggccagagttaaggagaacag

SEQ ID NO: 9482133 - DNA, 22 bp, Homo sapiens
aggccagagttaaggagaacag

SEQ ID NO: 9482134 - DNA, 22 bp, Homo sapiens
aggccagagttaaggagaacag

SEQ ID NO: 9482135 - DNA, 22 bp, Homo sapiens
aggccagagttaaggagaacag

SEQ ID NO: 9482136 - DNA, 22 bp, Homo sapiens
aggccagatattgtgctaccca

SEQ ID NO: 9482137 - DNA, 17 bp, Homo sapiens
aggccagatgaggcaag

SEQ ID NO: 9482138 - DNA, 17 bp, Homo sapiens
aggccagatgaggcaag

SEQ ID NO: 9482139 - DNA, 17 bp, Homo sapiens
aggccagatgaggcaag

SEQ ID NO: 9482140 - DNA, 17 bp, Homo sapiens
aggccagatgaggcaag

SEQ ID NO: 9482141 - DNA, 17 bp, Homo sapiens
aggccagatgaggcaag

SEQ ID NO: 9482142 - DNA, 22 bp, Homo sapiens
aggcatggatgtagcagtgacc

SEQ ID NO: 9482143 - DNA, 22 bp, Homo sapiens
aggcatggatgtagcagtgacc

SEQ ID NO: 9482144 - DNA, 22 bp, Homo sapiens
aggcatggcactgagcagcttc

SEQ ID NO: 9482145 - DNA, 22 bp, Homo sapiens
aggcatggcactgagcagcttc

SEQ ID NO: 9482146 - DNA, 22 bp, Homo sapiens
aggcatggcactgagcagcttc

SEQ ID NO: 9482147 - DNA, 22 bp, Homo sapiens
aggcatggcactgagcagcttc

SEQ ID NO: 9482148 - DNA, 22 bp, Homo sapiens
aggcatggatggatccagggct

SEQ ID NO: 9482149 - DNA, 22 bp, Homo sapiens
aggcatggatggatccagggct

SEQ ID NO: 9482150 - DNA, 22 bp, Homo sapiens
aggcatggatgtagcagtgacc

SEQ ID NO: 9482151 - DNA, 23 bp, Homo sapiens
aggcatggcatggatggtggctc

SEQ ID NO: 9482152 - DNA, 22 bp, Homo sapiens
ccagagtgacgtgaagtgtgaa

SEQ ID NO: 9482153 - DNA, 22 bp, Homo sapiens
ccagagtctttatattcctgaa

SEQ ID NO: 9482154 - DNA, 22 bp, Homo sapiens
aggcatggcactgagcagcttc

SEQ ID NO: 9482155 - DNA, 22 bp, Homo sapiens
aggcatggcactgagcagcttc

SEQ ID NO: 9482156 - DNA, 22 bp, Homo sapiens
aggcatggcactgagcagcttc

SEQ ID NO: 9482157 - DNA, 22 bp, Homo sapiens
aggcatggcactgagcagcttc

SEQ ID NO: 9482158 - DNA, 21 bp, Homo sapiens
aggcatggaaatggcacactg

SEQ ID NO: 9482159 - DNA, 21 bp, Homo sapiens
aggcatggaaatggcacactg

SEQ ID NO: 9482160 - DNA, 22 bp, Homo sapiens
aggcatggacatttcggcagct

SEQ ID NO: 9482161 - DNA, 22 bp, Homo sapiens
aggcatggacatttcggcagct

SEQ ID NO: 9482162 - DNA, 22 bp, Homo sapiens
ccagagatgtgaaaatgccgga

SEQ ID NO: 9482163 - DNA, 22 bp, Homo sapiens
ccagagcaattctcacagaact

SEQ ID NO: 9482164 - DNA, 22 bp, Homo sapiens
ccagagatgttcacattctaat

SEQ ID NO: 9482165 - DNA, 22 bp, Homo sapiens
ccagagatgttcacattctaat

SEQ ID NO: 9482166 - DNA, 22 bp, Homo sapiens
ccagagcagaaccggaacacca

SEQ ID NO: 9482167 - DNA, 22 bp, Homo sapiens
ccagagcagatgtggccttggt

SEQ ID NO: 9482168 - DNA, 22 bp, Homo sapiens
ccagagcaattctcacagaact

SEQ ID NO: 9482169 - DNA, 22 bp, Homo sapiens
ccagagcaattctcacagaact

SEQ ID NO: 9482170 - DNA, 22 bp, Homo sapiens
ccagagcagaaccggaacacca

SEQ ID NO: 9482171 - DNA, 22 bp, Homo sapiens
aggccagagaggggaccagcct

SEQ ID NO: 9482172 - DNA, 22 bp, Homo sapiens
aggccagagaggggaccagcct

SEQ ID NO: 9482173 - DNA, 22 bp, Homo sapiens
aggccagacagctagaaacagg

SEQ ID NO: 9482174 - DNA, 22 bp, Homo sapiens
aggccagaacagctctgcacca

SEQ ID NO: 9482175 - DNA, 22 bp, Homo sapiens
aggccagaaatttggagtatgt

SEQ ID NO: 9482176 - DNA, 22 bp, Homo sapiens
aggccagaagccagaaatgctt

SEQ ID NO: 9482177 - DNA, 22 bp, Homo sapiens
aggccagacagctagaaacagg

SEQ ID NO: 9482178 - DNA, 22 bp, Homo sapiens
aggccagacagctagaaacagg

SEQ ID NO: 9482179 - DNA, 22 bp, Homo sapiens
ccagcagagggcgcttcacacc

SEQ ID NO: 9482180 - DNA, 22 bp, Homo sapiens
ccagcagagctggaagtgtgct

SEQ ID NO: 9482181 - DNA, 22 bp, Homo sapiens
aggccagaaatttggagtatgt

SEQ ID NO: 9482182 - DNA, 22 bp, Homo sapiens
aggccagaaatttggagtatgt

SEQ ID NO: 9482183 - DNA, 22 bp, Homo sapiens
aggccagaaatgtcagggagtg

SEQ ID NO: 9482184 - DNA, 22 bp, Homo sapiens
ccagcagaggggcggagtgcag

SEQ ID NO: 9482185 - DNA, 22 bp, Homo sapiens
ccagcagagcatggggaggaag

SEQ ID NO: 9482186 - DNA, 22 bp, Homo sapiens
ccagcagagctcaaacttcctg

SEQ ID NO: 9482187 - DNA, 22 bp, Homo sapiens
ccagcagagctcaaacttcctg

SEQ ID NO: 9482188 - DNA, 22 bp, Homo sapiens
ccagcagagctggaagtgtgct

SEQ ID NO: 9482189 - DNA, 19 bp, Homo sapiens
ccagcagacacagctgccc

SEQ ID NO: 9482190 - DNA, 22 bp, Homo sapiens
ccagcagagcatggggaggaag

SEQ ID NO: 9482191 - DNA, 22 bp, Homo sapiens
ccagcactgctctcagactgag

SEQ ID NO: 9482192 - DNA, 19 bp, Homo sapiens
ccagcagaagccactcctg

SEQ ID NO: 9482193 - DNA, 22 bp, Homo sapiens
ccagagaaagtgaagcaaatgt

SEQ ID NO: 9482194 - DNA, 22 bp, Homo sapiens
ccagagaaagtgaagcaaatgt

SEQ ID NO: 9482195 - DNA, 23 bp, Homo sapiens
ccacaggcacagaggcttgcatc

SEQ ID NO: 9482196 - DNA, 22 bp, Homo sapiens
ccacaggatccaagggaaggca

SEQ ID NO: 9482197 - DNA, 22 bp, Homo sapiens
ccacaggacggaggtctggccg

SEQ ID NO: 9482198 - DNA, 22 bp, Homo sapiens
ccacaggaggaacaattagatg

SEQ ID NO: 9482199 - DNA, 22 bp, Homo sapiens
ccacaggaggatgttcagacaa

SEQ ID NO: 9482200 - DNA, 22 bp, Homo sapiens
ccagagagtaggaggcattatt

SEQ ID NO: 9482201 - DNA, 22 bp, Homo sapiens
ccagagaggggaagggcttgcc

SEQ ID NO: 9482202 - DNA, 22 bp, Homo sapiens
ccagagagtatcatggagagta

SEQ ID NO: 9482203 - DNA, 22 bp, Homo sapiens
ccagagagtatcatggagagta

SEQ ID NO: 9482204 - DNA, 22 bp, Homo sapiens
ccagagagtatcatggagagta

SEQ ID NO: 9482205 - DNA, 22 bp, Homo sapiens
ccagagagtatcatggagagta

SEQ ID NO: 9482206 - DNA, 22 bp, Homo sapiens
ccagagagtatcatggagagta

SEQ ID NO: 9482207 - DNA, 22 bp, Homo sapiens
ccagagagtcgatgggggacac

SEQ ID NO: 9482208 - DNA, 22 bp, Homo sapiens
ccacaggacacaactgctgacc

SEQ ID NO: 9482209 - DNA, 22 bp, Homo sapiens
ccacagcttcgcagtctgctgc

SEQ ID NO: 9482210 - DNA, 21 bp, Homo sapiens
ccacagctggtctctgagccc

SEQ ID NO: 9482211 - DNA, 22 bp, Homo sapiens
aggcagggtgatgataatgatt

SEQ ID NO: 9482212 - DNA, 22 bp, Homo sapiens
aggcagggtgatgataatgatt

SEQ ID NO: 9482213 - DNA, 22 bp, Homo sapiens
aggcagggtgatgataatgatt

SEQ ID NO: 9482214 - DNA, 22 bp, Homo sapiens
aggcagggtgatgataatgatt

SEQ ID NO: 9482215 - DNA, 17 bp, Homo sapiens
ccacagctgggtgcctt

SEQ ID NO: 9482216 - DNA, 22 bp, Homo sapiens
ccacagctgaccgcaggtgagc

SEQ ID NO: 9482217 - DNA, 22 bp, Homo sapiens
ccacagctgaccgcaggtgagc

SEQ ID NO: 9482218 - DNA, 22 bp, Homo sapiens
ccacagctgaccgcaggtgagc

SEQ ID NO: 9482219 - DNA, 17 bp, Homo sapiens
aggcaggtaagagttat

SEQ ID NO: 9482220 - DNA, 22 bp, Homo sapiens
aggcagggtcttgctatgttgc

SEQ ID NO: 9482221 - DNA, 22 bp, Homo sapiens
aggcaggggagctggaagggta

SEQ ID NO: 9482222 - DNA, 22 bp, Homo sapiens
aggcagggtgatgataatgatt

SEQ ID NO: 9482223 - DNA, 22 bp, Homo sapiens
aggcagggtcttgctatgttgc

SEQ ID NO: 9482224 - DNA, 22 bp, Homo sapiens
aggcagggtcttgctatgttgc

SEQ ID NO: 9482225 - DNA, 22 bp, Homo sapiens
aggcaggggagctggaagggta

SEQ ID NO: 9482226 - DNA, 22 bp, Homo sapiens
aggcaggggagctggaagggta

SEQ ID NO: 9482227 - DNA, 22 bp, Homo sapiens
aggcaggggagctggaagggta

SEQ ID NO: 9482228 - DNA, 22 bp, Homo sapiens
ccagggagcggggctgggtctc

SEQ ID NO: 9482229 - DNA, 22 bp, Homo sapiens
ccagggagcggggctgggtctc

SEQ ID NO: 9482230 - DNA, 22 bp, Homo sapiens
aggctccctgaatcgcccgttc

SEQ ID NO: 9482231 - DNA, 22 bp, Homo sapiens
ccagggaggagcatttcatggt

SEQ ID NO: 9482232 - DNA, 22 bp, Homo sapiens
aggctccgtccagtctcaggcc

SEQ ID NO: 9482233 - DNA, 22 bp, Homo sapiens
aggctcctgagaggcagaggct

SEQ ID NO: 9482234 - DNA, 20 bp, Homo sapiens
aggctcctccaggatgtgtg

SEQ ID NO: 9482235 - DNA, 22 bp, Homo sapiens
ccagggaatgtgggatgactct

SEQ ID NO: 9482236 - DNA, 22 bp, Homo sapiens
ccagggagcccacaggacaatg

SEQ ID NO: 9482237 - DNA, 22 bp, Homo sapiens
ccagggactttgcattgtttat

SEQ ID NO: 9482238 - DNA, 22 bp, Homo sapiens
ccagggagcccacaggacaatg

SEQ ID NO: 9482239 - DNA, 22 bp, Homo sapiens
ccagggagcccacaggacaatg

SEQ ID NO: 9482240 - DNA, 22 bp, Homo sapiens
ccagggagcctggtgtgtcagc

SEQ ID NO: 9482241 - DNA, 22 bp, Homo sapiens
ccagggagcctggtgtgtcagc

SEQ ID NO: 9482242 - DNA, 22 bp, Homo sapiens
ccagggagcctggtgtgtcagc

SEQ ID NO: 9482243 - DNA, 22 bp, Homo sapiens
ccagggagcctggtgtgtcagc

SEQ ID NO: 9482244 - DNA, 22 bp, Homo sapiens
ccagggaatcaggcagaagtca

SEQ ID NO: 9482245 - DNA, 22 bp, Homo sapiens
ccagggaatctctgagtgtgtt

SEQ ID NO: 9482246 - DNA, 22 bp, Homo sapiens
ccagggaagtcacattgtctag

SEQ ID NO: 9482247 - DNA, 22 bp, Homo sapiens
ccagggaagtcacattgtctag

SEQ ID NO: 9482248 - DNA, 22 bp, Homo sapiens
ccagggaagtcacattgtctag

SEQ ID NO: 9482249 - DNA, 22 bp, Homo sapiens
ccagggaagtagttgtgagagc

SEQ ID NO: 9482250 - DNA, 22 bp, Homo sapiens
ccaggctgtaaacaccttcaaa

SEQ ID NO: 9482251 - DNA, 22 bp, Homo sapiens
ccagggaagtagttgtgagagc

SEQ ID NO: 9482252 - DNA, 22 bp, Homo sapiens
aggctcctgcaggtgaggtgct

SEQ ID NO: 9482253 - DNA, 22 bp, Homo sapiens
aggctcctgcaggtgaggtgct

SEQ ID NO: 9482254 - DNA, 22 bp, Homo sapiens
aggctcctgagaggcagaggct

SEQ ID NO: 9482255 - DNA, 22 bp, Homo sapiens
aggctcctgagaggcagaggct

SEQ ID NO: 9482256 - DNA, 22 bp, Homo sapiens
aggctcctgagaggcagaggct

SEQ ID NO: 9482257 - DNA, 22 bp, Homo sapiens
aggctcctgatcctggggtctg

SEQ ID NO: 9482258 - DNA, 22 bp, Homo sapiens
ccagggcttaacttttcaggag

SEQ ID NO: 9482259 - DNA, 22 bp, Homo sapiens
ccagggctggtgggagatgctg

SEQ ID NO: 9482260 - DNA, 22 bp, Homo sapiens
ccagggtcttcgaggcagcaat

SEQ ID NO: 9482261 - DNA, 22 bp, Homo sapiens
ccagggtcttggagaggagtgc

SEQ ID NO: 9482262 - DNA, 22 bp, Homo sapiens
aggctccttgctcacaggctca

SEQ ID NO: 9482263 - DNA, 20 bp, Homo sapiens
aggctcctgtacctgaggaa

SEQ ID NO: 9482264 - DNA, 22 bp, Homo sapiens
ccagggtgaggaggctcccacg

SEQ ID NO: 9482265 - DNA, 22 bp, Homo sapiens
ccagggtgaggaggctcccacg

SEQ ID NO: 9482266 - DNA, 22 bp, Homo sapiens
ccagggtgagaaaaggctggat

SEQ ID NO: 9482267 - DNA, 22 bp, Homo sapiens
ccagggtgagtgtcatgggtta

SEQ ID NO: 9482268 - DNA, 22 bp, Homo sapiens
ccagggtgctctgtggcgtcgc

SEQ ID NO: 9482269 - DNA, 22 bp, Homo sapiens
ccagggtgagtgtcatgggtta

SEQ ID NO: 9482270 - DNA, 22 bp, Homo sapiens
ccagggtgaccctcccggtggc

SEQ ID NO: 9482271 - DNA, 22 bp, Homo sapiens
ccagggtgagaaaaggctggat

SEQ ID NO: 9482272 - DNA, 22 bp, Homo sapiens
ccagggtgagaaaaggctggat

SEQ ID NO: 9482273 - DNA, 22 bp, Homo sapiens
ccagggtgaccctcccggtggc

SEQ ID NO: 9482274 - DNA, 22 bp, Homo sapiens
ccagggtgagaaaaggctggat

SEQ ID NO: 9482275 - DNA, 22 bp, Homo sapiens
ccagggtgagaaaaggctggat

SEQ ID NO: 9482276 - DNA, 22 bp, Homo sapiens
ccagggtgaccagctggcctag

SEQ ID NO: 9482277 - DNA, 22 bp, Homo sapiens
ccagggtgaccagctggcctag

SEQ ID NO: 9482278 - DNA, 22 bp, Homo sapiens
ccagggtgaccagctggcctag

SEQ ID NO: 9482279 - DNA, 22 bp, Homo sapiens
ccagggtgaccagctggcctag

SEQ ID NO: 9482280 - DNA, 22 bp, Homo sapiens
ccaggaggaaattctaaaggta

SEQ ID NO: 9482281 - DNA, 22 bp, Homo sapiens
ccaggaggaaagaccagcccat

SEQ ID NO: 9482282 - DNA, 22 bp, Homo sapiens
ccaggagctggagggtgcagtg

SEQ ID NO: 9482283 - DNA, 22 bp, Homo sapiens
ccaggagctggcatgtggagag

SEQ ID NO: 9482284 - DNA, 22 bp, Homo sapiens
ccaggagctggcatgtggagag

SEQ ID NO: 9482285 - DNA, 22 bp, Homo sapiens
ccaggagctggagggtgcagtg

SEQ ID NO: 9482286 - DNA, 22 bp, Homo sapiens
ccaggagctggagggtgcagtg

SEQ ID NO: 9482287 - DNA, 22 bp, Homo sapiens
ccaggagctatgtacacactat

SEQ ID NO: 9482288 - DNA, 22 bp, Homo sapiens
ccaggagctatgtacacactat

SEQ ID NO: 9482289 - DNA, 17 bp, Homo sapiens
ccaggagcgtgggtctc

SEQ ID NO: 9482290 - DNA, 22 bp, Homo sapiens
aggctcagtctgttcatgcact

SEQ ID NO: 9482291 - DNA, 22 bp, Homo sapiens
aggctcagtctgttcatgcact

SEQ ID NO: 9482292 - DNA, 22 bp, Homo sapiens
aggctcagtgatgtaaaatata

SEQ ID NO: 9482293 - DNA, 22 bp, Homo sapiens
aggctcagtatagctggcaagt

SEQ ID NO: 9482294 - DNA, 22 bp, Homo sapiens
aggctcagtcccggcccgcgcc

SEQ ID NO: 9482295 - DNA, 22 bp, Homo sapiens
aggctcagtatagctggcaagt

SEQ ID NO: 9482296 - DNA, 22 bp, Homo sapiens
aggctcaggtgcctcattcaca

SEQ ID NO: 9482297 - DNA, 22 bp, Homo sapiens
aggctcagcctgggcctagagc

SEQ ID NO: 9482298 - DNA, 22 bp, Homo sapiens
aggctcagcctgggcctagagc

SEQ ID NO: 9482299 - DNA, 22 bp, Homo sapiens
aggctcagcctgggcctagagc

SEQ ID NO: 9482300 - DNA, 22 bp, Homo sapiens
aggctcagtttggtttccattg

SEQ ID NO: 9482301 - DNA, 22 bp, Homo sapiens
aggctccaaattaccaagctct

SEQ ID NO: 9482302 - DNA, 22 bp, Homo sapiens
aggctcagttctgtggtgagcc

SEQ ID NO: 9482303 - DNA, 22 bp, Homo sapiens
aggctcagttctgtggtgagcc

SEQ ID NO: 9482304 - DNA, 22 bp, Homo sapiens
aggctcagttctgtggtgagcc

SEQ ID NO: 9482305 - DNA, 22 bp, Homo sapiens
aggctcagtgcaaatcattctg

SEQ ID NO: 9482306 - DNA, 22 bp, Homo sapiens
aggctcagttcacgtcaacttt

SEQ ID NO: 9482307 - DNA, 22 bp, Homo sapiens
ccagggaaggctgctggctgtg

SEQ ID NO: 9482308 - DNA, 22 bp, Homo sapiens
ccaggctgtaaacaccttcaaa

SEQ ID NO: 9482309 - DNA, 22 bp, Homo sapiens
ccaggctgtaaacaccttcaaa

SEQ ID NO: 9482310 - DNA, 22 bp, Homo sapiens
aggctccaccctacagagctcc

SEQ ID NO: 9482311 - DNA, 22 bp, Homo sapiens
aggctccaccctacagagctcc

SEQ ID NO: 9482312 - DNA, 22 bp, Homo sapiens
aggctccaccctacagagctcc

SEQ ID NO: 9482313 - DNA, 22 bp, Homo sapiens
aggctccaccctacagagctcc

SEQ ID NO: 9482314 - DNA, 22 bp, Homo sapiens
aggctccaccctacagagctcc

SEQ ID NO: 9482315 - DNA, 22 bp, Homo sapiens
ccaggctgtaaacaccttcaaa

SEQ ID NO: 9482316 - DNA, 22 bp, Homo sapiens
aggctccaccagtcaggtgcat

SEQ ID NO: 9482317 - DNA, 22 bp, Homo sapiens
aggctccaccccgccagacctt

SEQ ID NO: 9482318 - DNA, 22 bp, Homo sapiens
aggctccaccagtcaggtgcat

SEQ ID NO: 9482319 - DNA, 22 bp, Homo sapiens
aggctccaccagtcaggtgcat

SEQ ID NO: 9482320 - DNA, 22 bp, Homo sapiens
aggctccaccagtcaggtgcat

SEQ ID NO: 9482321 - DNA, 23 bp, Homo sapiens
aggctccacatgggcactttgca

SEQ ID NO: 9482322 - DNA, 22 bp, Homo sapiens
cccagagccggtggtgctcaca

SEQ ID NO: 9482323 - DNA, 22 bp, Homo sapiens
cccagagccggtggtgctcaca

SEQ ID NO: 9482324 - DNA, 22 bp, Homo sapiens
cccagagccggtggtgctcaca

SEQ ID NO: 9482325 - DNA, 21 bp, Homo sapiens
cccagagcctagggagggcac

SEQ ID NO: 9482326 - DNA, 22 bp, Homo sapiens
aggctggcgtcaggggctgtac

SEQ ID NO: 9482327 - DNA, 22 bp, Homo sapiens
aggctggcgtcaggggctgtac

SEQ ID NO: 9482328 - DNA, 17 bp, Homo sapiens
aggctggctcacaggga

SEQ ID NO: 9482329 - DNA, 17 bp, Homo sapiens
aggctggctcacaggga

SEQ ID NO: 9482330 - DNA, 22 bp, Homo sapiens
aggctggctgacttctgaagca

SEQ ID NO: 9482331 - DNA, 22 bp, Homo sapiens
aggctggctcggcttttctgtc

SEQ ID NO: 9482332 - DNA, 22 bp, Homo sapiens
aggctggctgaaaaacaccctt

SEQ ID NO: 9482333 - DNA, 22 bp, Homo sapiens
cccagagatgtcctgagtgata

SEQ ID NO: 9482334 - DNA, 23 bp, Homo sapiens
cccagagcacagcctccagatgc

SEQ ID NO: 9482335 - DNA, 19 bp, Homo sapiens
cccagagcatcctgaactt

SEQ ID NO: 9482336 - DNA, 20 bp, Homo sapiens
cccagagcactttttcatgt

SEQ ID NO: 9482337 - DNA, 22 bp, Homo sapiens
cccagagcataacgtatcttga

SEQ ID NO: 9482338 - DNA, 20 bp, Homo sapiens
cccagagccatagccagaca

SEQ ID NO: 9482339 - DNA, 22 bp, Homo sapiens
cccagagcatgtgctgcctttg

SEQ ID NO: 9482340 - DNA, 22 bp, Homo sapiens
cccagagccgctcccctacttc

SEQ ID NO: 9482341 - DNA, 20 bp, Homo sapiens
cccagagccatagccagaca

SEQ ID NO: 9482342 - DNA, 20 bp, Homo sapiens
cccagagccatagccagaca

SEQ ID NO: 9482343 - DNA, 22 bp, Homo sapiens
cccagagccgctcccctacttc

SEQ ID NO: 9482344 - DNA, 22 bp, Homo sapiens
aggctgcctctgcaggatccct

SEQ ID NO: 9482345 - DNA, 22 bp, Homo sapiens
aggctgcctcgtgagctcgctg

SEQ ID NO: 9482346 - DNA, 22 bp, Homo sapiens
aggctgcctcttttgagagggt

SEQ ID NO: 9482347 - DNA, 22 bp, Homo sapiens
aggctgcctcttttgagagggt

SEQ ID NO: 9482348 - DNA, 22 bp, Homo sapiens
aggctgcctgttccaatctcct

SEQ ID NO: 9482349 - DNA, 22 bp, Homo sapiens
aggctgcgttagcctcactccc

SEQ ID NO: 9482350 - DNA, 22 bp, Homo sapiens
cccactgctgctctccatggca

SEQ ID NO: 9482351 - DNA, 21 bp, Homo sapiens
ccatgggaagcatcctcgcgg

SEQ ID NO: 9482352 - DNA, 22 bp, Homo sapiens
ccatgggaattgggaggtccca

SEQ ID NO: 9482353 - DNA, 22 bp, Homo sapiens
ccatgggagatgatggggagtg

SEQ ID NO: 9482354 - DNA, 21 bp, Homo sapiens
ccatgggagctgttaatcctg

SEQ ID NO: 9482355 - DNA, 22 bp, Homo sapiens
ccatgggacctacctcctgtgc

SEQ ID NO: 9482356 - DNA, 22 bp, Homo sapiens
ccatgggagatgatggggagtg

SEQ ID NO: 9482357 - DNA, 22 bp, Homo sapiens
ccatgggcgcacaggcctggag

SEQ ID NO: 9482358 - DNA, 22 bp, Homo sapiens
ccatgtacatgaacacggcggc

SEQ ID NO: 9482359 - DNA, 22 bp, Homo sapiens
ccatgggcgcacaggcctggag

SEQ ID NO: 9482360 - DNA, 22 bp, Homo sapiens
ccatgggcgcacaggcctggag

SEQ ID NO: 9482361 - DNA, 21 bp, Homo sapiens
ccatgtcagatgtgggctgtg

SEQ ID NO: 9482362 - DNA, 21 bp, Homo sapiens
ccatgtcagatgtgggctgtg

SEQ ID NO: 9482363 - DNA, 20 bp, Homo sapiens
aggctgcctaaggctctgca

SEQ ID NO: 9482364 - DNA, 22 bp, Homo sapiens
ccatgtgcttgctctggcacct

SEQ ID NO: 9482365 - DNA, 22 bp, Homo sapiens
aggctctgtgatccacaatgag

SEQ ID NO: 9482366 - DNA, 22 bp, Homo sapiens
aggctctgtgatgtgccaggca

SEQ ID NO: 9482367 - DNA, 22 bp, Homo sapiens
aggctctgtgatgtgccaggca

SEQ ID NO: 9482368 - DNA, 22 bp, Homo sapiens
aggctctgtgatgtgccaggca

SEQ ID NO: 9482369 - DNA, 22 bp, Homo sapiens
aggctctgtgcagcctgcatct

SEQ ID NO: 9482370 - DNA, 22 bp, Homo sapiens
aggctctgtcaggcggagcagc

SEQ ID NO: 9482371 - DNA, 22 bp, Homo sapiens
ccagggtggaggctggatggag

SEQ ID NO: 9482372 - DNA, 22 bp, Homo sapiens
ccagggtggaggctggatggag

SEQ ID NO: 9482373 - DNA, 22 bp, Homo sapiens
aggctctgtgacaatcaagctg

SEQ ID NO: 9482374 - DNA, 22 bp, Homo sapiens
aggctctgtgacaatcaagctg

SEQ ID NO: 9482375 - DNA, 22 bp, Homo sapiens
aggctgaggcgggtagatcacc

SEQ ID NO: 9482376 - DNA, 22 bp, Homo sapiens
aggctgaggcgggtagatcacc

SEQ ID NO: 9482377 - DNA, 22 bp, Homo sapiens
aggctgaggcgggtagatcacc

SEQ ID NO: 9482378 - DNA, 22 bp, Homo sapiens
aggctgaggggcgagggaccct

SEQ ID NO: 9482379 - DNA, 22 bp, Homo sapiens
aggctgaggggcgagggaccct

SEQ ID NO: 9482380 - DNA, 22 bp, Homo sapiens
aggctgaggggcgagggaccct

SEQ ID NO: 9482381 - DNA, 22 bp, Homo sapiens
aggctctgtgcagcctgcatct

SEQ ID NO: 9482382 - DNA, 22 bp, Homo sapiens
aggctctgtgcatcctccccaa

SEQ ID NO: 9482383 - DNA, 22 bp, Homo sapiens
aggctgaggtaggaggatcgct

SEQ ID NO: 9482384 - DNA, 20 bp, Homo sapiens
aggctgagggtgattgtgtc

SEQ ID NO: 9482385 - DNA, 22 bp, Homo sapiens
aggctgaggtaggaggatcgct

SEQ ID NO: 9482386 - DNA, 20 bp, Homo sapiens
aggctgagggtgattgtgtc

SEQ ID NO: 9482387 - DNA, 22 bp, Homo sapiens
aggctgaggggcgagggaccct

SEQ ID NO: 9482388 - DNA, 20 bp, Homo sapiens
aggctgagggtgattgtgtc

SEQ ID NO: 9482389 - DNA, 22 bp, Homo sapiens
aggctgaggggcgagggaccct

SEQ ID NO: 9482390 - DNA, 22 bp, Homo sapiens
aggctgaggggcgagggaccct

SEQ ID NO: 9482391 - DNA, 20 bp, Homo sapiens
aggctgagggtgattgtgtc

SEQ ID NO: 9482392 - DNA, 22 bp, Homo sapiens
aggctgagtcaagttagggtga

SEQ ID NO: 9482393 - DNA, 22 bp, Homo sapiens
aggctgagtcaagttagggtga

SEQ ID NO: 9482394 - DNA, 22 bp, Homo sapiens
aggctgagtcaagttagggtga

SEQ ID NO: 9482395 - DNA, 22 bp, Homo sapiens
aggctgaggtgtgctgtgatcg

SEQ ID NO: 9482396 - DNA, 22 bp, Homo sapiens
aggctgaggtgtgctgtgatcg

SEQ ID NO: 9482397 - DNA, 22 bp, Homo sapiens
aggctgagtcgggaggatcact

SEQ ID NO: 9482398 - DNA, 22 bp, Homo sapiens
aggctgagtcgggaggatcact

SEQ ID NO: 9482399 - DNA, 22 bp, Homo sapiens
aggctgagtcgggaggatcact

SEQ ID NO: 9482400 - DNA, 22 bp, Homo sapiens
aggctgaggtgtgctgtgatcg

SEQ ID NO: 9482401 - DNA, 22 bp, Homo sapiens
aggctgaggtgtgctgtgatcg

SEQ ID NO: 9482402 - DNA, 22 bp, Homo sapiens
aggctgaggtaggaggatcgct

SEQ ID NO: 9482403 - DNA, 22 bp, Homo sapiens
aggctgaggtgtgctgtgatcg

SEQ ID NO: 9482404 - DNA, 22 bp, Homo sapiens
aggctgaggtgtgctgtgatcg

SEQ ID NO: 9482405 - DNA, 22 bp, Homo sapiens
aggctgaggtgtgctgtgatcg

SEQ ID NO: 9482406 - DNA, 22 bp, Homo sapiens
aggctgaggtaggaggatcgct

SEQ ID NO: 9482407 - DNA, 22 bp, Homo sapiens
aggctgaggtaggaggatcgct

SEQ ID NO: 9482408 - DNA, 22 bp, Homo sapiens
aggctgaggtaggaggatcgct

SEQ ID NO: 9482409 - DNA, 22 bp, Homo sapiens
aggctgaggtaggaggatcgct

SEQ ID NO: 9482410 - DNA, 22 bp, Homo sapiens
ccatggctttctttcattgtaa

SEQ ID NO: 9482411 - DNA, 22 bp, Homo sapiens
ccatggcttttgagtctcaaga

SEQ ID NO: 9482412 - DNA, 22 bp, Homo sapiens
ccatggcttttgagtctcaaga

SEQ ID NO: 9482413 - DNA, 22 bp, Homo sapiens
ccatggcttacagatggagcat

SEQ ID NO: 9482414 - DNA, 22 bp, Homo sapiens
ccatggcttacagatggagcat

SEQ ID NO: 9482415 - DNA, 22 bp, Homo sapiens
ccatggctccttgccctgtagc

SEQ ID NO: 9482416 - DNA, 22 bp, Homo sapiens
ccatggctaagtatctgtagaa

SEQ ID NO: 9482417 - DNA, 22 bp, Homo sapiens
aggctgagtcgggaggatcact

SEQ ID NO: 9482418 - DNA, 22 bp, Homo sapiens
aggctgagtcgggaggatcact

SEQ ID NO: 9482419 - DNA, 22 bp, Homo sapiens
cgtggcctctatggctcccgcc

SEQ ID NO: 9482420 - DNA, 19 bp, Homo sapiens
cgtggagctggcaggcagg

SEQ ID NO: 9482421 - DNA, 22 bp, Homo sapiens
cgtgcttttcaaccattctcaa

SEQ ID NO: 9482422 - DNA, 22 bp, Homo sapiens
ctaaaattatcaagataattcc

SEQ ID NO: 9482423 - DNA, 22 bp, Homo sapiens
cgtggctggggaggtcagccag

SEQ ID NO: 9482424 - DNA, 22 bp, Homo sapiens
cgtggctcttttctgcatcagg

SEQ ID NO: 9482425 - DNA, 17 bp, Homo sapiens
cgtggctgagccataga

SEQ ID NO: 9482426 - DNA, 22 bp, Homo sapiens
ctaaaattatcaagataattcc

SEQ ID NO: 9482427 - DNA, 22 bp, Homo sapiens
ctaaacaagatactaatgaggt

SEQ ID NO: 9482428 - DNA, 22 bp, Homo sapiens
ctaaaattatcaagataattcc

SEQ ID NO: 9482429 - DNA, 22 bp, Homo sapiens
ctaaaattatcaagataattcc

SEQ ID NO: 9482430 - DNA, 22 bp, Homo sapiens
ctaaaattatcaagataattcc

SEQ ID NO: 9482431 - DNA, 22 bp, Homo sapiens
ctaaacatgaactacatttagg

SEQ ID NO: 9482432 - DNA, 22 bp, Homo sapiens
ctaaacatggcttagaacactc

SEQ ID NO: 9482433 - DNA, 22 bp, Homo sapiens
ctaaacatgcaagagcttctgg

SEQ ID NO: 9482434 - DNA, 22 bp, Homo sapiens
ctaaacatgtagcttttgtggt

SEQ ID NO: 9482435 - DNA, 22 bp, Homo sapiens
ctaaacatgttggtgctttaaa

SEQ ID NO: 9482436 - DNA, 22 bp, Homo sapiens
ctaaactagcagttctgcaaca

SEQ ID NO: 9482437 - DNA, 22 bp, Homo sapiens
ctaaacaagggattataattga

SEQ ID NO: 9482438 - DNA, 22 bp, Homo sapiens
ctaaacatcttgcaatgcacag

SEQ ID NO: 9482439 - DNA, 22 bp, Homo sapiens
ctaaacatcttgcaatgcacag

SEQ ID NO: 9482440 - DNA, 22 bp, Homo sapiens
ctaaacactatgtaagcaagaa

SEQ ID NO: 9482441 - DNA, 22 bp, Homo sapiens
ctaaacaggaaggagcacctga

SEQ ID NO: 9482442 - DNA, 22 bp, Homo sapiens
cgcctggctgcagccggcgagg

SEQ ID NO: 9482443 - DNA, 19 bp, Homo sapiens
cgcctggcaggccctgcgc

SEQ ID NO: 9482444 - DNA, 22 bp, Homo sapiens
cgcgctcatttccgcctccttc

SEQ ID NO: 9482445 - DNA, 22 bp, Homo sapiens
cgcggagctccgcccggtgccc

SEQ ID NO: 9482446 - DNA, 22 bp, Homo sapiens
cgcgggcctccagacccagtat

SEQ ID NO: 9482447 - DNA, 22 bp, Homo sapiens
cgcgggcccctgcgctccgggc

SEQ ID NO: 9482448 - DNA, 22 bp, Homo sapiens
cgcggtggcggcctccagcgcc

SEQ ID NO: 9482449 - DNA, 22 bp, Homo sapiens
cgcggtggcggcctccagcgcc

SEQ ID NO: 9482450 - DNA, 22 bp, Homo sapiens
cgcggggcttcagccgcccagt

SEQ ID NO: 9482451 - DNA, 22 bp, Homo sapiens
cgtgcatgatatatgagttgtt

SEQ ID NO: 9482452 - DNA, 22 bp, Homo sapiens
cgtgatgctcaggaggtcatag

SEQ ID NO: 9482453 - DNA, 22 bp, Homo sapiens
cgtgatgaatggtgagacccgc

SEQ ID NO: 9482454 - DNA, 22 bp, Homo sapiens
cgtgcgcctcagcctcgtgcgc

SEQ ID NO: 9482455 - DNA, 22 bp, Homo sapiens
cgtgcgcctcagcctcgtgcgc

SEQ ID NO: 9482456 - DNA, 22 bp, Homo sapiens
cgtgaggggggtaaggcgtccg

SEQ ID NO: 9482457 - DNA, 22 bp, Homo sapiens
cgtgagggcatggcagtgagga

SEQ ID NO: 9482458 - DNA, 22 bp, Homo sapiens
cgtgagggcatggcagtgagga

SEQ ID NO: 9482459 - DNA, 22 bp, Homo sapiens
cgtgagcaaaatggacactccc

SEQ ID NO: 9482460 - DNA, 22 bp, Homo sapiens
cggtcaggtgcagcgttggcac

SEQ ID NO: 9482461 - DNA, 22 bp, Homo sapiens
cggtcaggtgcagcgttggcac

SEQ ID NO: 9482462 - DNA, 18 bp, Homo sapiens
agtcagttgatggggacc

SEQ ID NO: 9482463 - DNA, 19 bp, Homo sapiens
agtcagttctgaggaggaa

SEQ ID NO: 9482464 - DNA, 19 bp, Homo sapiens
agtcagttctgaggaggaa

SEQ ID NO: 9482465 - DNA, 22 bp, Homo sapiens
agtcagttgtggagatttaact

SEQ ID NO: 9482466 - DNA, 22 bp, Homo sapiens
agtcagttgcagtttatggatg

SEQ ID NO: 9482467 - DNA, 22 bp, Homo sapiens
agtcagttgcagtttatggatg

SEQ ID NO: 9482468 - DNA, 22 bp, Homo sapiens
agtcagttttcttaaagggaag

SEQ ID NO: 9482469 - DNA, 22 bp, Homo sapiens
agtcataattataaacatcagt

SEQ ID NO: 9482470 - DNA, 22 bp, Homo sapiens
agtcagtgtcaacaggaagtag

SEQ ID NO: 9482471 - DNA, 22 bp, Homo sapiens
agtcagggcctggcctgctgaa

SEQ ID NO: 9482472 - DNA, 22 bp, Homo sapiens
agtcagtgtagaaagcccaggc

SEQ ID NO: 9482473 - DNA, 22 bp, Homo sapiens
agtcagtgtgattctcaggagg

SEQ ID NO: 9482474 - DNA, 22 bp, Homo sapiens
agtcagttaaactttgtaaagt

SEQ ID NO: 9482475 - DNA, 22 bp, Homo sapiens
agtcaggatttaaactcagaca

SEQ ID NO: 9482476 - DNA, 21 bp, Homo sapiens
ctacagaatcgagcattctgg

SEQ ID NO: 9482477 - DNA, 22 bp, Homo sapiens
agtcaggattttggattattcg

SEQ ID NO: 9482478 - DNA, 22 bp, Homo sapiens
agtcaggatttaaactcagaca

SEQ ID NO: 9482479 - DNA, 22 bp, Homo sapiens
agtcagtgtagaaagcccaggc

SEQ ID NO: 9482480 - DNA, 22 bp, Homo sapiens
agtcaggggatctagacttgaa

SEQ ID NO: 9482481 - DNA, 22 bp, Homo sapiens
agtcagggcctggcctgctgaa

SEQ ID NO: 9482482 - DNA, 22 bp, Homo sapiens
ctacacttgttcgactgcagga

SEQ ID NO: 9482483 - DNA, 21 bp, Homo sapiens
ctacacagctttctataggaa

SEQ ID NO: 9482484 - DNA, 20 bp, Homo sapiens
ctacacagggttcgctgggc

SEQ ID NO: 9482485 - DNA, 22 bp, Homo sapiens
ctacagaaacctttttcataca

SEQ ID NO: 9482486 - DNA, 22 bp, Homo sapiens
ctacagaagaaactatcactat

SEQ ID NO: 9482487 - DNA, 22 bp, Homo sapiens
ctacagaagaaactatcactat

SEQ ID NO: 9482488 - DNA, 21 bp, Homo sapiens
ctacagaatcgagcattctgg

SEQ ID NO: 9482489 - DNA, 22 bp, Homo sapiens
ctacagaagaaactatcactat

SEQ ID NO: 9482490 - DNA, 22 bp, Homo sapiens
agtcagagaccctagatctaat

SEQ ID NO: 9482491 - DNA, 22 bp, Homo sapiens
agtcagagaccctagatctaat

SEQ ID NO: 9482492 - DNA, 22 bp, Homo sapiens
agtcagagagctctcagcatag

SEQ ID NO: 9482493 - DNA, 22 bp, Homo sapiens
agtcagagcaaactggacagac

SEQ ID NO: 9482494 - DNA, 22 bp, Homo sapiens
agtcagaattcgatcccaggtc

SEQ ID NO: 9482495 - DNA, 22 bp, Homo sapiens
agtcagacataattctaacatt

SEQ ID NO: 9482496 - DNA, 22 bp, Homo sapiens
agtcactttgctactctgcctt

SEQ ID NO: 9482497 - DNA, 22 bp, Homo sapiens
agtcaccaacatggttcccagg

SEQ ID NO: 9482498 - DNA, 22 bp, Homo sapiens
agtcactttatgagagaaccat

SEQ ID NO: 9482499 - DNA, 22 bp, Homo sapiens
agtcactttatgagagaaccat

SEQ ID NO: 9482500 - DNA, 22 bp, Homo sapiens
agtcactttctacttggtttct

SEQ ID NO: 9482501 - DNA, 22 bp, Homo sapiens
ctacaagatttttaaaactgta

SEQ ID NO: 9482502 - DNA, 23 bp, Homo sapiens
ctacaagagcaagcatggacaag

SEQ ID NO: 9482503 - DNA, 22 bp, Homo sapiens
agtcagaggaatgggccaggct

SEQ ID NO: 9482504 - DNA, 22 bp, Homo sapiens
agtcagaggaatgggccaggct

SEQ ID NO: 9482505 - DNA, 22 bp, Homo sapiens
agtcagagtcgccgacagtcaa

SEQ ID NO: 9482506 - DNA, 22 bp, Homo sapiens
agtcagaggaatgggccaggct

SEQ ID NO: 9482507 - DNA, 22 bp, Homo sapiens
agtcagagtgtgcaggccggct

SEQ ID NO: 9482508 - DNA, 22 bp, Homo sapiens
cctttaggagtgaggaccgagc

SEQ ID NO: 9482509 - DNA, 19 bp, Homo sapiens
cctttagttgctcagagaa

SEQ ID NO: 9482510 - DNA, 22 bp, Homo sapiens
cctttatactaaggcatacaat

SEQ ID NO: 9482511 - DNA, 20 bp, Homo sapiens
cctttattatttgtatgatg

SEQ ID NO: 9482512 - DNA, 22 bp, Homo sapiens
aggtttctatgctgtttatctt

SEQ ID NO: 9482513 - DNA, 22 bp, Homo sapiens
aggtttctcctttaaagcatgg

SEQ ID NO: 9482514 - DNA, 22 bp, Homo sapiens
aggtttctcctttaaagcatgg

SEQ ID NO: 9482515 - DNA, 19 bp, Homo sapiens
aggtttctaactattcaag

SEQ ID NO: 9482516 - DNA, 19 bp, Homo sapiens
aggtttctaactattcaag

SEQ ID NO: 9482517 - DNA, 22 bp, Homo sapiens
aggtttccagcatggggaaggc

SEQ ID NO: 9482518 - DNA, 22 bp, Homo sapiens
aggtttctcctttaaagcatgg

SEQ ID NO: 9482519 - DNA, 21 bp, Homo sapiens
aggtttctcttttatggaggg

SEQ ID NO: 9482520 - DNA, 21 bp, Homo sapiens
aggtttctcttttatggaggg

SEQ ID NO: 9482521 - DNA, 17 bp, Homo sapiens
aggtttatggtatttga

SEQ ID NO: 9482522 - DNA, 21 bp, Homo sapiens
agtacaaaaattcctttctca

SEQ ID NO: 9482523 - DNA, 21 bp, Homo sapiens
agtacaaaaattcctttctca

SEQ ID NO: 9482524 - DNA, 22 bp, Homo sapiens
agtaatttgttataaagcaata

SEQ ID NO: 9482525 - DNA, 22 bp, Homo sapiens
agtaataatttatattagggag

SEQ ID NO: 9482526 - DNA, 22 bp, Homo sapiens
agtaacagcatctccactggaa

SEQ ID NO: 9482527 - DNA, 22 bp, Homo sapiens
agtaataatttatattagggag

SEQ ID NO: 9482528 - DNA, 22 bp, Homo sapiens
agtacaaaggcccttgattact

SEQ ID NO: 9482529 - DNA, 22 bp, Homo sapiens
agtacaaaggcccttgattact

SEQ ID NO: 9482530 - DNA, 22 bp, Homo sapiens
agtacaaaggcccttgattact

SEQ ID NO: 9482531 - DNA, 22 bp, Homo sapiens
agtacaaaggcccttgattact

SEQ ID NO: 9482532 - DNA, 22 bp, Homo sapiens
agtacaaactgtttcaaagtag

SEQ ID NO: 9482533 - DNA, 22 bp, Homo sapiens
agtacaaaatgcagcatcatca

SEQ ID NO: 9482534 - DNA, 22 bp, Homo sapiens
agtacaaagtgctcctggttct

SEQ ID NO: 9482535 - DNA, 22 bp, Homo sapiens
agtacaaatgcagccagagtag

SEQ ID NO: 9482536 - DNA, 22 bp, Homo sapiens
aggttagtgctgaaatgacatg

SEQ ID NO: 9482537 - DNA, 22 bp, Homo sapiens
aggttatatgtcatactgaagt

SEQ ID NO: 9482538 - DNA, 22 bp, Homo sapiens
aggttattaaagtgtatttttg

SEQ ID NO: 9482539 - DNA, 22 bp, Homo sapiens
aggtgtgtataaacatacatat

SEQ ID NO: 9482540 - DNA, 19 bp, Homo sapiens
aggttacaggtgtcacaga

SEQ ID NO: 9482541 - DNA, 23 bp, Homo sapiens
aggttacagttgttaagttgcaa

SEQ ID NO: 9482542 - DNA, 22 bp, Homo sapiens
aggttacagtcatctcagaatc

SEQ ID NO: 9482543 - DNA, 22 bp, Homo sapiens
aggttggctgctcttttcctaa

SEQ ID NO: 9482544 - DNA, 22 bp, Homo sapiens
aggttccaagaaatcatcagtg

SEQ ID NO: 9482545 - DNA, 22 bp, Homo sapiens
aggttggcctcagggaggctct

SEQ ID NO: 9482546 - DNA, 22 bp, Homo sapiens
aggttggccaagctgctggccc

SEQ ID NO: 9482547 - DNA, 22 bp, Homo sapiens
aggttgggatgagtgggtgagc

SEQ ID NO: 9482548 - DNA, 22 bp, Homo sapiens
aggttcacacacacaaaaagat

SEQ ID NO: 9482549 - DNA, 19 bp, Homo sapiens
aggtgtgggggctgcagac

SEQ ID NO: 9482550 - DNA, 19 bp, Homo sapiens
aggtgtgggggctgcagac

SEQ ID NO: 9482551 - DNA, 22 bp, Homo sapiens
aggtgtgggaaacgggtgacct

SEQ ID NO: 9482552 - DNA, 22 bp, Homo sapiens
aggtgtgggaaacgggtgacct

SEQ ID NO: 9482553 - DNA, 19 bp, Homo sapiens
aggtgtgggggctgcagac

SEQ ID NO: 9482554 - DNA, 17 bp, Homo sapiens
aggtgtggtcaagggag

SEQ ID NO: 9482555 - DNA, 22 bp, Homo sapiens
aggtgtggctggggcagaggcc

SEQ ID NO: 9482556 - DNA, 22 bp, Homo sapiens
aggtgtggcttgaagtctctat

SEQ ID NO: 9482557 - DNA, 22 bp, Homo sapiens
aggtgtggctggggcagaggcc

SEQ ID NO: 9482558 - DNA, 22 bp, Homo sapiens
aggtgtggctggggcagaggcc

SEQ ID NO: 9482559 - DNA, 22 bp, Homo sapiens
aggtgtggctggggcagaggcc

SEQ ID NO: 9482560 - DNA, 22 bp, Homo sapiens
aggtggggttcagtctcagccg

SEQ ID NO: 9482561 - DNA, 22 bp, Homo sapiens
aggtggggttcagtctcagccg

SEQ ID NO: 9482562 - DNA, 22 bp, Homo sapiens
aggtgtctgggctttggagtca

SEQ ID NO: 9482563 - DNA, 22 bp, Homo sapiens
aggtgtctggatgggtgtcctt

SEQ ID NO: 9482564 - DNA, 22 bp, Homo sapiens
aggtgtctgtgatgggagcgat

SEQ ID NO: 9482565 - DNA, 22 bp, Homo sapiens
aggtgtcttcagggtgagacag

SEQ ID NO: 9482566 - DNA, 22 bp, Homo sapiens
aggtgtctttgcggcccgccgc

SEQ ID NO: 9482567 - DNA, 22 bp, Homo sapiens
cctggtgccactagagaatgtc

SEQ ID NO: 9482568 - DNA, 22 bp, Homo sapiens
cctggtgagctgggtgcacggc

SEQ ID NO: 9482569 - DNA, 22 bp, Homo sapiens
cctggtgcaccaagtaagggtg

SEQ ID NO: 9482570 - DNA, 22 bp, Homo sapiens
cctggtgaatgttcatggactg

SEQ ID NO: 9482571 - DNA, 22 bp, Homo sapiens
cctggtccccatcggcccagcg

SEQ ID NO: 9482572 - DNA, 22 bp, Homo sapiens
cctggtccccatcggcccagcg

SEQ ID NO: 9482573 - DNA, 18 bp, Homo sapiens
aggtctgaggaagagcct

SEQ ID NO: 9482574 - DNA, 18 bp, Homo sapiens
aggtctgaggaagagcct

SEQ ID NO: 9482575 - DNA, 22 bp, Homo sapiens
aggtctgagtagagaaaaggca

SEQ ID NO: 9482576 - DNA, 22 bp, Homo sapiens
aggtctgagtatggcctgagaa

SEQ ID NO: 9482577 - DNA, 22 bp, Homo sapiens
aggtctgagtatggcctgagaa

SEQ ID NO: 9482578 - DNA, 22 bp, Homo sapiens
aggtctgagtatggcctgagaa

SEQ ID NO: 9482579 - DNA, 22 bp, Homo sapiens
aggtctgagctcagggcctggc

SEQ ID NO: 9482580 - DNA, 22 bp, Homo sapiens
aggtctgagctccttcctctga

SEQ ID NO: 9482581 - DNA, 22 bp, Homo sapiens
aggtctgagcaggggagaacag

SEQ ID NO: 9482582 - DNA, 22 bp, Homo sapiens
aggtctgagctcagggcctggc

SEQ ID NO: 9482583 - DNA, 20 bp, Homo sapiens
aggtctgattccagaatcag

SEQ ID NO: 9482584 - DNA, 22 bp, Homo sapiens
aggtctggaaacagcagggaga

SEQ ID NO: 9482585 - DNA, 22 bp, Homo sapiens
aggtctgcctcactcacttctg

SEQ ID NO: 9482586 - DNA, 23 bp, Homo sapiens
aggtctggacccttggcccctgc

SEQ ID NO: 9482587 - DNA, 22 bp, Homo sapiens
aggtctggaaacagcagggaga

SEQ ID NO: 9482588 - DNA, 22 bp, Homo sapiens
aggtctcttgctgtctctgggc

SEQ ID NO: 9482589 - DNA, 22 bp, Homo sapiens
aggtcctgtccttggtctctga

SEQ ID NO: 9482590 - DNA, 22 bp, Homo sapiens
aggtcctgtccttggtctctga

SEQ ID NO: 9482591 - DNA, 17 bp, Homo sapiens
aggtctgagagtatctg

SEQ ID NO: 9482592 - DNA, 22 bp, Homo sapiens
aggtctgacttcaagcctgtgg

SEQ ID NO: 9482593 - DNA, 20 bp, Homo sapiens
aggtctgaatgtcagggctg

SEQ ID NO: 9482594 - DNA, 22 bp, Homo sapiens
aggtctgactctttgccacata

SEQ ID NO: 9482595 - DNA, 22 bp, Homo sapiens
aggtatgtgggtgagaggagga

SEQ ID NO: 9482596 - DNA, 22 bp, Homo sapiens
aggtatggcataaatcacaggg

SEQ ID NO: 9482597 - DNA, 22 bp, Homo sapiens
aggtatgagagccactctgtag

SEQ ID NO: 9482598 - DNA, 22 bp, Homo sapiens
aggtctggtatttttctatact

SEQ ID NO: 9482599 - DNA, 22 bp, Homo sapiens
aggtctgggcaccactggctgc

SEQ ID NO: 9482600 - DNA, 22 bp, Homo sapiens
aggtctgggcaccactggctgc

SEQ ID NO: 9482601 - DNA, 22 bp, Homo sapiens
aggtctgggattgaagacatca

SEQ ID NO: 9482602 - DNA, 22 bp, Homo sapiens
aggtctgggattgaagacatca

SEQ ID NO: 9482603 - DNA, 22 bp, Homo sapiens
aggtctggtgggctttagattg

SEQ ID NO: 9482604 - DNA, 22 bp, Homo sapiens
aggtctggtgagagcaggtgct

SEQ ID NO: 9482605 - DNA, 22 bp, Homo sapiens
aggtctggtgagagcaggtgct

SEQ ID NO: 9482606 - DNA, 22 bp, Homo sapiens
aggtctggtgagagcaggtgct

SEQ ID NO: 9482607 - DNA, 22 bp, Homo sapiens
aggtctggagtgggatctgaga

SEQ ID NO: 9482608 - DNA, 22 bp, Homo sapiens
aggtctggagtgggatctgaga

SEQ ID NO: 9482609 - DNA, 22 bp, Homo sapiens
aggtctggaggcggagtcagga

SEQ ID NO: 9482610 - DNA, 22 bp, Homo sapiens
aggtctggagtgggatctgaga

SEQ ID NO: 9482611 - DNA, 22 bp, Homo sapiens
aggtctggctcttctccacaga

SEQ ID NO: 9482612 - DNA, 22 bp, Homo sapiens
aggtctgggagttcattccctg

SEQ ID NO: 9482613 - DNA, 23 bp, Homo sapiens
aggtctggacccttggcccctgc

SEQ ID NO: 9482614 - DNA, 22 bp, Homo sapiens
aggtctggaggcggagtcagga

SEQ ID NO: 9482615 - DNA, 22 bp, Homo sapiens
aggtctggaggcggagtcagga

SEQ ID NO: 9482616 - DNA, 22 bp, Homo sapiens
aggtctggaggcggagtcagga

SEQ ID NO: 9482617 - DNA, 22 bp, Homo sapiens
aggtctggaggcggagtcagga

SEQ ID NO: 9482618 - DNA, 22 bp, Homo sapiens
aggtctggaggcggagtcagga

SEQ ID NO: 9482619 - DNA, 19 bp, Homo sapiens
aggtgaggggcaccatgtc

SEQ ID NO: 9482620 - DNA, 19 bp, Homo sapiens
aggtgaggggcaccatgtc

SEQ ID NO: 9482621 - DNA, 22 bp, Homo sapiens
aggtgagggtgccagtgcatgg

SEQ ID NO: 9482622 - DNA, 22 bp, Homo sapiens
aggtgagggtgccagtgcatgg

SEQ ID NO: 9482623 - DNA, 22 bp, Homo sapiens
aggtgagggtgccagtgcatgg

SEQ ID NO: 9482624 - DNA, 22 bp, Homo sapiens
aggtgagggtgccagtgcatgg

SEQ ID NO: 9482625 - DNA, 22 bp, Homo sapiens
aggtgaggtttgggaggtgtca

SEQ ID NO: 9482626 - DNA, 22 bp, Homo sapiens
aggtgaggtttgggaggtgtca

SEQ ID NO: 9482627 - DNA, 22 bp, Homo sapiens
aggtgagggtgccagtgcatgg

SEQ ID NO: 9482628 - DNA, 18 bp, Homo sapiens
aggtctgtggtcaccagg

SEQ ID NO: 9482629 - DNA, 18 bp, Homo sapiens
aggtctgtggtcaccagg

SEQ ID NO: 9482630 - DNA, 22 bp, Homo sapiens
aggtctgtctggccccatgaat

SEQ ID NO: 9482631 - DNA, 22 bp, Homo sapiens
aggtctgtgaattcctgagaaa

SEQ ID NO: 9482632 - DNA, 22 bp, Homo sapiens
aggtctggtgttgggcctgaaa

SEQ ID NO: 9482633 - DNA, 22 bp, Homo sapiens
aggtctggtgttgatgaattcc

SEQ ID NO: 9482634 - DNA, 22 bp, Homo sapiens
aggtctggtgttgggcctgaaa

SEQ ID NO: 9482635 - DNA, 22 bp, Homo sapiens
aggtctggtgttgggcctgaaa

SEQ ID NO: 9482636 - DNA, 22 bp, Homo sapiens
aggtctgtcaaactgtcagtga

SEQ ID NO: 9482637 - DNA, 22 bp, Homo sapiens
aggtctgtctggccccatgaat

SEQ ID NO: 9482638 - DNA, 22 bp, Homo sapiens
cctgggcagcctgctcaaggac

SEQ ID NO: 9482639 - DNA, 21 bp, Homo sapiens
aggtgcagagccagggaccag

SEQ ID NO: 9482640 - DNA, 22 bp, Homo sapiens
aggtgcagaaaaaagtccttta

SEQ ID NO: 9482641 - DNA, 21 bp, Homo sapiens
aggtgcagagccagggaccag

SEQ ID NO: 9482642 - DNA, 22 bp, Homo sapiens
aggtgattcaactgtgcagtga

SEQ ID NO: 9482643 - DNA, 22 bp, Homo sapiens
aggtgattctaatgtgcagtca

SEQ ID NO: 9482644 - DNA, 22 bp, Homo sapiens
aggtgattagcttgaaatcctt

SEQ ID NO: 9482645 - DNA, 22 bp, Homo sapiens
aggtgagttacaggaggaggtc

SEQ ID NO: 9482646 - DNA, 19 bp, Homo sapiens
aggtgagtgtgggaaaggg

SEQ ID NO: 9482647 - DNA, 22 bp, Homo sapiens
aggtgagtcctgggcacaggta

SEQ ID NO: 9482648 - DNA, 22 bp, Homo sapiens
aggtgaggtttgggaggtgtca

SEQ ID NO: 9482649 - DNA, 22 bp, Homo sapiens
cctgggcaggatgggcccggtg

SEQ ID NO: 9482650 - DNA, 22 bp, Homo sapiens
cctgggcaggatgggcccggtg

SEQ ID NO: 9482651 - DNA, 22 bp, Homo sapiens
cctgggcagggagaccaggctc

SEQ ID NO: 9482652 - DNA, 22 bp, Homo sapiens
cctgggcaggtgtggcttcccc

SEQ ID NO: 9482653 - DNA, 22 bp, Homo sapiens
cctgggcagtgctggagttgaa

SEQ ID NO: 9482654 - DNA, 22 bp, Homo sapiens
aggtgctgtttgtcagcagttt

SEQ ID NO: 9482655 - DNA, 22 bp, Homo sapiens
cctgggcaggtgtggcttcccc

SEQ ID NO: 9482656 - DNA, 22 bp, Homo sapiens
cctgggcagggctggactctca

SEQ ID NO: 9482657 - DNA, 22 bp, Homo sapiens
cctgggcagggctggactctca

SEQ ID NO: 9482658 - DNA, 23 bp, Homo sapiens
aggtggagctgtgcagccggggc

SEQ ID NO: 9482659 - DNA, 22 bp, Homo sapiens
aggtgcttgagggaagaaatta

SEQ ID NO: 9482660 - DNA, 22 bp, Homo sapiens
aggtggagtgaaggaaaggcag

SEQ ID NO: 9482661 - DNA, 22 bp, Homo sapiens
aggtggagtgaaggaaaggcag

SEQ ID NO: 9482662 - DNA, 22 bp, Homo sapiens
aggtggagtgaaggaaaggcag

SEQ ID NO: 9482663 - DNA, 21 bp, Homo sapiens
aggtggagtgcttagcatcca

SEQ ID NO: 9482664 - DNA, 22 bp, Homo sapiens
aggtggagtgtgcagggagagc

SEQ ID NO: 9482665 - DNA, 22 bp, Homo sapiens
aggtggagtgtgcagggagagc

SEQ ID NO: 9482666 - DNA, 22 bp, Homo sapiens
aggtggagtgtgcagggagagc

SEQ ID NO: 9482667 - DNA, 22 bp, Homo sapiens
aggtggagttggctgtagttca

SEQ ID NO: 9482668 - DNA, 22 bp, Homo sapiens
aggtggagttaagtgtgaactg

SEQ ID NO: 9482669 - DNA, 22 bp, Homo sapiens
aggtggagttaagtgtgaactg

SEQ ID NO: 9482670 - DNA, 22 bp, Homo sapiens
aggtggatctcagctcatctaa

SEQ ID NO: 9482671 - DNA, 22 bp, Homo sapiens
cctgggtgtcatgggcagctgg

SEQ ID NO: 9482672 - DNA, 22 bp, Homo sapiens
cctgggtgtcatgggcagctgg

SEQ ID NO: 9482673 - DNA, 22 bp, Homo sapiens
cctggtcacccctctctctgca

SEQ ID NO: 9482674 - DNA, 22 bp, Homo sapiens
cctggtcacccctctctctgca

SEQ ID NO: 9482675 - DNA, 22 bp, Homo sapiens
cctgggttggagagcaatggtg

SEQ ID NO: 9482676 - DNA, 22 bp, Homo sapiens
cctggtcaggtaactgggctga

SEQ ID NO: 9482677 - DNA, 22 bp, Homo sapiens
cctggtcaggtaactgggctga

SEQ ID NO: 9482678 - DNA, 22 bp, Homo sapiens
cctggtcagagcagtcaggatc

SEQ ID NO: 9482679 - DNA, 22 bp, Homo sapiens
cctggtcccattgcggctgcct

SEQ ID NO: 9482680 - DNA, 22 bp, Homo sapiens
cctggtcccattgcggctgcct

SEQ ID NO: 9482681 - DNA, 22 bp, Homo sapiens
cctgcctgctttctgctttgca

SEQ ID NO: 9482682 - DNA, 22 bp, Homo sapiens
cctgcctggagctgagtgtgga

SEQ ID NO: 9482683 - DNA, 22 bp, Homo sapiens
cctgcctgctttctgctttgca

SEQ ID NO: 9482684 - DNA, 22 bp, Homo sapiens
cctgcctgctttctgctttgca

SEQ ID NO: 9482685 - DNA, 22 bp, Homo sapiens
cctgcctgcgtcctctgagggc

SEQ ID NO: 9482686 - DNA, 22 bp, Homo sapiens
cctgcctggatcagccatcctg

SEQ ID NO: 9482687 - DNA, 22 bp, Homo sapiens
cctgcctggagctgagtgtgga

SEQ ID NO: 9482688 - DNA, 22 bp, Homo sapiens
cctgcctggatcagccatcctg

SEQ ID NO: 9482689 - DNA, 22 bp, Homo sapiens
cctgcctggcacatagtactct

SEQ ID NO: 9482690 - DNA, 20 bp, Homo sapiens
cctgcctggccattccttgg

SEQ ID NO: 9482691 - DNA, 22 bp, Homo sapiens
cctgcctggcccaccttgccac

SEQ ID NO: 9482692 - DNA, 22 bp, Homo sapiens
cctgcctggcccaccttgccac

SEQ ID NO: 9482693 - DNA, 22 bp, Homo sapiens
cctgcctggatcagccatcctg

SEQ ID NO: 9482694 - DNA, 22 bp, Homo sapiens
cctgcctggcacatagtactct

SEQ ID NO: 9482695 - DNA, 22 bp, Homo sapiens
cctgcctggctgtcagcagagc

SEQ ID NO: 9482696 - DNA, 22 bp, Homo sapiens
cctgcctggctgtcagcagagc

SEQ ID NO: 9482697 - DNA, 22 bp, Homo sapiens
cctgcctggcccaccttgccac

SEQ ID NO: 9482698 - DNA, 22 bp, Homo sapiens
cctggagcccaaggcagtgaga

SEQ ID NO: 9482699 - DNA, 22 bp, Homo sapiens
cctggagcatcaggaggaaggg

SEQ ID NO: 9482700 - DNA, 22 bp, Homo sapiens
cctggagcccaaggcagtgaga

SEQ ID NO: 9482701 - DNA, 22 bp, Homo sapiens
cctggagcatcaggaggaaggg

SEQ ID NO: 9482702 - DNA, 22 bp, Homo sapiens
cctggagcatcaggaggaaggg

SEQ ID NO: 9482703 - DNA, 22 bp, Homo sapiens
cctggagcatcaggaggaaggg

SEQ ID NO: 9482704 - DNA, 22 bp, Homo sapiens
cctggagcaggagctgcagagg

SEQ ID NO: 9482705 - DNA, 22 bp, Homo sapiens
cctggagcaggagctgcagagg

SEQ ID NO: 9482706 - DNA, 22 bp, Homo sapiens
cctggagcaggagctgcagagg

SEQ ID NO: 9482707 - DNA, 18 bp, Homo sapiens
cctggacctgtctccttt

SEQ ID NO: 9482708 - DNA, 21 bp, Homo sapiens
cctggactaaaaccaggccac

SEQ ID NO: 9482709 - DNA, 22 bp, Homo sapiens
cctgcctggctgtcagcagagc

SEQ ID NO: 9482710 - DNA, 22 bp, Homo sapiens
agggtggcacctggaagggatg

SEQ ID NO: 9482711 - DNA, 22 bp, Homo sapiens
agggtggcacctggaagggatg

SEQ ID NO: 9482712 - DNA, 22 bp, Homo sapiens
agggtggcactggtggctctat

SEQ ID NO: 9482713 - DNA, 22 bp, Homo sapiens
agggtggcacctggaagggatg

SEQ ID NO: 9482714 - DNA, 20 bp, Homo sapiens
agggtggcaagttagtgaca

SEQ ID NO: 9482715 - DNA, 19 bp, Homo sapiens
agggtggcaaaggagggtg

SEQ ID NO: 9482716 - DNA, 19 bp, Homo sapiens
agggtggcaaaggagggtg

SEQ ID NO: 9482717 - DNA, 19 bp, Homo sapiens
agggtggcaaaggagggtg

SEQ ID NO: 9482718 - DNA, 19 bp, Homo sapiens
agggtggcaaaggagggtg

SEQ ID NO: 9482719 - DNA, 22 bp, Homo sapiens
agggtggcactggtggctctat

SEQ ID NO: 9482720 - DNA, 22 bp, Homo sapiens
agggtggcagttactggagcaa

SEQ ID NO: 9482721 - DNA, 22 bp, Homo sapiens
cctgcctgcggcccgcggggag

SEQ ID NO: 9482722 - DNA, 22 bp, Homo sapiens
cctgcctgcgtcctctgagggc

SEQ ID NO: 9482723 - DNA, 22 bp, Homo sapiens
cctgcctgcgtcctctgagggc

SEQ ID NO: 9482724 - DNA, 22 bp, Homo sapiens
cctgcctgcgtcctctgagggc

SEQ ID NO: 9482725 - DNA, 22 bp, Homo sapiens
agggtgctctggaaaatgtagt

SEQ ID NO: 9482726 - DNA, 22 bp, Homo sapiens
agggtgctgccggacaggtggg

SEQ ID NO: 9482727 - DNA, 22 bp, Homo sapiens
agggtgctgccggacaggtggg

SEQ ID NO: 9482728 - DNA, 22 bp, Homo sapiens
agggtgctaatctcattcacat

SEQ ID NO: 9482729 - DNA, 22 bp, Homo sapiens
agggtgcgttctatgagaatct

SEQ ID NO: 9482730 - DNA, 23 bp, Homo sapiens
agggtgagcaagctatggagacc

SEQ ID NO: 9482731 - DNA, 22 bp, Homo sapiens
agggtggagggagtccctgagc

SEQ ID NO: 9482732 - DNA, 19 bp, Homo sapiens
agggtggcaaaggagggtg

SEQ ID NO: 9482733 - DNA, 22 bp, Homo sapiens
aggggcttcccttcctgggtag

SEQ ID NO: 9482734 - DNA, 22 bp, Homo sapiens
aggggctgtggaaaccaactct

SEQ ID NO: 9482735 - DNA, 22 bp, Homo sapiens
aggggctgtggaaaccaactct

SEQ ID NO: 9482736 - DNA, 22 bp, Homo sapiens
agggtggccatgagggagagat

SEQ ID NO: 9482737 - DNA, 22 bp, Homo sapiens
agggtggccatgagggagagat

SEQ ID NO: 9482738 - DNA, 22 bp, Homo sapiens
agggtggccatgagggagagat

SEQ ID NO: 9482739 - DNA, 22 bp, Homo sapiens
agggtggccatgagggagagat

SEQ ID NO: 9482740 - DNA, 22 bp, Homo sapiens
agggtggccaccaagtatgtca

SEQ ID NO: 9482741 - DNA, 22 bp, Homo sapiens
agggtggccatgagggagagat

SEQ ID NO: 9482742 - DNA, 20 bp, Homo sapiens
cctggagcctggaaggagtc

SEQ ID NO: 9482743 - DNA, 22 bp, Homo sapiens
cctggagctcactgggagccgg

SEQ ID NO: 9482744 - DNA, 22 bp, Homo sapiens
agggtggccaccaagtatgtca

SEQ ID NO: 9482745 - DNA, 22 bp, Homo sapiens
agggtggcagttactggagcaa

SEQ ID NO: 9482746 - DNA, 22 bp, Homo sapiens
agggtggcagttactggagcaa

SEQ ID NO: 9482747 - DNA, 22 bp, Homo sapiens
cctggagcccctctggccagcc

SEQ ID NO: 9482748 - DNA, 22 bp, Homo sapiens
cctggagcgcgggtcaagctgg

SEQ ID NO: 9482749 - DNA, 20 bp, Homo sapiens
cctggagcctggaaggagtc

SEQ ID NO: 9482750 - DNA, 22 bp, Homo sapiens
agggtggctgtgaagtgcttgg

SEQ ID NO: 9482751 - DNA, 22 bp, Homo sapiens
agggtggctggaggaatcagaa

SEQ ID NO: 9482752 - DNA, 22 bp, Homo sapiens
agggtggctgagtagatggaag

SEQ ID NO: 9482753 - DNA, 22 bp, Homo sapiens
agggtggctggaggaatcagaa

SEQ ID NO: 9482754 - DNA, 22 bp, Homo sapiens
agggtggctggaggaatcagaa

SEQ ID NO: 9482755 - DNA, 22 bp, Homo sapiens
agggtggctgagtagatggaag

SEQ ID NO: 9482756 - DNA, 22 bp, Homo sapiens
agggtggctgagtagatggaag

SEQ ID NO: 9482757 - DNA, 22 bp, Homo sapiens
agggtggctgagtagatggaag

SEQ ID NO: 9482758 - DNA, 22 bp, Homo sapiens
agggtggctgagtagatggaag

SEQ ID NO: 9482759 - DNA, 22 bp, Homo sapiens
agggtggctgagtagatggaag

SEQ ID NO: 9482760 - DNA, 21 bp, Homo sapiens
agggtggctctgggtcagaac

SEQ ID NO: 9482761 - DNA, 21 bp, Homo sapiens
agggtggctctgggtcagaac

SEQ ID NO: 9482762 - DNA, 21 bp, Homo sapiens
agggtggctctgggtcagaac

SEQ ID NO: 9482763 - DNA, 22 bp, Homo sapiens
agggtggcttaattccaaaggg

SEQ ID NO: 9482764 - DNA, 22 bp, Homo sapiens
agggtggctgtgaagtgcttgg

SEQ ID NO: 9482765 - DNA, 22 bp, Homo sapiens
cctggccagcagccccttcctc

SEQ ID NO: 9482766 - DNA, 23 bp, Homo sapiens
agggtggcttgctttgcttcctt

SEQ ID NO: 9482767 - DNA, 22 bp, Homo sapiens
cctggccttaagggcagggagc

SEQ ID NO: 9482768 - DNA, 22 bp, Homo sapiens
cctggccttaagggcagggagc

SEQ ID NO: 9482769 - DNA, 22 bp, Homo sapiens
cctggccagcagccccttcctc

SEQ ID NO: 9482770 - DNA, 22 bp, Homo sapiens
cctggctcagtgttgaaggggt

SEQ ID NO: 9482771 - DNA, 22 bp, Homo sapiens
cctggctcattatgtgccccca

SEQ ID NO: 9482772 - DNA, 22 bp, Homo sapiens
cctggctcattatgtgccccca

SEQ ID NO: 9482773 - DNA, 22 bp, Homo sapiens
cctggctcattatgtgccccca

SEQ ID NO: 9482774 - DNA, 22 bp, Homo sapiens
cctggctcaggcacgcatggct

SEQ ID NO: 9482775 - DNA, 22 bp, Homo sapiens
cctggctcagtgttgaaggggt

SEQ ID NO: 9482776 - DNA, 22 bp, Homo sapiens
aggtagtgtagctgagtgggat

SEQ ID NO: 9482777 - DNA, 22 bp, Homo sapiens
cctggctccaaagctgtgactc

SEQ ID NO: 9482778 - DNA, 22 bp, Homo sapiens
cctggctcattatgtgccccca

SEQ ID NO: 9482779 - DNA, 22 bp, Homo sapiens
aggtataactttatgcatggaa

SEQ ID NO: 9482780 - DNA, 17 bp, Homo sapiens
aggtataaaatggtagc

SEQ ID NO: 9482781 - DNA, 22 bp, Homo sapiens
aggtataagtctcatttctgtt

SEQ ID NO: 9482782 - DNA, 22 bp, Homo sapiens
aggtataagtctcatttctgtt

SEQ ID NO: 9482783 - DNA, 22 bp, Homo sapiens
aggtataagtctcatttctgtt

SEQ ID NO: 9482784 - DNA, 22 bp, Homo sapiens
aggtatattttgtatatactct

SEQ ID NO: 9482785 - DNA, 22 bp, Homo sapiens
aggtatcaacagcagagtctga

SEQ ID NO: 9482786 - DNA, 22 bp, Homo sapiens
aggtatctggtaagaggcagac

SEQ ID NO: 9482787 - DNA, 22 bp, Homo sapiens
cctggctcaaggcgaggactcc

SEQ ID NO: 9482788 - DNA, 23 bp, Homo sapiens
cctggctcaccccttatgtccag

SEQ ID NO: 9482789 - DNA, 23 bp, Homo sapiens
cctggctcaccccttatgtccag

SEQ ID NO: 9482790 - DNA, 23 bp, Homo sapiens
cctggctcaccccttatgtccag

SEQ ID NO: 9482791 - DNA, 23 bp, Homo sapiens
cctggctcaccccttatgtccag

SEQ ID NO: 9482792 - DNA, 22 bp, Homo sapiens
cctggccttaagggcagggagc

SEQ ID NO: 9482793 - DNA, 22 bp, Homo sapiens
cctggcctttgaacgctagact

SEQ ID NO: 9482794 - DNA, 22 bp, Homo sapiens
cctggcctttgaacgctagact

SEQ ID NO: 9482795 - DNA, 22 bp, Homo sapiens
cctggcctttgaacgctagact

SEQ ID NO: 9482796 - DNA, 22 bp, Homo sapiens
cctggctcaaggcgaggactcc

SEQ ID NO: 9482797 - DNA, 22 bp, Homo sapiens
cctggctcaaggcgaggactcc

SEQ ID NO: 9482798 - DNA, 22 bp, Homo sapiens
cctggctcagaccccagttctg

SEQ ID NO: 9482799 - DNA, 22 bp, Homo sapiens
cctggctcagaccccagttctg

SEQ ID NO: 9482800 - DNA, 22 bp, Homo sapiens
cctggctcagagtatgtcatcg

SEQ ID NO: 9482801 - DNA, 22 bp, Homo sapiens
cctggctcagaccccagttctg

SEQ ID NO: 9482802 - DNA, 22 bp, Homo sapiens
cctggctcagcagctctttctc

SEQ ID NO: 9482803 - DNA, 22 bp, Homo sapiens
cctggctcagcagctctttctc

SEQ ID NO: 9482804 - DNA, 22 bp, Homo sapiens
cctggctcagagtatgtcatcg

SEQ ID NO: 9482805 - DNA, 22 bp, Homo sapiens
cctggctcaggcacgcatggct

SEQ ID NO: 9482806 - DNA, 22 bp, Homo sapiens
ctctctggtcccagattccaga

SEQ ID NO: 9482807 - DNA, 22 bp, Homo sapiens
ctctctgggtcctcttttatag

SEQ ID NO: 9482808 - DNA, 22 bp, Homo sapiens
ctctctggtcccagattccaga

SEQ ID NO: 9482809 - DNA, 22 bp, Homo sapiens
ctctctggtcccagattccaga

SEQ ID NO: 9482810 - DNA, 22 bp, Homo sapiens
agtggcagccgagcaggagatg

SEQ ID NO: 9482811 - DNA, 22 bp, Homo sapiens
agtggcagccgagcaggagatg

SEQ ID NO: 9482812 - DNA, 22 bp, Homo sapiens
agtggcagccgagcaggagatg

SEQ ID NO: 9482813 - DNA, 22 bp, Homo sapiens
agtggcagctgtcatgccctag

SEQ ID NO: 9482814 - DNA, 22 bp, Homo sapiens
agtggcaggatctcggttcact

SEQ ID NO: 9482815 - DNA, 17 bp, Homo sapiens
agtggcaggcagatggg

SEQ ID NO: 9482816 - DNA, 17 bp, Homo sapiens
agtggcaggcagatggg

SEQ ID NO: 9482817 - DNA, 17 bp, Homo sapiens
agtggcaggcagatggg

SEQ ID NO: 9482818 - DNA, 22 bp, Homo sapiens
agtggcaggcggagatgtagga

SEQ ID NO: 9482819 - DNA, 22 bp, Homo sapiens
agtggcaggcggagatgtagga

SEQ ID NO: 9482820 - DNA, 23 bp, Homo sapiens
agtggctggacagactttcctgg

SEQ ID NO: 9482821 - DNA, 22 bp, Homo sapiens
agtggctgaatatattttacta

SEQ ID NO: 9482822 - DNA, 22 bp, Homo sapiens
agtggctgaagcatcaaaggca

SEQ ID NO: 9482823 - DNA, 22 bp, Homo sapiens
agtggctggcataggaacagac

SEQ ID NO: 9482824 - DNA, 22 bp, Homo sapiens
agtggctggcataggaacagac

SEQ ID NO: 9482825 - DNA, 22 bp, Homo sapiens
agtggctggagccccaggctgg

SEQ ID NO: 9482826 - DNA, 22 bp, Homo sapiens
agtggctggagccccaggctgg

SEQ ID NO: 9482827 - DNA, 22 bp, Homo sapiens
agtggctggacgacaagggtga

SEQ ID NO: 9482828 - DNA, 22 bp, Homo sapiens
agtgcaggagcctggccagagc

SEQ ID NO: 9482829 - DNA, 22 bp, Homo sapiens
agtgcaggccccaggccaggcc

SEQ ID NO: 9482830 - DNA, 22 bp, Homo sapiens
agtgcaggccccaggccaggcc

SEQ ID NO: 9482831 - DNA, 22 bp, Homo sapiens
agtgcaggccccaggccaggcc

SEQ ID NO: 9482832 - DNA, 22 bp, Homo sapiens
agtgcaggccccaggccaggcc

SEQ ID NO: 9482833 - DNA, 22 bp, Homo sapiens
ctctctggcttggcacggagat

SEQ ID NO: 9482834 - DNA, 22 bp, Homo sapiens
ctctctggcttggcacggagat

SEQ ID NO: 9482835 - DNA, 23 bp, Homo sapiens
ctctctctaccatgtgaggacac

SEQ ID NO: 9482836 - DNA, 22 bp, Homo sapiens
ctctctccttagctgcagacca

SEQ ID NO: 9482837 - DNA, 22 bp, Homo sapiens
agtgcaggctcgcttgtgaggc

SEQ ID NO: 9482838 - DNA, 19 bp, Homo sapiens
agtgcagggagcaccctca

SEQ ID NO: 9482839 - DNA, 22 bp, Homo sapiens
ctctctccttagctgcagacca

SEQ ID NO: 9482840 - DNA, 22 bp, Homo sapiens
ctctctccttagctgcagacca

SEQ ID NO: 9482841 - DNA, 22 bp, Homo sapiens
ctctctgggggccatgccaaga

SEQ ID NO: 9482842 - DNA, 22 bp, Homo sapiens
ctctctgggggccatgccaaga

SEQ ID NO: 9482843 - DNA, 22 bp, Homo sapiens
ctctctgggaatattttattct

SEQ ID NO: 9482844 - DNA, 22 bp, Homo sapiens
ctctctgggcccagttggcacc

SEQ ID NO: 9482845 - DNA, 22 bp, Homo sapiens
ctctctgggcccagttggcacc

SEQ ID NO: 9482846 - DNA, 22 bp, Homo sapiens
ctctctgggaatattttattct

SEQ ID NO: 9482847 - DNA, 22 bp, Homo sapiens
ctctctggcttggcacggagat

SEQ ID NO: 9482848 - DNA, 22 bp, Homo sapiens
ctctctgggaatattttattct

SEQ ID NO: 9482849 - DNA, 22 bp, Homo sapiens
ctctctggcttggcacggagat

SEQ ID NO: 9482850 - DNA, 18 bp, Homo sapiens
ctctctgggtgaggacaa

SEQ ID NO: 9482851 - DNA, 18 bp, Homo sapiens
ctctctgggtgaggacaa

SEQ ID NO: 9482852 - DNA, 22 bp, Homo sapiens
ctctctggtacatagagtttgg

SEQ ID NO: 9482853 - DNA, 18 bp, Homo sapiens
ctctctgggtgaggacaa

SEQ ID NO: 9482854 - DNA, 22 bp, Homo sapiens
ctctctgggtcctcttttatag

SEQ ID NO: 9482855 - DNA, 22 bp, Homo sapiens
ctctctgggtcctcttttatag

SEQ ID NO: 9482856 - DNA, 22 bp, Homo sapiens
ctctctggggttccagacgtgg

SEQ ID NO: 9482857 - DNA, 22 bp, Homo sapiens
ctctctggggttccagacgtgg

SEQ ID NO: 9482858 - DNA, 22 bp, Homo sapiens
ctctctggggttccagacgtgg

SEQ ID NO: 9482859 - DNA, 22 bp, Homo sapiens
ctctctggggttccagacgtgg

SEQ ID NO: 9482860 - DNA, 22 bp, Homo sapiens
ctctgagagcggtctgtggctt

SEQ ID NO: 9482861 - DNA, 22 bp, Homo sapiens
ctctgagagcggtctgtggctt

SEQ ID NO: 9482862 - DNA, 22 bp, Homo sapiens
ctctgagaggctgccctgccat

SEQ ID NO: 9482863 - DNA, 22 bp, Homo sapiens
ctctgagaggatcctgcccggg

SEQ ID NO: 9482864 - DNA, 22 bp, Homo sapiens
ctctgagacttagcatctacat

SEQ ID NO: 9482865 - DNA, 22 bp, Homo sapiens
ctctgagagagctggtgagcac

SEQ ID NO: 9482866 - DNA, 22 bp, Homo sapiens
ctctgagagtgctcagagggta

SEQ ID NO: 9482867 - DNA, 22 bp, Homo sapiens
ctctgagagtgctcagagggta

SEQ ID NO: 9482868 - DNA, 22 bp, Homo sapiens
ctctgagaggtgagaagcagca

SEQ ID NO: 9482869 - DNA, 22 bp, Homo sapiens
ctctgagaggtgagaagcagca

SEQ ID NO: 9482870 - DNA, 22 bp, Homo sapiens
ctctgagaggtgagaagcagca

SEQ ID NO: 9482871 - DNA, 22 bp, Homo sapiens
ctctgagaatataagactattt

SEQ ID NO: 9482872 - DNA, 22 bp, Homo sapiens
ctctgagaagccttgatgggga

SEQ ID NO: 9482873 - DNA, 22 bp, Homo sapiens
ctctgagaagagttcaagtaaa

SEQ ID NO: 9482874 - DNA, 22 bp, Homo sapiens
ctctgagaactcaggattctga

SEQ ID NO: 9482875 - DNA, 22 bp, Homo sapiens
ctctgagaactcaggattctga

SEQ ID NO: 9482876 - DNA, 22 bp, Homo sapiens
ctctgagaactcaggattctga

SEQ ID NO: 9482877 - DNA, 22 bp, Homo sapiens
ctctgagaaagctgtgagctaa

SEQ ID NO: 9482878 - DNA, 22 bp, Homo sapiens
ctctgagaatatgagctctttg

SEQ ID NO: 9482879 - DNA, 22 bp, Homo sapiens
ctctgagaatataagactattt

SEQ ID NO: 9482880 - DNA, 22 bp, Homo sapiens
ctctgagactcaagtgagtggg

SEQ ID NO: 9482881 - DNA, 23 bp, Homo sapiens
ctctgagacccaggtggacacgg

SEQ ID NO: 9482882 - DNA, 22 bp, Homo sapiens
ctctgagaatatgagctctttg

SEQ ID NO: 9482883 - DNA, 22 bp, Homo sapiens
ctctgagactcaagtgagtggg

SEQ ID NO: 9482884 - DNA, 22 bp, Homo sapiens
ctctgagacttagcatctacat

SEQ ID NO: 9482885 - DNA, 22 bp, Homo sapiens
ctctgagacttagcatctacat

SEQ ID NO: 9482886 - DNA, 22 bp, Homo sapiens
ctctgagacttagcatctacat

SEQ ID NO: 9482887 - DNA, 22 bp, Homo sapiens
agtggctggtagttactgagca

SEQ ID NO: 9482888 - DNA, 19 bp, Homo sapiens
agtggctgggcagaagcaa

SEQ ID NO: 9482889 - DNA, 22 bp, Homo sapiens
agtggctggtctaaggtcacag

SEQ ID NO: 9482890 - DNA, 22 bp, Homo sapiens
agtggctgtactattttttcat

SEQ ID NO: 9482891 - DNA, 22 bp, Homo sapiens
agtggctgtaggctatgagaga

SEQ ID NO: 9482892 - DNA, 22 bp, Homo sapiens
agtggctgtaggctatgagaga

SEQ ID NO: 9482893 - DNA, 22 bp, Homo sapiens
agtggctgtatcagtcaaccct

SEQ ID NO: 9482894 - DNA, 22 bp, Homo sapiens
ctctgactgacctggaatgaat

SEQ ID NO: 9482895 - DNA, 22 bp, Homo sapiens
ctctgagaaagctgtgagctaa

SEQ ID NO: 9482896 - DNA, 22 bp, Homo sapiens
ctctgactttaaatacaggatg

SEQ ID NO: 9482897 - DNA, 22 bp, Homo sapiens
ctctgacctctagccagctctg

SEQ ID NO: 9482898 - DNA, 18 bp, Homo sapiens
ctctgaccgccacttgct

SEQ ID NO: 9482899 - DNA, 21 bp, Homo sapiens
agtggctgtcaagggggcctt

SEQ ID NO: 9482900 - DNA, 21 bp, Homo sapiens
agtggctgtcaagggggcctt

SEQ ID NO: 9482901 - DNA, 22 bp, Homo sapiens
ctctgacattctgtgactctga

SEQ ID NO: 9482902 - DNA, 22 bp, Homo sapiens
agtggctgtcctggctctaact

SEQ ID NO: 9482903 - DNA, 22 bp, Homo sapiens
agtgggccggacagcccaggcc

SEQ ID NO: 9482904 - DNA, 22 bp, Homo sapiens
agtggggaagagcatgggccct

SEQ ID NO: 9482905 - DNA, 22 bp, Homo sapiens
agtggggaagagcatgggccct

SEQ ID NO: 9482906 - DNA, 22 bp, Homo sapiens
agtgggctggtggcagggagaa

SEQ ID NO: 9482907 - DNA, 22 bp, Homo sapiens
agtgggctggtggcagggagaa

SEQ ID NO: 9482908 - DNA, 22 bp, Homo sapiens
agtgggcaggcagggtgcgcag

SEQ ID NO: 9482909 - DNA, 22 bp, Homo sapiens
agtgggcagtgcgctcggatgc

SEQ ID NO: 9482910 - DNA, 18 bp, Homo sapiens
agtgggcacacagagaac

SEQ ID NO: 9482911 - DNA, 22 bp, Homo sapiens
agtgggcaaaacagctcagagc

SEQ ID NO: 9482912 - DNA, 22 bp, Homo sapiens
agtgggcaaaacagctcagagc

SEQ ID NO: 9482913 - DNA, 20 bp, Homo sapiens
agtgggagagggcagactgc

SEQ ID NO: 9482914 - DNA, 22 bp, Homo sapiens
agtgggagagaagcaagtagta

SEQ ID NO: 9482915 - DNA, 22 bp, Homo sapiens
ctctgagcagaggccgtggcta

SEQ ID NO: 9482916 - DNA, 22 bp, Homo sapiens
ctctgagatgataccttctgga

SEQ ID NO: 9482917 - DNA, 22 bp, Homo sapiens
ctctgagatgataccttctgga

SEQ ID NO: 9482918 - DNA, 22 bp, Homo sapiens
ctctgagatgataccttctgga

SEQ ID NO: 9482919 - DNA, 22 bp, Homo sapiens
ctctgagatagtttctatcaat

SEQ ID NO: 9482920 - DNA, 22 bp, Homo sapiens
ctctgagatgcttgaagaggat

SEQ ID NO: 9482921 - DNA, 22 bp, Homo sapiens
ctgagaggcggagcttgcagtg

SEQ ID NO: 9482922 - DNA, 22 bp, Homo sapiens
ctgagaggcagccagagaaaat

SEQ ID NO: 9482923 - DNA, 22 bp, Homo sapiens
ctgagaggcacaaggcatttcg

SEQ ID NO: 9482924 - DNA, 22 bp, Homo sapiens
ctgagaggcacaaggcatttcg

SEQ ID NO: 9482925 - DNA, 22 bp, Homo sapiens
ctgagaggatgctgcagtggag

SEQ ID NO: 9482926 - DNA, 22 bp, Homo sapiens
ctgagaggcggagcttgcagtg

SEQ ID NO: 9482927 - DNA, 22 bp, Homo sapiens
ctgagaggcggagcttgcagtg

SEQ ID NO: 9482928 - DNA, 22 bp, Homo sapiens
ctgagaggcggagcttgcagtg

SEQ ID NO: 9482929 - DNA, 22 bp, Homo sapiens
ctgagaggcagccagagaaaat

SEQ ID NO: 9482930 - DNA, 22 bp, Homo sapiens
ctgagaggcggaggttgcagtg

SEQ ID NO: 9482931 - DNA, 22 bp, Homo sapiens
ctgagaggcggaggttgcagtg

SEQ ID NO: 9482932 - DNA, 22 bp, Homo sapiens
ctgagaggcggagcttgcagtg

SEQ ID NO: 9482933 - DNA, 22 bp, Homo sapiens
ctgagagcagggacttgagcca

SEQ ID NO: 9482934 - DNA, 22 bp, Homo sapiens
ctgagagcatcgctggagatag

SEQ ID NO: 9482935 - DNA, 22 bp, Homo sapiens
ctgagagcatcgctggagatag

SEQ ID NO: 9482936 - DNA, 22 bp, Homo sapiens
ctgagagatggtgtgtttataa

SEQ ID NO: 9482937 - DNA, 22 bp, Homo sapiens
ctgagagcagggacttgagcca

SEQ ID NO: 9482938 - DNA, 22 bp, Homo sapiens
ctgagagcagggacttgagcca

SEQ ID NO: 9482939 - DNA, 22 bp, Homo sapiens
ctgagaaagtgagggttaaaca

SEQ ID NO: 9482940 - DNA, 22 bp, Homo sapiens
ctgagaggatgctgcagtggag

SEQ ID NO: 9482941 - DNA, 22 bp, Homo sapiens
ctgagaggatgctgcagtggag

SEQ ID NO: 9482942 - DNA, 22 bp, Homo sapiens
ctgagaggatgctgcagtggag

SEQ ID NO: 9482943 - DNA, 22 bp, Homo sapiens
ctgagaggatgctgcagtggag

SEQ ID NO: 9482944 - DNA, 22 bp, Homo sapiens
ctgagaggatgctgcagtggag

SEQ ID NO: 9482945 - DNA, 22 bp, Homo sapiens
ctgagaggaacatcttatgctt

SEQ ID NO: 9482946 - DNA, 22 bp, Homo sapiens
ctgaagctctccagtttgtttc

SEQ ID NO: 9482947 - DNA, 22 bp, Homo sapiens
ctgaagctgcataccaaagact

SEQ ID NO: 9482948 - DNA, 22 bp, Homo sapiens
ctgagaaaggacctcaaacagg

SEQ ID NO: 9482949 - DNA, 22 bp, Homo sapiens
ctgagaaagtgagggttaaaca

SEQ ID NO: 9482950 - DNA, 22 bp, Homo sapiens
ctgaagcttgataaactataaa

SEQ ID NO: 9482951 - DNA, 22 bp, Homo sapiens
ctgaagcttagtttacgctcca

SEQ ID NO: 9482952 - DNA, 22 bp, Homo sapiens
ctgaagcaggcctacttcattg

SEQ ID NO: 9482953 - DNA, 22 bp, Homo sapiens
ctgaagcagggagtgatgaagt

SEQ ID NO: 9482954 - DNA, 22 bp, Homo sapiens
ctgaagccagtttgctgccctt

SEQ ID NO: 9482955 - DNA, 22 bp, Homo sapiens
ctgaagccatgtgctcactggt

SEQ ID NO: 9482956 - DNA, 22 bp, Homo sapiens
ctgaagcatgcgtttgtaaact

SEQ ID NO: 9482957 - DNA, 22 bp, Homo sapiens
ctgaagccacgatagcttccta

SEQ ID NO: 9482958 - DNA, 18 bp, Homo sapiens
agtgtgtgccctttcagg

SEQ ID NO: 9482959 - DNA, 22 bp, Homo sapiens
agtgtgtgcctttggatacctg

SEQ ID NO: 9482960 - DNA, 22 bp, Homo sapiens
agtgtgtgcctttggatacctg

SEQ ID NO: 9482961 - DNA, 22 bp, Homo sapiens
agtgtgtgcctttggatacctg

SEQ ID NO: 9482962 - DNA, 22 bp, Homo sapiens
agtgtgtgctgttccccggagg

SEQ ID NO: 9482963 - DNA, 22 bp, Homo sapiens
agtgtgtgctgttccccggagg

SEQ ID NO: 9482964 - DNA, 22 bp, Homo sapiens
agtgtgtgctgttccccggagg

SEQ ID NO: 9482965 - DNA, 21 bp, Homo sapiens
agtgtgtgtggaatgagaata

SEQ ID NO: 9482966 - DNA, 21 bp, Homo sapiens
agtgtgtgtggaatgagaata

SEQ ID NO: 9482967 - DNA, 21 bp, Homo sapiens
agtgtgtgtggaatgagaata

SEQ ID NO: 9482968 - DNA, 21 bp, Homo sapiens
agtgtgtgtggaatgagaata

SEQ ID NO: 9482969 - DNA, 21 bp, Homo sapiens
agtgtgtgtggaatgagaata

SEQ ID NO: 9482970 - DNA, 22 bp, Homo sapiens
agtgtgtgcatgcattcgtgca

SEQ ID NO: 9482971 - DNA, 22 bp, Homo sapiens
agtgtgtgcatgcattcgtgca

SEQ ID NO: 9482972 - DNA, 22 bp, Homo sapiens
agtgtgtgcatgcattcgtgca

SEQ ID NO: 9482973 - DNA, 22 bp, Homo sapiens
agtgtgtgcatgcattcgtgca

SEQ ID NO: 9482974 - DNA, 18 bp, Homo sapiens
agtgtgtgccctttcagg

SEQ ID NO: 9482975 - DNA, 18 bp, Homo sapiens
agtgtgtgccctttcagg

SEQ ID NO: 9482976 - DNA, 22 bp, Homo sapiens
agtgtgggggctttggtgtcac

SEQ ID NO: 9482977 - DNA, 22 bp, Homo sapiens
agtgtgggggctttggtgtcac

SEQ ID NO: 9482978 - DNA, 21 bp, Homo sapiens
agtgtgtgataggcaggaaga

SEQ ID NO: 9482979 - DNA, 21 bp, Homo sapiens
agtgtgtgataggcaggaaga

SEQ ID NO: 9482980 - DNA, 21 bp, Homo sapiens
agtgtgtgataggcaggaaga

SEQ ID NO: 9482981 - DNA, 22 bp, Homo sapiens
agtgtgggggctttggtgtcac

SEQ ID NO: 9482982 - DNA, 22 bp, Homo sapiens
agtgttaacatgaatggtttcc

SEQ ID NO: 9482983 - DNA, 19 bp, Homo sapiens
agtgttaacccagtgttgg

SEQ ID NO: 9482984 - DNA, 22 bp, Homo sapiens
ctgaagcaaatgaaacagctct

SEQ ID NO: 9482985 - DNA, 22 bp, Homo sapiens
ctgaagcaaatgaaacagctct

SEQ ID NO: 9482986 - DNA, 22 bp, Homo sapiens
ctgaagcacagcatataaataa

SEQ ID NO: 9482987 - DNA, 22 bp, Homo sapiens
agtgtgtgtttgggcggtttat

SEQ ID NO: 9482988 - DNA, 22 bp, Homo sapiens
agtgtgtgtttgggcggtttat

SEQ ID NO: 9482989 - DNA, 21 bp, Homo sapiens
agtgtgtgtggaatgagaata

SEQ ID NO: 9482990 - DNA, 22 bp, Homo sapiens
agtgtgtgtttgggcggtttat

SEQ ID NO: 9482991 - DNA, 22 bp, Homo sapiens
agtgtgtgtttgggcggtttat

SEQ ID NO: 9482992 - DNA, 23 bp, Homo sapiens
agtgttaaatttcgcacctaaat

SEQ ID NO: 9482993 - DNA, 23 bp, Homo sapiens
agtgttaaatttcgcacctaaat

SEQ ID NO: 9482994 - DNA, 22 bp, Homo sapiens
agtgtgtttggagcgagggagg

SEQ ID NO: 9482995 - DNA, 20 bp, Homo sapiens
ctcttaaatgtaaagtaggc

SEQ ID NO: 9482996 - DNA, 20 bp, Homo sapiens
ctcttaaatgtaaagtaggc

SEQ ID NO: 9482997 - DNA, 22 bp, Homo sapiens
ctcttaatgaccttaattcaag

SEQ ID NO: 9482998 - DNA, 22 bp, Homo sapiens
ctcttaatgaccttaattcaag

SEQ ID NO: 9482999 - DNA, 22 bp, Homo sapiens
ctcttaatgttttatagattga

SEQ ID NO: 9483000 - DNA, 22 bp, Homo sapiens
ctcttaaataacatcattgctt

SEQ ID NO: 9483001 - DNA, 22 bp, Homo sapiens
ctcttaaataacatcattgctt

SEQ ID NO: 9483002 - DNA, 22 bp, Homo sapiens
ctcttaaagcttccagtttcaa

SEQ ID NO: 9483003 - DNA, 22 bp, Homo sapiens
ctcttaaagcttccagtttcaa

SEQ ID NO: 9483004 - DNA, 22 bp, Homo sapiens
ctcttagaaactatagagatta

SEQ ID NO: 9483005 - DNA, 22 bp, Homo sapiens
ctcttacattcttttactagca

SEQ ID NO: 9483006 - DNA, 22 bp, Homo sapiens
ctcttacattcttttactagca

SEQ ID NO: 9483007 - DNA, 22 bp, Homo sapiens
agtgtgggggctttggtgtcac

SEQ ID NO: 9483008 - DNA, 22 bp, Homo sapiens
ctcttaattaagctgagatctg

SEQ ID NO: 9483009 - DNA, 20 bp, Homo sapiens
ctcttaattgctcacattag

SEQ ID NO: 9483010 - DNA, 22 bp, Homo sapiens
ctcttaattaagctgagatctg

SEQ ID NO: 9483011 - DNA, 19 bp, Homo sapiens
ctcttacagaatagacaca

SEQ ID NO: 9483012 - DNA, 22 bp, Homo sapiens
agtgtctgccagctgccaggtg

SEQ ID NO: 9483013 - DNA, 22 bp, Homo sapiens
agtgtctgccaactgcatggtc

SEQ ID NO: 9483014 - DNA, 22 bp, Homo sapiens
agtgtctgccagctgccaggtg

SEQ ID NO: 9483015 - DNA, 22 bp, Homo sapiens
agtgtctgcctatttttcaagc

SEQ ID NO: 9483016 - DNA, 22 bp, Homo sapiens
agtgtctgcagtgatgtctctt

SEQ ID NO: 9483017 - DNA, 22 bp, Homo sapiens
agtgtctgccaactgcatggtc

SEQ ID NO: 9483018 - DNA, 22 bp, Homo sapiens
agtgtctgcagtgatgtctctt

SEQ ID NO: 9483019 - DNA, 22 bp, Homo sapiens
ctcttaaaaacttgatatattt

SEQ ID NO: 9483020 - DNA, 22 bp, Homo sapiens
ctcttaaaaacttgatatattt

SEQ ID NO: 9483021 - DNA, 22 bp, Homo sapiens
ctcttaaaaacttgatatattt

SEQ ID NO: 9483022 - DNA, 22 bp, Homo sapiens
ctcttaaaaacttgatatattt

SEQ ID NO: 9483023 - DNA, 22 bp, Homo sapiens
ctcttaaagaatgttccagctg

SEQ ID NO: 9483024 - DNA, 22 bp, Homo sapiens
ctcttaaaaacttgatatattt

SEQ ID NO: 9483025 - DNA, 22 bp, Homo sapiens
agtgtctgagccagaattagaa

SEQ ID NO: 9483026 - DNA, 22 bp, Homo sapiens
agtgtctgagctatcattaggg

SEQ ID NO: 9483027 - DNA, 22 bp, Homo sapiens
agtgtctgagtaaatttctcat

SEQ ID NO: 9483028 - DNA, 23 bp, Homo sapiens
agtgtctgagtgcaggctgtgca

SEQ ID NO: 9483029 - DNA, 22 bp, Homo sapiens
agtgtctgatcagttgactaga

SEQ ID NO: 9483030 - DNA, 22 bp, Homo sapiens
agtgtctgatcagttgactaga

SEQ ID NO: 9483031 - DNA, 22 bp, Homo sapiens
agtgtctgatgcacagttgtcc

SEQ ID NO: 9483032 - DNA, 22 bp, Homo sapiens
agtgtctgcaaaatgaaagagc

SEQ ID NO: 9483033 - DNA, 22 bp, Homo sapiens
agtgtctgatgcacagttgtcc

SEQ ID NO: 9483034 - DNA, 22 bp, Homo sapiens
agtgtcctctattatgacttta

SEQ ID NO: 9483035 - DNA, 22 bp, Homo sapiens
agtgtctgaactgggtgctgac

SEQ ID NO: 9483036 - DNA, 22 bp, Homo sapiens
agtgtctgaagcctcagcccga

SEQ ID NO: 9483037 - DNA, 22 bp, Homo sapiens
agtgtctgaaggatttggcttc

SEQ ID NO: 9483038 - DNA, 22 bp, Homo sapiens
agtgtctgagccagaattagaa

SEQ ID NO: 9483039 - DNA, 21 bp, Homo sapiens
agtgtctgagcgctgcttctg

SEQ ID NO: 9483040 - DNA, 22 bp, Homo sapiens
agtggggaggtccaggccaccc

SEQ ID NO: 9483041 - DNA, 20 bp, Homo sapiens
agtggggagtcaggagtgcc

SEQ ID NO: 9483042 - DNA, 20 bp, Homo sapiens
agtggggagtcaggagtgcc

SEQ ID NO: 9483043 - DNA, 20 bp, Homo sapiens
agtggggagtcaggagtgcc

SEQ ID NO: 9483044 - DNA, 20 bp, Homo sapiens
agtggggagtcaggagtgcc

SEQ ID NO: 9483045 - DNA, 20 bp, Homo sapiens
agtggggagtcaggagtgcc

SEQ ID NO: 9483046 - DNA, 22 bp, Homo sapiens
agtggggaagattttgcagtca

SEQ ID NO: 9483047 - DNA, 22 bp, Homo sapiens
agtggggacaatgagagcaggt

SEQ ID NO: 9483048 - DNA, 22 bp, Homo sapiens
agtggggaagattttgcagtca

SEQ ID NO: 9483049 - DNA, 22 bp, Homo sapiens
agtggggacttatgccagcatt

SEQ ID NO: 9483050 - DNA, 22 bp, Homo sapiens
agtggggacaatgagagcaggt

SEQ ID NO: 9483051 - DNA, 22 bp, Homo sapiens
agtggggacaatgagagcaggt

SEQ ID NO: 9483052 - DNA, 22 bp, Homo sapiens
agtctgagttactggcaaatac

SEQ ID NO: 9483053 - DNA, 22 bp, Homo sapiens
agtctgagtgcactcaataaag

SEQ ID NO: 9483054 - DNA, 22 bp, Homo sapiens
agtctgagtctaaaggcttgag

SEQ ID NO: 9483055 - DNA, 22 bp, Homo sapiens
agtctgcactcaggtggaggtc

SEQ ID NO: 9483056 - DNA, 22 bp, Homo sapiens
agtctgagttagtggaaatgta

SEQ ID NO: 9483057 - DNA, 22 bp, Homo sapiens
agtctgagttagtggaaatgta

SEQ ID NO: 9483058 - DNA, 19 bp, Homo sapiens
agtctgcatttctagcaag

SEQ ID NO: 9483059 - DNA, 19 bp, Homo sapiens
agtctgcatttctagcaag

SEQ ID NO: 9483060 - DNA, 22 bp, Homo sapiens
agtctgaagatattcttgcagg

SEQ ID NO: 9483061 - DNA, 22 bp, Homo sapiens
agtctgaagatattcttgcagg

SEQ ID NO: 9483062 - DNA, 22 bp, Homo sapiens
agtctgaaggcaatctgctgac

SEQ ID NO: 9483063 - DNA, 22 bp, Homo sapiens
agtctgaaggcaatctgctgac

SEQ ID NO: 9483064 - DNA, 22 bp, Homo sapiens
agtctgaagtagtctttagtgt

SEQ ID NO: 9483065 - DNA, 22 bp, Homo sapiens
agtctgaagtagtctttagtgt

SEQ ID NO: 9483066 - DNA, 22 bp, Homo sapiens
agtctgagtatctctgagccag

SEQ ID NO: 9483067 - DNA, 21 bp, Homo sapiens
agtctgaggtggggcctagga

SEQ ID NO: 9483068 - DNA, 21 bp, Homo sapiens
agtctgaggtggggcctagga

SEQ ID NO: 9483069 - DNA, 22 bp, Homo sapiens
agtctgaggtaatatttttctc

SEQ ID NO: 9483070 - DNA, 23 bp, Homo sapiens
agtctgaattgagatgtgctgtg

SEQ ID NO: 9483071 - DNA, 22 bp, Homo sapiens
agtctgaggcaccctgaatatt

SEQ ID NO: 9483072 - DNA, 22 bp, Homo sapiens
agtctgagattctgcatttcta

SEQ ID NO: 9483073 - DNA, 22 bp, Homo sapiens
agtctgaagactcatgtctgaa

SEQ ID NO: 9483074 - DNA, 22 bp, Homo sapiens
agtctgaagactcatgtctgaa

SEQ ID NO: 9483075 - DNA, 22 bp, Homo sapiens
agtctgaaccagatggcaaggt

SEQ ID NO: 9483076 - DNA, 22 bp, Homo sapiens
agtctgaaagtatgttgtaatg

SEQ ID NO: 9483077 - DNA, 22 bp, Homo sapiens
agtctcttttgcgaagagtgtt

SEQ ID NO: 9483078 - DNA, 22 bp, Homo sapiens
agtccaaggccatacagttgtg

SEQ ID NO: 9483079 - DNA, 22 bp, Homo sapiens
agtccaagattagggtgacagc

SEQ ID NO: 9483080 - DNA, 22 bp, Homo sapiens
agtctctttaatcacagtgtct

SEQ ID NO: 9483081 - DNA, 22 bp, Homo sapiens
agtcatccaagagcctgggcag

SEQ ID NO: 9483082 - DNA, 22 bp, Homo sapiens
agtcatcatttatatcaagtct

SEQ ID NO: 9483083 - DNA, 22 bp, Homo sapiens
agtcatcatttatatcaagtct

SEQ ID NO: 9483084 - DNA, 22 bp, Homo sapiens
agtcatatctgaggaggaatcc

SEQ ID NO: 9483085 - DNA, 22 bp, Homo sapiens
agtcatatgacccttcacaaac

SEQ ID NO: 9483086 - DNA, 22 bp, Homo sapiens
agtcatgtaatcacaatgacct

SEQ ID NO: 9483087 - DNA, 22 bp, Homo sapiens
agtcattacggactagtactac

SEQ ID NO: 9483088 - DNA, 23 bp, Homo sapiens
agtcattaagaagttcaggaact

SEQ ID NO: 9483089 - DNA, 22 bp, Homo sapiens
agtccaaagcagatgagggcca

SEQ ID NO: 9483090 - DNA, 22 bp, Homo sapiens
agtcattttctgcctgtaatct

SEQ ID NO: 9483091 - DNA, 22 bp, Homo sapiens
agtccaaacaaacttcccgagg

SEQ ID NO: 9483092 - DNA, 22 bp, Homo sapiens
agtcattttctgcctgtaatct

SEQ ID NO: 9483093 - DNA, 22 bp, Homo sapiens
agtcattttgccagtcttcagg

SEQ ID NO: 9483094 - DNA, 22 bp, Homo sapiens
agtcattttctgcctgtaatct

SEQ ID NO: 9483095 - DNA, 22 bp, Homo sapiens
agtcatttggagcaccttatta

SEQ ID NO: 9483096 - DNA, 22 bp, Homo sapiens
agtcattttctgcctgtaatct

SEQ ID NO: 9483097 - DNA, 22 bp, Homo sapiens
agtcatttctgtagtcatgttt

SEQ ID NO: 9483098 - DNA, 22 bp, Homo sapiens
agtcatttctgtagtcatgttt

SEQ ID NO: 9483099 - DNA, 22 bp, Homo sapiens
agtcatttcccattcttcatat

SEQ ID NO: 9483100 - DNA, 18 bp, Homo sapiens
agtcatttacttttgtga

SEQ ID NO: 9483101 - DNA, 18 bp, Homo sapiens
agtcatttacttttgtga

SEQ ID NO: 9483102 - DNA, 18 bp, Homo sapiens
agtcatttacttttgtga

SEQ ID NO: 9483103 - DNA, 21 bp, Homo sapiens
agtctgttaggatgactctga

SEQ ID NO: 9483104 - DNA, 22 bp, Homo sapiens
agtctgtgtatattcactgccc

SEQ ID NO: 9483105 - DNA, 22 bp, Homo sapiens
agtctgtgtgaatgtgggcttt

SEQ ID NO: 9483106 - DNA, 22 bp, Homo sapiens
agtctgtgtgaatgtgggcttt

SEQ ID NO: 9483107 - DNA, 22 bp, Homo sapiens
agtctgtgtatattcactgccc

SEQ ID NO: 9483108 - DNA, 22 bp, Homo sapiens
agtctgtgtatattcactgccc

SEQ ID NO: 9483109 - DNA, 22 bp, Homo sapiens
agtctgtggatggactggcaga

SEQ ID NO: 9483110 - DNA, 22 bp, Homo sapiens
agtctgtgtacctttggccttc

SEQ ID NO: 9483111 - DNA, 22 bp, Homo sapiens
agtctgtgtactgggtttctgt

SEQ ID NO: 9483112 - DNA, 19 bp, Homo sapiens
agtctgtggatttgtgggt

SEQ ID NO: 9483113 - DNA, 19 bp, Homo sapiens
agtctgtggatttgtgggt

SEQ ID NO: 9483114 - DNA, 22 bp, Homo sapiens
agtctgtggggtccctggggca

SEQ ID NO: 9483115 - DNA, 22 bp, Homo sapiens
agtctgtgtacctttggccttc

SEQ ID NO: 9483116 - DNA, 22 bp, Homo sapiens
ctcaggatgcaattccatcaag

SEQ ID NO: 9483117 - DNA, 22 bp, Homo sapiens
ctcaggcaaggcccgcattctc

SEQ ID NO: 9483118 - DNA, 22 bp, Homo sapiens
ctcaggcacgggtcagtgagcg

SEQ ID NO: 9483119 - DNA, 18 bp, Homo sapiens
ctcaggcagagaagcttt

SEQ ID NO: 9483120 - DNA, 22 bp, Homo sapiens
ctcaggcagtgccctctggccg

SEQ ID NO: 9483121 - DNA, 22 bp, Homo sapiens
ctcaggcagtgccctctggccg

SEQ ID NO: 9483122 - DNA, 22 bp, Homo sapiens
ctcaggcagtgccctctggccg

SEQ ID NO: 9483123 - DNA, 18 bp, Homo sapiens
ctcaggcagagaagcttt

SEQ ID NO: 9483124 - DNA, 22 bp, Homo sapiens
ctcaggcacttttgtcacagac

SEQ ID NO: 9483125 - DNA, 22 bp, Homo sapiens
ctcaggcacttttgtcacagac

SEQ ID NO: 9483126 - DNA, 22 bp, Homo sapiens
ctcaggcacttttgtcacagac

SEQ ID NO: 9483127 - DNA, 22 bp, Homo sapiens
agtctggatttagaggtgggcc

SEQ ID NO: 9483128 - DNA, 22 bp, Homo sapiens
agtctgtctgtcacttctgcag

SEQ ID NO: 9483129 - DNA, 19 bp, Homo sapiens
agtctgtctgctttccctc

SEQ ID NO: 9483130 - DNA, 22 bp, Homo sapiens
agtctgtctttggcttcaccac

SEQ ID NO: 9483131 - DNA, 17 bp, Homo sapiens
agtctgtctttccttgt

SEQ ID NO: 9483132 - DNA, 22 bp, Homo sapiens
agtctgtgaaaagataggaagt

SEQ ID NO: 9483133 - DNA, 22 bp, Homo sapiens
agtctgtgaaaagataggaagt

SEQ ID NO: 9483134 - DNA, 22 bp, Homo sapiens
agtctgtgaacttggcagggaa

SEQ ID NO: 9483135 - DNA, 22 bp, Homo sapiens
agtctgtgactcattggatctc

SEQ ID NO: 9483136 - DNA, 22 bp, Homo sapiens
agtctgtgaacttggcagggaa

SEQ ID NO: 9483137 - DNA, 22 bp, Homo sapiens
agtctgtgactcattggatctc

SEQ ID NO: 9483138 - DNA, 22 bp, Homo sapiens
agtctgtgactcattggatctc

SEQ ID NO: 9483139 - DNA, 22 bp, Homo sapiens
agtctgtgagtgatgtacctgc

SEQ ID NO: 9483140 - DNA, 23 bp, Homo sapiens
agtctgtgctgaagaagttacaa

SEQ ID NO: 9483141 - DNA, 22 bp, Homo sapiens
agtctgtgaacttggcagggaa

SEQ ID NO: 9483142 - DNA, 22 bp, Homo sapiens
agtctgtgctgttggtgaggat

SEQ ID NO: 9483143 - DNA, 22 bp, Homo sapiens
agtctgtgctgttggtgaggat

SEQ ID NO: 9483144 - DNA, 23 bp, Homo sapiens
agtctgtgctgaagaagttacaa

SEQ ID NO: 9483145 - DNA, 23 bp, Homo sapiens
agtctgtgcttggtgggagggcc

SEQ ID NO: 9483146 - DNA, 22 bp, Homo sapiens
agtctgtgagtgatgtacctgc

SEQ ID NO: 9483147 - DNA, 23 bp, Homo sapiens
agtctgtgcttggtgggagggcc

SEQ ID NO: 9483148 - DNA, 22 bp, Homo sapiens
agtctgtggatggactggcaga

SEQ ID NO: 9483149 - DNA, 22 bp, Homo sapiens
agtctggagtagagcctagaaa

SEQ ID NO: 9483150 - DNA, 22 bp, Homo sapiens
agtctggagtgcggcggcagga

SEQ ID NO: 9483151 - DNA, 22 bp, Homo sapiens
agtctggaatttggcctgagca

SEQ ID NO: 9483152 - DNA, 22 bp, Homo sapiens
agtctggaatttggcctgagca

SEQ ID NO: 9483153 - DNA, 22 bp, Homo sapiens
agtgactggtgtgaagttaaat

SEQ ID NO: 9483154 - DNA, 22 bp, Homo sapiens
agtgatttgactcttttattgt

SEQ ID NO: 9483155 - DNA, 22 bp, Homo sapiens
agtgactggtgtgaagttaaat

SEQ ID NO: 9483156 - DNA, 22 bp, Homo sapiens
agtgactggtgtgaagttaaat

SEQ ID NO: 9483157 - DNA, 22 bp, Homo sapiens
agtgactggtgtgaagttaaat

SEQ ID NO: 9483158 - DNA, 22 bp, Homo sapiens
agtgactggtgtgaagttaaat

SEQ ID NO: 9483159 - DNA, 22 bp, Homo sapiens
agtgactgggcagggcagggcc

SEQ ID NO: 9483160 - DNA, 22 bp, Homo sapiens
agtgactggtgtgaagttaaat

SEQ ID NO: 9483161 - DNA, 22 bp, Homo sapiens
agtgactcaactagtcttacta

SEQ ID NO: 9483162 - DNA, 22 bp, Homo sapiens
agtgactcactagctctcagtg

SEQ ID NO: 9483163 - DNA, 21 bp, Homo sapiens
agtgactctgaaccacttgaa

SEQ ID NO: 9483164 - DNA, 22 bp, Homo sapiens
agtgactctgtgaaaggcagaa

SEQ ID NO: 9483165 - DNA, 22 bp, Homo sapiens
agtgaccaacaatgctgagaag

SEQ ID NO: 9483166 - DNA, 22 bp, Homo sapiens
agtgaccaatcatggttagatt

SEQ ID NO: 9483167 - DNA, 22 bp, Homo sapiens
agtgaccattttcagctagagg

SEQ ID NO: 9483168 - DNA, 22 bp, Homo sapiens
agtgaccgaggcacttggcaac

SEQ ID NO: 9483169 - DNA, 22 bp, Homo sapiens
agtgaccgaggcacttggcaac

SEQ ID NO: 9483170 - DNA, 22 bp, Homo sapiens
agtgcactggcaccatctcagc

SEQ ID NO: 9483171 - DNA, 22 bp, Homo sapiens
agtgcacagcctgctgcagaat

SEQ ID NO: 9483172 - DNA, 22 bp, Homo sapiens
agtgcagagacctggtcaggca

SEQ ID NO: 9483173 - DNA, 22 bp, Homo sapiens
agtgcacttttgggggatgtta

SEQ ID NO: 9483174 - DNA, 22 bp, Homo sapiens
agtgcacaccttagtacaaagt

SEQ ID NO: 9483175 - DNA, 22 bp, Homo sapiens
agtgatttgcagtatttactaa

SEQ ID NO: 9483176 - DNA, 22 bp, Homo sapiens
agtgcagaggctgggaaatgct

SEQ ID NO: 9483177 - DNA, 22 bp, Homo sapiens
agtgcagatttttagtcagctt

SEQ ID NO: 9483178 - DNA, 22 bp, Homo sapiens
agtgcagatttttagtcagctt

SEQ ID NO: 9483179 - DNA, 22 bp, Homo sapiens
agtgcagaggctgggaaatgct

SEQ ID NO: 9483180 - DNA, 22 bp, Homo sapiens
agtgacagtctcagagatcagg

SEQ ID NO: 9483181 - DNA, 22 bp, Homo sapiens
agtgacagtctcagagatcagg

SEQ ID NO: 9483182 - DNA, 22 bp, Homo sapiens
agtgacagtctcagagatcagg

SEQ ID NO: 9483183 - DNA, 22 bp, Homo sapiens
agtgacagtctgatttctcaaa

SEQ ID NO: 9483184 - DNA, 22 bp, Homo sapiens
agtgacagtttcaggcattttt

SEQ ID NO: 9483185 - DNA, 22 bp, Homo sapiens
ctccatggaaaaggctgttgtt

SEQ ID NO: 9483186 - DNA, 22 bp, Homo sapiens
agtgacagtatttgttgccaat

SEQ ID NO: 9483187 - DNA, 22 bp, Homo sapiens
ctccatatgttcagttatgcag

SEQ ID NO: 9483188 - DNA, 22 bp, Homo sapiens
ctccatatgttcagttatgcag

SEQ ID NO: 9483189 - DNA, 22 bp, Homo sapiens
ctccagttggccccagttggtt

SEQ ID NO: 9483190 - DNA, 22 bp, Homo sapiens
ctccagttggccccagttggtt

SEQ ID NO: 9483191 - DNA, 22 bp, Homo sapiens
ctccagttggccccagttggtt

SEQ ID NO: 9483192 - DNA, 22 bp, Homo sapiens
ctccagttggccccagttggtt

SEQ ID NO: 9483193 - DNA, 20 bp, Homo sapiens
ctccagtgttcaggggagtg

SEQ ID NO: 9483194 - DNA, 20 bp, Homo sapiens
ctccagtgttcaggggagtg

SEQ ID NO: 9483195 - DNA, 20 bp, Homo sapiens
ctccagtgttcaggggagtg

SEQ ID NO: 9483196 - DNA, 22 bp, Homo sapiens
ctccagtgtctcagagcagatg

SEQ ID NO: 9483197 - DNA, 22 bp, Homo sapiens
ctccagtggtgatggggaagaa

SEQ ID NO: 9483198 - DNA, 22 bp, Homo sapiens
ctccagtgctgtcatcccttcc

SEQ ID NO: 9483199 - DNA, 22 bp, Homo sapiens
ctccagtgggggtgagcctaga

SEQ ID NO: 9483200 - DNA, 22 bp, Homo sapiens
ctccagtgggggtgagcctaga

SEQ ID NO: 9483201 - DNA, 22 bp, Homo sapiens
ctcctccctgggaggctggcat

SEQ ID NO: 9483202 - DNA, 22 bp, Homo sapiens
ctcctcctggacacaggctgtg

SEQ ID NO: 9483203 - DNA, 22 bp, Homo sapiens
ctcctccctctttgccacacat

SEQ ID NO: 9483204 - DNA, 22 bp, Homo sapiens
ctcctccctgcgattgctctgc

SEQ ID NO: 9483205 - DNA, 22 bp, Homo sapiens
ctcctccctctttgccacacat

SEQ ID NO: 9483206 - DNA, 22 bp, Homo sapiens
ctcctccctctttgccacacat

SEQ ID NO: 9483207 - DNA, 22 bp, Homo sapiens
ctcctccccttgagtctgggat

SEQ ID NO: 9483208 - DNA, 22 bp, Homo sapiens
ctcctcccacggtctcaggaag

SEQ ID NO: 9483209 - DNA, 22 bp, Homo sapiens
ctcctcccacggtctcaggaag

SEQ ID NO: 9483210 - DNA, 22 bp, Homo sapiens
ctcccaggttccgacgcctctt

SEQ ID NO: 9483211 - DNA, 22 bp, Homo sapiens
ctcctcccacggtctcaggaag

SEQ ID NO: 9483212 - DNA, 22 bp, Homo sapiens
ctcctcccacggtctcaggaag

SEQ ID NO: 9483213 - DNA, 22 bp, Homo sapiens
agtgcagctgggactgtagggt

SEQ ID NO: 9483214 - DNA, 22 bp, Homo sapiens
agtgcaggagcctggccagagc

SEQ ID NO: 9483215 - DNA, 22 bp, Homo sapiens
ctcctcctggacacaggctgtg

SEQ ID NO: 9483216 - DNA, 22 bp, Homo sapiens
ctcctcctggacacaggctgtg

SEQ ID NO: 9483217 - DNA, 22 bp, Homo sapiens
ctcctcgaagcaacctgcaggc

SEQ ID NO: 9483218 - DNA, 22 bp, Homo sapiens
ctcctctcaggctggatggcgc

SEQ ID NO: 9483219 - DNA, 22 bp, Homo sapiens
ctcctctagaagctgacctgga

SEQ ID NO: 9483220 - DNA, 22 bp, Homo sapiens
agtgcagcaccatgttacagag

SEQ ID NO: 9483221 - DNA, 22 bp, Homo sapiens
agtgcagcatgaagcacatgtg

SEQ ID NO: 9483222 - DNA, 22 bp, Homo sapiens
agtgcagcatgaagcacatgtg

SEQ ID NO: 9483223 - DNA, 22 bp, Homo sapiens
agtgcagcatgctggggaggct

SEQ ID NO: 9483224 - DNA, 22 bp, Homo sapiens
agtgcagccgagatcaggtgct

SEQ ID NO: 9483225 - DNA, 22 bp, Homo sapiens
agtgcagccgagatcaggtgct

SEQ ID NO: 9483226 - DNA, 22 bp, Homo sapiens
agtgcagccgagatcaggtgct

SEQ ID NO: 9483227 - DNA, 22 bp, Homo sapiens
ctcccaggggaactatcaagta

SEQ ID NO: 9483228 - DNA, 22 bp, Homo sapiens
agtgcagccttctgggccgctt

SEQ ID NO: 9483229 - DNA, 22 bp, Homo sapiens
ctcccagggtagggagagacta

SEQ ID NO: 9483230 - DNA, 22 bp, Homo sapiens
ctcccagggtctaggctgctgg

SEQ ID NO: 9483231 - DNA, 22 bp, Homo sapiens
ctcccagggtctaggctgctgg

SEQ ID NO: 9483232 - DNA, 22 bp, Homo sapiens
ctcccaggggagtcatctgctt

SEQ ID NO: 9483233 - DNA, 22 bp, Homo sapiens
ctcctcagctgggaggagtccc

SEQ ID NO: 9483234 - DNA, 22 bp, Homo sapiens
ctcccaggttccgacgcctctt

SEQ ID NO: 9483235 - DNA, 22 bp, Homo sapiens
ctcccaggttccgacgcctctt

SEQ ID NO: 9483236 - DNA, 22 bp, Homo sapiens
ctcccaggttacatctgagcct

SEQ ID NO: 9483237 - DNA, 21 bp, Homo sapiens
ctcccagggtgactgttcaac

SEQ ID NO: 9483238 - DNA, 22 bp, Homo sapiens
ctcccagggtctaggctgctgg

SEQ ID NO: 9483239 - DNA, 21 bp, Homo sapiens
ctcccagggtgactgttcaac

SEQ ID NO: 9483240 - DNA, 22 bp, Homo sapiens
ctcccaggtgtcccttctgcca

SEQ ID NO: 9483241 - DNA, 22 bp, Homo sapiens
ctcccaggttacatctgagcct

SEQ ID NO: 9483242 - DNA, 22 bp, Homo sapiens
ctcccaggttacatctgagcct

SEQ ID NO: 9483243 - DNA, 22 bp, Homo sapiens
atagcagttgtcaaactccatc

SEQ ID NO: 9483244 - DNA, 22 bp, Homo sapiens
atagcagtggatgtggagaaag

SEQ ID NO: 9483245 - DNA, 22 bp, Homo sapiens
ataggcaagcacaaagtcagga

SEQ ID NO: 9483246 - DNA, 22 bp, Homo sapiens
atagaccttctacacaggacaa

SEQ ID NO: 9483247 - DNA, 22 bp, Homo sapiens
atagaccctggaaatggcagag

SEQ ID NO: 9483248 - DNA, 23 bp, Homo sapiens
atagacccaagagtaaaggcatc

SEQ ID NO: 9483249 - DNA, 22 bp, Homo sapiens
ataggcatcacctaggagcttg

SEQ ID NO: 9483250 - DNA, 22 bp, Homo sapiens
atagggcagtggcatctcttaa

SEQ ID NO: 9483251 - DNA, 22 bp, Homo sapiens
atagtaactggcatgtttatga

SEQ ID NO: 9483252 - DNA, 22 bp, Homo sapiens
atagtaactggcatgtttatga

SEQ ID NO: 9483253 - DNA, 22 bp, Homo sapiens
atagtaaattatcgtggagaga

SEQ ID NO: 9483254 - DNA, 22 bp, Homo sapiens
ataggtttgggaattaggcaga

SEQ ID NO: 9483255 - DNA, 22 bp, Homo sapiens
ataggtctgaaagtgtatcctg

SEQ ID NO: 9483256 - DNA, 21 bp, Homo sapiens
ataggtaacccagcagacttg

SEQ ID NO: 9483257 - DNA, 22 bp, Homo sapiens
ataggtacagcagatattctta

SEQ ID NO: 9483258 - DNA, 22 bp, Homo sapiens
ataggtaaatgtgtgccacggt

SEQ ID NO: 9483259 - DNA, 22 bp, Homo sapiens
atagtacacatcctacaatgtt

SEQ ID NO: 9483260 - DNA, 22 bp, Homo sapiens
atagtacacatcctacaatgtt

SEQ ID NO: 9483261 - DNA, 22 bp, Homo sapiens
atagtacacatcctacaatgtt

SEQ ID NO: 9483262 - DNA, 20 bp, Homo sapiens
atagtaatgaagtcttgttc

SEQ ID NO: 9483263 - DNA, 22 bp, Homo sapiens
atagtacaatcagttaattagt

SEQ ID NO: 9483264 - DNA, 22 bp, Homo sapiens
atagtacaagggaagagtgaag

SEQ ID NO: 9483265 - DNA, 22 bp, Homo sapiens
atagtacaatcagttaattagt

SEQ ID NO: 9483266 - DNA, 22 bp, Homo sapiens
atagtacaatcagttaattagt

SEQ ID NO: 9483267 - DNA, 22 bp, Homo sapiens
atagaattctttgaaatttatg

SEQ ID NO: 9483268 - DNA, 22 bp, Homo sapiens
atagaattcgtgtttgtaattc

SEQ ID NO: 9483269 - DNA, 22 bp, Homo sapiens
atagaattcgtgtttgtaattc

SEQ ID NO: 9483270 - DNA, 22 bp, Homo sapiens
atagaattcgtgtttgtaattc

SEQ ID NO: 9483271 - DNA, 22 bp, Homo sapiens
atagaattcgtgtttgtaattc

SEQ ID NO: 9483272 - DNA, 22 bp, Homo sapiens
atagaattcgtgtttgtaattc

SEQ ID NO: 9483273 - DNA, 22 bp, Homo sapiens
atagaatgtattatagtacaga

SEQ ID NO: 9483274 - DNA, 22 bp, Homo sapiens
atagaatgtattatagtacaga

SEQ ID NO: 9483275 - DNA, 22 bp, Homo sapiens
atagaatttgcactaaatctgc

SEQ ID NO: 9483276 - DNA, 22 bp, Homo sapiens
atagaattctttgaaatttatg

SEQ ID NO: 9483277 - DNA, 22 bp, Homo sapiens
atagacaaacacgaagatgaca

SEQ ID NO: 9483278 - DNA, 22 bp, Homo sapiens
atagacaaacacgaagatgaca

SEQ ID NO: 9483279 - DNA, 22 bp, Homo sapiens
atagacaaacacgaagatgaca

SEQ ID NO: 9483280 - DNA, 20 bp, Homo sapiens
atagacaaagacatgccaga

SEQ ID NO: 9483281 - DNA, 22 bp, Homo sapiens
atagacagaaagataatagaat

SEQ ID NO: 9483282 - DNA, 22 bp, Homo sapiens
atagacagaaagataatagaat

SEQ ID NO: 9483283 - DNA, 22 bp, Homo sapiens
atagacagcgcattaaaaatgt

SEQ ID NO: 9483284 - DNA, 22 bp, Homo sapiens
atagacagatgatagataaatc

SEQ ID NO: 9483285 - DNA, 22 bp, Homo sapiens
atagacaatggtttgccaagaa

SEQ ID NO: 9483286 - DNA, 22 bp, Homo sapiens
atagacaatggtttgccaagaa

SEQ ID NO: 9483287 - DNA, 22 bp, Homo sapiens
atagacaatggtttgccaagaa

SEQ ID NO: 9483288 - DNA, 22 bp, Homo sapiens
atagacaatggtttgccaagaa

SEQ ID NO: 9483289 - DNA, 22 bp, Homo sapiens
atagacaacacttattattcct

SEQ ID NO: 9483290 - DNA, 22 bp, Homo sapiens
atagacaacacttattattcct

SEQ ID NO: 9483291 - DNA, 22 bp, Homo sapiens
atagacatggtcttttgtcatt

SEQ ID NO: 9483292 - DNA, 22 bp, Homo sapiens
atagacatggtcttttgtcatt

SEQ ID NO: 9483293 - DNA, 22 bp, Homo sapiens
atagacatgcaacactttttac

SEQ ID NO: 9483294 - DNA, 22 bp, Homo sapiens
atagacatagccgtaatttatt

SEQ ID NO: 9483295 - DNA, 22 bp, Homo sapiens
atagacatagccgtaatttatt

SEQ ID NO: 9483296 - DNA, 22 bp, Homo sapiens
atagacatatggctttgtttct

SEQ ID NO: 9483297 - DNA, 22 bp, Homo sapiens
atagaatagcatagaaaattga

SEQ ID NO: 9483298 - DNA, 22 bp, Homo sapiens
atagaatatgacttttagatcc

SEQ ID NO: 9483299 - DNA, 22 bp, Homo sapiens
atagaatatgacttttagatcc

SEQ ID NO: 9483300 - DNA, 22 bp, Homo sapiens
atagaatagcatagaaaattga

SEQ ID NO: 9483301 - DNA, 22 bp, Homo sapiens
atagaatagcatagaaaattga

SEQ ID NO: 9483302 - DNA, 22 bp, Homo sapiens
atagaatagcatagaaaattga

SEQ ID NO: 9483303 - DNA, 22 bp, Homo sapiens
atagaatatgacttttagatcc

SEQ ID NO: 9483304 - DNA, 22 bp, Homo sapiens
atagaatatgacttttagatcc

SEQ ID NO: 9483305 - DNA, 22 bp, Homo sapiens
atagaatatgacttttagatcc

SEQ ID NO: 9483306 - DNA, 22 bp, Homo sapiens
atagaatatgacttttagatcc

SEQ ID NO: 9483307 - DNA, 22 bp, Homo sapiens
atagaaaggtctttggcagaca

SEQ ID NO: 9483308 - DNA, 22 bp, Homo sapiens
atagaaatggcagctggtgcta

SEQ ID NO: 9483309 - DNA, 22 bp, Homo sapiens
atagaaatggcagctggtgcta

SEQ ID NO: 9483310 - DNA, 19 bp, Homo sapiens
atagaaagggttaaagaca

SEQ ID NO: 9483311 - DNA, 19 bp, Homo sapiens
atagaaagggttaaagaca

SEQ ID NO: 9483312 - DNA, 19 bp, Homo sapiens
atagaaagggttaaagaca

SEQ ID NO: 9483313 - DNA, 22 bp, Homo sapiens
atacttttaattccttctgagt

SEQ ID NO: 9483314 - DNA, 22 bp, Homo sapiens
atacttttaattccttctgagt

SEQ ID NO: 9483315 - DNA, 22 bp, Homo sapiens
atactttgctacattgtacatt

SEQ ID NO: 9483316 - DNA, 21 bp, Homo sapiens
atactttgaattacagccttg

SEQ ID NO: 9483317 - DNA, 22 bp, Homo sapiens
atagaaaacagatgtccttaaa

SEQ ID NO: 9483318 - DNA, 22 bp, Homo sapiens
atagaaaacagatgtccttaaa

SEQ ID NO: 9483319 - DNA, 22 bp, Homo sapiens
atagaaacagggaagcaaagca

SEQ ID NO: 9483320 - DNA, 22 bp, Homo sapiens
atagaaacagggaagcaaagca

SEQ ID NO: 9483321 - DNA, 22 bp, Homo sapiens
atagaaacagggaagcaaagca

SEQ ID NO: 9483322 - DNA, 22 bp, Homo sapiens
ctggccaggcttgggacagaca

SEQ ID NO: 9483323 - DNA, 22 bp, Homo sapiens
ctggccaggcttgggacagaca

SEQ ID NO: 9483324 - DNA, 22 bp, Homo sapiens
ctggccaggcttgggacagaca

SEQ ID NO: 9483325 - DNA, 22 bp, Homo sapiens
ctggccagggtgcgatcgtggt

SEQ ID NO: 9483326 - DNA, 22 bp, Homo sapiens
ctggccaggcttgggacagaca

SEQ ID NO: 9483327 - DNA, 22 bp, Homo sapiens
ctggccagggtgcgatcgtggt

SEQ ID NO: 9483328 - DNA, 22 bp, Homo sapiens
ctggccagggtgcgatcgtggt

SEQ ID NO: 9483329 - DNA, 22 bp, Homo sapiens
ctggccagggtgcgatcgtggt

SEQ ID NO: 9483330 - DNA, 22 bp, Homo sapiens
ctggccaggttttgaacagttg

SEQ ID NO: 9483331 - DNA, 22 bp, Homo sapiens
ctggccaggttttgaacagttg

SEQ ID NO: 9483332 - DNA, 22 bp, Homo sapiens
ctggccaggttttgaacagttg

SEQ ID NO: 9483333 - DNA, 22 bp, Homo sapiens
ctggccaggttttgaacagttg

SEQ ID NO: 9483334 - DNA, 22 bp, Homo sapiens
ctggccagtgactgctcacccg

SEQ ID NO: 9483335 - DNA, 22 bp, Homo sapiens
ctggccagtgcctgtgggcccc

SEQ ID NO: 9483336 - DNA, 22 bp, Homo sapiens
ctggccagtgcctgtgggcccc

SEQ ID NO: 9483337 - DNA, 22 bp, Homo sapiens
ctggccagtgactgctcacccg

SEQ ID NO: 9483338 - DNA, 22 bp, Homo sapiens
ctggccagtgactgctcacccg

SEQ ID NO: 9483339 - DNA, 22 bp, Homo sapiens
ctggagcttattgggagcagaa

SEQ ID NO: 9483340 - DNA, 21 bp, Homo sapiens
ctggagcttggtgagaagtgt

SEQ ID NO: 9483341 - DNA, 22 bp, Homo sapiens
ctggagcttattgggagcagaa

SEQ ID NO: 9483342 - DNA, 22 bp, Homo sapiens
ctggagcttattgggagcagaa

SEQ ID NO: 9483343 - DNA, 22 bp, Homo sapiens
ctggccaggctctcacgtggtc

SEQ ID NO: 9483344 - DNA, 22 bp, Homo sapiens
ctggccagaggttcctctgccc

SEQ ID NO: 9483345 - DNA, 22 bp, Homo sapiens
ctggccaggctctcacgtggtc

SEQ ID NO: 9483346 - DNA, 22 bp, Homo sapiens
ctggccaggctctcacgtggtc

SEQ ID NO: 9483347 - DNA, 22 bp, Homo sapiens
ctggccagaggttcctctgccc

SEQ ID NO: 9483348 - DNA, 22 bp, Homo sapiens
ctggccagaggttcctctgccc

SEQ ID NO: 9483349 - DNA, 22 bp, Homo sapiens
ctggccagaggttcctctgccc

SEQ ID NO: 9483350 - DNA, 22 bp, Homo sapiens
ctggccaggctctcacgtggtc

SEQ ID NO: 9483351 - DNA, 22 bp, Homo sapiens
ctggccagaggttcctctgccc

SEQ ID NO: 9483352 - DNA, 22 bp, Homo sapiens
atacagaagcctgtatttctgg

SEQ ID NO: 9483353 - DNA, 21 bp, Homo sapiens
atacagaaggtggcaaagtac

SEQ ID NO: 9483354 - DNA, 22 bp, Homo sapiens
atacagaagcctgtatttctgg

SEQ ID NO: 9483355 - DNA, 22 bp, Homo sapiens
atacagaagcctgtatttctgg

SEQ ID NO: 9483356 - DNA, 22 bp, Homo sapiens
atacagaagcctgtatttctgg

SEQ ID NO: 9483357 - DNA, 22 bp, Homo sapiens
atacagaagacccctccgtcat

SEQ ID NO: 9483358 - DNA, 19 bp, Homo sapiens
ctggaaagttggcagtgag

SEQ ID NO: 9483359 - DNA, 21 bp, Homo sapiens
atacagaaggtggcaaagtac

SEQ ID NO: 9483360 - DNA, 21 bp, Homo sapiens
atacagaaggtggcaaagtac

SEQ ID NO: 9483361 - DNA, 22 bp, Homo sapiens
ctggaacaagtggccttgcaag

SEQ ID NO: 9483362 - DNA, 21 bp, Homo sapiens
ctggaacaaatactagcaaac

SEQ ID NO: 9483363 - DNA, 21 bp, Homo sapiens
ctggaacaaatactagcaaac

SEQ ID NO: 9483364 - DNA, 22 bp, Homo sapiens
ctggaagaactccagttctgtg

SEQ ID NO: 9483365 - DNA, 22 bp, Homo sapiens
ctggaagaactccagttctgtg

SEQ ID NO: 9483366 - DNA, 22 bp, Homo sapiens
ctggaagaactccagttctgtg

SEQ ID NO: 9483367 - DNA, 22 bp, Homo sapiens
ctggaagaactccagttctgtg

SEQ ID NO: 9483368 - DNA, 22 bp, Homo sapiens
ctggaagaactccagttctgtg

SEQ ID NO: 9483369 - DNA, 21 bp, Homo sapiens
ctggaagaagcagcaggattc

SEQ ID NO: 9483370 - DNA, 22 bp, Homo sapiens
ctggaacccaggcctggaagcc

SEQ ID NO: 9483371 - DNA, 23 bp, Homo sapiens
ctggaacatagtagatggtcaga

SEQ ID NO: 9483372 - DNA, 23 bp, Homo sapiens
ctggaacatagtagatggtcaga

SEQ ID NO: 9483373 - DNA, 22 bp, Homo sapiens
ctggaacagtgttggagcttga

SEQ ID NO: 9483374 - DNA, 23 bp, Homo sapiens
ctggaacatagtagatggtcaga

SEQ ID NO: 9483375 - DNA, 22 bp, Homo sapiens
ctggaacagtgttggagcttga

SEQ ID NO: 9483376 - DNA, 22 bp, Homo sapiens
ctggaacagtgttggagcttga

SEQ ID NO: 9483377 - DNA, 22 bp, Homo sapiens
ctggaacacctgagttaccact

SEQ ID NO: 9483378 - DNA, 22 bp, Homo sapiens
ctggaacagaagcactggagag

SEQ ID NO: 9483379 - DNA, 22 bp, Homo sapiens
ctggaacagaagcactggagag

SEQ ID NO: 9483380 - DNA, 22 bp, Homo sapiens
ctggaacagaagcactggagag

SEQ ID NO: 9483381 - DNA, 21 bp, Homo sapiens
ctggaagaagcagcaggattc

SEQ ID NO: 9483382 - DNA, 22 bp, Homo sapiens
ctggaagaccccccaggactca

SEQ ID NO: 9483383 - DNA, 22 bp, Homo sapiens
ctggaagacgtttgaagccatg

SEQ ID NO: 9483384 - DNA, 22 bp, Homo sapiens
ctggaagacgtttgaagccatg

SEQ ID NO: 9483385 - DNA, 22 bp, Homo sapiens
ctggaagacgtttgaagccatg

SEQ ID NO: 9483386 - DNA, 22 bp, Homo sapiens
atacatatatggtacttcctgg

SEQ ID NO: 9483387 - DNA, 22 bp, Homo sapiens
atacatatatggtacttcctgg

SEQ ID NO: 9483388 - DNA, 22 bp, Homo sapiens
atacatctcatgtaagagataa

SEQ ID NO: 9483389 - DNA, 22 bp, Homo sapiens
atacatctatgcctttctgaca

SEQ ID NO: 9483390 - DNA, 22 bp, Homo sapiens
atacatgaggaggctggaaaca

SEQ ID NO: 9483391 - DNA, 22 bp, Homo sapiens
atacatgaggaggctggaaaca

SEQ ID NO: 9483392 - DNA, 22 bp, Homo sapiens
atacatcttgtcagattcatgt

SEQ ID NO: 9483393 - DNA, 22 bp, Homo sapiens
atacatcttgtcagattcatgt

SEQ ID NO: 9483394 - DNA, 22 bp, Homo sapiens
atacatgacactgggctacagg

SEQ ID NO: 9483395 - DNA, 22 bp, Homo sapiens
atacatctcatgtaagagataa

SEQ ID NO: 9483396 - DNA, 22 bp, Homo sapiens
atacatctcatgtaagagataa

SEQ ID NO: 9483397 - DNA, 22 bp, Homo sapiens
atacatctcatgtaagagataa

SEQ ID NO: 9483398 - DNA, 22 bp, Homo sapiens
atacatcttccttttaaaatgc

SEQ ID NO: 9483399 - DNA, 22 bp, Homo sapiens
atacatcttccttttaaaatgc

SEQ ID NO: 9483400 - DNA, 22 bp, Homo sapiens
ctggagctggcttccttccact

SEQ ID NO: 9483401 - DNA, 22 bp, Homo sapiens
ctggagctggcccaggctggcc

SEQ ID NO: 9483402 - DNA, 22 bp, Homo sapiens
ctggagctggcttccttccact

SEQ ID NO: 9483403 - DNA, 22 bp, Homo sapiens
ctggagctggtatagggacaaa

SEQ ID NO: 9483404 - DNA, 22 bp, Homo sapiens
ctggagctggtatagggacaaa

SEQ ID NO: 9483405 - DNA, 22 bp, Homo sapiens
atacatgatacttagtacgtag

SEQ ID NO: 9483406 - DNA, 22 bp, Homo sapiens
atacatgatcactgtattataa

SEQ ID NO: 9483407 - DNA, 22 bp, Homo sapiens
ctggagctggcccaggctggcc

SEQ ID NO: 9483408 - DNA, 22 bp, Homo sapiens
ctggagctggcccaggctggcc

SEQ ID NO: 9483409 - DNA, 22 bp, Homo sapiens
ctggagctgccagggctgccgc

SEQ ID NO: 9483410 - DNA, 20 bp, Homo sapiens
atacacattcatagaaaaat

SEQ ID NO: 9483411 - DNA, 22 bp, Homo sapiens
ataatttacaactgcttttaat

SEQ ID NO: 9483412 - DNA, 22 bp, Homo sapiens
ataatttacaactgcttttaat

SEQ ID NO: 9483413 - DNA, 22 bp, Homo sapiens
ataatttacaactgcttttaat

SEQ ID NO: 9483414 - DNA, 20 bp, Homo sapiens
ataatttaccctgcaccact

SEQ ID NO: 9483415 - DNA, 20 bp, Homo sapiens
ataatttaccctgcaccact

SEQ ID NO: 9483416 - DNA, 22 bp, Homo sapiens
ataatttaattttcacagtggt

SEQ ID NO: 9483417 - DNA, 22 bp, Homo sapiens
ataatttacaactgcttttaat

SEQ ID NO: 9483418 - DNA, 22 bp, Homo sapiens
ataatttaaattagtatgtgat

SEQ ID NO: 9483419 - DNA, 22 bp, Homo sapiens
ataatttaattttcacagtggt

SEQ ID NO: 9483420 - DNA, 22 bp, Homo sapiens
ataatttaattttcacagtggt

SEQ ID NO: 9483421 - DNA, 22 bp, Homo sapiens
ataatttaattttcacagtggt

SEQ ID NO: 9483422 - DNA, 22 bp, Homo sapiens
ataatttaattttcacagtggt

SEQ ID NO: 9483423 - DNA, 22 bp, Homo sapiens
atacagaagaactatagccact

SEQ ID NO: 9483424 - DNA, 22 bp, Homo sapiens
atacagaagaactatagccact

SEQ ID NO: 9483425 - DNA, 22 bp, Homo sapiens
atacagaagaactatagccact

SEQ ID NO: 9483426 - DNA, 22 bp, Homo sapiens
atacagaagaactatagccact

SEQ ID NO: 9483427 - DNA, 22 bp, Homo sapiens
atacagaactctcagttgtata

SEQ ID NO: 9483428 - DNA, 22 bp, Homo sapiens
atacagaactctcagttgtata

SEQ ID NO: 9483429 - DNA, 22 bp, Homo sapiens
atacagaactctcagttgtata

SEQ ID NO: 9483430 - DNA, 21 bp, Homo sapiens
atacagaacattgatccaaga

SEQ ID NO: 9483431 - DNA, 21 bp, Homo sapiens
atacagaacattgatccaaga

SEQ ID NO: 9483432 - DNA, 21 bp, Homo sapiens
atacagaacattgatccaaga

SEQ ID NO: 9483433 - DNA, 22 bp, Homo sapiens
atacagaaaagtggatagccag

SEQ ID NO: 9483434 - DNA, 22 bp, Homo sapiens
atacactttagaaaaacgctgc

SEQ ID NO: 9483435 - DNA, 20 bp, Homo sapiens
atacacattcatagaaaaat

SEQ ID NO: 9483436 - DNA, 22 bp, Homo sapiens
atacactttagaaaaacgctgc

SEQ ID NO: 9483437 - DNA, 22 bp, Homo sapiens
atacagaaaatgatgcagagtt

SEQ ID NO: 9483438 - DNA, 22 bp, Homo sapiens
atacagaaaatgatgcagagtt

SEQ ID NO: 9483439 - DNA, 22 bp, Homo sapiens
atacagaaaatgatgcagagtt

SEQ ID NO: 9483440 - DNA, 22 bp, Homo sapiens
atacagaacaagcctcacctcc

SEQ ID NO: 9483441 - DNA, 22 bp, Homo sapiens
ataatgtgttcatcttacaatt

SEQ ID NO: 9483442 - DNA, 22 bp, Homo sapiens
ataatgtgatatttcatttaca

SEQ ID NO: 9483443 - DNA, 22 bp, Homo sapiens
ataatcattcacataaggtgct

SEQ ID NO: 9483444 - DNA, 22 bp, Homo sapiens
ataatcattcacataaggtgct

SEQ ID NO: 9483445 - DNA, 22 bp, Homo sapiens
ataatcagaattcatgaaagat

SEQ ID NO: 9483446 - DNA, 21 bp, Homo sapiens
ataatgtacaaaaactgtctt

SEQ ID NO: 9483447 - DNA, 21 bp, Homo sapiens
ataatgtacaaaaactgtctt

SEQ ID NO: 9483448 - DNA, 21 bp, Homo sapiens
ataatgtacaaaaactgtctt

SEQ ID NO: 9483449 - DNA, 22 bp, Homo sapiens
ataatgtaaggctccctacagt

SEQ ID NO: 9483450 - DNA, 21 bp, Homo sapiens
ataatgtacaaaaactgtctt

SEQ ID NO: 9483451 - DNA, 22 bp, Homo sapiens
ataattatctcagacacttgtt

SEQ ID NO: 9483452 - DNA, 20 bp, Homo sapiens
ataattatttacttttgtgc

SEQ ID NO: 9483453 - DNA, 20 bp, Homo sapiens
ataattatttacttttgtgc

SEQ ID NO: 9483454 - DNA, 20 bp, Homo sapiens
ataattatttacttttgtgc

SEQ ID NO: 9483455 - DNA, 22 bp, Homo sapiens
ataatttaaattagtatgtgat

SEQ ID NO: 9483456 - DNA, 22 bp, Homo sapiens
ataatttaaattagtatgtgat

SEQ ID NO: 9483457 - DNA, 22 bp, Homo sapiens
ataattctccaatttttgttgt

SEQ ID NO: 9483458 - DNA, 22 bp, Homo sapiens
ataattctccaatttttgttgt

SEQ ID NO: 9483459 - DNA, 22 bp, Homo sapiens
ataattatctcagacacttgtt

SEQ ID NO: 9483460 - DNA, 22 bp, Homo sapiens
ataattatctcagacacttgtt

SEQ ID NO: 9483461 - DNA, 22 bp, Homo sapiens
ataattacattatactgttaga

SEQ ID NO: 9483462 - DNA, 22 bp, Homo sapiens
ataattatctcagacacttgtt

SEQ ID NO: 9483463 - DNA, 22 bp, Homo sapiens
ataattaatttcagtaatctcc

SEQ ID NO: 9483464 - DNA, 22 bp, Homo sapiens
ataatgtttttgtataagcatg

SEQ ID NO: 9483465 - DNA, 21 bp, Homo sapiens
ctgataattgttaaattattt

SEQ ID NO: 9483466 - DNA, 22 bp, Homo sapiens
ctgagttctgcccaaggtctgg

SEQ ID NO: 9483467 - DNA, 22 bp, Homo sapiens
ctgagtgaggggagcttgatgg

SEQ ID NO: 9483468 - DNA, 22 bp, Homo sapiens
ctgagtgatagcgatggggaac

SEQ ID NO: 9483469 - DNA, 22 bp, Homo sapiens
ctgagtgatcagcttgggtccg

SEQ ID NO: 9483470 - DNA, 22 bp, Homo sapiens
ctgagtggaacataggatgata

SEQ ID NO: 9483471 - DNA, 22 bp, Homo sapiens
ctgataatttgctgactttcag

SEQ ID NO: 9483472 - DNA, 22 bp, Homo sapiens
ctgatacaatgctaataaattt

SEQ ID NO: 9483473 - DNA, 21 bp, Homo sapiens
ctgataattgttaaattattt

SEQ ID NO: 9483474 - DNA, 22 bp, Homo sapiens
ctgatagacaatcaccatggga

SEQ ID NO: 9483475 - DNA, 22 bp, Homo sapiens
ctgatagacaatcaccatggga

SEQ ID NO: 9483476 - DNA, 22 bp, Homo sapiens
ctgatacatagtagcatgtcat

SEQ ID NO: 9483477 - DNA, 22 bp, Homo sapiens
agttttattccaatgtgcagca

SEQ ID NO: 9483478 - DNA, 20 bp, Homo sapiens
agtttgtgtgtctatgcgct

SEQ ID NO: 9483479 - DNA, 22 bp, Homo sapiens
agtttgtatgccaacagcaaag

SEQ ID NO: 9483480 - DNA, 22 bp, Homo sapiens
agtttgtatgccaacagcaaag

SEQ ID NO: 9483481 - DNA, 22 bp, Homo sapiens
agtttgtatgccaacagcaaag

SEQ ID NO: 9483482 - DNA, 22 bp, Homo sapiens
agttttatgttcacagaaggat

SEQ ID NO: 9483483 - DNA, 22 bp, Homo sapiens
ctgatattctattttgcttgct

SEQ ID NO: 9483484 - DNA, 23 bp, Homo sapiens
agtttcacattttacatgtggct

SEQ ID NO: 9483485 - DNA, 22 bp, Homo sapiens
agtttcacatagctcagtgctc

SEQ ID NO: 9483486 - DNA, 22 bp, Homo sapiens
agtttcacagtctgtcattgtt

SEQ ID NO: 9483487 - DNA, 22 bp, Homo sapiens
agtttcactaaggtctgtgtgt

SEQ ID NO: 9483488 - DNA, 22 bp, Homo sapiens
agtttcatattaccatgtcacc

SEQ ID NO: 9483489 - DNA, 22 bp, Homo sapiens
agtttcatccgatctggtctca

SEQ ID NO: 9483490 - DNA, 22 bp, Homo sapiens
agtttctatgtaagctacgtga

SEQ ID NO: 9483491 - DNA, 22 bp, Homo sapiens
agtttctatgtaagctacgtga

SEQ ID NO: 9483492 - DNA, 22 bp, Homo sapiens
agtttctagcctcactgtttag

SEQ ID NO: 9483493 - DNA, 22 bp, Homo sapiens
agtttctagcctcactgtttag

SEQ ID NO: 9483494 - DNA, 22 bp, Homo sapiens
agtttctctcagtatagaatag

SEQ ID NO: 9483495 - DNA, 22 bp, Homo sapiens
agtttctcttaatctagtatct

SEQ ID NO: 9483496 - DNA, 22 bp, Homo sapiens
agtttctctcagtatagaatag

SEQ ID NO: 9483497 - DNA, 22 bp, Homo sapiens
agtttctctagagtctttgaaa

SEQ ID NO: 9483498 - DNA, 22 bp, Homo sapiens
agtttctctagagtctttgaaa

SEQ ID NO: 9483499 - DNA, 22 bp, Homo sapiens
agtttcttggtcacagttttca

SEQ ID NO: 9483500 - DNA, 22 bp, Homo sapiens
agtttcttgccgtgctttccat

SEQ ID NO: 9483501 - DNA, 22 bp, Homo sapiens
agtttcttgaagactgatgttt

SEQ ID NO: 9483502 - DNA, 22 bp, Homo sapiens
agtttctttagatagaaagttc

SEQ ID NO: 9483503 - DNA, 22 bp, Homo sapiens
agtttctttagatagaaagttc

SEQ ID NO: 9483504 - DNA, 22 bp, Homo sapiens
agtttcttgaagactgatgttt

SEQ ID NO: 9483505 - DNA, 22 bp, Homo sapiens
agtttcttgaagactgatgttt

SEQ ID NO: 9483506 - DNA, 22 bp, Homo sapiens
agtttcttgccgtgctttccat

SEQ ID NO: 9483507 - DNA, 22 bp, Homo sapiens
agtttctttagatagaaagttc

SEQ ID NO: 9483508 - DNA, 22 bp, Homo sapiens
agtttcttattcttagttatgt

SEQ ID NO: 9483509 - DNA, 22 bp, Homo sapiens
agtttcttcatccaaaaaatgg

SEQ ID NO: 9483510 - DNA, 22 bp, Homo sapiens
agtttcttcatccaaaaaatgg

SEQ ID NO: 9483511 - DNA, 22 bp, Homo sapiens
agtttctctttgacaccaaaat

SEQ ID NO: 9483512 - DNA, 22 bp, Homo sapiens
agtttctcttaatctagtatct

SEQ ID NO: 9483513 - DNA, 22 bp, Homo sapiens
agtttatttctccatttaccta

SEQ ID NO: 9483514 - DNA, 22 bp, Homo sapiens
agtttatttttgataagtcttg

SEQ ID NO: 9483515 - DNA, 22 bp, Homo sapiens
agtttatttctccatttaccta

SEQ ID NO: 9483516 - DNA, 22 bp, Homo sapiens
agtttatttctccatttaccta

SEQ ID NO: 9483517 - DNA, 17 bp, Homo sapiens
agtttatttagccttct

SEQ ID NO: 9483518 - DNA, 17 bp, Homo sapiens
agtttatttagccttct

SEQ ID NO: 9483519 - DNA, 22 bp, Homo sapiens
agtttatttctccatttaccta

SEQ ID NO: 9483520 - DNA, 17 bp, Homo sapiens
agtttatttagccttct

SEQ ID NO: 9483521 - DNA, 22 bp, Homo sapiens
agtttcacagagggttagacgc

SEQ ID NO: 9483522 - DNA, 22 bp, Homo sapiens
agtttcacagagggttagacgc

SEQ ID NO: 9483523 - DNA, 22 bp, Homo sapiens
agtttcacacaacatttgcatg

SEQ ID NO: 9483524 - DNA, 22 bp, Homo sapiens
agtttatttttgataagtcttg

SEQ ID NO: 9483525 - DNA, 22 bp, Homo sapiens
agtttatttttgataagtcttg

SEQ ID NO: 9483526 - DNA, 22 bp, Homo sapiens
agtttattctctggtcttagta

SEQ ID NO: 9483527 - DNA, 22 bp, Homo sapiens
agtttattctctggtcttagta

SEQ ID NO: 9483528 - DNA, 22 bp, Homo sapiens
agtttattctctggtcttagta

SEQ ID NO: 9483529 - DNA, 20 bp, Homo sapiens
agtttattccaggagaactg

SEQ ID NO: 9483530 - DNA, 20 bp, Homo sapiens
agtttattccaggagaactg

SEQ ID NO: 9483531 - DNA, 20 bp, Homo sapiens
agtttattccaggagaactg

SEQ ID NO: 9483532 - DNA, 22 bp, Homo sapiens
agtttattctgcttggccctcc

SEQ ID NO: 9483533 - DNA, 22 bp, Homo sapiens
agtttattctgcttggccctcc

SEQ ID NO: 9483534 - DNA, 17 bp, Homo sapiens
agtttatttagccttct

SEQ ID NO: 9483535 - DNA, 22 bp, Homo sapiens
agtttattgtatatggtagttt

SEQ ID NO: 9483536 - DNA, 22 bp, Homo sapiens
agtttattgtatatggtagttt

SEQ ID NO: 9483537 - DNA, 22 bp, Homo sapiens
agtgttagtggctgcagctggt

SEQ ID NO: 9483538 - DNA, 22 bp, Homo sapiens
agtgttcagtgattgtcaaccg

SEQ ID NO: 9483539 - DNA, 23 bp, Homo sapiens
agtgttcagcatgtagtaaatac

SEQ ID NO: 9483540 - DNA, 22 bp, Homo sapiens
agtgttcaggatctgaggccag

SEQ ID NO: 9483541 - DNA, 23 bp, Homo sapiens
agtgttcagcatgtagtaaatac

SEQ ID NO: 9483542 - DNA, 23 bp, Homo sapiens
agtgttcagcatgtagtaaatac

SEQ ID NO: 9483543 - DNA, 22 bp, Homo sapiens
agtgttcactctgtggagccca

SEQ ID NO: 9483544 - DNA, 22 bp, Homo sapiens
agtgttatttttcaaaggccct

SEQ ID NO: 9483545 - DNA, 22 bp, Homo sapiens
agtgttactggttcatgaatct

SEQ ID NO: 9483546 - DNA, 22 bp, Homo sapiens
agtgttaatggtgtatattagg

SEQ ID NO: 9483547 - DNA, 21 bp, Homo sapiens
agtgttaatggaaattatatt

SEQ ID NO: 9483548 - DNA, 21 bp, Homo sapiens
agtgttaatggaaattatatt

SEQ ID NO: 9483549 - DNA, 22 bp, Homo sapiens
agtgttaatggtgtatattagg

SEQ ID NO: 9483550 - DNA, 22 bp, Homo sapiens
agtgttaatggtgtatattagg

SEQ ID NO: 9483551 - DNA, 22 bp, Homo sapiens
agtgttaagagaaaattctgct

SEQ ID NO: 9483552 - DNA, 22 bp, Homo sapiens
agtgttaaggctggttgctata

SEQ ID NO: 9483553 - DNA, 18 bp, Homo sapiens
agtgttaagtaagtagca

SEQ ID NO: 9483554 - DNA, 22 bp, Homo sapiens
agtgttaatatctggccctagg

SEQ ID NO: 9483555 - DNA, 18 bp, Homo sapiens
agtgttaagtaagtagca

SEQ ID NO: 9483556 - DNA, 22 bp, Homo sapiens
ctgagaggcggaggttgcagtg

SEQ ID NO: 9483557 - DNA, 22 bp, Homo sapiens
agtgttaagagaaaattctgct

SEQ ID NO: 9483558 - DNA, 22 bp, Homo sapiens
ctgagaggcggaggttgcagtg

SEQ ID NO: 9483559 - DNA, 22 bp, Homo sapiens
ctgagaggcggaggttgcagtg

SEQ ID NO: 9483560 - DNA, 22 bp, Homo sapiens
agtgttaagagaaaattctgct

SEQ ID NO: 9483561 - DNA, 19 bp, Homo sapiens
agtttattataggtgattc

SEQ ID NO: 9483562 - DNA, 19 bp, Homo sapiens
agtttattataggtgattc

SEQ ID NO: 9483563 - DNA, 19 bp, Homo sapiens
agtttattataggtgattc

SEQ ID NO: 9483564 - DNA, 22 bp, Homo sapiens
agtttatgttgtttataagcca

SEQ ID NO: 9483565 - DNA, 22 bp, Homo sapiens
agtttatgttgtttataagcca

SEQ ID NO: 9483566 - DNA, 21 bp, Homo sapiens
agtttacaactgtccagcccc

SEQ ID NO: 9483567 - DNA, 22 bp, Homo sapiens
agtttatgtaaaattagtaatg

SEQ ID NO: 9483568 - DNA, 22 bp, Homo sapiens
agtttatgtaaaattagtaatg

SEQ ID NO: 9483569 - DNA, 22 bp, Homo sapiens
agtttacaacagtagctatgga

SEQ ID NO: 9483570 - DNA, 22 bp, Homo sapiens
agtttacaacagtagctatgga

SEQ ID NO: 9483571 - DNA, 22 bp, Homo sapiens
agtgttccacacatctggggaa

SEQ ID NO: 9483572 - DNA, 22 bp, Homo sapiens
agtgttcatttattcattcact

SEQ ID NO: 9483573 - DNA, 22 bp, Homo sapiens
agtgttcatttattcattcact

SEQ ID NO: 9483574 - DNA, 22 bp, Homo sapiens
ataataaaccaggatgggtctg

SEQ ID NO: 9483575 - DNA, 22 bp, Homo sapiens
ataataaaccaggatgggtctg

SEQ ID NO: 9483576 - DNA, 22 bp, Homo sapiens
ataataaaccaggatgggtctg

SEQ ID NO: 9483577 - DNA, 22 bp, Homo sapiens
ataagtgtgtaaggcattctgt

SEQ ID NO: 9483578 - DNA, 22 bp, Homo sapiens
ataagtgctgtgctttaagact

SEQ ID NO: 9483579 - DNA, 22 bp, Homo sapiens
ataagtgcttgttgaataatag

SEQ ID NO: 9483580 - DNA, 22 bp, Homo sapiens
ataagtgcccaaaatgaaagga

SEQ ID NO: 9483581 - DNA, 22 bp, Homo sapiens
ataagtgttaggtaaacatctt

SEQ ID NO: 9483582 - DNA, 22 bp, Homo sapiens
ctgccctgtggctctgagtcat

SEQ ID NO: 9483583 - DNA, 22 bp, Homo sapiens
ctgccctgtggctctgagtcat

SEQ ID NO: 9483584 - DNA, 22 bp, Homo sapiens
ctgccctgtggttgtgggttct

SEQ ID NO: 9483585 - DNA, 22 bp, Homo sapiens
ctgccctgtggttgtgggttct

SEQ ID NO: 9483586 - DNA, 22 bp, Homo sapiens
ataagtgatatttagctataga

SEQ ID NO: 9483587 - DNA, 22 bp, Homo sapiens
ataagtgagaacaaaaattaga

SEQ ID NO: 9483588 - DNA, 22 bp, Homo sapiens
ctgccctgtgagggtccttggg

SEQ ID NO: 9483589 - DNA, 22 bp, Homo sapiens
ctgccctgtgagggtccttggg

SEQ ID NO: 9483590 - DNA, 22 bp, Homo sapiens
ctgccctgtgagggtccttggg

SEQ ID NO: 9483591 - DNA, 22 bp, Homo sapiens
ctgccctgtctttttctgatga

SEQ ID NO: 9483592 - DNA, 22 bp, Homo sapiens
ctgccctgtgagggtccttggg

SEQ ID NO: 9483593 - DNA, 22 bp, Homo sapiens
ctgccctgtgagggtccttggg

SEQ ID NO: 9483594 - DNA, 22 bp, Homo sapiens
ctgccctgtgagggtccttggg

SEQ ID NO: 9483595 - DNA, 22 bp, Homo sapiens
ctgccctgtgcacaggaaactg

SEQ ID NO: 9483596 - DNA, 22 bp, Homo sapiens
ctgccctgtgcacaggaaactg

SEQ ID NO: 9483597 - DNA, 22 bp, Homo sapiens
ctgccctgtggctctgagtcat

SEQ ID NO: 9483598 - DNA, 22 bp, Homo sapiens
ctgccctgtggctctgagtcat

SEQ ID NO: 9483599 - DNA, 22 bp, Homo sapiens
ctgccctgtggctctgagtcat

SEQ ID NO: 9483600 - DNA, 22 bp, Homo sapiens
ctgccctgtatcttctcccaat

SEQ ID NO: 9483601 - DNA, 22 bp, Homo sapiens
ctgccctgtatcttctcccaat

SEQ ID NO: 9483602 - DNA, 22 bp, Homo sapiens
ctgccctgtagctgttctagca

SEQ ID NO: 9483603 - DNA, 22 bp, Homo sapiens
ctgccctgtagctgttctagca

SEQ ID NO: 9483604 - DNA, 22 bp, Homo sapiens
ctgccctgtagctgttctagca

SEQ ID NO: 9483605 - DNA, 22 bp, Homo sapiens
ctgccctgtagctgttctagca

SEQ ID NO: 9483606 - DNA, 22 bp, Homo sapiens
ctgccctgtccttcccgccggc

SEQ ID NO: 9483607 - DNA, 22 bp, Homo sapiens
ctgccctgtatcttctcccaat

SEQ ID NO: 9483608 - DNA, 22 bp, Homo sapiens
ctgccctgtccttcccgccggc

SEQ ID NO: 9483609 - DNA, 22 bp, Homo sapiens
ctgccctgtatcttctcccaat

SEQ ID NO: 9483610 - DNA, 22 bp, Homo sapiens
ctgccctgtctgcagcctggct

SEQ ID NO: 9483611 - DNA, 22 bp, Homo sapiens
ctgccctgtctgcagcctggct

SEQ ID NO: 9483612 - DNA, 22 bp, Homo sapiens
ctgccctgtctttttctgatga

SEQ ID NO: 9483613 - DNA, 22 bp, Homo sapiens
ctgccctgtctttttctgatga

SEQ ID NO: 9483614 - DNA, 22 bp, Homo sapiens
ctgccctgtctgcagcctggct

SEQ ID NO: 9483615 - DNA, 22 bp, Homo sapiens
ctgccctgtctgcagcctggct

SEQ ID NO: 9483616 - DNA, 22 bp, Homo sapiens
ctgcctgctgccctccagagcc

SEQ ID NO: 9483617 - DNA, 22 bp, Homo sapiens
ctgcctgctgccctccagagcc

SEQ ID NO: 9483618 - DNA, 22 bp, Homo sapiens
ctgcctgctgccctccagagcc

SEQ ID NO: 9483619 - DNA, 22 bp, Homo sapiens
ctgcctgctgccctccagagcc

SEQ ID NO: 9483620 - DNA, 22 bp, Homo sapiens
ctgcctgctgcctgtggagggt

SEQ ID NO: 9483621 - DNA, 22 bp, Homo sapiens
ctgcctgctgccctccagagcc

SEQ ID NO: 9483622 - DNA, 22 bp, Homo sapiens
ctgcctgctgcctgtggagggt

SEQ ID NO: 9483623 - DNA, 23 bp, Homo sapiens
ctgcctgctggggagacagatct

SEQ ID NO: 9483624 - DNA, 22 bp, Homo sapiens
ctgcctgcttctgagccagagg

SEQ ID NO: 9483625 - DNA, 22 bp, Homo sapiens
ctgcctgcttttctgggagccg

SEQ ID NO: 9483626 - DNA, 22 bp, Homo sapiens
ataataatactgtgcaatggat

SEQ ID NO: 9483627 - DNA, 22 bp, Homo sapiens
ataataatgaaagccactgtgt

SEQ ID NO: 9483628 - DNA, 22 bp, Homo sapiens
ataataatgaaagccactgtgt

SEQ ID NO: 9483629 - DNA, 22 bp, Homo sapiens
ataataatactgtgcaatggat

SEQ ID NO: 9483630 - DNA, 22 bp, Homo sapiens
ataataacacctgaataggaaa

SEQ ID NO: 9483631 - DNA, 22 bp, Homo sapiens
ataataacaatgccagatgcct

SEQ ID NO: 9483632 - DNA, 22 bp, Homo sapiens
ataataaaccaggatgggtctg

SEQ ID NO: 9483633 - DNA, 22 bp, Homo sapiens
ataataaaccaggatgggtctg

SEQ ID NO: 9483634 - DNA, 22 bp, Homo sapiens
ataataaaccaggatgggtctg

SEQ ID NO: 9483635 - DNA, 22 bp, Homo sapiens
ataataatgaaagccactgtgt

SEQ ID NO: 9483636 - DNA, 22 bp, Homo sapiens
ataataatgaaagccactgtgt

SEQ ID NO: 9483637 - DNA, 23 bp, Homo sapiens
ataataattatggcagcaaagtg

SEQ ID NO: 9483638 - DNA, 23 bp, Homo sapiens
ataataattatggcagcaaagtg

SEQ ID NO: 9483639 - DNA, 23 bp, Homo sapiens
ataataattatggcagcaaagtg

SEQ ID NO: 9483640 - DNA, 22 bp, Homo sapiens
ctgcctgctctatccaggcctg

SEQ ID NO: 9483641 - DNA, 18 bp, Homo sapiens
ctgcctgctctccagctt

SEQ ID NO: 9483642 - DNA, 18 bp, Homo sapiens
ctgcctgctctccagctt

SEQ ID NO: 9483643 - DNA, 22 bp, Homo sapiens
agttttctgggatcactggaat

SEQ ID NO: 9483644 - DNA, 21 bp, Homo sapiens
agttttctgagttataaaata

SEQ ID NO: 9483645 - DNA, 21 bp, Homo sapiens
agttttctgagttataaaata

SEQ ID NO: 9483646 - DNA, 22 bp, Homo sapiens
agttttctgatgtgtagtgaga

SEQ ID NO: 9483647 - DNA, 22 bp, Homo sapiens
agttttctttcatctatcagca

SEQ ID NO: 9483648 - DNA, 22 bp, Homo sapiens
agttttctttcgcaaaggtaca

SEQ ID NO: 9483649 - DNA, 22 bp, Homo sapiens
agttttgaaatgaaatgtagtt

SEQ ID NO: 9483650 - DNA, 22 bp, Homo sapiens
agttttctgttctacaatttga

SEQ ID NO: 9483651 - DNA, 22 bp, Homo sapiens
agttttctgttctacaatttga

SEQ ID NO: 9483652 - DNA, 22 bp, Homo sapiens
agttttctttcatctatcagca

SEQ ID NO: 9483653 - DNA, 22 bp, Homo sapiens
agttttcctggtcacagcttgg

SEQ ID NO: 9483654 - DNA, 22 bp, Homo sapiens
agttttcctctcatttatcaat

SEQ ID NO: 9483655 - DNA, 22 bp, Homo sapiens
agttttcctctcatttatcaat

SEQ ID NO: 9483656 - DNA, 22 bp, Homo sapiens
agttttcctggtcacagcttgg

SEQ ID NO: 9483657 - DNA, 22 bp, Homo sapiens
agttttctcacatcaaaaatga

SEQ ID NO: 9483658 - DNA, 22 bp, Homo sapiens
agttttctcacatcaaaaatga

SEQ ID NO: 9483659 - DNA, 21 bp, Homo sapiens
agttttctgagttataaaata

SEQ ID NO: 9483660 - DNA, 22 bp, Homo sapiens
agttttcagtaaatattagtga

SEQ ID NO: 9483661 - DNA, 22 bp, Homo sapiens
agttttcagtaaatattagtga

SEQ ID NO: 9483662 - DNA, 22 bp, Homo sapiens
agttttcagtaaatattagtga

SEQ ID NO: 9483663 - DNA, 22 bp, Homo sapiens
agttttcagtaaatattagtga

SEQ ID NO: 9483664 - DNA, 22 bp, Homo sapiens
agttttcacactcaccaaaagg

SEQ ID NO: 9483665 - DNA, 22 bp, Homo sapiens
agttttcacactcaccaaaagg

SEQ ID NO: 9483666 - DNA, 22 bp, Homo sapiens
agttttcacactcaccaaaagg

SEQ ID NO: 9483667 - DNA, 22 bp, Homo sapiens
agttttcaatatatgatagtga

SEQ ID NO: 9483668 - DNA, 22 bp, Homo sapiens
agttttgatactttctcttcat

SEQ ID NO: 9483669 - DNA, 17 bp, Homo sapiens
agttttgatataatggc

SEQ ID NO: 9483670 - DNA, 18 bp, Homo sapiens
ctgcccagagcatttcat

SEQ ID NO: 9483671 - DNA, 18 bp, Homo sapiens
ctgcccagagcacttgtg

SEQ ID NO: 9483672 - DNA, 18 bp, Homo sapiens
ctgcccagagcatttcat

SEQ ID NO: 9483673 - DNA, 22 bp, Homo sapiens
ctgccctcgggccctcccatag

SEQ ID NO: 9483674 - DNA, 22 bp, Homo sapiens
ctgccctctagaggaggactga

SEQ ID NO: 9483675 - DNA, 22 bp, Homo sapiens
ctgccctcgggccctcccatag

SEQ ID NO: 9483676 - DNA, 22 bp, Homo sapiens
ctgccctcgggccctcccatag

SEQ ID NO: 9483677 - DNA, 22 bp, Homo sapiens
ctgcccgctgctagagaggccg

SEQ ID NO: 9483678 - DNA, 22 bp, Homo sapiens
ctgcccgcaccatccccgggct

SEQ ID NO: 9483679 - DNA, 22 bp, Homo sapiens
ctgcccgtaagttagaaaagca

SEQ ID NO: 9483680 - DNA, 22 bp, Homo sapiens
ctgcccgtccctttgctctcgc

SEQ ID NO: 9483681 - DNA, 22 bp, Homo sapiens
ctgccctcccagttggtccgtg

SEQ ID NO: 9483682 - DNA, 22 bp, Homo sapiens
ctgccctctagggatgcactgg

SEQ ID NO: 9483683 - DNA, 22 bp, Homo sapiens
ctgccctctagggatgcactgg

SEQ ID NO: 9483684 - DNA, 22 bp, Homo sapiens
ctgccctctagggatgcactgg

SEQ ID NO: 9483685 - DNA, 22 bp, Homo sapiens
ctgccctgacctgcctcagagt

SEQ ID NO: 9483686 - DNA, 22 bp, Homo sapiens
ctgccctctagaggaggactga

SEQ ID NO: 9483687 - DNA, 22 bp, Homo sapiens
ctgccctctagaggaggactga

SEQ ID NO: 9483688 - DNA, 22 bp, Homo sapiens
ctgccctctagggatgcactgg

SEQ ID NO: 9483689 - DNA, 22 bp, Homo sapiens
ctgccctctagggatgcactgg

SEQ ID NO: 9483690 - DNA, 22 bp, Homo sapiens
ctgccctggtcccatggctgat

SEQ ID NO: 9483691 - DNA, 22 bp, Homo sapiens
ctgccctggtcccatggctgat

SEQ ID NO: 9483692 - DNA, 22 bp, Homo sapiens
ctgccctggtcccatggctgat

SEQ ID NO: 9483693 - DNA, 22 bp, Homo sapiens
ctgccctggtcccatggctgat

SEQ ID NO: 9483694 - DNA, 22 bp, Homo sapiens
ctgccctggtcccatggctgat

SEQ ID NO: 9483695 - DNA, 22 bp, Homo sapiens
ctgccctggtcccatggctgat

SEQ ID NO: 9483696 - DNA, 22 bp, Homo sapiens
ctgccctggtcccatggctgat

SEQ ID NO: 9483697 - DNA, 22 bp, Homo sapiens
ctgccctgacctgcctcagagt

SEQ ID NO: 9483698 - DNA, 22 bp, Homo sapiens
ctgccctgacctgcctcagagt

SEQ ID NO: 9483699 - DNA, 22 bp, Homo sapiens
ctgccctgactgaccttttgaa

SEQ ID NO: 9483700 - DNA, 21 bp, Homo sapiens
cttcagcaaatacttggcagg

SEQ ID NO: 9483701 - DNA, 22 bp, Homo sapiens
cttcagatcctaatttgtcttt

SEQ ID NO: 9483702 - DNA, 22 bp, Homo sapiens
cttcagagtgcagaagattggg

SEQ ID NO: 9483703 - DNA, 22 bp, Homo sapiens
cttcagaggggactcaaagtca

SEQ ID NO: 9483704 - DNA, 22 bp, Homo sapiens
cttcacagaataaactcattat

SEQ ID NO: 9483705 - DNA, 22 bp, Homo sapiens
cttcagaatgggactgtgtttg

SEQ ID NO: 9483706 - DNA, 22 bp, Homo sapiens
cttcagaattcctcagcctcag

SEQ ID NO: 9483707 - DNA, 22 bp, Homo sapiens
cttcagaattcctcagcctcag

SEQ ID NO: 9483708 - DNA, 22 bp, Homo sapiens
cttcagagagtccagggactgc

SEQ ID NO: 9483709 - DNA, 22 bp, Homo sapiens
cttcagagagtccagggactgc

SEQ ID NO: 9483710 - DNA, 22 bp, Homo sapiens
ctgtttcctgtcttctcactat

SEQ ID NO: 9483711 - DNA, 22 bp, Homo sapiens
ctgtttcctgtcttctcactat

SEQ ID NO: 9483712 - DNA, 22 bp, Homo sapiens
ctgtttcctaccgtttttcatt

SEQ ID NO: 9483713 - DNA, 22 bp, Homo sapiens
ctgtttcaagtgaagtcagaca

SEQ ID NO: 9483714 - DNA, 22 bp, Homo sapiens
atccttggtaagagagttggat

SEQ ID NO: 9483715 - DNA, 18 bp, Homo sapiens
atccttggggctgctgct

SEQ ID NO: 9483716 - DNA, 22 bp, Homo sapiens
atccttggatcctgtgttcctg

SEQ ID NO: 9483717 - DNA, 22 bp, Homo sapiens
atccttggcacagtggaattca

SEQ ID NO: 9483718 - DNA, 22 bp, Homo sapiens
atccttcttctgctagtgtcta

SEQ ID NO: 9483719 - DNA, 22 bp, Homo sapiens
atccttccttcatttgacaggt

SEQ ID NO: 9483720 - DNA, 22 bp, Homo sapiens
atccttccagagttattctcaa

SEQ ID NO: 9483721 - DNA, 22 bp, Homo sapiens
cttcagcatctttttcttgggg

SEQ ID NO: 9483722 - DNA, 22 bp, Homo sapiens
atccttaatttacttgcatctt

SEQ ID NO: 9483723 - DNA, 22 bp, Homo sapiens
atccttcaaaaggaatagcagg

SEQ ID NO: 9483724 - DNA, 22 bp, Homo sapiens
atccttcaaaaggaatagcagg

SEQ ID NO: 9483725 - DNA, 22 bp, Homo sapiens
cttcagcaccatagctccttct

SEQ ID NO: 9483726 - DNA, 22 bp, Homo sapiens
cttcagcaactttggaatgttt

SEQ ID NO: 9483727 - DNA, 22 bp, Homo sapiens
cttcatgagggtaatctacaaa

SEQ ID NO: 9483728 - DNA, 22 bp, Homo sapiens
cttcatgctcccatttcctaca

SEQ ID NO: 9483729 - DNA, 22 bp, Homo sapiens
cttcatgatgaccaactgccat

SEQ ID NO: 9483730 - DNA, 21 bp, Homo sapiens
cttcatcccggagattctggt

SEQ ID NO: 9483731 - DNA, 22 bp, Homo sapiens
cttcatctttctgagcctcagt

SEQ ID NO: 9483732 - DNA, 22 bp, Homo sapiens
cttcatgagactccactgccat

SEQ ID NO: 9483733 - DNA, 22 bp, Homo sapiens
cttcataaactcagaaggcagc

SEQ ID NO: 9483734 - DNA, 22 bp, Homo sapiens
cttcataattaccttgtctgcc

SEQ ID NO: 9483735 - DNA, 22 bp, Homo sapiens
cttcataaactcagaaggcagc

SEQ ID NO: 9483736 - DNA, 22 bp, Homo sapiens
cttcataatctgaaatttgtaa

SEQ ID NO: 9483737 - DNA, 23 bp, Homo sapiens
cttcatcaaaagttaacactagt

SEQ ID NO: 9483738 - DNA, 22 bp, Homo sapiens
cttcatagtgagtttaatgatg

SEQ ID NO: 9483739 - DNA, 17 bp, Homo sapiens
atctggaagctagctga

SEQ ID NO: 9483740 - DNA, 21 bp, Homo sapiens
atctggaagaactggtaagtg

SEQ ID NO: 9483741 - DNA, 21 bp, Homo sapiens
atctggaagaactggtaagtg

SEQ ID NO: 9483742 - DNA, 22 bp, Homo sapiens
atctggaacaaagcttaggaat

SEQ ID NO: 9483743 - DNA, 21 bp, Homo sapiens
atctggaaattctgccagaga

SEQ ID NO: 9483744 - DNA, 17 bp, Homo sapiens
atctgcatttctaatga

SEQ ID NO: 9483745 - DNA, 22 bp, Homo sapiens
atctgcatttacattgcttgta

SEQ ID NO: 9483746 - DNA, 22 bp, Homo sapiens
atctgcatgtccccatggatcc

SEQ ID NO: 9483747 - DNA, 22 bp, Homo sapiens
atctgcatgtatctctctgcat

SEQ ID NO: 9483748 - DNA, 22 bp, Homo sapiens
cttcattaaccaaaatgcaata

SEQ ID NO: 9483749 - DNA, 22 bp, Homo sapiens
atctcccaaactcatttcttca

SEQ ID NO: 9483750 - DNA, 22 bp, Homo sapiens
atctccagttagcagtactgat

SEQ ID NO: 9483751 - DNA, 22 bp, Homo sapiens
atctccagtgaggcagattctg

SEQ ID NO: 9483752 - DNA, 22 bp, Homo sapiens
atctccaggattttcacactca

SEQ ID NO: 9483753 - DNA, 22 bp, Homo sapiens
cttcagttatgtgccaaggaca

SEQ ID NO: 9483754 - DNA, 22 bp, Homo sapiens
cttcagttatgtgccaaggaca

SEQ ID NO: 9483755 - DNA, 22 bp, Homo sapiens
cttcagtttacaatgcattggc

SEQ ID NO: 9483756 - DNA, 22 bp, Homo sapiens
atctcaggggttccttctagag

SEQ ID NO: 9483757 - DNA, 22 bp, Homo sapiens
atctcaggtgaaacttctaggt

SEQ ID NO: 9483758 - DNA, 22 bp, Homo sapiens
atctcataaacacacatatatg

SEQ ID NO: 9483759 - DNA, 22 bp, Homo sapiens
atctcataatcgtcattgcttt

SEQ ID NO: 9483760 - DNA, 22 bp, Homo sapiens
atctcattttggtttctactta

SEQ ID NO: 9483761 - DNA, 22 bp, Homo sapiens
atctcattttggtttctactta

SEQ ID NO: 9483762 - DNA, 22 bp, Homo sapiens
atctcattttggtttctactta

SEQ ID NO: 9483763 - DNA, 22 bp, Homo sapiens
atctccagaacatttataaacg

SEQ ID NO: 9483764 - DNA, 22 bp, Homo sapiens
ctgttactggacgcacgcagct

SEQ ID NO: 9483765 - DNA, 22 bp, Homo sapiens
ctgttactgctggagccattga

SEQ ID NO: 9483766 - DNA, 22 bp, Homo sapiens
ctgttactgttggcccagggtg

SEQ ID NO: 9483767 - DNA, 22 bp, Homo sapiens
ctgttactgtatttaatcatct

SEQ ID NO: 9483768 - DNA, 16 bp, Homo sapiens
ctgttacttgactgtt

SEQ ID NO: 9483769 - DNA, 22 bp, Homo sapiens
ctgttacttcaatcttctcccg

SEQ ID NO: 9483770 - DNA, 22 bp, Homo sapiens
ctgttacttcaatcttctcccg

SEQ ID NO: 9483771 - DNA, 22 bp, Homo sapiens
ctgttattaaaaagctcaggct

SEQ ID NO: 9483772 - DNA, 22 bp, Homo sapiens
ctgttattccccttgctgtggt

SEQ ID NO: 9483773 - DNA, 19 bp, Homo sapiens
ctgttattgtcagagctcc

SEQ ID NO: 9483774 - DNA, 22 bp, Homo sapiens
ctgttattcaagacaaaggcag

SEQ ID NO: 9483775 - DNA, 22 bp, Homo sapiens
ctgttattcaagacaaaggcag

SEQ ID NO: 9483776 - DNA, 23 bp, Homo sapiens
ctgttattccaggctgatgggtg

SEQ ID NO: 9483777 - DNA, 22 bp, Homo sapiens
ctgttatttatgctgctccatt

SEQ ID NO: 9483778 - DNA, 22 bp, Homo sapiens
ctgttatttagaacatggaatc

SEQ ID NO: 9483779 - DNA, 22 bp, Homo sapiens
ctgttatttagaacatggaatc

SEQ ID NO: 9483780 - DNA, 22 bp, Homo sapiens
ctgttatttctgccaggtgagt

SEQ ID NO: 9483781 - DNA, 22 bp, Homo sapiens
ctgttatttctgaatgccatcc

SEQ ID NO: 9483782 - DNA, 22 bp, Homo sapiens
ctgtttatctctaacctgttta

SEQ ID NO: 9483783 - DNA, 22 bp, Homo sapiens
ctgtttatctctaacctgttta

SEQ ID NO: 9483784 - DNA, 22 bp, Homo sapiens
ctgtttatctaggagttgcagg

SEQ ID NO: 9483785 - DNA, 22 bp, Homo sapiens
ctgttatttgctggaagagttt

SEQ ID NO: 9483786 - DNA, 22 bp, Homo sapiens
ctgttatttgagagtgttgaat

SEQ ID NO: 9483787 - DNA, 22 bp, Homo sapiens
ctgttattttataattcaagaa

SEQ ID NO: 9483788 - DNA, 22 bp, Homo sapiens
ctgttatttggaggatgcttgg

SEQ ID NO: 9483789 - DNA, 22 bp, Homo sapiens
ctgttattttataattcaagaa

SEQ ID NO: 9483790 - DNA, 22 bp, Homo sapiens
ctgtttattgagcaatctgcca

SEQ ID NO: 9483791 - DNA, 21 bp, Homo sapiens
ctgtttatttcacctgggtgc

SEQ ID NO: 9483792 - DNA, 22 bp, Homo sapiens
ctgtttcaaaactagtacaaca

SEQ ID NO: 9483793 - DNA, 22 bp, Homo sapiens
ctgtttattgagcaatctgcca

SEQ ID NO: 9483794 - DNA, 22 bp, Homo sapiens
ctgtttattgagcaatctgcca

SEQ ID NO: 9483795 - DNA, 22 bp, Homo sapiens
atcattcaagtgctctaaaatg

SEQ ID NO: 9483796 - DNA, 22 bp, Homo sapiens
atcattcaagtgctctaaaatg

SEQ ID NO: 9483797 - DNA, 22 bp, Homo sapiens
atcattcaaatgatttggaggt

SEQ ID NO: 9483798 - DNA, 22 bp, Homo sapiens
atcattatcctcctatttgcct

SEQ ID NO: 9483799 - DNA, 22 bp, Homo sapiens
atcattcagcctaagcaagtac

SEQ ID NO: 9483800 - DNA, 22 bp, Homo sapiens
atcattcagcctaagcaagtac

SEQ ID NO: 9483801 - DNA, 22 bp, Homo sapiens
atcattcagtctctgggacagt

SEQ ID NO: 9483802 - DNA, 22 bp, Homo sapiens
atcattcagcctaagcaagtac

SEQ ID NO: 9483803 - DNA, 22 bp, Homo sapiens
atcattcagtctctgggacagt

SEQ ID NO: 9483804 - DNA, 22 bp, Homo sapiens
atcattcagtctctgggacagt

SEQ ID NO: 9483805 - DNA, 22 bp, Homo sapiens
atcattcagtctctgggacagt

SEQ ID NO: 9483806 - DNA, 22 bp, Homo sapiens
atcattcagtgaccacttccca

SEQ ID NO: 9483807 - DNA, 22 bp, Homo sapiens
atcattctagctgttgtgttga

SEQ ID NO: 9483808 - DNA, 22 bp, Homo sapiens
ctgtgtgtcctcggacgagttt

SEQ ID NO: 9483809 - DNA, 22 bp, Homo sapiens
ctgtgtgtgaacacagcccagc

SEQ ID NO: 9483810 - DNA, 22 bp, Homo sapiens
ctgtgtgtgaacacagcccagc

SEQ ID NO: 9483811 - DNA, 22 bp, Homo sapiens
ctgttactaatcttttctgcta

SEQ ID NO: 9483812 - DNA, 22 bp, Homo sapiens
ctgttactgaaatgcaccgtgc

SEQ ID NO: 9483813 - DNA, 22 bp, Homo sapiens
ctgttactcctttggcagatta

SEQ ID NO: 9483814 - DNA, 23 bp, Homo sapiens
atcattaacagtgcaggggtagg

SEQ ID NO: 9483815 - DNA, 22 bp, Homo sapiens
atcattagaccaaactagagct

SEQ ID NO: 9483816 - DNA, 22 bp, Homo sapiens
ctgtgtcccttgtcccagagcc

SEQ ID NO: 9483817 - DNA, 22 bp, Homo sapiens
ctgtgtcccttgtcccagagcc

SEQ ID NO: 9483818 - DNA, 22 bp, Homo sapiens
ctgtgtcccttgtcccagagcc

SEQ ID NO: 9483819 - DNA, 22 bp, Homo sapiens
atcattaaatataagcttcaca

SEQ ID NO: 9483820 - DNA, 22 bp, Homo sapiens
atcattaaatataagcttcaca

SEQ ID NO: 9483821 - DNA, 22 bp, Homo sapiens
atcattaaatataagcttcaca

SEQ ID NO: 9483822 - DNA, 22 bp, Homo sapiens
ctgtgtcccagtaccttgggta

SEQ ID NO: 9483823 - DNA, 22 bp, Homo sapiens
ctgtgtcccagtaccttgggta

SEQ ID NO: 9483824 - DNA, 22 bp, Homo sapiens
ctgtgtcccagtaccttgggta

SEQ ID NO: 9483825 - DNA, 22 bp, Homo sapiens
ctgtgtccccctcagccaggtg

SEQ ID NO: 9483826 - DNA, 22 bp, Homo sapiens
atcaggaagccagtctaatgga

SEQ ID NO: 9483827 - DNA, 22 bp, Homo sapiens
atcaggaagtctgccacaaggc

SEQ ID NO: 9483828 - DNA, 19 bp, Homo sapiens
atcaggaacaaggctgatc

SEQ ID NO: 9483829 - DNA, 22 bp, Homo sapiens
atcaggaaatacttatttataa

SEQ ID NO: 9483830 - DNA, 20 bp, Homo sapiens
ctgtgctccgggttcctgga

SEQ ID NO: 9483831 - DNA, 22 bp, Homo sapiens
atcaggaaatacttatttataa

SEQ ID NO: 9483832 - DNA, 20 bp, Homo sapiens
atcaggaagagagactgacc

SEQ ID NO: 9483833 - DNA, 22 bp, Homo sapiens
atcaggccagcaatccctgggc

SEQ ID NO: 9483834 - DNA, 22 bp, Homo sapiens
atcaggccagcaatccctgggc

SEQ ID NO: 9483835 - DNA, 22 bp, Homo sapiens
ctgtgggagcacatgacagata

SEQ ID NO: 9483836 - DNA, 22 bp, Homo sapiens
atcaggccagcaatccctgggc

SEQ ID NO: 9483837 - DNA, 19 bp, Homo sapiens
ctgtgtcacatttatgaaa

SEQ ID NO: 9483838 - DNA, 19 bp, Homo sapiens
ctgtgtcacatttatgaaa

SEQ ID NO: 9483839 - DNA, 22 bp, Homo sapiens
ctgtgggagcacatgacagata

SEQ ID NO: 9483840 - DNA, 22 bp, Homo sapiens
ctgtgtccaatggccttagcag

SEQ ID NO: 9483841 - DNA, 22 bp, Homo sapiens
ctgtgtcactcactgcgttatg

SEQ ID NO: 9483842 - DNA, 22 bp, Homo sapiens
ctgtgtccaatggccttagcag

SEQ ID NO: 9483843 - DNA, 22 bp, Homo sapiens
ctgtgtccaatggccttagcag

SEQ ID NO: 9483844 - DNA, 22 bp, Homo sapiens
ctgtgcctggggggcagagctg

SEQ ID NO: 9483845 - DNA, 22 bp, Homo sapiens
ctgtgcctggggggcagagctg

SEQ ID NO: 9483846 - DNA, 22 bp, Homo sapiens
ctgtgccttagtattctcattt

SEQ ID NO: 9483847 - DNA, 22 bp, Homo sapiens
ctgtgccttagtattctcattt

SEQ ID NO: 9483848 - DNA, 22 bp, Homo sapiens
ctgtgcctgccttgttcactga

SEQ ID NO: 9483849 - DNA, 22 bp, Homo sapiens
ctgtgcctccaagtggtctctg

SEQ ID NO: 9483850 - DNA, 22 bp, Homo sapiens
ctgtgcctccagtctcgcttct

SEQ ID NO: 9483851 - DNA, 22 bp, Homo sapiens
ctgtgcctgcaggccacatcaa

SEQ ID NO: 9483852 - DNA, 22 bp, Homo sapiens
ctgtgcctgcaggccacatcaa

SEQ ID NO: 9483853 - DNA, 22 bp, Homo sapiens
ctgtgctccctctggcgccccg

SEQ ID NO: 9483854 - DNA, 22 bp, Homo sapiens
ctgtgctccctctggcgccccg

SEQ ID NO: 9483855 - DNA, 22 bp, Homo sapiens
ctgtgcgtaagtagccaaaata

SEQ ID NO: 9483856 - DNA, 22 bp, Homo sapiens
ctgtgcgttgtgaaatgtttag

SEQ ID NO: 9483857 - DNA, 22 bp, Homo sapiens
ctgtgccttctacttcactcta

SEQ ID NO: 9483858 - DNA, 22 bp, Homo sapiens
ctgtgccttctgcctggaacat

SEQ ID NO: 9483859 - DNA, 22 bp, Homo sapiens
ctgtgcctttgtagctgtgcct

SEQ ID NO: 9483860 - DNA, 22 bp, Homo sapiens
ctgtgccttggcgctgtgccac

SEQ ID NO: 9483861 - DNA, 22 bp, Homo sapiens
ctgtgccctttgtcctcgtctc

SEQ ID NO: 9483862 - DNA, 22 bp, Homo sapiens
ctgtgccctttgtcctcgtctc

SEQ ID NO: 9483863 - DNA, 20 bp, Homo sapiens
ctgtgcctaaacctccgggt

SEQ ID NO: 9483864 - DNA, 22 bp, Homo sapiens
ctgtgccctttcgctgcactgt

SEQ ID NO: 9483865 - DNA, 22 bp, Homo sapiens
ctgtgcagtaggtcagggctgg

SEQ ID NO: 9483866 - DNA, 22 bp, Homo sapiens
ctgtgccctttcgctgcactgt

SEQ ID NO: 9483867 - DNA, 22 bp, Homo sapiens
ctgtgcctccaagtggtctctg

SEQ ID NO: 9483868 - DNA, 22 bp, Homo sapiens
ctgtgcctccaagtggtctctg

SEQ ID NO: 9483869 - DNA, 22 bp, Homo sapiens
ctgtgcctcagtgtcctcgagt

SEQ ID NO: 9483870 - DNA, 22 bp, Homo sapiens
ctgtgcctcagtgtcctcgagt

SEQ ID NO: 9483871 - DNA, 22 bp, Homo sapiens
ctgtgcctaagatgcatgtctc

SEQ ID NO: 9483872 - DNA, 22 bp, Homo sapiens
ctgtgcagtaggtcagggctgg

SEQ ID NO: 9483873 - DNA, 21 bp, Homo sapiens
ctgtccagtaattcctggcac

SEQ ID NO: 9483874 - DNA, 21 bp, Homo sapiens
ctgtccagtaattcctggcac

SEQ ID NO: 9483875 - DNA, 22 bp, Homo sapiens
ctgtccagcttggctcctgggg

SEQ ID NO: 9483876 - DNA, 22 bp, Homo sapiens
ctgtccagcttggctcctgggg

SEQ ID NO: 9483877 - DNA, 22 bp, Homo sapiens
atattttcacagaacttgcaaa

SEQ ID NO: 9483878 - DNA, 22 bp, Homo sapiens
atattttcacagaacttgcaaa

SEQ ID NO: 9483879 - DNA, 22 bp, Homo sapiens
atattttcacagaacttgcaaa

SEQ ID NO: 9483880 - DNA, 22 bp, Homo sapiens
atattttcacagaacttgcaaa

SEQ ID NO: 9483881 - DNA, 22 bp, Homo sapiens
atatttgtttggcagagttcag

SEQ ID NO: 9483882 - DNA, 22 bp, Homo sapiens
atatttgttgagttcttatgat

SEQ ID NO: 9483883 - DNA, 22 bp, Homo sapiens
atattttcactgaaccaaagta

SEQ ID NO: 9483884 - DNA, 22 bp, Homo sapiens
atattttcactgaaccaaagta

SEQ ID NO: 9483885 - DNA, 22 bp, Homo sapiens
atattttctggaactatgcctg

SEQ ID NO: 9483886 - DNA, 22 bp, Homo sapiens
atattttccgaacttgaggtag

SEQ ID NO: 9483887 - DNA, 22 bp, Homo sapiens
atattttccgaacttgaggtag

SEQ ID NO: 9483888 - DNA, 22 bp, Homo sapiens
atattttgaagttaataatgtg

SEQ ID NO: 9483889 - DNA, 22 bp, Homo sapiens
atattttgaagttaataatgtg

SEQ ID NO: 9483890 - DNA, 22 bp, Homo sapiens
atattttgaagttaataatgtg

SEQ ID NO: 9483891 - DNA, 22 bp, Homo sapiens
ctgtaatcccagctactcggga

SEQ ID NO: 9483892 - DNA, 22 bp, Homo sapiens
ctgtaatcccagctactcggga

SEQ ID NO: 9483893 - DNA, 22 bp, Homo sapiens
ctgtaatcccagctactcggga

SEQ ID NO: 9483894 - DNA, 22 bp, Homo sapiens
ctgtaatcccagctactcggga

SEQ ID NO: 9483895 - DNA, 22 bp, Homo sapiens
ctgtatctgtcagctggtctcg

SEQ ID NO: 9483896 - DNA, 22 bp, Homo sapiens
ctgtatctgtcagctggtctcg

SEQ ID NO: 9483897 - DNA, 22 bp, Homo sapiens
ctgtatatgtgcatacacacac

SEQ ID NO: 9483898 - DNA, 22 bp, Homo sapiens
ctgtatgaacccatatacttat

SEQ ID NO: 9483899 - DNA, 22 bp, Homo sapiens
ctgtatctgtgttggatgagtt

SEQ ID NO: 9483900 - DNA, 22 bp, Homo sapiens
ctgtatctgtgttggatgagtt

SEQ ID NO: 9483901 - DNA, 22 bp, Homo sapiens
ctgtatgttgggtaagcattgc

SEQ ID NO: 9483902 - DNA, 22 bp, Homo sapiens
ctgtattagccaggtgcacaag

SEQ ID NO: 9483903 - DNA, 22 bp, Homo sapiens
ctgtattaaaggcagtgatctt

SEQ ID NO: 9483904 - DNA, 22 bp, Homo sapiens
ctgtattcaagcttctgcccaa

SEQ ID NO: 9483905 - DNA, 22 bp, Homo sapiens
ctgtattcaaagtgaggatgta

SEQ ID NO: 9483906 - DNA, 21 bp, Homo sapiens
ctgtattaacttttgcacctt

SEQ ID NO: 9483907 - DNA, 22 bp, Homo sapiens
ctgtatttagttaaaatgctaa

SEQ ID NO: 9483908 - DNA, 22 bp, Homo sapiens
ctgtattctgggcagggaagga

SEQ ID NO: 9483909 - DNA, 22 bp, Homo sapiens
ctgtatttcttggacagttgct

SEQ ID NO: 9483910 - DNA, 22 bp, Homo sapiens
ctgtatttcttggacagttgct

SEQ ID NO: 9483911 - DNA, 22 bp, Homo sapiens
ctgtatttcccacattctctat

SEQ ID NO: 9483912 - DNA, 22 bp, Homo sapiens
ctgtatttcccacattctctat

SEQ ID NO: 9483913 - DNA, 21 bp, Homo sapiens
ctgtccacatcacagagcctc

SEQ ID NO: 9483914 - DNA, 22 bp, Homo sapiens
ctgtcatttttttagaacacct

SEQ ID NO: 9483915 - DNA, 22 bp, Homo sapiens
ctgtccagcttggctcctgggg

SEQ ID NO: 9483916 - DNA, 22 bp, Homo sapiens
ctgtccagctgaccagagcagc

SEQ ID NO: 9483917 - DNA, 22 bp, Homo sapiens
ctgtccagctgaccagagcagc

SEQ ID NO: 9483918 - DNA, 22 bp, Homo sapiens
ctgtccagaaagggggcaacaa

SEQ ID NO: 9483919 - DNA, 22 bp, Homo sapiens
ctgtccagcacatgtctgcccc

SEQ ID NO: 9483920 - DNA, 22 bp, Homo sapiens
ctggtggcatcttgagacggtt

SEQ ID NO: 9483921 - DNA, 22 bp, Homo sapiens
ctggtggcatcttgagatggtt

SEQ ID NO: 9483922 - DNA, 22 bp, Homo sapiens
ctggtgggagcagcaggcagct

SEQ ID NO: 9483923 - DNA, 22 bp, Homo sapiens
ctggtggagagtgggctctgga

SEQ ID NO: 9483924 - DNA, 22 bp, Homo sapiens
ctggtgggagcagcaggcagct

SEQ ID NO: 9483925 - DNA, 22 bp, Homo sapiens
ctggtgggagcagcaggcagct

SEQ ID NO: 9483926 - DNA, 22 bp, Homo sapiens
ctggtgggaggcaaggtggaag

SEQ ID NO: 9483927 - DNA, 22 bp, Homo sapiens
ctggtgggaggcaaggtggaag

SEQ ID NO: 9483928 - DNA, 22 bp, Homo sapiens
ctggtgggaggcaaggtggaag

SEQ ID NO: 9483929 - DNA, 22 bp, Homo sapiens
ctggtgggaggcaaggtggaag

SEQ ID NO: 9483930 - DNA, 22 bp, Homo sapiens
ctggtgctggagcctagtccct

SEQ ID NO: 9483931 - DNA, 22 bp, Homo sapiens
ctggtgctggagcctagtccct

SEQ ID NO: 9483932 - DNA, 22 bp, Homo sapiens
ctggtgctggcaacagagtagg

SEQ ID NO: 9483933 - DNA, 22 bp, Homo sapiens
ctggtgctttgctcatttgata

SEQ ID NO: 9483934 - DNA, 22 bp, Homo sapiens
ctggtggaatggcagagggaac

SEQ ID NO: 9483935 - DNA, 22 bp, Homo sapiens
ctggtcctccttgccttcagat

SEQ ID NO: 9483936 - DNA, 22 bp, Homo sapiens
ctggggcatcatccattctttc

SEQ ID NO: 9483937 - DNA, 22 bp, Homo sapiens
ctggtcctctccagcaggcatt

SEQ ID NO: 9483938 - DNA, 22 bp, Homo sapiens
ctggtcctctccagcaggcatt

SEQ ID NO: 9483939 - DNA, 22 bp, Homo sapiens
ctggtcctctccagcaggcatt

SEQ ID NO: 9483940 - DNA, 19 bp, Homo sapiens
ctggtcctgactgaggggt

SEQ ID NO: 9483941 - DNA, 17 bp, Homo sapiens
ctggggatgtgggactc

SEQ ID NO: 9483942 - DNA, 22 bp, Homo sapiens
ctggggcagagcccagcaattt

SEQ ID NO: 9483943 - DNA, 22 bp, Homo sapiens
ctggggcagagcccagcaattt

SEQ ID NO: 9483944 - DNA, 22 bp, Homo sapiens
ctggggaggcagggctgcccct

SEQ ID NO: 9483945 - DNA, 22 bp, Homo sapiens
ctggggaggcagggctgcccct

SEQ ID NO: 9483946 - DNA, 22 bp, Homo sapiens
ctggggaggcagggctgcccct

SEQ ID NO: 9483947 - DNA, 22 bp, Homo sapiens
ctggggagtgaaattcttaaat

SEQ ID NO: 9483948 - DNA, 22 bp, Homo sapiens
ctggggagtgaaattcttaaat

SEQ ID NO: 9483949 - DNA, 22 bp, Homo sapiens
ctggggatgggacctggcataa

SEQ ID NO: 9483950 - DNA, 22 bp, Homo sapiens
ctggggatgggacctggcataa

SEQ ID NO: 9483951 - DNA, 22 bp, Homo sapiens
ctggggatgggacctggcataa

SEQ ID NO: 9483952 - DNA, 22 bp, Homo sapiens
ctggggatgggacctggcataa

SEQ ID NO: 9483953 - DNA, 22 bp, Homo sapiens
ctggggagtgaaggtaattaca

SEQ ID NO: 9483954 - DNA, 22 bp, Homo sapiens
ctggggatcctttttgcatcta

SEQ ID NO: 9483955 - DNA, 22 bp, Homo sapiens
ctggggatcctttttgcatcta

SEQ ID NO: 9483956 - DNA, 22 bp, Homo sapiens
ctggggaggatgctacgacctg

SEQ ID NO: 9483957 - DNA, 22 bp, Homo sapiens
ctggggaggatgctacgacctg

SEQ ID NO: 9483958 - DNA, 22 bp, Homo sapiens
ctggggaggatgctacgacctg

SEQ ID NO: 9483959 - DNA, 22 bp, Homo sapiens
ctggggaggatgctacgacctg

SEQ ID NO: 9483960 - DNA, 22 bp, Homo sapiens
ctggggaggatgctacgacctg

SEQ ID NO: 9483961 - DNA, 22 bp, Homo sapiens
ctggggaggcagggctgcccct

SEQ ID NO: 9483962 - DNA, 22 bp, Homo sapiens
ctgggctgtggtgtggcccaaa

SEQ ID NO: 9483963 - DNA, 22 bp, Homo sapiens
ctgggctgtggtgtggcccaaa

SEQ ID NO: 9483964 - DNA, 22 bp, Homo sapiens
ctgggctgtggtgtggcccaaa

SEQ ID NO: 9483965 - DNA, 22 bp, Homo sapiens
ctgggctgtggtgtggcccaaa

SEQ ID NO: 9483966 - DNA, 22 bp, Homo sapiens
ctgggctgtcccagggcggcag

SEQ ID NO: 9483967 - DNA, 23 bp, Homo sapiens
ctgggctgtcctgaggtcacctc

SEQ ID NO: 9483968 - DNA, 23 bp, Homo sapiens
ctgggctgtcctgaggtcacctc

SEQ ID NO: 9483969 - DNA, 23 bp, Homo sapiens
ctgggctgtcctgaggtcacctc

SEQ ID NO: 9483970 - DNA, 22 bp, Homo sapiens
ctgggctgtcccaaccccatcc

SEQ ID NO: 9483971 - DNA, 22 bp, Homo sapiens
ctgggctgtcccagggcggcag

SEQ ID NO: 9483972 - DNA, 22 bp, Homo sapiens
ctgggctgtcccagggcggcag

SEQ ID NO: 9483973 - DNA, 22 bp, Homo sapiens
ctgggctgtcaatggccctctg

SEQ ID NO: 9483974 - DNA, 22 bp, Homo sapiens
ctgggccatgggccagcgaggc

SEQ ID NO: 9483975 - DNA, 22 bp, Homo sapiens
ctgggccatgggccagcgaggc

SEQ ID NO: 9483976 - DNA, 22 bp, Homo sapiens
ctgggcctctcagctcccgcgg

SEQ ID NO: 9483977 - DNA, 17 bp, Homo sapiens
ctgggcctctgcccttt

SEQ ID NO: 9483978 - DNA, 17 bp, Homo sapiens
ctgggcctctgcccttt

SEQ ID NO: 9483979 - DNA, 17 bp, Homo sapiens
ctgggcctctgcccttt

SEQ ID NO: 9483980 - DNA, 22 bp, Homo sapiens
ctgggccatggaagtctctgcc

SEQ ID NO: 9483981 - DNA, 22 bp, Homo sapiens
ctgggccatgggccagcgaggc

SEQ ID NO: 9483982 - DNA, 22 bp, Homo sapiens
ctgggccatctctctgcaagtg

SEQ ID NO: 9483983 - DNA, 22 bp, Homo sapiens
ctgggccatctctctgcaagtg

SEQ ID NO: 9483984 - DNA, 22 bp, Homo sapiens
ctgggccatggaagtctctgcc

SEQ ID NO: 9483985 - DNA, 22 bp, Homo sapiens
ctgggccatctctctgcaagtg

SEQ ID NO: 9483986 - DNA, 22 bp, Homo sapiens
ctgggccatcagaggggctgga

SEQ ID NO: 9483987 - DNA, 22 bp, Homo sapiens
ctgggccatcagaggggctgga

SEQ ID NO: 9483988 - DNA, 22 bp, Homo sapiens
ctgggccagttatgtctcatct

SEQ ID NO: 9483989 - DNA, 22 bp, Homo sapiens
ctgggccagtctcggccgctct

SEQ ID NO: 9483990 - DNA, 22 bp, Homo sapiens
ctgggccagttatgtctcatct

SEQ ID NO: 9483991 - DNA, 22 bp, Homo sapiens
ctgggcagttcgctttcgtttt

SEQ ID NO: 9483992 - DNA, 22 bp, Homo sapiens
ctgggcagttcgctttcgtttt

SEQ ID NO: 9483993 - DNA, 22 bp, Homo sapiens
ctgggccagtctcggccgctct

SEQ ID NO: 9483994 - DNA, 22 bp, Homo sapiens
ctgggccagggaggtgtctgta

SEQ ID NO: 9483995 - DNA, 22 bp, Homo sapiens
ctgggctgggtttaccctcttc

SEQ ID NO: 9483996 - DNA, 22 bp, Homo sapiens
ctgggctgtaatgtggcactga

SEQ ID NO: 9483997 - DNA, 22 bp, Homo sapiens
ctgggctgtaatgtggcactga

SEQ ID NO: 9483998 - DNA, 22 bp, Homo sapiens
ctgggctgtaatgtggcactga

SEQ ID NO: 9483999 - DNA, 22 bp, Homo sapiens
ctgggcctggggctgttgagag

SEQ ID NO: 9484000 - DNA, 22 bp, Homo sapiens
ctgggcctgggaggccaggtct

SEQ ID NO: 9484001 - DNA, 22 bp, Homo sapiens
ctgggcctgggaggccaggtct

SEQ ID NO: 9484002 - DNA, 22 bp, Homo sapiens
ctgggctgatttagtcacgttt

SEQ ID NO: 9484003 - DNA, 22 bp, Homo sapiens
ctgggctgatttagtcacgttt

SEQ ID NO: 9484004 - DNA, 22 bp, Homo sapiens
ctgggcctggacgggcagatct

SEQ ID NO: 9484005 - DNA, 22 bp, Homo sapiens
ctgggcctggagcccacgagcc

SEQ ID NO: 9484006 - DNA, 22 bp, Homo sapiens
ctgggcctggagcccacgagcc

SEQ ID NO: 9484007 - DNA, 22 bp, Homo sapiens
ctgggcctggcgttccaggctg

SEQ ID NO: 9484008 - DNA, 22 bp, Homo sapiens
ctgggcctggcgttccaggctg

SEQ ID NO: 9484009 - DNA, 22 bp, Homo sapiens
ctgggcctggcgttccaggctg

SEQ ID NO: 9484010 - DNA, 22 bp, Homo sapiens
ctgggcctgagctctgaagagt

SEQ ID NO: 9484011 - DNA, 17 bp, Homo sapiens
ctgggcctctgcccttt

SEQ ID NO: 9484012 - DNA, 19 bp, Homo sapiens
ctgggcctgcatggttgtt

SEQ ID NO: 9484013 - DNA, 22 bp, Homo sapiens
ctgggcctgagctctgaagagt

SEQ ID NO: 9484014 - DNA, 22 bp, Homo sapiens
ctgggcctggacgggcagatct

SEQ ID NO: 9484015 - DNA, 22 bp, Homo sapiens
ctgggcctgccaccatcttagg

SEQ ID NO: 9484016 - DNA, 22 bp, Homo sapiens
ctgggcctgccaccatcttagg

SEQ ID NO: 9484017 - DNA, 22 bp, Homo sapiens
atatattacaaaagaggaagga

SEQ ID NO: 9484018 - DNA, 19 bp, Homo sapiens
atatatgtatacaatgtgg

SEQ ID NO: 9484019 - DNA, 19 bp, Homo sapiens
atatatgtatacaatgtgg

SEQ ID NO: 9484020 - DNA, 21 bp, Homo sapiens
atagtgatagataactgagtt

SEQ ID NO: 9484021 - DNA, 19 bp, Homo sapiens
atagtctttccaattatac

SEQ ID NO: 9484022 - DNA, 22 bp, Homo sapiens
atagtcttccaggtcttctact

SEQ ID NO: 9484023 - DNA, 22 bp, Homo sapiens
atagtgaaaatgctgtcagcat

SEQ ID NO: 9484024 - DNA, 22 bp, Homo sapiens
atagtctttactgctgaattga

SEQ ID NO: 9484025 - DNA, 22 bp, Homo sapiens
atagtcttcagcactttgatca

SEQ ID NO: 9484026 - DNA, 22 bp, Homo sapiens
atatattttttgagacagagtc

SEQ ID NO: 9484027 - DNA, 22 bp, Homo sapiens
atatattttttgagacagagtc

SEQ ID NO: 9484028 - DNA, 22 bp, Homo sapiens
atatattttgcggtcacgtggc

SEQ ID NO: 9484029 - DNA, 22 bp, Homo sapiens
atagtactccaccagtacatgt

SEQ ID NO: 9484030 - DNA, 22 bp, Homo sapiens
atagtacatgggtgtcctcaca

SEQ ID NO: 9484031 - DNA, 22 bp, Homo sapiens
atagtatttccagaaatagtct

SEQ ID NO: 9484032 - DNA, 22 bp, Homo sapiens
atagtatttccagaaatagtct

SEQ ID NO: 9484033 - DNA, 22 bp, Homo sapiens
atagtcttcagcactttgatca

SEQ ID NO: 9484034 - DNA, 22 bp, Homo sapiens
atagtcttagtctatagttttg

SEQ ID NO: 9484035 - DNA, 22 bp, Homo sapiens
atagtcttcagcactttgatca

SEQ ID NO: 9484036 - DNA, 22 bp, Homo sapiens
atagtcttagtctatagttttg

SEQ ID NO: 9484037 - DNA, 22 bp, Homo sapiens
atagtcttagtctatagttttg

SEQ ID NO: 9484038 - DNA, 22 bp, Homo sapiens
atagtcttcagcactttgatca

SEQ ID NO: 9484039 - DNA, 22 bp, Homo sapiens
atagtcttagatcagataaagt

SEQ ID NO: 9484040 - DNA, 22 bp, Homo sapiens
atagtcttagatcagataaagt

SEQ ID NO: 9484041 - DNA, 22 bp, Homo sapiens
atagtcaaccttgtaattagcc

SEQ ID NO: 9484042 - DNA, 22 bp, Homo sapiens
atagtcttagaatcttgagtgt

SEQ ID NO: 9484043 - DNA, 22 bp, Homo sapiens
atatcacagatgcagaaagaga

SEQ ID NO: 9484044 - DNA, 22 bp, Homo sapiens
atatcacagctctttcattgct

SEQ ID NO: 9484045 - DNA, 22 bp, Homo sapiens
atatcacagtagttgtttagtt

SEQ ID NO: 9484046 - DNA, 22 bp, Homo sapiens
atatcacaggaaaggaagatac

SEQ ID NO: 9484047 - DNA, 22 bp, Homo sapiens
atatcacaggtgtttacctgat

SEQ ID NO: 9484048 - DNA, 22 bp, Homo sapiens
atatcattatgttatgagcaca

SEQ ID NO: 9484049 - DNA, 22 bp, Homo sapiens
atatcattatgttatgagcaca

SEQ ID NO: 9484050 - DNA, 22 bp, Homo sapiens
atatcattatgttatgagcaca

SEQ ID NO: 9484051 - DNA, 22 bp, Homo sapiens
atatcattatgttatgagcaca

SEQ ID NO: 9484052 - DNA, 22 bp, Homo sapiens
atatcattatgttatgagcaca

SEQ ID NO: 9484053 - DNA, 22 bp, Homo sapiens
atatcataaatcggtgcatgaa

SEQ ID NO: 9484054 - DNA, 18 bp, Homo sapiens
atatcagctacttcatgg

SEQ ID NO: 9484055 - DNA, 18 bp, Homo sapiens
atatcagctacttcatgg

SEQ ID NO: 9484056 - DNA, 22 bp, Homo sapiens
atatcaaaataaacagcatgca

SEQ ID NO: 9484057 - DNA, 22 bp, Homo sapiens
atatcaaaataaacagcatgca

SEQ ID NO: 9484058 - DNA, 22 bp, Homo sapiens
atatcaaacgaagttattttaa

SEQ ID NO: 9484059 - DNA, 22 bp, Homo sapiens
atatcaaacgaagttattttaa

SEQ ID NO: 9484060 - DNA, 22 bp, Homo sapiens
atatcaaacgaagttattttaa

SEQ ID NO: 9484061 - DNA, 23 bp, Homo sapiens
atatcacacccagtacagtctcc

SEQ ID NO: 9484062 - DNA, 23 bp, Homo sapiens
atatcacacccagtacagtctcc

SEQ ID NO: 9484063 - DNA, 21 bp, Homo sapiens
atatcacaaacatatggtctg

SEQ ID NO: 9484064 - DNA, 22 bp, Homo sapiens
atatcacaaacaagtctgtact

SEQ ID NO: 9484065 - DNA, 22 bp, Homo sapiens
atatcaaagctagtggaaattt

SEQ ID NO: 9484066 - DNA, 22 bp, Homo sapiens
atatcaaagctagtggaaattt

SEQ ID NO: 9484067 - DNA, 22 bp, Homo sapiens
tcccagaggaaatggcagctga

SEQ ID NO: 9484068 - DNA, 22 bp, Homo sapiens
tcccagaggaaatggcagctga

SEQ ID NO: 9484069 - DNA, 22 bp, Homo sapiens
tcccagagctgataagccttta

SEQ ID NO: 9484070 - DNA, 22 bp, Homo sapiens
tcccagagctgataagccttta

SEQ ID NO: 9484071 - DNA, 22 bp, Homo sapiens
tcccagccacaggtgtagccct

SEQ ID NO: 9484072 - DNA, 22 bp, Homo sapiens
tcccagccacaggtgtagccct

SEQ ID NO: 9484073 - DNA, 22 bp, Homo sapiens
tcccagccacaggtgtagccct

SEQ ID NO: 9484074 - DNA, 22 bp, Homo sapiens
tcccagaggaaatggcagctga

SEQ ID NO: 9484075 - DNA, 22 bp, Homo sapiens
tcccagaggaaatggcagctga

SEQ ID NO: 9484076 - DNA, 22 bp, Homo sapiens
tcccagaggactgttggtgcta

SEQ ID NO: 9484077 - DNA, 22 bp, Homo sapiens
tcccagagcctctgccactctg

SEQ ID NO: 9484078 - DNA, 22 bp, Homo sapiens
tcccagagcctctgccactctg

SEQ ID NO: 9484079 - DNA, 22 bp, Homo sapiens
tcccagagctctgacaccagct

SEQ ID NO: 9484080 - DNA, 22 bp, Homo sapiens
tcccagagctctgacaccagct

SEQ ID NO: 9484081 - DNA, 22 bp, Homo sapiens
tcccagagctctgacaccagct

SEQ ID NO: 9484082 - DNA, 22 bp, Homo sapiens
tcccagagctctggaggttgga

SEQ ID NO: 9484083 - DNA, 22 bp, Homo sapiens
tcccagagctctggaggttgga

SEQ ID NO: 9484084 - DNA, 22 bp, Homo sapiens
tcccagagctctgacaccagct

SEQ ID NO: 9484085 - DNA, 22 bp, Homo sapiens
tcccagagctctggaggttgga

SEQ ID NO: 9484086 - DNA, 22 bp, Homo sapiens
tcccagagctctggaggttgga

SEQ ID NO: 9484087 - DNA, 21 bp, Homo sapiens
tcccactctaaatggactgaa

SEQ ID NO: 9484088 - DNA, 22 bp, Homo sapiens
tcccagagcccaagttggagag

SEQ ID NO: 9484089 - DNA, 22 bp, Homo sapiens
tcccagagcctctgccactctg

SEQ ID NO: 9484090 - DNA, 22 bp, Homo sapiens
tcccagagcccaagttggagag

SEQ ID NO: 9484091 - DNA, 22 bp, Homo sapiens
tcccagagcccaagttggagag

SEQ ID NO: 9484092 - DNA, 22 bp, Homo sapiens
tcccagagcccaagttggagag

SEQ ID NO: 9484093 - DNA, 22 bp, Homo sapiens
cattcattctgtaagtaactat

SEQ ID NO: 9484094 - DNA, 22 bp, Homo sapiens
cattcatttactttcaacagct

SEQ ID NO: 9484095 - DNA, 22 bp, Homo sapiens
cattcattcacattttgtctat

SEQ ID NO: 9484096 - DNA, 22 bp, Homo sapiens
cattcattcagcaactgttatt

SEQ ID NO: 9484097 - DNA, 22 bp, Homo sapiens
cattcattcagcaactgttatt

SEQ ID NO: 9484098 - DNA, 22 bp, Homo sapiens
tcccagccaggctctaccactt

SEQ ID NO: 9484099 - DNA, 22 bp, Homo sapiens
tcccagccaggctctaccactt

SEQ ID NO: 9484100 - DNA, 22 bp, Homo sapiens
tcccagccacagtttccacctg

SEQ ID NO: 9484101 - DNA, 22 bp, Homo sapiens
tcccagccacagtttccacctg

SEQ ID NO: 9484102 - DNA, 22 bp, Homo sapiens
tcccagccacagtttccacctg

SEQ ID NO: 9484103 - DNA, 22 bp, Homo sapiens
tcccagccacaggtgtagccct

SEQ ID NO: 9484104 - DNA, 22 bp, Homo sapiens
tcccagccacagtttccacctg

SEQ ID NO: 9484105 - DNA, 22 bp, Homo sapiens
tcccagccacagtttccacctg

SEQ ID NO: 9484106 - DNA, 22 bp, Homo sapiens
tcccagcccagatttgtgtgac

SEQ ID NO: 9484107 - DNA, 22 bp, Homo sapiens
tcccagcccagacttctccagt

SEQ ID NO: 9484108 - DNA, 22 bp, Homo sapiens
tcccagcccagatttgtgtgac

SEQ ID NO: 9484109 - DNA, 22 bp, Homo sapiens
tcccagcccaggtatgatgata

SEQ ID NO: 9484110 - DNA, 22 bp, Homo sapiens
tcccagccattcctttaggtgt

SEQ ID NO: 9484111 - DNA, 22 bp, Homo sapiens
tcccagccattcctttaggtgt

SEQ ID NO: 9484112 - DNA, 22 bp, Homo sapiens
tcccagcccagacttctccagt

SEQ ID NO: 9484113 - DNA, 22 bp, Homo sapiens
tcccagcccagacttctccagt

SEQ ID NO: 9484114 - DNA, 22 bp, Homo sapiens
tcccagcccagacttctccagt

SEQ ID NO: 9484115 - DNA, 22 bp, Homo sapiens
tcccaggaattgaagccagtgt

SEQ ID NO: 9484116 - DNA, 22 bp, Homo sapiens
tcccaggaatccgtcctctaga

SEQ ID NO: 9484117 - DNA, 22 bp, Homo sapiens
catgtttaattgcgatgtttga

SEQ ID NO: 9484118 - DNA, 22 bp, Homo sapiens
catgttgtatcattctgttcct

SEQ ID NO: 9484119 - DNA, 22 bp, Homo sapiens
catgttgggaatcagctgagag

SEQ ID NO: 9484120 - DNA, 22 bp, Homo sapiens
cattatattacagcactgttaa

SEQ ID NO: 9484121 - DNA, 22 bp, Homo sapiens
catgtttctgagaaaagtagga

SEQ ID NO: 9484122 - DNA, 22 bp, Homo sapiens
cattatattacagcactgttaa

SEQ ID NO: 9484123 - DNA, 22 bp, Homo sapiens
cattatattacagcactgttaa

SEQ ID NO: 9484124 - DNA, 22 bp, Homo sapiens
cattatattacagcactgttaa

SEQ ID NO: 9484125 - DNA, 22 bp, Homo sapiens
cattcaaaggcatgtcctattt

SEQ ID NO: 9484126 - DNA, 22 bp, Homo sapiens
cattatctcagttgaacttatg

SEQ ID NO: 9484127 - DNA, 22 bp, Homo sapiens
catgttcagtgacagttattga

SEQ ID NO: 9484128 - DNA, 22 bp, Homo sapiens
catgttcacctgtggcactagt

SEQ ID NO: 9484129 - DNA, 22 bp, Homo sapiens
catgttctcttaatgttaacta

SEQ ID NO: 9484130 - DNA, 22 bp, Homo sapiens
catgttaagtgtttgataacca

SEQ ID NO: 9484131 - DNA, 22 bp, Homo sapiens
catgttaagtgtttgataacca

SEQ ID NO: 9484132 - DNA, 22 bp, Homo sapiens
catgttaactaagattaactat

SEQ ID NO: 9484133 - DNA, 22 bp, Homo sapiens
cattcacaatagttgaaaggtg

SEQ ID NO: 9484134 - DNA, 22 bp, Homo sapiens
cattcacaactgagcattgttg

SEQ ID NO: 9484135 - DNA, 22 bp, Homo sapiens
cattcacaaagctgattgatgg

SEQ ID NO: 9484136 - DNA, 22 bp, Homo sapiens
cattcacaaagctgattgatgg

SEQ ID NO: 9484137 - DNA, 22 bp, Homo sapiens
cattcacaactgagcattgttg

SEQ ID NO: 9484138 - DNA, 22 bp, Homo sapiens
cattcacagagggggaagcatc

SEQ ID NO: 9484139 - DNA, 22 bp, Homo sapiens
cattcacagcaggtcagctgaa

SEQ ID NO: 9484140 - DNA, 22 bp, Homo sapiens
cattcacagagggggaagcatc

SEQ ID NO: 9484141 - DNA, 22 bp, Homo sapiens
cattcacaatggattgcttcaa

SEQ ID NO: 9484142 - DNA, 22 bp, Homo sapiens
cattcacaatggattgcttcaa

SEQ ID NO: 9484143 - DNA, 22 bp, Homo sapiens
cattcacaatggattgcttcaa

SEQ ID NO: 9484144 - DNA, 22 bp, Homo sapiens
cattcacagagggggaagcatc

SEQ ID NO: 9484145 - DNA, 22 bp, Homo sapiens
cattcacaaaaccacatgccat

SEQ ID NO: 9484146 - DNA, 22 bp, Homo sapiens
cattcacaaaaccacatgccat

SEQ ID NO: 9484147 - DNA, 22 bp, Homo sapiens
cattcacaaaaccacatgccat

SEQ ID NO: 9484148 - DNA, 22 bp, Homo sapiens
cattcacaaaaccacatgccat

SEQ ID NO: 9484149 - DNA, 22 bp, Homo sapiens
cattcacaaagctgattgatgg

SEQ ID NO: 9484150 - DNA, 22 bp, Homo sapiens
cattcacaaaaccacatgccat

SEQ ID NO: 9484151 - DNA, 22 bp, Homo sapiens
cattcaaatgtgccactgtcct

SEQ ID NO: 9484152 - DNA, 22 bp, Homo sapiens
cattcaaaggcatgtcctattt

SEQ ID NO: 9484153 - DNA, 22 bp, Homo sapiens
cattcaaatgtgccactgtcct

SEQ ID NO: 9484154 - DNA, 22 bp, Homo sapiens
cattcaaattaagattttgtta

SEQ ID NO: 9484155 - DNA, 22 bp, Homo sapiens
cattcaagagtggacataatgc

SEQ ID NO: 9484156 - DNA, 22 bp, Homo sapiens
cattcagagctttcttatcata

SEQ ID NO: 9484157 - DNA, 22 bp, Homo sapiens
cattcagagctttcttatcata

SEQ ID NO: 9484158 - DNA, 22 bp, Homo sapiens
cattcagagctttcttatcata

SEQ ID NO: 9484159 - DNA, 22 bp, Homo sapiens
cattcacattcttcttactgtt

SEQ ID NO: 9484160 - DNA, 22 bp, Homo sapiens
cattcacatcttgttccatcac

SEQ ID NO: 9484161 - DNA, 22 bp, Homo sapiens
cattcacatcttgttccatcac

SEQ ID NO: 9484162 - DNA, 22 bp, Homo sapiens
cattcacatcttgttccatcac

SEQ ID NO: 9484163 - DNA, 22 bp, Homo sapiens
cattcacatcttgttccatcac

SEQ ID NO: 9484164 - DNA, 21 bp, Homo sapiens
cattcacagtctggctcttga

SEQ ID NO: 9484165 - DNA, 21 bp, Homo sapiens
cattcacagtctggctcttga

SEQ ID NO: 9484166 - DNA, 22 bp, Homo sapiens
cattcacatcttgttccatcac

SEQ ID NO: 9484167 - DNA, 22 bp, Homo sapiens
cattcacatcttgttccatcac

SEQ ID NO: 9484168 - DNA, 22 bp, Homo sapiens
cattcattcacattttgtctat

SEQ ID NO: 9484169 - DNA, 22 bp, Homo sapiens
cattcattagaatagatatgta

SEQ ID NO: 9484170 - DNA, 22 bp, Homo sapiens
cattcatctatcaaatggtacc

SEQ ID NO: 9484171 - DNA, 22 bp, Homo sapiens
cattcagtcatgctggttttga

SEQ ID NO: 9484172 - DNA, 22 bp, Homo sapiens
cattcagtggagtattattcag

SEQ ID NO: 9484173 - DNA, 22 bp, Homo sapiens
cattcataggaggagatgatta

SEQ ID NO: 9484174 - DNA, 22 bp, Homo sapiens
cattgcaacttcaaactcctgg

SEQ ID NO: 9484175 - DNA, 22 bp, Homo sapiens
cattgattatggaaagcagtgg

SEQ ID NO: 9484176 - DNA, 22 bp, Homo sapiens
tcccagggtcctcttctggaat

SEQ ID NO: 9484177 - DNA, 22 bp, Homo sapiens
tcccagggtcctcttctggaat

SEQ ID NO: 9484178 - DNA, 22 bp, Homo sapiens
tcccagggtcctcttctggaat

SEQ ID NO: 9484179 - DNA, 22 bp, Homo sapiens
tccccactcctgggcagatgcg

SEQ ID NO: 9484180 - DNA, 22 bp, Homo sapiens
cattgcaccacattgcatccct

SEQ ID NO: 9484181 - DNA, 22 bp, Homo sapiens
cattgcaacttcaaactcctgg

SEQ ID NO: 9484182 - DNA, 22 bp, Homo sapiens
cattgcacaccagcctgggcaa

SEQ ID NO: 9484183 - DNA, 22 bp, Homo sapiens
cattgaaagagataaagccttt

SEQ ID NO: 9484184 - DNA, 22 bp, Homo sapiens
cattgaaacctaacataggctg

SEQ ID NO: 9484185 - DNA, 22 bp, Homo sapiens
cattgaaacctaacataggctg

SEQ ID NO: 9484186 - DNA, 18 bp, Homo sapiens
cattgacagtatatcttt

SEQ ID NO: 9484187 - DNA, 22 bp, Homo sapiens
cattgaaatatggaaactgatg

SEQ ID NO: 9484188 - DNA, 22 bp, Homo sapiens
cattgaaatatggaaactgatg

SEQ ID NO: 9484189 - DNA, 22 bp, Homo sapiens
cattgaaatatggaaactgatg

SEQ ID NO: 9484190 - DNA, 22 bp, Homo sapiens
tcccaggaggtgcttcctagga

SEQ ID NO: 9484191 - DNA, 22 bp, Homo sapiens
cattgaaaaacgttgactgagt

SEQ ID NO: 9484192 - DNA, 22 bp, Homo sapiens
cattgaaaaacgttgactgagt

SEQ ID NO: 9484193 - DNA, 22 bp, Homo sapiens
tccccagcattgagggtctctc

SEQ ID NO: 9484194 - DNA, 22 bp, Homo sapiens
tccccagccgtgaaggagagga

SEQ ID NO: 9484195 - DNA, 22 bp, Homo sapiens
tccccagcattgagggtctctc

SEQ ID NO: 9484196 - DNA, 22 bp, Homo sapiens
tccccagcattgagggtctctc

SEQ ID NO: 9484197 - DNA, 22 bp, Homo sapiens
tccccagccgtgaaggagagga

SEQ ID NO: 9484198 - DNA, 22 bp, Homo sapiens
tccccagccgtgaaggagagga

SEQ ID NO: 9484199 - DNA, 22 bp, Homo sapiens
tccctagcttatttgtgctcta

SEQ ID NO: 9484200 - DNA, 22 bp, Homo sapiens
tccctagcttccgggggctgcc

SEQ ID NO: 9484201 - DNA, 22 bp, Homo sapiens
tcccgtcttgctgttgtctgcg

SEQ ID NO: 9484202 - DNA, 22 bp, Homo sapiens
tccccagatgacatcaaaaggc

SEQ ID NO: 9484203 - DNA, 22 bp, Homo sapiens
tccccagatggccagctacatg

SEQ ID NO: 9484204 - DNA, 22 bp, Homo sapiens
tccccagaggtgaggcagcttt

SEQ ID NO: 9484205 - DNA, 22 bp, Homo sapiens
tccccagatggccagctacatg

SEQ ID NO: 9484206 - DNA, 22 bp, Homo sapiens
tccccagatggccagctacatg

SEQ ID NO: 9484207 - DNA, 22 bp, Homo sapiens
tccccagatggccagctacatg

SEQ ID NO: 9484208 - DNA, 19 bp, Homo sapiens
tccccagcacctctgagtc

SEQ ID NO: 9484209 - DNA, 22 bp, Homo sapiens
tccccagattcatgtctgctgt

SEQ ID NO: 9484210 - DNA, 22 bp, Homo sapiens
tccccagacagcgggaggcctg

SEQ ID NO: 9484211 - DNA, 22 bp, Homo sapiens
tccccagagggctgtttaggcc

SEQ ID NO: 9484212 - DNA, 22 bp, Homo sapiens
tccccagaggaatatgagattg

SEQ ID NO: 9484213 - DNA, 22 bp, Homo sapiens
tccccactctgggccaccacaa

SEQ ID NO: 9484214 - DNA, 22 bp, Homo sapiens
tccccactgggcctcctctttc

SEQ ID NO: 9484215 - DNA, 22 bp, Homo sapiens
tccccactgggcctcctctttc

SEQ ID NO: 9484216 - DNA, 22 bp, Homo sapiens
tcctcaggatgtggggtagaat

SEQ ID NO: 9484217 - DNA, 22 bp, Homo sapiens
tcctcaggctgcctggaagact

SEQ ID NO: 9484218 - DNA, 22 bp, Homo sapiens
tcctcaggcggtgaggaggggc

SEQ ID NO: 9484219 - DNA, 22 bp, Homo sapiens
tcctcaggcggtgaggaggggc

SEQ ID NO: 9484220 - DNA, 22 bp, Homo sapiens
tcctcaggatgtggagtagaat

SEQ ID NO: 9484221 - DNA, 22 bp, Homo sapiens
tcctcaggatgtggagtagaat

SEQ ID NO: 9484222 - DNA, 22 bp, Homo sapiens
tcctcaggatgtggggtagaat

SEQ ID NO: 9484223 - DNA, 22 bp, Homo sapiens
tcctcaggatctaggagtgctt

SEQ ID NO: 9484224 - DNA, 22 bp, Homo sapiens
tcctcaggatctaggagtgctt

SEQ ID NO: 9484225 - DNA, 22 bp, Homo sapiens
tcctcaggatgtggagtagaat

SEQ ID NO: 9484226 - DNA, 18 bp, Homo sapiens
tcctcagcctcacctagc

SEQ ID NO: 9484227 - DNA, 22 bp, Homo sapiens
tcctcagcttttatttcacttg

SEQ ID NO: 9484228 - DNA, 22 bp, Homo sapiens
tcctcaggagagctcctatgcc

SEQ ID NO: 9484229 - DNA, 22 bp, Homo sapiens
tcctcaggatctaggagtgctt

SEQ ID NO: 9484230 - DNA, 22 bp, Homo sapiens
tcctcaggagagctcctatgcc

SEQ ID NO: 9484231 - DNA, 22 bp, Homo sapiens
tcctcaggagagctcctatgcc

SEQ ID NO: 9484232 - DNA, 22 bp, Homo sapiens
tcctcaggatctaggagtgctt

SEQ ID NO: 9484233 - DNA, 22 bp, Homo sapiens
tccctaggtcctagtcacagta

SEQ ID NO: 9484234 - DNA, 20 bp, Homo sapiens
tccctaggcaggagggcact

SEQ ID NO: 9484235 - DNA, 20 bp, Homo sapiens
tccctaggcaggagggcact

SEQ ID NO: 9484236 - DNA, 22 bp, Homo sapiens
tccctagtagacccagatcatt

SEQ ID NO: 9484237 - DNA, 22 bp, Homo sapiens
tccctagtcgcatctgtggaga

SEQ ID NO: 9484238 - DNA, 22 bp, Homo sapiens
tccctagtcgcatctgtggaga

SEQ ID NO: 9484239 - DNA, 22 bp, Homo sapiens
tccctcactggttctgcatccc

SEQ ID NO: 9484240 - DNA, 22 bp, Homo sapiens
tccctcacctagtctttgactc

SEQ ID NO: 9484241 - DNA, 22 bp, Homo sapiens
tccctcagaaattctctctgaa

SEQ ID NO: 9484242 - DNA, 22 bp, Homo sapiens
tccctcactggttctgcatccc

SEQ ID NO: 9484243 - DNA, 22 bp, Homo sapiens
tccctcactggttctgcatccc

SEQ ID NO: 9484244 - DNA, 22 bp, Homo sapiens
tccctcactggttctgcatccc

SEQ ID NO: 9484245 - DNA, 18 bp, Homo sapiens
tcctcagcctcacctagc

SEQ ID NO: 9484246 - DNA, 22 bp, Homo sapiens
tcctcagcattagcacagacat

SEQ ID NO: 9484247 - DNA, 22 bp, Homo sapiens
tcctagaaggatcattctagtg

SEQ ID NO: 9484248 - DNA, 22 bp, Homo sapiens
tcctagaagatggatcagagaa

SEQ ID NO: 9484249 - DNA, 20 bp, Homo sapiens
catttgggatcatgaggttt

SEQ ID NO: 9484250 - DNA, 22 bp, Homo sapiens
catttggccattccagtcacat

SEQ ID NO: 9484251 - DNA, 22 bp, Homo sapiens
catttggattttgaagagagta

SEQ ID NO: 9484252 - DNA, 22 bp, Homo sapiens
catttggaccaaaatagccaac

SEQ ID NO: 9484253 - DNA, 22 bp, Homo sapiens
tcctcagggaagatgagcctca

SEQ ID NO: 9484254 - DNA, 22 bp, Homo sapiens
tcctcagggaagatgagcctca

SEQ ID NO: 9484255 - DNA, 22 bp, Homo sapiens
tcctcaggctgcctggaagact

SEQ ID NO: 9484256 - DNA, 22 bp, Homo sapiens
tcctcaggctgcctggaagact

SEQ ID NO: 9484257 - DNA, 22 bp, Homo sapiens
tcctcaggctgcctggaagact

SEQ ID NO: 9484258 - DNA, 22 bp, Homo sapiens
catttgtacagaacagctttat

SEQ ID NO: 9484259 - DNA, 22 bp, Homo sapiens
catttgtaatactgacttgcag

SEQ ID NO: 9484260 - DNA, 22 bp, Homo sapiens
catttggtgttaggcatgttaa

SEQ ID NO: 9484261 - DNA, 22 bp, Homo sapiens
catttgtaagcatggcgttgga

SEQ ID NO: 9484262 - DNA, 22 bp, Homo sapiens
catttgtactgttcaatgtcat

SEQ ID NO: 9484263 - DNA, 22 bp, Homo sapiens
catttgtactgttcaatgtcat

SEQ ID NO: 9484264 - DNA, 22 bp, Homo sapiens
catttgtacagaacagctttat

SEQ ID NO: 9484265 - DNA, 22 bp, Homo sapiens
catttgtagagtaggaaagagt

SEQ ID NO: 9484266 - DNA, 22 bp, Homo sapiens
catttgtagagtaggaaagagt

SEQ ID NO: 9484267 - DNA, 22 bp, Homo sapiens
catttgtagagtaggaaagagt

SEQ ID NO: 9484268 - DNA, 22 bp, Homo sapiens
catttgtagctatttactgtat

SEQ ID NO: 9484269 - DNA, 22 bp, Homo sapiens
tcctcccctcagggcaacggat

SEQ ID NO: 9484270 - DNA, 22 bp, Homo sapiens
tcctcccctcagggcaacggat

SEQ ID NO: 9484271 - DNA, 22 bp, Homo sapiens
tcctctccaggtgagccgaaat

SEQ ID NO: 9484272 - DNA, 22 bp, Homo sapiens
catttgtatgttcctccttagg

SEQ ID NO: 9484273 - DNA, 21 bp, Homo sapiens
tcctctccatgatctgtttgt

SEQ ID NO: 9484274 - DNA, 21 bp, Homo sapiens
tcctctccatgatctgtttgt

SEQ ID NO: 9484275 - DNA, 22 bp, Homo sapiens
tcctctccatattttctgattt

SEQ ID NO: 9484276 - DNA, 22 bp, Homo sapiens
catttgtagtatctgtttatat

SEQ ID NO: 9484277 - DNA, 22 bp, Homo sapiens
catttgtagtatctgtttatat

SEQ ID NO: 9484278 - DNA, 22 bp, Homo sapiens
catttgtatcatatgtatctta

SEQ ID NO: 9484279 - DNA, 22 bp, Homo sapiens
catttgtagttaaaaatgtctc

SEQ ID NO: 9484280 - DNA, 22 bp, Homo sapiens
catttgtagttaaaaatgtctc

SEQ ID NO: 9484281 - DNA, 22 bp, Homo sapiens
tccagcccagctcctctcagaa

SEQ ID NO: 9484282 - DNA, 22 bp, Homo sapiens
tccagcccagctcctctcagaa

SEQ ID NO: 9484283 - DNA, 22 bp, Homo sapiens
tccagcccagctgtccccttca

SEQ ID NO: 9484284 - DNA, 22 bp, Homo sapiens
tccagcccagctgtccccttca

SEQ ID NO: 9484285 - DNA, 22 bp, Homo sapiens
tccagccctgtggcttccaccc

SEQ ID NO: 9484286 - DNA, 22 bp, Homo sapiens
tccagccctgtggcttccaccc

SEQ ID NO: 9484287 - DNA, 22 bp, Homo sapiens
tccagagagccacggacagggg

SEQ ID NO: 9484288 - DNA, 22 bp, Homo sapiens
tccagagagccacggacagggg

SEQ ID NO: 9484289 - DNA, 22 bp, Homo sapiens
tccagagagatagtggctaata

SEQ ID NO: 9484290 - DNA, 19 bp, Homo sapiens
tccagccctgttccctttt

SEQ ID NO: 9484291 - DNA, 22 bp, Homo sapiens
tccagccctgtgtctgggagag

SEQ ID NO: 9484292 - DNA, 19 bp, Homo sapiens
tccagccctgttccctttt

SEQ ID NO: 9484293 - DNA, 22 bp, Homo sapiens
tccagccctgtgtctgggagag

SEQ ID NO: 9484294 - DNA, 19 bp, Homo sapiens
tccagccctgttccctttt

SEQ ID NO: 9484295 - DNA, 22 bp, Homo sapiens
tccagccgccggccctgcaggt

SEQ ID NO: 9484296 - DNA, 22 bp, Homo sapiens
tccagccctgtgtctgggagag

SEQ ID NO: 9484297 - DNA, 22 bp, Homo sapiens
tccagccctgtgtctgggagag

SEQ ID NO: 9484298 - DNA, 22 bp, Homo sapiens
tccagccctgtggcttccaccc

SEQ ID NO: 9484299 - DNA, 22 bp, Homo sapiens
tccagccctgtgtctgggagag

SEQ ID NO: 9484300 - DNA, 22 bp, Homo sapiens
tccagccctgtggcttccaccc

SEQ ID NO: 9484301 - DNA, 22 bp, Homo sapiens
tccagactgccctgcacatgtg

SEQ ID NO: 9484302 - DNA, 22 bp, Homo sapiens
tccagactgcttctaggatgag

SEQ ID NO: 9484303 - DNA, 22 bp, Homo sapiens
tccagactggggccatgtctgc

SEQ ID NO: 9484304 - DNA, 19 bp, Homo sapiens
tccagactgtccaggctat

SEQ ID NO: 9484305 - DNA, 22 bp, Homo sapiens
tccagactgttcacattggcat

SEQ ID NO: 9484306 - DNA, 19 bp, Homo sapiens
tccagactgtccaggctat

SEQ ID NO: 9484307 - DNA, 22 bp, Homo sapiens
tccagactctttaagttcattt

SEQ ID NO: 9484308 - DNA, 22 bp, Homo sapiens
tccagactctgtcacttcctag

SEQ ID NO: 9484309 - DNA, 22 bp, Homo sapiens
tccagactctgtcacttcctag

SEQ ID NO: 9484310 - DNA, 22 bp, Homo sapiens
tccagactctgtcacttcctag

SEQ ID NO: 9484311 - DNA, 23 bp, Homo sapiens
tccagactctaaagccctccaca

SEQ ID NO: 9484312 - DNA, 22 bp, Homo sapiens
tccagactcactcatgtgacta

SEQ ID NO: 9484313 - DNA, 22 bp, Homo sapiens
tccagagaattctacgcagtgc

SEQ ID NO: 9484314 - DNA, 22 bp, Homo sapiens
tccagagacttgcatgtgcttg

SEQ ID NO: 9484315 - DNA, 22 bp, Homo sapiens
tccagagaacgatgaaagctgg

SEQ ID NO: 9484316 - DNA, 22 bp, Homo sapiens
tccagagaacgatgaaagctgg

SEQ ID NO: 9484317 - DNA, 22 bp, Homo sapiens
tccagctgctgccagccaagct

SEQ ID NO: 9484318 - DNA, 22 bp, Homo sapiens
tccagctgcaaggggcacagct

SEQ ID NO: 9484319 - DNA, 23 bp, Homo sapiens
tccagctgcagtgggatggggaa

SEQ ID NO: 9484320 - DNA, 21 bp, Homo sapiens
tccagctgcacaagcatgggg

SEQ ID NO: 9484321 - DNA, 21 bp, Homo sapiens
tccagctgcacaagcatgggg

SEQ ID NO: 9484322 - DNA, 22 bp, Homo sapiens
tccagctgcaaggggcacagct

SEQ ID NO: 9484323 - DNA, 22 bp, Homo sapiens
tccagctgcaaggggcacagct

SEQ ID NO: 9484324 - DNA, 22 bp, Homo sapiens
tccagctgaggtggcctctgtg

SEQ ID NO: 9484325 - DNA, 22 bp, Homo sapiens
tccagctgaggtggcctctgtg

SEQ ID NO: 9484326 - DNA, 22 bp, Homo sapiens
tccagctgacatctcctgaggg

SEQ ID NO: 9484327 - DNA, 22 bp, Homo sapiens
tccagctgacatctcctgaggg

SEQ ID NO: 9484328 - DNA, 22 bp, Homo sapiens
tccagctcttgttgcccactgc

SEQ ID NO: 9484329 - DNA, 22 bp, Homo sapiens
tccagctcttcagttctgcaaa

SEQ ID NO: 9484330 - DNA, 22 bp, Homo sapiens
tccagctcttgttgcccactgc

SEQ ID NO: 9484331 - DNA, 17 bp, Homo sapiens
tccagcctcctctgctg

SEQ ID NO: 9484332 - DNA, 17 bp, Homo sapiens
tccagcctcctctgctg

SEQ ID NO: 9484333 - DNA, 17 bp, Homo sapiens
tccagcctcctctgctg

SEQ ID NO: 9484334 - DNA, 22 bp, Homo sapiens
tccagcctcctatttaccctaa

SEQ ID NO: 9484335 - DNA, 22 bp, Homo sapiens
tccagcctaggggaacagctgc

SEQ ID NO: 9484336 - DNA, 22 bp, Homo sapiens
tccagcctaggggaacagctgc

SEQ ID NO: 9484337 - DNA, 22 bp, Homo sapiens
tccagcctaggggaacagctgc

SEQ ID NO: 9484338 - DNA, 22 bp, Homo sapiens
tccagcctaatgttcttcccac

SEQ ID NO: 9484339 - DNA, 22 bp, Homo sapiens
tccagcctcatttctcctgctt

SEQ ID NO: 9484340 - DNA, 22 bp, Homo sapiens
tccagcctcatttctcctgctt

SEQ ID NO: 9484341 - DNA, 22 bp, Homo sapiens
tccagcctcatttctcctgctt

SEQ ID NO: 9484342 - DNA, 22 bp, Homo sapiens
tccagcctcatttctcctgctt

SEQ ID NO: 9484343 - DNA, 22 bp, Homo sapiens
tccagctggcccggccatgaat

SEQ ID NO: 9484344 - DNA, 22 bp, Homo sapiens
tccagctggcccggccatgaat

SEQ ID NO: 9484345 - DNA, 22 bp, Homo sapiens
tccagctggcccggccatgaat

SEQ ID NO: 9484346 - DNA, 22 bp, Homo sapiens
tccagctggcctaacttcaggg

SEQ ID NO: 9484347 - DNA, 20 bp, Homo sapiens
tccaggcagctcagagtgtc

SEQ ID NO: 9484348 - DNA, 22 bp, Homo sapiens
tccaggcccatagacacttctc

SEQ ID NO: 9484349 - DNA, 20 bp, Homo sapiens
tccaggcagctcagagtgtc

SEQ ID NO: 9484350 - DNA, 20 bp, Homo sapiens
tccaggcagctcagagtgtc

SEQ ID NO: 9484351 - DNA, 22 bp, Homo sapiens
tccaggccccactgaagcccct

SEQ ID NO: 9484352 - DNA, 22 bp, Homo sapiens
tccaggccccactgaagcccct

SEQ ID NO: 9484353 - DNA, 22 bp, Homo sapiens
tccaggcccatggagcagagct

SEQ ID NO: 9484354 - DNA, 22 bp, Homo sapiens
tccaggcccatggagcagagct

SEQ ID NO: 9484355 - DNA, 22 bp, Homo sapiens
tccaggctcagcacttgctact

SEQ ID NO: 9484356 - DNA, 22 bp, Homo sapiens
tccaggcccctgcctgggcctg

SEQ ID NO: 9484357 - DNA, 22 bp, Homo sapiens
tccaggcccctgcctgggcctg

SEQ ID NO: 9484358 - DNA, 22 bp, Homo sapiens
tccaggccccagcaccttggga

SEQ ID NO: 9484359 - DNA, 22 bp, Homo sapiens
tccaggccccccacgctaatgg

SEQ ID NO: 9484360 - DNA, 22 bp, Homo sapiens
tccaggccccagaccgtactgc

SEQ ID NO: 9484361 - DNA, 22 bp, Homo sapiens
tccaggccccagaccgtactgc

SEQ ID NO: 9484362 - DNA, 22 bp, Homo sapiens
tccaggccccactgaagcccct

SEQ ID NO: 9484363 - DNA, 22 bp, Homo sapiens
tccaggctcccctgcgtgctcc

SEQ ID NO: 9484364 - DNA, 22 bp, Homo sapiens
tccaggctcccctgcgtgctcc

SEQ ID NO: 9484365 - DNA, 22 bp, Homo sapiens
tccaggctcccctgcgtgctcc

SEQ ID NO: 9484366 - DNA, 22 bp, Homo sapiens
tccaggctcccctgcgtgctcc

SEQ ID NO: 9484367 - DNA, 18 bp, Homo sapiens
tccaggctccaggctaac

SEQ ID NO: 9484368 - DNA, 18 bp, Homo sapiens
tccaggctccaggctaac

SEQ ID NO: 9484369 - DNA, 22 bp, Homo sapiens
catgtgtgtggacgagcgtggc

SEQ ID NO: 9484370 - DNA, 22 bp, Homo sapiens
catgtgtgtctccaccagctgc

SEQ ID NO: 9484371 - DNA, 18 bp, Homo sapiens
catgtgttctacatcagt

SEQ ID NO: 9484372 - DNA, 22 bp, Homo sapiens
catgtgtgtggacgagcgtggc

SEQ ID NO: 9484373 - DNA, 22 bp, Homo sapiens
catgtgttttgtcatttcaata

SEQ ID NO: 9484374 - DNA, 22 bp, Homo sapiens
catgtgttttgtcatttcaata

SEQ ID NO: 9484375 - DNA, 22 bp, Homo sapiens
catgttaaaatatacattctga

SEQ ID NO: 9484376 - DNA, 22 bp, Homo sapiens
tcatgcaatgagtcaggaggca

SEQ ID NO: 9484377 - DNA, 22 bp, Homo sapiens
catcttttcagaagccattctg

SEQ ID NO: 9484378 - DNA, 22 bp, Homo sapiens
catcttttcagaagccattctg

SEQ ID NO: 9484379 - DNA, 22 bp, Homo sapiens
catcttttggcctattctgagg

SEQ ID NO: 9484380 - DNA, 22 bp, Homo sapiens
catctttgttctgtaaactttt

SEQ ID NO: 9484381 - DNA, 23 bp, Homo sapiens
tcatgtggaaaaggatctggtct

SEQ ID NO: 9484382 - DNA, 22 bp, Homo sapiens
tcatgtgacaggcactgttctg

SEQ ID NO: 9484383 - DNA, 20 bp, Homo sapiens
tcattccaaatagttcagca

SEQ ID NO: 9484384 - DNA, 22 bp, Homo sapiens
catgaaaaatttactgttaaca

SEQ ID NO: 9484385 - DNA, 22 bp, Homo sapiens
catgaaaaatttactgttaaca

SEQ ID NO: 9484386 - DNA, 22 bp, Homo sapiens
catgaaaaatttactgttaaca

SEQ ID NO: 9484387 - DNA, 19 bp, Homo sapiens
tcatgtctctcatctgtga

SEQ ID NO: 9484388 - DNA, 22 bp, Homo sapiens
tcatgtctgggagcagactcca

SEQ ID NO: 9484389 - DNA, 22 bp, Homo sapiens
tcatgcaaggctgaaacatggt

SEQ ID NO: 9484390 - DNA, 22 bp, Homo sapiens
tcatgcaaaagacttgaacttt

SEQ ID NO: 9484391 - DNA, 22 bp, Homo sapiens
tcatgcaaatactgttccagaa

SEQ ID NO: 9484392 - DNA, 22 bp, Homo sapiens
tcatgcaaagccaattccagct

SEQ ID NO: 9484393 - DNA, 22 bp, Homo sapiens
tcatgcaaagccaattccagct

SEQ ID NO: 9484394 - DNA, 22 bp, Homo sapiens
tcatgagtttaaggtttaggct

SEQ ID NO: 9484395 - DNA, 22 bp, Homo sapiens
tcatgaggatttactagactag

SEQ ID NO: 9484396 - DNA, 18 bp, Homo sapiens
tcatgaggtagaggctgg

SEQ ID NO: 9484397 - DNA, 22 bp, Homo sapiens
tcatgagtggattaatatggct

SEQ ID NO: 9484398 - DNA, 22 bp, Homo sapiens
tcatgagtctgcaaattatgga

SEQ ID NO: 9484399 - DNA, 22 bp, Homo sapiens
tcatgaatcgtggaatgattta

SEQ ID NO: 9484400 - DNA, 22 bp, Homo sapiens
tcatgacaactatattattcca

SEQ ID NO: 9484401 - DNA, 22 bp, Homo sapiens
tcatgacagaggagctggaatg

SEQ ID NO: 9484402 - DNA, 22 bp, Homo sapiens
tcatgacactgggacaggagag

SEQ ID NO: 9484403 - DNA, 22 bp, Homo sapiens
tcatgacaggtgagtttttagg

SEQ ID NO: 9484404 - DNA, 22 bp, Homo sapiens
tcatgacatctgtttatctcaa

SEQ ID NO: 9484405 - DNA, 22 bp, Homo sapiens
tcatgaacttcctagccagact

SEQ ID NO: 9484406 - DNA, 22 bp, Homo sapiens
tcatgaacatggaatatctttt

SEQ ID NO: 9484407 - DNA, 22 bp, Homo sapiens
tcatgaacatctcaaataacca

SEQ ID NO: 9484408 - DNA, 22 bp, Homo sapiens
tcatgaacaaatgatttactaa

SEQ ID NO: 9484409 - DNA, 22 bp, Homo sapiens
tcattccctccagctgtggcta

SEQ ID NO: 9484410 - DNA, 22 bp, Homo sapiens
tcattccatttccagctctgaa

SEQ ID NO: 9484411 - DNA, 22 bp, Homo sapiens
tcattcctcaggaagggattta

SEQ ID NO: 9484412 - DNA, 22 bp, Homo sapiens
tcattccttaacattcatttgc

SEQ ID NO: 9484413 - DNA, 22 bp, Homo sapiens
tcattcctccagcgggagtcca

SEQ ID NO: 9484414 - DNA, 22 bp, Homo sapiens
tcattctcagactcttggcctc

SEQ ID NO: 9484415 - DNA, 22 bp, Homo sapiens
tcattcctttacagttgatcct

SEQ ID NO: 9484416 - DNA, 22 bp, Homo sapiens
tcattccttatccgtatctttt

SEQ ID NO: 9484417 - DNA, 22 bp, Homo sapiens
tcattctcagactcttggcctc

SEQ ID NO: 9484418 - DNA, 22 bp, Homo sapiens
tcattctctgggatgcagtttg

SEQ ID NO: 9484419 - DNA, 22 bp, Homo sapiens
tcattctgcatcactcttgctc

SEQ ID NO: 9484420 - DNA, 22 bp, Homo sapiens
tcattcttgcgtatgccatggt

SEQ ID NO: 9484421 - DNA, 22 bp, Homo sapiens
tcattgaaaactcagcatctac

SEQ ID NO: 9484422 - DNA, 22 bp, Homo sapiens
tcatttatgcaggaatggcata

SEQ ID NO: 9484423 - DNA, 22 bp, Homo sapiens
tcatttatgcaggaatggcata

SEQ ID NO: 9484424 - DNA, 22 bp, Homo sapiens
tcatttatgcaggaatggcata

SEQ ID NO: 9484425 - DNA, 22 bp, Homo sapiens
tcatttatgcaggaatggcata

SEQ ID NO: 9484426 - DNA, 22 bp, Homo sapiens
tcatttatcatttgtgctgtag

SEQ ID NO: 9484427 - DNA, 22 bp, Homo sapiens
tcatttatcgctgccttttaaa

SEQ ID NO: 9484428 - DNA, 22 bp, Homo sapiens
tcatttatcgctgccttttaaa

SEQ ID NO: 9484429 - DNA, 21 bp, Homo sapiens
tcatttattgagaaatgactg

SEQ ID NO: 9484430 - DNA, 21 bp, Homo sapiens
tcatttattgagaaatgactg

SEQ ID NO: 9484431 - DNA, 21 bp, Homo sapiens
tcatttattgagaaatgactg

SEQ ID NO: 9484432 - DNA, 21 bp, Homo sapiens
tcatttattgagaaatgactg

SEQ ID NO: 9484433 - DNA, 21 bp, Homo sapiens
tcatttattgagaaatgactg

SEQ ID NO: 9484434 - DNA, 21 bp, Homo sapiens
tcatttattgagaaatgactg

SEQ ID NO: 9484435 - DNA, 21 bp, Homo sapiens
tcatttattgagaaatgactg

SEQ ID NO: 9484436 - DNA, 22 bp, Homo sapiens
tcatttatgcaggaatggcata

SEQ ID NO: 9484437 - DNA, 22 bp, Homo sapiens
tcatttatgtctttgccatcca

SEQ ID NO: 9484438 - DNA, 21 bp, Homo sapiens
tcatttattgagaaatgactg

SEQ ID NO: 9484439 - DNA, 22 bp, Homo sapiens
tcatttatgcaggaatggcata

SEQ ID NO: 9484440 - DNA, 22 bp, Homo sapiens
tccagaccatggatggctgcaa

SEQ ID NO: 9484441 - DNA, 22 bp, Homo sapiens
tccagaccatggatggctgcaa

SEQ ID NO: 9484442 - DNA, 22 bp, Homo sapiens
tccagaccaaggaaggctgggc

SEQ ID NO: 9484443 - DNA, 22 bp, Homo sapiens
tccacattatgtttctcctttc

SEQ ID NO: 9484444 - DNA, 22 bp, Homo sapiens
tccacatgacttctaataactg

SEQ ID NO: 9484445 - DNA, 22 bp, Homo sapiens
tccacatgacttctaataactg

SEQ ID NO: 9484446 - DNA, 22 bp, Homo sapiens
tccacattatgtttctcctttc

SEQ ID NO: 9484447 - DNA, 22 bp, Homo sapiens
tccacattagaatgttttctca

SEQ ID NO: 9484448 - DNA, 22 bp, Homo sapiens
tccacattatgtttctcctttc

SEQ ID NO: 9484449 - DNA, 22 bp, Homo sapiens
tccacagttttgccactagctg

SEQ ID NO: 9484450 - DNA, 22 bp, Homo sapiens
tccacagttttgccactagctg

SEQ ID NO: 9484451 - DNA, 22 bp, Homo sapiens
tccacagttttgccactagctg

SEQ ID NO: 9484452 - DNA, 22 bp, Homo sapiens
tccacatctctcgccaaccaat

SEQ ID NO: 9484453 - DNA, 22 bp, Homo sapiens
tccacatagtcattaatttctg

SEQ ID NO: 9484454 - DNA, 22 bp, Homo sapiens
tccacatcaagggcagagaggt

SEQ ID NO: 9484455 - DNA, 22 bp, Homo sapiens
tcatttatttataccattgcct

SEQ ID NO: 9484456 - DNA, 22 bp, Homo sapiens
tcatttatttgactttggagtg

SEQ ID NO: 9484457 - DNA, 22 bp, Homo sapiens
tcatttatttgactttggagtg

SEQ ID NO: 9484458 - DNA, 17 bp, Homo sapiens
tccaagccagcttgcct

SEQ ID NO: 9484459 - DNA, 22 bp, Homo sapiens
tccacagggcctttctggtgtg

SEQ ID NO: 9484460 - DNA, 21 bp, Homo sapiens
tccaagccttcaacacattca

SEQ ID NO: 9484461 - DNA, 22 bp, Homo sapiens
tccacagtggtggaattgttca

SEQ ID NO: 9484462 - DNA, 22 bp, Homo sapiens
tccacaggtccggcatgaacag

SEQ ID NO: 9484463 - DNA, 22 bp, Homo sapiens
tccacaggtccggcatgaacag

SEQ ID NO: 9484464 - DNA, 22 bp, Homo sapiens
tccacaggtcctctttgcaaag

SEQ ID NO: 9484465 - DNA, 22 bp, Homo sapiens
tccacaggtatgaggccccacc

SEQ ID NO: 9484466 - DNA, 22 bp, Homo sapiens
tccacaggtatttctccttgct

SEQ ID NO: 9484467 - DNA, 22 bp, Homo sapiens
tccacaggtatttctccttgct

SEQ ID NO: 9484468 - DNA, 22 bp, Homo sapiens
tccacaggtcagggagataggc

SEQ ID NO: 9484469 - DNA, 16 bp, Homo sapiens
ccacctgcagctctca

SEQ ID NO: 9484470 - DNA, 22 bp, Homo sapiens
ccacctcctcggccatgtgacg

SEQ ID NO: 9484471 - DNA, 22 bp, Homo sapiens
ccacctcctcggccatgtgacg

SEQ ID NO: 9484472 - DNA, 22 bp, Homo sapiens
ccacctctcagggtttcctaat

SEQ ID NO: 9484473 - DNA, 22 bp, Homo sapiens
ccacctcctcggccatgtgacg

SEQ ID NO: 9484474 - DNA, 22 bp, Homo sapiens
ccacctccacctattgccagcc

SEQ ID NO: 9484475 - DNA, 22 bp, Homo sapiens
tctcaactaatggtgcaagatg

SEQ ID NO: 9484476 - DNA, 21 bp, Homo sapiens
tctcaacttttctctttgggc

SEQ ID NO: 9484477 - DNA, 22 bp, Homo sapiens
tctcaactttgagaaacattgt

SEQ ID NO: 9484478 - DNA, 21 bp, Homo sapiens
tctcaacttttctctttgggc

SEQ ID NO: 9484479 - DNA, 22 bp, Homo sapiens
tctcaagcttgttggtatgttt

SEQ ID NO: 9484480 - DNA, 22 bp, Homo sapiens
tctcaagcttgttggtatgttt

SEQ ID NO: 9484481 - DNA, 22 bp, Homo sapiens
tctcaaatgtaaagcatgattt

SEQ ID NO: 9484482 - DNA, 22 bp, Homo sapiens
tctcaaattcccttttcctcct

SEQ ID NO: 9484483 - DNA, 22 bp, Homo sapiens
tctcaaatttatacagagttca

SEQ ID NO: 9484484 - DNA, 22 bp, Homo sapiens
tctcaaatttgttagataaaat

SEQ ID NO: 9484485 - DNA, 22 bp, Homo sapiens
tctcaacagtgaaatgtgtttg

SEQ ID NO: 9484486 - DNA, 22 bp, Homo sapiens
ccacttttctacccactgtgac

SEQ ID NO: 9484487 - DNA, 22 bp, Homo sapiens
ccacttttcactaagatgaatt

SEQ ID NO: 9484488 - DNA, 22 bp, Homo sapiens
ccacttttcactaagatgaatt

SEQ ID NO: 9484489 - DNA, 19 bp, Homo sapiens
ccactttgcttctctgggt

SEQ ID NO: 9484490 - DNA, 22 bp, Homo sapiens
ccactttttcagtgtgcatgca

SEQ ID NO: 9484491 - DNA, 22 bp, Homo sapiens
ccacttttttctccatctctga

SEQ ID NO: 9484492 - DNA, 22 bp, Homo sapiens
ccacttttttctccatctctga

SEQ ID NO: 9484493 - DNA, 22 bp, Homo sapiens
ccactttttagagaacaaaact

SEQ ID NO: 9484494 - DNA, 22 bp, Homo sapiens
ccacttttgggaacagtgagta

SEQ ID NO: 9484495 - DNA, 22 bp, Homo sapiens
ccactttgagaagctgatgaaa

SEQ ID NO: 9484496 - DNA, 22 bp, Homo sapiens
ccactttgaaccactgaggtgg

SEQ ID NO: 9484497 - DNA, 22 bp, Homo sapiens
ccacttgaaacttagtggcata

SEQ ID NO: 9484498 - DNA, 22 bp, Homo sapiens
ccacttgtgaaataatcaaata

SEQ ID NO: 9484499 - DNA, 22 bp, Homo sapiens
tctccacaagtgttgagagtac

SEQ ID NO: 9484500 - DNA, 22 bp, Homo sapiens
tctccacaagctttctcctttt

SEQ ID NO: 9484501 - DNA, 22 bp, Homo sapiens
tctcagtttcctcatatgtaaa

SEQ ID NO: 9484502 - DNA, 22 bp, Homo sapiens
ccagaaaaatcctcccttgtcc

SEQ ID NO: 9484503 - DNA, 22 bp, Homo sapiens
ccagaaaaatcctcccttgtcc

SEQ ID NO: 9484504 - DNA, 22 bp, Homo sapiens
tctccacattctattggctata

SEQ ID NO: 9484505 - DNA, 22 bp, Homo sapiens
tctccactattttctagctctt

SEQ ID NO: 9484506 - DNA, 22 bp, Homo sapiens
tctccacagtcccacctcgctt

SEQ ID NO: 9484507 - DNA, 22 bp, Homo sapiens
tctccacagaaggttccaggcc

SEQ ID NO: 9484508 - DNA, 22 bp, Homo sapiens
tctccacagaaggttccaggcc

SEQ ID NO: 9484509 - DNA, 22 bp, Homo sapiens
tctccacaccagaaggagctga

SEQ ID NO: 9484510 - DNA, 22 bp, Homo sapiens
ccagagagctacaaggcataaa

SEQ ID NO: 9484511 - DNA, 22 bp, Homo sapiens
ccagagagctacaaggcataaa

SEQ ID NO: 9484512 - DNA, 22 bp, Homo sapiens
ccagagagctacaaggcataaa

SEQ ID NO: 9484513 - DNA, 19 bp, Homo sapiens
ccagagagctaggtacaga

SEQ ID NO: 9484514 - DNA, 22 bp, Homo sapiens
ccagagaggcaaaactccttcc

SEQ ID NO: 9484515 - DNA, 21 bp, Homo sapiens
ccagagagagggaagtgggtt

SEQ ID NO: 9484516 - DNA, 22 bp, Homo sapiens
ccagagagagtactgggctctg

SEQ ID NO: 9484517 - DNA, 22 bp, Homo sapiens
ccagagagagtactgggctctg

SEQ ID NO: 9484518 - DNA, 22 bp, Homo sapiens
ccagagagagtactgggctctg

SEQ ID NO: 9484519 - DNA, 18 bp, Homo sapiens
tctccacttctgtgagaa

SEQ ID NO: 9484520 - DNA, 18 bp, Homo sapiens
tctccacttctgtgagaa

SEQ ID NO: 9484521 - DNA, 22 bp, Homo sapiens
tctccactctgagtgcctttca

SEQ ID NO: 9484522 - DNA, 22 bp, Homo sapiens
tctccactctgagtgcctttca

SEQ ID NO: 9484523 - DNA, 22 bp, Homo sapiens
tctccagagtaaccttggagca

SEQ ID NO: 9484524 - DNA, 20 bp, Homo sapiens
tctccagatgcagatgacat

SEQ ID NO: 9484525 - DNA, 20 bp, Homo sapiens
tctccagatgcagatgacat

SEQ ID NO: 9484526 - DNA, 19 bp, Homo sapiens
tctccagctttgggctttt

SEQ ID NO: 9484527 - DNA, 22 bp, Homo sapiens
tctccaggaaagacactggact

SEQ ID NO: 9484528 - DNA, 22 bp, Homo sapiens
tctccaggaaccatcatggtaa

SEQ ID NO: 9484529 - DNA, 22 bp, Homo sapiens
tctccgatcacaggttttcaat

SEQ ID NO: 9484530 - DNA, 20 bp, Homo sapiens
tctccctgcccatctcagat

SEQ ID NO: 9484531 - DNA, 20 bp, Homo sapiens
tctccctgcccatctcagat

SEQ ID NO: 9484532 - DNA, 23 bp, Homo sapiens
tctccctgaggttgttagcatta

SEQ ID NO: 9484533 - DNA, 22 bp, Homo sapiens
tctccctctttgtctgctttgg

SEQ ID NO: 9484534 - DNA, 22 bp, Homo sapiens
tctccctctttgtctgctttgg

SEQ ID NO: 9484535 - DNA, 22 bp, Homo sapiens
tctccctctttgtctgctttgg

SEQ ID NO: 9484536 - DNA, 22 bp, Homo sapiens
ccagagaggccttggcaagaca

SEQ ID NO: 9484537 - DNA, 22 bp, Homo sapiens
ccagagaggccaaggtcgtggt

SEQ ID NO: 9484538 - DNA, 22 bp, Homo sapiens
ccagagaggccaaggtcgtggt

SEQ ID NO: 9484539 - DNA, 22 bp, Homo sapiens
ccagagaggcaaaactccttcc

SEQ ID NO: 9484540 - DNA, 22 bp, Homo sapiens
tctccctcattcctgcttccat

SEQ ID NO: 9484541 - DNA, 22 bp, Homo sapiens
tctccctcattcctgcttccat

SEQ ID NO: 9484542 - DNA, 22 bp, Homo sapiens
tctccctcattcctgcttccat

SEQ ID NO: 9484543 - DNA, 22 bp, Homo sapiens
tctccctctcagatttattcac

SEQ ID NO: 9484544 - DNA, 22 bp, Homo sapiens
tctccctctgtaagatcagggg

SEQ ID NO: 9484545 - DNA, 22 bp, Homo sapiens
tctccctctgtaagatcagggg

SEQ ID NO: 9484546 - DNA, 22 bp, Homo sapiens
tctccctctgtaagatcagggg

SEQ ID NO: 9484547 - DNA, 22 bp, Homo sapiens
ccaccagagggcagactgtgat

SEQ ID NO: 9484548 - DNA, 22 bp, Homo sapiens
ccaccagatttactttactatt

SEQ ID NO: 9484549 - DNA, 22 bp, Homo sapiens
ccaccagagggcagactgtgat

SEQ ID NO: 9484550 - DNA, 22 bp, Homo sapiens
ccaccagagcttcgtggcttaa

SEQ ID NO: 9484551 - DNA, 22 bp, Homo sapiens
ccaccagaccaccaagagcaac

SEQ ID NO: 9484552 - DNA, 22 bp, Homo sapiens
ccaccagctgcatatgcacgta

SEQ ID NO: 9484553 - DNA, 22 bp, Homo sapiens
ccaccagcttcagcagccgcgg

SEQ ID NO: 9484554 - DNA, 22 bp, Homo sapiens
ccacattttgctttgcctaggt

SEQ ID NO: 9484555 - DNA, 22 bp, Homo sapiens
ccaccagaccaccaagagcaac

SEQ ID NO: 9484556 - DNA, 22 bp, Homo sapiens
ccaccagaagctgggagaagct

SEQ ID NO: 9484557 - DNA, 22 bp, Homo sapiens
ccaccagaagctgggagaagct

SEQ ID NO: 9484558 - DNA, 22 bp, Homo sapiens
ccaccagaagctgggagaagct

SEQ ID NO: 9484559 - DNA, 22 bp, Homo sapiens
ccaccagaaagactctgtgtga

SEQ ID NO: 9484560 - DNA, 22 bp, Homo sapiens
ccaccacttctggcttctggtg

SEQ ID NO: 9484561 - DNA, 18 bp, Homo sapiens
tcctttcaccccttctct

SEQ ID NO: 9484562 - DNA, 22 bp, Homo sapiens
ccaccaggacagccctgagggg

SEQ ID NO: 9484563 - DNA, 22 bp, Homo sapiens
tcctttccagcctcacctcagc

SEQ ID NO: 9484564 - DNA, 22 bp, Homo sapiens
tcctttccagcctcacctcagc

SEQ ID NO: 9484565 - DNA, 22 bp, Homo sapiens
tcctttccagcctcacctcagc

SEQ ID NO: 9484566 - DNA, 22 bp, Homo sapiens
ccaccagctttgccaccctgct

SEQ ID NO: 9484567 - DNA, 22 bp, Homo sapiens
ccaccagctttgccaccctgct

SEQ ID NO: 9484568 - DNA, 22 bp, Homo sapiens
ccaccagctttgccaccctgct

SEQ ID NO: 9484569 - DNA, 22 bp, Homo sapiens
ccaccagctttggcggtgacag

SEQ ID NO: 9484570 - DNA, 22 bp, Homo sapiens
tcgctggcctggaggggagcca

SEQ ID NO: 9484571 - DNA, 22 bp, Homo sapiens
tcgctgaggctgcacggctgcc

SEQ ID NO: 9484572 - DNA, 22 bp, Homo sapiens
tcgcgcccccaagcgtcattgg

SEQ ID NO: 9484573 - DNA, 22 bp, Homo sapiens
tcgccccgaggcagccctatgc

SEQ ID NO: 9484574 - DNA, 22 bp, Homo sapiens
ccaccgccatggcgttgtacag

SEQ ID NO: 9484575 - DNA, 22 bp, Homo sapiens
ccaccgctgaaggcactggcat

SEQ ID NO: 9484576 - DNA, 22 bp, Homo sapiens
ccacccttgggttcggaggccg

SEQ ID NO: 9484577 - DNA, 22 bp, Homo sapiens
ccaccctgtgtttttgccattg

SEQ ID NO: 9484578 - DNA, 22 bp, Homo sapiens
ccaccctgtgcaggcgtgggta

SEQ ID NO: 9484579 - DNA, 23 bp, Homo sapiens
tcggtgggcgtggaggccgaggc

SEQ ID NO: 9484580 - DNA, 22 bp, Homo sapiens
ccaccctgggttctgatgtgga

SEQ ID NO: 9484581 - DNA, 22 bp, Homo sapiens
ccaccctgggttctgatgtgga

SEQ ID NO: 9484582 - DNA, 22 bp, Homo sapiens
tcggagagctcacagctgtggc

SEQ ID NO: 9484583 - DNA, 22 bp, Homo sapiens
tcggagctgtagatgaaaccct

SEQ ID NO: 9484584 - DNA, 22 bp, Homo sapiens
tcgctgtgaaaaccttggacaa

SEQ ID NO: 9484585 - DNA, 22 bp, Homo sapiens
tcgggctcgctctcctagcgga

SEQ ID NO: 9484586 - DNA, 22 bp, Homo sapiens
tcggggtctttgacacgctctg

SEQ ID NO: 9484587 - DNA, 20 bp, Homo sapiens
tcctgaatttcctttctgct

SEQ ID NO: 9484588 - DNA, 22 bp, Homo sapiens
tcctgacctgaactggggtctt

SEQ ID NO: 9484589 - DNA, 22 bp, Homo sapiens
ccacagtgatccctgcctgcga

SEQ ID NO: 9484590 - DNA, 22 bp, Homo sapiens
ccacagtgatccctgcctgcga

SEQ ID NO: 9484591 - DNA, 22 bp, Homo sapiens
ccacagtgagttctgtactctg

SEQ ID NO: 9484592 - DNA, 22 bp, Homo sapiens
tcctgacctgaactggggtctt

SEQ ID NO: 9484593 - DNA, 22 bp, Homo sapiens
ccacatgaaattgcttatattt

SEQ ID NO: 9484594 - DNA, 22 bp, Homo sapiens
ccacatgagctggcaatgccct

SEQ ID NO: 9484595 - DNA, 20 bp, Homo sapiens
ccacatgagctctttctgac

SEQ ID NO: 9484596 - DNA, 22 bp, Homo sapiens
ccacatgatgaggaagctgaac

SEQ ID NO: 9484597 - DNA, 22 bp, Homo sapiens
ccacatgctctctctccaggtt

SEQ ID NO: 9484598 - DNA, 22 bp, Homo sapiens
ccacatctgcagtcccttctgt

SEQ ID NO: 9484599 - DNA, 22 bp, Homo sapiens
ccacatgctcaccaagtccctg

SEQ ID NO: 9484600 - DNA, 22 bp, Homo sapiens
ccacatgatgaggaagctgaac

SEQ ID NO: 9484601 - DNA, 22 bp, Homo sapiens
ccacatctcttgatgtacctac

SEQ ID NO: 9484602 - DNA, 22 bp, Homo sapiens
ccacatctgttcttagttctga

SEQ ID NO: 9484603 - DNA, 22 bp, Homo sapiens
ccacatctggtggccagtgcta

SEQ ID NO: 9484604 - DNA, 22 bp, Homo sapiens
ccacatctgcatttaatgtata

SEQ ID NO: 9484605 - DNA, 23 bp, Homo sapiens
ccacatggcaagatgatgcattc

SEQ ID NO: 9484606 - DNA, 23 bp, Homo sapiens
ccacatggcaagatgatgcattc

SEQ ID NO: 9484607 - DNA, 22 bp, Homo sapiens
ccacatggatagatagggacat

SEQ ID NO: 9484608 - DNA, 22 bp, Homo sapiens
ccacatggatagatagggacat

SEQ ID NO: 9484609 - DNA, 22 bp, Homo sapiens
ccacatggagcaggaggtgggg

SEQ ID NO: 9484610 - DNA, 22 bp, Homo sapiens
ccacatggagcaggaggtgggg

SEQ ID NO: 9484611 - DNA, 19 bp, Homo sapiens
ccacatggctggatgacag

SEQ ID NO: 9484612 - DNA, 19 bp, Homo sapiens
ccacatggctggatgacag

SEQ ID NO: 9484613 - DNA, 23 bp, Homo sapiens
ccacatggcaagatgatgcattc

SEQ ID NO: 9484614 - DNA, 22 bp, Homo sapiens
ccacatgtgcactgctgtatgg

SEQ ID NO: 9484615 - DNA, 22 bp, Homo sapiens
ccacatgtgcactgctgtatgg

SEQ ID NO: 9484616 - DNA, 22 bp, Homo sapiens
ccacatgtgcactgctgtatgg

SEQ ID NO: 9484617 - DNA, 22 bp, Homo sapiens
ccacatgtgcactgctgtatgg

SEQ ID NO: 9484618 - DNA, 21 bp, Homo sapiens
ccacatggtgaaaccctatct

SEQ ID NO: 9484619 - DNA, 22 bp, Homo sapiens
ccacattgactgtctgtagatt

SEQ ID NO: 9484620 - DNA, 21 bp, Homo sapiens
ccacattctcattctgactgc

SEQ ID NO: 9484621 - DNA, 21 bp, Homo sapiens
ccacattctcattctgactgc

SEQ ID NO: 9484622 - DNA, 22 bp, Homo sapiens
ccacattcagtccaggcttgga

SEQ ID NO: 9484623 - DNA, 22 bp, Homo sapiens
ccacattcagtccaggcttgga

SEQ ID NO: 9484624 - DNA, 22 bp, Homo sapiens
ccacattcactcatttcattgt

SEQ ID NO: 9484625 - DNA, 22 bp, Homo sapiens
ccacattcaccagctgcacgac

SEQ ID NO: 9484626 - DNA, 22 bp, Homo sapiens
ccacatttactggatgctcagg

SEQ ID NO: 9484627 - DNA, 22 bp, Homo sapiens
ccacatttactggatgctcagg

SEQ ID NO: 9484628 - DNA, 22 bp, Homo sapiens
ccacatttcttcacttgtccca

SEQ ID NO: 9484629 - DNA, 22 bp, Homo sapiens
ccacatttcttcacttgtccca

SEQ ID NO: 9484630 - DNA, 22 bp, Homo sapiens
ccacatttggagaagatacttt

SEQ ID NO: 9484631 - DNA, 22 bp, Homo sapiens
tcctgaattgttgagaagcagc

SEQ ID NO: 9484632 - DNA, 22 bp, Homo sapiens
tcctgaatttcccagcatgaac

SEQ ID NO: 9484633 - DNA, 22 bp, Homo sapiens
tcctgaattgaactcagttaat

SEQ ID NO: 9484634 - DNA, 22 bp, Homo sapiens
tcctgaataaattagctgtcac

SEQ ID NO: 9484635 - DNA, 22 bp, Homo sapiens
tcctgaagtcacaggctctgag

SEQ ID NO: 9484636 - DNA, 22 bp, Homo sapiens
tcctgaagtcacaggctctgag

SEQ ID NO: 9484637 - DNA, 22 bp, Homo sapiens
tcctgaatccaggagagtaggg

SEQ ID NO: 9484638 - DNA, 22 bp, Homo sapiens
tcctgaatgagttgatcacaat

SEQ ID NO: 9484639 - DNA, 22 bp, Homo sapiens
tcctgaattcctctttgcatcc

SEQ ID NO: 9484640 - DNA, 22 bp, Homo sapiens
tcctgaagtatgggtatggagt

SEQ ID NO: 9484641 - DNA, 22 bp, Homo sapiens
tcctgaaggcctgagttccacc

SEQ ID NO: 9484642 - DNA, 22 bp, Homo sapiens
tcctctgccaaagggagttgcc

SEQ ID NO: 9484643 - DNA, 22 bp, Homo sapiens
tcctctgagacatcaggttgag

SEQ ID NO: 9484644 - DNA, 22 bp, Homo sapiens
tcctctgagctcaaaatccagc

SEQ ID NO: 9484645 - DNA, 22 bp, Homo sapiens
tcctctgagcctcagtttctca

SEQ ID NO: 9484646 - DNA, 22 bp, Homo sapiens
tcctctgaggtcctctcggcca

SEQ ID NO: 9484647 - DNA, 21 bp, Homo sapiens
tcctctgcagtgaggtggcct

SEQ ID NO: 9484648 - DNA, 22 bp, Homo sapiens
tcctctgatttgattacctagt

SEQ ID NO: 9484649 - DNA, 22 bp, Homo sapiens
tcctctgagtaaagaagattgc

SEQ ID NO: 9484650 - DNA, 21 bp, Homo sapiens
tcctctgatcctggatccgca

SEQ ID NO: 9484651 - DNA, 18 bp, Homo sapiens
tcctctctttccccaggg

SEQ ID NO: 9484652 - DNA, 22 bp, Homo sapiens
tcctctgaaggttccgagggag

SEQ ID NO: 9484653 - DNA, 22 bp, Homo sapiens
tcctctgaagaaaaggagcagg

SEQ ID NO: 9484654 - DNA, 22 bp, Homo sapiens
tcctctgaagaaaaggagcagg

SEQ ID NO: 9484655 - DNA, 22 bp, Homo sapiens
tcctctgaaatctagattgtga

SEQ ID NO: 9484656 - DNA, 22 bp, Homo sapiens
tcctctgaaatgtgtgttcggc

SEQ ID NO: 9484657 - DNA, 22 bp, Homo sapiens
tcctctgaattcgctctgtgat

SEQ ID NO: 9484658 - DNA, 22 bp, Homo sapiens
tcctctgaatgctgttgaagaa

SEQ ID NO: 9484659 - DNA, 19 bp, Homo sapiens
tcctctgaaggttctttta

SEQ ID NO: 9484660 - DNA, 22 bp, Homo sapiens
tcctctgaaggttccgagggag

SEQ ID NO: 9484661 - DNA, 22 bp, Homo sapiens
tcctctgactcacagcctgggg

SEQ ID NO: 9484662 - DNA, 22 bp, Homo sapiens
tcctctgaattcgctctgtgat

SEQ ID NO: 9484663 - DNA, 22 bp, Homo sapiens
tcctctgacaccttgtgcagtg

SEQ ID NO: 9484664 - DNA, 22 bp, Homo sapiens
tcctctgaatgtacttcataat

SEQ ID NO: 9484665 - DNA, 22 bp, Homo sapiens
tcctctgacttctggttgagtt

SEQ ID NO: 9484666 - DNA, 22 bp, Homo sapiens
tcctctgactcacagcctgggg

SEQ ID NO: 9484667 - DNA, 22 bp, Homo sapiens
tcctctgactcccatggcccgc

SEQ ID NO: 9484668 - DNA, 22 bp, Homo sapiens
tcctctctgcactggccctgcc

SEQ ID NO: 9484669 - DNA, 18 bp, Homo sapiens
tcctctctttccccaggg

SEQ ID NO: 9484670 - DNA, 18 bp, Homo sapiens
tcctctctttccccaggg

SEQ ID NO: 9484671 - DNA, 22 bp, Homo sapiens
tcctctctgcactggccctgcc

SEQ ID NO: 9484672 - DNA, 22 bp, Homo sapiens
tcctctccatgtctcacgccac

SEQ ID NO: 9484673 - DNA, 22 bp, Homo sapiens
tcctctccatgtctcacgccac

SEQ ID NO: 9484674 - DNA, 22 bp, Homo sapiens
tcctctccatgtctcacgccac

SEQ ID NO: 9484675 - DNA, 22 bp, Homo sapiens
tcctctccatgtctcacgccac

SEQ ID NO: 9484676 - DNA, 22 bp, Homo sapiens
ccagccctgtcaccaactggag

SEQ ID NO: 9484677 - DNA, 22 bp, Homo sapiens
ccagccctgtcaccaactggag

SEQ ID NO: 9484678 - DNA, 22 bp, Homo sapiens
ccagccctgtcaccaactggag

SEQ ID NO: 9484679 - DNA, 22 bp, Homo sapiens
ccagccctgtaaggatgaggca

SEQ ID NO: 9484680 - DNA, 22 bp, Homo sapiens
ccagccctgtaaggatgaggca

SEQ ID NO: 9484681 - DNA, 22 bp, Homo sapiens
ccagccctgtttatgtgtcact

SEQ ID NO: 9484682 - DNA, 22 bp, Homo sapiens
ccagccctgtttatgtgtcact

SEQ ID NO: 9484683 - DNA, 19 bp, Homo sapiens
ccagccctgtcacttcttg

SEQ ID NO: 9484684 - DNA, 22 bp, Homo sapiens
ccagccctgtttatgtgtcact

SEQ ID NO: 9484685 - DNA, 22 bp, Homo sapiens
ccagcatttgcttctggtgggg

SEQ ID NO: 9484686 - DNA, 22 bp, Homo sapiens
ccagcattcacactggttcctt

SEQ ID NO: 9484687 - DNA, 22 bp, Homo sapiens
ccagcattcacactggttcctt

SEQ ID NO: 9484688 - DNA, 22 bp, Homo sapiens
ccagccacagcttccagctcct

SEQ ID NO: 9484689 - DNA, 22 bp, Homo sapiens
ccagccacagcttccagctcct

SEQ ID NO: 9484690 - DNA, 22 bp, Homo sapiens
ccagccacagcttccagctcct

SEQ ID NO: 9484691 - DNA, 22 bp, Homo sapiens
ccagccctgcctctcagggccc

SEQ ID NO: 9484692 - DNA, 22 bp, Homo sapiens
ccagccctgcctctcagggccc

SEQ ID NO: 9484693 - DNA, 22 bp, Homo sapiens
ccagccctgcctctcagggccc

SEQ ID NO: 9484694 - DNA, 22 bp, Homo sapiens
ccagccctcactgaggcctctc

SEQ ID NO: 9484695 - DNA, 22 bp, Homo sapiens
ccagccctcactgaggcctctc

SEQ ID NO: 9484696 - DNA, 22 bp, Homo sapiens
ccagccctcactgaggcctctc

SEQ ID NO: 9484697 - DNA, 22 bp, Homo sapiens
tctgagaggttaagcaatttga

SEQ ID NO: 9484698 - DNA, 22 bp, Homo sapiens
tctgagaggtgaattcagcaaa

SEQ ID NO: 9484699 - DNA, 22 bp, Homo sapiens
tctgagaggtgaattcagcaaa

SEQ ID NO: 9484700 - DNA, 22 bp, Homo sapiens
tctgagaggcatctgcacttct

SEQ ID NO: 9484701 - DNA, 22 bp, Homo sapiens
tctgagaggcagaccttcctaa

SEQ ID NO: 9484702 - DNA, 22 bp, Homo sapiens
tctgagaggattcctgtcccga

SEQ ID NO: 9484703 - DNA, 22 bp, Homo sapiens
tctgagagctgtagaagcctat

SEQ ID NO: 9484704 - DNA, 22 bp, Homo sapiens
tctgagagctgtagaagcctat

SEQ ID NO: 9484705 - DNA, 22 bp, Homo sapiens
tctgagagctgtagaagcctat

SEQ ID NO: 9484706 - DNA, 22 bp, Homo sapiens
tctgagagcctctagcctaagt

SEQ ID NO: 9484707 - DNA, 22 bp, Homo sapiens
tctgagagctctggggcccctt

SEQ ID NO: 9484708 - DNA, 22 bp, Homo sapiens
tctgagagctgccatctcattt

SEQ ID NO: 9484709 - DNA, 22 bp, Homo sapiens
tctgagagctgccatctcattt

SEQ ID NO: 9484710 - DNA, 22 bp, Homo sapiens
tctgagagctgccatctcattt

SEQ ID NO: 9484711 - DNA, 22 bp, Homo sapiens
tctgagagcaggaggagctgct

SEQ ID NO: 9484712 - DNA, 22 bp, Homo sapiens
tctgagagcaggaggagctgct

SEQ ID NO: 9484713 - DNA, 22 bp, Homo sapiens
tctgagagccactgaacagcaa

SEQ ID NO: 9484714 - DNA, 22 bp, Homo sapiens
tctgagagcatcactggggtac

SEQ ID NO: 9484715 - DNA, 22 bp, Homo sapiens
tctgagagccactgaacagcaa

SEQ ID NO: 9484716 - DNA, 21 bp, Homo sapiens
tctgagagcaactgcccttta

SEQ ID NO: 9484717 - DNA, 22 bp, Homo sapiens
tctgagagatacaaggaggcaa

SEQ ID NO: 9484718 - DNA, 22 bp, Homo sapiens
tctgagagcaaggcattagcag

SEQ ID NO: 9484719 - DNA, 22 bp, Homo sapiens
tctgagagatacaaggaggcaa

SEQ ID NO: 9484720 - DNA, 22 bp, Homo sapiens
tctgagagatacaaggaggcaa

SEQ ID NO: 9484721 - DNA, 22 bp, Homo sapiens
tctgcagaaggaatcagctgag

SEQ ID NO: 9484722 - DNA, 22 bp, Homo sapiens
tctgcagaagctcactaaatcc

SEQ ID NO: 9484723 - DNA, 22 bp, Homo sapiens
tctgcagaattcgaggaagaaa

SEQ ID NO: 9484724 - DNA, 22 bp, Homo sapiens
tctgcagaagtggctgggccac

SEQ ID NO: 9484725 - DNA, 19 bp, Homo sapiens
tctgcagaaggcatacatg

SEQ ID NO: 9484726 - DNA, 22 bp, Homo sapiens
tctgagagtctctgaggcagat

SEQ ID NO: 9484727 - DNA, 22 bp, Homo sapiens
tctgagagtctctgaggcagat

SEQ ID NO: 9484728 - DNA, 22 bp, Homo sapiens
tctgatatgaatgtctagctct

SEQ ID NO: 9484729 - DNA, 22 bp, Homo sapiens
tctgagagtagagctgcctctt

SEQ ID NO: 9484730 - DNA, 22 bp, Homo sapiens
tctgagagtacgggctgcgcgc

SEQ ID NO: 9484731 - DNA, 22 bp, Homo sapiens
tctgagagtacgggctgcgcgc

SEQ ID NO: 9484732 - DNA, 22 bp, Homo sapiens
tctgagagtacgggctgcgcgc

SEQ ID NO: 9484733 - DNA, 22 bp, Homo sapiens
tctgagagtccatctccaagcc

SEQ ID NO: 9484734 - DNA, 22 bp, Homo sapiens
tctgagagtctctgaggcagat

SEQ ID NO: 9484735 - DNA, 22 bp, Homo sapiens
tctgagagtctctgaggcagat

SEQ ID NO: 9484736 - DNA, 22 bp, Homo sapiens
ccagcatcagcacccaaggagc

SEQ ID NO: 9484737 - DNA, 22 bp, Homo sapiens
ccagcatcagcacccaaggagc

SEQ ID NO: 9484738 - DNA, 22 bp, Homo sapiens
ccagcagggttggtttcttctg

SEQ ID NO: 9484739 - DNA, 22 bp, Homo sapiens
ccagcaggtgtagggctcatgg

SEQ ID NO: 9484740 - DNA, 19 bp, Homo sapiens
ccagcaggttcatttcagg

SEQ ID NO: 9484741 - DNA, 22 bp, Homo sapiens
ccagcaggtgtagggctcatgg

SEQ ID NO: 9484742 - DNA, 22 bp, Homo sapiens
ccagcaggtgtagggctcatgg

SEQ ID NO: 9484743 - DNA, 22 bp, Homo sapiens
ccagcaggtgtagggctcatgg

SEQ ID NO: 9484744 - DNA, 22 bp, Homo sapiens
ccagcaggtgtagggctcatgg

SEQ ID NO: 9484745 - DNA, 22 bp, Homo sapiens
tctctgtgttccctgttttctc

SEQ ID NO: 9484746 - DNA, 22 bp, Homo sapiens
tctctgtgtgttggctgtatat

SEQ ID NO: 9484747 - DNA, 22 bp, Homo sapiens
tctcttaaaggtcttcagctga

SEQ ID NO: 9484748 - DNA, 22 bp, Homo sapiens
tctctgttcatggcactatgtc

SEQ ID NO: 9484749 - DNA, 22 bp, Homo sapiens
tctctgttcatggcactatgtc

SEQ ID NO: 9484750 - DNA, 22 bp, Homo sapiens
tctcttaaaagagtaatagaga

SEQ ID NO: 9484751 - DNA, 22 bp, Homo sapiens
tctgaatagttctattttaaag

SEQ ID NO: 9484752 - DNA, 22 bp, Homo sapiens
tctgaatagtatattgaaagca

SEQ ID NO: 9484753 - DNA, 22 bp, Homo sapiens
tctgaatagagagaggtccttt

SEQ ID NO: 9484754 - DNA, 22 bp, Homo sapiens
tctgaatatgtttatcatctct

SEQ ID NO: 9484755 - DNA, 19 bp, Homo sapiens
tctgaagtccagggcatac

SEQ ID NO: 9484756 - DNA, 19 bp, Homo sapiens
tctgaagtccagggcatac

SEQ ID NO: 9484757 - DNA, 22 bp, Homo sapiens
tctgaataatgtccttgtatca

SEQ ID NO: 9484758 - DNA, 19 bp, Homo sapiens
tctgaattatttatgtacc

SEQ ID NO: 9484759 - DNA, 22 bp, Homo sapiens
tctgaattctgacaatttgaat

SEQ ID NO: 9484760 - DNA, 18 bp, Homo sapiens
tctgaatattatgcagtg

SEQ ID NO: 9484761 - DNA, 22 bp, Homo sapiens
tctgaatgttaggaaactttct

SEQ ID NO: 9484762 - DNA, 22 bp, Homo sapiens
tctgaattctgacaatttgaat

SEQ ID NO: 9484763 - DNA, 22 bp, Homo sapiens
tctgaattcttagaattaaagg

SEQ ID NO: 9484764 - DNA, 22 bp, Homo sapiens
tctgaattcttagaattaaagg

SEQ ID NO: 9484765 - DNA, 20 bp, Homo sapiens
tctgaattgagtgaatgtct

SEQ ID NO: 9484766 - DNA, 22 bp, Homo sapiens
ccagcatccatgctccctcggg

SEQ ID NO: 9484767 - DNA, 22 bp, Homo sapiens
ccagcatccatgctccctcggg

SEQ ID NO: 9484768 - DNA, 22 bp, Homo sapiens
ccagcatccctggggttggcca

SEQ ID NO: 9484769 - DNA, 22 bp, Homo sapiens
ccagcatccatgctccctcggg

SEQ ID NO: 9484770 - DNA, 22 bp, Homo sapiens
ccagcatctaacgctcctggga

SEQ ID NO: 9484771 - DNA, 22 bp, Homo sapiens
ccagcatctaacgctcctggga

SEQ ID NO: 9484772 - DNA, 22 bp, Homo sapiens
ccagcatctaacgctcctggga

SEQ ID NO: 9484773 - DNA, 22 bp, Homo sapiens
ccagcatctaacgctcctggga

SEQ ID NO: 9484774 - DNA, 22 bp, Homo sapiens
ccagcatcgacttcctgcctga

SEQ ID NO: 9484775 - DNA, 18 bp, Homo sapiens
ccagcatgccagaggctg

SEQ ID NO: 9484776 - DNA, 22 bp, Homo sapiens
ccagcagctcagctactggtca

SEQ ID NO: 9484777 - DNA, 22 bp, Homo sapiens
ccagcagctccctcagggtccg

SEQ ID NO: 9484778 - DNA, 22 bp, Homo sapiens
ccagcagctccctcagggtccg

SEQ ID NO: 9484779 - DNA, 22 bp, Homo sapiens
ccagcagctccctcagggtccg

SEQ ID NO: 9484780 - DNA, 22 bp, Homo sapiens
ccagcagctccctcagggtccg

SEQ ID NO: 9484781 - DNA, 22 bp, Homo sapiens
ccagcagctcagctactggtca

SEQ ID NO: 9484782 - DNA, 21 bp, Homo sapiens
ccagcagctcaaggatctctt

SEQ ID NO: 9484783 - DNA, 21 bp, Homo sapiens
ccagcagctcaaggatctctt

SEQ ID NO: 9484784 - DNA, 22 bp, Homo sapiens
ccagcagcgatagggtgagtgc

SEQ ID NO: 9484785 - DNA, 22 bp, Homo sapiens
ccagcagcgatagggtgagtgc

SEQ ID NO: 9484786 - DNA, 22 bp, Homo sapiens
ccagcagctgcaaagcctgggt

SEQ ID NO: 9484787 - DNA, 22 bp, Homo sapiens
ccagcagctgctatgtggtttt

SEQ ID NO: 9484788 - DNA, 22 bp, Homo sapiens
ccagcagctgcaaagcctgggt

SEQ ID NO: 9484789 - DNA, 22 bp, Homo sapiens
ccagcagctgacaccagtccca

SEQ ID NO: 9484790 - DNA, 22 bp, Homo sapiens
ccagcagctgacaccagtccca

SEQ ID NO: 9484791 - DNA, 22 bp, Homo sapiens
ccagcagctttattggctctcc

SEQ ID NO: 9484792 - DNA, 22 bp, Homo sapiens
ccagcagctttattggctctcc

SEQ ID NO: 9484793 - DNA, 22 bp, Homo sapiens
ccagcagctttattggctctcc

SEQ ID NO: 9484794 - DNA, 22 bp, Homo sapiens
ccagcagctgctatgtggtttt

SEQ ID NO: 9484795 - DNA, 22 bp, Homo sapiens
ccagcagctgtggctttgcctc

SEQ ID NO: 9484796 - DNA, 22 bp, Homo sapiens
ccagcagctttattggctctcc

SEQ ID NO: 9484797 - DNA, 22 bp, Homo sapiens
ccagcagctgtggctttgcctc

SEQ ID NO: 9484798 - DNA, 22 bp, Homo sapiens
ccagcagggcagtgccctggac

SEQ ID NO: 9484799 - DNA, 22 bp, Homo sapiens
ccagcaggggaatatttttagg

SEQ ID NO: 9484800 - DNA, 22 bp, Homo sapiens
ccagcactgctctcagactgag

SEQ ID NO: 9484801 - DNA, 22 bp, Homo sapiens
ccagcagagtctaggaaggagg

SEQ ID NO: 9484802 - DNA, 22 bp, Homo sapiens
ccagcagagtctaggaaggagg

SEQ ID NO: 9484803 - DNA, 22 bp, Homo sapiens
ccagcagagggtcttggccatt

SEQ ID NO: 9484804 - DNA, 22 bp, Homo sapiens
ccagcagcagcgtccaaggaga

SEQ ID NO: 9484805 - DNA, 22 bp, Homo sapiens
ccagcagcagcgtccaaggaga

SEQ ID NO: 9484806 - DNA, 22 bp, Homo sapiens
ccagcagcaggccaggccctcc

SEQ ID NO: 9484807 - DNA, 22 bp, Homo sapiens
ccagcagcagcgtccaaggaga

SEQ ID NO: 9484808 - DNA, 22 bp, Homo sapiens
ccagcagcccacaggcgtccct

SEQ ID NO: 9484809 - DNA, 22 bp, Homo sapiens
ccagcagcccacaggcgtccct

SEQ ID NO: 9484810 - DNA, 22 bp, Homo sapiens
ccagcagcccctcaatgatctg

SEQ ID NO: 9484811 - DNA, 22 bp, Homo sapiens
ccagcagcccacaggcgtccct

SEQ ID NO: 9484812 - DNA, 22 bp, Homo sapiens
ccagcagcccacaggcgtccct

SEQ ID NO: 9484813 - DNA, 22 bp, Homo sapiens
ccagcagccctcttccaagact

SEQ ID NO: 9484814 - DNA, 22 bp, Homo sapiens
ccagcagcgatagggtgagtgc

SEQ ID NO: 9484815 - DNA, 22 bp, Homo sapiens
ccagcagcccctcaatgatctg

SEQ ID NO: 9484816 - DNA, 22 bp, Homo sapiens
ccagcagccctcttccaagact

SEQ ID NO: 9484817 - DNA, 22 bp, Homo sapiens
ccagcagccctcttccaagact

SEQ ID NO: 9484818 - DNA, 22 bp, Homo sapiens
ccagcagccaccttctcgaaat

SEQ ID NO: 9484819 - DNA, 22 bp, Homo sapiens
ccagcagccaccttctcgaaat

SEQ ID NO: 9484820 - DNA, 22 bp, Homo sapiens
ccagcagccaccttctcgaaat

SEQ ID NO: 9484821 - DNA, 22 bp, Homo sapiens
ccagcagcatcctgcagcactt

SEQ ID NO: 9484822 - DNA, 22 bp, Homo sapiens
ccagcagccagagaaggacctc

SEQ ID NO: 9484823 - DNA, 22 bp, Homo sapiens
ccagcagccagagaaggacctc

SEQ ID NO: 9484824 - DNA, 22 bp, Homo sapiens
ccagcagcaggccaggccctcc

SEQ ID NO: 9484825 - DNA, 22 bp, Homo sapiens
ccagcagcaggccaggccctcc

SEQ ID NO: 9484826 - DNA, 22 bp, Homo sapiens
ccagcagcaggccaggccctcc

SEQ ID NO: 9484827 - DNA, 22 bp, Homo sapiens
ccagcagcaggccaggccctcc

SEQ ID NO: 9484828 - DNA, 22 bp, Homo sapiens
ccagcagcatcctgcagcactt

SEQ ID NO: 9484829 - DNA, 22 bp, Homo sapiens
tctctgggagttgagcagcagc

SEQ ID NO: 9484830 - DNA, 21 bp, Homo sapiens
tctctgggaggacttgtgaga

SEQ ID NO: 9484831 - DNA, 22 bp, Homo sapiens
ccagcactctgtcccagcttcc

SEQ ID NO: 9484832 - DNA, 22 bp, Homo sapiens
tctctgggagttgagcagcagc

SEQ ID NO: 9484833 - DNA, 22 bp, Homo sapiens
tctctgggagccaggatgacac

SEQ ID NO: 9484834 - DNA, 21 bp, Homo sapiens
tctctgggaggacttgtgaga

SEQ ID NO: 9484835 - DNA, 22 bp, Homo sapiens
tctctgggagccaggatgacac

SEQ ID NO: 9484836 - DNA, 22 bp, Homo sapiens
tctctgggagcaattgtttgct

SEQ ID NO: 9484837 - DNA, 22 bp, Homo sapiens
tctctgggaattttttggacat

SEQ ID NO: 9484838 - DNA, 22 bp, Homo sapiens
tctctgggaattttttggacat

SEQ ID NO: 9484839 - DNA, 22 bp, Homo sapiens
tctctgggacactgggtcagtt

SEQ ID NO: 9484840 - DNA, 22 bp, Homo sapiens
tctctgcccatcctcagtccac

SEQ ID NO: 9484841 - DNA, 22 bp, Homo sapiens
tctctgggaatgggcctgggta

SEQ ID NO: 9484842 - DNA, 22 bp, Homo sapiens
tctctgggaattcacaagccct

SEQ ID NO: 9484843 - DNA, 22 bp, Homo sapiens
tctctgggaattcacaagccct

SEQ ID NO: 9484844 - DNA, 22 bp, Homo sapiens
tctctgggaaatggagaatttt

SEQ ID NO: 9484845 - DNA, 22 bp, Homo sapiens
tctctgcacttgcacataagct

SEQ ID NO: 9484846 - DNA, 22 bp, Homo sapiens
tctctgagttttaaggatgatg

SEQ ID NO: 9484847 - DNA, 23 bp, Homo sapiens
tctctgcatgtcctgagcacatc

SEQ ID NO: 9484848 - DNA, 22 bp, Homo sapiens
tctctcttgtcaccccatctgc

SEQ ID NO: 9484849 - DNA, 22 bp, Homo sapiens
tctctcttgtcaccccatctgc

SEQ ID NO: 9484850 - DNA, 22 bp, Homo sapiens
tctctcttgtcaccccatctgc

SEQ ID NO: 9484851 - DNA, 22 bp, Homo sapiens
tctctgagttctcctccagccc

SEQ ID NO: 9484852 - DNA, 23 bp, Homo sapiens
tctctgagttgtactttcccttg

SEQ ID NO: 9484853 - DNA, 22 bp, Homo sapiens
tctctgagttgtaaaaaatagt

SEQ ID NO: 9484854 - DNA, 22 bp, Homo sapiens
tctctgagttctcctccagccc

SEQ ID NO: 9484855 - DNA, 22 bp, Homo sapiens
tctctgagttctcctccagccc

SEQ ID NO: 9484856 - DNA, 22 bp, Homo sapiens
tctctgagttttaaggatgatg

SEQ ID NO: 9484857 - DNA, 20 bp, Homo sapiens
tctctgagtttcctaatttg

SEQ ID NO: 9484858 - DNA, 22 bp, Homo sapiens
tctctgagttttaaggatgatg

SEQ ID NO: 9484859 - DNA, 23 bp, Homo sapiens
tctcctggctgcactgtggccac

SEQ ID NO: 9484860 - DNA, 23 bp, Homo sapiens
tctcctggctgcactgtggccac

SEQ ID NO: 9484861 - DNA, 23 bp, Homo sapiens
tctcctggctgcactgtggccac

SEQ ID NO: 9484862 - DNA, 22 bp, Homo sapiens
tctcctggctcaccaggctgga

SEQ ID NO: 9484863 - DNA, 22 bp, Homo sapiens
tctcctggctcaccaggctgga

SEQ ID NO: 9484864 - DNA, 22 bp, Homo sapiens
tctcctggccgggctgtcccct

SEQ ID NO: 9484865 - DNA, 22 bp, Homo sapiens
cagtcccaaggaggaagcagtc

SEQ ID NO: 9484866 - DNA, 20 bp, Homo sapiens
cagtcccaatccagggccag

SEQ ID NO: 9484867 - DNA, 20 bp, Homo sapiens
cagtcccaatccagggccag

SEQ ID NO: 9484868 - DNA, 20 bp, Homo sapiens
cagtcccaatccagggccag

SEQ ID NO: 9484869 - DNA, 20 bp, Homo sapiens
cagtcccaatccagggccag

SEQ ID NO: 9484870 - DNA, 22 bp, Homo sapiens
cagtcccaccaggatcgctctt

SEQ ID NO: 9484871 - DNA, 22 bp, Homo sapiens
cagtcccaccaggatcgctctt

SEQ ID NO: 9484872 - DNA, 22 bp, Homo sapiens
cagtcccactagtgccaatacc

SEQ ID NO: 9484873 - DNA, 22 bp, Homo sapiens
cagtcccacaagatctccacaa

SEQ ID NO: 9484874 - DNA, 22 bp, Homo sapiens
cagtcccacaagatctccacaa

SEQ ID NO: 9484875 - DNA, 20 bp, Homo sapiens
cagtccaatcagaggccacc

SEQ ID NO: 9484876 - DNA, 20 bp, Homo sapiens
cagtccaatcagaggccacc

SEQ ID NO: 9484877 - DNA, 22 bp, Homo sapiens
cagtatatgctctttcatcaaa

SEQ ID NO: 9484878 - DNA, 20 bp, Homo sapiens
cagtccactggagttcctac

SEQ ID NO: 9484879 - DNA, 22 bp, Homo sapiens
cagtccagagcccaccagagga

SEQ ID NO: 9484880 - DNA, 18 bp, Homo sapiens
cagtcccaaaccttagga

SEQ ID NO: 9484881 - DNA, 18 bp, Homo sapiens
cagtcccaaaccttagga

SEQ ID NO: 9484882 - DNA, 22 bp, Homo sapiens
cagtcccaaggaggaagcagtc

SEQ ID NO: 9484883 - DNA, 19 bp, Homo sapiens
cagtcccaaattcttgtca

SEQ ID NO: 9484884 - DNA, 22 bp, Homo sapiens
cagtcccaaggaggaagcagtc

SEQ ID NO: 9484885 - DNA, 19 bp, Homo sapiens
cagtcccaaattcttgtca

SEQ ID NO: 9484886 - DNA, 22 bp, Homo sapiens
tatttcttgttccctccaagtt

SEQ ID NO: 9484887 - DNA, 22 bp, Homo sapiens
tatttcttgttccctccaagtt

SEQ ID NO: 9484888 - DNA, 22 bp, Homo sapiens
cagtcccagacatagtaaggga

SEQ ID NO: 9484889 - DNA, 22 bp, Homo sapiens
cagtcccactagtgccaatacc

SEQ ID NO: 9484890 - DNA, 22 bp, Homo sapiens
cagtcccagaagagcctgggag

SEQ ID NO: 9484891 - DNA, 22 bp, Homo sapiens
cagtcccagaagagcctgggag

SEQ ID NO: 9484892 - DNA, 22 bp, Homo sapiens
cagtcccagacatagtaaggga

SEQ ID NO: 9484893 - DNA, 21 bp, Homo sapiens
tatttctttgactctctccct

SEQ ID NO: 9484894 - DNA, 22 bp, Homo sapiens
tatttctttcaggtatgtgttg

SEQ ID NO: 9484895 - DNA, 22 bp, Homo sapiens
tatttctttcaggtatgtgttg

SEQ ID NO: 9484896 - DNA, 22 bp, Homo sapiens
tatttctttcaggtatgtgttg

SEQ ID NO: 9484897 - DNA, 22 bp, Homo sapiens
cagtataagagtgaggaagggc

SEQ ID NO: 9484898 - DNA, 22 bp, Homo sapiens
cagtatacgactaacgcatgac

SEQ ID NO: 9484899 - DNA, 22 bp, Homo sapiens
cagtagttattagttgccactg

SEQ ID NO: 9484900 - DNA, 22 bp, Homo sapiens
cagtagtggtctatcactggag

SEQ ID NO: 9484901 - DNA, 22 bp, Homo sapiens
cagtagtggtctatcactggag

SEQ ID NO: 9484902 - DNA, 22 bp, Homo sapiens
cagtagtggggagcccagtgtc

SEQ ID NO: 9484903 - DNA, 22 bp, Homo sapiens
cagtagtgttgctgagtgtcag

SEQ ID NO: 9484904 - DNA, 22 bp, Homo sapiens
cagtagtggaagggagagaaaa

SEQ ID NO: 9484905 - DNA, 22 bp, Homo sapiens
cagtagtggaagggagagaaaa

SEQ ID NO: 9484906 - DNA, 17 bp, Homo sapiens
cagtagtggcactggag

SEQ ID NO: 9484907 - DNA, 22 bp, Homo sapiens
cagtaggaaggatgcagaaaaa

SEQ ID NO: 9484908 - DNA, 22 bp, Homo sapiens
cagtaggaaggatgcagaaaaa

SEQ ID NO: 9484909 - DNA, 22 bp, Homo sapiens
cagtagtctttttcctcctaga

SEQ ID NO: 9484910 - DNA, 21 bp, Homo sapiens
cagtagtgcgtcgcagaggac

SEQ ID NO: 9484911 - DNA, 22 bp, Homo sapiens
tatttccacctattattttctg

SEQ ID NO: 9484912 - DNA, 22 bp, Homo sapiens
cagtagcatgtaataaagacag

SEQ ID NO: 9484913 - DNA, 22 bp, Homo sapiens
cagtagcatgcttatcttttga

SEQ ID NO: 9484914 - DNA, 22 bp, Homo sapiens
tatttccaagctgaatccaatg

SEQ ID NO: 9484915 - DNA, 22 bp, Homo sapiens
tatttccaccctcagtaaggaa

SEQ ID NO: 9484916 - DNA, 22 bp, Homo sapiens
tatttccaaaagcctattatga

SEQ ID NO: 9484917 - DNA, 22 bp, Homo sapiens
cagggtggccctgtggtctcat

SEQ ID NO: 9484918 - DNA, 22 bp, Homo sapiens
cagggtggccctgtggtctcat

SEQ ID NO: 9484919 - DNA, 22 bp, Homo sapiens
cagggtggccctgtggtctcat

SEQ ID NO: 9484920 - DNA, 22 bp, Homo sapiens
cagggtgggcacccagcctcca

SEQ ID NO: 9484921 - DNA, 22 bp, Homo sapiens
cagggtgggcacccagcctcca

SEQ ID NO: 9484922 - DNA, 22 bp, Homo sapiens
cagggtgggcacccagcctcca

SEQ ID NO: 9484923 - DNA, 22 bp, Homo sapiens
caggtgttaatcacttttaagc

SEQ ID NO: 9484924 - DNA, 22 bp, Homo sapiens
caggtgttaattgttggagcaa

SEQ ID NO: 9484925 - DNA, 22 bp, Homo sapiens
caggtgttatacatgaaattta

SEQ ID NO: 9484926 - DNA, 22 bp, Homo sapiens
caggtgtgccgggagcagtttg

SEQ ID NO: 9484927 - DNA, 22 bp, Homo sapiens
cagggtggggaaatagcgccct

SEQ ID NO: 9484928 - DNA, 22 bp, Homo sapiens
cagggtggggaaatagcgccct

SEQ ID NO: 9484929 - DNA, 22 bp, Homo sapiens
cagggtggggaaatagcgccct

SEQ ID NO: 9484930 - DNA, 22 bp, Homo sapiens
caggtgttgatactaatcgtgg

SEQ ID NO: 9484931 - DNA, 17 bp, Homo sapiens
caggtgttctgtttttc

SEQ ID NO: 9484932 - DNA, 22 bp, Homo sapiens
caggtgttctaagccgggcagt

SEQ ID NO: 9484933 - DNA, 22 bp, Homo sapiens
caggtgttcaagctggaggcca

SEQ ID NO: 9484934 - DNA, 22 bp, Homo sapiens
caggtgttctggaaatcagcag

SEQ ID NO: 9484935 - DNA, 22 bp, Homo sapiens
caggtgttgcctaaattgacaa

SEQ ID NO: 9484936 - DNA, 22 bp, Homo sapiens
caggtgttgcagttgaagactg

SEQ ID NO: 9484937 - DNA, 22 bp, Homo sapiens
caggtgttgatgtttattgagt

SEQ ID NO: 9484938 - DNA, 22 bp, Homo sapiens
caggtgttgtctaaagcttcag

SEQ ID NO: 9484939 - DNA, 22 bp, Homo sapiens
caggtgttggaagggcagtggg

SEQ ID NO: 9484940 - DNA, 22 bp, Homo sapiens
caggtgttgggagaagagataa

SEQ ID NO: 9484941 - DNA, 22 bp, Homo sapiens
caggtgtttcaatcccaagtca

SEQ ID NO: 9484942 - DNA, 22 bp, Homo sapiens
caggtgtttaggtttcatggat

SEQ ID NO: 9484943 - DNA, 22 bp, Homo sapiens
caggtgtttcaaatgtgaaact

SEQ ID NO: 9484944 - DNA, 22 bp, Homo sapiens
caggtgtttgtcaattccatcc

SEQ ID NO: 9484945 - DNA, 22 bp, Homo sapiens
caggtgtttcctgaagttgatg

SEQ ID NO: 9484946 - DNA, 23 bp, Homo sapiens
caggtgttttacatatggtagtt

SEQ ID NO: 9484947 - DNA, 22 bp, Homo sapiens
caggtgttttttattctgaaag

SEQ ID NO: 9484948 - DNA, 22 bp, Homo sapiens
caggttccctagcagcaaagcc

SEQ ID NO: 9484949 - DNA, 22 bp, Homo sapiens
caggttcccaggtccagggctt

SEQ ID NO: 9484950 - DNA, 22 bp, Homo sapiens
caggttcccaggtccagggctt

SEQ ID NO: 9484951 - DNA, 22 bp, Homo sapiens
caggttccagttgcagggactt

SEQ ID NO: 9484952 - DNA, 22 bp, Homo sapiens
caggttcttgaagccttctggc

SEQ ID NO: 9484953 - DNA, 22 bp, Homo sapiens
caggttcttaagtaacagcaca

SEQ ID NO: 9484954 - DNA, 22 bp, Homo sapiens
caggttcttaacttgttcttcc

SEQ ID NO: 9484955 - DNA, 22 bp, Homo sapiens
caggttctggggctccactgtg

SEQ ID NO: 9484956 - DNA, 22 bp, Homo sapiens
caggttctgccatttacttgta

SEQ ID NO: 9484957 - DNA, 22 bp, Homo sapiens
caggttctggagatgcagagat

SEQ ID NO: 9484958 - DNA, 22 bp, Homo sapiens
caggttctcagaaggcagtcac

SEQ ID NO: 9484959 - DNA, 22 bp, Homo sapiens
caggttctatactgaataattt

SEQ ID NO: 9484960 - DNA, 22 bp, Homo sapiens
caggttcccttgcagctaagtg

SEQ ID NO: 9484961 - DNA, 22 bp, Homo sapiens
caggttcttgtttcaaacagac

SEQ ID NO: 9484962 - DNA, 22 bp, Homo sapiens
caggttggggacttaggatgac

SEQ ID NO: 9484963 - DNA, 22 bp, Homo sapiens
caggttggtcggcaagtacaca

SEQ ID NO: 9484964 - DNA, 22 bp, Homo sapiens
caggttggggacttaggatgac

SEQ ID NO: 9484965 - DNA, 22 bp, Homo sapiens
caggtttctagttctaagaata

SEQ ID NO: 9484966 - DNA, 22 bp, Homo sapiens
caggtttcattggcagcttcat

SEQ ID NO: 9484967 - DNA, 22 bp, Homo sapiens
tatttataacagtgagaacggg

SEQ ID NO: 9484968 - DNA, 22 bp, Homo sapiens
tatttcagtcacttcttctctg

SEQ ID NO: 9484969 - DNA, 22 bp, Homo sapiens
caggtttctagttctaagaata

SEQ ID NO: 9484970 - DNA, 21 bp, Homo sapiens
caggtttgctatggagcagcc

SEQ ID NO: 9484971 - DNA, 21 bp, Homo sapiens
tatttagttttacaaatgtgg

SEQ ID NO: 9484972 - DNA, 22 bp, Homo sapiens
tatttcattctttatcaggagc

SEQ ID NO: 9484973 - DNA, 22 bp, Homo sapiens
tatttcattctttatcaggagc

SEQ ID NO: 9484974 - DNA, 22 bp, Homo sapiens
tatttcattctttatcaggagc

SEQ ID NO: 9484975 - DNA, 22 bp, Homo sapiens
tatttcattctttatcaggagc

SEQ ID NO: 9484976 - DNA, 22 bp, Homo sapiens
tatttcatgtgcaccataattc

SEQ ID NO: 9484977 - DNA, 22 bp, Homo sapiens
tatttcatctggaacaaggtaa

SEQ ID NO: 9484978 - DNA, 22 bp, Homo sapiens
cagtgagataccacagagcaaa

SEQ ID NO: 9484979 - DNA, 22 bp, Homo sapiens
cagtgagataccacagagcaaa

SEQ ID NO: 9484980 - DNA, 22 bp, Homo sapiens
cagtgagataccacagagcaaa

SEQ ID NO: 9484981 - DNA, 22 bp, Homo sapiens
cagtgagataccacagagcaaa

SEQ ID NO: 9484982 - DNA, 22 bp, Homo sapiens
tcacacttagagcgaattgttt

SEQ ID NO: 9484983 - DNA, 22 bp, Homo sapiens
cagtgaggaagctgtctggacc

SEQ ID NO: 9484984 - DNA, 22 bp, Homo sapiens
cagtgaggaagctgtctggacc

SEQ ID NO: 9484985 - DNA, 22 bp, Homo sapiens
cagtgagctcctgtctgtccct

SEQ ID NO: 9484986 - DNA, 22 bp, Homo sapiens
tcacagacctggtgggaggtgg

SEQ ID NO: 9484987 - DNA, 22 bp, Homo sapiens
tcacacttcaaagggttagatc

SEQ ID NO: 9484988 - DNA, 22 bp, Homo sapiens
tcacacttatcccactcagtca

SEQ ID NO: 9484989 - DNA, 22 bp, Homo sapiens
tcacagactcttgattgtctaa

SEQ ID NO: 9484990 - DNA, 22 bp, Homo sapiens
cagtgaagtttaaagtgtagat

SEQ ID NO: 9484991 - DNA, 22 bp, Homo sapiens
cagtgaagtttaaagtgtagat

SEQ ID NO: 9484992 - DNA, 22 bp, Homo sapiens
cagtgaagttctactgaatggt

SEQ ID NO: 9484993 - DNA, 22 bp, Homo sapiens
cagtgaagttctactgaatggt

SEQ ID NO: 9484994 - DNA, 22 bp, Homo sapiens
tcacaagactgagcttgcttga

SEQ ID NO: 9484995 - DNA, 22 bp, Homo sapiens
tcacaagactgagcttgcttga

SEQ ID NO: 9484996 - DNA, 22 bp, Homo sapiens
cagtgagaaaactaagacatta

SEQ ID NO: 9484997 - DNA, 22 bp, Homo sapiens
cagtgagaattcagtaggtact

SEQ ID NO: 9484998 - DNA, 22 bp, Homo sapiens
cagtgagagagaacgcattcat

SEQ ID NO: 9484999 - DNA, 22 bp, Homo sapiens
cagtgagaccttctaaggtggt

SEQ ID NO: 9485000 - DNA, 22 bp, Homo sapiens
cagtgacgtaaactgcatgtgc

SEQ ID NO: 9485001 - DNA, 22 bp, Homo sapiens
tatttgaaagtgtacaaaaact

SEQ ID NO: 9485002 - DNA, 22 bp, Homo sapiens
tcaatgaagagatttaaatcat

SEQ ID NO: 9485003 - DNA, 22 bp, Homo sapiens
tatttgaaagtgtacaaaaact

SEQ ID NO: 9485004 - DNA, 22 bp, Homo sapiens
tatttgaaagtgtacaaaaact

SEQ ID NO: 9485005 - DNA, 22 bp, Homo sapiens
tatttgaaagtgtacaaaaact

SEQ ID NO: 9485006 - DNA, 22 bp, Homo sapiens
tatttgaaagtgtacaaaaact

SEQ ID NO: 9485007 - DNA, 22 bp, Homo sapiens
tatttcttttcgtgacttattg

SEQ ID NO: 9485008 - DNA, 22 bp, Homo sapiens
tatttcttttcgtgacttattg

SEQ ID NO: 9485009 - DNA, 22 bp, Homo sapiens
tcaatgacattgtatcagagtt

SEQ ID NO: 9485010 - DNA, 22 bp, Homo sapiens
tcacaaatagctatattaagga

SEQ ID NO: 9485011 - DNA, 22 bp, Homo sapiens
tcacaaatattttaacagtagg

SEQ ID NO: 9485012 - DNA, 22 bp, Homo sapiens
tcacaaatattttaacagtagg

SEQ ID NO: 9485013 - DNA, 22 bp, Homo sapiens
tcacaaatattttaacagtagg

SEQ ID NO: 9485014 - DNA, 22 bp, Homo sapiens
tcacaagacaagacaaattgca

SEQ ID NO: 9485015 - DNA, 22 bp, Homo sapiens
tcacaagaatttgtagatgaaa

SEQ ID NO: 9485016 - DNA, 22 bp, Homo sapiens
tcacaagaatttgtagatgaaa

SEQ ID NO: 9485017 - DNA, 21 bp, Homo sapiens
tcacaactttgaatttcaata

SEQ ID NO: 9485018 - DNA, 22 bp, Homo sapiens
tcacaagaatttgtagatgaaa

SEQ ID NO: 9485019 - DNA, 22 bp, Homo sapiens
tcacaagaatttgtagatgaaa

SEQ ID NO: 9485020 - DNA, 22 bp, Homo sapiens
tcacaacaggaaggaccagctg

SEQ ID NO: 9485021 - DNA, 22 bp, Homo sapiens
tcacaacaggaaggaccagctg

SEQ ID NO: 9485022 - DNA, 22 bp, Homo sapiens
tcacaaatgtctcctgtcctgt

SEQ ID NO: 9485023 - DNA, 22 bp, Homo sapiens
tcacaaatcattttatctgtgt

SEQ ID NO: 9485024 - DNA, 22 bp, Homo sapiens
tcacaaatcattttatctgtgt

SEQ ID NO: 9485025 - DNA, 22 bp, Homo sapiens
cagtgccaagccacagatcact

SEQ ID NO: 9485026 - DNA, 17 bp, Homo sapiens
tcacagttggtctcagt

SEQ ID NO: 9485027 - DNA, 17 bp, Homo sapiens
tcacagttggtctcagt

SEQ ID NO: 9485028 - DNA, 22 bp, Homo sapiens
tcacagttgattgaaacacagc

SEQ ID NO: 9485029 - DNA, 21 bp, Homo sapiens
tcacagttggccaggcattta

SEQ ID NO: 9485030 - DNA, 22 bp, Homo sapiens
tcacagttatagtctgtagaat

SEQ ID NO: 9485031 - DNA, 22 bp, Homo sapiens
tcacagttatagtctgtagaat

SEQ ID NO: 9485032 - DNA, 23 bp, Homo sapiens
tcacagttacttttgcatcaacc

SEQ ID NO: 9485033 - DNA, 23 bp, Homo sapiens
tcacagttacttttgcatcaacc

SEQ ID NO: 9485034 - DNA, 22 bp, Homo sapiens
tcacagttatagtctgtagaat

SEQ ID NO: 9485035 - DNA, 22 bp, Homo sapiens
tcacagttcaactagttcagat

SEQ ID NO: 9485036 - DNA, 21 bp, Homo sapiens
tcacagttcaagatgaacccc

SEQ ID NO: 9485037 - DNA, 21 bp, Homo sapiens
tcacagttcaagatgaacccc

SEQ ID NO: 9485038 - DNA, 22 bp, Homo sapiens
tcacagttctagaggtaagcag

SEQ ID NO: 9485039 - DNA, 22 bp, Homo sapiens
tcacagttcatctgataaacta

SEQ ID NO: 9485040 - DNA, 22 bp, Homo sapiens
tcacagttcatctgataaacta

SEQ ID NO: 9485041 - DNA, 20 bp, Homo sapiens
tcacaggagggaaggcaggt

SEQ ID NO: 9485042 - DNA, 20 bp, Homo sapiens
tcacaggagggaaggcaggt

SEQ ID NO: 9485043 - DNA, 20 bp, Homo sapiens
tcacaggagggaaggcaggt

SEQ ID NO: 9485044 - DNA, 20 bp, Homo sapiens
tcacaggagggaaggcaggt

SEQ ID NO: 9485045 - DNA, 22 bp, Homo sapiens
tcacagtgttggaatcagagct

SEQ ID NO: 9485046 - DNA, 22 bp, Homo sapiens
tcacagtgtggcaactcacaga

SEQ ID NO: 9485047 - DNA, 22 bp, Homo sapiens
tcacagtgtggcaactcacaga

SEQ ID NO: 9485048 - DNA, 22 bp, Homo sapiens
tcacagttaattgttggaatgt

SEQ ID NO: 9485049 - DNA, 22 bp, Homo sapiens
tcacagttaattgttggaatgt

SEQ ID NO: 9485050 - DNA, 22 bp, Homo sapiens
tcacagttactccttcagatga

SEQ ID NO: 9485051 - DNA, 22 bp, Homo sapiens
tcacagagaaatgtggcacaaa

SEQ ID NO: 9485052 - DNA, 22 bp, Homo sapiens
tcacagagaaaagctatcacaa

SEQ ID NO: 9485053 - DNA, 22 bp, Homo sapiens
tcacagagaaaagctatcacaa

SEQ ID NO: 9485054 - DNA, 22 bp, Homo sapiens
tcacagagaactataatccatc

SEQ ID NO: 9485055 - DNA, 22 bp, Homo sapiens
tcacagagaaatgtggcacaaa

SEQ ID NO: 9485056 - DNA, 22 bp, Homo sapiens
tcacagagaactataatccatc

SEQ ID NO: 9485057 - DNA, 21 bp, Homo sapiens
tcacagactggtcagtgaggc

SEQ ID NO: 9485058 - DNA, 22 bp, Homo sapiens
tcacagctttgagcagagacca

SEQ ID NO: 9485059 - DNA, 22 bp, Homo sapiens
tcagagaaaatggaaactttta

SEQ ID NO: 9485060 - DNA, 23 bp, Homo sapiens
tcagaagtgggatacaaagctga

SEQ ID NO: 9485061 - DNA, 22 bp, Homo sapiens
tcagaagtctggactgcttctc

SEQ ID NO: 9485062 - DNA, 22 bp, Homo sapiens
tcagaagtgctgtccttatccc

SEQ ID NO: 9485063 - DNA, 22 bp, Homo sapiens
tcagagaacacagaggtgatgt

SEQ ID NO: 9485064 - DNA, 22 bp, Homo sapiens
tcagagaaatgctgagctcatg

SEQ ID NO: 9485065 - DNA, 22 bp, Homo sapiens
cagtgtctcagtttcacttgaa

SEQ ID NO: 9485066 - DNA, 22 bp, Homo sapiens
cagtgtctcaaaacaagttgct

SEQ ID NO: 9485067 - DNA, 21 bp, Homo sapiens
tcagagaacccggcaggcaag

SEQ ID NO: 9485068 - DNA, 21 bp, Homo sapiens
tcagagaacccggcaggcaag

SEQ ID NO: 9485069 - DNA, 22 bp, Homo sapiens
cagtgtctccagatgctccaat

SEQ ID NO: 9485070 - DNA, 22 bp, Homo sapiens
tcagagaaatgacaatatatag

SEQ ID NO: 9485071 - DNA, 22 bp, Homo sapiens
tcagagaaatgacaatatatag

SEQ ID NO: 9485072 - DNA, 22 bp, Homo sapiens
tcagagaaatgctgagctcatg

SEQ ID NO: 9485073 - DNA, 22 bp, Homo sapiens
tcagagaaataattgctgagtt

SEQ ID NO: 9485074 - DNA, 22 bp, Homo sapiens
tcagagaaataattgctgagtt

SEQ ID NO: 9485075 - DNA, 22 bp, Homo sapiens
cagtgtctgggacagaaagtca

SEQ ID NO: 9485076 - DNA, 22 bp, Homo sapiens
cagtgtctgcctttctgtttgg

SEQ ID NO: 9485077 - DNA, 22 bp, Homo sapiens
cagtgtctgaaataacaccgga

SEQ ID NO: 9485078 - DNA, 22 bp, Homo sapiens
cagtgtctcccccaggttctgt

SEQ ID NO: 9485079 - DNA, 22 bp, Homo sapiens
cagtgtctccagatgctccaat

SEQ ID NO: 9485080 - DNA, 18 bp, Homo sapiens
cagtgtcttggtaaaata

SEQ ID NO: 9485081 - DNA, 22 bp, Homo sapiens
cagtgtcttatttgtagctcag

SEQ ID NO: 9485082 - DNA, 18 bp, Homo sapiens
cagtgtcttggtaaaata

SEQ ID NO: 9485083 - DNA, 22 bp, Homo sapiens
cagtgtctggttggctctacgt

SEQ ID NO: 9485084 - DNA, 22 bp, Homo sapiens
cagtgtctggttggctctacgt

SEQ ID NO: 9485085 - DNA, 22 bp, Homo sapiens
cagtgtctttcagactcagaaa

SEQ ID NO: 9485086 - DNA, 23 bp, Homo sapiens
cagtgtgacgaggtgaggcaggc

SEQ ID NO: 9485087 - DNA, 23 bp, Homo sapiens
cagtgtgacgaggtgaggcaggc

SEQ ID NO: 9485088 - DNA, 22 bp, Homo sapiens
cagtgtttagcacagtgcttgg

SEQ ID NO: 9485089 - DNA, 22 bp, Homo sapiens
cagttaaaaggtatgctaccaa

SEQ ID NO: 9485090 - DNA, 22 bp, Homo sapiens
cagttaaaatgtgctataagaa

SEQ ID NO: 9485091 - DNA, 22 bp, Homo sapiens
cagtgtttctgagttccagctc

SEQ ID NO: 9485092 - DNA, 22 bp, Homo sapiens
cagtgtttgcttaagttatatg

SEQ ID NO: 9485093 - DNA, 22 bp, Homo sapiens
cagtgtttgtggaattcaggtg

SEQ ID NO: 9485094 - DNA, 23 bp, Homo sapiens
cagtgggcttctaactgctcctg

SEQ ID NO: 9485095 - DNA, 22 bp, Homo sapiens
cagtggggggactgaggcctga

SEQ ID NO: 9485096 - DNA, 22 bp, Homo sapiens
cagtgggggtgaggccgaggta

SEQ ID NO: 9485097 - DNA, 22 bp, Homo sapiens
cagtggggtttctgtgggtgct

SEQ ID NO: 9485098 - DNA, 22 bp, Homo sapiens
cagtgggtaggaaaggctcttc

SEQ ID NO: 9485099 - DNA, 22 bp, Homo sapiens
cagtgggtaggaaaggctcttc

SEQ ID NO: 9485100 - DNA, 22 bp, Homo sapiens
tcagaagtctggactgcttctc

SEQ ID NO: 9485101 - DNA, 22 bp, Homo sapiens
cagtgggatatgggggcagcat

SEQ ID NO: 9485102 - DNA, 22 bp, Homo sapiens
cagtgggaagggcagaggcttt

SEQ ID NO: 9485103 - DNA, 22 bp, Homo sapiens
cagtgggaaagtgaagagcatt

SEQ ID NO: 9485104 - DNA, 22 bp, Homo sapiens
cagtgggaaagtgaagagcatt

SEQ ID NO: 9485105 - DNA, 22 bp, Homo sapiens
cagtgggaaagtgaagagcatt

SEQ ID NO: 9485106 - DNA, 22 bp, Homo sapiens
cagtgccatgtctgagccccta

SEQ ID NO: 9485107 - DNA, 22 bp, Homo sapiens
cagtgccatgatgcagagcaat

SEQ ID NO: 9485108 - DNA, 22 bp, Homo sapiens
cagtgccatgtctgagccccta

SEQ ID NO: 9485109 - DNA, 22 bp, Homo sapiens
cagtgccatattgaaagacatt

SEQ ID NO: 9485110 - DNA, 22 bp, Homo sapiens
cagtgccatgatgcagagcaat

SEQ ID NO: 9485111 - DNA, 22 bp, Homo sapiens
cagtgccagctgcttggcctac

SEQ ID NO: 9485112 - DNA, 22 bp, Homo sapiens
cagtgccagggttgtgtaaatc

SEQ ID NO: 9485113 - DNA, 22 bp, Homo sapiens
cagtgccaaggatggcctggga

SEQ ID NO: 9485114 - DNA, 22 bp, Homo sapiens
cagtgccaaggctcttggtctg

SEQ ID NO: 9485115 - DNA, 22 bp, Homo sapiens
cagtgccacaggaatggccaat

SEQ ID NO: 9485116 - DNA, 22 bp, Homo sapiens
cagtgccacaggaatggccaat

SEQ ID NO: 9485117 - DNA, 22 bp, Homo sapiens
cagtgccacttaatgaggctgc

SEQ ID NO: 9485118 - DNA, 21 bp, Homo sapiens
cagtgccagccacaggacgcc

SEQ ID NO: 9485119 - DNA, 22 bp, Homo sapiens
cagtgccaggagacaagatcag

SEQ ID NO: 9485120 - DNA, 22 bp, Homo sapiens
cagtgccagaggtactagtgga

SEQ ID NO: 9485121 - DNA, 21 bp, Homo sapiens
cagtgccagccacaggacgcc

SEQ ID NO: 9485122 - DNA, 22 bp, Homo sapiens
cagtggcagttagaaaatattc

SEQ ID NO: 9485123 - DNA, 22 bp, Homo sapiens
cagtggcaggggaagcaggtgt

SEQ ID NO: 9485124 - DNA, 22 bp, Homo sapiens
cagtggctgtttctggaaggca

SEQ ID NO: 9485125 - DNA, 22 bp, Homo sapiens
cagtggcttctcatgtcattca

SEQ ID NO: 9485126 - DNA, 20 bp, Homo sapiens
cagtggcttctgtggaatat

SEQ ID NO: 9485127 - DNA, 22 bp, Homo sapiens
cagtggcttcttcctagagcca

SEQ ID NO: 9485128 - DNA, 22 bp, Homo sapiens
tcagctttggtcacattgagtt

SEQ ID NO: 9485129 - DNA, 22 bp, Homo sapiens
cagtttatatataagcacattg

SEQ ID NO: 9485130 - DNA, 22 bp, Homo sapiens
tcagctgcataagtcaccttgc

SEQ ID NO: 9485131 - DNA, 22 bp, Homo sapiens
tcagctgcataagtcaccttgc

SEQ ID NO: 9485132 - DNA, 21 bp, Homo sapiens
tcagctttgcaactgcacatc

SEQ ID NO: 9485133 - DNA, 22 bp, Homo sapiens
tcagctttgcaagttagaaaat

SEQ ID NO: 9485134 - DNA, 22 bp, Homo sapiens
cagtttatagctctagcagctt

SEQ ID NO: 9485135 - DNA, 22 bp, Homo sapiens
cagtttatatataagcacattg

SEQ ID NO: 9485136 - DNA, 22 bp, Homo sapiens
cagtttatatataagcacattg

SEQ ID NO: 9485137 - DNA, 22 bp, Homo sapiens
cagtttatagttgttatgtgtg

SEQ ID NO: 9485138 - DNA, 22 bp, Homo sapiens
cagtttatatataagcacattg

SEQ ID NO: 9485139 - DNA, 22 bp, Homo sapiens
cagtttagcatttaccgtgatg

SEQ ID NO: 9485140 - DNA, 22 bp, Homo sapiens
cagtttaggtcatccttgcttt

SEQ ID NO: 9485141 - DNA, 22 bp, Homo sapiens
cagtttaggagagacgcgttct

SEQ ID NO: 9485142 - DNA, 22 bp, Homo sapiens
cagtttaagtagaactgagaat

SEQ ID NO: 9485143 - DNA, 22 bp, Homo sapiens
cagtttaagtagaactgagaat

SEQ ID NO: 9485144 - DNA, 20 bp, Homo sapiens
cagtttacaacataaattgt

SEQ ID NO: 9485145 - DNA, 22 bp, Homo sapiens
cataaagtagcagagcatgact

SEQ ID NO: 9485146 - DNA, 22 bp, Homo sapiens
cataaactcttgagattcttgt

SEQ ID NO: 9485147 - DNA, 22 bp, Homo sapiens
cataaactcttgagattcttgt

SEQ ID NO: 9485148 - DNA, 22 bp, Homo sapiens
cataaagtcatgatctgagtat

SEQ ID NO: 9485149 - DNA, 22 bp, Homo sapiens
cataaagtaggcaagcattcca

SEQ ID NO: 9485150 - DNA, 22 bp, Homo sapiens
cataaagtaggcaagcattcca

SEQ ID NO: 9485151 - DNA, 22 bp, Homo sapiens
cataaagttaagctgtaagtat

SEQ ID NO: 9485152 - DNA, 19 bp, Homo sapiens
cataaatgtacaagataca

SEQ ID NO: 9485153 - DNA, 22 bp, Homo sapiens
cataaagttttataggctcaaa

SEQ ID NO: 9485154 - DNA, 22 bp, Homo sapiens
cataaagttaagctgtaagtat

SEQ ID NO: 9485155 - DNA, 19 bp, Homo sapiens
cataaatgtacaagataca

SEQ ID NO: 9485156 - DNA, 19 bp, Homo sapiens
cataaatgtacaagataca

SEQ ID NO: 9485157 - DNA, 22 bp, Homo sapiens
tcaggaaagagtaatgtataca

SEQ ID NO: 9485158 - DNA, 22 bp, Homo sapiens
tcaggaaagagtaatgtataca

SEQ ID NO: 9485159 - DNA, 22 bp, Homo sapiens
tcaggaaagaagatgctcagtg

SEQ ID NO: 9485160 - DNA, 22 bp, Homo sapiens
tcaggaaactgtcaagtgggat

SEQ ID NO: 9485161 - DNA, 22 bp, Homo sapiens
cataaactctctgtaccaatat

SEQ ID NO: 9485162 - DNA, 22 bp, Homo sapiens
cataaaatggcttgttctttaa

SEQ ID NO: 9485163 - DNA, 22 bp, Homo sapiens
tcagcttttgtcagaaattgta

SEQ ID NO: 9485164 - DNA, 22 bp, Homo sapiens
tcaggaaaatactgcttatcca

SEQ ID NO: 9485165 - DNA, 22 bp, Homo sapiens
tcaggaaaatactgcttatcca

SEQ ID NO: 9485166 - DNA, 21 bp, Homo sapiens
tcaggaaacacctcttaagga

SEQ ID NO: 9485167 - DNA, 22 bp, Homo sapiens
tcaggaaactacagttgaacta

SEQ ID NO: 9485168 - DNA, 22 bp, Homo sapiens
tcaggaaactacagttgaacta

SEQ ID NO: 9485169 - DNA, 21 bp, Homo sapiens
tcaggaaacacctcttaagga

SEQ ID NO: 9485170 - DNA, 21 bp, Homo sapiens
tcaggaaacacctcttaagga

SEQ ID NO: 9485171 - DNA, 22 bp, Homo sapiens
tcagcagcagctcagcatgttt

SEQ ID NO: 9485172 - DNA, 22 bp, Homo sapiens
tcagcagcagctcagcatgttt

SEQ ID NO: 9485173 - DNA, 21 bp, Homo sapiens
tcagcagcatctgcctagagt

SEQ ID NO: 9485174 - DNA, 23 bp, Homo sapiens
tcagcagcagaagtgctgggatg

SEQ ID NO: 9485175 - DNA, 23 bp, Homo sapiens
tcagcagcagaagtgctgggatg

SEQ ID NO: 9485176 - DNA, 19 bp, Homo sapiens
tcagcagcactgtgatttc

SEQ ID NO: 9485177 - DNA, 20 bp, Homo sapiens
cagtttaactttgagcagtt

SEQ ID NO: 9485178 - DNA, 21 bp, Homo sapiens
tcagcagcatctgcctagagt

SEQ ID NO: 9485179 - DNA, 22 bp, Homo sapiens
tcagcagccgcagctgactcag

SEQ ID NO: 9485180 - DNA, 22 bp, Homo sapiens
cagttgttcccagcaatgaaag

SEQ ID NO: 9485181 - DNA, 22 bp, Homo sapiens
tcagcagagtggaacattgtca

SEQ ID NO: 9485182 - DNA, 22 bp, Homo sapiens
tcagcagactaggcagattact

SEQ ID NO: 9485183 - DNA, 22 bp, Homo sapiens
tcagcagagcgagaccaagtca

SEQ ID NO: 9485184 - DNA, 22 bp, Homo sapiens
tcagcagactaggcagattact

SEQ ID NO: 9485185 - DNA, 22 bp, Homo sapiens
tcagcagacattattttctggc

SEQ ID NO: 9485186 - DNA, 22 bp, Homo sapiens
cagttaaacgggccatgtgagt

SEQ ID NO: 9485187 - DNA, 22 bp, Homo sapiens
cagttaatcttgccattatatc

SEQ ID NO: 9485188 - DNA, 22 bp, Homo sapiens
cagttaacttcatatgatcatt

SEQ ID NO: 9485189 - DNA, 22 bp, Homo sapiens
cagttaatgtcctatacaatag

SEQ ID NO: 9485190 - DNA, 19 bp, Homo sapiens
cagttacagcagctaagac

SEQ ID NO: 9485191 - DNA, 19 bp, Homo sapiens
cagttacagcagctaagac

SEQ ID NO: 9485192 - DNA, 18 bp, Homo sapiens
cagttacaccttcattca

SEQ ID NO: 9485193 - DNA, 22 bp, Homo sapiens
cagttactcaataattcttgcg

SEQ ID NO: 9485194 - DNA, 22 bp, Homo sapiens
cagttactgtatgtcaaagact

SEQ ID NO: 9485195 - DNA, 22 bp, Homo sapiens
tcagatgagtgctttcagctgc

SEQ ID NO: 9485196 - DNA, 22 bp, Homo sapiens
caggctggagtgcaatggcaca

SEQ ID NO: 9485197 - DNA, 22 bp, Homo sapiens
caggctggagtgcaatggcaca

SEQ ID NO: 9485198 - DNA, 22 bp, Homo sapiens
caggctggagtgcaatgacgcc

SEQ ID NO: 9485199 - DNA, 22 bp, Homo sapiens
caggctggagtgcaatgacgcc

SEQ ID NO: 9485200 - DNA, 22 bp, Homo sapiens
caggctggagtgcaatggtgct

SEQ ID NO: 9485201 - DNA, 22 bp, Homo sapiens
caggctggagtgcagtggcgcc

SEQ ID NO: 9485202 - DNA, 22 bp, Homo sapiens
caggctggagtgagtgtagtgg

SEQ ID NO: 9485203 - DNA, 22 bp, Homo sapiens
caggctgcctggaagaggactg

SEQ ID NO: 9485204 - DNA, 22 bp, Homo sapiens
caggctggagtgagtgtagtgg

SEQ ID NO: 9485205 - DNA, 22 bp, Homo sapiens
caggctgcctggaagaggactg

SEQ ID NO: 9485206 - DNA, 22 bp, Homo sapiens
caggctggagtgagtgtagtgg

SEQ ID NO: 9485207 - DNA, 22 bp, Homo sapiens
caggctggagtgagtgtagtgg

SEQ ID NO: 9485208 - DNA, 22 bp, Homo sapiens
tagaataagttgatgatatatg

SEQ ID NO: 9485209 - DNA, 22 bp, Homo sapiens
tagaataagttgatgatatatg

SEQ ID NO: 9485210 - DNA, 22 bp, Homo sapiens
tagaataagttgatgatatatg

SEQ ID NO: 9485211 - DNA, 22 bp, Homo sapiens
tagaacataagtcattcatttg

SEQ ID NO: 9485212 - DNA, 22 bp, Homo sapiens
tagaacataagtcattcatttg

SEQ ID NO: 9485213 - DNA, 22 bp, Homo sapiens
tagaacataagtcattcatttg

SEQ ID NO: 9485214 - DNA, 22 bp, Homo sapiens
caggctggagtgcagtggtgcc

SEQ ID NO: 9485215 - DNA, 22 bp, Homo sapiens
tagaatatacactacagcttaa

SEQ ID NO: 9485216 - DNA, 22 bp, Homo sapiens
tagaatactagtgaagtcatcg

SEQ ID NO: 9485217 - DNA, 22 bp, Homo sapiens
tagaatagtgttttcattatgg

SEQ ID NO: 9485218 - DNA, 22 bp, Homo sapiens
caggctggagtgcagtggcgct

SEQ ID NO: 9485219 - DNA, 22 bp, Homo sapiens
caggctggagtgcagtggggcg

SEQ ID NO: 9485220 - DNA, 22 bp, Homo sapiens
caggctggagtgcagtggggcg

SEQ ID NO: 9485221 - DNA, 22 bp, Homo sapiens
caggctggagtgcagtggggcg

SEQ ID NO: 9485222 - DNA, 22 bp, Homo sapiens
caggctggagtgcagtggcgct

SEQ ID NO: 9485223 - DNA, 22 bp, Homo sapiens
caggctggagtgcagtggcgct

SEQ ID NO: 9485224 - DNA, 22 bp, Homo sapiens
caggctggagtgcagtggcgcc

SEQ ID NO: 9485225 - DNA, 22 bp, Homo sapiens
caggctggagtgcagtggcgcc

SEQ ID NO: 9485226 - DNA, 22 bp, Homo sapiens
gtgagggaggtagatttcatca

SEQ ID NO: 9485227 - DNA, 22 bp, Homo sapiens
gtgagggcaaattagaatcaaa

SEQ ID NO: 9485228 - DNA, 20 bp, Homo sapiens
cagccctgtgacctggccct

SEQ ID NO: 9485229 - DNA, 20 bp, Homo sapiens
cagccctgtgacctggccct

SEQ ID NO: 9485230 - DNA, 20 bp, Homo sapiens
cagccctgtgacctggccct

SEQ ID NO: 9485231 - DNA, 22 bp, Homo sapiens
gtgaggggccaagagtagggca

SEQ ID NO: 9485232 - DNA, 22 bp, Homo sapiens
gtgaggggagtaaagccatgtt

SEQ ID NO: 9485233 - DNA, 22 bp, Homo sapiens
gtgaggggagtaaagccatgtt

SEQ ID NO: 9485234 - DNA, 22 bp, Homo sapiens
gtgaggggagtaaagccatgtt

SEQ ID NO: 9485235 - DNA, 22 bp, Homo sapiens
tacctctggacattgtggagca

SEQ ID NO: 9485236 - DNA, 22 bp, Homo sapiens
tacctctggacattgtggagca

SEQ ID NO: 9485237 - DNA, 22 bp, Homo sapiens
tacctctctaaacccagggaca

SEQ ID NO: 9485238 - DNA, 22 bp, Homo sapiens
tactatgtgaaaatactatagt

SEQ ID NO: 9485239 - DNA, 22 bp, Homo sapiens
tacctgaagtaacaatgaatat

SEQ ID NO: 9485240 - DNA, 22 bp, Homo sapiens
tacctgaaccaagcccagctct

SEQ ID NO: 9485241 - DNA, 22 bp, Homo sapiens
tactattgaatcattgtcaatc

SEQ ID NO: 9485242 - DNA, 22 bp, Homo sapiens
tactatgttcttcctaaatagt

SEQ ID NO: 9485243 - DNA, 22 bp, Homo sapiens
tactatttggaattttaaattg

SEQ ID NO: 9485244 - DNA, 22 bp, Homo sapiens
gtgaggggtctggacgcacagt

SEQ ID NO: 9485245 - DNA, 22 bp, Homo sapiens
gtgaggggccaagagtagggca

SEQ ID NO: 9485246 - DNA, 22 bp, Homo sapiens
gtgaggggtggctgagcagttt

SEQ ID NO: 9485247 - DNA, 22 bp, Homo sapiens
gtgaggggtggctgagcagttt

SEQ ID NO: 9485248 - DNA, 22 bp, Homo sapiens
tactgtctgcttcttatagctt

SEQ ID NO: 9485249 - DNA, 22 bp, Homo sapiens
tactgtctggagttgccaaagg

SEQ ID NO: 9485250 - DNA, 22 bp, Homo sapiens
tactgtctatacacttgattac

SEQ ID NO: 9485251 - DNA, 22 bp, Homo sapiens
tactgtctaataagattgatgg

SEQ ID NO: 9485252 - DNA, 21 bp, Homo sapiens
tactgtatagatgtgttcttg

SEQ ID NO: 9485253 - DNA, 22 bp, Homo sapiens
tactgtatactactgctgttct

SEQ ID NO: 9485254 - DNA, 22 bp, Homo sapiens
tactgtaggtgggtcactagta

SEQ ID NO: 9485255 - DNA, 21 bp, Homo sapiens
tactgtatagatgtgttcttg

SEQ ID NO: 9485256 - DNA, 21 bp, Homo sapiens
tactgtagccttgcactgtag

SEQ ID NO: 9485257 - DNA, 22 bp, Homo sapiens
tactgtaggtgggtcactagta

SEQ ID NO: 9485258 - DNA, 21 bp, Homo sapiens
tactgtagccttgcactgtag

SEQ ID NO: 9485259 - DNA, 22 bp, Homo sapiens
tactgtattgttggctcttttg

SEQ ID NO: 9485260 - DNA, 23 bp, Homo sapiens
tactgtatattactgtgttatac

SEQ ID NO: 9485261 - DNA, 22 bp, Homo sapiens
tactgtatgaattatgttattt

SEQ ID NO: 9485262 - DNA, 22 bp, Homo sapiens
tactgtatgaattatgttattt

SEQ ID NO: 9485263 - DNA, 22 bp, Homo sapiens
tactcagtttatgatttcaagt

SEQ ID NO: 9485264 - DNA, 22 bp, Homo sapiens
tactcacattctgtttcttgct

SEQ ID NO: 9485265 - DNA, 22 bp, Homo sapiens
tactcacattctgtttcttgct

SEQ ID NO: 9485266 - DNA, 22 bp, Homo sapiens
tactcaaactcactaagacaga

SEQ ID NO: 9485267 - DNA, 22 bp, Homo sapiens
tactatttttgcaacgtataca

SEQ ID NO: 9485268 - DNA, 22 bp, Homo sapiens
tactatttttgcaacgtataca

SEQ ID NO: 9485269 - DNA, 22 bp, Homo sapiens
tactattttgacatgaaattga

SEQ ID NO: 9485270 - DNA, 22 bp, Homo sapiens
caggctgggctccggagataaa

SEQ ID NO: 9485271 - DNA, 22 bp, Homo sapiens
caggctgggctccggagataaa

SEQ ID NO: 9485272 - DNA, 22 bp, Homo sapiens
caggctgggctccggagataaa

SEQ ID NO: 9485273 - DNA, 22 bp, Homo sapiens
caggctgggctggtgttagagt

SEQ ID NO: 9485274 - DNA, 22 bp, Homo sapiens
caggctgggctggtgttagagt

SEQ ID NO: 9485275 - DNA, 22 bp, Homo sapiens
caggctgggctggtgttagagt

SEQ ID NO: 9485276 - DNA, 22 bp, Homo sapiens
caggctgggctggtgttagagt

SEQ ID NO: 9485277 - DNA, 22 bp, Homo sapiens
caggctggtcccagagcattgc

SEQ ID NO: 9485278 - DNA, 22 bp, Homo sapiens
tagacattttctcaacatctct

SEQ ID NO: 9485279 - DNA, 22 bp, Homo sapiens
tagacattttctcaacatctct

SEQ ID NO: 9485280 - DNA, 22 bp, Homo sapiens
tagacattttctcaacatctct

SEQ ID NO: 9485281 - DNA, 22 bp, Homo sapiens
tagacattttccctaccctcat

SEQ ID NO: 9485282 - DNA, 22 bp, Homo sapiens
tagacattttaagacatatacc

SEQ ID NO: 9485283 - DNA, 22 bp, Homo sapiens
tagaatatgtggtgtatacttt

SEQ ID NO: 9485284 - DNA, 22 bp, Homo sapiens
tagaatcaagcagtagagcaga

SEQ ID NO: 9485285 - DNA, 22 bp, Homo sapiens
tagaatatgattaattttctta

SEQ ID NO: 9485286 - DNA, 22 bp, Homo sapiens
tagaatatgtggtaggatctgg

SEQ ID NO: 9485287 - DNA, 22 bp, Homo sapiens
tagaatatgtggtaggatctgg

SEQ ID NO: 9485288 - DNA, 21 bp, Homo sapiens
tagaatcactaataagatgta

SEQ ID NO: 9485289 - DNA, 21 bp, Homo sapiens
tagaatcactaataagatgta

SEQ ID NO: 9485290 - DNA, 22 bp, Homo sapiens
caggctgggcagcctccccggc

SEQ ID NO: 9485291 - DNA, 22 bp, Homo sapiens
caggctgggctccggagataaa

SEQ ID NO: 9485292 - DNA, 22 bp, Homo sapiens
caggctgggcagcctccccggc

SEQ ID NO: 9485293 - DNA, 22 bp, Homo sapiens
tagaggaaatttccaaggtgag

SEQ ID NO: 9485294 - DNA, 22 bp, Homo sapiens
tagaggaaccaggcaggctgag

SEQ ID NO: 9485295 - DNA, 22 bp, Homo sapiens
tagaggagaacacaaattatag

SEQ ID NO: 9485296 - DNA, 22 bp, Homo sapiens
tagagtgtaagctccttgaggg

SEQ ID NO: 9485297 - DNA, 19 bp, Homo sapiens
tagaggagaagggaagtgg

SEQ ID NO: 9485298 - DNA, 22 bp, Homo sapiens
tagagtgtccaacacataggag

SEQ ID NO: 9485299 - DNA, 22 bp, Homo sapiens
tagagtgtcctatctcccacgg

SEQ ID NO: 9485300 - DNA, 22 bp, Homo sapiens
tagagtgttttgttaggcagca

SEQ ID NO: 9485301 - DNA, 22 bp, Homo sapiens
tagataaaagggcaaagggcat

SEQ ID NO: 9485302 - DNA, 22 bp, Homo sapiens
tagataaattagaaagtttact

SEQ ID NO: 9485303 - DNA, 19 bp, Homo sapiens
tagagcttgttttaggaag

SEQ ID NO: 9485304 - DNA, 22 bp, Homo sapiens
tagagcttggggatttagtagt

SEQ ID NO: 9485305 - DNA, 21 bp, Homo sapiens
tagagcttggcacagagtaga

SEQ ID NO: 9485306 - DNA, 22 bp, Homo sapiens
tagagcttggactgcattttcg

SEQ ID NO: 9485307 - DNA, 22 bp, Homo sapiens
tagagcttgattggattcaggg

SEQ ID NO: 9485308 - DNA, 22 bp, Homo sapiens
tagagcttagagaatgagtttg

SEQ ID NO: 9485309 - DNA, 20 bp, Homo sapiens
tagagcttaggttttattct

SEQ ID NO: 9485310 - DNA, 22 bp, Homo sapiens
tagagctggaaaactgcaggta

SEQ ID NO: 9485311 - DNA, 22 bp, Homo sapiens
tagagctgggcagtgctctgag

SEQ ID NO: 9485312 - DNA, 22 bp, Homo sapiens
tagagctggaatttgcagcaag

SEQ ID NO: 9485313 - DNA, 22 bp, Homo sapiens
tagagctggaatttgcagcaag

SEQ ID NO: 9485314 - DNA, 22 bp, Homo sapiens
cagggcagaacatatagatagt

SEQ ID NO: 9485315 - DNA, 22 bp, Homo sapiens
cagggcagaacatatagatagt

SEQ ID NO: 9485316 - DNA, 22 bp, Homo sapiens
cagggcagaacatatagatagt

SEQ ID NO: 9485317 - DNA, 22 bp, Homo sapiens
cagggcagaacatatagatagt

SEQ ID NO: 9485318 - DNA, 22 bp, Homo sapiens
cagggcagaaggcactctactc

SEQ ID NO: 9485319 - DNA, 20 bp, Homo sapiens
cagggcacactgcagcctcg

SEQ ID NO: 9485320 - DNA, 22 bp, Homo sapiens
cagggcacagatcggggcgcac

SEQ ID NO: 9485321 - DNA, 20 bp, Homo sapiens
cagggcacactgcagcctcg

SEQ ID NO: 9485322 - DNA, 22 bp, Homo sapiens
tagataaattagaaagtttact

SEQ ID NO: 9485323 - DNA, 22 bp, Homo sapiens
tagataacagcactggcctcgc

SEQ ID NO: 9485324 - DNA, 22 bp, Homo sapiens
tagataacttgcacctacagga

SEQ ID NO: 9485325 - DNA, 22 bp, Homo sapiens
tagataatttggcatcatattg

SEQ ID NO: 9485326 - DNA, 22 bp, Homo sapiens
tagataatttggcatcatattg

SEQ ID NO: 9485327 - DNA, 22 bp, Homo sapiens
tagataatttggcatcatattg

SEQ ID NO: 9485328 - DNA, 19 bp, Homo sapiens
tagataaggcatttaatct

SEQ ID NO: 9485329 - DNA, 19 bp, Homo sapiens
tagataaggcatttaatct

SEQ ID NO: 9485330 - DNA, 22 bp, Homo sapiens
tagataaattagaaagtttact

SEQ ID NO: 9485331 - DNA, 22 bp, Homo sapiens
tagatacacacacagtcatgtg

SEQ ID NO: 9485332 - DNA, 22 bp, Homo sapiens
cagggatggcctggcgggccac

SEQ ID NO: 9485333 - DNA, 22 bp, Homo sapiens
cagggcaaagagagcacatgct

SEQ ID NO: 9485334 - DNA, 21 bp, Homo sapiens
cagggcaaccaagtccagaga

SEQ ID NO: 9485335 - DNA, 22 bp, Homo sapiens
cagggcaaagagagcacatgct

SEQ ID NO: 9485336 - DNA, 22 bp, Homo sapiens
tagcattccatcactcagcacc

SEQ ID NO: 9485337 - DNA, 22 bp, Homo sapiens
tagcaatgtgtgtgtataaatt

SEQ ID NO: 9485338 - DNA, 22 bp, Homo sapiens
tagcattatctgtcttatcatt

SEQ ID NO: 9485339 - DNA, 20 bp, Homo sapiens
tagcattccagaaaactcag

SEQ ID NO: 9485340 - DNA, 22 bp, Homo sapiens
tagcattccatcactcagcacc

SEQ ID NO: 9485341 - DNA, 22 bp, Homo sapiens
tagctaaggcaatcttttgcac

SEQ ID NO: 9485342 - DNA, 22 bp, Homo sapiens
tagctacacatctaaacagcaa

SEQ ID NO: 9485343 - DNA, 22 bp, Homo sapiens
tagctacaaatctgataagtgg

SEQ ID NO: 9485344 - DNA, 22 bp, Homo sapiens
tagctaatggtgaagattcaga

SEQ ID NO: 9485345 - DNA, 22 bp, Homo sapiens
tagcaatgtgtgtgtataaatt

SEQ ID NO: 9485346 - DNA, 22 bp, Homo sapiens
tagcaatgcttcattatttaaa

SEQ ID NO: 9485347 - DNA, 22 bp, Homo sapiens
tagcaatgtaagatgttaacac

SEQ ID NO: 9485348 - DNA, 22 bp, Homo sapiens
tagcaatccgttgatcccttgc

SEQ ID NO: 9485349 - DNA, 22 bp, Homo sapiens
tagcaatgctctatgatgaaaa

SEQ ID NO: 9485350 - DNA, 22 bp, Homo sapiens
tagcaatagaaacatataaagt

SEQ ID NO: 9485351 - DNA, 20 bp, Homo sapiens
tagcaatgagtgttccattt

SEQ ID NO: 9485352 - DNA, 22 bp, Homo sapiens
cagggcagaaggcactctactc

SEQ ID NO: 9485353 - DNA, 22 bp, Homo sapiens
cagggcagaaggcactctactc

SEQ ID NO: 9485354 - DNA, 22 bp, Homo sapiens
cagggcagaaggcactctactc

SEQ ID NO: 9485355 - DNA, 22 bp, Homo sapiens
tagcaagatccttccctggcgt

SEQ ID NO: 9485356 - DNA, 22 bp, Homo sapiens
tagcaagatgatgaattattca

SEQ ID NO: 9485357 - DNA, 22 bp, Homo sapiens
tagcaaggacaacatatgagag

SEQ ID NO: 9485358 - DNA, 22 bp, Homo sapiens
tagcaaggacgtccaaagaact

SEQ ID NO: 9485359 - DNA, 22 bp, Homo sapiens
tagcaaggacaacatatgagag

SEQ ID NO: 9485360 - DNA, 22 bp, Homo sapiens
tagcaaggcgtggcactcaaat

SEQ ID NO: 9485361 - DNA, 22 bp, Homo sapiens
tagcaaggcttccaatgaacag

SEQ ID NO: 9485362 - DNA, 22 bp, Homo sapiens
tagcaagtgttggtgaagatgt

SEQ ID NO: 9485363 - DNA, 22 bp, Homo sapiens
tagcaaggtgaagtatgggtga

SEQ ID NO: 9485364 - DNA, 22 bp, Homo sapiens
tagcaaggtgaagtatgggtga

SEQ ID NO: 9485365 - DNA, 22 bp, Homo sapiens
tagggtggagactggaagcagg

SEQ ID NO: 9485366 - DNA, 22 bp, Homo sapiens
tagggtggagactggaagcagg

SEQ ID NO: 9485367 - DNA, 22 bp, Homo sapiens
taggtaatggataatgaagtga

SEQ ID NO: 9485368 - DNA, 22 bp, Homo sapiens
tagggtggttagaaggagtatg

SEQ ID NO: 9485369 - DNA, 22 bp, Homo sapiens
tagggtggttagaaggagtatg

SEQ ID NO: 9485370 - DNA, 22 bp, Homo sapiens
taggtacattattagatgcatg

SEQ ID NO: 9485371 - DNA, 22 bp, Homo sapiens
taggtagctttggcgtttcttg

SEQ ID NO: 9485372 - DNA, 22 bp, Homo sapiens
taggtagatcttagtaatgaaa

SEQ ID NO: 9485373 - DNA, 22 bp, Homo sapiens
taggtagctttggcgtttcttg

SEQ ID NO: 9485374 - DNA, 22 bp, Homo sapiens
taggtagacaaagaaatgtgtt

SEQ ID NO: 9485375 - DNA, 22 bp, Homo sapiens
caggggaaggagccttgaaact

SEQ ID NO: 9485376 - DNA, 22 bp, Homo sapiens
caggggaaggagccttgaaact

SEQ ID NO: 9485377 - DNA, 22 bp, Homo sapiens
caggggaagatgccaagggaga

SEQ ID NO: 9485378 - DNA, 22 bp, Homo sapiens
caggggacattaaagctccata

SEQ ID NO: 9485379 - DNA, 22 bp, Homo sapiens
cagggctgtggctttgtgctgt

SEQ ID NO: 9485380 - DNA, 18 bp, Homo sapiens
cagggctgtggggtcact

SEQ ID NO: 9485381 - DNA, 22 bp, Homo sapiens
cagggctttcccttgtagaaat

SEQ ID NO: 9485382 - DNA, 22 bp, Homo sapiens
cagggctttcctgagaagtgat

SEQ ID NO: 9485383 - DNA, 22 bp, Homo sapiens
tagggctcactgagatgaatat

SEQ ID NO: 9485384 - DNA, 22 bp, Homo sapiens
tagggccagttagggaagcttt

SEQ ID NO: 9485385 - DNA, 22 bp, Homo sapiens
tagggcagtttcatgttatctt

SEQ ID NO: 9485386 - DNA, 22 bp, Homo sapiens
tagggcagtttcatgttatctt

SEQ ID NO: 9485387 - DNA, 22 bp, Homo sapiens
tagggcagttataacattagtg

SEQ ID NO: 9485388 - DNA, 22 bp, Homo sapiens
tagggcagttataacattagtg

SEQ ID NO: 9485389 - DNA, 22 bp, Homo sapiens
tagggtccatatggatgaatgg

SEQ ID NO: 9485390 - DNA, 22 bp, Homo sapiens
tagggtcccagataggagccag

SEQ ID NO: 9485391 - DNA, 22 bp, Homo sapiens
tagggtcctgcctacagagaca

SEQ ID NO: 9485392 - DNA, 22 bp, Homo sapiens
tagggtcctcatctgtaaatga

SEQ ID NO: 9485393 - DNA, 22 bp, Homo sapiens
tagggtccaagccttataatta

SEQ ID NO: 9485394 - DNA, 22 bp, Homo sapiens
tagggtacatgtgcacaacatg

SEQ ID NO: 9485395 - DNA, 22 bp, Homo sapiens
tagggtacatgtgcacaacatg

SEQ ID NO: 9485396 - DNA, 22 bp, Homo sapiens
tagggaaggagaccaagccaca

SEQ ID NO: 9485397 - DNA, 22 bp, Homo sapiens
tagggaagctcctgattcccct

SEQ ID NO: 9485398 - DNA, 22 bp, Homo sapiens
tagggaagtgtataggggtcat

SEQ ID NO: 9485399 - DNA, 22 bp, Homo sapiens
tagggaaggagaccaagccaca

SEQ ID NO: 9485400 - DNA, 21 bp, Homo sapiens
tagggcaggcattggaagaga

SEQ ID NO: 9485401 - DNA, 21 bp, Homo sapiens
tagggcaggcattggaagaga

SEQ ID NO: 9485402 - DNA, 22 bp, Homo sapiens
tagggcaggtgaagaaaagcta

SEQ ID NO: 9485403 - DNA, 22 bp, Homo sapiens
tagggcaggtgaagaaaagcta

SEQ ID NO: 9485404 - DNA, 22 bp, Homo sapiens
tagggcaggtgaagaaaagcta

SEQ ID NO: 9485405 - DNA, 22 bp, Homo sapiens
tagggcaggggaggaatctgaa

SEQ ID NO: 9485406 - DNA, 22 bp, Homo sapiens
tagggcaggtgaagaaaagcta

SEQ ID NO: 9485407 - DNA, 21 bp, Homo sapiens
tagggcaggcattggaagaga

SEQ ID NO: 9485408 - DNA, 21 bp, Homo sapiens
tagggcaggcattggaagaga

SEQ ID NO: 9485409 - DNA, 21 bp, Homo sapiens
tagggcaggcattggaagaga

SEQ ID NO: 9485410 - DNA, 22 bp, Homo sapiens
tagggcaggggaggaatctgaa

SEQ ID NO: 9485411 - DNA, 22 bp, Homo sapiens
tagggcaggggaggaatctgaa

SEQ ID NO: 9485412 - DNA, 22 bp, Homo sapiens
cagggtggcaggcaccatggcc

SEQ ID NO: 9485413 - DNA, 22 bp, Homo sapiens
cagggtggccctgtggtctcat

SEQ ID NO: 9485414 - DNA, 22 bp, Homo sapiens
cagggtggcactcagcgcatct

SEQ ID NO: 9485415 - DNA, 22 bp, Homo sapiens
cagggtggcactcagcgcatct

SEQ ID NO: 9485416 - DNA, 22 bp, Homo sapiens
tatcatttaacagaatcattgc

SEQ ID NO: 9485417 - DNA, 22 bp, Homo sapiens
tatcatttaacagaatcattgc

SEQ ID NO: 9485418 - DNA, 22 bp, Homo sapiens
tatcatttaacagaatcattgc

SEQ ID NO: 9485419 - DNA, 22 bp, Homo sapiens
tatcatttaacagaatcattgc

SEQ ID NO: 9485420 - DNA, 22 bp, Homo sapiens
tatcatttaacagaatcattgc

SEQ ID NO: 9485421 - DNA, 22 bp, Homo sapiens
tatcattgtgttatttcttcca

SEQ ID NO: 9485422 - DNA, 22 bp, Homo sapiens
tatcatgttgaatttctgagaa

SEQ ID NO: 9485423 - DNA, 22 bp, Homo sapiens
tatcagtgtgcatctctgaatg

SEQ ID NO: 9485424 - DNA, 22 bp, Homo sapiens
tatcagtgtggtttctggactg

SEQ ID NO: 9485425 - DNA, 22 bp, Homo sapiens
tatcagtttattctataaatag

SEQ ID NO: 9485426 - DNA, 22 bp, Homo sapiens
tatcagtggtcacaagatacat

SEQ ID NO: 9485427 - DNA, 22 bp, Homo sapiens
tatcagtgctcccagcttagca

SEQ ID NO: 9485428 - DNA, 23 bp, Homo sapiens
tatcagtgtgatgaggctgctgc

SEQ ID NO: 9485429 - DNA, 22 bp, Homo sapiens
tatcagtccagggttttgtgac

SEQ ID NO: 9485430 - DNA, 22 bp, Homo sapiens
tatcagtgattgctgtatacaa

SEQ ID NO: 9485431 - DNA, 22 bp, Homo sapiens
tatcagtatggattcatggatt

SEQ ID NO: 9485432 - DNA, 22 bp, Homo sapiens
tatcagtagataaacggattgc

SEQ ID NO: 9485433 - DNA, 22 bp, Homo sapiens
tatcagtagaacaatggacatt

SEQ ID NO: 9485434 - DNA, 22 bp, Homo sapiens
tatcatcacattacctcttggg

SEQ ID NO: 9485435 - DNA, 22 bp, Homo sapiens
tatcatcactgtaatccgttga

SEQ ID NO: 9485436 - DNA, 22 bp, Homo sapiens
tatcataagttaattaaacagt

SEQ ID NO: 9485437 - DNA, 22 bp, Homo sapiens
tatcataagttaattaaacagt

SEQ ID NO: 9485438 - DNA, 22 bp, Homo sapiens
tatcatcttgttgtcatgcagc

SEQ ID NO: 9485439 - DNA, 22 bp, Homo sapiens
tatcatctgcaaagcacatcta

SEQ ID NO: 9485440 - DNA, 22 bp, Homo sapiens
tatcatctgcaaagcacatcta

SEQ ID NO: 9485441 - DNA, 22 bp, Homo sapiens
tagtgaaatatgtgctgatagc

SEQ ID NO: 9485442 - DNA, 22 bp, Homo sapiens
tagtgaaagtcaaagacagcta

SEQ ID NO: 9485443 - DNA, 22 bp, Homo sapiens
tagtgaaatgagaatgtatgac

SEQ ID NO: 9485444 - DNA, 22 bp, Homo sapiens
tagtgaaatgagaatgtatgac

SEQ ID NO: 9485445 - DNA, 22 bp, Homo sapiens
tagtgaaatgataacagagcag

SEQ ID NO: 9485446 - DNA, 22 bp, Homo sapiens
tagtgaatgttggctattaata

SEQ ID NO: 9485447 - DNA, 22 bp, Homo sapiens
tatatttaaatccaggttgaaa

SEQ ID NO: 9485448 - DNA, 22 bp, Homo sapiens
tatattgttggtgggaatataa

SEQ ID NO: 9485449 - DNA, 22 bp, Homo sapiens
tagtgacaggaactgaatctct

SEQ ID NO: 9485450 - DNA, 22 bp, Homo sapiens
tagtgaaacctgacagatcatg

SEQ ID NO: 9485451 - DNA, 22 bp, Homo sapiens
tagtgaaacctgacagatcatg

SEQ ID NO: 9485452 - DNA, 22 bp, Homo sapiens
tagtctttttaataaataatgc

SEQ ID NO: 9485453 - DNA, 22 bp, Homo sapiens
tagtctttttaataaataatgc

SEQ ID NO: 9485454 - DNA, 22 bp, Homo sapiens
tagtcttttgagaagtatatct

SEQ ID NO: 9485455 - DNA, 22 bp, Homo sapiens
tagtcttttgagaagtatatct

SEQ ID NO: 9485456 - DNA, 22 bp, Homo sapiens
tagtctttcatttggagcattt

SEQ ID NO: 9485457 - DNA, 19 bp, Homo sapiens
tagtctttattcttaattt

SEQ ID NO: 9485458 - DNA, 19 bp, Homo sapiens
tagtctttattcttaattt

SEQ ID NO: 9485459 - DNA, 19 bp, Homo sapiens
tagtctttattcttaattt

SEQ ID NO: 9485460 - DNA, 22 bp, Homo sapiens
caggggagtgagtccctctctg

SEQ ID NO: 9485461 - DNA, 22 bp, Homo sapiens
caggggagttttatgcaacaga

SEQ ID NO: 9485462 - DNA, 22 bp, Homo sapiens
taggacctggagcccagcaccg

SEQ ID NO: 9485463 - DNA, 19 bp, Homo sapiens
taggaccctggtggccccc

SEQ ID NO: 9485464 - DNA, 19 bp, Homo sapiens
taggaccctggtggccccc

SEQ ID NO: 9485465 - DNA, 22 bp, Homo sapiens
taggacccctgtggtagatggg

SEQ ID NO: 9485466 - DNA, 17 bp, Homo sapiens
taggagactggctgtcc

SEQ ID NO: 9485467 - DNA, 22 bp, Homo sapiens
taggactttggcgtcagaactg

SEQ ID NO: 9485468 - DNA, 22 bp, Homo sapiens
taggagaagagtcagggcctaa

SEQ ID NO: 9485469 - DNA, 22 bp, Homo sapiens
taggagaggtgaatggcacact

SEQ ID NO: 9485470 - DNA, 18 bp, Homo sapiens
taggagataatagagggc

SEQ ID NO: 9485471 - DNA, 22 bp, Homo sapiens
cagggcctgcctggttcctgga

SEQ ID NO: 9485472 - DNA, 22 bp, Homo sapiens
cagggcctggagctgggcctgc

SEQ ID NO: 9485473 - DNA, 22 bp, Homo sapiens
cagggcctggagctgggcctgc

SEQ ID NO: 9485474 - DNA, 22 bp, Homo sapiens
cagggcctggagctgggcctgc

SEQ ID NO: 9485475 - DNA, 22 bp, Homo sapiens
cagggcctcattgtcagtcctg

SEQ ID NO: 9485476 - DNA, 22 bp, Homo sapiens
cagggcctcattgtcagtcctg

SEQ ID NO: 9485477 - DNA, 22 bp, Homo sapiens
taggagctaaaatattttatat

SEQ ID NO: 9485478 - DNA, 22 bp, Homo sapiens
cagggctcactcggctggcgtc

SEQ ID NO: 9485479 - DNA, 22 bp, Homo sapiens
cagggctcagaagacagacctc

SEQ ID NO: 9485480 - DNA, 22 bp, Homo sapiens
cagggctcagaagacagacctc

SEQ ID NO: 9485481 - DNA, 22 bp, Homo sapiens
cagggctcaccactgggatcct

SEQ ID NO: 9485482 - DNA, 22 bp, Homo sapiens
cagggctcactcggctggcgtc

SEQ ID NO: 9485483 - DNA, 22 bp, Homo sapiens
cagggctcaccactgggatcct

SEQ ID NO: 9485484 - DNA, 22 bp, Homo sapiens
cagggctcaccactgggatcct

SEQ ID NO: 9485485 - DNA, 22 bp, Homo sapiens
cagggctcagggactgcagaaa

SEQ ID NO: 9485486 - DNA, 22 bp, Homo sapiens
cagggctcaggaaatcagacgt

SEQ ID NO: 9485487 - DNA, 22 bp, Homo sapiens
cagggctcaggaaatcagacgt

SEQ ID NO: 9485488 - DNA, 22 bp, Homo sapiens
cagggctcaggctctgggattc

SEQ ID NO: 9485489 - DNA, 22 bp, Homo sapiens
cagggctcaggctctgggattc

SEQ ID NO: 9485490 - DNA, 22 bp, Homo sapiens
cagggccttgttcaggagtgaa

SEQ ID NO: 9485491 - DNA, 22 bp, Homo sapiens
cagggccttgttcaggagtgaa

SEQ ID NO: 9485492 - DNA, 22 bp, Homo sapiens
cagggccttgttcaggagtgaa

SEQ ID NO: 9485493 - DNA, 22 bp, Homo sapiens
cagggccttgttcaggagtgaa

SEQ ID NO: 9485494 - DNA, 22 bp, Homo sapiens
cagggccttgttcaggagtgaa

SEQ ID NO: 9485495 - DNA, 22 bp, Homo sapiens
cagggccttttagcatcttctc

SEQ ID NO: 9485496 - DNA, 21 bp, Homo sapiens
cagggctagagagaatgacaa

SEQ ID NO: 9485497 - DNA, 22 bp, Homo sapiens
cagggccttcgtaagtgtccgg

SEQ ID NO: 9485498 - DNA, 22 bp, Homo sapiens
cagggccttatcctgccattga

SEQ ID NO: 9485499 - DNA, 22 bp, Homo sapiens
cagggcctgtcacgacgctcat

SEQ ID NO: 9485500 - DNA, 22 bp, Homo sapiens
cagggcctgtacaagtcccacc

SEQ ID NO: 9485501 - DNA, 22 bp, Homo sapiens
cagggcctgtacaagtcccacc

SEQ ID NO: 9485502 - DNA, 22 bp, Homo sapiens
cagggcctgtcacgacgctcat

SEQ ID NO: 9485503 - DNA, 22 bp, Homo sapiens
cagggcctgtcacgacgctcat

SEQ ID NO: 9485504 - DNA, 22 bp, Homo sapiens
cagggcagcttcctttgttagg

SEQ ID NO: 9485505 - DNA, 22 bp, Homo sapiens
cagggcagccaggccccgtggg

SEQ ID NO: 9485506 - DNA, 22 bp, Homo sapiens
cagggcagccaggccccgtggg

SEQ ID NO: 9485507 - DNA, 22 bp, Homo sapiens
cagggcagccaggccccgtggg

SEQ ID NO: 9485508 - DNA, 22 bp, Homo sapiens
cagggcagccaggccccgtggg

SEQ ID NO: 9485509 - DNA, 22 bp, Homo sapiens
cagggcagccaggccccgtggg

SEQ ID NO: 9485510 - DNA, 22 bp, Homo sapiens
cagggcagagccaggatttcaa

SEQ ID NO: 9485511 - DNA, 22 bp, Homo sapiens
cagggcagagccaggatttcaa

SEQ ID NO: 9485512 - DNA, 22 bp, Homo sapiens
cagggcagagccaggatttcaa

SEQ ID NO: 9485513 - DNA, 22 bp, Homo sapiens
cagggcagagccaggatttcaa

SEQ ID NO: 9485514 - DNA, 22 bp, Homo sapiens
cagggcagagggaaactccttt

SEQ ID NO: 9485515 - DNA, 22 bp, Homo sapiens
cagggcagagggaaactccttt

SEQ ID NO: 9485516 - DNA, 22 bp, Homo sapiens
cagggcagagggaaactccttt

SEQ ID NO: 9485517 - DNA, 22 bp, Homo sapiens
cagggcagagggaaactccttt

SEQ ID NO: 9485518 - DNA, 22 bp, Homo sapiens
tagctcaaaggttaagtgtgga

SEQ ID NO: 9485519 - DNA, 22 bp, Homo sapiens
tagctcaaaggttaagtgtgga

SEQ ID NO: 9485520 - DNA, 22 bp, Homo sapiens
tagctcctccccatccaggttc

SEQ ID NO: 9485521 - DNA, 22 bp, Homo sapiens
tagctcctggctgcagggcctc

SEQ ID NO: 9485522 - DNA, 20 bp, Homo sapiens
tagctaccttgatcccctgg

SEQ ID NO: 9485523 - DNA, 22 bp, Homo sapiens
tagctagaaggttgaaagcagg

SEQ ID NO: 9485524 - DNA, 22 bp, Homo sapiens
tagctattgttggtagttaccc

SEQ ID NO: 9485525 - DNA, 22 bp, Homo sapiens
tagctatttggaaaattccaat

SEQ ID NO: 9485526 - DNA, 22 bp, Homo sapiens
tagctatttggaaaattccaat

SEQ ID NO: 9485527 - DNA, 22 bp, Homo sapiens
tagctattttgcttggaaatac

SEQ ID NO: 9485528 - DNA, 22 bp, Homo sapiens
taggaacagtcctagaaatctg

SEQ ID NO: 9485529 - DNA, 22 bp, Homo sapiens
taggaacagtcctagaaatctg

SEQ ID NO: 9485530 - DNA, 22 bp, Homo sapiens
taggaacacagggacttgatga

SEQ ID NO: 9485531 - DNA, 22 bp, Homo sapiens
taggaacacacatgtgtagctg

SEQ ID NO: 9485532 - DNA, 22 bp, Homo sapiens
taggaacacagggacttgatga

SEQ ID NO: 9485533 - DNA, 22 bp, Homo sapiens
taggaacaactgcaggtacaag

SEQ ID NO: 9485534 - DNA, 22 bp, Homo sapiens
taggaacaactgcaggtacaag

SEQ ID NO: 9485535 - DNA, 22 bp, Homo sapiens
taggaacaagtttccttgctgt

SEQ ID NO: 9485536 - DNA, 22 bp, Homo sapiens
taggaacaagtttccttgctgt

SEQ ID NO: 9485537 - DNA, 22 bp, Homo sapiens
taggaacatatgcagtgctttt

SEQ ID NO: 9485538 - DNA, 22 bp, Homo sapiens
taggaacatgcccttaccttcc

SEQ ID NO: 9485539 - DNA, 22 bp, Homo sapiens
taggaacacatcctcctctagc

SEQ ID NO: 9485540 - DNA, 22 bp, Homo sapiens
taggaacagtcctagaaatctg

SEQ ID NO: 9485541 - DNA, 22 bp, Homo sapiens
taggaacagtttcaggatgttt

SEQ ID NO: 9485542 - DNA, 18 bp, Homo sapiens
taggaacattgattggag

SEQ ID NO: 9485543 - DNA, 22 bp, Homo sapiens
taggaaattggaaactcttcac

SEQ ID NO: 9485544 - DNA, 22 bp, Homo sapiens
taggaaattggaaactcttcac

SEQ ID NO: 9485545 - DNA, 22 bp, Homo sapiens
taggaaattggaaactcttcac

SEQ ID NO: 9485546 - DNA, 22 bp, Homo sapiens
taggaaattggaaactcttcac

SEQ ID NO: 9485547 - DNA, 22 bp, Homo sapiens
taggaaattggaaactcttcac

SEQ ID NO: 9485548 - DNA, 22 bp, Homo sapiens
taggaaatttatagaggtgttt

SEQ ID NO: 9485549 - DNA, 22 bp, Homo sapiens
taggaaatttatagaggtgttt

SEQ ID NO: 9485550 - DNA, 22 bp, Homo sapiens
taggaaatttcatttgaggtct

SEQ ID NO: 9485551 - DNA, 22 bp, Homo sapiens
taggaaatttcatttgaggtct

SEQ ID NO: 9485552 - DNA, 22 bp, Homo sapiens
taggaaatttgaaatatgtggg

SEQ ID NO: 9485553 - DNA, 22 bp, Homo sapiens
taggaacaaagagcctcacatt

SEQ ID NO: 9485554 - DNA, 22 bp, Homo sapiens
taggaacaaaaggttttcctga

SEQ ID NO: 9485555 - DNA, 22 bp, Homo sapiens
taggaacaaagagcctcacatt

SEQ ID NO: 9485556 - DNA, 22 bp, Homo sapiens
taggaaattttactggtctggg

SEQ ID NO: 9485557 - DNA, 22 bp, Homo sapiens
taggaaattttactggtctggg

SEQ ID NO: 9485558 - DNA, 22 bp, Homo sapiens
taggaaatttgaaatatgtggg

SEQ ID NO: 9485559 - DNA, 22 bp, Homo sapiens
taggaaatttgaaatatgtggg

SEQ ID NO: 9485560 - DNA, 22 bp, Homo sapiens
taggaaatttgaaatatgtggg

SEQ ID NO: 9485561 - DNA, 22 bp, Homo sapiens
taggaaattttactggtctggg

SEQ ID NO: 9485562 - DNA, 22 bp, Homo sapiens
cagggcaggaatttgacattgc

SEQ ID NO: 9485563 - DNA, 22 bp, Homo sapiens
cagggcaggaatttgacattgc

SEQ ID NO: 9485564 - DNA, 22 bp, Homo sapiens
cagggcaggaatttgacattgc

SEQ ID NO: 9485565 - DNA, 22 bp, Homo sapiens
cagggcagcttcctttgttagg

SEQ ID NO: 9485566 - DNA, 22 bp, Homo sapiens
cagggcaggaatttgacattgc

SEQ ID NO: 9485567 - DNA, 22 bp, Homo sapiens
cagggcaggaatttgacattgc

SEQ ID NO: 9485568 - DNA, 22 bp, Homo sapiens
tagctttaagatgagatgtgga

SEQ ID NO: 9485569 - DNA, 22 bp, Homo sapiens
taggaaattaagtctcttttgt

SEQ ID NO: 9485570 - DNA, 22 bp, Homo sapiens
taggaaattaagtctcttttgt

SEQ ID NO: 9485571 - DNA, 22 bp, Homo sapiens
taggaaatggctcagttactgc

SEQ ID NO: 9485572 - DNA, 22 bp, Homo sapiens
tagctttaataagctgctgaat

SEQ ID NO: 9485573 - DNA, 22 bp, Homo sapiens
taggaaattagaacttggaaac

SEQ ID NO: 9485574 - DNA, 22 bp, Homo sapiens
taggaaattaagtctcttttgt

SEQ ID NO: 9485575 - DNA, 22 bp, Homo sapiens
taggaaattagaacttggaaac

SEQ ID NO: 9485576 - DNA, 22 bp, Homo sapiens
taggaaattctcttgctaagtt

SEQ ID NO: 9485577 - DNA, 22 bp, Homo sapiens
taggaaattctcttgctaagtt

SEQ ID NO: 9485578 - DNA, 22 bp, Homo sapiens
taggaaattctcttgctaagtt

SEQ ID NO: 9485579 - DNA, 22 bp, Homo sapiens
taggaaattgacacctgcttga

SEQ ID NO: 9485580 - DNA, 22 bp, Homo sapiens
taggaaattgccaatatatgac

SEQ ID NO: 9485581 - DNA, 22 bp, Homo sapiens
taggaaattgccaatatatgac

SEQ ID NO: 9485582 - DNA, 22 bp, Homo sapiens
taggaaattgccaatatatgac

SEQ ID NO: 9485583 - DNA, 22 bp, Homo sapiens
taggaaattgacacctgcttga

SEQ ID NO: 9485584 - DNA, 22 bp, Homo sapiens
taggaaattgacacctgcttga

SEQ ID NO: 9485585 - DNA, 22 bp, Homo sapiens
taggaaattgacacctgcttga

SEQ ID NO: 9485586 - DNA, 22 bp, Homo sapiens
taggaaattgccaatatatgac

SEQ ID NO: 9485587 - DNA, 22 bp, Homo sapiens
cctccctgcgctcctgcggcgg

SEQ ID NO: 9485588 - DNA, 22 bp, Homo sapiens
cctccctgctcctcaactggca

SEQ ID NO: 9485589 - DNA, 22 bp, Homo sapiens
tggctctcagctcccagcagcc

SEQ ID NO: 9485590 - DNA, 22 bp, Homo sapiens
tggctctcagctcccagcagcc

SEQ ID NO: 9485591 - DNA, 22 bp, Homo sapiens
cctccctgcgctcctgcggcgg

SEQ ID NO: 9485592 - DNA, 22 bp, Homo sapiens
cctccctgcgctcctgcggcgg

SEQ ID NO: 9485593 - DNA, 22 bp, Homo sapiens
cctccctgcgctcctgcggcgg

SEQ ID NO: 9485594 - DNA, 22 bp, Homo sapiens
cctccctctttcagtcccacag

SEQ ID NO: 9485595 - DNA, 22 bp, Homo sapiens
cctccctgccggctggactagt

SEQ ID NO: 9485596 - DNA, 22 bp, Homo sapiens
cctccctgcgctcctgcggcgg

SEQ ID NO: 9485597 - DNA, 20 bp, Homo sapiens
tggctctctctagtaagtgg

SEQ ID NO: 9485598 - DNA, 23 bp, Homo sapiens
tggctctctcagtgctgcagagg

SEQ ID NO: 9485599 - DNA, 22 bp, Homo sapiens
tggctctctacaggtcaagacc

SEQ ID NO: 9485600 - DNA, 22 bp, Homo sapiens
tggctctcccaatacctttctg

SEQ ID NO: 9485601 - DNA, 22 bp, Homo sapiens
tggctctctacaggtcaagacc

SEQ ID NO: 9485602 - DNA, 22 bp, Homo sapiens
tggctctcaggcctgctgcgtt

SEQ ID NO: 9485603 - DNA, 22 bp, Homo sapiens
tggctctcaggcctgctgcgtt

SEQ ID NO: 9485604 - DNA, 22 bp, Homo sapiens
tggctctcagctcccagcagcc

SEQ ID NO: 9485605 - DNA, 22 bp, Homo sapiens
tggctctccagctctaaggcct

SEQ ID NO: 9485606 - DNA, 22 bp, Homo sapiens
tggctctccagagcctatggta

SEQ ID NO: 9485607 - DNA, 22 bp, Homo sapiens
tggctctccagagcctatggta

SEQ ID NO: 9485608 - DNA, 22 bp, Homo sapiens
tggctctccagagcctatggta

SEQ ID NO: 9485609 - DNA, 22 bp, Homo sapiens
tggctctcaggcctgctgcgtt

SEQ ID NO: 9485610 - DNA, 22 bp, Homo sapiens
tggctctcttgtaaggtagtag

SEQ ID NO: 9485611 - DNA, 22 bp, Homo sapiens
tggctctcttgtaaggtagtag

SEQ ID NO: 9485612 - DNA, 22 bp, Homo sapiens
tggctctctgggaggtcctggc

SEQ ID NO: 9485613 - DNA, 22 bp, Homo sapiens
tggctctcttgtaaggtagtag

SEQ ID NO: 9485614 - DNA, 22 bp, Homo sapiens
tggctctctgggaggtcctggc

SEQ ID NO: 9485615 - DNA, 22 bp, Homo sapiens
tggctctctgggaggtcctggc

SEQ ID NO: 9485616 - DNA, 20 bp, Homo sapiens
tggctctctctagtaagtgg

SEQ ID NO: 9485617 - DNA, 21 bp, Homo sapiens
tggctctgaaagagtgctgca

SEQ ID NO: 9485618 - DNA, 21 bp, Homo sapiens
tggctctgaaagagtgctgca

SEQ ID NO: 9485619 - DNA, 21 bp, Homo sapiens
tggctctgaaagagtgctgca

SEQ ID NO: 9485620 - DNA, 22 bp, Homo sapiens
tgggagcaggaagcaggaagta

SEQ ID NO: 9485621 - DNA, 22 bp, Homo sapiens
tgggagcaggtgtgctagggaa

SEQ ID NO: 9485622 - DNA, 22 bp, Homo sapiens
tgggagcaggtgtgctagggaa

SEQ ID NO: 9485623 - DNA, 22 bp, Homo sapiens
tggctctgaccaggtagaggag

SEQ ID NO: 9485624 - DNA, 22 bp, Homo sapiens
cctctggcaacttcacagccca

SEQ ID NO: 9485625 - DNA, 22 bp, Homo sapiens
cctctggcaacttcacagccca

SEQ ID NO: 9485626 - DNA, 22 bp, Homo sapiens
cctctggagtcagaccagcttg

SEQ ID NO: 9485627 - DNA, 22 bp, Homo sapiens
cctctggatctttctccacact

SEQ ID NO: 9485628 - DNA, 22 bp, Homo sapiens
tgggagctcagaaagggaggtc

SEQ ID NO: 9485629 - DNA, 23 bp, Homo sapiens
tgggagctcaagggaggctgccc

SEQ ID NO: 9485630 - DNA, 22 bp, Homo sapiens
tgggagctcacaggcctggctc

SEQ ID NO: 9485631 - DNA, 22 bp, Homo sapiens
cctctggcagccagccagttgt

SEQ ID NO: 9485632 - DNA, 22 bp, Homo sapiens
cctctggcagccagccagttgt

SEQ ID NO: 9485633 - DNA, 22 bp, Homo sapiens
cctctggccacatgggacatag

SEQ ID NO: 9485634 - DNA, 22 bp, Homo sapiens
cctctggcatagcaagtggcct

SEQ ID NO: 9485635 - DNA, 22 bp, Homo sapiens
cctctggcatagcaagtggcct

SEQ ID NO: 9485636 - DNA, 16 bp, Homo sapiens
cctctggcaattagat

SEQ ID NO: 9485637 - DNA, 16 bp, Homo sapiens
cctctggcaattagat

SEQ ID NO: 9485638 - DNA, 22 bp, Homo sapiens
cctctggcaacttcacagccca

SEQ ID NO: 9485639 - DNA, 22 bp, Homo sapiens
cctctggcaacttcacagccca

SEQ ID NO: 9485640 - DNA, 22 bp, Homo sapiens
cctctggcaagtgatttatcat

SEQ ID NO: 9485641 - DNA, 22 bp, Homo sapiens
tgggagcagttgtgaagctcag

SEQ ID NO: 9485642 - DNA, 22 bp, Homo sapiens
tgggagcagttcaggtgtggct

SEQ ID NO: 9485643 - DNA, 22 bp, Homo sapiens
tgggagcagttcaggtgtggct

SEQ ID NO: 9485644 - DNA, 22 bp, Homo sapiens
tgggagcaggtgtgctagggaa

SEQ ID NO: 9485645 - DNA, 22 bp, Homo sapiens
tgggagcaggtgtgctagggaa

SEQ ID NO: 9485646 - DNA, 22 bp, Homo sapiens
tgggagccattttagaggctgc

SEQ ID NO: 9485647 - DNA, 22 bp, Homo sapiens
tgggagcccaagggagctgccg

SEQ ID NO: 9485648 - DNA, 22 bp, Homo sapiens
tgggagcccaagggagctgccg

SEQ ID NO: 9485649 - DNA, 22 bp, Homo sapiens
tgggagcccaagggagctgccg

SEQ ID NO: 9485650 - DNA, 22 bp, Homo sapiens
tgggagccattttagaggctgc

SEQ ID NO: 9485651 - DNA, 22 bp, Homo sapiens
tgggagccattttagaggctgc

SEQ ID NO: 9485652 - DNA, 22 bp, Homo sapiens
tgggagccattttagaggctgc

SEQ ID NO: 9485653 - DNA, 23 bp, Homo sapiens
tgggagctcaagggaggctgccc

SEQ ID NO: 9485654 - DNA, 22 bp, Homo sapiens
tgggagctaattactccggttg

SEQ ID NO: 9485655 - DNA, 22 bp, Homo sapiens
tgggagcctggcaggccagagg

SEQ ID NO: 9485656 - DNA, 22 bp, Homo sapiens
cctctttgtgcctgcaggctgc

SEQ ID NO: 9485657 - DNA, 22 bp, Homo sapiens
cctctttgttcaggctgctggc

SEQ ID NO: 9485658 - DNA, 22 bp, Homo sapiens
cctctttgactctcaggtcttt

SEQ ID NO: 9485659 - DNA, 22 bp, Homo sapiens
cctctttgagattcagttttcc

SEQ ID NO: 9485660 - DNA, 22 bp, Homo sapiens
cctgaagcacccggagctggca

SEQ ID NO: 9485661 - DNA, 22 bp, Homo sapiens
cctgaagcacaaaagcacagct

SEQ ID NO: 9485662 - DNA, 22 bp, Homo sapiens
cctgaagcacaaaagcacagct

SEQ ID NO: 9485663 - DNA, 22 bp, Homo sapiens
cctgaatactggtgctgaaagt

SEQ ID NO: 9485664 - DNA, 22 bp, Homo sapiens
cctgaataatttgtgaaaagat

SEQ ID NO: 9485665 - DNA, 23 bp, Homo sapiens
cctgaagggtcagggtcctcagc

SEQ ID NO: 9485666 - DNA, 22 bp, Homo sapiens
cctgaagggactccagagagca

SEQ ID NO: 9485667 - DNA, 22 bp, Homo sapiens
cctgaataggctctgctcaaaa

SEQ ID NO: 9485668 - DNA, 22 bp, Homo sapiens
cctgaatgcctgacatttcact

SEQ ID NO: 9485669 - DNA, 22 bp, Homo sapiens
cctgaagggactccagagagca

SEQ ID NO: 9485670 - DNA, 18 bp, Homo sapiens
cctgaagcctgtgtcttt

SEQ ID NO: 9485671 - DNA, 22 bp, Homo sapiens
cctgaagctcttaagaccttta

SEQ ID NO: 9485672 - DNA, 22 bp, Homo sapiens
cctcttgattggttggaagcgg

SEQ ID NO: 9485673 - DNA, 22 bp, Homo sapiens
cctcttgattggttggaagcgg

SEQ ID NO: 9485674 - DNA, 22 bp, Homo sapiens
cctcttgccaatcagctacaga

SEQ ID NO: 9485675 - DNA, 22 bp, Homo sapiens
cctctttgactatagtagttaa

SEQ ID NO: 9485676 - DNA, 22 bp, Homo sapiens
cctctttgacaagtacctgccc

SEQ ID NO: 9485677 - DNA, 22 bp, Homo sapiens
cctcttgaatgccaggaaggac

SEQ ID NO: 9485678 - DNA, 22 bp, Homo sapiens
cctcttgaacctaggcaagact

SEQ ID NO: 9485679 - DNA, 22 bp, Homo sapiens
cctcttctgcttcaggagcact

SEQ ID NO: 9485680 - DNA, 22 bp, Homo sapiens
cctcttctgcttcaggagcact

SEQ ID NO: 9485681 - DNA, 22 bp, Homo sapiens
cctcttctgagtgagactccct

SEQ ID NO: 9485682 - DNA, 22 bp, Homo sapiens
cctctggcctaggccgggagag

SEQ ID NO: 9485683 - DNA, 22 bp, Homo sapiens
cctctggcctaggccgggagag

SEQ ID NO: 9485684 - DNA, 22 bp, Homo sapiens
cctctggccatcccccattaag

SEQ ID NO: 9485685 - DNA, 22 bp, Homo sapiens
cctctggccattctttgatgga

SEQ ID NO: 9485686 - DNA, 22 bp, Homo sapiens
cctctggccattctttgatgga

SEQ ID NO: 9485687 - DNA, 22 bp, Homo sapiens
cctctggccagagaaaggccag

SEQ ID NO: 9485688 - DNA, 22 bp, Homo sapiens
cctctggccatcccccattaag

SEQ ID NO: 9485689 - DNA, 22 bp, Homo sapiens
cctctggccagagaaaggccag

SEQ ID NO: 9485690 - DNA, 22 bp, Homo sapiens
cctctggccacatgggacatag

SEQ ID NO: 9485691 - DNA, 22 bp, Homo sapiens
cctctggccacatgggacatag

SEQ ID NO: 9485692 - DNA, 22 bp, Homo sapiens
tgggccacgtgacccttaccct

SEQ ID NO: 9485693 - DNA, 22 bp, Homo sapiens
tgggccactcttccctgggtct

SEQ ID NO: 9485694 - DNA, 22 bp, Homo sapiens
tgggccagagagtaagaaaggt

SEQ ID NO: 9485695 - DNA, 22 bp, Homo sapiens
tgggccagagagtaagaaaggt

SEQ ID NO: 9485696 - DNA, 22 bp, Homo sapiens
tgggccagaggcatggagctat

SEQ ID NO: 9485697 - DNA, 22 bp, Homo sapiens
tgggccagaggcatggagctat

SEQ ID NO: 9485698 - DNA, 22 bp, Homo sapiens
tgggccagaggcatggagctat

SEQ ID NO: 9485699 - DNA, 22 bp, Homo sapiens
tgggccagaagtatgcatgttt

SEQ ID NO: 9485700 - DNA, 22 bp, Homo sapiens
tgggccagaagtatgcatgttt

SEQ ID NO: 9485701 - DNA, 22 bp, Homo sapiens
tgggccagaagtatgcatgttt

SEQ ID NO: 9485702 - DNA, 22 bp, Homo sapiens
tgggccacttgaaagtggatgt

SEQ ID NO: 9485703 - DNA, 22 bp, Homo sapiens
tgggccagaagtatgcatgttt

SEQ ID NO: 9485704 - DNA, 22 bp, Homo sapiens
tgggccagatccatggcaataa

SEQ ID NO: 9485705 - DNA, 22 bp, Homo sapiens
tgggccagatccatggcaataa

SEQ ID NO: 9485706 - DNA, 22 bp, Homo sapiens
tgggccagaggcatggagctat

SEQ ID NO: 9485707 - DNA, 22 bp, Homo sapiens
tgggccagcaattgctgctcag

SEQ ID NO: 9485708 - DNA, 21 bp, Homo sapiens
tgggccagatctgagtttcta

SEQ ID NO: 9485709 - DNA, 21 bp, Homo sapiens
tgggccagatctgagtttcta

SEQ ID NO: 9485710 - DNA, 21 bp, Homo sapiens
tgggccagatctgagtttcta

SEQ ID NO: 9485711 - DNA, 22 bp, Homo sapiens
tgggggtggttcttgcctccag

SEQ ID NO: 9485712 - DNA, 21 bp, Homo sapiens
tgggggagaattggttgcttt

SEQ ID NO: 9485713 - DNA, 22 bp, Homo sapiens
tgggggagagaggcattctttc

SEQ ID NO: 9485714 - DNA, 22 bp, Homo sapiens
cctgaggtcatggtccagtgtt

SEQ ID NO: 9485715 - DNA, 22 bp, Homo sapiens
cctgagggtcaaggagccctag

SEQ ID NO: 9485716 - DNA, 21 bp, Homo sapiens
cctgagggtggttgtgaagat

SEQ ID NO: 9485717 - DNA, 22 bp, Homo sapiens
cctgagggtcaaggagccctag

SEQ ID NO: 9485718 - DNA, 21 bp, Homo sapiens
cctgagggtggttgtgaagat

SEQ ID NO: 9485719 - DNA, 22 bp, Homo sapiens
cctgaggtcacaacttgcttat

SEQ ID NO: 9485720 - DNA, 22 bp, Homo sapiens
tggggtcccaactctgattgat

SEQ ID NO: 9485721 - DNA, 19 bp, Homo sapiens
tggggtcaagagaggcttc

SEQ ID NO: 9485722 - DNA, 19 bp, Homo sapiens
tggggtcaagagaggcttc

SEQ ID NO: 9485723 - DNA, 22 bp, Homo sapiens
tggggtaggtatgaaaactagg

SEQ ID NO: 9485724 - DNA, 22 bp, Homo sapiens
tggggtagggaaaagaagtcga

SEQ ID NO: 9485725 - DNA, 22 bp, Homo sapiens
tggggtaggagtcagcgagaga

SEQ ID NO: 9485726 - DNA, 22 bp, Homo sapiens
tgggggtgtcctggtgcacaca

SEQ ID NO: 9485727 - DNA, 22 bp, Homo sapiens
tgggggtgtgccagggacctcc

SEQ ID NO: 9485728 - DNA, 17 bp, Homo sapiens
tggggtccccgatggtg

SEQ ID NO: 9485729 - DNA, 22 bp, Homo sapiens
cctgatggctgtctgggcctga

SEQ ID NO: 9485730 - DNA, 22 bp, Homo sapiens
cctgcaagacctgagacacacc

SEQ ID NO: 9485731 - DNA, 22 bp, Homo sapiens
cctgcacatgtgtgcgcctgta

SEQ ID NO: 9485732 - DNA, 22 bp, Homo sapiens
cctgcacaggccaggcatctga

SEQ ID NO: 9485733 - DNA, 22 bp, Homo sapiens
cctgcaccaggcccagcatggt

SEQ ID NO: 9485734 - DNA, 22 bp, Homo sapiens
cctgcacctgagcagcctgact

SEQ ID NO: 9485735 - DNA, 22 bp, Homo sapiens
cctgcacctgccatgtgagata

SEQ ID NO: 9485736 - DNA, 22 bp, Homo sapiens
cctgcacccaggccgcacctct

SEQ ID NO: 9485737 - DNA, 22 bp, Homo sapiens
cctgcagaagagtccagctcat

SEQ ID NO: 9485738 - DNA, 22 bp, Homo sapiens
cctgcagaaagggtccccagga

SEQ ID NO: 9485739 - DNA, 22 bp, Homo sapiens
cctgcacttctcacagctgctg

SEQ ID NO: 9485740 - DNA, 22 bp, Homo sapiens
cctgcacttctcacagctgctg

SEQ ID NO: 9485741 - DNA, 22 bp, Homo sapiens
cctgcagaagagtccagctcat

SEQ ID NO: 9485742 - DNA, 22 bp, Homo sapiens
cctgccaggagctggtgctgca

SEQ ID NO: 9485743 - DNA, 22 bp, Homo sapiens
cctgccaggagctggtgctgca

SEQ ID NO: 9485744 - DNA, 22 bp, Homo sapiens
cctgagaaacctggtgcaatta

SEQ ID NO: 9485745 - DNA, 22 bp, Homo sapiens
cctgactagctgggactacaga

SEQ ID NO: 9485746 - DNA, 22 bp, Homo sapiens
cctgacgaaaggcgtgctggag

SEQ ID NO: 9485747 - DNA, 22 bp, Homo sapiens
cctgaccttcaagtctgttctt

SEQ ID NO: 9485748 - DNA, 22 bp, Homo sapiens
cctgacctccaagtggctctgg

SEQ ID NO: 9485749 - DNA, 22 bp, Homo sapiens
cctgacctccaagtggctctgg

SEQ ID NO: 9485750 - DNA, 22 bp, Homo sapiens
cctgaccttagtttccttgtga

SEQ ID NO: 9485751 - DNA, 22 bp, Homo sapiens
cctgagaaatagcatcattttt

SEQ ID NO: 9485752 - DNA, 22 bp, Homo sapiens
cctgagaaatagcatcattttt

SEQ ID NO: 9485753 - DNA, 22 bp, Homo sapiens
cctgagaagactgtttctttga

SEQ ID NO: 9485754 - DNA, 22 bp, Homo sapiens
cctgagaagagcttatgagtga

SEQ ID NO: 9485755 - DNA, 22 bp, Homo sapiens
cctgagaataattctccatagc

SEQ ID NO: 9485756 - DNA, 22 bp, Homo sapiens
cctgagaataacaaattgctgc

SEQ ID NO: 9485757 - DNA, 22 bp, Homo sapiens
cctgagaagctggacctggcag

SEQ ID NO: 9485758 - DNA, 22 bp, Homo sapiens
cctgagaagctggacctggcag

SEQ ID NO: 9485759 - DNA, 22 bp, Homo sapiens
cctgagacatgaaccaggctcc

SEQ ID NO: 9485760 - DNA, 22 bp, Homo sapiens
cctgagaccaagttgcagccat

SEQ ID NO: 9485761 - DNA, 22 bp, Homo sapiens
cctgagaatttgtggttcagga

SEQ ID NO: 9485762 - DNA, 22 bp, Homo sapiens
cctgagaataattctccatagc

SEQ ID NO: 9485763 - DNA, 22 bp, Homo sapiens
cctgagaatgtttaacagagaa

SEQ ID NO: 9485764 - DNA, 19 bp, Homo sapiens
cctgaccacacaggccttg

SEQ ID NO: 9485765 - DNA, 22 bp, Homo sapiens
cctgacagttaattgtcctgta

SEQ ID NO: 9485766 - DNA, 22 bp, Homo sapiens
cctgacagtccttttctagtgt

SEQ ID NO: 9485767 - DNA, 22 bp, Homo sapiens
cctgaatggtctccaaatagat

SEQ ID NO: 9485768 - DNA, 22 bp, Homo sapiens
cctgacagcgtgtccctggccc

SEQ ID NO: 9485769 - DNA, 22 bp, Homo sapiens
cctgaccatttgccacatgggt

SEQ ID NO: 9485770 - DNA, 22 bp, Homo sapiens
cctgaccagagtgagggcttag

SEQ ID NO: 9485771 - DNA, 22 bp, Homo sapiens
cctgaccacccttggacaaggt

SEQ ID NO: 9485772 - DNA, 19 bp, Homo sapiens
cctgaccacacaggccttg

SEQ ID NO: 9485773 - DNA, 22 bp, Homo sapiens
cctgacctatttttctcagctg

SEQ ID NO: 9485774 - DNA, 22 bp, Homo sapiens
cctgaggggctgcaggccagct

SEQ ID NO: 9485775 - DNA, 22 bp, Homo sapiens
cctgaggggctgcaggccagct

SEQ ID NO: 9485776 - DNA, 22 bp, Homo sapiens
cctgaggggaagcttcccaaga

SEQ ID NO: 9485777 - DNA, 22 bp, Homo sapiens
cctgaggggctgcaggccagct

SEQ ID NO: 9485778 - DNA, 22 bp, Homo sapiens
cctgaggggctgcaggccagct

SEQ ID NO: 9485779 - DNA, 22 bp, Homo sapiens
cctgagggatctgtggaatagc

SEQ ID NO: 9485780 - DNA, 22 bp, Homo sapiens
cctgagggcgccgagctcccag

SEQ ID NO: 9485781 - DNA, 22 bp, Homo sapiens
cctgagggcgccgagctcccag

SEQ ID NO: 9485782 - DNA, 22 bp, Homo sapiens
cctgagggcgtaattaacagtg

SEQ ID NO: 9485783 - DNA, 22 bp, Homo sapiens
cctgagggctcagcccccagcc

SEQ ID NO: 9485784 - DNA, 22 bp, Homo sapiens
cctgaggcttaatctgtcccaa

SEQ ID NO: 9485785 - DNA, 22 bp, Homo sapiens
cctgaggcttaatctgtcccaa

SEQ ID NO: 9485786 - DNA, 22 bp, Homo sapiens
cctgaggcttaatctgtcccaa

SEQ ID NO: 9485787 - DNA, 22 bp, Homo sapiens
cctgaggcttaatctgtcccaa

SEQ ID NO: 9485788 - DNA, 22 bp, Homo sapiens
cctgaggcttgggagttccgcc

SEQ ID NO: 9485789 - DNA, 22 bp, Homo sapiens
cctgagggaaggatgctaccca

SEQ ID NO: 9485790 - DNA, 22 bp, Homo sapiens
cctgagggagggtataggctgt

SEQ ID NO: 9485791 - DNA, 22 bp, Homo sapiens
cctgaggcttgggagttccgcc

SEQ ID NO: 9485792 - DNA, 22 bp, Homo sapiens
cctgagggaacatgcacccaat

SEQ ID NO: 9485793 - DNA, 22 bp, Homo sapiens
cctgagggaacatgcacccaat

SEQ ID NO: 9485794 - DNA, 22 bp, Homo sapiens
cctgaggctctcctgaataatg

SEQ ID NO: 9485795 - DNA, 22 bp, Homo sapiens
cctgaggctcgcgcgcccctgg

SEQ ID NO: 9485796 - DNA, 22 bp, Homo sapiens
cctgaggctcgcgcgcccctgg

SEQ ID NO: 9485797 - DNA, 22 bp, Homo sapiens
cctgaggctcgcgcgcccctgg

SEQ ID NO: 9485798 - DNA, 22 bp, Homo sapiens
cctgaggctccacctccagaga

SEQ ID NO: 9485799 - DNA, 22 bp, Homo sapiens
cctgaggctccacctccagaga

SEQ ID NO: 9485800 - DNA, 22 bp, Homo sapiens
cctgaggctctcctgaataatg

SEQ ID NO: 9485801 - DNA, 22 bp, Homo sapiens
cctgaggctggcccttccatcc

SEQ ID NO: 9485802 - DNA, 22 bp, Homo sapiens
cctgaggctggcccttccatcc

SEQ ID NO: 9485803 - DNA, 22 bp, Homo sapiens
cctgaggctggcccttccatcc

SEQ ID NO: 9485804 - DNA, 22 bp, Homo sapiens
cctgaggctccacctccagaga

SEQ ID NO: 9485805 - DNA, 22 bp, Homo sapiens
cctgaggctccacctccagaga

SEQ ID NO: 9485806 - DNA, 22 bp, Homo sapiens
cctgaggctccacctccagaga

SEQ ID NO: 9485807 - DNA, 22 bp, Homo sapiens
cctgaggctccacctccagaga

SEQ ID NO: 9485808 - DNA, 22 bp, Homo sapiens
cctgaggccctggctgtgctga

SEQ ID NO: 9485809 - DNA, 22 bp, Homo sapiens
cctgaggccctggctgtgctga

SEQ ID NO: 9485810 - DNA, 22 bp, Homo sapiens
cctgaggccctggctgtgctga

SEQ ID NO: 9485811 - DNA, 22 bp, Homo sapiens
cctgagctggcagtgacctgga

SEQ ID NO: 9485812 - DNA, 22 bp, Homo sapiens
cctgagcttgatccttctgtct

SEQ ID NO: 9485813 - DNA, 22 bp, Homo sapiens
cctgagcttgatccttctgtct

SEQ ID NO: 9485814 - DNA, 22 bp, Homo sapiens
cctgagcttgatccttctgtct

SEQ ID NO: 9485815 - DNA, 22 bp, Homo sapiens
cctgctgttagatttcagtcac

SEQ ID NO: 9485816 - DNA, 22 bp, Homo sapiens
cctgctgtgtccctggctttct

SEQ ID NO: 9485817 - DNA, 20 bp, Homo sapiens
cctgctgtgctttccatgga

SEQ ID NO: 9485818 - DNA, 22 bp, Homo sapiens
cctgctgttttcttcacttcag

SEQ ID NO: 9485819 - DNA, 22 bp, Homo sapiens
cctgcttaacattgccatgaca

SEQ ID NO: 9485820 - DNA, 22 bp, Homo sapiens
cctgcttaacattgccatgaca

SEQ ID NO: 9485821 - DNA, 22 bp, Homo sapiens
tgtaaagaaatagcatttgtag

SEQ ID NO: 9485822 - DNA, 22 bp, Homo sapiens
tgtaaagacagataaaacagca

SEQ ID NO: 9485823 - DNA, 22 bp, Homo sapiens
tgtaaagagaagaaacgtgagc

SEQ ID NO: 9485824 - DNA, 21 bp, Homo sapiens
tgtaagtttcatctgaattgg

SEQ ID NO: 9485825 - DNA, 21 bp, Homo sapiens
tgtaagtttcatctgaattgg

SEQ ID NO: 9485826 - DNA, 21 bp, Homo sapiens
tgtaagtttcatctgaattgg

SEQ ID NO: 9485827 - DNA, 22 bp, Homo sapiens
tgtaagtagtaatggaaggaca

SEQ ID NO: 9485828 - DNA, 22 bp, Homo sapiens
tgtaagtctggcttatagcttt

SEQ ID NO: 9485829 - DNA, 22 bp, Homo sapiens
tgtaatcattacagtacatgga

SEQ ID NO: 9485830 - DNA, 22 bp, Homo sapiens
tgtaatcatgcatcagttagtt

SEQ ID NO: 9485831 - DNA, 22 bp, Homo sapiens
tgtaatattgtagtgacagtac

SEQ ID NO: 9485832 - DNA, 22 bp, Homo sapiens
tgtaatgatgtacttagaagga

SEQ ID NO: 9485833 - DNA, 22 bp, Homo sapiens
tgtaatgagaaagagagtgaat

SEQ ID NO: 9485834 - DNA, 21 bp, Homo sapiens
tgtaatctaaagaagctcttt

SEQ ID NO: 9485835 - DNA, 21 bp, Homo sapiens
tgtaatctaaagaagctcttt

SEQ ID NO: 9485836 - DNA, 22 bp, Homo sapiens
tgtaccaaaaatgtgtcagact

SEQ ID NO: 9485837 - DNA, 22 bp, Homo sapiens
cctggagcactctccctggctg

SEQ ID NO: 9485838 - DNA, 22 bp, Homo sapiens
cctggagcactctccctggctg

SEQ ID NO: 9485839 - DNA, 22 bp, Homo sapiens
cctggagcacatggcaggaggc

SEQ ID NO: 9485840 - DNA, 22 bp, Homo sapiens
tgtacatttagagctcaataga

SEQ ID NO: 9485841 - DNA, 22 bp, Homo sapiens
tgtacatttagagctcaataga

SEQ ID NO: 9485842 - DNA, 22 bp, Homo sapiens
tgtacatagaaaggatacagct

SEQ ID NO: 9485843 - DNA, 22 bp, Homo sapiens
tgtacatattcaagcacttcta

SEQ ID NO: 9485844 - DNA, 19 bp, Homo sapiens
tgtacatatagagctcagt

SEQ ID NO: 9485845 - DNA, 22 bp, Homo sapiens
tgtacatacatagatatacaca

SEQ ID NO: 9485846 - DNA, 22 bp, Homo sapiens
tgtacatacatagatatacaca

SEQ ID NO: 9485847 - DNA, 18 bp, Homo sapiens
tgtacagttatgagcatt

SEQ ID NO: 9485848 - DNA, 23 bp, Homo sapiens
tgtacagttgtttgactcagctc

SEQ ID NO: 9485849 - DNA, 22 bp, Homo sapiens
tgtacagtgccatgcagtttgc

SEQ ID NO: 9485850 - DNA, 22 bp, Homo sapiens
tgtacagtgtagtcatgaggtt

SEQ ID NO: 9485851 - DNA, 22 bp, Homo sapiens
tgtaattaaactgaagacagaa

SEQ ID NO: 9485852 - DNA, 22 bp, Homo sapiens
tgtaatttcctgatgttagaac

SEQ ID NO: 9485853 - DNA, 22 bp, Homo sapiens
tgtaatttcctgatgttagaac

SEQ ID NO: 9485854 - DNA, 22 bp, Homo sapiens
tgtcaaatttttattgcagtat

SEQ ID NO: 9485855 - DNA, 22 bp, Homo sapiens
tgtcaaattatgtaatgggaag

SEQ ID NO: 9485856 - DNA, 22 bp, Homo sapiens
tgtcaaatagtagaaagatggc

SEQ ID NO: 9485857 - DNA, 22 bp, Homo sapiens
tgtcaaatagtagaaagatggc

SEQ ID NO: 9485858 - DNA, 22 bp, Homo sapiens
tgtcaaatttttattgcagtat

SEQ ID NO: 9485859 - DNA, 22 bp, Homo sapiens
tgtattcatgtgagcctaggaa

SEQ ID NO: 9485860 - DNA, 22 bp, Homo sapiens
tgtattcagtgatttcacaata

SEQ ID NO: 9485861 - DNA, 22 bp, Homo sapiens
tgtattcagtgcctagcatatg

SEQ ID NO: 9485862 - DNA, 22 bp, Homo sapiens
tgtattcagtgcctagcatatg

SEQ ID NO: 9485863 - DNA, 16 bp, Homo sapiens
cctggaggtcacttca

SEQ ID NO: 9485864 - DNA, 18 bp, Homo sapiens
cctggaggtcttcggggt

SEQ ID NO: 9485865 - DNA, 22 bp, Homo sapiens
cctggaggggaccaggaccagg

SEQ ID NO: 9485866 - DNA, 22 bp, Homo sapiens
cctggaggggaccaggaccagg

SEQ ID NO: 9485867 - DNA, 22 bp, Homo sapiens
cctggaggggaccaggaccagg

SEQ ID NO: 9485868 - DNA, 22 bp, Homo sapiens
cctggagggcgccgcacagtcc

SEQ ID NO: 9485869 - DNA, 22 bp, Homo sapiens
cctggagggcgccgcacagtcc

SEQ ID NO: 9485870 - DNA, 22 bp, Homo sapiens
cctggagggcgccgcacagtcc

SEQ ID NO: 9485871 - DNA, 22 bp, Homo sapiens
tgtcaagagtgcacacatctgc

SEQ ID NO: 9485872 - DNA, 22 bp, Homo sapiens
tgtcaagtgattagccataatg

SEQ ID NO: 9485873 - DNA, 22 bp, Homo sapiens
tgtcaagtctctgaatgaaatg

SEQ ID NO: 9485874 - DNA, 22 bp, Homo sapiens
tgtcaagttgttaagttctggg

SEQ ID NO: 9485875 - DNA, 22 bp, Homo sapiens
tgtcaataactggagtcattat

SEQ ID NO: 9485876 - DNA, 22 bp, Homo sapiens
tgtcaataacatttacttctat

SEQ ID NO: 9485877 - DNA, 22 bp, Homo sapiens
tgtcaaccacttcattatgaga

SEQ ID NO: 9485878 - DNA, 22 bp, Homo sapiens
tgtcaacatttatcaagttatt

SEQ ID NO: 9485879 - DNA, 22 bp, Homo sapiens
tgtcaacatttatcaagttatt

SEQ ID NO: 9485880 - DNA, 22 bp, Homo sapiens
tgtcaacattggctgacagttg

SEQ ID NO: 9485881 - DNA, 22 bp, Homo sapiens
tgtcaacattggctgacagttg

SEQ ID NO: 9485882 - DNA, 22 bp, Homo sapiens
tgtcaacagatctcaaagctgg

SEQ ID NO: 9485883 - DNA, 22 bp, Homo sapiens
tgtcaacaggctttctaaggca

SEQ ID NO: 9485884 - DNA, 22 bp, Homo sapiens
tgtcaacagatactagagagct

SEQ ID NO: 9485885 - DNA, 22 bp, Homo sapiens
tgtcaacagatactagagagct

SEQ ID NO: 9485886 - DNA, 22 bp, Homo sapiens
tgtcaacacacctatctcaatt

SEQ ID NO: 9485887 - DNA, 22 bp, Homo sapiens
tgtcaacacacctatctcaatt

SEQ ID NO: 9485888 - DNA, 18 bp, Homo sapiens
cctggagctccacagcaa

SEQ ID NO: 9485889 - DNA, 18 bp, Homo sapiens
cctggagctccacagcaa

SEQ ID NO: 9485890 - DNA, 22 bp, Homo sapiens
cctggagcttttccagttgaca

SEQ ID NO: 9485891 - DNA, 22 bp, Homo sapiens
cctggagcttttccagttgaca

SEQ ID NO: 9485892 - DNA, 22 bp, Homo sapiens
cctggagcttggtcacgctgcg

SEQ ID NO: 9485893 - DNA, 22 bp, Homo sapiens
cctggaggagcgctgaccagct

SEQ ID NO: 9485894 - DNA, 22 bp, Homo sapiens
cctggaggagcgctgaccagct

SEQ ID NO: 9485895 - DNA, 22 bp, Homo sapiens
cctggaggagcgctgaccagct

SEQ ID NO: 9485896 - DNA, 22 bp, Homo sapiens
cctggagcttttccatcctgga

SEQ ID NO: 9485897 - DNA, 22 bp, Homo sapiens
cctggaggctctgggagggcag

SEQ ID NO: 9485898 - DNA, 22 bp, Homo sapiens
cctggaggctctgggagggcag

SEQ ID NO: 9485899 - DNA, 22 bp, Homo sapiens
cctggaggcggaggttgcagtg

SEQ ID NO: 9485900 - DNA, 22 bp, Homo sapiens
cctggaggcggaggttgcagtg

SEQ ID NO: 9485901 - DNA, 22 bp, Homo sapiens
cctggaggagcgctgaccagct

SEQ ID NO: 9485902 - DNA, 22 bp, Homo sapiens
cctggaggcagaaataggactt

SEQ ID NO: 9485903 - DNA, 22 bp, Homo sapiens
cctggaggcggaggttgcagtg

SEQ ID NO: 9485904 - DNA, 22 bp, Homo sapiens
cctggagggcgccgcacagtcc

SEQ ID NO: 9485905 - DNA, 22 bp, Homo sapiens
cctggagggcgccgcacagtcc

SEQ ID NO: 9485906 - DNA, 22 bp, Homo sapiens
cctggagggcagcccattctgg

SEQ ID NO: 9485907 - DNA, 22 bp, Homo sapiens
cctggagggaccctggccctgt

SEQ ID NO: 9485908 - DNA, 22 bp, Homo sapiens
cctggagggaccctggccctgt

SEQ ID NO: 9485909 - DNA, 22 bp, Homo sapiens
cctggagggaccctggccctgt

SEQ ID NO: 9485910 - DNA, 22 bp, Homo sapiens
tggtctgaaggtggatttgaga

SEQ ID NO: 9485911 - DNA, 22 bp, Homo sapiens
tggtctgaaggacttctgaggg

SEQ ID NO: 9485912 - DNA, 22 bp, Homo sapiens
tggtctgaggaacaccagcact

SEQ ID NO: 9485913 - DNA, 22 bp, Homo sapiens
tggtctgataccggattccagt

SEQ ID NO: 9485914 - DNA, 22 bp, Homo sapiens
tggtctgattcttgctccccaa

SEQ ID NO: 9485915 - DNA, 23 bp, Homo sapiens
tggtctgaagcctcaggttcctc

SEQ ID NO: 9485916 - DNA, 22 bp, Homo sapiens
tggtctcttcttccaagatggc

SEQ ID NO: 9485917 - DNA, 22 bp, Homo sapiens
tggtctcttcttccaagatggc

SEQ ID NO: 9485918 - DNA, 22 bp, Homo sapiens
cctgccttccagccttgggctc

SEQ ID NO: 9485919 - DNA, 22 bp, Homo sapiens
cctgccttcagccctgaagtct

SEQ ID NO: 9485920 - DNA, 22 bp, Homo sapiens
cctgccttcccagcttggcttt

SEQ ID NO: 9485921 - DNA, 22 bp, Homo sapiens
cctgccttccagccttgggctc

SEQ ID NO: 9485922 - DNA, 22 bp, Homo sapiens
cctgctctaaatctcatggaac

SEQ ID NO: 9485923 - DNA, 22 bp, Homo sapiens
tggtctgttcaaggtggctgat

SEQ ID NO: 9485924 - DNA, 22 bp, Homo sapiens
cctgctggacctcaacacattt

SEQ ID NO: 9485925 - DNA, 17 bp, Homo sapiens
tggtctggaagaactga

SEQ ID NO: 9485926 - DNA, 22 bp, Homo sapiens
tggtctgctgaacagccgtatc

SEQ ID NO: 9485927 - DNA, 22 bp, Homo sapiens
tggtctgctgaacagccgtatc

SEQ ID NO: 9485928 - DNA, 20 bp, Homo sapiens
tggtctggagccagtgagga

SEQ ID NO: 9485929 - DNA, 22 bp, Homo sapiens
tggtctgggcaaatccttctga

SEQ ID NO: 9485930 - DNA, 20 bp, Homo sapiens
tggtctggagccagtgagga

SEQ ID NO: 9485931 - DNA, 22 bp, Homo sapiens
tggtctggggaccgagggttac

SEQ ID NO: 9485932 - DNA, 22 bp, Homo sapiens
cctgctgtagggcccctggggc

SEQ ID NO: 9485933 - DNA, 22 bp, Homo sapiens
cctgctgtaatgtgtctttatt

SEQ ID NO: 9485934 - DNA, 22 bp, Homo sapiens
cctgctgggcctgagcaatgag

SEQ ID NO: 9485935 - DNA, 22 bp, Homo sapiens
cctgctgtctctgggcaggcag

SEQ ID NO: 9485936 - DNA, 22 bp, Homo sapiens
cctgctggccactgctccacct

SEQ ID NO: 9485937 - DNA, 20 bp, Homo sapiens
cctgctgggaaccctctgaa

SEQ ID NO: 9485938 - DNA, 22 bp, Homo sapiens
cctgctgggacgtgtggttgcc

SEQ ID NO: 9485939 - DNA, 22 bp, Homo sapiens
cctgctgggcctgagcaatgag

SEQ ID NO: 9485940 - DNA, 22 bp, Homo sapiens
cctgctggctggtagagttccg

SEQ ID NO: 9485941 - DNA, 22 bp, Homo sapiens
cctgctggctggtagagttccg

SEQ ID NO: 9485942 - DNA, 22 bp, Homo sapiens
cctgctggcgtggctggcgccc

SEQ ID NO: 9485943 - DNA, 22 bp, Homo sapiens
cctgctggcgtggctggcgccc

SEQ ID NO: 9485944 - DNA, 22 bp, Homo sapiens
cctgctggcgtggctggcgccc

SEQ ID NO: 9485945 - DNA, 22 bp, Homo sapiens
cctgcctgcagaaagtatctcc

SEQ ID NO: 9485946 - DNA, 20 bp, Homo sapiens
cctgcctgcctcggctcatt

SEQ ID NO: 9485947 - DNA, 22 bp, Homo sapiens
cctgcctggggacaaaggaggg

SEQ ID NO: 9485948 - DNA, 22 bp, Homo sapiens
cctgcctgggctcacttgccag

SEQ ID NO: 9485949 - DNA, 22 bp, Homo sapiens
cctgcctggggacaaaggaggg

SEQ ID NO: 9485950 - DNA, 22 bp, Homo sapiens
cctgcctgggttcaaatcccag

SEQ ID NO: 9485951 - DNA, 22 bp, Homo sapiens
cctgcctggcttccagaagaga

SEQ ID NO: 9485952 - DNA, 22 bp, Homo sapiens
cctgcctggcttccagaagaga

SEQ ID NO: 9485953 - DNA, 22 bp, Homo sapiens
cctgcctggcttccagaagaga

SEQ ID NO: 9485954 - DNA, 22 bp, Homo sapiens
cctgcctgggctcacttgccag

SEQ ID NO: 9485955 - DNA, 22 bp, Homo sapiens
cctgcctgcctgctggccggga

SEQ ID NO: 9485956 - DNA, 22 bp, Homo sapiens
cctgcctgtactagagacccag

SEQ ID NO: 9485957 - DNA, 22 bp, Homo sapiens
cctgcctgtactagagacccag

SEQ ID NO: 9485958 - DNA, 22 bp, Homo sapiens
cctgcctgtaagatgggtacaa

SEQ ID NO: 9485959 - DNA, 22 bp, Homo sapiens
cctgcctgtaagatgggtacaa

SEQ ID NO: 9485960 - DNA, 22 bp, Homo sapiens
cctgcctggtgtaagtctaagg

SEQ ID NO: 9485961 - DNA, 22 bp, Homo sapiens
cctgcctgtccctcagtccaca

SEQ ID NO: 9485962 - DNA, 22 bp, Homo sapiens
cctgcctgtcatcgcctgcgcc

SEQ ID NO: 9485963 - DNA, 22 bp, Homo sapiens
cctgcctgtccctcagtccaca

SEQ ID NO: 9485964 - DNA, 22 bp, Homo sapiens
cctgcctgtccctcagtccaca

SEQ ID NO: 9485965 - DNA, 22 bp, Homo sapiens
cctgcctgtctttatcccctgt

SEQ ID NO: 9485966 - DNA, 22 bp, Homo sapiens
cctgcctgtctttatcccctgt

SEQ ID NO: 9485967 - DNA, 23 bp, Homo sapiens
cctgcctgttctaactccatttc

SEQ ID NO: 9485968 - DNA, 23 bp, Homo sapiens
cctgcctgttctaactccatttc

SEQ ID NO: 9485969 - DNA, 23 bp, Homo sapiens
cctgcctgttctaactccatttc

SEQ ID NO: 9485970 - DNA, 20 bp, Homo sapiens
cctgcctgtgtttgtgatga

SEQ ID NO: 9485971 - DNA, 22 bp, Homo sapiens
tgggtcagaatcagagagttgc

SEQ ID NO: 9485972 - DNA, 22 bp, Homo sapiens
tgggtcagacagccagtgggcc

SEQ ID NO: 9485973 - DNA, 22 bp, Homo sapiens
tgggtaggggacgtggaagaaa

SEQ ID NO: 9485974 - DNA, 18 bp, Homo sapiens
cctgccagtctggagcag

SEQ ID NO: 9485975 - DNA, 22 bp, Homo sapiens
tgggtaggggacgtggaagaaa

SEQ ID NO: 9485976 - DNA, 22 bp, Homo sapiens
tgggtaggtgctggggattcag

SEQ ID NO: 9485977 - DNA, 22 bp, Homo sapiens
tgggtaggtgctggggattcag

SEQ ID NO: 9485978 - DNA, 22 bp, Homo sapiens
tgggtaggtgtggcctgaatgt

SEQ ID NO: 9485979 - DNA, 22 bp, Homo sapiens
cctgccaggcgagtctaggcca

SEQ ID NO: 9485980 - DNA, 22 bp, Homo sapiens
cctgccagggccagaggccagc

SEQ ID NO: 9485981 - DNA, 22 bp, Homo sapiens
cctgccagggccttggaagaaa

SEQ ID NO: 9485982 - DNA, 21 bp, Homo sapiens
tggaaggctgctctgccaggg

SEQ ID NO: 9485983 - DNA, 22 bp, Homo sapiens
tggaaggcctgttgtgtcctag

SEQ ID NO: 9485984 - DNA, 22 bp, Homo sapiens
tggaaggcttggaatacttcca

SEQ ID NO: 9485985 - DNA, 17 bp, Homo sapiens
tggaaggcttcaatatt

SEQ ID NO: 9485986 - DNA, 22 bp, Homo sapiens
tggaagacaggcatggaagtgg

SEQ ID NO: 9485987 - DNA, 22 bp, Homo sapiens
tggaagacaggagatgtgtgta

SEQ ID NO: 9485988 - DNA, 22 bp, Homo sapiens
tggaagacagttgatgggagtt

SEQ ID NO: 9485989 - DNA, 22 bp, Homo sapiens
tggaaggcaggacctgccttgg

SEQ ID NO: 9485990 - DNA, 20 bp, Homo sapiens
tggaaggcatctgcattatt

SEQ ID NO: 9485991 - DNA, 22 bp, Homo sapiens
tggaagacaaagattcaatatt

SEQ ID NO: 9485992 - DNA, 22 bp, Homo sapiens
tggaagaatttggggataaatt

SEQ ID NO: 9485993 - DNA, 22 bp, Homo sapiens
tggaagaatttggggataaatt

SEQ ID NO: 9485994 - DNA, 22 bp, Homo sapiens
tggaagaatgctccacagggaa

SEQ ID NO: 9485995 - DNA, 22 bp, Homo sapiens
tggaagaatgctccacagggaa

SEQ ID NO: 9485996 - DNA, 22 bp, Homo sapiens
tggaagacactatttaccaggt

SEQ ID NO: 9485997 - DNA, 20 bp, Homo sapiens
tggaagacactgaagggcca

SEQ ID NO: 9485998 - DNA, 22 bp, Homo sapiens
tggaagacaatgtacatgcagt

SEQ ID NO: 9485999 - DNA, 22 bp, Homo sapiens
ccctagaacacgcagacactga

SEQ ID NO: 9486000 - DNA, 22 bp, Homo sapiens
ccctagaacacgcagacactga

SEQ ID NO: 9486001 - DNA, 22 bp, Homo sapiens
ccctagaacacgcagacactga

SEQ ID NO: 9486002 - DNA, 19 bp, Homo sapiens
ccctagagtaagactgcat

SEQ ID NO: 9486003 - DNA, 19 bp, Homo sapiens
ccctagagtaagactgcat

SEQ ID NO: 9486004 - DNA, 22 bp, Homo sapiens
tggaaagacatgtccttcatta

SEQ ID NO: 9486005 - DNA, 22 bp, Homo sapiens
tggaaagacattcagccgctgg

SEQ ID NO: 9486006 - DNA, 20 bp, Homo sapiens
tggaagaagaactcaggctt

SEQ ID NO: 9486007 - DNA, 22 bp, Homo sapiens
tggaagaagctacaagcggtga

SEQ ID NO: 9486008 - DNA, 22 bp, Homo sapiens
tggaagaataggatagaagaac

SEQ ID NO: 9486009 - DNA, 22 bp, Homo sapiens
tggaagaatagaagatggttga

SEQ ID NO: 9486010 - DNA, 22 bp, Homo sapiens
tggaagaataggatagaagaac

SEQ ID NO: 9486011 - DNA, 22 bp, Homo sapiens
tggaagaatatgggggtacaga

SEQ ID NO: 9486012 - DNA, 22 bp, Homo sapiens
tggaagaatatgggggtacaga

SEQ ID NO: 9486013 - DNA, 22 bp, Homo sapiens
tggaagaataggatagaagaac

SEQ ID NO: 9486014 - DNA, 22 bp, Homo sapiens
tggaagaataggatagaagaac

SEQ ID NO: 9486015 - DNA, 22 bp, Homo sapiens
tggaagaaggcagagaggcatt

SEQ ID NO: 9486016 - DNA, 22 bp, Homo sapiens
tggaagaaggcagagaggcatt

SEQ ID NO: 9486017 - DNA, 22 bp, Homo sapiens
tggaagaagctacaagcggtga

SEQ ID NO: 9486018 - DNA, 22 bp, Homo sapiens
tggaagaagctacaagcggtga

SEQ ID NO: 9486019 - DNA, 22 bp, Homo sapiens
tggaagaatagaagatggttga

SEQ ID NO: 9486020 - DNA, 22 bp, Homo sapiens
tggaagaaggcagagaggcatt

SEQ ID NO: 9486021 - DNA, 22 bp, Homo sapiens
tggaagaaggcagagaggcatt

SEQ ID NO: 9486022 - DNA, 18 bp, Homo sapiens
cccggctaatttttggta

SEQ ID NO: 9486023 - DNA, 22 bp, Homo sapiens
cccgggaggcagaggttgcagt

SEQ ID NO: 9486024 - DNA, 22 bp, Homo sapiens
cccgggaggcggaggttgcagt

SEQ ID NO: 9486025 - DNA, 22 bp, Homo sapiens
cccgggaggtggaggttgcagt

SEQ ID NO: 9486026 - DNA, 22 bp, Homo sapiens
cccgggttgtccgcgcgtccgg

SEQ ID NO: 9486027 - DNA, 22 bp, Homo sapiens
cccgtcccttttgcccgctggt

SEQ ID NO: 9486028 - DNA, 22 bp, Homo sapiens
cccgtgtgtgcgaggctcccgc

SEQ ID NO: 9486029 - DNA, 17 bp, Homo sapiens
cccgttctcttcgctgg

SEQ ID NO: 9486030 - DNA, 22 bp, Homo sapiens
cccgtgtggacagcgtgccagt

SEQ ID NO: 9486031 - DNA, 22 bp, Homo sapiens
cccgtgtggatgcgctggtgct

SEQ ID NO: 9486032 - DNA, 22 bp, Homo sapiens
ccctaaggacacctgctgtcca

SEQ ID NO: 9486033 - DNA, 22 bp, Homo sapiens
ccctaaaagtctcattttccag

SEQ ID NO: 9486034 - DNA, 22 bp, Homo sapiens
ccctaaggcagcccagtctgtg

SEQ ID NO: 9486035 - DNA, 22 bp, Homo sapiens
tgcctgcctctggagcccatcc

SEQ ID NO: 9486036 - DNA, 21 bp, Homo sapiens
tgcctgcctcctttggctagg

SEQ ID NO: 9486037 - DNA, 22 bp, Homo sapiens
tgcctgcctctggagcccatcc

SEQ ID NO: 9486038 - DNA, 22 bp, Homo sapiens
tgcctgcctctggcagccctgc

SEQ ID NO: 9486039 - DNA, 22 bp, Homo sapiens
tgcctgccttgctgctggacag

SEQ ID NO: 9486040 - DNA, 22 bp, Homo sapiens
tgcctgcgaggcatgggtgaga

SEQ ID NO: 9486041 - DNA, 22 bp, Homo sapiens
tgcctgcctgcatagtcccacg

SEQ ID NO: 9486042 - DNA, 22 bp, Homo sapiens
tgcctgcctgcatagtcccacg

SEQ ID NO: 9486043 - DNA, 22 bp, Homo sapiens
tgcctgccctttccacacagcc

SEQ ID NO: 9486044 - DNA, 22 bp, Homo sapiens
tgcctgccgctgtctagtactg

SEQ ID NO: 9486045 - DNA, 22 bp, Homo sapiens
tgcctgcctaggaagctgtgaa

SEQ ID NO: 9486046 - DNA, 22 bp, Homo sapiens
tgcctgcctaggaagctgtgaa

SEQ ID NO: 9486047 - DNA, 22 bp, Homo sapiens
tgcctgcctcaggccgagtgct

SEQ ID NO: 9486048 - DNA, 22 bp, Homo sapiens
tgcctgcctcaggccgagtgct

SEQ ID NO: 9486049 - DNA, 22 bp, Homo sapiens
tgcctgccctttccacacagcc

SEQ ID NO: 9486050 - DNA, 18 bp, Homo sapiens
tgcctgccccgtaagggt

SEQ ID NO: 9486051 - DNA, 22 bp, Homo sapiens
tgcctcagtttcatctgcagaa

SEQ ID NO: 9486052 - DNA, 17 bp, Homo sapiens
tgcctccagcagggtga

SEQ ID NO: 9486053 - DNA, 23 bp, Homo sapiens
tgcctccaccgagggccaggcat

SEQ ID NO: 9486054 - DNA, 22 bp, Homo sapiens
tgcctccatgtttcagcatcta

SEQ ID NO: 9486055 - DNA, 22 bp, Homo sapiens
tgcctccaggaggggcagctct

SEQ ID NO: 9486056 - DNA, 22 bp, Homo sapiens
tgcttgtccgaggtgagtactt

SEQ ID NO: 9486057 - DNA, 19 bp, Homo sapiens
tgcctgctcctggcttcca

SEQ ID NO: 9486058 - DNA, 22 bp, Homo sapiens
tgcttgtctcagataaaactat

SEQ ID NO: 9486059 - DNA, 22 bp, Homo sapiens
tgcctgctatttgcctaaagtg

SEQ ID NO: 9486060 - DNA, 22 bp, Homo sapiens
tgcctgctatttgcctaaagtg

SEQ ID NO: 9486061 - DNA, 22 bp, Homo sapiens
tgcctgctaggcactttcaaac

SEQ ID NO: 9486062 - DNA, 22 bp, Homo sapiens
tgctttattgcatcagtgtggg

SEQ ID NO: 9486063 - DNA, 22 bp, Homo sapiens
tgctttattgcatcagtgtggg

SEQ ID NO: 9486064 - DNA, 22 bp, Homo sapiens
tgctttatttataaaatagcaa

SEQ ID NO: 9486065 - DNA, 22 bp, Homo sapiens
tgctttatttataaaatagcaa

SEQ ID NO: 9486066 - DNA, 22 bp, Homo sapiens
tgctttatttataaaatagcaa

SEQ ID NO: 9486067 - DNA, 22 bp, Homo sapiens
tgctttatttataaaatagcaa

SEQ ID NO: 9486068 - DNA, 22 bp, Homo sapiens
tgctttcacaccatgcctataa

SEQ ID NO: 9486069 - DNA, 22 bp, Homo sapiens
tgctttcacctgtttgcaccca

SEQ ID NO: 9486070 - DNA, 22 bp, Homo sapiens
tgctttcactgatgtatcattt

SEQ ID NO: 9486071 - DNA, 22 bp, Homo sapiens
tgctttcacatgtatgcacaaa

SEQ ID NO: 9486072 - DNA, 22 bp, Homo sapiens
tgctttcacatgtatgcacaaa

SEQ ID NO: 9486073 - DNA, 22 bp, Homo sapiens
tgctttcagccagtgtctggat

SEQ ID NO: 9486074 - DNA, 21 bp, Homo sapiens
tgctttcagactcttacagaa

SEQ ID NO: 9486075 - DNA, 22 bp, Homo sapiens
tgctttcacttctctgcagcca

SEQ ID NO: 9486076 - DNA, 22 bp, Homo sapiens
tgctttcattcacaaaatagca

SEQ ID NO: 9486077 - DNA, 22 bp, Homo sapiens
tgctttcatgaagtctatagag

SEQ ID NO: 9486078 - DNA, 22 bp, Homo sapiens
tgctttcatattgcctatgact

SEQ ID NO: 9486079 - DNA, 22 bp, Homo sapiens
tggacatcttagtcatgtcaat

SEQ ID NO: 9486080 - DNA, 22 bp, Homo sapiens
tggacagttgtcttgtagctaa

SEQ ID NO: 9486081 - DNA, 22 bp, Homo sapiens
tggacagttgtcttgtagctaa

SEQ ID NO: 9486082 - DNA, 23 bp, Homo sapiens
tggacagtagggtagacagtgcc

SEQ ID NO: 9486083 - DNA, 23 bp, Homo sapiens
tggacagttatctcattgtcctg

SEQ ID NO: 9486084 - DNA, 22 bp, Homo sapiens
tggacagtgctcagaaatttgt

SEQ ID NO: 9486085 - DNA, 22 bp, Homo sapiens
tggacagttactgagcttgagt

SEQ ID NO: 9486086 - DNA, 22 bp, Homo sapiens
tggacagtgcagatacagaatg

SEQ ID NO: 9486087 - DNA, 22 bp, Homo sapiens
tggacaggtgcacacagcagcc

SEQ ID NO: 9486088 - DNA, 22 bp, Homo sapiens
tggacaggttgagtaggaggag

SEQ ID NO: 9486089 - DNA, 22 bp, Homo sapiens
tggacaggttgagtaggaggag

SEQ ID NO: 9486090 - DNA, 22 bp, Homo sapiens
tggacaggtttgggtgcctgtt

SEQ ID NO: 9486091 - DNA, 22 bp, Homo sapiens
tggacaggtttgggtgcctgtt

SEQ ID NO: 9486092 - DNA, 22 bp, Homo sapiens
tggacaggttgagtaggaggag

SEQ ID NO: 9486093 - DNA, 22 bp, Homo sapiens
tggacaggtttgggtgcctgtt

SEQ ID NO: 9486094 - DNA, 22 bp, Homo sapiens
tggacagtaagagaagatgtag

SEQ ID NO: 9486095 - DNA, 22 bp, Homo sapiens
ccctgcctgtgggcatcaacat

SEQ ID NO: 9486096 - DNA, 22 bp, Homo sapiens
ccctgcctctgaagctgctcag

SEQ ID NO: 9486097 - DNA, 22 bp, Homo sapiens
ccctgcctacagggttttcttt

SEQ ID NO: 9486098 - DNA, 20 bp, Homo sapiens
ccctgcagccatgggagtgg

SEQ ID NO: 9486099 - DNA, 22 bp, Homo sapiens
tggacaggtgcacacagcagcc

SEQ ID NO: 9486100 - DNA, 22 bp, Homo sapiens
tggacaggtgcacacagcagcc

SEQ ID NO: 9486101 - DNA, 23 bp, Homo sapiens
ccctgcactaagaggagaaggtg

SEQ ID NO: 9486102 - DNA, 22 bp, Homo sapiens
ccctgcagaccaatgccataga

SEQ ID NO: 9486103 - DNA, 22 bp, Homo sapiens
tggaagggaacaggtgggtgtt

SEQ ID NO: 9486104 - DNA, 17 bp, Homo sapiens
ccctgcaccctactctc

SEQ ID NO: 9486105 - DNA, 22 bp, Homo sapiens
ccctgaggaccaggaaggaggg

SEQ ID NO: 9486106 - DNA, 22 bp, Homo sapiens
ccctgaggaccaggaaggaggg

SEQ ID NO: 9486107 - DNA, 22 bp, Homo sapiens
ccctgaggagagcgcttcccga

SEQ ID NO: 9486108 - DNA, 22 bp, Homo sapiens
ccctgctgaatcccatggagtc

SEQ ID NO: 9486109 - DNA, 22 bp, Homo sapiens
tggaggccaggaaggcagcgag

SEQ ID NO: 9486110 - DNA, 22 bp, Homo sapiens
ccctgctcttagtgcctgtgtg

SEQ ID NO: 9486111 - DNA, 22 bp, Homo sapiens
ccctgctcttctgactcaagct

SEQ ID NO: 9486112 - DNA, 22 bp, Homo sapiens
ccctgctgaagaacgttcatac

SEQ ID NO: 9486113 - DNA, 22 bp, Homo sapiens
ccctgctagttgtctcagtgat

SEQ ID NO: 9486114 - DNA, 22 bp, Homo sapiens
ccctgccttgtctgggctaggt

SEQ ID NO: 9486115 - DNA, 22 bp, Homo sapiens
ccctgccttgttggagcctatg

SEQ ID NO: 9486116 - DNA, 22 bp, Homo sapiens
ccctgccttcttggcctttaaa

SEQ ID NO: 9486117 - DNA, 22 bp, Homo sapiens
ccctgccttcttggcctttaaa

SEQ ID NO: 9486118 - DNA, 22 bp, Homo sapiens
ccctgccttggggtccacaccg

SEQ ID NO: 9486119 - DNA, 22 bp, Homo sapiens
tggaggtgaaatgagattttgt

SEQ ID NO: 9486120 - DNA, 22 bp, Homo sapiens
tggaggtgacggggcctcgttg

SEQ ID NO: 9486121 - DNA, 22 bp, Homo sapiens
ccctggagctagtctgagcaga

SEQ ID NO: 9486122 - DNA, 22 bp, Homo sapiens
tggaggtgagtgtggtacagca

SEQ ID NO: 9486123 - DNA, 22 bp, Homo sapiens
tggaggtgagtgtggtacagca

SEQ ID NO: 9486124 - DNA, 22 bp, Homo sapiens
tggaggtgagtgtggtacagca

SEQ ID NO: 9486125 - DNA, 23 bp, Homo sapiens
ccctggagctagtctgagcagag

SEQ ID NO: 9486126 - DNA, 23 bp, Homo sapiens
ccctggagctagtctgagcagag

SEQ ID NO: 9486127 - DNA, 23 bp, Homo sapiens
ccctggagctagtctgagcagag

SEQ ID NO: 9486128 - DNA, 23 bp, Homo sapiens
ccctggagctagtctgagcgggg

SEQ ID NO: 9486129 - DNA, 23 bp, Homo sapiens
ccctggagctagtctgagcagag

SEQ ID NO: 9486130 - DNA, 22 bp, Homo sapiens
ccctggagctagtctgagcaga

SEQ ID NO: 9486131 - DNA, 22 bp, Homo sapiens
ccctggagctagtctgagcaga

SEQ ID NO: 9486132 - DNA, 19 bp, Homo sapiens
tggaggggtttgaatgtgg

SEQ ID NO: 9486133 - DNA, 19 bp, Homo sapiens
tggaggggtttgaatgtgg

SEQ ID NO: 9486134 - DNA, 19 bp, Homo sapiens
tggaggggtttgaatgtgg

SEQ ID NO: 9486135 - DNA, 19 bp, Homo sapiens
tggaggggtttgaatgtgg

SEQ ID NO: 9486136 - DNA, 22 bp, Homo sapiens
tggaggggcaatggagcgcgga

SEQ ID NO: 9486137 - DNA, 22 bp, Homo sapiens
tggaggggcaatggagcgcgga

SEQ ID NO: 9486138 - DNA, 22 bp, Homo sapiens
tggaggggcaatggagcgcgga

SEQ ID NO: 9486139 - DNA, 22 bp, Homo sapiens
tggaggtcttacccagggctat

SEQ ID NO: 9486140 - DNA, 22 bp, Homo sapiens
tggaggtctgcaaggcgctgga

SEQ ID NO: 9486141 - DNA, 22 bp, Homo sapiens
tggaggtctgcaaggcgctgga

SEQ ID NO: 9486142 - DNA, 22 bp, Homo sapiens
tggaggtcgctagcgagcgggc

SEQ ID NO: 9486143 - DNA, 19 bp, Homo sapiens
tggaggggtttgaatgtgg

SEQ ID NO: 9486144 - DNA, 19 bp, Homo sapiens
tggaggtccaggagtaggg

SEQ ID NO: 9486145 - DNA, 22 bp, Homo sapiens
tggaggtcgcgcgggtgctgca

SEQ ID NO: 9486146 - DNA, 22 bp, Homo sapiens
tggaggtcctgcaggatggcac

SEQ ID NO: 9486147 - DNA, 22 bp, Homo sapiens
tggaggtcgcgcgggtgctgca

SEQ ID NO: 9486148 - DNA, 22 bp, Homo sapiens
tggctacatttgttgatcactt

SEQ ID NO: 9486149 - DNA, 22 bp, Homo sapiens
tggctaacaaggtgaaaccccg

SEQ ID NO: 9486150 - DNA, 22 bp, Homo sapiens
tggctacaagtgtgtttagttt

SEQ ID NO: 9486151 - DNA, 22 bp, Homo sapiens
tggctaatcttaaggcttttgc

SEQ ID NO: 9486152 - DNA, 22 bp, Homo sapiens
tggctcagccattcgtgttgcc

SEQ ID NO: 9486153 - DNA, 22 bp, Homo sapiens
tggctcagcctggccctttcat

SEQ ID NO: 9486154 - DNA, 22 bp, Homo sapiens
tggctcagcgcggcctggtctt

SEQ ID NO: 9486155 - DNA, 22 bp, Homo sapiens
tggctcagcgcggcctggtctt

SEQ ID NO: 9486156 - DNA, 22 bp, Homo sapiens
tggctagataactagaatttca

SEQ ID NO: 9486157 - DNA, 22 bp, Homo sapiens
tggctagcaactcaactgttaa

SEQ ID NO: 9486158 - DNA, 20 bp, Homo sapiens
tggctagcattaaaatgact

SEQ ID NO: 9486159 - DNA, 22 bp, Homo sapiens
tggctcagccagccctaggaac

SEQ ID NO: 9486160 - DNA, 22 bp, Homo sapiens
tggctaggacctctgcggagca

SEQ ID NO: 9486161 - DNA, 22 bp, Homo sapiens
tggctaggctccaagagctgga

SEQ ID NO: 9486162 - DNA, 19 bp, Homo sapiens
cctccccttggaccagcaa

SEQ ID NO: 9486163 - DNA, 19 bp, Homo sapiens
cctccccttggaccagcaa

SEQ ID NO: 9486164 - DNA, 19 bp, Homo sapiens
cctccccttggaccagcaa

SEQ ID NO: 9486165 - DNA, 22 bp, Homo sapiens
cctccctctttcagtcccacag

SEQ ID NO: 9486166 - DNA, 22 bp, Homo sapiens
cctccctctttcagtcccacag

SEQ ID NO: 9486167 - DNA, 22 bp, Homo sapiens
cctccctctgttagagctgtct

SEQ ID NO: 9486168 - DNA, 22 bp, Homo sapiens
cctccctccctcttatggttta

SEQ ID NO: 9486169 - DNA, 22 bp, Homo sapiens
cctccctccctcttatggttta

SEQ ID NO: 9486170 - DNA, 22 bp, Homo sapiens
cctccctccattgccatcgtct

SEQ ID NO: 9486171 - DNA, 22 bp, Homo sapiens
cctccctccattgccatcgtct

SEQ ID NO: 9486172 - DNA, 22 bp, Homo sapiens
cctccctccattgccatcgtct

SEQ ID NO: 9486173 - DNA, 22 bp, Homo sapiens
tggctcagcgcggcctggtctt

SEQ ID NO: 9486174 - DNA, 22 bp, Homo sapiens
tggctcagcgcggcctggtctt

SEQ ID NO: 9486175 - DNA, 22 bp, Homo sapiens
tggctcagcggtggcagcagac

SEQ ID NO: 9486176 - DNA, 22 bp, Homo sapiens
tggctcagcggtggcagcagac

SEQ ID NO: 9486177 - DNA, 23 bp, Homo sapiens
tggctcagctagttttccatttc

SEQ ID NO: 9486178 - DNA, 23 bp, Homo sapiens
tggctcagctagttttccatttc

SEQ ID NO: 9486179 - DNA, 22 bp, Homo sapiens
tggctcagcggtggcagcagac

SEQ ID NO: 9486180 - DNA, 22 bp, Homo sapiens
cctcccagatgtgcccaatgga

SEQ ID NO: 9486181 - DNA, 22 bp, Homo sapiens
cctcccagatgtgcccaatgga

SEQ ID NO: 9486182 - DNA, 22 bp, Homo sapiens
cctcccaggcattgccattttc

SEQ ID NO: 9486183 - DNA, 22 bp, Homo sapiens
cctcccagatgtgcccaatgga

SEQ ID NO: 9486184 - DNA, 22 bp, Homo sapiens
cctcccctcagacagagactgg

SEQ ID NO: 9486185 - DNA, 22 bp, Homo sapiens
cctcccctgctcagaactctgg

SEQ ID NO: 9486186 - DNA, 22 bp, Homo sapiens
cctcccctcagacagagactgg

SEQ ID NO: 9486187 - DNA, 22 bp, Homo sapiens
cctccccatgacccggtgctgg

SEQ ID NO: 9486188 - DNA, 22 bp, Homo sapiens
tggcctcagattattgcacagt

SEQ ID NO: 9486189 - DNA, 22 bp, Homo sapiens
tggcctcaccactagctgggtg

SEQ ID NO: 9486190 - DNA, 21 bp, Homo sapiens
tggcctcccacacttccatgg

SEQ ID NO: 9486191 - DNA, 22 bp, Homo sapiens
tggcctcccctaacagcctctt

SEQ ID NO: 9486192 - DNA, 21 bp, Homo sapiens
tggcctcccacacttccatgg

SEQ ID NO: 9486193 - DNA, 21 bp, Homo sapiens
tggccctggccacggctgcca

SEQ ID NO: 9486194 - DNA, 21 bp, Homo sapiens
tggccctggccacggctgcca

SEQ ID NO: 9486195 - DNA, 22 bp, Homo sapiens
cctcagaagctcaaggacattg

SEQ ID NO: 9486196 - DNA, 22 bp, Homo sapiens
tggccctgcttatgtctctctt

SEQ ID NO: 9486197 - DNA, 22 bp, Homo sapiens
tggccctgcttatgtctctctt

SEQ ID NO: 9486198 - DNA, 22 bp, Homo sapiens
tggcctcaaccgtcctaagcac

SEQ ID NO: 9486199 - DNA, 22 bp, Homo sapiens
tggcctcaatctgtcctccagc

SEQ ID NO: 9486200 - DNA, 22 bp, Homo sapiens
tggcctcaatctgtcctccagc

SEQ ID NO: 9486201 - DNA, 22 bp, Homo sapiens
cctcactgaagaggtgacattt

SEQ ID NO: 9486202 - DNA, 22 bp, Homo sapiens
cctcagaagactttagggaaga

SEQ ID NO: 9486203 - DNA, 19 bp, Homo sapiens
cctcaccctgcagaggagg

SEQ ID NO: 9486204 - DNA, 22 bp, Homo sapiens
cctcaccttcccagagacgatc

SEQ ID NO: 9486205 - DNA, 19 bp, Homo sapiens
cctcaccctgcagaggagg

SEQ ID NO: 9486206 - DNA, 19 bp, Homo sapiens
cctcaccctgcagaggagg

SEQ ID NO: 9486207 - DNA, 19 bp, Homo sapiens
cctcaccctgcagaggagg

SEQ ID NO: 9486208 - DNA, 22 bp, Homo sapiens
tggctaacaaggtgaaaccccg

SEQ ID NO: 9486209 - DNA, 22 bp, Homo sapiens
tggctaacaaggtgaaaccccg

SEQ ID NO: 9486210 - DNA, 22 bp, Homo sapiens
tggctaacaaggtgaaaccccg

SEQ ID NO: 9486211 - DNA, 22 bp, Homo sapiens
cctcagctgtcttttccgaggt

SEQ ID NO: 9486212 - DNA, 22 bp, Homo sapiens
cctcagctgcttccctggagcc

SEQ ID NO: 9486213 - DNA, 22 bp, Homo sapiens
cctcagctgcttccctggagcc

SEQ ID NO: 9486214 - DNA, 22 bp, Homo sapiens
tggcctggggacctgtgagacc

SEQ ID NO: 9486215 - DNA, 22 bp, Homo sapiens
cctcagccttggccccaggcag

SEQ ID NO: 9486216 - DNA, 22 bp, Homo sapiens
cctcagctcttccctgtgcaca

SEQ ID NO: 9486217 - DNA, 22 bp, Homo sapiens
cctcagctcttccctgtgcaca

SEQ ID NO: 9486218 - DNA, 22 bp, Homo sapiens
cctcagctgcttccctggagcc

SEQ ID NO: 9486219 - DNA, 22 bp, Homo sapiens
cctcagctgcttccctggagcc

SEQ ID NO: 9486220 - DNA, 22 bp, Homo sapiens
cctcagctgcttccctggagcc

SEQ ID NO: 9486221 - DNA, 22 bp, Homo sapiens
cctcagctgctgcacagctttt

SEQ ID NO: 9486222 - DNA, 22 bp, Homo sapiens
cctcagctgctgcacagctttt

SEQ ID NO: 9486223 - DNA, 22 bp, Homo sapiens
cctcagctgctgcacagctttt

SEQ ID NO: 9486224 - DNA, 22 bp, Homo sapiens
tggcctctctaccaggcagcct

SEQ ID NO: 9486225 - DNA, 22 bp, Homo sapiens
tggcctctctaccaggcagcct

SEQ ID NO: 9486226 - DNA, 23 bp, Homo sapiens
cctcagcatggcaggagcccagc

SEQ ID NO: 9486227 - DNA, 22 bp, Homo sapiens
cctcagcatcctggtgaagtag

SEQ ID NO: 9486228 - DNA, 22 bp, Homo sapiens
cctcagccttggccccaggcag

SEQ ID NO: 9486229 - DNA, 22 bp, Homo sapiens
cctcagccttggccccaggcag

SEQ ID NO: 9486230 - DNA, 22 bp, Homo sapiens
cctcagccttggccccaggcag

SEQ ID NO: 9486231 - DNA, 22 bp, Homo sapiens
cctcagcccctgaatggagaga

SEQ ID NO: 9486232 - DNA, 22 bp, Homo sapiens
tggcctcggcatccagcaagag

SEQ ID NO: 9486233 - DNA, 22 bp, Homo sapiens
tggcctcccctaacagcctctt

SEQ ID NO: 9486234 - DNA, 22 bp, Homo sapiens
tggcctcccctaacagcctctt

SEQ ID NO: 9486235 - DNA, 22 bp, Homo sapiens
tggcctcctcgggctgaccctg

SEQ ID NO: 9486236 - DNA, 22 bp, Homo sapiens
tggcctcggcatccagcaagag

SEQ ID NO: 9486237 - DNA, 22 bp, Homo sapiens
tggcctcctcgggctgaccctg

SEQ ID NO: 9486238 - DNA, 22 bp, Homo sapiens
tggcctctctaccaggcagcct

SEQ ID NO: 9486239 - DNA, 22 bp, Homo sapiens
tggcctctcctggcagcatcca

SEQ ID NO: 9486240 - DNA, 22 bp, Homo sapiens
tggcctctcctggcagcatcca

SEQ ID NO: 9486241 - DNA, 23 bp, Homo sapiens
tggcctctccccacctggcagaa

SEQ ID NO: 9486242 - DNA, 23 bp, Homo sapiens
tggcctctccccacctggcagaa

SEQ ID NO: 9486243 - DNA, 22 bp, Homo sapiens
tggcctcggcatccagcaagag

SEQ ID NO: 9486244 - DNA, 22 bp, Homo sapiens
ccctgtgcagatggcagctggg

SEQ ID NO: 9486245 - DNA, 22 bp, Homo sapiens
ccctgtgcacacacttcactct

SEQ ID NO: 9486246 - DNA, 22 bp, Homo sapiens
ccctgtgcacacacttcactct

SEQ ID NO: 9486247 - DNA, 22 bp, Homo sapiens
ccctgtgcattggagggtgttt

SEQ ID NO: 9486248 - DNA, 22 bp, Homo sapiens
ccctgtgcatattgccagatac

SEQ ID NO: 9486249 - DNA, 22 bp, Homo sapiens
ccctgtgcagatggcagctggg

SEQ ID NO: 9486250 - DNA, 20 bp, Homo sapiens
ccctgtgattggcaagtgtc

SEQ ID NO: 9486251 - DNA, 20 bp, Homo sapiens
ccctgtgattggcaagtgtc

SEQ ID NO: 9486252 - DNA, 22 bp, Homo sapiens
ccctgtgatgtagctagagtag

SEQ ID NO: 9486253 - DNA, 20 bp, Homo sapiens
ccctgtgattggcaagtgtc

SEQ ID NO: 9486254 - DNA, 20 bp, Homo sapiens
ccctgtgattggcaagtgtc

SEQ ID NO: 9486255 - DNA, 22 bp, Homo sapiens
ccctgtgatgtagctagagtag

SEQ ID NO: 9486256 - DNA, 22 bp, Homo sapiens
ccctgtgacgagcacggccagt

SEQ ID NO: 9486257 - DNA, 22 bp, Homo sapiens
ccctgtgacgagcacggccagt

SEQ ID NO: 9486258 - DNA, 22 bp, Homo sapiens
ccctgtgagcggctggatgcct

SEQ ID NO: 9486259 - DNA, 22 bp, Homo sapiens
ccctgtgagtagggactggtgg

SEQ ID NO: 9486260 - DNA, 22 bp, Homo sapiens
ccctgtgatgtagctagagtag

SEQ ID NO: 9486261 - DNA, 22 bp, Homo sapiens
ccctgtgcctagttggcctaaa

SEQ ID NO: 9486262 - DNA, 22 bp, Homo sapiens
ccctgtgccagagaggcaggag

SEQ ID NO: 9486263 - DNA, 22 bp, Homo sapiens
ccctgtgcctcagtttcctcat

SEQ ID NO: 9486264 - DNA, 22 bp, Homo sapiens
ccctgtgctgtcatgctgggcg

SEQ ID NO: 9486265 - DNA, 22 bp, Homo sapiens
ccctgtggaggaggagagcagt

SEQ ID NO: 9486266 - DNA, 22 bp, Homo sapiens
ccctgtggaggaggagagcagt

SEQ ID NO: 9486267 - DNA, 22 bp, Homo sapiens
ccctgtggaggcagcatcctgc

SEQ ID NO: 9486268 - DNA, 22 bp, Homo sapiens
ccgcgccacccattcccactga

SEQ ID NO: 9486269 - DNA, 22 bp, Homo sapiens
ccctttccatggctctcctagg

SEQ ID NO: 9486270 - DNA, 22 bp, Homo sapiens
ccctgtggatttcagtttgtgt

SEQ ID NO: 9486271 - DNA, 22 bp, Homo sapiens
ccctgtggcaggaggaggagca

SEQ ID NO: 9486272 - DNA, 22 bp, Homo sapiens
ccggctactcgggaggctgacg

SEQ ID NO: 9486273 - DNA, 22 bp, Homo sapiens
ccggcaaaggccccttccccag

SEQ ID NO: 9486274 - DNA, 22 bp, Homo sapiens
ccggagaaactggcaaacccta

SEQ ID NO: 9486275 - DNA, 22 bp, Homo sapiens
ccgcgtcttttgttcgggccta

SEQ ID NO: 9486276 - DNA, 22 bp, Homo sapiens
ccctgtcctgctaggccctggt

SEQ ID NO: 9486277 - DNA, 22 bp, Homo sapiens
ccctgtcctgctaggccctggt

SEQ ID NO: 9486278 - DNA, 22 bp, Homo sapiens
ccctgtcctggatgggagcact

SEQ ID NO: 9486279 - DNA, 23 bp, Homo sapiens
ccctgtagcccaggacaggcttt

SEQ ID NO: 9486280 - DNA, 22 bp, Homo sapiens
ccctgtcacaatggatgacatt

SEQ ID NO: 9486281 - DNA, 22 bp, Homo sapiens
ccctgtcctgctaggccctggt

SEQ ID NO: 9486282 - DNA, 22 bp, Homo sapiens
ccctgtccttggctgtgaggct

SEQ ID NO: 9486283 - DNA, 22 bp, Homo sapiens
ccctgtccttggctgtgaggct

SEQ ID NO: 9486284 - DNA, 22 bp, Homo sapiens
ccctgtgacagtatctgcttga

SEQ ID NO: 9486285 - DNA, 22 bp, Homo sapiens
ccctgtctgtaccgtgatgagc

SEQ ID NO: 9486286 - DNA, 22 bp, Homo sapiens
ccctgtctcattgatcacttgt

SEQ ID NO: 9486287 - DNA, 22 bp, Homo sapiens
ccctggtgtccactggaggaag

SEQ ID NO: 9486288 - DNA, 22 bp, Homo sapiens
ccctggtggtacggcactggca

SEQ ID NO: 9486289 - DNA, 22 bp, Homo sapiens
ccctggtggtacggcactggca

SEQ ID NO: 9486290 - DNA, 22 bp, Homo sapiens
ccctggtgtccactggaggaag

SEQ ID NO: 9486291 - DNA, 22 bp, Homo sapiens
ccctggtgtggatgtgattggc

SEQ ID NO: 9486292 - DNA, 22 bp, Homo sapiens
ccctggtcagggaaggcgcctg

SEQ ID NO: 9486293 - DNA, 22 bp, Homo sapiens
ccctggtcagggaaggcgcctg

SEQ ID NO: 9486294 - DNA, 22 bp, Homo sapiens
ccctgggataccagacaccaga

SEQ ID NO: 9486295 - DNA, 22 bp, Homo sapiens
ccctggtggtacggcactggca

SEQ ID NO: 9486296 - DNA, 22 bp, Homo sapiens
ccctggtggggccagacttgct

SEQ ID NO: 9486297 - DNA, 22 bp, Homo sapiens
ccctggtgccctgggtcagcct

SEQ ID NO: 9486298 - DNA, 22 bp, Homo sapiens
ccctggtgccctgggtcagcct

SEQ ID NO: 9486299 - DNA, 22 bp, Homo sapiens
ccctggtcagggaaggcgcctg

SEQ ID NO: 9486300 - DNA, 22 bp, Homo sapiens
ccctgggagtccactgatgtca

SEQ ID NO: 9486301 - DNA, 23 bp, Homo sapiens
ccctggagctagtctgagcgggg

SEQ ID NO: 9486302 - DNA, 22 bp, Homo sapiens
ccctggaggaaaatctgaggct

SEQ ID NO: 9486303 - DNA, 22 bp, Homo sapiens
ccctggaggaaaatctgaggct

SEQ ID NO: 9486304 - DNA, 22 bp, Homo sapiens
ccctggaggaaaatctgaggct

SEQ ID NO: 9486305 - DNA, 22 bp, Homo sapiens
ccctggagctgcttgcatgttg

SEQ ID NO: 9486306 - DNA, 22 bp, Homo sapiens
ccgggctggagtgcaatggctc

SEQ ID NO: 9486307 - DNA, 22 bp, Homo sapiens
ccgtattataagtttttccttc

SEQ ID NO: 9486308 - DNA, 22 bp, Homo sapiens
ccggtcccaggtgccccggtga

SEQ ID NO: 9486309 - DNA, 22 bp, Homo sapiens
ccgggttgaggttcccatagat

SEQ ID NO: 9486310 - DNA, 22 bp, Homo sapiens
ccggtcccaggtgccccggtga

SEQ ID NO: 9486311 - DNA, 22 bp, Homo sapiens
ccgtggtcacctgagctccttg

SEQ ID NO: 9486312 - DNA, 22 bp, Homo sapiens
ccgtggtcacctgagctccttg

SEQ ID NO: 9486313 - DNA, 22 bp, Homo sapiens
ccgtggagttgtgctgagtatg

SEQ ID NO: 9486314 - DNA, 22 bp, Homo sapiens
ccgtggagttgtgctgagtatg

SEQ ID NO: 9486315 - DNA, 22 bp, Homo sapiens
ccgtggccttgatggctccggt

SEQ ID NO: 9486316 - DNA, 22 bp, Homo sapiens
ccgtgcttcttcagatgtgaat

SEQ ID NO: 9486317 - DNA, 21 bp, Homo sapiens
ccgtgctcggctatggaccac

SEQ ID NO: 9486318 - DNA, 21 bp, Homo sapiens
ccgtgctcggctatggaccac

SEQ ID NO: 9486319 - DNA, 22 bp, Homo sapiens
ccgtccccagccacctgctgat

SEQ ID NO: 9486320 - DNA, 22 bp, Homo sapiens
ccggctactcgggaggctgacg

SEQ ID NO: 9486321 - DNA, 22 bp, Homo sapiens
ccggctactcgggaggctgacg

SEQ ID NO: 9486322 - DNA, 22 bp, Homo sapiens
ccggctactcgggaggctgacg

SEQ ID NO: 9486323 - DNA, 22 bp, Homo sapiens
ccggctcggcgaccaggctgaa

SEQ ID NO: 9486324 - DNA, 22 bp, Homo sapiens
ccgggagcaggcgccaccgcca

SEQ ID NO: 9486325 - DNA, 22 bp, Homo sapiens
ccgggcctcgggacaccgggta

SEQ ID NO: 9486326 - DNA, 22 bp, Homo sapiens
ccgggagcaggcgccaccgcca

SEQ ID NO: 9486327 - DNA, 22 bp, Homo sapiens
ccgggagcaggcgccaccgcca

SEQ ID NO: 9486328 - DNA, 22 bp, Homo sapiens
ccgggagcaggcgccaccgcca

SEQ ID NO: 9486329 - DNA, 22 bp, Homo sapiens
ccgggagcaggcgccaccgcca

SEQ ID NO: 9486330 - DNA, 22 bp, Homo sapiens
ccgggagcaggcgccaccgcca

SEQ ID NO: 9486331 - DNA, 22 bp, Homo sapiens
ccgggcctcgggacaccgggta

SEQ ID NO: 9486332 - DNA, 22 bp, Homo sapiens
ccgggcctcgggacaccgggta

SEQ ID NO: 9486333 - DNA, 22 bp, Homo sapiens
ccgggcgggggctctcgtcacc

SEQ ID NO: 9486334 - DNA, 22 bp, Homo sapiens
ccgggcctcgggacaccgggta

SEQ ID NO: 9486335 - DNA, 22 bp, Homo sapiens
cctcacagcctcatgcccagcc

SEQ ID NO: 9486336 - DNA, 17 bp, Homo sapiens
cctcacagggaccagac

SEQ ID NO: 9486337 - DNA, 22 bp, Homo sapiens
cctcacccagtcacctaggtgg

SEQ ID NO: 9486338 - DNA, 22 bp, Homo sapiens
cctcacccagtcacctaggtgg

SEQ ID NO: 9486339 - DNA, 22 bp, Homo sapiens
cctcacccagtcacctaggtgg

SEQ ID NO: 9486340 - DNA, 22 bp, Homo sapiens
cctcacccactacactcaaggg

SEQ ID NO: 9486341 - DNA, 22 bp, Homo sapiens
cctcacagtttggctaactgtg

SEQ ID NO: 9486342 - DNA, 22 bp, Homo sapiens
cctcacatgaatgtaagctcca

SEQ ID NO: 9486343 - DNA, 22 bp, Homo sapiens
cctcacagtgttcgtgtcagat

SEQ ID NO: 9486344 - DNA, 22 bp, Homo sapiens
cctcacagtcagttcttagtct

SEQ ID NO: 9486345 - DNA, 22 bp, Homo sapiens
cctcacagccctcctctagcac

SEQ ID NO: 9486346 - DNA, 22 bp, Homo sapiens
cctcacagcccttggcccagga

SEQ ID NO: 9486347 - DNA, 22 bp, Homo sapiens
cctcacagcccttggcccagga

SEQ ID NO: 9486348 - DNA, 22 bp, Homo sapiens
cctcacagcaaggatttcagtg

SEQ ID NO: 9486349 - DNA, 22 bp, Homo sapiens
cctcacagaggggcagccatct

SEQ ID NO: 9486350 - DNA, 22 bp, Homo sapiens
cctcacagagcccagatgtcta

SEQ ID NO: 9486351 - DNA, 22 bp, Homo sapiens
cctcacagaggggcagccatct

SEQ ID NO: 9486352 - DNA, 22 bp, Homo sapiens
cctcacagaggggcagccatct

SEQ ID NO: 9486353 - DNA, 22 bp, Homo sapiens
cctaaacagaacaaagaggcag

SEQ ID NO: 9486354 - DNA, 22 bp, Homo sapiens
ccgtgtgtatggtggaactgct

SEQ ID NO: 9486355 - DNA, 23 bp, Homo sapiens
ccgtgtgtatactctgtaataga

SEQ ID NO: 9486356 - DNA, 22 bp, Homo sapiens
cctcacagagcccagatgtcta

SEQ ID NO: 9486357 - DNA, 22 bp, Homo sapiens
cctatttgtaggctgggccagt

SEQ ID NO: 9486358 - DNA, 22 bp, Homo sapiens
cccagctcccatgttctccaat

SEQ ID NO: 9486359 - DNA, 22 bp, Homo sapiens
cccagctcccatgttctccaat

SEQ ID NO: 9486360 - DNA, 22 bp, Homo sapiens
cccagctcccatgttctccaat

SEQ ID NO: 9486361 - DNA, 22 bp, Homo sapiens
cccagctcccatgttctccaat

SEQ ID NO: 9486362 - DNA, 22 bp, Homo sapiens
cccagctcccaagttgctatgg

SEQ ID NO: 9486363 - DNA, 18 bp, Homo sapiens
cccagctccacttccctc

SEQ ID NO: 9486364 - DNA, 22 bp, Homo sapiens
cccagctccagagccagaaaca

SEQ ID NO: 9486365 - DNA, 22 bp, Homo sapiens
cccagctccagagccagaaaca

SEQ ID NO: 9486366 - DNA, 22 bp, Homo sapiens
cccaggaaatagccaggaggtg

SEQ ID NO: 9486367 - DNA, 22 bp, Homo sapiens
cccaggaattggaggctgcagt

SEQ ID NO: 9486368 - DNA, 22 bp, Homo sapiens
cccagctccctggtatttgtgc

SEQ ID NO: 9486369 - DNA, 22 bp, Homo sapiens
cccagctccgagctccgagccg

SEQ ID NO: 9486370 - DNA, 22 bp, Homo sapiens
cccagctccgagctccgagccg

SEQ ID NO: 9486371 - DNA, 22 bp, Homo sapiens
cccaggactcttcactgcagcc

SEQ ID NO: 9486372 - DNA, 22 bp, Homo sapiens
cccaggactctgacacccccaa

SEQ ID NO: 9486373 - DNA, 21 bp, Homo sapiens
cccaggagaagaaaagatgca

SEQ ID NO: 9486374 - DNA, 21 bp, Homo sapiens
cccaggagaagaaaagatgca

SEQ ID NO: 9486375 - DNA, 22 bp, Homo sapiens
cccaggaattggaggctgcagt

SEQ ID NO: 9486376 - DNA, 22 bp, Homo sapiens
cccaggacccttcaatggctcc

SEQ ID NO: 9486377 - DNA, 22 bp, Homo sapiens
cccaggaccatccttctgtgcc

SEQ ID NO: 9486378 - DNA, 22 bp, Homo sapiens
cccaggactaatgagctctacg

SEQ ID NO: 9486379 - DNA, 22 bp, Homo sapiens
cccaggaccgcgcggctgagcg

SEQ ID NO: 9486380 - DNA, 22 bp, Homo sapiens
cccaggaccgcgcggctgagcg

SEQ ID NO: 9486381 - DNA, 22 bp, Homo sapiens
cccaggaccgcgcggctgagcg

SEQ ID NO: 9486382 - DNA, 22 bp, Homo sapiens
tgcaggtgctgtgtcaagagag

SEQ ID NO: 9486383 - DNA, 22 bp, Homo sapiens
cccagccctgacctattggaaa

SEQ ID NO: 9486384 - DNA, 22 bp, Homo sapiens
cccagccctgacctattggaaa

SEQ ID NO: 9486385 - DNA, 22 bp, Homo sapiens
tgcaggtggacacgggagacgg

SEQ ID NO: 9486386 - DNA, 22 bp, Homo sapiens
tgcagtctggatgtcctcagat

SEQ ID NO: 9486387 - DNA, 22 bp, Homo sapiens
tgcagtgagaagcagttatgat

SEQ ID NO: 9486388 - DNA, 22 bp, Homo sapiens
tgcagtggaagaggtggagatc

SEQ ID NO: 9486389 - DNA, 22 bp, Homo sapiens
tgcagtggaagaggtggagatc

SEQ ID NO: 9486390 - DNA, 22 bp, Homo sapiens
tgcagtgatttgtacaattaga

SEQ ID NO: 9486391 - DNA, 22 bp, Homo sapiens
tgcagtgatgcttctggctcag

SEQ ID NO: 9486392 - DNA, 22 bp, Homo sapiens
cccagctcatcaggagccgccc

SEQ ID NO: 9486393 - DNA, 22 bp, Homo sapiens
cccagctcaagcagagagctaa

SEQ ID NO: 9486394 - DNA, 22 bp, Homo sapiens
cccagctcaagcagagagctaa

SEQ ID NO: 9486395 - DNA, 22 bp, Homo sapiens
cccagctccaagggacagcgaa

SEQ ID NO: 9486396 - DNA, 22 bp, Homo sapiens
cccagctccaagggacagcgaa

SEQ ID NO: 9486397 - DNA, 22 bp, Homo sapiens
cccagctcatcaggagccgccc

SEQ ID NO: 9486398 - DNA, 22 bp, Homo sapiens
cccagctcatcaggagccgccc

SEQ ID NO: 9486399 - DNA, 18 bp, Homo sapiens
cccagctccacttccctc

SEQ ID NO: 9486400 - DNA, 18 bp, Homo sapiens
cccagctccacttccctc

SEQ ID NO: 9486401 - DNA, 22 bp, Homo sapiens
tgcagtggaagaggtggagatc

SEQ ID NO: 9486402 - DNA, 22 bp, Homo sapiens
tgcagtggaatctggagagcag

SEQ ID NO: 9486403 - DNA, 22 bp, Homo sapiens
tgcagtggaggccgtgagacag

SEQ ID NO: 9486404 - DNA, 22 bp, Homo sapiens
tgcagtggaggccgtgagacag

SEQ ID NO: 9486405 - DNA, 19 bp, Homo sapiens
cccagccaggtcttgcatc

SEQ ID NO: 9486406 - DNA, 18 bp, Homo sapiens
cccagcccaccatttctc

SEQ ID NO: 9486407 - DNA, 19 bp, Homo sapiens
cccagccaggtcttgcatc

SEQ ID NO: 9486408 - DNA, 19 bp, Homo sapiens
cccagccaggtcttgcatc

SEQ ID NO: 9486409 - DNA, 19 bp, Homo sapiens
cccagccaggtcttgcatc

SEQ ID NO: 9486410 - DNA, 18 bp, Homo sapiens
cccagcccaccatttctc

SEQ ID NO: 9486411 - DNA, 18 bp, Homo sapiens
cccagcccaccatttctc

SEQ ID NO: 9486412 - DNA, 18 bp, Homo sapiens
cccagcccaccatttctc

SEQ ID NO: 9486413 - DNA, 22 bp, Homo sapiens
cccagcccagcgttcgaggggt

SEQ ID NO: 9486414 - DNA, 22 bp, Homo sapiens
cccagcccagcgttcgaggggt

SEQ ID NO: 9486415 - DNA, 22 bp, Homo sapiens
cccagcccagcgttcgaggggt

SEQ ID NO: 9486416 - DNA, 22 bp, Homo sapiens
cccagcccagcgttcgaggggt

SEQ ID NO: 9486417 - DNA, 22 bp, Homo sapiens
cccagcccagcgttcgaggggt

SEQ ID NO: 9486418 - DNA, 22 bp, Homo sapiens
cccagcccacggtcctgggtgg

SEQ ID NO: 9486419 - DNA, 22 bp, Homo sapiens
cccagcccacggtcctgggtgg

SEQ ID NO: 9486420 - DNA, 22 bp, Homo sapiens
cccagcccacggtcctgggtgg

SEQ ID NO: 9486421 - DNA, 22 bp, Homo sapiens
cccagcccacggtcctgggtgg

SEQ ID NO: 9486422 - DNA, 22 bp, Homo sapiens
cccagcccccgagtgtctggaa

SEQ ID NO: 9486423 - DNA, 22 bp, Homo sapiens
cccagcccccgagtgtctggaa

SEQ ID NO: 9486424 - DNA, 22 bp, Homo sapiens
cccagcccccgagtgtctggaa

SEQ ID NO: 9486425 - DNA, 22 bp, Homo sapiens
cccagcccatctcaaaggtcta

SEQ ID NO: 9486426 - DNA, 22 bp, Homo sapiens
cccagcccatctcaaaggtcta

SEQ ID NO: 9486427 - DNA, 22 bp, Homo sapiens
cccagcccatctcaaaggtcta

SEQ ID NO: 9486428 - DNA, 20 bp, Homo sapiens
cccagcccgggccgcgctcg

SEQ ID NO: 9486429 - DNA, 20 bp, Homo sapiens
cccagcccgggccgcgctcg

SEQ ID NO: 9486430 - DNA, 20 bp, Homo sapiens
cccagcccctacctgttgcc

SEQ ID NO: 9486431 - DNA, 20 bp, Homo sapiens
cccagcccctacctgttgcc

SEQ ID NO: 9486432 - DNA, 20 bp, Homo sapiens
cccagcccctacctgttgcc

SEQ ID NO: 9486433 - DNA, 22 bp, Homo sapiens
cccagccaagtgatctgaccgc

SEQ ID NO: 9486434 - DNA, 22 bp, Homo sapiens
cccagccaagtgatctgaccgc

SEQ ID NO: 9486435 - DNA, 22 bp, Homo sapiens
cccagccaagtgatctgaccgc

SEQ ID NO: 9486436 - DNA, 22 bp, Homo sapiens
cccagccaagtgatctgaccgc

SEQ ID NO: 9486437 - DNA, 22 bp, Homo sapiens
cccagccagcctcttcccatat

SEQ ID NO: 9486438 - DNA, 22 bp, Homo sapiens
cccagccagcctcttcccatat

SEQ ID NO: 9486439 - DNA, 22 bp, Homo sapiens
cccagccagcctcttcccatat

SEQ ID NO: 9486440 - DNA, 22 bp, Homo sapiens
cccagccaaggtgctggtgttg

SEQ ID NO: 9486441 - DNA, 22 bp, Homo sapiens
cccagccaaggtgctggtgttg

SEQ ID NO: 9486442 - DNA, 22 bp, Homo sapiens
cccagcatggagtgaggactca

SEQ ID NO: 9486443 - DNA, 22 bp, Homo sapiens
cccagcatgcacgctgacactc

SEQ ID NO: 9486444 - DNA, 22 bp, Homo sapiens
cccagcatgcacgctgacactc

SEQ ID NO: 9486445 - DNA, 22 bp, Homo sapiens
cccagcatctccaggcatggcc

SEQ ID NO: 9486446 - DNA, 22 bp, Homo sapiens
cccagcaggtgccatcactctg

SEQ ID NO: 9486447 - DNA, 22 bp, Homo sapiens
cccagcaggtgccatcactctg

SEQ ID NO: 9486448 - DNA, 22 bp, Homo sapiens
tgcagcagtttaatgcagggtt

SEQ ID NO: 9486449 - DNA, 22 bp, Homo sapiens
tgcagcagtttaatgcagggtt

SEQ ID NO: 9486450 - DNA, 22 bp, Homo sapiens
tgcagcatctccttaaatcttg

SEQ ID NO: 9486451 - DNA, 22 bp, Homo sapiens
tgcagcatctccttaaatcttg

SEQ ID NO: 9486452 - DNA, 22 bp, Homo sapiens
tgcagcatccatatattattag

SEQ ID NO: 9486453 - DNA, 22 bp, Homo sapiens
tgcagcagtttaatgcagggtt

SEQ ID NO: 9486454 - DNA, 22 bp, Homo sapiens
tgcagcatctccttgtgccatg

SEQ ID NO: 9486455 - DNA, 18 bp, Homo sapiens
tgcagcatgttcccataa

SEQ ID NO: 9486456 - DNA, 22 bp, Homo sapiens
tgcagcattagtacaagtctca

SEQ ID NO: 9486457 - DNA, 22 bp, Homo sapiens
tgcagcattatgtagctgtttt

SEQ ID NO: 9486458 - DNA, 22 bp, Homo sapiens
cccagcaggtgccatcactctg

SEQ ID NO: 9486459 - DNA, 22 bp, Homo sapiens
cccagcaggtgccatcactctg

SEQ ID NO: 9486460 - DNA, 22 bp, Homo sapiens
tgcagcattgaaatagctaggc

SEQ ID NO: 9486461 - DNA, 22 bp, Homo sapiens
tgcagcattgcaaagcagtctt

SEQ ID NO: 9486462 - DNA, 23 bp, Homo sapiens
tgcctcagtggaatgtgagggtg

SEQ ID NO: 9486463 - DNA, 22 bp, Homo sapiens
tgcctcagtttcatctgcagaa

SEQ ID NO: 9486464 - DNA, 23 bp, Homo sapiens
tgcctcagtggaatgtgagggtg

SEQ ID NO: 9486465 - DNA, 22 bp, Homo sapiens
tgccctggttacactggagtcc

SEQ ID NO: 9486466 - DNA, 22 bp, Homo sapiens
tgccctggttctgtgggtgagc

SEQ ID NO: 9486467 - DNA, 20 bp, Homo sapiens
cccaggagtgagcagcttta

SEQ ID NO: 9486468 - DNA, 22 bp, Homo sapiens
tgccctggttacactggagtcc

SEQ ID NO: 9486469 - DNA, 20 bp, Homo sapiens
cccaggagtgagcagcttta

SEQ ID NO: 9486470 - DNA, 20 bp, Homo sapiens
cccaggagtgagcagcttta

SEQ ID NO: 9486471 - DNA, 20 bp, Homo sapiens
cccaggagtgagcagcttta

SEQ ID NO: 9486472 - DNA, 19 bp, Homo sapiens
cccaggagtctggctggtt

SEQ ID NO: 9486473 - DNA, 20 bp, Homo sapiens
cccaggagtgagcagcttta

SEQ ID NO: 9486474 - DNA, 22 bp, Homo sapiens
cccaggaggttggggctacagt

SEQ ID NO: 9486475 - DNA, 22 bp, Homo sapiens
cccaggaggttggggctacagt

SEQ ID NO: 9486476 - DNA, 22 bp, Homo sapiens
cccaggagtaagtgacattgtt

SEQ ID NO: 9486477 - DNA, 22 bp, Homo sapiens
cccaggagtaagtgacattgtt

SEQ ID NO: 9486478 - DNA, 19 bp, Homo sapiens
cccaggagtctggctggtt

SEQ ID NO: 9486479 - DNA, 19 bp, Homo sapiens
cccaggagtctggctggtt

SEQ ID NO: 9486480 - DNA, 19 bp, Homo sapiens
cccaggagtctggctggtt

SEQ ID NO: 9486481 - DNA, 22 bp, Homo sapiens
cccaggaggttggggctacagt

SEQ ID NO: 9486482 - DNA, 22 bp, Homo sapiens
cccaggaggttgaggctgcagt

SEQ ID NO: 9486483 - DNA, 22 bp, Homo sapiens
cccaggaggttgaggctgcagt

SEQ ID NO: 9486484 - DNA, 22 bp, Homo sapiens
cccaggaggttgaggctgcagt

SEQ ID NO: 9486485 - DNA, 22 bp, Homo sapiens
cccaggaggttgaggctgcagt

SEQ ID NO: 9486486 - DNA, 22 bp, Homo sapiens
cccaggaggttgaggctgcagt

SEQ ID NO: 9486487 - DNA, 22 bp, Homo sapiens
tgccctctttctgtacagctcc

SEQ ID NO: 9486488 - DNA, 22 bp, Homo sapiens
tgcccaggatctggcgatgctc

SEQ ID NO: 9486489 - DNA, 22 bp, Homo sapiens
tgcccagcttcttacttttaaa

SEQ ID NO: 9486490 - DNA, 21 bp, Homo sapiens
cccaggaggctgagaagagca

SEQ ID NO: 9486491 - DNA, 21 bp, Homo sapiens
cccaggaggctgagaagagca

SEQ ID NO: 9486492 - DNA, 22 bp, Homo sapiens
tgcccagcttcttacttttaaa

SEQ ID NO: 9486493 - DNA, 22 bp, Homo sapiens
tgccctcagcagcagctcctgc

SEQ ID NO: 9486494 - DNA, 22 bp, Homo sapiens
cccaggaggcggaggttgcagt

SEQ ID NO: 9486495 - DNA, 22 bp, Homo sapiens
cccaggaggcggaggttgcagt

SEQ ID NO: 9486496 - DNA, 22 bp, Homo sapiens
cccaggaggcggaggttgcagt

SEQ ID NO: 9486497 - DNA, 21 bp, Homo sapiens
cccaggaggctgagaagagca

SEQ ID NO: 9486498 - DNA, 21 bp, Homo sapiens
cccaggaggctgagaagagca

SEQ ID NO: 9486499 - DNA, 21 bp, Homo sapiens
cccaggaggctgagaagagca

SEQ ID NO: 9486500 - DNA, 22 bp, Homo sapiens
cccaggaggcggaggttgtggt

SEQ ID NO: 9486501 - DNA, 22 bp, Homo sapiens
tgccctcagccacctccaagtt

SEQ ID NO: 9486502 - DNA, 22 bp, Homo sapiens
tgccctcattataagaggctca

SEQ ID NO: 9486503 - DNA, 22 bp, Homo sapiens
tgccctccctgtactgtcagga

SEQ ID NO: 9486504 - DNA, 22 bp, Homo sapiens
tgccctcccacattatggctgt

SEQ ID NO: 9486505 - DNA, 22 bp, Homo sapiens
tgccctctgcaggccgccatgg

SEQ ID NO: 9486506 - DNA, 22 bp, Homo sapiens
tgccctctaggctacagttcca

SEQ ID NO: 9486507 - DNA, 22 bp, Homo sapiens
tgccctctgcaggccgccatgg

SEQ ID NO: 9486508 - DNA, 22 bp, Homo sapiens
tgccctctaggctacagttcca

SEQ ID NO: 9486509 - DNA, 22 bp, Homo sapiens
tgccctcttaggtctgcgcagc

SEQ ID NO: 9486510 - DNA, 22 bp, Homo sapiens
tgccctcttaggtctgcgcagc

SEQ ID NO: 9486511 - DNA, 22 bp, Homo sapiens
tgccctctgcctcctctgcaga

SEQ ID NO: 9486512 - DNA, 22 bp, Homo sapiens
tgcatattctcctttattttgt

SEQ ID NO: 9486513 - DNA, 22 bp, Homo sapiens
tgcatattatgtgtatctgtct

SEQ ID NO: 9486514 - DNA, 22 bp, Homo sapiens
tgcatattataaagagaattag

SEQ ID NO: 9486515 - DNA, 22 bp, Homo sapiens
cccaggagaatatttttgggtc

SEQ ID NO: 9486516 - DNA, 22 bp, Homo sapiens
cccaggagacagaaacagaggt

SEQ ID NO: 9486517 - DNA, 22 bp, Homo sapiens
cccaggagacagaaacagaggt

SEQ ID NO: 9486518 - DNA, 21 bp, Homo sapiens
tgcatatataagtgcatacac

SEQ ID NO: 9486519 - DNA, 22 bp, Homo sapiens
cccaggagacagaaacagaggt

SEQ ID NO: 9486520 - DNA, 22 bp, Homo sapiens
cccaggagacatatagaaggac

SEQ ID NO: 9486521 - DNA, 22 bp, Homo sapiens
tgcatatttgattgagatacct

SEQ ID NO: 9486522 - DNA, 22 bp, Homo sapiens
tgcatatttgtatgatgtttag

SEQ ID NO: 9486523 - DNA, 22 bp, Homo sapiens
tgcatatttgtatgatgtttag

SEQ ID NO: 9486524 - DNA, 22 bp, Homo sapiens
tgcatattttataaagatggaa

SEQ ID NO: 9486525 - DNA, 22 bp, Homo sapiens
tgcatattgtgaaaatgtagat

SEQ ID NO: 9486526 - DNA, 22 bp, Homo sapiens
tgcatattgtccttgatattat

SEQ ID NO: 9486527 - DNA, 21 bp, Homo sapiens
tgcatattcttctggtggctg

SEQ ID NO: 9486528 - DNA, 22 bp, Homo sapiens
cccaggagataacgttcccaag

SEQ ID NO: 9486529 - DNA, 22 bp, Homo sapiens
cccaggagatctggatctcgtc

SEQ ID NO: 9486530 - DNA, 22 bp, Homo sapiens
cccaggagataacgttcccaag

SEQ ID NO: 9486531 - DNA, 22 bp, Homo sapiens
tgcatattttctgattcagaag

SEQ ID NO: 9486532 - DNA, 22 bp, Homo sapiens
tgcatattttctgattcagaag

SEQ ID NO: 9486533 - DNA, 21 bp, Homo sapiens
cccaggaggagctccggctcc

SEQ ID NO: 9486534 - DNA, 22 bp, Homo sapiens
cccaggaggacattccataccc

SEQ ID NO: 9486535 - DNA, 22 bp, Homo sapiens
cccaggaggcagagcttgcagt

SEQ ID NO: 9486536 - DNA, 22 bp, Homo sapiens
cccaggaggcagagcttgcagt

SEQ ID NO: 9486537 - DNA, 22 bp, Homo sapiens
cccaggaggcagagatagcagt

SEQ ID NO: 9486538 - DNA, 22 bp, Homo sapiens
cccaggaggcagagatagcagt

SEQ ID NO: 9486539 - DNA, 22 bp, Homo sapiens
cccaggaggcagagatagcagt

SEQ ID NO: 9486540 - DNA, 22 bp, Homo sapiens
cccaggaggcagagatagcagt

SEQ ID NO: 9486541 - DNA, 22 bp, Homo sapiens
cccaggaggcagagcttgcagt

SEQ ID NO: 9486542 - DNA, 22 bp, Homo sapiens
cccaggaggcagagcttgcagt

SEQ ID NO: 9486543 - DNA, 22 bp, Homo sapiens
cccaggaggcagaggttgcagt

SEQ ID NO: 9486544 - DNA, 22 bp, Homo sapiens
cccaggaggcagaagttgcagt

SEQ ID NO: 9486545 - DNA, 22 bp, Homo sapiens
cccaggaggcagaagttgcagt

SEQ ID NO: 9486546 - DNA, 22 bp, Homo sapiens
cccaggaggcagaagttgcagt

SEQ ID NO: 9486547 - DNA, 22 bp, Homo sapiens
cccaggaggcagaagttgcagt

SEQ ID NO: 9486548 - DNA, 21 bp, Homo sapiens
cccaggaggagctccggctcc

SEQ ID NO: 9486549 - DNA, 21 bp, Homo sapiens
cccaggaggagctccggctcc

SEQ ID NO: 9486550 - DNA, 22 bp, Homo sapiens
cccaggaggaggaaaaagctcg

SEQ ID NO: 9486551 - DNA, 22 bp, Homo sapiens
cccaggaggcagaagttgcagt

SEQ ID NO: 9486552 - DNA, 22 bp, Homo sapiens
cccaggaggaggaaaaagctcg

SEQ ID NO: 9486553 - DNA, 22 bp, Homo sapiens
cccaggaggcctgcctggccgg

SEQ ID NO: 9486554 - DNA, 22 bp, Homo sapiens
cccaggaggccaaggttgcagt

SEQ ID NO: 9486555 - DNA, 22 bp, Homo sapiens
cccaggaggccaaggttgcagt

SEQ ID NO: 9486556 - DNA, 22 bp, Homo sapiens
cccaggaggcgcaggttgcggt

SEQ ID NO: 9486557 - DNA, 22 bp, Homo sapiens
cccaggaggcctgcctggccgg

SEQ ID NO: 9486558 - DNA, 22 bp, Homo sapiens
cccaggaggcagaggttgcagt

SEQ ID NO: 9486559 - DNA, 22 bp, Homo sapiens
cccaggaggcagaggttgcagt

SEQ ID NO: 9486560 - DNA, 22 bp, Homo sapiens
cccaggaggccaaggttgcagt

SEQ ID NO: 9486561 - DNA, 22 bp, Homo sapiens
cccaggaggcagaggttggagc

SEQ ID NO: 9486562 - DNA, 22 bp, Homo sapiens
cccaggaggcagatgttgcagt

SEQ ID NO: 9486563 - DNA, 22 bp, Homo sapiens
cccacaggtgtgagcttgctgg

SEQ ID NO: 9486564 - DNA, 22 bp, Homo sapiens
cccacaggtgtgagcttgctgg

SEQ ID NO: 9486565 - DNA, 22 bp, Homo sapiens
cccacaggtggaagcctcggaa

SEQ ID NO: 9486566 - DNA, 22 bp, Homo sapiens
cccacaggtggaagcctcggaa

SEQ ID NO: 9486567 - DNA, 22 bp, Homo sapiens
cccacaggtggaagcctcggaa

SEQ ID NO: 9486568 - DNA, 22 bp, Homo sapiens
cccacaggctaggggtagggca

SEQ ID NO: 9486569 - DNA, 22 bp, Homo sapiens
cccacaggctaggggtagggca

SEQ ID NO: 9486570 - DNA, 22 bp, Homo sapiens
cccacaggctaggggtagggca

SEQ ID NO: 9486571 - DNA, 22 bp, Homo sapiens
cccacagggctgctgatggcag

SEQ ID NO: 9486572 - DNA, 22 bp, Homo sapiens
cccacagggctgctgatggcag

SEQ ID NO: 9486573 - DNA, 22 bp, Homo sapiens
cccacaggtccccatgaactcg

SEQ ID NO: 9486574 - DNA, 22 bp, Homo sapiens
cccacaggtccccatgaactcg

SEQ ID NO: 9486575 - DNA, 22 bp, Homo sapiens
cccacaggcaggggcagagaca

SEQ ID NO: 9486576 - DNA, 22 bp, Homo sapiens
cccacaggacgggctaaagagt

SEQ ID NO: 9486577 - DNA, 19 bp, Homo sapiens
cccacaggaggacatatgg

SEQ ID NO: 9486578 - DNA, 22 bp, Homo sapiens
cccaagggtgcccagcagagga

SEQ ID NO: 9486579 - DNA, 22 bp, Homo sapiens
cccaagggtgcccagcagagga

SEQ ID NO: 9486580 - DNA, 22 bp, Homo sapiens
tgattcaactttcataacaaaa

SEQ ID NO: 9486581 - DNA, 22 bp, Homo sapiens
cccacaggcaggggcagagaca

SEQ ID NO: 9486582 - DNA, 22 bp, Homo sapiens
cccacaggcaggtgcatgggct

SEQ ID NO: 9486583 - DNA, 22 bp, Homo sapiens
cccacaggccctgctgccttga

SEQ ID NO: 9486584 - DNA, 22 bp, Homo sapiens
cccacaggccctgctgccttga

SEQ ID NO: 9486585 - DNA, 22 bp, Homo sapiens
cccacaggcaggtgcatgggct

SEQ ID NO: 9486586 - DNA, 22 bp, Homo sapiens
cccacaggcaggtgcatgggct

SEQ ID NO: 9486587 - DNA, 22 bp, Homo sapiens
cccacaggccctgctgccttga

SEQ ID NO: 9486588 - DNA, 22 bp, Homo sapiens
tgcagaggtttccaggcaagtt

SEQ ID NO: 9486589 - DNA, 21 bp, Homo sapiens
tgcagagatatctgaagcaga

SEQ ID NO: 9486590 - DNA, 22 bp, Homo sapiens
tgcagaggtgaaagactagcaa

SEQ ID NO: 9486591 - DNA, 22 bp, Homo sapiens
tgcagaggtgaaagactagcaa

SEQ ID NO: 9486592 - DNA, 22 bp, Homo sapiens
tgcagaggtgaaagactagcaa

SEQ ID NO: 9486593 - DNA, 22 bp, Homo sapiens
tgcagaggtgtgcattcttaag

SEQ ID NO: 9486594 - DNA, 22 bp, Homo sapiens
tgcagaggtgttgctgagataa

SEQ ID NO: 9486595 - DNA, 22 bp, Homo sapiens
tgcagaggtgttgctgagataa

SEQ ID NO: 9486596 - DNA, 22 bp, Homo sapiens
cccaccagccatctgagagtgt

SEQ ID NO: 9486597 - DNA, 22 bp, Homo sapiens
cccacccactctgaccagaagc

SEQ ID NO: 9486598 - DNA, 23 bp, Homo sapiens
cccacatgtctgagtcagtgcca

SEQ ID NO: 9486599 - DNA, 23 bp, Homo sapiens
cccacatgtctgagtcagtgcca

SEQ ID NO: 9486600 - DNA, 22 bp, Homo sapiens
cccacatttttgagtcttcatc

SEQ ID NO: 9486601 - DNA, 22 bp, Homo sapiens
cccaccagacctgcaccggcac

SEQ ID NO: 9486602 - DNA, 22 bp, Homo sapiens
cccaccagacctgcaccggcac

SEQ ID NO: 9486603 - DNA, 22 bp, Homo sapiens
tgcagagagttagggcccgtat

SEQ ID NO: 9486604 - DNA, 22 bp, Homo sapiens
cccacccctggacaggtgagtg

SEQ ID NO: 9486605 - DNA, 22 bp, Homo sapiens
tgcagagatagaactactttct

SEQ ID NO: 9486606 - DNA, 22 bp, Homo sapiens
tgcagagatagaactactttct

SEQ ID NO: 9486607 - DNA, 22 bp, Homo sapiens
cccacccagcctggctgagggg

SEQ ID NO: 9486608 - DNA, 22 bp, Homo sapiens
cccacccagcctggctgagggg

SEQ ID NO: 9486609 - DNA, 22 bp, Homo sapiens
cccacccagctgagccgctcac

SEQ ID NO: 9486610 - DNA, 22 bp, Homo sapiens
cccacccagctgagccgctcac

SEQ ID NO: 9486611 - DNA, 22 bp, Homo sapiens
tgcagaggtttccaggcaagtt

SEQ ID NO: 9486612 - DNA, 22 bp, Homo sapiens
tgcagaggtttccaggcaagtt

SEQ ID NO: 9486613 - DNA, 22 bp, Homo sapiens
tgcagaggtttgtggtgttgct

SEQ ID NO: 9486614 - DNA, 22 bp, Homo sapiens
tgcagagtaaaagcagatgcta

SEQ ID NO: 9486615 - DNA, 22 bp, Homo sapiens
tgcagagtaaaagcagatgcta

SEQ ID NO: 9486616 - DNA, 22 bp, Homo sapiens
cccagagaattccacatagagg

SEQ ID NO: 9486617 - DNA, 22 bp, Homo sapiens
cccagagaatctttcagaaagg

SEQ ID NO: 9486618 - DNA, 22 bp, Homo sapiens
cccagagaatctttcagaaagg

SEQ ID NO: 9486619 - DNA, 22 bp, Homo sapiens
cccagagaatctttcagaaagg

SEQ ID NO: 9486620 - DNA, 22 bp, Homo sapiens
cccagagaagtgaagtgacttg

SEQ ID NO: 9486621 - DNA, 22 bp, Homo sapiens
cccagagaaccttctgtgccac

SEQ ID NO: 9486622 - DNA, 22 bp, Homo sapiens
cccagagaaccttctgtgccac

SEQ ID NO: 9486623 - DNA, 22 bp, Homo sapiens
cccagagaagtgaagtgacttg

SEQ ID NO: 9486624 - DNA, 22 bp, Homo sapiens
cccagaggtgaaggaggtggga

SEQ ID NO: 9486625 - DNA, 22 bp, Homo sapiens
cccagcactcagcaggctcata

SEQ ID NO: 9486626 - DNA, 22 bp, Homo sapiens
cccagaggtgaaggaggtggga

SEQ ID NO: 9486627 - DNA, 22 bp, Homo sapiens
cccagcactcagcaggctcata

SEQ ID NO: 9486628 - DNA, 22 bp, Homo sapiens
cccagcactcagcaggctcata

SEQ ID NO: 9486629 - DNA, 22 bp, Homo sapiens
cccagcactcagcaggctcata

SEQ ID NO: 9486630 - DNA, 22 bp, Homo sapiens
cccagagggtggaggttgcagt

SEQ ID NO: 9486631 - DNA, 22 bp, Homo sapiens
cccagagggtggaggttgcagt

SEQ ID NO: 9486632 - DNA, 22 bp, Homo sapiens
cccagagatcttgtcctttcca

SEQ ID NO: 9486633 - DNA, 22 bp, Homo sapiens
cccagagatctactgagcccag

SEQ ID NO: 9486634 - DNA, 22 bp, Homo sapiens
cccagagaggtaaaacagcctt

SEQ ID NO: 9486635 - DNA, 22 bp, Homo sapiens
cccagagaggtaaaacagcctt

SEQ ID NO: 9486636 - DNA, 22 bp, Homo sapiens
cccagagagcatttggacaaag

SEQ ID NO: 9486637 - DNA, 19 bp, Homo sapiens
cccagagagatctcttgcc

SEQ ID NO: 9486638 - DNA, 22 bp, Homo sapiens
cccagagaattccacatagagg

SEQ ID NO: 9486639 - DNA, 22 bp, Homo sapiens
cccagagaattccacatagagg

SEQ ID NO: 9486640 - DNA, 22 bp, Homo sapiens
cccagagactttgtccgacgac

SEQ ID NO: 9486641 - DNA, 22 bp, Homo sapiens
cccagcagccagaatgaggagc

SEQ ID NO: 9486642 - DNA, 23 bp, Homo sapiens
cccagcagattgtaaagtgtcca

SEQ ID NO: 9486643 - DNA, 23 bp, Homo sapiens
cccagcagattgtaaagtgtcca

SEQ ID NO: 9486644 - DNA, 23 bp, Homo sapiens
cccagcagattgtaaagtgtcca

SEQ ID NO: 9486645 - DNA, 22 bp, Homo sapiens
cccagcagatggctatgtgcta

SEQ ID NO: 9486646 - DNA, 22 bp, Homo sapiens
cccagcagccagaatgaggagc

SEQ ID NO: 9486647 - DNA, 22 bp, Homo sapiens
cccagcagccagaatgaggagc

SEQ ID NO: 9486648 - DNA, 22 bp, Homo sapiens
cccagcagccagaatgaggagc

SEQ ID NO: 9486649 - DNA, 22 bp, Homo sapiens
tgcagcaggtgacaacgagtgg

SEQ ID NO: 9486650 - DNA, 22 bp, Homo sapiens
tgcagcaggttccaaagggtta

SEQ ID NO: 9486651 - DNA, 22 bp, Homo sapiens
tgcagcaggtatggcaagctcc

SEQ ID NO: 9486652 - DNA, 22 bp, Homo sapiens
tgcagcagtcagtcaggcctgg

SEQ ID NO: 9486653 - DNA, 22 bp, Homo sapiens
tgcagcagtcagtcaggcctgg

SEQ ID NO: 9486654 - DNA, 22 bp, Homo sapiens
tgcagcagtgttccttggcttg

SEQ ID NO: 9486655 - DNA, 22 bp, Homo sapiens
tgcagcagtcagtcaggcctgg

SEQ ID NO: 9486656 - DNA, 22 bp, Homo sapiens
cccagcagatggctatgtgcta

SEQ ID NO: 9486657 - DNA, 22 bp, Homo sapiens
cccagcagatggctatgtgcta

SEQ ID NO: 9486658 - DNA, 22 bp, Homo sapiens
cccagcagatggctatgtgcta

SEQ ID NO: 9486659 - DNA, 22 bp, Homo sapiens
cccagcagaccgctgtgatggc

SEQ ID NO: 9486660 - DNA, 23 bp, Homo sapiens
cccagcagagatgaggaggggtc

SEQ ID NO: 9486661 - DNA, 23 bp, Homo sapiens
cccagcagagatgaggaggggtc

SEQ ID NO: 9486662 - DNA, 22 bp, Homo sapiens
cccagcactttgaatatgtcac

SEQ ID NO: 9486663 - DNA, 18 bp, Homo sapiens
cccagcactttgggagcc

SEQ ID NO: 9486664 - DNA, 22 bp, Homo sapiens
cccagcactttgaatatgtcac

SEQ ID NO: 9486665 - DNA, 22 bp, Homo sapiens
cccagcagaatctgatgagggc

SEQ ID NO: 9486666 - DNA, 22 bp, Homo sapiens
cccagcagaatctgatgagggc

SEQ ID NO: 9486667 - DNA, 22 bp, Homo sapiens
tgattacagtatttgagatcca

SEQ ID NO: 9486668 - DNA, 22 bp, Homo sapiens
tgattacattggtaatgtttat

SEQ ID NO: 9486669 - DNA, 23 bp, Homo sapiens
tgattacaggaagttcaagtgtt

SEQ ID NO: 9486670 - DNA, 22 bp, Homo sapiens
tgattacacagcagtaatttca

SEQ ID NO: 9486671 - DNA, 22 bp, Homo sapiens
tgattacactatttgggaatag

SEQ ID NO: 9486672 - DNA, 22 bp, Homo sapiens
tgattagctttgaatgtgctgc

SEQ ID NO: 9486673 - DNA, 22 bp, Homo sapiens
tgattagattgagtcaaccttg

SEQ ID NO: 9486674 - DNA, 22 bp, Homo sapiens
tgattatattaactatgttcct

SEQ ID NO: 9486675 - DNA, 22 bp, Homo sapiens
tgattatgcatgagacagtact

SEQ ID NO: 9486676 - DNA, 22 bp, Homo sapiens
tgattatattctaacttcataa

SEQ ID NO: 9486677 - DNA, 22 bp, Homo sapiens
tgattcaactttcataacaaaa

SEQ ID NO: 9486678 - DNA, 17 bp, Homo sapiens
tgattcaactagaaact

SEQ ID NO: 9486679 - DNA, 22 bp, Homo sapiens
tgattacacaccacagtgctcc

SEQ ID NO: 9486680 - DNA, 22 bp, Homo sapiens
cccaagccagaccctgaccctg

SEQ ID NO: 9486681 - DNA, 22 bp, Homo sapiens
cccaagccagaccctgaccctg

SEQ ID NO: 9486682 - DNA, 22 bp, Homo sapiens
cccaagatctttcgtgcactaa

SEQ ID NO: 9486683 - DNA, 22 bp, Homo sapiens
cccaagcagggtgcagaggcat

SEQ ID NO: 9486684 - DNA, 22 bp, Homo sapiens
cccaagagatcgcatgtagttg

SEQ ID NO: 9486685 - DNA, 22 bp, Homo sapiens
cccaagatctaggacagaaaga

SEQ ID NO: 9486686 - DNA, 22 bp, Homo sapiens
cccaaccagaaattgacagaga

SEQ ID NO: 9486687 - DNA, 22 bp, Homo sapiens
cccaaccagaaattgacagaca

SEQ ID NO: 9486688 - DNA, 22 bp, Homo sapiens
cccaaagggtgtcagcagcaag

SEQ ID NO: 9486689 - DNA, 22 bp, Homo sapiens
cccaaaggttgaggctgcagtg

SEQ ID NO: 9486690 - DNA, 22 bp, Homo sapiens
cccaaagggtgtcagcagcaag

SEQ ID NO: 9486691 - DNA, 22 bp, Homo sapiens
cccaacaacatgaaactaccta

SEQ ID NO: 9486692 - DNA, 22 bp, Homo sapiens
cccaacaacatgaaactaccta

SEQ ID NO: 9486693 - DNA, 22 bp, Homo sapiens
cccaacactcacctccggatta

SEQ ID NO: 9486694 - DNA, 22 bp, Homo sapiens
ccatttttaaagagcttaagta

SEQ ID NO: 9486695 - DNA, 22 bp, Homo sapiens
ccatttttcacaagactcactt

SEQ ID NO: 9486696 - DNA, 23 bp, Homo sapiens
ccattttgtgttttggagaaaca

SEQ ID NO: 9486697 - DNA, 22 bp, Homo sapiens
ccattgtaaattctgtggaagt

SEQ ID NO: 9486698 - DNA, 22 bp, Homo sapiens
ccatggccgccgctgctcagga

SEQ ID NO: 9486699 - DNA, 22 bp, Homo sapiens
cccaaaggcattttgctgacca

SEQ ID NO: 9486700 - DNA, 22 bp, Homo sapiens
cccaaaggcattttgctgacca

SEQ ID NO: 9486701 - DNA, 22 bp, Homo sapiens
cccaaaggaaggacaaggcaga

SEQ ID NO: 9486702 - DNA, 22 bp, Homo sapiens
ccatttttgacagaaggcctaa

SEQ ID NO: 9486703 - DNA, 22 bp, Homo sapiens
cccaaaatgtgcatgttcgaat

SEQ ID NO: 9486704 - DNA, 22 bp, Homo sapiens
cccaaaatgtgcatgttcgaat

SEQ ID NO: 9486705 - DNA, 22 bp, Homo sapiens
ccatttttcataaactatccaa

SEQ ID NO: 9486706 - DNA, 20 bp, Homo sapiens
ccatggccacatctgtgctg

SEQ ID NO: 9486707 - DNA, 20 bp, Homo sapiens
ccatggccacatctgtgctg

SEQ ID NO: 9486708 - DNA, 22 bp, Homo sapiens
ccatggagcgggtgagtgagtg

SEQ ID NO: 9486709 - DNA, 22 bp, Homo sapiens
ccatggagcgggtgagtgagtg

SEQ ID NO: 9486710 - DNA, 22 bp, Homo sapiens
ccatggcagccatgggagccac

SEQ ID NO: 9486711 - DNA, 22 bp, Homo sapiens
ccagtgtgggctggtggaggac

SEQ ID NO: 9486712 - DNA, 22 bp, Homo sapiens
ccagtgtgggcccggcctcctc

SEQ ID NO: 9486713 - DNA, 22 bp, Homo sapiens
ccagtgtggccaggtgctggta

SEQ ID NO: 9486714 - DNA, 23 bp, Homo sapiens
ccagtgtggtaggtccacaggtg

SEQ ID NO: 9486715 - DNA, 22 bp, Homo sapiens
ccagtgtggtaggtccacaggt

SEQ ID NO: 9486716 - DNA, 22 bp, Homo sapiens
ccagtgtggtaggtccacaggt

SEQ ID NO: 9486717 - DNA, 22 bp, Homo sapiens
ccagtgtgttccctgcctcact

SEQ ID NO: 9486718 - DNA, 22 bp, Homo sapiens
ccagtgtgtttttctctgactc

SEQ ID NO: 9486719 - DNA, 22 bp, Homo sapiens
tgaggcagtattttagtgactt

SEQ ID NO: 9486720 - DNA, 18 bp, Homo sapiens
tgaggcagtcagtgatgg

SEQ ID NO: 9486721 - DNA, 22 bp, Homo sapiens
tgaggcagtcaccccctcctgc

SEQ ID NO: 9486722 - DNA, 22 bp, Homo sapiens
tgatgaattagtaacaaatgag

SEQ ID NO: 9486723 - DNA, 22 bp, Homo sapiens
tgatgaattagtaacaaatgag

SEQ ID NO: 9486724 - DNA, 22 bp, Homo sapiens
tgatgaattggaaattctgatt

SEQ ID NO: 9486725 - DNA, 22 bp, Homo sapiens
tgatgacaaactttcctgatgc

SEQ ID NO: 9486726 - DNA, 22 bp, Homo sapiens
tgatgacagtgttacagctcca

SEQ ID NO: 9486727 - DNA, 22 bp, Homo sapiens
tgatacagtcagctcacaattg

SEQ ID NO: 9486728 - DNA, 18 bp, Homo sapiens
tgaggcagtcagtgatgg

SEQ ID NO: 9486729 - DNA, 22 bp, Homo sapiens
tgatgagagaggtcattgaaat

SEQ ID NO: 9486730 - DNA, 22 bp, Homo sapiens
tgatgaggagactgtggcttgg

SEQ ID NO: 9486731 - DNA, 22 bp, Homo sapiens
tgatgaggcatatgctacacat

SEQ ID NO: 9486732 - DNA, 21 bp, Homo sapiens
tgatgaggtcatagcaccctc

SEQ ID NO: 9486733 - DNA, 19 bp, Homo sapiens
ccatggagagagatgcatt

SEQ ID NO: 9486734 - DNA, 19 bp, Homo sapiens
ccatggagagagatgcatt

SEQ ID NO: 9486735 - DNA, 22 bp, Homo sapiens
tgatgaggggctcagaggtcag

SEQ ID NO: 9486736 - DNA, 22 bp, Homo sapiens
tgatgagggcagttcttgttgc

SEQ ID NO: 9486737 - DNA, 22 bp, Homo sapiens
tgaaagcattagtctaaggtag

SEQ ID NO: 9486738 - DNA, 22 bp, Homo sapiens
tgaaagctgtacatgtggtaca

SEQ ID NO: 9486739 - DNA, 22 bp, Homo sapiens
tgaaagcatatgctaaagacca

SEQ ID NO: 9486740 - DNA, 22 bp, Homo sapiens
tgaaagcagtgccatgattatg

SEQ ID NO: 9486741 - DNA, 22 bp, Homo sapiens
tgaaagcatgcttgccaagctt

SEQ ID NO: 9486742 - DNA, 22 bp, Homo sapiens
tgaaagcatgcttgccaagctt

SEQ ID NO: 9486743 - DNA, 22 bp, Homo sapiens
tgaaagcagtgatttctccttc

SEQ ID NO: 9486744 - DNA, 22 bp, Homo sapiens
tgaaagcaggcgggctacttta

SEQ ID NO: 9486745 - DNA, 22 bp, Homo sapiens
tgaaagcagtgccatgattatg

SEQ ID NO: 9486746 - DNA, 22 bp, Homo sapiens
tgaaagcagcaccaataccatt

SEQ ID NO: 9486747 - DNA, 22 bp, Homo sapiens
tgaaagcagatagctctgttgt

SEQ ID NO: 9486748 - DNA, 22 bp, Homo sapiens
tgaaagcactgattctcaactc

SEQ ID NO: 9486749 - DNA, 22 bp, Homo sapiens
tgaaacagctatcagtagactg

SEQ ID NO: 9486750 - DNA, 22 bp, Homo sapiens
ccaggctcctcatgatcttgtt

SEQ ID NO: 9486751 - DNA, 22 bp, Homo sapiens
ccaggctcctcatgatcttgtt

SEQ ID NO: 9486752 - DNA, 22 bp, Homo sapiens
ccaggctccgcatagaccccac

SEQ ID NO: 9486753 - DNA, 22 bp, Homo sapiens
ccaggctccgcatagaccccac

SEQ ID NO: 9486754 - DNA, 22 bp, Homo sapiens
ccaggctccccaggaggccctt

SEQ ID NO: 9486755 - DNA, 22 bp, Homo sapiens
tgaacacacacctatgtacaaa

SEQ ID NO: 9486756 - DNA, 22 bp, Homo sapiens
ccaggctgctcacaagctgccc

SEQ ID NO: 9486757 - DNA, 22 bp, Homo sapiens
tgaaatgattatatggtgtttg

SEQ ID NO: 9486758 - DNA, 22 bp, Homo sapiens
ccaggctgctcacaagctgccc

SEQ ID NO: 9486759 - DNA, 22 bp, Homo sapiens
tgaacacagttctgatgagctt

SEQ ID NO: 9486760 - DNA, 22 bp, Homo sapiens
tgaacacataaggctttcctgt

SEQ ID NO: 9486761 - DNA, 22 bp, Homo sapiens
tgaacacagggccaaacttgag

SEQ ID NO: 9486762 - DNA, 22 bp, Homo sapiens
tgaacacagcatattttgttac

SEQ ID NO: 9486763 - DNA, 18 bp, Homo sapiens
tgaacacagtacaattcc

SEQ ID NO: 9486764 - DNA, 22 bp, Homo sapiens
ccaggctgccgaggaaagaaag

SEQ ID NO: 9486765 - DNA, 22 bp, Homo sapiens
ccaggctgccgaggaaagaaag

SEQ ID NO: 9486766 - DNA, 22 bp, Homo sapiens
ccaggctgcagtcaaggggcat

SEQ ID NO: 9486767 - DNA, 22 bp, Homo sapiens
ccaggctgcagtcaaggggcat

SEQ ID NO: 9486768 - DNA, 22 bp, Homo sapiens
ccaggctgcagtcaaggggcat

SEQ ID NO: 9486769 - DNA, 22 bp, Homo sapiens
ccaggctgcagtcaaggggcat

SEQ ID NO: 9486770 - DNA, 22 bp, Homo sapiens
tgaaagggaacctgctggactg

SEQ ID NO: 9486771 - DNA, 22 bp, Homo sapiens
ccaggctgagcatgattggagc

SEQ ID NO: 9486772 - DNA, 22 bp, Homo sapiens
ccaggctgagcatgattggagc

SEQ ID NO: 9486773 - DNA, 22 bp, Homo sapiens
ccaggctgagcatgattggagc

SEQ ID NO: 9486774 - DNA, 22 bp, Homo sapiens
ccaggctgcagtcaaggggcat

SEQ ID NO: 9486775 - DNA, 22 bp, Homo sapiens
tgaagctttaggatgggttcat

SEQ ID NO: 9486776 - DNA, 22 bp, Homo sapiens
tgaagctttaggatgggttcat

SEQ ID NO: 9486777 - DNA, 22 bp, Homo sapiens
tgaagctttaggatgggttcat

SEQ ID NO: 9486778 - DNA, 22 bp, Homo sapiens
tgaagatttaagcatctcaatt

SEQ ID NO: 9486779 - DNA, 22 bp, Homo sapiens
tgaaggaaagagggaacatccc

SEQ ID NO: 9486780 - DNA, 22 bp, Homo sapiens
tgaaggaaagagggaacatccc

SEQ ID NO: 9486781 - DNA, 22 bp, Homo sapiens
tgaagctttaggatgggttcat

SEQ ID NO: 9486782 - DNA, 22 bp, Homo sapiens
tgaagctttcctgtggtcagga

SEQ ID NO: 9486783 - DNA, 22 bp, Homo sapiens
tgaagatctgtcaaccccatat

SEQ ID NO: 9486784 - DNA, 17 bp, Homo sapiens
tgaagatgcatggcagc

SEQ ID NO: 9486785 - DNA, 22 bp, Homo sapiens
tgaagatattttaaaatactga

SEQ ID NO: 9486786 - DNA, 22 bp, Homo sapiens
tgaagataacagtaaggtattg

SEQ ID NO: 9486787 - DNA, 17 bp, Homo sapiens
tgaagatgcatggcagc

SEQ ID NO: 9486788 - DNA, 17 bp, Homo sapiens
tgaagatgcatggcagc

SEQ ID NO: 9486789 - DNA, 22 bp, Homo sapiens
tgaagatctgtcaaccccatat

SEQ ID NO: 9486790 - DNA, 22 bp, Homo sapiens
tgaaggaagaataggcagtgtt

SEQ ID NO: 9486791 - DNA, 22 bp, Homo sapiens
tgaaggaagaataggcagtgtt

SEQ ID NO: 9486792 - DNA, 22 bp, Homo sapiens
tgaaggaaatgacggcagaaga

SEQ ID NO: 9486793 - DNA, 22 bp, Homo sapiens
tgaaggaagaataggcagtgtt

SEQ ID NO: 9486794 - DNA, 17 bp, Homo sapiens
tgaaggaaggatgatgt

SEQ ID NO: 9486795 - DNA, 17 bp, Homo sapiens
tgaaggaaggatgatgt

SEQ ID NO: 9486796 - DNA, 22 bp, Homo sapiens
tgaaggaatgagggagtgggtc

SEQ ID NO: 9486797 - DNA, 22 bp, Homo sapiens
tgaaggaatgagggagtgggtc

SEQ ID NO: 9486798 - DNA, 22 bp, Homo sapiens
tgaaggacagcagtggctccaa

SEQ ID NO: 9486799 - DNA, 22 bp, Homo sapiens
tgaaggagaaatggaaagtggg

SEQ ID NO: 9486800 - DNA, 22 bp, Homo sapiens
tgaaggaatggaggatcagagc

SEQ ID NO: 9486801 - DNA, 22 bp, Homo sapiens
tgaaggaatgagtatactgttt

SEQ ID NO: 9486802 - DNA, 22 bp, Homo sapiens
tgaaggaatgagtatactgttt

SEQ ID NO: 9486803 - DNA, 22 bp, Homo sapiens
tgaagagatagaagtacatgct

SEQ ID NO: 9486804 - DNA, 22 bp, Homo sapiens
tgaagagatagaagtacatgct

SEQ ID NO: 9486805 - DNA, 22 bp, Homo sapiens
tgaagagaagaaaattatcttt

SEQ ID NO: 9486806 - DNA, 22 bp, Homo sapiens
tgaagagaagaaaattatcttt

SEQ ID NO: 9486807 - DNA, 22 bp, Homo sapiens
tgaagagatagaagtacatgct

SEQ ID NO: 9486808 - DNA, 22 bp, Homo sapiens
tgaagagattaagttggttttg

SEQ ID NO: 9486809 - DNA, 23 bp, Homo sapiens
tgaacagtatgtgggacattgag

SEQ ID NO: 9486810 - DNA, 22 bp, Homo sapiens
tgaagagtgcttgagattttaa

SEQ ID NO: 9486811 - DNA, 22 bp, Homo sapiens
tgaagaggccgtgtgcaggtga

SEQ ID NO: 9486812 - DNA, 22 bp, Homo sapiens
tgaagaggccgtgtgcaggtga

SEQ ID NO: 9486813 - DNA, 22 bp, Homo sapiens
tgaagaggccaaactatcattg

SEQ ID NO: 9486814 - DNA, 22 bp, Homo sapiens
tgaagagattaagttggttttg

SEQ ID NO: 9486815 - DNA, 20 bp, Homo sapiens
tgaagaggaagaggacggcc

SEQ ID NO: 9486816 - DNA, 20 bp, Homo sapiens
tgaagaggaagaggacggcc

SEQ ID NO: 9486817 - DNA, 22 bp, Homo sapiens
tgaacagactgacctctgacct

SEQ ID NO: 9486818 - DNA, 19 bp, Homo sapiens
tgaacagagaggactctgg

SEQ ID NO: 9486819 - DNA, 22 bp, Homo sapiens
tgaacacattttcttcagtaga

SEQ ID NO: 9486820 - DNA, 18 bp, Homo sapiens
tgaacagatgagttgaag

SEQ ID NO: 9486821 - DNA, 22 bp, Homo sapiens
tgaacagatgtggaggtacctt

SEQ ID NO: 9486822 - DNA, 21 bp, Homo sapiens
tcttgtgtgggaaacaatttg

SEQ ID NO: 9486823 - DNA, 22 bp, Homo sapiens
tcttgtctgcagatactttgaa

SEQ ID NO: 9486824 - DNA, 22 bp, Homo sapiens
tcttgtcctaagagctggattc

SEQ ID NO: 9486825 - DNA, 22 bp, Homo sapiens
tcttgttaaagtgaagatactg

SEQ ID NO: 9486826 - DNA, 22 bp, Homo sapiens
tcttgtgtggtggaagatatgg

SEQ ID NO: 9486827 - DNA, 22 bp, Homo sapiens
tcttgtttctgtatataatgac

SEQ ID NO: 9486828 - DNA, 22 bp, Homo sapiens
tctttaaagttggagcttgcaa

SEQ ID NO: 9486829 - DNA, 22 bp, Homo sapiens
tctttaaagttggagcttgcaa

SEQ ID NO: 9486830 - DNA, 22 bp, Homo sapiens
tctttaaagttggagcttgcaa

SEQ ID NO: 9486831 - DNA, 21 bp, Homo sapiens
ccagcctcagatcagggagct

SEQ ID NO: 9486832 - DNA, 21 bp, Homo sapiens
ccagcctcagatcagggagct

SEQ ID NO: 9486833 - DNA, 21 bp, Homo sapiens
ccagcctcagatcagggagct

SEQ ID NO: 9486834 - DNA, 18 bp, Homo sapiens
tcttgcctgcaccctctc

SEQ ID NO: 9486835 - DNA, 21 bp, Homo sapiens
ccagcctcagatcagggagct

SEQ ID NO: 9486836 - DNA, 21 bp, Homo sapiens
ccagcctcagatcagggagct

SEQ ID NO: 9486837 - DNA, 21 bp, Homo sapiens
ccagcctcagatcagggagct

SEQ ID NO: 9486838 - DNA, 22 bp, Homo sapiens
ccagcctcactggcatcaccta

SEQ ID NO: 9486839 - DNA, 22 bp, Homo sapiens
ccagcctcactggcatcaccta

SEQ ID NO: 9486840 - DNA, 21 bp, Homo sapiens
tcttggggaggagggctgcac

SEQ ID NO: 9486841 - DNA, 22 bp, Homo sapiens
tcttgggggactttggcatgga

SEQ ID NO: 9486842 - DNA, 21 bp, Homo sapiens
tcttggggaggagggctgcac

SEQ ID NO: 9486843 - DNA, 22 bp, Homo sapiens
tcttgggggactttggcatgga

SEQ ID NO: 9486844 - DNA, 22 bp, Homo sapiens
tcttgggggactttggcatgga

SEQ ID NO: 9486845 - DNA, 22 bp, Homo sapiens
tcttggggtagacctgagaatt

SEQ ID NO: 9486846 - DNA, 22 bp, Homo sapiens
tcttggggtagacctgagaatt

SEQ ID NO: 9486847 - DNA, 22 bp, Homo sapiens
tcttggtgcctcagaccttgtg

SEQ ID NO: 9486848 - DNA, 22 bp, Homo sapiens
ccagcctcactggcatcaccta

SEQ ID NO: 9486849 - DNA, 22 bp, Homo sapiens
ccagcctcactggcatcaccta

SEQ ID NO: 9486850 - DNA, 22 bp, Homo sapiens
ccagcctcactggcatcaccta

SEQ ID NO: 9486851 - DNA, 22 bp, Homo sapiens
ccagccgcggtgagggtggctg

SEQ ID NO: 9486852 - DNA, 22 bp, Homo sapiens
ccagccctttgtggttcactga

SEQ ID NO: 9486853 - DNA, 22 bp, Homo sapiens
ccagcctcactggcatcaccta

SEQ ID NO: 9486854 - DNA, 22 bp, Homo sapiens
ccagcccttgaggtctgtccat

SEQ ID NO: 9486855 - DNA, 22 bp, Homo sapiens
ccagcccttgctgaagggtggc

SEQ ID NO: 9486856 - DNA, 22 bp, Homo sapiens
ccagcccttgctgaagggtggc

SEQ ID NO: 9486857 - DNA, 22 bp, Homo sapiens
ccagccctttgtggttcactga

SEQ ID NO: 9486858 - DNA, 22 bp, Homo sapiens
ccagccctttgtggttcactga

SEQ ID NO: 9486859 - DNA, 22 bp, Homo sapiens
ccagcccttgagatggaaggga

SEQ ID NO: 9486860 - DNA, 22 bp, Homo sapiens
ccagcccttgagatggaaggga

SEQ ID NO: 9486861 - DNA, 22 bp, Homo sapiens
ccagcccttgaggtctgtccat

SEQ ID NO: 9486862 - DNA, 22 bp, Homo sapiens
ccagcccttgaggtctgtccat

SEQ ID NO: 9486863 - DNA, 22 bp, Homo sapiens
ccagcccttgaggtctgtccat

SEQ ID NO: 9486864 - DNA, 22 bp, Homo sapiens
tctgcagatccctttagtgagg

SEQ ID NO: 9486865 - DNA, 22 bp, Homo sapiens
tctgcagaggtaatttacagat

SEQ ID NO: 9486866 - DNA, 22 bp, Homo sapiens
tctgcagaggtaatttacagat

SEQ ID NO: 9486867 - DNA, 22 bp, Homo sapiens
tctgcagagcattatagcaaaa

SEQ ID NO: 9486868 - DNA, 22 bp, Homo sapiens
tctgcagacttgcctaagtgtg

SEQ ID NO: 9486869 - DNA, 22 bp, Homo sapiens
tctgcagagacaaagtgttatt

SEQ ID NO: 9486870 - DNA, 22 bp, Homo sapiens
tctgcagagggagtgctgggtc

SEQ ID NO: 9486871 - DNA, 19 bp, Homo sapiens
tctgcagaggaattcttca

SEQ ID NO: 9486872 - DNA, 22 bp, Homo sapiens
tctgcagagcctcaggagaaca

SEQ ID NO: 9486873 - DNA, 22 bp, Homo sapiens
tctgcagacaggaagctgaggc

SEQ ID NO: 9486874 - DNA, 23 bp, Homo sapiens
tctgcagacgctgttctattgtc

SEQ ID NO: 9486875 - DNA, 22 bp, Homo sapiens
tctgcagacttgataaccactg

SEQ ID NO: 9486876 - DNA, 22 bp, Homo sapiens
tctgcagacttgataaccactg

SEQ ID NO: 9486877 - DNA, 22 bp, Homo sapiens
tctgcagacaggaagctgaggc

SEQ ID NO: 9486878 - DNA, 22 bp, Homo sapiens
tctgcagacaggaagctgaggc

SEQ ID NO: 9486879 - DNA, 22 bp, Homo sapiens
tctttattttatgcttgtgcaa

SEQ ID NO: 9486880 - DNA, 22 bp, Homo sapiens
tctttattttatgcttgtgcaa

SEQ ID NO: 9486881 - DNA, 22 bp, Homo sapiens
tctttattttatgcttgtgcaa

SEQ ID NO: 9486882 - DNA, 22 bp, Homo sapiens
tctttattttatgcttgtgcaa

SEQ ID NO: 9486883 - DNA, 22 bp, Homo sapiens
tctttcaaagctgtagtagatt

SEQ ID NO: 9486884 - DNA, 22 bp, Homo sapiens
tctttcaaagcaaaatgaggct

SEQ ID NO: 9486885 - DNA, 19 bp, Homo sapiens
ccaggcctggcgtctccgc

SEQ ID NO: 9486886 - DNA, 19 bp, Homo sapiens
ccaggcctggcgtctccgc

SEQ ID NO: 9486887 - DNA, 22 bp, Homo sapiens
tctttcaaagctgtagtagatt

SEQ ID NO: 9486888 - DNA, 23 bp, Homo sapiens
ccaggctaaatgttagagtctga

SEQ ID NO: 9486889 - DNA, 22 bp, Homo sapiens
tctttatttctgaatcccccat

SEQ ID NO: 9486890 - DNA, 22 bp, Homo sapiens
tctttatttctgaatcccccat

SEQ ID NO: 9486891 - DNA, 22 bp, Homo sapiens
tctttatttaagtctgttgtaa

SEQ ID NO: 9486892 - DNA, 22 bp, Homo sapiens
tctttatttctgaatcccccat

SEQ ID NO: 9486893 - DNA, 22 bp, Homo sapiens
tctttaagagttcatttgcatg

SEQ ID NO: 9486894 - DNA, 22 bp, Homo sapiens
ccaggctcagggcagactttca

SEQ ID NO: 9486895 - DNA, 22 bp, Homo sapiens
ccaggctcaggtgcgagagaca

SEQ ID NO: 9486896 - DNA, 17 bp, Homo sapiens
ccaggctccatcactgt

SEQ ID NO: 9486897 - DNA, 22 bp, Homo sapiens
ccaggctcaggtgcgagagaca

SEQ ID NO: 9486898 - DNA, 17 bp, Homo sapiens
ccaggctccatcactgt

SEQ ID NO: 9486899 - DNA, 17 bp, Homo sapiens
ccaggctccatcactgt

SEQ ID NO: 9486900 - DNA, 22 bp, Homo sapiens
ccaggctcaggcctgctcgttg

SEQ ID NO: 9486901 - DNA, 22 bp, Homo sapiens
ccaggctcagcgcgcacgtctg

SEQ ID NO: 9486902 - DNA, 22 bp, Homo sapiens
ccaggctcagctattaagaaac

SEQ ID NO: 9486903 - DNA, 22 bp, Homo sapiens
ccaggctagagtgcagtggcat

SEQ ID NO: 9486904 - DNA, 22 bp, Homo sapiens
ccaggctagagtgcaatggcat

SEQ ID NO: 9486905 - DNA, 22 bp, Homo sapiens
ccaggctagagagcagtggcat

SEQ ID NO: 9486906 - DNA, 22 bp, Homo sapiens
ccaggctagagagcagtggcac

SEQ ID NO: 9486907 - DNA, 22 bp, Homo sapiens
ccaggctcacagcatcccagga

SEQ ID NO: 9486908 - DNA, 22 bp, Homo sapiens
ccaggctagagtgcaatggcgc

SEQ ID NO: 9486909 - DNA, 22 bp, Homo sapiens
ccaggctagagtgcagtggcgt

SEQ ID NO: 9486910 - DNA, 22 bp, Homo sapiens
ccaggctcactgactaccacat

SEQ ID NO: 9486911 - DNA, 22 bp, Homo sapiens
ccaggctcactgactaccacat

SEQ ID NO: 9486912 - DNA, 22 bp, Homo sapiens
ccaggctcactgactaccacat

SEQ ID NO: 9486913 - DNA, 22 bp, Homo sapiens
ccaggctcacctggagcccctg

SEQ ID NO: 9486914 - DNA, 22 bp, Homo sapiens
ccaggctcacagcatcccagga

SEQ ID NO: 9486915 - DNA, 22 bp, Homo sapiens
ccagggccaagagacctcgagg

SEQ ID NO: 9486916 - DNA, 22 bp, Homo sapiens
ccagggcatgggaagaactgaa

SEQ ID NO: 9486917 - DNA, 22 bp, Homo sapiens
ccagggcatgtaactaatggtg

SEQ ID NO: 9486918 - DNA, 22 bp, Homo sapiens
ccagggcatgggaagaactgaa

SEQ ID NO: 9486919 - DNA, 22 bp, Homo sapiens
ccagggcatgggaagaactgaa

SEQ ID NO: 9486920 - DNA, 22 bp, Homo sapiens
ccagggcatgggaagaactgaa

SEQ ID NO: 9486921 - DNA, 22 bp, Homo sapiens
tgacagagtcggggcaagctgt

SEQ ID NO: 9486922 - DNA, 22 bp, Homo sapiens
tgacagagcatgtagtgacagc

SEQ ID NO: 9486923 - DNA, 22 bp, Homo sapiens
tgacagaggagctggaatgatt

SEQ ID NO: 9486924 - DNA, 22 bp, Homo sapiens
tgacagagctgggatttgaagc

SEQ ID NO: 9486925 - DNA, 22 bp, Homo sapiens
tgacagagcatgtagtgacagc

SEQ ID NO: 9486926 - DNA, 19 bp, Homo sapiens
tgacagagagcagggtggt

SEQ ID NO: 9486927 - DNA, 22 bp, Homo sapiens
tgacagagacttcagagccaaa

SEQ ID NO: 9486928 - DNA, 19 bp, Homo sapiens
tgacagagagcagggtggt

SEQ ID NO: 9486929 - DNA, 19 bp, Homo sapiens
tgacagagagcagggtggt

SEQ ID NO: 9486930 - DNA, 23 bp, Homo sapiens
tgacagagcacagtgggggagat

SEQ ID NO: 9486931 - DNA, 22 bp, Homo sapiens
tgacagagcaagatcttatctc

SEQ ID NO: 9486932 - DNA, 22 bp, Homo sapiens
tgacagagatggaatgaatctt

SEQ ID NO: 9486933 - DNA, 22 bp, Homo sapiens
tgacaattgcagacacagaagt

SEQ ID NO: 9486934 - DNA, 22 bp, Homo sapiens
tgacaatgggtggacaagatag

SEQ ID NO: 9486935 - DNA, 22 bp, Homo sapiens
tgacaatgggtggacaagatag

SEQ ID NO: 9486936 - DNA, 22 bp, Homo sapiens
tgacagagacagattgaagctt

SEQ ID NO: 9486937 - DNA, 22 bp, Homo sapiens
ccagggaagaaagatgaagtgc

SEQ ID NO: 9486938 - DNA, 22 bp, Homo sapiens
ccagggaagaccacttcctgga

SEQ ID NO: 9486939 - DNA, 21 bp, Homo sapiens
ccagggaagaaatgagggcag

SEQ ID NO: 9486940 - DNA, 22 bp, Homo sapiens
ccagggaaaggaggttgacttg

SEQ ID NO: 9486941 - DNA, 22 bp, Homo sapiens
ccagggaaactttggagtggag

SEQ ID NO: 9486942 - DNA, 22 bp, Homo sapiens
ccagggaagaaagatgaagtgc

SEQ ID NO: 9486943 - DNA, 22 bp, Homo sapiens
ccagggaagaaagatgaagtgc

SEQ ID NO: 9486944 - DNA, 22 bp, Homo sapiens
ccagggaaattaatgagttaat

SEQ ID NO: 9486945 - DNA, 19 bp, Homo sapiens
ccaggctttatgcaaatac

SEQ ID NO: 9486946 - DNA, 22 bp, Homo sapiens
ccaggctttaagaggtggaaac

SEQ ID NO: 9486947 - DNA, 19 bp, Homo sapiens
ccaggctttatgcaaatac

SEQ ID NO: 9486948 - DNA, 22 bp, Homo sapiens
ccaggcttggtgtgtggtcagg

SEQ ID NO: 9486949 - DNA, 22 bp, Homo sapiens
ccaggcttttagctgcatggca

SEQ ID NO: 9486950 - DNA, 22 bp, Homo sapiens
ccaggcttttctcatggagtca

SEQ ID NO: 9486951 - DNA, 22 bp, Homo sapiens
ccagggaaaatcaacttctact

SEQ ID NO: 9486952 - DNA, 22 bp, Homo sapiens
ccagggaaacagcccagtgtga

SEQ ID NO: 9486953 - DNA, 22 bp, Homo sapiens
ccaggctttcccagcctctcca

SEQ ID NO: 9486954 - DNA, 22 bp, Homo sapiens
ccaggctttctcctgactcaca

SEQ ID NO: 9486955 - DNA, 22 bp, Homo sapiens
tgaccaggctggagtgcagtgg

SEQ ID NO: 9486956 - DNA, 22 bp, Homo sapiens
tgaccaggatactgcagggatg

SEQ ID NO: 9486957 - DNA, 22 bp, Homo sapiens
tgaccaggatactgcagggatg

SEQ ID NO: 9486958 - DNA, 22 bp, Homo sapiens
tgaccagacatcaatttcaaag

SEQ ID NO: 9486959 - DNA, 22 bp, Homo sapiens
tgacccatcaggccacatgagg

SEQ ID NO: 9486960 - DNA, 22 bp, Homo sapiens
tgacccaggtgagctgtgacca

SEQ ID NO: 9486961 - DNA, 22 bp, Homo sapiens
tgacccaagggcttagcagttt

SEQ ID NO: 9486962 - DNA, 22 bp, Homo sapiens
tgaccatttgatctacattcca

SEQ ID NO: 9486963 - DNA, 22 bp, Homo sapiens
tgaccatggcacatgtttgcct

SEQ ID NO: 9486964 - DNA, 22 bp, Homo sapiens
tgaccaaagactttagatgttc

SEQ ID NO: 9486965 - DNA, 22 bp, Homo sapiens
tgaccaaaggtggtttatttgg

SEQ ID NO: 9486966 - DNA, 22 bp, Homo sapiens
tgaccaaggacagtcacgctgt

SEQ ID NO: 9486967 - DNA, 22 bp, Homo sapiens
tgaccaaagagttgcttgtatt

SEQ ID NO: 9486968 - DNA, 22 bp, Homo sapiens
tgaccacacgtctggaattgtg

SEQ ID NO: 9486969 - DNA, 22 bp, Homo sapiens
tgaccactgacctcagccctgg

SEQ ID NO: 9486970 - DNA, 22 bp, Homo sapiens
tgaccactgaaaacatggctag

SEQ ID NO: 9486971 - DNA, 22 bp, Homo sapiens
ccagggccagtaagattggcat

SEQ ID NO: 9486972 - DNA, 22 bp, Homo sapiens
ccagggccagtaagattggcat

SEQ ID NO: 9486973 - DNA, 23 bp, Homo sapiens
ccagggcccctacaccactgtcc

SEQ ID NO: 9486974 - DNA, 22 bp, Homo sapiens
ccagggcccacggccagaatag

SEQ ID NO: 9486975 - DNA, 23 bp, Homo sapiens
ccagggcccctacaccactgtcc

SEQ ID NO: 9486976 - DNA, 22 bp, Homo sapiens
tgacatttttataagagtcaaa

SEQ ID NO: 9486977 - DNA, 22 bp, Homo sapiens
tgacatttttgtacaaagtcag

SEQ ID NO: 9486978 - DNA, 22 bp, Homo sapiens
tgacttttggacctcactgtcc

SEQ ID NO: 9486979 - DNA, 22 bp, Homo sapiens
tgagaaaacagtttgtaataat

SEQ ID NO: 9486980 - DNA, 22 bp, Homo sapiens
tgagaaaacagtttgtaataat

SEQ ID NO: 9486981 - DNA, 22 bp, Homo sapiens
tgagaaaactcaaagacagatc

SEQ ID NO: 9486982 - DNA, 22 bp, Homo sapiens
tgagaaaacagtttgtaataat

SEQ ID NO: 9486983 - DNA, 22 bp, Homo sapiens
tgagaaaacagtttgtaataat

SEQ ID NO: 9486984 - DNA, 22 bp, Homo sapiens
tgagaaaacagtttgtaataat

SEQ ID NO: 9486985 - DNA, 22 bp, Homo sapiens
ccagggtggaggctggatggag

SEQ ID NO: 9486986 - DNA, 22 bp, Homo sapiens
ccagggtcttcgaggcagcaat

SEQ ID NO: 9486987 - DNA, 22 bp, Homo sapiens
ccagggtggaggctggatggag

SEQ ID NO: 9486988 - DNA, 22 bp, Homo sapiens
ccagggtctctgctgcctgaga

SEQ ID NO: 9486989 - DNA, 22 bp, Homo sapiens
ccagggtctctgctgcctgaga

SEQ ID NO: 9486990 - DNA, 22 bp, Homo sapiens
tgagaaaaggttgagatgataa

SEQ ID NO: 9486991 - DNA, 17 bp, Homo sapiens
tgactttatttgcttgg

SEQ ID NO: 9486992 - DNA, 21 bp, Homo sapiens
tgaccctcccagccctgccaa

SEQ ID NO: 9486993 - DNA, 22 bp, Homo sapiens
tgaccctgcttcttggtgcagg

SEQ ID NO: 9486994 - DNA, 21 bp, Homo sapiens
tgagctgggagttctgaaaag

SEQ ID NO: 9486995 - DNA, 22 bp, Homo sapiens
tgagctgggagtggtgatgagg

SEQ ID NO: 9486996 - DNA, 22 bp, Homo sapiens
tgagctgggagtggtgatgagg

SEQ ID NO: 9486997 - DNA, 22 bp, Homo sapiens
tgagctgggaagagcagccaga

SEQ ID NO: 9486998 - DNA, 22 bp, Homo sapiens
tgagctgggaagagcagccaga

SEQ ID NO: 9486999 - DNA, 19 bp, Homo sapiens
tgagctggctgagcctctc

SEQ ID NO: 9487000 - DNA, 22 bp, Homo sapiens
tgagctggcacttttcctggga

SEQ ID NO: 9487001 - DNA, 22 bp, Homo sapiens
tgagctggcacttttcctggga

SEQ ID NO: 9487002 - DNA, 19 bp, Homo sapiens
tgagctggctgagcctctc

SEQ ID NO: 9487003 - DNA, 22 bp, Homo sapiens
tgagctggcaggggctcaggga

SEQ ID NO: 9487004 - DNA, 22 bp, Homo sapiens
tgagctggcaggggctcaggga

SEQ ID NO: 9487005 - DNA, 22 bp, Homo sapiens
tgagcagaacacgggatccatg

SEQ ID NO: 9487006 - DNA, 22 bp, Homo sapiens
tgagcagaacacgggatccatg

SEQ ID NO: 9487007 - DNA, 22 bp, Homo sapiens
tgagcagaagattggaacttac

SEQ ID NO: 9487008 - DNA, 22 bp, Homo sapiens
tgagcagaagccctcctggact

SEQ ID NO: 9487009 - DNA, 22 bp, Homo sapiens
tgagcagaagccctcctggact

SEQ ID NO: 9487010 - DNA, 22 bp, Homo sapiens
tgagcagaaaagaatgctgagc

SEQ ID NO: 9487011 - DNA, 22 bp, Homo sapiens
tgagcagaaaagaatgctgagc

SEQ ID NO: 9487012 - DNA, 22 bp, Homo sapiens
tgagcagaaaagaatgctgagc

SEQ ID NO: 9487013 - DNA, 22 bp, Homo sapiens
tgagcagaacacgggatccatg

SEQ ID NO: 9487014 - DNA, 21 bp, Homo sapiens
tgagcaccttcttatattttg

SEQ ID NO: 9487015 - DNA, 22 bp, Homo sapiens
tgagcaccttgtgactggctgc

SEQ ID NO: 9487016 - DNA, 22 bp, Homo sapiens
tgagcagaaaagaatgctgagc

SEQ ID NO: 9487017 - DNA, 22 bp, Homo sapiens
tgagcccaggagttggagaccg

SEQ ID NO: 9487018 - DNA, 22 bp, Homo sapiens
tgagcagacttgatgaggcagc

SEQ ID NO: 9487019 - DNA, 22 bp, Homo sapiens
tgagcagacttgatgaggcagc

SEQ ID NO: 9487020 - DNA, 22 bp, Homo sapiens
tgagcagacttgatgaggcagc

SEQ ID NO: 9487021 - DNA, 22 bp, Homo sapiens
tgagcagactctgcagagccac

SEQ ID NO: 9487022 - DNA, 22 bp, Homo sapiens
tgagcagaatgttcagataaat

SEQ ID NO: 9487023 - DNA, 22 bp, Homo sapiens
tgagcagaagttataaataaga

SEQ ID NO: 9487024 - DNA, 22 bp, Homo sapiens
tgagcagaagttataaataaga

SEQ ID NO: 9487025 - DNA, 22 bp, Homo sapiens
ccagtgggaacactggcattgc

SEQ ID NO: 9487026 - DNA, 22 bp, Homo sapiens
ccagtgtgccaatttacagctg

SEQ ID NO: 9487027 - DNA, 22 bp, Homo sapiens
tgaggacattggtcaggacatg

SEQ ID NO: 9487028 - DNA, 22 bp, Homo sapiens
tgaggacattggtcaggacatg

SEQ ID NO: 9487029 - DNA, 22 bp, Homo sapiens
tgaggacatttatcttggcgca

SEQ ID NO: 9487030 - DNA, 22 bp, Homo sapiens
tgaggacattaggaagtgaagg

SEQ ID NO: 9487031 - DNA, 22 bp, Homo sapiens
tgaggacattgagactggagac

SEQ ID NO: 9487032 - DNA, 22 bp, Homo sapiens
tgaggacattgagactggagac

SEQ ID NO: 9487033 - DNA, 22 bp, Homo sapiens
tgaggacattgagactggagac

SEQ ID NO: 9487034 - DNA, 22 bp, Homo sapiens
tgaggacattgagactggagac

SEQ ID NO: 9487035 - DNA, 22 bp, Homo sapiens
tgaggacattgagactggagac

SEQ ID NO: 9487036 - DNA, 22 bp, Homo sapiens
tgaggacattaggaagtgaagg

SEQ ID NO: 9487037 - DNA, 22 bp, Homo sapiens
tgaggacattaggaagtgaagg

SEQ ID NO: 9487038 - DNA, 22 bp, Homo sapiens
tgaggacatgagtgggacagag

SEQ ID NO: 9487039 - DNA, 22 bp, Homo sapiens
tgaggacatgagtgggacagag

SEQ ID NO: 9487040 - DNA, 22 bp, Homo sapiens
tgaggacatgagtgggacagag

SEQ ID NO: 9487041 - DNA, 22 bp, Homo sapiens
tgaggacatgagtgggacagag

SEQ ID NO: 9487042 - DNA, 23 bp, Homo sapiens
tgagctgggcctgcaggggtctc

SEQ ID NO: 9487043 - DNA, 22 bp, Homo sapiens
tgagctgggctgggctgagctg

SEQ ID NO: 9487044 - DNA, 23 bp, Homo sapiens
tgagctgggcctgcaggggtctc

SEQ ID NO: 9487045 - DNA, 22 bp, Homo sapiens
tgagctgggctgggctgagctg

SEQ ID NO: 9487046 - DNA, 22 bp, Homo sapiens
tgagctgggctgggctgagctg

SEQ ID NO: 9487047 - DNA, 22 bp, Homo sapiens
tgagctgggctgggctgagctg

SEQ ID NO: 9487048 - DNA, 22 bp, Homo sapiens
tgagctgggctgggctgagctg

SEQ ID NO: 9487049 - DNA, 22 bp, Homo sapiens
tgagctggggtcagctcccctg

SEQ ID NO: 9487050 - DNA, 22 bp, Homo sapiens
tgagctggggtcagctcccctg

SEQ ID NO: 9487051 - DNA, 22 bp, Homo sapiens
tgaggaagttgtttctcttcta

SEQ ID NO: 9487052 - DNA, 22 bp, Homo sapiens
tgaggaatgctgagcagaggaa

SEQ ID NO: 9487053 - DNA, 22 bp, Homo sapiens
tgaggaagttgtttctcttcta

SEQ ID NO: 9487054 - DNA, 22 bp, Homo sapiens
tgaggaagttgtttctcttcta

SEQ ID NO: 9487055 - DNA, 23 bp, Homo sapiens
tgagctggtattgtccatctcca

SEQ ID NO: 9487056 - DNA, 22 bp, Homo sapiens
tgaggacaatccctaactcaga

SEQ ID NO: 9487057 - DNA, 22 bp, Homo sapiens
tgaggaatgctgagcagaggaa

SEQ ID NO: 9487058 - DNA, 22 bp, Homo sapiens
tgaggaatgctgagcagaggaa

SEQ ID NO: 9487059 - DNA, 22 bp, Homo sapiens
tgaggaatgttttgagtgccga

SEQ ID NO: 9487060 - DNA, 22 bp, Homo sapiens
tgaggaatggcttaatgtggga

SEQ ID NO: 9487061 - DNA, 22 bp, Homo sapiens
tgagcacctaccttgtccagtg

SEQ ID NO: 9487062 - DNA, 21 bp, Homo sapiens
tgagcacctactatgtgtcag

SEQ ID NO: 9487063 - DNA, 22 bp, Homo sapiens
tgagcacctactagaatgctaa

SEQ ID NO: 9487064 - DNA, 22 bp, Homo sapiens
tgagcacctactgtattccagg

SEQ ID NO: 9487065 - DNA, 22 bp, Homo sapiens
tgagcacctggaccagattctg

SEQ ID NO: 9487066 - DNA, 20 bp, Homo sapiens
tgagcacctgggtgttctgg

SEQ ID NO: 9487067 - DNA, 22 bp, Homo sapiens
tgagcaccttctctcatttccc

SEQ ID NO: 9487068 - DNA, 19 bp, Homo sapiens
tgagcaccttctcacgtaa

SEQ ID NO: 9487069 - DNA, 22 bp, Homo sapiens
tgagcacctccctgacagtggg

SEQ ID NO: 9487070 - DNA, 22 bp, Homo sapiens
tgagcacctggaccagattctg

SEQ ID NO: 9487071 - DNA, 22 bp, Homo sapiens
tgagcacctactgtattccagg

SEQ ID NO: 9487072 - DNA, 22 bp, Homo sapiens
tgagcaccatctgtttgtgtgc

SEQ ID NO: 9487073 - DNA, 22 bp, Homo sapiens
tgagcaccctctggaaaatggg

SEQ ID NO: 9487074 - DNA, 23 bp, Homo sapiens
tgagcacctaatgctgggcactg

SEQ ID NO: 9487075 - DNA, 23 bp, Homo sapiens
tgagcacctaatgctgggcactg

SEQ ID NO: 9487076 - DNA, 23 bp, Homo sapiens
tgagcacctacctggagccaagc

SEQ ID NO: 9487077 - DNA, 22 bp, Homo sapiens
tgagcaccgccgcatttccaag

SEQ ID NO: 9487078 - DNA, 22 bp, Homo sapiens
tgagataaggatgttatactcg

SEQ ID NO: 9487079 - DNA, 22 bp, Homo sapiens
tgagataataaatagctttctt

SEQ ID NO: 9487080 - DNA, 22 bp, Homo sapiens
tgagataataaacatctcctta

SEQ ID NO: 9487081 - DNA, 22 bp, Homo sapiens
tgagagttcctcctctttccac

SEQ ID NO: 9487082 - DNA, 22 bp, Homo sapiens
tgagagttctctcttcaggtgg

SEQ ID NO: 9487083 - DNA, 22 bp, Homo sapiens
tgagagttttgacgcttgtaac

SEQ ID NO: 9487084 - DNA, 22 bp, Homo sapiens
tgagagttttgacgcttgtaac

SEQ ID NO: 9487085 - DNA, 21 bp, Homo sapiens
tgagataaatttccttactac

SEQ ID NO: 9487086 - DNA, 22 bp, Homo sapiens
tgagataacaaaattatcttca

SEQ ID NO: 9487087 - DNA, 22 bp, Homo sapiens
tgagataactattctgtcaact

SEQ ID NO: 9487088 - DNA, 22 bp, Homo sapiens
tgagataacatggaagagtagc

SEQ ID NO: 9487089 - DNA, 22 bp, Homo sapiens
tgagataactattctgtcaact

SEQ ID NO: 9487090 - DNA, 22 bp, Homo sapiens
tgagataacaaaattatcttca

SEQ ID NO: 9487091 - DNA, 22 bp, Homo sapiens
tgagataacaaaattatcttca

SEQ ID NO: 9487092 - DNA, 22 bp, Homo sapiens
tgagataagcaaggataaaggt

SEQ ID NO: 9487093 - DNA, 22 bp, Homo sapiens
tgagataagcaaggataaaggt

SEQ ID NO: 9487094 - DNA, 22 bp, Homo sapiens
tgagataactctgatttatgtt

SEQ ID NO: 9487095 - DNA, 19 bp, Homo sapiens
tgagactgggtgcagtact

SEQ ID NO: 9487096 - DNA, 22 bp, Homo sapiens
tgagagtagagtcttcatctgt

SEQ ID NO: 9487097 - DNA, 22 bp, Homo sapiens
tgagaggtgaggcatgaggcat

SEQ ID NO: 9487098 - DNA, 19 bp, Homo sapiens
tgagactgggtgcagtact

SEQ ID NO: 9487099 - DNA, 22 bp, Homo sapiens
ccaggtctatcaagttgggctc

SEQ ID NO: 9487100 - DNA, 22 bp, Homo sapiens
ccaggtcctgttttcaccacag

SEQ ID NO: 9487101 - DNA, 22 bp, Homo sapiens
ccaggtcctgttttcaccacag

SEQ ID NO: 9487102 - DNA, 22 bp, Homo sapiens
ccaggtcctgttttcaccacag

SEQ ID NO: 9487103 - DNA, 22 bp, Homo sapiens
tgagagtggttcagctcagaag

SEQ ID NO: 9487104 - DNA, 19 bp, Homo sapiens
tgagagtgaggaaggcttc

SEQ ID NO: 9487105 - DNA, 22 bp, Homo sapiens
tgagagtgaaatgtcacatgtc

SEQ ID NO: 9487106 - DNA, 22 bp, Homo sapiens
tgagagtattttggcattatca

SEQ ID NO: 9487107 - DNA, 22 bp, Homo sapiens
tgagagtattttggcattatca

SEQ ID NO: 9487108 - DNA, 22 bp, Homo sapiens
tgagagtattttggcattatca

SEQ ID NO: 9487109 - DNA, 22 bp, Homo sapiens
ccagggtgggaggctgaaggcg

SEQ ID NO: 9487110 - DNA, 22 bp, Homo sapiens
ccagggtgggaggctgaaggcg

SEQ ID NO: 9487111 - DNA, 22 bp, Homo sapiens
ccagggtggggcaggcccactg

SEQ ID NO: 9487112 - DNA, 22 bp, Homo sapiens
ccagggtgggaggctgaaggcg

SEQ ID NO: 9487113 - DNA, 22 bp, Homo sapiens
ccagggtggcgtagatgctggg

SEQ ID NO: 9487114 - DNA, 22 bp, Homo sapiens
ccagggtgggaggctgaaggcg

SEQ ID NO: 9487115 - DNA, 22 bp, Homo sapiens
ccagggtggcgtagatgctggg

SEQ ID NO: 9487116 - DNA, 22 bp, Homo sapiens
ccagggtggggtccaggaacca

SEQ ID NO: 9487117 - DNA, 22 bp, Homo sapiens
ccagggtggggtccaggaacca

SEQ ID NO: 9487118 - DNA, 22 bp, Homo sapiens
ccagggtggggcaggcccactg

SEQ ID NO: 9487119 - DNA, 22 bp, Homo sapiens
ccagggtggggtccaggaacca

SEQ ID NO: 9487120 - DNA, 22 bp, Homo sapiens
ccagggtgtagggattccagat

SEQ ID NO: 9487121 - DNA, 22 bp, Homo sapiens
ccagggtgtgagaaggaagtag

SEQ ID NO: 9487122 - DNA, 22 bp, Homo sapiens
ccagggttataaatgcatctgt

SEQ ID NO: 9487123 - DNA, 22 bp, Homo sapiens
ccagggtgtgggcgtcggcacg

SEQ ID NO: 9487124 - DNA, 22 bp, Homo sapiens
ccagggttgctttagattctga

SEQ ID NO: 9487125 - DNA, 22 bp, Homo sapiens
ccagggttgcagggagccagca

SEQ ID NO: 9487126 - DNA, 22 bp, Homo sapiens
ccaggtccctggaatttatgag

SEQ ID NO: 9487127 - DNA, 22 bp, Homo sapiens
ctggagcatccatgcccagggt

SEQ ID NO: 9487128 - DNA, 22 bp, Homo sapiens
ctggagcaggtttaggagtccc

SEQ ID NO: 9487129 - DNA, 22 bp, Homo sapiens
ctggagccccaggctgtgcaga

SEQ ID NO: 9487130 - DNA, 22 bp, Homo sapiens
ctggagccccaggctgtgcaga

SEQ ID NO: 9487131 - DNA, 22 bp, Homo sapiens
ctggagcaggtttaggagtccc

SEQ ID NO: 9487132 - DNA, 22 bp, Homo sapiens
ctggagcaggtttaggagtccc

SEQ ID NO: 9487133 - DNA, 22 bp, Homo sapiens
ctggagcaggtttaggagtccc

SEQ ID NO: 9487134 - DNA, 22 bp, Homo sapiens
ctggagcaggtttaggagtccc

SEQ ID NO: 9487135 - DNA, 22 bp, Homo sapiens
ctggagcaggcttgtcccagct

SEQ ID NO: 9487136 - DNA, 22 bp, Homo sapiens
ctggagcaggtttaggagtccc

SEQ ID NO: 9487137 - DNA, 22 bp, Homo sapiens
ctggagcagcaggtggccaggg

SEQ ID NO: 9487138 - DNA, 22 bp, Homo sapiens
ctggagcaggcttgtcccagct

SEQ ID NO: 9487139 - DNA, 22 bp, Homo sapiens
ctggagcctaggttgacctggg

SEQ ID NO: 9487140 - DNA, 22 bp, Homo sapiens
ctggagcctaggttgacctggg

SEQ ID NO: 9487141 - DNA, 17 bp, Homo sapiens
ctggagcctccaactcc

SEQ ID NO: 9487142 - DNA, 17 bp, Homo sapiens
ctggagcctccaactcc

SEQ ID NO: 9487143 - DNA, 22 bp, Homo sapiens
ctggagcctgcagttttcactt

SEQ ID NO: 9487144 - DNA, 22 bp, Homo sapiens
ctggagccggcgagccccagcc

SEQ ID NO: 9487145 - DNA, 22 bp, Homo sapiens
ctggagccggcgagccccagcc

SEQ ID NO: 9487146 - DNA, 22 bp, Homo sapiens
ctggagccggcgagccccagcc

SEQ ID NO: 9487147 - DNA, 22 bp, Homo sapiens
ctggagcctaggttgacctggg

SEQ ID NO: 9487148 - DNA, 22 bp, Homo sapiens
ctggagcctaggttgacctggg

SEQ ID NO: 9487149 - DNA, 22 bp, Homo sapiens
ctggagccggcgagccccagcc

SEQ ID NO: 9487150 - DNA, 22 bp, Homo sapiens
ctggagccgcatggagcaggga

SEQ ID NO: 9487151 - DNA, 22 bp, Homo sapiens
ctggagccgcatggagcaggga

SEQ ID NO: 9487152 - DNA, 22 bp, Homo sapiens
ctggagccgcatggagcaggga

SEQ ID NO: 9487153 - DNA, 22 bp, Homo sapiens
ctggagccgcatggagcaggga

SEQ ID NO: 9487154 - DNA, 22 bp, Homo sapiens
ctggagccctgaatgggcagga

SEQ ID NO: 9487155 - DNA, 22 bp, Homo sapiens
ctggagccctgaatgggcagga

SEQ ID NO: 9487156 - DNA, 22 bp, Homo sapiens
ctggagccctgaatgggcagga

SEQ ID NO: 9487157 - DNA, 22 bp, Homo sapiens
ctggagccggaccagggacggt

SEQ ID NO: 9487158 - DNA, 22 bp, Homo sapiens
ctggagccggaccagggacggt

SEQ ID NO: 9487159 - DNA, 22 bp, Homo sapiens
ctggagccggaccagggacggt

SEQ ID NO: 9487160 - DNA, 22 bp, Homo sapiens
ctggagccggaccagggacggt

SEQ ID NO: 9487161 - DNA, 22 bp, Homo sapiens
ctggagccggaccagggacggt

SEQ ID NO: 9487162 - DNA, 22 bp, Homo sapiens
ctggagagggagccctggcagt

SEQ ID NO: 9487163 - DNA, 22 bp, Homo sapiens
ctggagagggagccctggcagt

SEQ ID NO: 9487164 - DNA, 22 bp, Homo sapiens
ctggagagggagccctggcagt

SEQ ID NO: 9487165 - DNA, 22 bp, Homo sapiens
ctggagaggctgggaacaggtt

SEQ ID NO: 9487166 - DNA, 22 bp, Homo sapiens
ctggagaggctgggaacaggtt

SEQ ID NO: 9487167 - DNA, 22 bp, Homo sapiens
ctggagaggctgggaacaggtt

SEQ ID NO: 9487168 - DNA, 22 bp, Homo sapiens
ctggagaggctgggaacaggtt

SEQ ID NO: 9487169 - DNA, 22 bp, Homo sapiens
ctggagaggccccaagatattt

SEQ ID NO: 9487170 - DNA, 22 bp, Homo sapiens
ctggagagaccgaaagaggctg

SEQ ID NO: 9487171 - DNA, 22 bp, Homo sapiens
ctggagagttggaagatggact

SEQ ID NO: 9487172 - DNA, 22 bp, Homo sapiens
ctggagagggagctgttggaag

SEQ ID NO: 9487173 - DNA, 22 bp, Homo sapiens
ctggagagtaatctctgtgtta

SEQ ID NO: 9487174 - DNA, 22 bp, Homo sapiens
ctggagagtaatctctgtgtta

SEQ ID NO: 9487175 - DNA, 22 bp, Homo sapiens
ctggagcaaaagtgactcctct

SEQ ID NO: 9487176 - DNA, 22 bp, Homo sapiens
ctggagcaaaagtgactcctct

SEQ ID NO: 9487177 - DNA, 22 bp, Homo sapiens
ctggagattaagttctcagcca

SEQ ID NO: 9487178 - DNA, 22 bp, Homo sapiens
ctggagatgtccgggtgctgtt

SEQ ID NO: 9487179 - DNA, 22 bp, Homo sapiens
ctggagattaagttctcagcca

SEQ ID NO: 9487180 - DNA, 22 bp, Homo sapiens
ctggagatgtccgggtgctgtt

SEQ ID NO: 9487181 - DNA, 22 bp, Homo sapiens
ctggagagttggaagatggact

SEQ ID NO: 9487182 - DNA, 22 bp, Homo sapiens
ctggagataagcagtcccaggc

SEQ ID NO: 9487183 - DNA, 19 bp, Homo sapiens
ctggagatagggcctttaa

SEQ ID NO: 9487184 - DNA, 22 bp, Homo sapiens
ctggagatactgctctccatat

SEQ ID NO: 9487185 - DNA, 22 bp, Homo sapiens
ctggaaggctctgctgcctgtc

SEQ ID NO: 9487186 - DNA, 22 bp, Homo sapiens
ctggaagggggacagccacaca

SEQ ID NO: 9487187 - DNA, 22 bp, Homo sapiens
ctggaagggtacataggaaact

SEQ ID NO: 9487188 - DNA, 19 bp, Homo sapiens
ctggaaggagggactgttc

SEQ ID NO: 9487189 - DNA, 22 bp, Homo sapiens
ctggaaggctctgctgcctgtc

SEQ ID NO: 9487190 - DNA, 19 bp, Homo sapiens
ctggaaggagggactgttc

SEQ ID NO: 9487191 - DNA, 19 bp, Homo sapiens
ctggaaggagggactgttc

SEQ ID NO: 9487192 - DNA, 22 bp, Homo sapiens
ctggaaggtaacaaggccatta

SEQ ID NO: 9487193 - DNA, 22 bp, Homo sapiens
ctggaaggtggatggcgaggcc

SEQ ID NO: 9487194 - DNA, 22 bp, Homo sapiens
ctggaaggtctgtccccactgc

SEQ ID NO: 9487195 - DNA, 22 bp, Homo sapiens
ctggagagaccgaaagaggctg

SEQ ID NO: 9487196 - DNA, 22 bp, Homo sapiens
ctggagagaccgaaagaggctg

SEQ ID NO: 9487197 - DNA, 22 bp, Homo sapiens
ctggagaaacatcaggcatagg

SEQ ID NO: 9487198 - DNA, 22 bp, Homo sapiens
ctggagaacagagctgtttaga

SEQ ID NO: 9487199 - DNA, 22 bp, Homo sapiens
ctggagaaaatccatgtgtatg

SEQ ID NO: 9487200 - DNA, 22 bp, Homo sapiens
ctggaaggttcctcccagctcc

SEQ ID NO: 9487201 - DNA, 22 bp, Homo sapiens
ctggaagctggaacaggtgtgg

SEQ ID NO: 9487202 - DNA, 22 bp, Homo sapiens
ctggaagcttgtttgccagtct

SEQ ID NO: 9487203 - DNA, 22 bp, Homo sapiens
ctggaagcttgtttgccagtct

SEQ ID NO: 9487204 - DNA, 22 bp, Homo sapiens
ctggaaggagaaggaggctgtg

SEQ ID NO: 9487205 - DNA, 22 bp, Homo sapiens
ctggaagcgtcggaggaagggc

SEQ ID NO: 9487206 - DNA, 20 bp, Homo sapiens
ctggaagcctttccagagca

SEQ ID NO: 9487207 - DNA, 20 bp, Homo sapiens
ctggaagcctttccagagca

SEQ ID NO: 9487208 - DNA, 22 bp, Homo sapiens
ctggaagagtgactttgcattt

SEQ ID NO: 9487209 - DNA, 22 bp, Homo sapiens
ctggaagagtgactttgcattt

SEQ ID NO: 9487210 - DNA, 22 bp, Homo sapiens
ctggaagaggaagccagctgga

SEQ ID NO: 9487211 - DNA, 22 bp, Homo sapiens
ctggaagaggacacacgaatca

SEQ ID NO: 9487212 - DNA, 22 bp, Homo sapiens
ctggaagaggacacacgaatca

SEQ ID NO: 9487213 - DNA, 22 bp, Homo sapiens
ctggaagaggacacacgaatca

SEQ ID NO: 9487214 - DNA, 22 bp, Homo sapiens
ctggaagaggggaaatgccatg

SEQ ID NO: 9487215 - DNA, 22 bp, Homo sapiens
ctggaagagtcctaaacagata

SEQ ID NO: 9487216 - DNA, 22 bp, Homo sapiens
ctggaagagtcctaaacagata

SEQ ID NO: 9487217 - DNA, 22 bp, Homo sapiens
ctggaagagtcctaaacagata

SEQ ID NO: 9487218 - DNA, 22 bp, Homo sapiens
ctggaagagtcctaaacagata

SEQ ID NO: 9487219 - DNA, 22 bp, Homo sapiens
ctggaagagtaatataaattag

SEQ ID NO: 9487220 - DNA, 22 bp, Homo sapiens
ctggaagagtaatataaattag

SEQ ID NO: 9487221 - DNA, 22 bp, Homo sapiens
ctggaagagtaatataaattag

SEQ ID NO: 9487222 - DNA, 22 bp, Homo sapiens
ctggaagagtaatataaattag

SEQ ID NO: 9487223 - DNA, 22 bp, Homo sapiens
ctggaagaggggaaatgccatg

SEQ ID NO: 9487224 - DNA, 22 bp, Homo sapiens
ctggaaagtgaggagagttcca

SEQ ID NO: 9487225 - DNA, 22 bp, Homo sapiens
ctggaaagtgcttttctgagag

SEQ ID NO: 9487226 - DNA, 22 bp, Homo sapiens
ctggaaagtgcttttctgagag

SEQ ID NO: 9487227 - DNA, 22 bp, Homo sapiens
ctggaaagtgcatgtaatgagg

SEQ ID NO: 9487228 - DNA, 22 bp, Homo sapiens
ctggaaagtgctgagacaattg

SEQ ID NO: 9487229 - DNA, 22 bp, Homo sapiens
ctgctgtctagtatcttaaaaa

SEQ ID NO: 9487230 - DNA, 22 bp, Homo sapiens
ctgctgtgagtggttcttgcct

SEQ ID NO: 9487231 - DNA, 22 bp, Homo sapiens
ctgctggtgatgtctgggcatg

SEQ ID NO: 9487232 - DNA, 22 bp, Homo sapiens
ctgctgtcaaaggaaatatttg

SEQ ID NO: 9487233 - DNA, 22 bp, Homo sapiens
ctgctgtagagaagggttgtca

SEQ ID NO: 9487234 - DNA, 22 bp, Homo sapiens
ctgctgtagccactgggctcag

SEQ ID NO: 9487235 - DNA, 22 bp, Homo sapiens
ctgctgtaatgagtcagcatct

SEQ ID NO: 9487236 - DNA, 22 bp, Homo sapiens
ctgctgtacttaggaagaggaa

SEQ ID NO: 9487237 - DNA, 22 bp, Homo sapiens
ctgctgtaatgagtcagcatct

SEQ ID NO: 9487238 - DNA, 22 bp, Homo sapiens
ctgctgtcatagccatccctcc

SEQ ID NO: 9487239 - DNA, 22 bp, Homo sapiens
ctgctgtcaaaggaaatatttg

SEQ ID NO: 9487240 - DNA, 22 bp, Homo sapiens
ctgctgtccaggagtgccctgt

SEQ ID NO: 9487241 - DNA, 22 bp, Homo sapiens
ctgctgggtctatgcaagtgga

SEQ ID NO: 9487242 - DNA, 22 bp, Homo sapiens
ctgctgggtctatgcaagtgga

SEQ ID NO: 9487243 - DNA, 22 bp, Homo sapiens
ctgctgggtctatgcaagtgga

SEQ ID NO: 9487244 - DNA, 22 bp, Homo sapiens
ctgctgggtctatgcaagtgga

SEQ ID NO: 9487245 - DNA, 22 bp, Homo sapiens
ctgctgggtctatgcaagtgga

SEQ ID NO: 9487246 - DNA, 22 bp, Homo sapiens
ctgctgggtccccctgctgatt

SEQ ID NO: 9487247 - DNA, 22 bp, Homo sapiens
ctgctggggtcagagcactggg

SEQ ID NO: 9487248 - DNA, 22 bp, Homo sapiens
ctgctgggtccccctgctgatt

SEQ ID NO: 9487249 - DNA, 22 bp, Homo sapiens
ctgctgggtccccctgctgatt

SEQ ID NO: 9487250 - DNA, 22 bp, Homo sapiens
ctgctgggtccccctgctgatt

SEQ ID NO: 9487251 - DNA, 22 bp, Homo sapiens
ctgctgggtttgcctttcacca

SEQ ID NO: 9487252 - DNA, 19 bp, Homo sapiens
ctgctgggtgctgagggag

SEQ ID NO: 9487253 - DNA, 19 bp, Homo sapiens
ctgctgggtgctgagggag

SEQ ID NO: 9487254 - DNA, 19 bp, Homo sapiens
ctgctgggtgctgagggag

SEQ ID NO: 9487255 - DNA, 19 bp, Homo sapiens
ctgctgggtgctgagggag

SEQ ID NO: 9487256 - DNA, 22 bp, Homo sapiens
ctgctgaaaacaataatgatga

SEQ ID NO: 9487257 - DNA, 22 bp, Homo sapiens
ctgctcttcccactcactccca

SEQ ID NO: 9487258 - DNA, 22 bp, Homo sapiens
ctgctcttgagggactgcggtc

SEQ ID NO: 9487259 - DNA, 19 bp, Homo sapiens
ctgctgaattagctctgga

SEQ ID NO: 9487260 - DNA, 19 bp, Homo sapiens
ctgctgaattagctctgga

SEQ ID NO: 9487261 - DNA, 22 bp, Homo sapiens
ctgctgaagttcagctcctttt

SEQ ID NO: 9487262 - DNA, 22 bp, Homo sapiens
ctgctgaagttgttggtctttt

SEQ ID NO: 9487263 - DNA, 22 bp, Homo sapiens
ctgctgactcttcctggagtga

SEQ ID NO: 9487264 - DNA, 22 bp, Homo sapiens
ctgctgagagatgccaatctca

SEQ ID NO: 9487265 - DNA, 22 bp, Homo sapiens
ctgctgagactggctttgtgtc

SEQ ID NO: 9487266 - DNA, 22 bp, Homo sapiens
ctgctgagactggctttgtgtc

SEQ ID NO: 9487267 - DNA, 22 bp, Homo sapiens
ctgctgagaaaagactgaggga

SEQ ID NO: 9487268 - DNA, 22 bp, Homo sapiens
ctgctgagaaatgcatccagtt

SEQ ID NO: 9487269 - DNA, 22 bp, Homo sapiens
ctgctgagaaatgcatccagtt

SEQ ID NO: 9487270 - DNA, 22 bp, Homo sapiens
ctgctgagagccccagctgaga

SEQ ID NO: 9487271 - DNA, 22 bp, Homo sapiens
ctgctgagagccccagctgaga

SEQ ID NO: 9487272 - DNA, 22 bp, Homo sapiens
ctgctgagagccccagctgaga

SEQ ID NO: 9487273 - DNA, 20 bp, Homo sapiens
ctgctgagagcctggcttgc

SEQ ID NO: 9487274 - DNA, 22 bp, Homo sapiens
ctgctgagagctgaaggctgta

SEQ ID NO: 9487275 - DNA, 22 bp, Homo sapiens
ctgctgagcatcagggctgccc

SEQ ID NO: 9487276 - DNA, 22 bp, Homo sapiens
ctgctgagcatcagggctgccc

SEQ ID NO: 9487277 - DNA, 22 bp, Homo sapiens
ctgctgagatgccaggagctct

SEQ ID NO: 9487278 - DNA, 22 bp, Homo sapiens
ctgctgagcatcagggctgccc

SEQ ID NO: 9487279 - DNA, 22 bp, Homo sapiens
ctgctgggcagaggctgcatga

SEQ ID NO: 9487280 - DNA, 22 bp, Homo sapiens
ctgctgggaaggtctgctcagt

SEQ ID NO: 9487281 - DNA, 22 bp, Homo sapiens
ctgctgggaaggtctgctcagt

SEQ ID NO: 9487282 - DNA, 22 bp, Homo sapiens
ctgctgggaaggtctgctcagt

SEQ ID NO: 9487283 - DNA, 22 bp, Homo sapiens
ctgcctgtgggtacaagtggaa

SEQ ID NO: 9487284 - DNA, 22 bp, Homo sapiens
ctgcctgtggtctgtgatctaa

SEQ ID NO: 9487285 - DNA, 22 bp, Homo sapiens
ctgcctgtgggtacaagtggaa

SEQ ID NO: 9487286 - DNA, 22 bp, Homo sapiens
ctgcctgtggtctgtgatctaa

SEQ ID NO: 9487287 - DNA, 22 bp, Homo sapiens
ctgcctggggaatgtgaggatt

SEQ ID NO: 9487288 - DNA, 22 bp, Homo sapiens
ctgcctggggaatgtgaggatt

SEQ ID NO: 9487289 - DNA, 22 bp, Homo sapiens
ctgcctggggcatcagtcaagg

SEQ ID NO: 9487290 - DNA, 22 bp, Homo sapiens
ctgcctggggcatcagtcaagg

SEQ ID NO: 9487291 - DNA, 22 bp, Homo sapiens
ctgcctggggaatgtgaggatt

SEQ ID NO: 9487292 - DNA, 22 bp, Homo sapiens
ctgcctgttcctgatcattcta

SEQ ID NO: 9487293 - DNA, 22 bp, Homo sapiens
ctgcctgttagtctagcagtta

SEQ ID NO: 9487294 - DNA, 22 bp, Homo sapiens
ctgcctgtttcctcttgctccc

SEQ ID NO: 9487295 - DNA, 22 bp, Homo sapiens
ctgcctgtttcctcttgctccc

SEQ ID NO: 9487296 - DNA, 22 bp, Homo sapiens
ctgcctgttttctgatagattt

SEQ ID NO: 9487297 - DNA, 22 bp, Homo sapiens
ctgccttcatctctgagctggg

SEQ ID NO: 9487298 - DNA, 22 bp, Homo sapiens
ctgccttgcaccggctctctgg

SEQ ID NO: 9487299 - DNA, 22 bp, Homo sapiens
ctgccttgcaccggctctctgg

SEQ ID NO: 9487300 - DNA, 21 bp, Homo sapiens
ctgccttgaatggtactggga

SEQ ID NO: 9487301 - DNA, 22 bp, Homo sapiens
ctgccttctttcaagggtaagc

SEQ ID NO: 9487302 - DNA, 22 bp, Homo sapiens
ctgccttgaaaatgaagcttta

SEQ ID NO: 9487303 - DNA, 22 bp, Homo sapiens
ctgccttccaaccccagactcc

SEQ ID NO: 9487304 - DNA, 22 bp, Homo sapiens
ctgccttcatctctgagctggg

SEQ ID NO: 9487305 - DNA, 22 bp, Homo sapiens
ctgccttcatctctgagctggg

SEQ ID NO: 9487306 - DNA, 22 bp, Homo sapiens
ctgccttccaaccccagactcc

SEQ ID NO: 9487307 - DNA, 21 bp, Homo sapiens
ctgctctgacagtgaggccag

SEQ ID NO: 9487308 - DNA, 21 bp, Homo sapiens
ctgctctgacagtgaggccag

SEQ ID NO: 9487309 - DNA, 21 bp, Homo sapiens
ctgctctgacagtgaggccag

SEQ ID NO: 9487310 - DNA, 22 bp, Homo sapiens
ctgctctgaccctttcaccttc

SEQ ID NO: 9487311 - DNA, 22 bp, Homo sapiens
ctgctctgtgcacttgttcagg

SEQ ID NO: 9487312 - DNA, 22 bp, Homo sapiens
ctgctctgtgcacttgttcagg

SEQ ID NO: 9487313 - DNA, 22 bp, Homo sapiens
ctgctctgtttcttagctgggt

SEQ ID NO: 9487314 - DNA, 22 bp, Homo sapiens
ctgctctgtttcttagctgggt

SEQ ID NO: 9487315 - DNA, 22 bp, Homo sapiens
ctgctcttcacactacacccgt

SEQ ID NO: 9487316 - DNA, 22 bp, Homo sapiens
ctgctctgtttcttagctgggt

SEQ ID NO: 9487317 - DNA, 22 bp, Homo sapiens
ctgctctgtttcttagctgggt

SEQ ID NO: 9487318 - DNA, 22 bp, Homo sapiens
ctgctctgttcccccatcatct

SEQ ID NO: 9487319 - DNA, 22 bp, Homo sapiens
ctgctctgttcccccatcatct

SEQ ID NO: 9487320 - DNA, 22 bp, Homo sapiens
ctgctctgttcccccatcatct

SEQ ID NO: 9487321 - DNA, 22 bp, Homo sapiens
ctgccttgcaccggctctctgg

SEQ ID NO: 9487322 - DNA, 22 bp, Homo sapiens
ctgccttggtttctagcagggc

SEQ ID NO: 9487323 - DNA, 22 bp, Homo sapiens
ctgccttggttcccagccagca

SEQ ID NO: 9487324 - DNA, 22 bp, Homo sapiens
ctgccttgtcttgttttcaggg

SEQ ID NO: 9487325 - DNA, 22 bp, Homo sapiens
ctgcgcaggggtggcgccagaa

SEQ ID NO: 9487326 - DNA, 22 bp, Homo sapiens
ctgaggctgcccagggccaggt

SEQ ID NO: 9487327 - DNA, 22 bp, Homo sapiens
ctgaggctgagacaggtgaaat

SEQ ID NO: 9487328 - DNA, 22 bp, Homo sapiens
ctgaggctggagtgcagtggtg

SEQ ID NO: 9487329 - DNA, 22 bp, Homo sapiens
ctgaggctccctcgggtctgct

SEQ ID NO: 9487330 - DNA, 22 bp, Homo sapiens
ctgaggctccctcgggtctgct

SEQ ID NO: 9487331 - DNA, 22 bp, Homo sapiens
ctgaggctccctcgggtctgct

SEQ ID NO: 9487332 - DNA, 22 bp, Homo sapiens
ctgaggctcagcgtgaggaaag

SEQ ID NO: 9487333 - DNA, 22 bp, Homo sapiens
ctgaggctgaagagggcctacg

SEQ ID NO: 9487334 - DNA, 22 bp, Homo sapiens
ctgaggctgaagagggcctacg

SEQ ID NO: 9487335 - DNA, 22 bp, Homo sapiens
ctgaggctctgggtgtcactgt

SEQ ID NO: 9487336 - DNA, 22 bp, Homo sapiens
ctgaggctctgagaaagccaaa

SEQ ID NO: 9487337 - DNA, 22 bp, Homo sapiens
ctgaggctctgagaaagccaaa

SEQ ID NO: 9487338 - DNA, 22 bp, Homo sapiens
ctgaggtcaggagttcaagctg

SEQ ID NO: 9487339 - DNA, 22 bp, Homo sapiens
ctgaggtcaggagttcaagctg

SEQ ID NO: 9487340 - DNA, 22 bp, Homo sapiens
ctgaggtcctcagagggaaagg

SEQ ID NO: 9487341 - DNA, 22 bp, Homo sapiens
ctgaggtccttgactgcttgcc

SEQ ID NO: 9487342 - DNA, 22 bp, Homo sapiens
ctgaggtctattttgaaactgc

SEQ ID NO: 9487343 - DNA, 17 bp, Homo sapiens
ctgaggggagtgctgtg

SEQ ID NO: 9487344 - DNA, 17 bp, Homo sapiens
ctgaggggagtgctgtg

SEQ ID NO: 9487345 - DNA, 17 bp, Homo sapiens
ctgaggggagtgctgtg

SEQ ID NO: 9487346 - DNA, 17 bp, Homo sapiens
ctgaggggagtgctgtg

SEQ ID NO: 9487347 - DNA, 17 bp, Homo sapiens
ctgaggggagtgctgtg

SEQ ID NO: 9487348 - DNA, 18 bp, Homo sapiens
ctgaggctggcaggagcc

SEQ ID NO: 9487349 - DNA, 23 bp, Homo sapiens
ctgaggggaaaagggcttcaggc

SEQ ID NO: 9487350 - DNA, 22 bp, Homo sapiens
ctgaggggaaaagtcaggatga

SEQ ID NO: 9487351 - DNA, 22 bp, Homo sapiens
ctgaggctggagtgcagtggtg

SEQ ID NO: 9487352 - DNA, 22 bp, Homo sapiens
ctgaggctggagtgcagtggtg

SEQ ID NO: 9487353 - DNA, 22 bp, Homo sapiens
ctgaggcctgtgttggggcagt

SEQ ID NO: 9487354 - DNA, 22 bp, Homo sapiens
ctgaggcctggtgaggtggtga

SEQ ID NO: 9487355 - DNA, 22 bp, Homo sapiens
ctgaggcctgtgttggggcagt

SEQ ID NO: 9487356 - DNA, 22 bp, Homo sapiens
ctgaggcctggccccaccacag

SEQ ID NO: 9487357 - DNA, 22 bp, Homo sapiens
ctgaggcctgggggcgtggacg

SEQ ID NO: 9487358 - DNA, 22 bp, Homo sapiens
ctgaggcctggtgaggtggtga

SEQ ID NO: 9487359 - DNA, 22 bp, Homo sapiens
ctgaggcctgggggcgtggacg

SEQ ID NO: 9487360 - DNA, 22 bp, Homo sapiens
ctgaggctcaagggcaggtggg

SEQ ID NO: 9487361 - DNA, 22 bp, Homo sapiens
ctgaggctcaagggcaggtggg

SEQ ID NO: 9487362 - DNA, 22 bp, Homo sapiens
ctgaggctcaagggcaggtggg

SEQ ID NO: 9487363 - DNA, 22 bp, Homo sapiens
ctgaggctagtataaagagcat

SEQ ID NO: 9487364 - DNA, 22 bp, Homo sapiens
ctgaggctaacctcgagagaca

SEQ ID NO: 9487365 - DNA, 22 bp, Homo sapiens
ctgagccaaaaagcagagcttg

SEQ ID NO: 9487366 - DNA, 22 bp, Homo sapiens
ctgagcatttgccggagcgtca

SEQ ID NO: 9487367 - DNA, 22 bp, Homo sapiens
ctgaggccgttggtgggcctta

SEQ ID NO: 9487368 - DNA, 22 bp, Homo sapiens
ctgaggccgttggtgggcctta

SEQ ID NO: 9487369 - DNA, 22 bp, Homo sapiens
ctgaggccgttggtgggcctta

SEQ ID NO: 9487370 - DNA, 22 bp, Homo sapiens
ctgaggccgttggtgggcctta

SEQ ID NO: 9487371 - DNA, 23 bp, Homo sapiens
ctgaggcctgctgcgttcaggtt

SEQ ID NO: 9487372 - DNA, 22 bp, Homo sapiens
ctgaggccgttggtgggcctta

SEQ ID NO: 9487373 - DNA, 22 bp, Homo sapiens
ctgaggcctggccccaccacag

SEQ ID NO: 9487374 - DNA, 22 bp, Homo sapiens
ctgaggcctggccccaccacag

SEQ ID NO: 9487375 - DNA, 22 bp, Homo sapiens
ctgaggccgtctgggtctgcag

SEQ ID NO: 9487376 - DNA, 22 bp, Homo sapiens
ctgaggccgtctgggtctgcag

SEQ ID NO: 9487377 - DNA, 22 bp, Homo sapiens
ctgagccaaaaagcagagcttg

SEQ ID NO: 9487378 - DNA, 22 bp, Homo sapiens
ctgaggccgtctgggtctgcag

SEQ ID NO: 9487379 - DNA, 22 bp, Homo sapiens
ctgagccaaaaagcagagcttg

SEQ ID NO: 9487380 - DNA, 22 bp, Homo sapiens
ctgagcagggaccaaaagcatt

SEQ ID NO: 9487381 - DNA, 22 bp, Homo sapiens
ctgagcagggaccaaaagcatt

SEQ ID NO: 9487382 - DNA, 19 bp, Homo sapiens
ctgagcaggcaggtaggat

SEQ ID NO: 9487383 - DNA, 19 bp, Homo sapiens
ctgagcaggcaggtaggat

SEQ ID NO: 9487384 - DNA, 22 bp, Homo sapiens
ctgagcagtagagggtctcttt

SEQ ID NO: 9487385 - DNA, 22 bp, Homo sapiens
ctgagcagggaccaaaagcatt

SEQ ID NO: 9487386 - DNA, 22 bp, Homo sapiens
ctgagcagtagagggtctcttt

SEQ ID NO: 9487387 - DNA, 22 bp, Homo sapiens
ctgagcagtctagccaggtgtt

SEQ ID NO: 9487388 - DNA, 22 bp, Homo sapiens
ctgagcagtagagggtctcttt

SEQ ID NO: 9487389 - DNA, 22 bp, Homo sapiens
ctgagcagtggttcttgagcgc

SEQ ID NO: 9487390 - DNA, 22 bp, Homo sapiens
ctgagcagtgctttgcagtggg

SEQ ID NO: 9487391 - DNA, 22 bp, Homo sapiens
ctgagcagtttcttagggctca

SEQ ID NO: 9487392 - DNA, 22 bp, Homo sapiens
ctgagcagtggttcttgagcgc

SEQ ID NO: 9487393 - DNA, 22 bp, Homo sapiens
ctgagcagtctgactcaagcta

SEQ ID NO: 9487394 - DNA, 22 bp, Homo sapiens
ctgagcagtctagccaggtgtt

SEQ ID NO: 9487395 - DNA, 22 bp, Homo sapiens
ctgagcagtgctttgcagtggg

SEQ ID NO: 9487396 - DNA, 22 bp, Homo sapiens
ctgagcagtctgactcaagcta

SEQ ID NO: 9487397 - DNA, 22 bp, Homo sapiens
ctgagcagaccatggcagaggt

SEQ ID NO: 9487398 - DNA, 22 bp, Homo sapiens
ctgagcagaccatggcagaggt

SEQ ID NO: 9487399 - DNA, 19 bp, Homo sapiens
ctgagcagcggcagcactt

SEQ ID NO: 9487400 - DNA, 19 bp, Homo sapiens
ctgagcagcggcagcactt

SEQ ID NO: 9487401 - DNA, 22 bp, Homo sapiens
ctgagcactgggcacatagctg

SEQ ID NO: 9487402 - DNA, 22 bp, Homo sapiens
ctgagcagaagggtgcacgtgc

SEQ ID NO: 9487403 - DNA, 22 bp, Homo sapiens
ctgagcagctgttacagagtgt

SEQ ID NO: 9487404 - DNA, 22 bp, Homo sapiens
ctgagcaggatattcacagcag

SEQ ID NO: 9487405 - DNA, 22 bp, Homo sapiens
ctgagcaggacagtgggagacc

SEQ ID NO: 9487406 - DNA, 22 bp, Homo sapiens
ctgagcaggacagtgggagacc

SEQ ID NO: 9487407 - DNA, 22 bp, Homo sapiens
ctgagcagcgtggggagctggc

SEQ ID NO: 9487408 - DNA, 22 bp, Homo sapiens
ctgagcagctccctgagtggtc

SEQ ID NO: 9487409 - DNA, 22 bp, Homo sapiens
ctgagcagcgtggggagctggc

SEQ ID NO: 9487410 - DNA, 22 bp, Homo sapiens
ctgagcagcgtggggagctggc

SEQ ID NO: 9487411 - DNA, 22 bp, Homo sapiens
ttttgcttttgtaacacagtgt

SEQ ID NO: 9487412 - DNA, 22 bp, Homo sapiens
ttttgctttaagatggagagga

SEQ ID NO: 9487413 - DNA, 22 bp, Homo sapiens
ttttgctttaagatggagagga

SEQ ID NO: 9487414 - DNA, 22 bp, Homo sapiens
ctcttcccagctccacgagagg

SEQ ID NO: 9487415 - DNA, 20 bp, Homo sapiens
ctcttccggaggggcgctcc

SEQ ID NO: 9487416 - DNA, 22 bp, Homo sapiens
ctcttcccagctccacgagagg

SEQ ID NO: 9487417 - DNA, 22 bp, Homo sapiens
ttttggaacacagacattagaa

SEQ ID NO: 9487418 - DNA, 22 bp, Homo sapiens
ctcttctctgcagcctttgaag

SEQ ID NO: 9487419 - DNA, 22 bp, Homo sapiens
ctcttctctgcagcctttgaag

SEQ ID NO: 9487420 - DNA, 22 bp, Homo sapiens
ctcttctgtacctcggcctcca

SEQ ID NO: 9487421 - DNA, 22 bp, Homo sapiens
ctcttcttgaaagaggaattca

SEQ ID NO: 9487422 - DNA, 22 bp, Homo sapiens
ctcttctgtacctcggcctcca

SEQ ID NO: 9487423 - DNA, 22 bp, Homo sapiens
ctcttcctagtgtgcagcgtgg

SEQ ID NO: 9487424 - DNA, 22 bp, Homo sapiens
ctcttccttaagactataaaga

SEQ ID NO: 9487425 - DNA, 22 bp, Homo sapiens
ctcttcctttcccttgagggtg

SEQ ID NO: 9487426 - DNA, 22 bp, Homo sapiens
ctcttcctttcccttgagggtg

SEQ ID NO: 9487427 - DNA, 22 bp, Homo sapiens
ctgccccatggtccctggtggg

SEQ ID NO: 9487428 - DNA, 22 bp, Homo sapiens
ctgccccatggtccctggtggg

SEQ ID NO: 9487429 - DNA, 22 bp, Homo sapiens
ctgcccctgccaggcagctgtc

SEQ ID NO: 9487430 - DNA, 22 bp, Homo sapiens
ctgccccctgctttgtccttga

SEQ ID NO: 9487431 - DNA, 22 bp, Homo sapiens
ctgcccccaggctgcatggctg

SEQ ID NO: 9487432 - DNA, 22 bp, Homo sapiens
ctgccccaggacctcttctgga

SEQ ID NO: 9487433 - DNA, 22 bp, Homo sapiens
ctgccccaccccaacctgaggt

SEQ ID NO: 9487434 - DNA, 22 bp, Homo sapiens
ctgccccagcctggggccttct

SEQ ID NO: 9487435 - DNA, 22 bp, Homo sapiens
ctgcccaggaaccagaggggca

SEQ ID NO: 9487436 - DNA, 22 bp, Homo sapiens
ctgcccaggaaccagaggggca

SEQ ID NO: 9487437 - DNA, 22 bp, Homo sapiens
ctgcccaggaaggagaggatgg

SEQ ID NO: 9487438 - DNA, 22 bp, Homo sapiens
ctgcccaggaaggagaggatgg

SEQ ID NO: 9487439 - DNA, 22 bp, Homo sapiens
ctgcccaggctgaaggaacatc

SEQ ID NO: 9487440 - DNA, 22 bp, Homo sapiens
ctgcccaggctgaaggaacatc

SEQ ID NO: 9487441 - DNA, 22 bp, Homo sapiens
ctgcccaggggagtgctgtcgg

SEQ ID NO: 9487442 - DNA, 22 bp, Homo sapiens
ctgcccaggggagtgctgtcgg

SEQ ID NO: 9487443 - DNA, 22 bp, Homo sapiens
ctgcccaggggagtgctgtcgg

SEQ ID NO: 9487444 - DNA, 22 bp, Homo sapiens
ctgcccaggggagtgctgtcgg

SEQ ID NO: 9487445 - DNA, 22 bp, Homo sapiens
ctgcccaggctgaaggaacatc

SEQ ID NO: 9487446 - DNA, 22 bp, Homo sapiens
ctgcccaggctgaaggaacatc

SEQ ID NO: 9487447 - DNA, 22 bp, Homo sapiens
ctgcccagtttgggagcctttc

SEQ ID NO: 9487448 - DNA, 22 bp, Homo sapiens
ctgcccagtttgggagcctttc

SEQ ID NO: 9487449 - DNA, 21 bp, Homo sapiens
ctgcccatttgtgatgtcccc

SEQ ID NO: 9487450 - DNA, 20 bp, Homo sapiens
ctgcccagccactgagggat

SEQ ID NO: 9487451 - DNA, 20 bp, Homo sapiens
ctgcccagccactgagggat

SEQ ID NO: 9487452 - DNA, 20 bp, Homo sapiens
ctgcccagccactgagggat

SEQ ID NO: 9487453 - DNA, 20 bp, Homo sapiens
ctgcccagccactgagggat

SEQ ID NO: 9487454 - DNA, 20 bp, Homo sapiens
ctgcccagccactgagggat

SEQ ID NO: 9487455 - DNA, 22 bp, Homo sapiens
ctgcccaggaaccagaggggca

SEQ ID NO: 9487456 - DNA, 22 bp, Homo sapiens
ctgcccacacctgagctgggcc

SEQ ID NO: 9487457 - DNA, 22 bp, Homo sapiens
ctgcccacactcatggggaagg

SEQ ID NO: 9487458 - DNA, 22 bp, Homo sapiens
ctgcccagattttaccacctgc

SEQ ID NO: 9487459 - DNA, 22 bp, Homo sapiens
ctgcccacagttctctgccatg

SEQ ID NO: 9487460 - DNA, 22 bp, Homo sapiens
ctgcccacactcatggggaagg

SEQ ID NO: 9487461 - DNA, 22 bp, Homo sapiens
ctgcccagattttaccacctgc

SEQ ID NO: 9487462 - DNA, 18 bp, Homo sapiens
ctgccatgtcctactgtc

SEQ ID NO: 9487463 - DNA, 22 bp, Homo sapiens
ctgcccacacctgagctgggcc

SEQ ID NO: 9487464 - DNA, 22 bp, Homo sapiens
ctgccatgttacctgcacaggt

SEQ ID NO: 9487465 - DNA, 22 bp, Homo sapiens
ctgcaggagtgaaagcaggcct

SEQ ID NO: 9487466 - DNA, 22 bp, Homo sapiens
ctgcaggatttcatgggctgac

SEQ ID NO: 9487467 - DNA, 22 bp, Homo sapiens
ctgcaggaggatcctgagagtg

SEQ ID NO: 9487468 - DNA, 22 bp, Homo sapiens
ctgcaggaggatcctgagagtg

SEQ ID NO: 9487469 - DNA, 22 bp, Homo sapiens
ctgcaggaggatcctgagagtg

SEQ ID NO: 9487470 - DNA, 22 bp, Homo sapiens
ctgcaggagggctggggaagcc

SEQ ID NO: 9487471 - DNA, 22 bp, Homo sapiens
ctgaggtgtttagtaggggcgg

SEQ ID NO: 9487472 - DNA, 22 bp, Homo sapiens
ctgaggtgtttagtaggggcgg

SEQ ID NO: 9487473 - DNA, 22 bp, Homo sapiens
ctgaggtgtggtctgggagtat

SEQ ID NO: 9487474 - DNA, 22 bp, Homo sapiens
ctgaggtgtgctttcaatgggt

SEQ ID NO: 9487475 - DNA, 22 bp, Homo sapiens
ctgaggtgtggtctgggagtat

SEQ ID NO: 9487476 - DNA, 22 bp, Homo sapiens
ctgaggtgtgagccacttcccc

SEQ ID NO: 9487477 - DNA, 22 bp, Homo sapiens
ctgaggtgtgaaatggtggcaa

SEQ ID NO: 9487478 - DNA, 22 bp, Homo sapiens
ctgaggtggggcctgggcatca

SEQ ID NO: 9487479 - DNA, 22 bp, Homo sapiens
ctgaggtggcctctgccgggga

SEQ ID NO: 9487480 - DNA, 23 bp, Homo sapiens
ctgaggtggagagtgaggtaagt

SEQ ID NO: 9487481 - DNA, 22 bp, Homo sapiens
ctgaggtggcatcctagctcta

SEQ ID NO: 9487482 - DNA, 23 bp, Homo sapiens
ctgaggtggagagtgaggtaagt

SEQ ID NO: 9487483 - DNA, 19 bp, Homo sapiens
ctgaggtgaggggcatcat

SEQ ID NO: 9487484 - DNA, 19 bp, Homo sapiens
ctgaggtgaggggcatcat

SEQ ID NO: 9487485 - DNA, 22 bp, Homo sapiens
ctgaggtgagaggaggccatgt

SEQ ID NO: 9487486 - DNA, 23 bp, Homo sapiens
ctgaggtctgcaattctagtagt

SEQ ID NO: 9487487 - DNA, 22 bp, Homo sapiens
ctgaggtctctttccatagtga

SEQ ID NO: 9487488 - DNA, 19 bp, Homo sapiens
ctgaggtgcagtaagaggc

SEQ ID NO: 9487489 - DNA, 19 bp, Homo sapiens
ctgaggtgcagtaagaggc

SEQ ID NO: 9487490 - DNA, 22 bp, Homo sapiens
ctgaggtgatggcccgttttcc

SEQ ID NO: 9487491 - DNA, 22 bp, Homo sapiens
ctgaggtgctatggaggatacg

SEQ ID NO: 9487492 - DNA, 22 bp, Homo sapiens
ctgaggtgctatggaggatacg

SEQ ID NO: 9487493 - DNA, 22 bp, Homo sapiens
ctgaggtggaacagaggtgaag

SEQ ID NO: 9487494 - DNA, 22 bp, Homo sapiens
ctgaggtgctatggaggatacg

SEQ ID NO: 9487495 - DNA, 22 bp, Homo sapiens
ctgaggtgctagggtccctgct

SEQ ID NO: 9487496 - DNA, 22 bp, Homo sapiens
ctgcagctgtgagtgctggatg

SEQ ID NO: 9487497 - DNA, 22 bp, Homo sapiens
ctgcagctgtgagtgctggatg

SEQ ID NO: 9487498 - DNA, 22 bp, Homo sapiens
ctgcagcttaagggaggggttg

SEQ ID NO: 9487499 - DNA, 22 bp, Homo sapiens
ctgcagcttaaaggagttcaat

SEQ ID NO: 9487500 - DNA, 22 bp, Homo sapiens
ctgcagcttaaaggagttcaat

SEQ ID NO: 9487501 - DNA, 22 bp, Homo sapiens
ctgcagctgtagaggacagtgg

SEQ ID NO: 9487502 - DNA, 22 bp, Homo sapiens
ctgcagctgtctctactgggca

SEQ ID NO: 9487503 - DNA, 22 bp, Homo sapiens
ctgcagctgtctctactgggca

SEQ ID NO: 9487504 - DNA, 22 bp, Homo sapiens
ctgcagctgggccagggccacc

SEQ ID NO: 9487505 - DNA, 22 bp, Homo sapiens
ctgaggtttacaagctattgct

SEQ ID NO: 9487506 - DNA, 22 bp, Homo sapiens
ctgcagctttttgtgcttgtaa

SEQ ID NO: 9487507 - DNA, 22 bp, Homo sapiens
ctgcagctttttgtgcttgtaa

SEQ ID NO: 9487508 - DNA, 22 bp, Homo sapiens
ctgcaggaattcaaagtgagct

SEQ ID NO: 9487509 - DNA, 22 bp, Homo sapiens
ctgcaggaatctgtgctaggtg

SEQ ID NO: 9487510 - DNA, 22 bp, Homo sapiens
ctgcagcttatttgctgtgtga

SEQ ID NO: 9487511 - DNA, 22 bp, Homo sapiens
ctgcagcttatttgctgtgtga

SEQ ID NO: 9487512 - DNA, 22 bp, Homo sapiens
ctgcagctttcgctccatcagc

SEQ ID NO: 9487513 - DNA, 22 bp, Homo sapiens
ctgcagctttcgctccatcagc

SEQ ID NO: 9487514 - DNA, 22 bp, Homo sapiens
ctgcagctttcgctccatcagc

SEQ ID NO: 9487515 - DNA, 22 bp, Homo sapiens
ctgcaggaattcaaagtgagct

SEQ ID NO: 9487516 - DNA, 22 bp, Homo sapiens
ctgcaggactgaaagatgaggt

SEQ ID NO: 9487517 - DNA, 22 bp, Homo sapiens
ctgcaggactgaaagatgaggt

SEQ ID NO: 9487518 - DNA, 22 bp, Homo sapiens
ctgcaggactgaaagatgaggt

SEQ ID NO: 9487519 - DNA, 22 bp, Homo sapiens
ctctggccgcagctcagctctg

SEQ ID NO: 9487520 - DNA, 22 bp, Homo sapiens
ctctggccgcagctcagctctg

SEQ ID NO: 9487521 - DNA, 22 bp, Homo sapiens
ctctggccgagcatgggggtta

SEQ ID NO: 9487522 - DNA, 22 bp, Homo sapiens
ctctggccccagtggccccttg

SEQ ID NO: 9487523 - DNA, 22 bp, Homo sapiens
ctctggccgcagctcagctctg

SEQ ID NO: 9487524 - DNA, 22 bp, Homo sapiens
ctctggccgcagctcagctctg

SEQ ID NO: 9487525 - DNA, 22 bp, Homo sapiens
ctctggccgcagctcagctctg

SEQ ID NO: 9487526 - DNA, 19 bp, Homo sapiens
ctctggcctctggatgctg

SEQ ID NO: 9487527 - DNA, 22 bp, Homo sapiens
ctctggcagagctgtagacttc

SEQ ID NO: 9487528 - DNA, 22 bp, Homo sapiens
ctctggcagagctgtagacttc

SEQ ID NO: 9487529 - DNA, 22 bp, Homo sapiens
ctctggcacactccttccaggt

SEQ ID NO: 9487530 - DNA, 22 bp, Homo sapiens
ctctggccccagtggccccttg

SEQ ID NO: 9487531 - DNA, 22 bp, Homo sapiens
ctctggccagagcctgcgggaa

SEQ ID NO: 9487532 - DNA, 22 bp, Homo sapiens
ctctggcctgcttcctcaggta

SEQ ID NO: 9487533 - DNA, 22 bp, Homo sapiens
ctctggcctgcagatccatgct

SEQ ID NO: 9487534 - DNA, 22 bp, Homo sapiens
ctctggcctgcagatccatgct

SEQ ID NO: 9487535 - DNA, 22 bp, Homo sapiens
ctctggcctgcagatccatgct

SEQ ID NO: 9487536 - DNA, 22 bp, Homo sapiens
ctctggcctggggcctgctccc

SEQ ID NO: 9487537 - DNA, 22 bp, Homo sapiens
ctctggcctgcttcctcaggta

SEQ ID NO: 9487538 - DNA, 22 bp, Homo sapiens
ctctggcctggggcctgctccc

SEQ ID NO: 9487539 - DNA, 22 bp, Homo sapiens
ctctggcctggggcctgctccc

SEQ ID NO: 9487540 - DNA, 20 bp, Homo sapiens
ctctggcaaaggatgcctat

SEQ ID NO: 9487541 - DNA, 22 bp, Homo sapiens
ctctggagtgcagcctggtggc

SEQ ID NO: 9487542 - DNA, 22 bp, Homo sapiens
ctctggcaatggatttttgagg

SEQ ID NO: 9487543 - DNA, 22 bp, Homo sapiens
ctctggcaattgctgctgactc

SEQ ID NO: 9487544 - DNA, 22 bp, Homo sapiens
ctctggcacactccttccaggt

SEQ ID NO: 9487545 - DNA, 22 bp, Homo sapiens
ctctggagtgcagcctggtggc

SEQ ID NO: 9487546 - DNA, 22 bp, Homo sapiens
ctctggagtgcagcctggtggc

SEQ ID NO: 9487547 - DNA, 22 bp, Homo sapiens
tttgcaaagtgactattatatg

SEQ ID NO: 9487548 - DNA, 18 bp, Homo sapiens
tttgcaaaggaagtatgg

SEQ ID NO: 9487549 - DNA, 22 bp, Homo sapiens
tttgcaaaccggagctctgcaa

SEQ ID NO: 9487550 - DNA, 18 bp, Homo sapiens
tttgcaaaggaagtatgg

SEQ ID NO: 9487551 - DNA, 22 bp, Homo sapiens
tttgactcctgtgtttctggaa

SEQ ID NO: 9487552 - DNA, 22 bp, Homo sapiens
tttgactcctgccttctcctgt

SEQ ID NO: 9487553 - DNA, 22 bp, Homo sapiens
tttgacttctatctagtaagaa

SEQ ID NO: 9487554 - DNA, 22 bp, Homo sapiens
tttgacttctatctagtaagaa

SEQ ID NO: 9487555 - DNA, 22 bp, Homo sapiens
tttgacttctgggcattttggt

SEQ ID NO: 9487556 - DNA, 22 bp, Homo sapiens
tttgactcttgtctcttgttag

SEQ ID NO: 9487557 - DNA, 22 bp, Homo sapiens
tttgagaaacagacgaaagaca

SEQ ID NO: 9487558 - DNA, 22 bp, Homo sapiens
tttgagaaaaccagaaagatct

SEQ ID NO: 9487559 - DNA, 22 bp, Homo sapiens
tttgagaaaaagtgatgatgat

SEQ ID NO: 9487560 - DNA, 22 bp, Homo sapiens
tttgagaaaggggatttaattc

SEQ ID NO: 9487561 - DNA, 22 bp, Homo sapiens
tttgagaaactgattattatgg

SEQ ID NO: 9487562 - DNA, 22 bp, Homo sapiens
tttgagaaaggggatttaattc

SEQ ID NO: 9487563 - DNA, 22 bp, Homo sapiens
tttgagaactttggtattttcc

SEQ ID NO: 9487564 - DNA, 22 bp, Homo sapiens
tttgagaaccctgtattttaag

SEQ ID NO: 9487565 - DNA, 22 bp, Homo sapiens
tttgagaagagtttgaggtatt

SEQ ID NO: 9487566 - DNA, 22 bp, Homo sapiens
tttgcaaaatgaggtgaagagt

SEQ ID NO: 9487567 - DNA, 22 bp, Homo sapiens
tttgagaagatgtaatgttaag

SEQ ID NO: 9487568 - DNA, 22 bp, Homo sapiens
tttgagaagatgtaatgttaag

SEQ ID NO: 9487569 - DNA, 22 bp, Homo sapiens
tttgcaaaatgaggtgaagagt

SEQ ID NO: 9487570 - DNA, 22 bp, Homo sapiens
tttgcaaacacttaagaagaga

SEQ ID NO: 9487571 - DNA, 22 bp, Homo sapiens
tttgcaaacacttaagaagaga

SEQ ID NO: 9487572 - DNA, 22 bp, Homo sapiens
tttgcaaacacttaagaagaga

SEQ ID NO: 9487573 - DNA, 22 bp, Homo sapiens
tttgcaaacggccctgagtccc

SEQ ID NO: 9487574 - DNA, 22 bp, Homo sapiens
tttgcaaacattcagggctcca

SEQ ID NO: 9487575 - DNA, 22 bp, Homo sapiens
tttgaaactcatgatcatcact

SEQ ID NO: 9487576 - DNA, 22 bp, Homo sapiens
tttgaaactctgaacatgtttc

SEQ ID NO: 9487577 - DNA, 22 bp, Homo sapiens
tttgaaagacagaatatttttg

SEQ ID NO: 9487578 - DNA, 22 bp, Homo sapiens
tttgaaacctagttatatgact

SEQ ID NO: 9487579 - DNA, 22 bp, Homo sapiens
tttgaaaatttaagtgctacac

SEQ ID NO: 9487580 - DNA, 22 bp, Homo sapiens
tttgaaaagaaccatcgcctta

SEQ ID NO: 9487581 - DNA, 22 bp, Homo sapiens
tttcttgtaagatgtttattaa

SEQ ID NO: 9487582 - DNA, 22 bp, Homo sapiens
tttcttgggttccagttcccag

SEQ ID NO: 9487583 - DNA, 22 bp, Homo sapiens
tttcttggagctcttagggtcg

SEQ ID NO: 9487584 - DNA, 22 bp, Homo sapiens
tttcttggatgtgaaactaggg

SEQ ID NO: 9487585 - DNA, 22 bp, Homo sapiens
ctctgaagggagggccaagccc

SEQ ID NO: 9487586 - DNA, 22 bp, Homo sapiens
ctctgaagggagggccaagccc

SEQ ID NO: 9487587 - DNA, 18 bp, Homo sapiens
ctctgaacatctttctgg

SEQ ID NO: 9487588 - DNA, 22 bp, Homo sapiens
ctctgaagatggtaccagcttt

SEQ ID NO: 9487589 - DNA, 22 bp, Homo sapiens
ctctgaagatggtaccagcttt

SEQ ID NO: 9487590 - DNA, 22 bp, Homo sapiens
tttcttgattagctgtggctca

SEQ ID NO: 9487591 - DNA, 22 bp, Homo sapiens
ctctgacaccatctcatgacag

SEQ ID NO: 9487592 - DNA, 21 bp, Homo sapiens
ctctgaatcctgcttctcagt

SEQ ID NO: 9487593 - DNA, 22 bp, Homo sapiens
ctctgaaggtttctgttactgt

SEQ ID NO: 9487594 - DNA, 19 bp, Homo sapiens
tttgaaagagttttattgg

SEQ ID NO: 9487595 - DNA, 19 bp, Homo sapiens
tttgaaagagttttattgg

SEQ ID NO: 9487596 - DNA, 22 bp, Homo sapiens
ctctgaggtctaggaccatggc

SEQ ID NO: 9487597 - DNA, 22 bp, Homo sapiens
ctctgaggtctaggaccatggc

SEQ ID NO: 9487598 - DNA, 22 bp, Homo sapiens
ctctgaggttccctgggtccca

SEQ ID NO: 9487599 - DNA, 22 bp, Homo sapiens
ctctgaggtctaggaccatggc

SEQ ID NO: 9487600 - DNA, 22 bp, Homo sapiens
ctctgaggtctaggaccatggc

SEQ ID NO: 9487601 - DNA, 22 bp, Homo sapiens
ctctgaggtttcctcacaagct

SEQ ID NO: 9487602 - DNA, 22 bp, Homo sapiens
ctctgaggtttcctcacaagct

SEQ ID NO: 9487603 - DNA, 22 bp, Homo sapiens
ctctgaggttccctgggtccca

SEQ ID NO: 9487604 - DNA, 22 bp, Homo sapiens
ctctgaggttcctttgccctcg

SEQ ID NO: 9487605 - DNA, 22 bp, Homo sapiens
ctctgaggtttcctcacaagct

SEQ ID NO: 9487606 - DNA, 22 bp, Homo sapiens
ctctgagttgaggcaggagagt

SEQ ID NO: 9487607 - DNA, 22 bp, Homo sapiens
ctctgcaacttctagcagtgtc

SEQ ID NO: 9487608 - DNA, 22 bp, Homo sapiens
ctctgatttccttattctgtca

SEQ ID NO: 9487609 - DNA, 22 bp, Homo sapiens
ctctgatgtctgggggctggat

SEQ ID NO: 9487610 - DNA, 22 bp, Homo sapiens
ctctgatgtcgagtaaggtgtg

SEQ ID NO: 9487611 - DNA, 22 bp, Homo sapiens
ctctgcaatctgagcacttgta

SEQ ID NO: 9487612 - DNA, 22 bp, Homo sapiens
ctctgcaagtccagcccctggc

SEQ ID NO: 9487613 - DNA, 22 bp, Homo sapiens
tttgactcattgattttctctg

SEQ ID NO: 9487614 - DNA, 22 bp, Homo sapiens
tttgactcaagcctttctttag

SEQ ID NO: 9487615 - DNA, 22 bp, Homo sapiens
ctctgcagaatttgagctgctc

SEQ ID NO: 9487616 - DNA, 22 bp, Homo sapiens
ctctgcagaggcccaaggctga

SEQ ID NO: 9487617 - DNA, 22 bp, Homo sapiens
ctctgcagaatttgagctgctc

SEQ ID NO: 9487618 - DNA, 22 bp, Homo sapiens
tttggaatggtaccttcagttg

SEQ ID NO: 9487619 - DNA, 22 bp, Homo sapiens
tttggaatggaatagagattgc

SEQ ID NO: 9487620 - DNA, 22 bp, Homo sapiens
tttggaatgtagtttaatcatc

SEQ ID NO: 9487621 - DNA, 22 bp, Homo sapiens
tttggaatgttaggtgtctcat

SEQ ID NO: 9487622 - DNA, 22 bp, Homo sapiens
tttggaattatgcttaaagttt

SEQ ID NO: 9487623 - DNA, 20 bp, Homo sapiens
ctctgggctgcaccctcgcc

SEQ ID NO: 9487624 - DNA, 20 bp, Homo sapiens
ctctgggctgcaccctcgcc

SEQ ID NO: 9487625 - DNA, 22 bp, Homo sapiens
tttggaattccatttctgcatt

SEQ ID NO: 9487626 - DNA, 22 bp, Homo sapiens
ctctgggctgaatggctgaacc

SEQ ID NO: 9487627 - DNA, 22 bp, Homo sapiens
tttggaatgaaacagcagagcc

SEQ ID NO: 9487628 - DNA, 20 bp, Homo sapiens
ctctggctccgcgtgaccgc

SEQ ID NO: 9487629 - DNA, 22 bp, Homo sapiens
ctctggctcccgcagcccccat

SEQ ID NO: 9487630 - DNA, 22 bp, Homo sapiens
tttggaagtaaatgagtgtttt

SEQ ID NO: 9487631 - DNA, 22 bp, Homo sapiens
ctctggctcccgcagcccccat

SEQ ID NO: 9487632 - DNA, 22 bp, Homo sapiens
ctctggctcccgcagcccccat

SEQ ID NO: 9487633 - DNA, 22 bp, Homo sapiens
ctctggctcccgcagcccccat

SEQ ID NO: 9487634 - DNA, 22 bp, Homo sapiens
ctctggctccatttccctatgt

SEQ ID NO: 9487635 - DNA, 22 bp, Homo sapiens
ctctggctccatttccctatgt

SEQ ID NO: 9487636 - DNA, 22 bp, Homo sapiens
ctctggctccatttccctatgt

SEQ ID NO: 9487637 - DNA, 22 bp, Homo sapiens
ctctggctatctgtttctatgt

SEQ ID NO: 9487638 - DNA, 22 bp, Homo sapiens
ctctggctatctgtttctatgt

SEQ ID NO: 9487639 - DNA, 22 bp, Homo sapiens
ctctggctatctgtttctatgt

SEQ ID NO: 9487640 - DNA, 22 bp, Homo sapiens
ctctggctatggcacggcgctc

SEQ ID NO: 9487641 - DNA, 22 bp, Homo sapiens
tttgttcattagtacagttgta

SEQ ID NO: 9487642 - DNA, 22 bp, Homo sapiens
tttgttcattaaaagtgctgta

SEQ ID NO: 9487643 - DNA, 22 bp, Homo sapiens
tttgttcatgcctatattctca

SEQ ID NO: 9487644 - DNA, 22 bp, Homo sapiens
tttgttcatgaaaacctagatc

SEQ ID NO: 9487645 - DNA, 21 bp, Homo sapiens
tttgttcatagctcactcttt

SEQ ID NO: 9487646 - DNA, 22 bp, Homo sapiens
tttgttcataatggcaaagaga

SEQ ID NO: 9487647 - DNA, 21 bp, Homo sapiens
tttgttcaggcaagttacagt

SEQ ID NO: 9487648 - DNA, 22 bp, Homo sapiens
ctctgggtgtcttaggagctca

SEQ ID NO: 9487649 - DNA, 22 bp, Homo sapiens
ctctgggtgtgacagcacctgg

SEQ ID NO: 9487650 - DNA, 22 bp, Homo sapiens
ctctgggtgtgacagcacctgg

SEQ ID NO: 9487651 - DNA, 22 bp, Homo sapiens
ctctgggtgttaatgtcagtgt

SEQ ID NO: 9487652 - DNA, 22 bp, Homo sapiens
ctctgggtgttaatgtcagtgt

SEQ ID NO: 9487653 - DNA, 22 bp, Homo sapiens
ctctgggtggtctcactgagtg

SEQ ID NO: 9487654 - DNA, 22 bp, Homo sapiens
ctctgggtggtctcactgagtg

SEQ ID NO: 9487655 - DNA, 22 bp, Homo sapiens
ctctgggtgtcttaggagctca

SEQ ID NO: 9487656 - DNA, 22 bp, Homo sapiens
ctctgggtgggcagcagatgga

SEQ ID NO: 9487657 - DNA, 22 bp, Homo sapiens
ctctgggtgggcagcagatgga

SEQ ID NO: 9487658 - DNA, 22 bp, Homo sapiens
ctctgggtctacctgtggccag

SEQ ID NO: 9487659 - DNA, 20 bp, Homo sapiens
ctctgggtcgagacagactt

SEQ ID NO: 9487660 - DNA, 22 bp, Homo sapiens
ctctgggtcctggggctacaag

SEQ ID NO: 9487661 - DNA, 23 bp, Homo sapiens
ctctgggtccgatgtcctgacag

SEQ ID NO: 9487662 - DNA, 22 bp, Homo sapiens
ctctgggtctataatgcagctg

SEQ ID NO: 9487663 - DNA, 22 bp, Homo sapiens
ctctgggtctccctgaggctaa

SEQ ID NO: 9487664 - DNA, 17 bp, Homo sapiens
ctctgggtctcctgctt

SEQ ID NO: 9487665 - DNA, 17 bp, Homo sapiens
ctctgggtctcctgctt

SEQ ID NO: 9487666 - DNA, 22 bp, Homo sapiens
ctctgggtgagacagacctggt

SEQ ID NO: 9487667 - DNA, 22 bp, Homo sapiens
ttttgctgtgtccttgagccgg

SEQ ID NO: 9487668 - DNA, 22 bp, Homo sapiens
ttttgctgttatatgctattat

SEQ ID NO: 9487669 - DNA, 22 bp, Homo sapiens
ttttgcttaatctagattttgc

SEQ ID NO: 9487670 - DNA, 22 bp, Homo sapiens
ttttgctggggtggctagctta

SEQ ID NO: 9487671 - DNA, 22 bp, Homo sapiens
ttttgcctgagatccgagtctg

SEQ ID NO: 9487672 - DNA, 22 bp, Homo sapiens
ttttgcctgtgaatactatctt

SEQ ID NO: 9487673 - DNA, 22 bp, Homo sapiens
ttttgcctgcactgtatatata

SEQ ID NO: 9487674 - DNA, 17 bp, Homo sapiens
ttttctctcttggattc

SEQ ID NO: 9487675 - DNA, 22 bp, Homo sapiens
ttttctctccaggtggggtgat

SEQ ID NO: 9487676 - DNA, 21 bp, Homo sapiens
ctctgtgttgagggtgttgag

SEQ ID NO: 9487677 - DNA, 22 bp, Homo sapiens
ttttgcctgagagtgaaaataa

SEQ ID NO: 9487678 - DNA, 22 bp, Homo sapiens
ttttgcctgagagtgaaaataa

SEQ ID NO: 9487679 - DNA, 22 bp, Homo sapiens
ttttgcctagggttgacccgtt

SEQ ID NO: 9487680 - DNA, 22 bp, Homo sapiens
ttttgcctaagaatctctctga

SEQ ID NO: 9487681 - DNA, 22 bp, Homo sapiens
ttttctcttccctctggacctg

SEQ ID NO: 9487682 - DNA, 22 bp, Homo sapiens
ctctgtgtcagctgggtgtgca

SEQ ID NO: 9487683 - DNA, 22 bp, Homo sapiens
ctctgtggttagactatggctg

SEQ ID NO: 9487684 - DNA, 22 bp, Homo sapiens
ctctgtgtctgagttatggtct

SEQ ID NO: 9487685 - DNA, 22 bp, Homo sapiens
ctctgtgtctgaagccctattt

SEQ ID NO: 9487686 - DNA, 22 bp, Homo sapiens
ctctgtgtggtagattccatta

SEQ ID NO: 9487687 - DNA, 22 bp, Homo sapiens
ctctgtgtgctggtggggtcct

SEQ ID NO: 9487688 - DNA, 22 bp, Homo sapiens
ctctgtgttccgggttgctgct

SEQ ID NO: 9487689 - DNA, 22 bp, Homo sapiens
ctctgtgttcagcctagcagaa

SEQ ID NO: 9487690 - DNA, 22 bp, Homo sapiens
ctctgtgttcagcctagcagaa

SEQ ID NO: 9487691 - DNA, 22 bp, Homo sapiens
ctctgtgtggtcctctgtattg

SEQ ID NO: 9487692 - DNA, 22 bp, Homo sapiens
ctctgtgtggtatgattgtcat

SEQ ID NO: 9487693 - DNA, 22 bp, Homo sapiens
ctctgtgtggtcctctgtattg

SEQ ID NO: 9487694 - DNA, 22 bp, Homo sapiens
ctctgtgggcctgtgctttagt

SEQ ID NO: 9487695 - DNA, 22 bp, Homo sapiens
ctctgtgggaagctgggtgtga

SEQ ID NO: 9487696 - DNA, 22 bp, Homo sapiens
ctctgtggaagaagaaagaagg

SEQ ID NO: 9487697 - DNA, 22 bp, Homo sapiens
ctctggttgcagctgaagttcc

SEQ ID NO: 9487698 - DNA, 22 bp, Homo sapiens
ctctggttgagtgagaaccaag

SEQ ID NO: 9487699 - DNA, 22 bp, Homo sapiens
tttgttctagatcgtgtttgtg

SEQ ID NO: 9487700 - DNA, 22 bp, Homo sapiens
ctctggtttatttcttggaaag

SEQ ID NO: 9487701 - DNA, 22 bp, Homo sapiens
ctctggtttcgcaggaaataga

SEQ ID NO: 9487702 - DNA, 22 bp, Homo sapiens
tttgttctagatcgtgtttgtg

SEQ ID NO: 9487703 - DNA, 22 bp, Homo sapiens
tttgttctaacttctgcagaca

SEQ ID NO: 9487704 - DNA, 22 bp, Homo sapiens
tttgttcccagatttgctggca

SEQ ID NO: 9487705 - DNA, 22 bp, Homo sapiens
tttgttcccagatttgctggca

SEQ ID NO: 9487706 - DNA, 22 bp, Homo sapiens
tttgttcattttgagctcatca

SEQ ID NO: 9487707 - DNA, 17 bp, Homo sapiens
tttgttcattgaagaga

SEQ ID NO: 9487708 - DNA, 22 bp, Homo sapiens
ctctgtgccctactgctcagct

SEQ ID NO: 9487709 - DNA, 22 bp, Homo sapiens
ctctgtgattttgtgagccaga

SEQ ID NO: 9487710 - DNA, 22 bp, Homo sapiens
ctctgtgcttatgctccatggg

SEQ ID NO: 9487711 - DNA, 22 bp, Homo sapiens
tttcagaaattatattagatgc

SEQ ID NO: 9487712 - DNA, 22 bp, Homo sapiens
tttcagaaatggcactgaaatc

SEQ ID NO: 9487713 - DNA, 22 bp, Homo sapiens
tttcagaaccaagagagacatc

SEQ ID NO: 9487714 - DNA, 22 bp, Homo sapiens
tttcagaaggggagaaaggtca

SEQ ID NO: 9487715 - DNA, 22 bp, Homo sapiens
tttcagaaccgctaaaataaat

SEQ ID NO: 9487716 - DNA, 22 bp, Homo sapiens
tttcagaagtcaactaggtaaa

SEQ ID NO: 9487717 - DNA, 22 bp, Homo sapiens
tttcagaaccaagagagacatc

SEQ ID NO: 9487718 - DNA, 22 bp, Homo sapiens
tttcagaaccaagagagacatc

SEQ ID NO: 9487719 - DNA, 22 bp, Homo sapiens
tttcagaaccaagagagacatc

SEQ ID NO: 9487720 - DNA, 22 bp, Homo sapiens
tttcagaaccgctaaaataaat

SEQ ID NO: 9487721 - DNA, 22 bp, Homo sapiens
tttcagaaccgctaaaataaat

SEQ ID NO: 9487722 - DNA, 22 bp, Homo sapiens
tttcagaaccgctaaaataaat

SEQ ID NO: 9487723 - DNA, 22 bp, Homo sapiens
tttcagaaccgctaaaataaat

SEQ ID NO: 9487724 - DNA, 22 bp, Homo sapiens
tttattcagcagcagcagtggt

SEQ ID NO: 9487725 - DNA, 22 bp, Homo sapiens
tttattcatcatctgttcatat

SEQ ID NO: 9487726 - DNA, 22 bp, Homo sapiens
tttattcatcatctgttcatat

SEQ ID NO: 9487727 - DNA, 22 bp, Homo sapiens
tttcacatataggggaagctac

SEQ ID NO: 9487728 - DNA, 22 bp, Homo sapiens
tttcacatataggggaagctac

SEQ ID NO: 9487729 - DNA, 22 bp, Homo sapiens
tttcacatataggggaagctac

SEQ ID NO: 9487730 - DNA, 22 bp, Homo sapiens
tttcacatatcaactctatcct

SEQ ID NO: 9487731 - DNA, 22 bp, Homo sapiens
tttcacatataggggaagctac

SEQ ID NO: 9487732 - DNA, 22 bp, Homo sapiens
ctccttcctgccccagtgataa

SEQ ID NO: 9487733 - DNA, 22 bp, Homo sapiens
ctccttcctgcagatctgagat

SEQ ID NO: 9487734 - DNA, 22 bp, Homo sapiens
ctccttcctgcagatctgagat

SEQ ID NO: 9487735 - DNA, 22 bp, Homo sapiens
ctccttcctgcagatctgagat

SEQ ID NO: 9487736 - DNA, 22 bp, Homo sapiens
ctccttcctgcagatctgagat

SEQ ID NO: 9487737 - DNA, 22 bp, Homo sapiens
tttcagtttcatggcacagcta

SEQ ID NO: 9487738 - DNA, 22 bp, Homo sapiens
ctccttcctggttagcacctta

SEQ ID NO: 9487739 - DNA, 22 bp, Homo sapiens
ctccttcccatgagtgtgggca

SEQ ID NO: 9487740 - DNA, 22 bp, Homo sapiens
ctccttcccatgagtgtgggca

SEQ ID NO: 9487741 - DNA, 22 bp, Homo sapiens
ctccttcccctactcagcatcc

SEQ ID NO: 9487742 - DNA, 22 bp, Homo sapiens
ctccttcccctactcagcatcc

SEQ ID NO: 9487743 - DNA, 19 bp, Homo sapiens
ctccttccctggtttctgt

SEQ ID NO: 9487744 - DNA, 22 bp, Homo sapiens
ctccttccctaccatcaatgtt

SEQ ID NO: 9487745 - DNA, 22 bp, Homo sapiens
ctccttcccttcaagtgttcct

SEQ ID NO: 9487746 - DNA, 23 bp, Homo sapiens
tttcagaagtggtcctaggaagc

SEQ ID NO: 9487747 - DNA, 22 bp, Homo sapiens
tttcagaagtcaactaggtaaa

SEQ ID NO: 9487748 - DNA, 22 bp, Homo sapiens
tttcagaatagcaaagcaagct

SEQ ID NO: 9487749 - DNA, 22 bp, Homo sapiens
ctccttcatgtcatgtgtccgg

SEQ ID NO: 9487750 - DNA, 22 bp, Homo sapiens
ctccttccaacaagagaaagag

SEQ ID NO: 9487751 - DNA, 22 bp, Homo sapiens
ctccttccaacaagagaaagag

SEQ ID NO: 9487752 - DNA, 22 bp, Homo sapiens
ctccttcatgtcatgtgtccgg

SEQ ID NO: 9487753 - DNA, 22 bp, Homo sapiens
ctccttcagctgaatccctgct

SEQ ID NO: 9487754 - DNA, 22 bp, Homo sapiens
ctcctgttgcactagttcctga

SEQ ID NO: 9487755 - DNA, 22 bp, Homo sapiens
ctcctgtgttcaagcgattctc

SEQ ID NO: 9487756 - DNA, 22 bp, Homo sapiens
tttattcacttcagtgccaaag

SEQ ID NO: 9487757 - DNA, 22 bp, Homo sapiens
tttattcacttcagtgccaaag

SEQ ID NO: 9487758 - DNA, 22 bp, Homo sapiens
tttattcacttcagtgccaaag

SEQ ID NO: 9487759 - DNA, 19 bp, Homo sapiens
tttattcacctttaccttg

SEQ ID NO: 9487760 - DNA, 19 bp, Homo sapiens
tttattcacctttaccttg

SEQ ID NO: 9487761 - DNA, 22 bp, Homo sapiens
tttattcactcattcagccagt

SEQ ID NO: 9487762 - DNA, 22 bp, Homo sapiens
tttatgtaagtggaatgatgcc

SEQ ID NO: 9487763 - DNA, 19 bp, Homo sapiens
tttattcacctttaccttg

SEQ ID NO: 9487764 - DNA, 22 bp, Homo sapiens
tttatgtaagtggaatgatgcc

SEQ ID NO: 9487765 - DNA, 22 bp, Homo sapiens
tttatgtaagtggaatgatgcc

SEQ ID NO: 9487766 - DNA, 22 bp, Homo sapiens
tttatgtaagtggaatgatgcc

SEQ ID NO: 9487767 - DNA, 22 bp, Homo sapiens
tttatgcacaattagtcttata

SEQ ID NO: 9487768 - DNA, 22 bp, Homo sapiens
tttatgcacacttagacatggc

SEQ ID NO: 9487769 - DNA, 22 bp, Homo sapiens
tttatgcacacttagacatggc

SEQ ID NO: 9487770 - DNA, 21 bp, Homo sapiens
tttatgcagataatgctattt

SEQ ID NO: 9487771 - DNA, 22 bp, Homo sapiens
tttatgattattttaaagcagc

SEQ ID NO: 9487772 - DNA, 22 bp, Homo sapiens
tttatgattattttaaagcagc

SEQ ID NO: 9487773 - DNA, 22 bp, Homo sapiens
tttatgcagcactttacatttg

SEQ ID NO: 9487774 - DNA, 23 bp, Homo sapiens
tttatgcagcatgtagaacatgg

SEQ ID NO: 9487775 - DNA, 22 bp, Homo sapiens
tttatgcagatttgtacagtga

SEQ ID NO: 9487776 - DNA, 22 bp, Homo sapiens
tttatgcagcactttacatttg

SEQ ID NO: 9487777 - DNA, 21 bp, Homo sapiens
tttatgcagataatgctattt

SEQ ID NO: 9487778 - DNA, 22 bp, Homo sapiens
tttatgcagcctcagtatcaga

SEQ ID NO: 9487779 - DNA, 23 bp, Homo sapiens
tttatgcagcatgtagaacatgg

SEQ ID NO: 9487780 - DNA, 21 bp, Homo sapiens
tttatgcatgcctctctgtca

SEQ ID NO: 9487781 - DNA, 22 bp, Homo sapiens
tttatgcctccagatcttgctt

SEQ ID NO: 9487782 - DNA, 22 bp, Homo sapiens
tttatgcatctctaggaagggc

SEQ ID NO: 9487783 - DNA, 22 bp, Homo sapiens
tttatgctcatccaaggaaggt

SEQ ID NO: 9487784 - DNA, 22 bp, Homo sapiens
tttatgctactcaatagtcagt

SEQ ID NO: 9487785 - DNA, 22 bp, Homo sapiens
tttatgctactcaatagtcagt

SEQ ID NO: 9487786 - DNA, 22 bp, Homo sapiens
tttatgggcatccagggggtat

SEQ ID NO: 9487787 - DNA, 22 bp, Homo sapiens
ctccaggccatggctgcggagg

SEQ ID NO: 9487788 - DNA, 22 bp, Homo sapiens
ctccaggccagggaagtggaca

SEQ ID NO: 9487789 - DNA, 22 bp, Homo sapiens
ctccaggcccacggccgcggcc

SEQ ID NO: 9487790 - DNA, 22 bp, Homo sapiens
tttatgagcctcaaatctgagt

SEQ ID NO: 9487791 - DNA, 22 bp, Homo sapiens
tttatgattaatccaattctgt

SEQ ID NO: 9487792 - DNA, 23 bp, Homo sapiens
tttatattcctaatgtcttgagc

SEQ ID NO: 9487793 - DNA, 23 bp, Homo sapiens
tttatattcctaatgtcttgagc

SEQ ID NO: 9487794 - DNA, 23 bp, Homo sapiens
tttatattcctaatgtcttgagc

SEQ ID NO: 9487795 - DNA, 22 bp, Homo sapiens
ctccaggcccacgtcgaggagg

SEQ ID NO: 9487796 - DNA, 22 bp, Homo sapiens
ctccaggcccctggccttctgc

SEQ ID NO: 9487797 - DNA, 19 bp, Homo sapiens
ctccaggatggctgggcga

SEQ ID NO: 9487798 - DNA, 22 bp, Homo sapiens
ctccaggatgttagacgtccag

SEQ ID NO: 9487799 - DNA, 22 bp, Homo sapiens
ctccaggatgttagacgtccag

SEQ ID NO: 9487800 - DNA, 22 bp, Homo sapiens
ctccaggagtggcctggacacc

SEQ ID NO: 9487801 - DNA, 22 bp, Homo sapiens
ctccaggatacctgttcctata

SEQ ID NO: 9487802 - DNA, 22 bp, Homo sapiens
ctccaggagggggatggctgta

SEQ ID NO: 9487803 - DNA, 22 bp, Homo sapiens
ctccaggaggttgctgcttcct

SEQ ID NO: 9487804 - DNA, 22 bp, Homo sapiens
ctccaggagggcttcctgtgat

SEQ ID NO: 9487805 - DNA, 22 bp, Homo sapiens
ctccaggactgaggacagagct

SEQ ID NO: 9487806 - DNA, 22 bp, Homo sapiens
tttctcaaatactgttccagga

SEQ ID NO: 9487807 - DNA, 22 bp, Homo sapiens
tttctattttaaaggcatatgg

SEQ ID NO: 9487808 - DNA, 22 bp, Homo sapiens
tttctcaacctcaacactattt

SEQ ID NO: 9487809 - DNA, 22 bp, Homo sapiens
tttctcaacagagtatgccctt

SEQ ID NO: 9487810 - DNA, 22 bp, Homo sapiens
tttctcaaattgcatgagtagc

SEQ ID NO: 9487811 - DNA, 22 bp, Homo sapiens
tttctcaaattgcatgagtagc

SEQ ID NO: 9487812 - DNA, 22 bp, Homo sapiens
tttctcaaatactgttccagga

SEQ ID NO: 9487813 - DNA, 22 bp, Homo sapiens
tttctcaaattgcatgagtagc

SEQ ID NO: 9487814 - DNA, 22 bp, Homo sapiens
tttctacatgtcagtaactgat

SEQ ID NO: 9487815 - DNA, 22 bp, Homo sapiens
tttctacatgtcaatccaaacc

SEQ ID NO: 9487816 - DNA, 22 bp, Homo sapiens
tttctacatgtcagtaactgat

SEQ ID NO: 9487817 - DNA, 22 bp, Homo sapiens
tttctattttaaaggcatatgg

SEQ ID NO: 9487818 - DNA, 22 bp, Homo sapiens
tttctattttaaaggcatatgg

SEQ ID NO: 9487819 - DNA, 22 bp, Homo sapiens
tttctattttaaaggcatatgg

SEQ ID NO: 9487820 - DNA, 22 bp, Homo sapiens
tttctacatgtcaatccaaacc

SEQ ID NO: 9487821 - DNA, 22 bp, Homo sapiens
tttctcaaggtgtcatgtattt

SEQ ID NO: 9487822 - DNA, 22 bp, Homo sapiens
tttctcaaggtgtcatgtattt

SEQ ID NO: 9487823 - DNA, 22 bp, Homo sapiens
tttctcaagctgtttgccaatt

SEQ ID NO: 9487824 - DNA, 18 bp, Homo sapiens
tttctcaaggctgacatt

SEQ ID NO: 9487825 - DNA, 18 bp, Homo sapiens
tttctcaaggctgacatt

SEQ ID NO: 9487826 - DNA, 22 bp, Homo sapiens
tttctcaactgtattatgcaga

SEQ ID NO: 9487827 - DNA, 22 bp, Homo sapiens
tttctcaactgtattatgcaga

SEQ ID NO: 9487828 - DNA, 22 bp, Homo sapiens
ctctctggcccatcctgttgcc

SEQ ID NO: 9487829 - DNA, 22 bp, Homo sapiens
ctctctggcccatcctgttgcc

SEQ ID NO: 9487830 - DNA, 22 bp, Homo sapiens
tttctcaagttcagatatttga

SEQ ID NO: 9487831 - DNA, 22 bp, Homo sapiens
tttctcaagttcagatatttga

SEQ ID NO: 9487832 - DNA, 18 bp, Homo sapiens
ctctctggtctggatccc

SEQ ID NO: 9487833 - DNA, 18 bp, Homo sapiens
ctctctggtctggatccc

SEQ ID NO: 9487834 - DNA, 18 bp, Homo sapiens
ctctctggtctggatccc

SEQ ID NO: 9487835 - DNA, 18 bp, Homo sapiens
ctctctggtctggatccc

SEQ ID NO: 9487836 - DNA, 19 bp, Homo sapiens
ctctctggcggtgtctgcg

SEQ ID NO: 9487837 - DNA, 22 bp, Homo sapiens
ctctctgtggtggctgtcccat

SEQ ID NO: 9487838 - DNA, 22 bp, Homo sapiens
ctctctgtggtggctgtcccat

SEQ ID NO: 9487839 - DNA, 22 bp, Homo sapiens
ctctctgtggtggctgtcccat

SEQ ID NO: 9487840 - DNA, 22 bp, Homo sapiens
ctctctgtggtggctgtcccat

SEQ ID NO: 9487841 - DNA, 22 bp, Homo sapiens
ctctctggtttcagcgaagggg

SEQ ID NO: 9487842 - DNA, 22 bp, Homo sapiens
ctctctggtttcagcgaagggg

SEQ ID NO: 9487843 - DNA, 22 bp, Homo sapiens
ctctctgtatgtgtatatttat

SEQ ID NO: 9487844 - DNA, 22 bp, Homo sapiens
ctctctgttcattgagtcaaaa

SEQ ID NO: 9487845 - DNA, 22 bp, Homo sapiens
ctctctgttatgctttcatgaa

SEQ ID NO: 9487846 - DNA, 22 bp, Homo sapiens
ctctctttcattggtcgccttg

SEQ ID NO: 9487847 - DNA, 18 bp, Homo sapiens
ctctctttccactctttg

SEQ ID NO: 9487848 - DNA, 18 bp, Homo sapiens
ctctctttccactctttg

SEQ ID NO: 9487849 - DNA, 22 bp, Homo sapiens
ctctgaaagagtttagtattat

SEQ ID NO: 9487850 - DNA, 22 bp, Homo sapiens
ctctgaaagagtttagtattat

SEQ ID NO: 9487851 - DNA, 22 bp, Homo sapiens
ctctgaaagcaaaactagagaa

SEQ ID NO: 9487852 - DNA, 22 bp, Homo sapiens
ctctgaaagttagagaaaatag

SEQ ID NO: 9487853 - DNA, 22 bp, Homo sapiens
ctctctttttcgtgtgccgaag

SEQ ID NO: 9487854 - DNA, 22 bp, Homo sapiens
ctctctttgatgtataaataat

SEQ ID NO: 9487855 - DNA, 22 bp, Homo sapiens
ctctctttctgaatgaggacta

SEQ ID NO: 9487856 - DNA, 22 bp, Homo sapiens
tttccaagagcttatttctgaa

SEQ ID NO: 9487857 - DNA, 22 bp, Homo sapiens
tttccaagagcttatttctgaa

SEQ ID NO: 9487858 - DNA, 22 bp, Homo sapiens
tttccaagttgttaccttctac

SEQ ID NO: 9487859 - DNA, 22 bp, Homo sapiens
tttccaagtactgagctgtcaa

SEQ ID NO: 9487860 - DNA, 22 bp, Homo sapiens
tttccaataaggtcaccttcct

SEQ ID NO: 9487861 - DNA, 22 bp, Homo sapiens
tttccaataaagtgtcattgtt

SEQ ID NO: 9487862 - DNA, 22 bp, Homo sapiens
tttcattagtatgacagcacgc

SEQ ID NO: 9487863 - DNA, 22 bp, Homo sapiens
tttcattataaaaagttggctt

SEQ ID NO: 9487864 - DNA, 18 bp, Homo sapiens
tttcattataaagcaggc

SEQ ID NO: 9487865 - DNA, 18 bp, Homo sapiens
tttcattataaagcaggc

SEQ ID NO: 9487866 - DNA, 22 bp, Homo sapiens
tttcagtttccagctttgtcat

SEQ ID NO: 9487867 - DNA, 22 bp, Homo sapiens
tttcatgttggatactgtttca

SEQ ID NO: 9487868 - DNA, 22 bp, Homo sapiens
tttcattaaagtcaaatctggt

SEQ ID NO: 9487869 - DNA, 22 bp, Homo sapiens
tttcatgttttcttaaatggca

SEQ ID NO: 9487870 - DNA, 22 bp, Homo sapiens
tttcattaaagtcaaatctggt

SEQ ID NO: 9487871 - DNA, 22 bp, Homo sapiens
tttcattacgtgtttgacttgt

SEQ ID NO: 9487872 - DNA, 22 bp, Homo sapiens
tttcattacgtgtttgacttgt

SEQ ID NO: 9487873 - DNA, 22 bp, Homo sapiens
tttcattacgtgtttgacttgt

SEQ ID NO: 9487874 - DNA, 22 bp, Homo sapiens
tttcattaaagtcaaatctggt

SEQ ID NO: 9487875 - DNA, 22 bp, Homo sapiens
tttctacaacacttctgaatct

SEQ ID NO: 9487876 - DNA, 22 bp, Homo sapiens
tttcctttctcaagagccggca

SEQ ID NO: 9487877 - DNA, 22 bp, Homo sapiens
tttctacacttcgtggtgtttt

SEQ ID NO: 9487878 - DNA, 22 bp, Homo sapiens
tttctacagaagatacactgct

SEQ ID NO: 9487879 - DNA, 22 bp, Homo sapiens
tttctacagaagatacactgct

SEQ ID NO: 9487880 - DNA, 22 bp, Homo sapiens
tttctacagaagatacactgct

SEQ ID NO: 9487881 - DNA, 22 bp, Homo sapiens
tttctacagaagatacactgct

SEQ ID NO: 9487882 - DNA, 22 bp, Homo sapiens
tttctacaatttttggcatgag

SEQ ID NO: 9487883 - DNA, 22 bp, Homo sapiens
tttctacagaagatacactgct

SEQ ID NO: 9487884 - DNA, 22 bp, Homo sapiens
tttctacagctggtgcaacttt

SEQ ID NO: 9487885 - DNA, 22 bp, Homo sapiens
tttctacagctggtgcaacttt

SEQ ID NO: 9487886 - DNA, 22 bp, Homo sapiens
tttctacagctggtgcaacttt

SEQ ID NO: 9487887 - DNA, 22 bp, Homo sapiens
tttctacagtactgatttcata

SEQ ID NO: 9487888 - DNA, 22 bp, Homo sapiens
tttccacaatttgagcagcaga

SEQ ID NO: 9487889 - DNA, 22 bp, Homo sapiens
tttccaatttggtagtcatcgg

SEQ ID NO: 9487890 - DNA, 22 bp, Homo sapiens
tttccaatttggtagtcatcgg

SEQ ID NO: 9487891 - DNA, 22 bp, Homo sapiens
tttccaatttggtagtcatcgg

SEQ ID NO: 9487892 - DNA, 22 bp, Homo sapiens
tttccaattcaagcttttacgt

SEQ ID NO: 9487893 - DNA, 22 bp, Homo sapiens
tttcctttctagaagcctaaat

SEQ ID NO: 9487894 - DNA, 22 bp, Homo sapiens
tttcctttctagaagcctaaat

SEQ ID NO: 9487895 - DNA, 22 bp, Homo sapiens
tttccactctggccaccatctt

SEQ ID NO: 9487896 - DNA, 22 bp, Homo sapiens
tttccacccagagcatttgttt

SEQ ID NO: 9487897 - DNA, 22 bp, Homo sapiens
tttccactcctattgcatctca

SEQ ID NO: 9487898 - DNA, 22 bp, Homo sapiens
tttccacagctgtataaaataa

SEQ ID NO: 9487899 - DNA, 22 bp, Homo sapiens
tttccacactgcagccagcaaa

SEQ ID NO: 9487900 - DNA, 22 bp, Homo sapiens
ttctggaagctggaaaaggcaa

SEQ ID NO: 9487901 - DNA, 22 bp, Homo sapiens
ttctggaagctgggcagcaccc

SEQ ID NO: 9487902 - DNA, 22 bp, Homo sapiens
ttctggaagctgggcagcaccc

SEQ ID NO: 9487903 - DNA, 22 bp, Homo sapiens
ttctggaaggcagggagaaccc

SEQ ID NO: 9487904 - DNA, 22 bp, Homo sapiens
ttctggaagggtggagtagctt

SEQ ID NO: 9487905 - DNA, 22 bp, Homo sapiens
ttctggaagggtggagtagctt

SEQ ID NO: 9487906 - DNA, 23 bp, Homo sapiens
ttctggatgttctagtctgagag

SEQ ID NO: 9487907 - DNA, 22 bp, Homo sapiens
ttctggaagccctaagggagaa

SEQ ID NO: 9487908 - DNA, 22 bp, Homo sapiens
ttctggaagccccagagtcaga

SEQ ID NO: 9487909 - DNA, 22 bp, Homo sapiens
ttctggaagctgcaggtggccg

SEQ ID NO: 9487910 - DNA, 23 bp, Homo sapiens
ttctggaagatttacttgagaca

SEQ ID NO: 9487911 - DNA, 22 bp, Homo sapiens
ttctggaagccatgggaacagg

SEQ ID NO: 9487912 - DNA, 22 bp, Homo sapiens
ttctggaagccccagagtcaga

SEQ ID NO: 9487913 - DNA, 22 bp, Homo sapiens
ttctggaaccagcctgcctggg

SEQ ID NO: 9487914 - DNA, 22 bp, Homo sapiens
ttctggaaccagcctgcctggg

SEQ ID NO: 9487915 - DNA, 22 bp, Homo sapiens
ttctggaaccagcctgcctggg

SEQ ID NO: 9487916 - DNA, 22 bp, Homo sapiens
ttctggaaccaacatgccagtt

SEQ ID NO: 9487917 - DNA, 22 bp, Homo sapiens
ttctgcatgtgtttcaaatact

SEQ ID NO: 9487918 - DNA, 22 bp, Homo sapiens
ttctgcatggagaaactgagtc

SEQ ID NO: 9487919 - DNA, 17 bp, Homo sapiens
ttctgcatgtgaagatg

SEQ ID NO: 9487920 - DNA, 22 bp, Homo sapiens
ttctgcatggttggggagaagc

SEQ ID NO: 9487921 - DNA, 22 bp, Homo sapiens
ttctgcatgatattaaatgtaa

SEQ ID NO: 9487922 - DNA, 22 bp, Homo sapiens
ttctgcatgatattaaatgtaa

SEQ ID NO: 9487923 - DNA, 22 bp, Homo sapiens
ttctgcatgaaaagaactgaac

SEQ ID NO: 9487924 - DNA, 22 bp, Homo sapiens
ttctgcatgaacagtttattcc

SEQ ID NO: 9487925 - DNA, 22 bp, Homo sapiens
ttctgcatctcacagccagtgc

SEQ ID NO: 9487926 - DNA, 22 bp, Homo sapiens
ttctatgtggatatagaactgc

SEQ ID NO: 9487927 - DNA, 22 bp, Homo sapiens
ttctatgtgaacgttatagttt

SEQ ID NO: 9487928 - DNA, 22 bp, Homo sapiens
ttctatgtcagtgtgctctgtg

SEQ ID NO: 9487929 - DNA, 22 bp, Homo sapiens
ttctattgaatgataatctata

SEQ ID NO: 9487930 - DNA, 22 bp, Homo sapiens
ttctattgacattcactgtaac

SEQ ID NO: 9487931 - DNA, 22 bp, Homo sapiens
ttctattaatatgttaattctg

SEQ ID NO: 9487932 - DNA, 22 bp, Homo sapiens
ttctatgttctaagtctcaagg

SEQ ID NO: 9487933 - DNA, 22 bp, Homo sapiens
ttctattaatatgttaattctg

SEQ ID NO: 9487934 - DNA, 22 bp, Homo sapiens
ttctattgcacacaaataatta

SEQ ID NO: 9487935 - DNA, 22 bp, Homo sapiens
ttctattgggcagcattgcttc

SEQ ID NO: 9487936 - DNA, 22 bp, Homo sapiens
ttctatttccagtccttcagag

SEQ ID NO: 9487937 - DNA, 22 bp, Homo sapiens
ttctatttccagtccttcagag

SEQ ID NO: 9487938 - DNA, 22 bp, Homo sapiens
ttctattgtaccttttctctca

SEQ ID NO: 9487939 - DNA, 22 bp, Homo sapiens
ttctgaagctcccttttgtagt

SEQ ID NO: 9487940 - DNA, 22 bp, Homo sapiens
ttctgaagctcccttttgtagt

SEQ ID NO: 9487941 - DNA, 22 bp, Homo sapiens
ttctatttcttaatcttggctg

SEQ ID NO: 9487942 - DNA, 22 bp, Homo sapiens
ttctgcagctgtctcgcaggca

SEQ ID NO: 9487943 - DNA, 22 bp, Homo sapiens
ttctgcaggagccctagtgtat

SEQ ID NO: 9487944 - DNA, 22 bp, Homo sapiens
ttctgcagcccaacagtagttt

SEQ ID NO: 9487945 - DNA, 22 bp, Homo sapiens
ttctgaaggctcctcaggaaag

SEQ ID NO: 9487946 - DNA, 22 bp, Homo sapiens
ttctgaaggctcctcaggaaag

SEQ ID NO: 9487947 - DNA, 22 bp, Homo sapiens
ttctgcaggctgtacaagaagc

SEQ ID NO: 9487948 - DNA, 22 bp, Homo sapiens
ttctgcagtgttaacaatgtca

SEQ ID NO: 9487949 - DNA, 22 bp, Homo sapiens
ttctgcagtgaatgactcaata

SEQ ID NO: 9487950 - DNA, 22 bp, Homo sapiens
ttctgcagtgttaacaatgtca

SEQ ID NO: 9487951 - DNA, 22 bp, Homo sapiens
ttctgcatacactgaatgtagt

SEQ ID NO: 9487952 - DNA, 22 bp, Homo sapiens
ttctgcataggctatatttgtt

SEQ ID NO: 9487953 - DNA, 22 bp, Homo sapiens
ttctgcatcccagaagaggaca

SEQ ID NO: 9487954 - DNA, 22 bp, Homo sapiens
ctaaaaatccacactaggtgaa

SEQ ID NO: 9487955 - DNA, 22 bp, Homo sapiens
ctaaaaatccacactaggtgaa

SEQ ID NO: 9487956 - DNA, 22 bp, Homo sapiens
ctaaaaactctacgatgcacag

SEQ ID NO: 9487957 - DNA, 22 bp, Homo sapiens
ctagaaatacaggcacgtgcca

SEQ ID NO: 9487958 - DNA, 22 bp, Homo sapiens
ctagagaaaatgttaatacagt

SEQ ID NO: 9487959 - DNA, 22 bp, Homo sapiens
ctagagaaaatgatagcaggaa

SEQ ID NO: 9487960 - DNA, 22 bp, Homo sapiens
ctagagaaaggcagtggagcaa

SEQ ID NO: 9487961 - DNA, 22 bp, Homo sapiens
ctagagaaacgccgtgggagga

SEQ ID NO: 9487962 - DNA, 22 bp, Homo sapiens
ctagagaaaccccatgagcttt

SEQ ID NO: 9487963 - DNA, 22 bp, Homo sapiens
ctagagaacaacattcatatgg

SEQ ID NO: 9487964 - DNA, 22 bp, Homo sapiens
ctagagaagaggttaagcatga

SEQ ID NO: 9487965 - DNA, 22 bp, Homo sapiens
ctagagaagaggctcagccagc

SEQ ID NO: 9487966 - DNA, 22 bp, Homo sapiens
ctagagaatcttttaagaagtg

SEQ ID NO: 9487967 - DNA, 22 bp, Homo sapiens
ctagagaatcttttaagaagtg

SEQ ID NO: 9487968 - DNA, 22 bp, Homo sapiens
ctagagaattgtcttgagagtt

SEQ ID NO: 9487969 - DNA, 22 bp, Homo sapiens
ctagagaattgtcttgagagtt

SEQ ID NO: 9487970 - DNA, 22 bp, Homo sapiens
ctagaggctcagcagatgcctg

SEQ ID NO: 9487971 - DNA, 22 bp, Homo sapiens
ctagagcagattgcagagtagg

SEQ ID NO: 9487972 - DNA, 22 bp, Homo sapiens
ctagagctgttctgtgcactca

SEQ ID NO: 9487973 - DNA, 22 bp, Homo sapiens
ctagataaggtggcttggaatt

SEQ ID NO: 9487974 - DNA, 22 bp, Homo sapiens
ctagataaggatttctcaactt

SEQ ID NO: 9487975 - DNA, 22 bp, Homo sapiens
ctagaggtgagatggaatcact

SEQ ID NO: 9487976 - DNA, 22 bp, Homo sapiens
ctagaggtagaggcagtgggaa

SEQ ID NO: 9487977 - DNA, 22 bp, Homo sapiens
ctagaggtctactcttggtagt

SEQ ID NO: 9487978 - DNA, 22 bp, Homo sapiens
ttctatgattcatttagaagtt

SEQ ID NO: 9487979 - DNA, 22 bp, Homo sapiens
cgtgtctgggatagcagaagta

SEQ ID NO: 9487980 - DNA, 22 bp, Homo sapiens
cgtgtctgggctcccatggcag

SEQ ID NO: 9487981 - DNA, 22 bp, Homo sapiens
cgtgtctgtgtatgcaggccgt

SEQ ID NO: 9487982 - DNA, 22 bp, Homo sapiens
cgtgtctgtatgtcaatcagct

SEQ ID NO: 9487983 - DNA, 23 bp, Homo sapiens
cgtgtctgtgggcgatccggcct

SEQ ID NO: 9487984 - DNA, 17 bp, Homo sapiens
cgtgtgcttgtgtgcac

SEQ ID NO: 9487985 - DNA, 17 bp, Homo sapiens
cgtgtgcttgtgtgcac

SEQ ID NO: 9487986 - DNA, 22 bp, Homo sapiens
cgtgtgcgcacacctgtttcca

SEQ ID NO: 9487987 - DNA, 22 bp, Homo sapiens
cgtgtgcgtgcatatgcacaag

SEQ ID NO: 9487988 - DNA, 22 bp, Homo sapiens
cgtgtgtgtacctgcgcattta

SEQ ID NO: 9487989 - DNA, 22 bp, Homo sapiens
cgtgtgtgtacctgcgcattta

SEQ ID NO: 9487990 - DNA, 20 bp, Homo sapiens
cgtgtgtggctattttgggt

SEQ ID NO: 9487991 - DNA, 22 bp, Homo sapiens
cgtgtgtgtacctgcgcattta

SEQ ID NO: 9487992 - DNA, 20 bp, Homo sapiens
cgtgtgtggctattttgggt

SEQ ID NO: 9487993 - DNA, 20 bp, Homo sapiens
cgtgtgtggctattttgggt

SEQ ID NO: 9487994 - DNA, 22 bp, Homo sapiens
cgttaataggtgcaaggtaagg

SEQ ID NO: 9487995 - DNA, 22 bp, Homo sapiens
cgtgtttcagccagggccacct

SEQ ID NO: 9487996 - DNA, 22 bp, Homo sapiens
cgtgtgtgtacctgcgcattta

SEQ ID NO: 9487997 - DNA, 22 bp, Homo sapiens
cgtttattttgaagattccact

SEQ ID NO: 9487998 - DNA, 22 bp, Homo sapiens
cgtttattttgaagattccact

SEQ ID NO: 9487999 - DNA, 22 bp, Homo sapiens
cgttcttttcatatttacatgg

SEQ ID NO: 9488000 - DNA, 22 bp, Homo sapiens
cgttcctctactccagctaccc

SEQ ID NO: 9488001 - DNA, 22 bp, Homo sapiens
cgtttccaactgtgatgaggtc

SEQ ID NO: 9488002 - DNA, 17 bp, Homo sapiens
cgttggtttgcctcatt

SEQ ID NO: 9488003 - DNA, 22 bp, Homo sapiens
cgtttattttgaagattccact

SEQ ID NO: 9488004 - DNA, 22 bp, Homo sapiens
cgtttttcagtggtcttaggtc

SEQ ID NO: 9488005 - DNA, 16 bp, Homo sapiens
cgtttccatcctttgt

SEQ ID NO: 9488006 - DNA, 22 bp, Homo sapiens
ctaaaaatccacactaggtgaa

SEQ ID NO: 9488007 - DNA, 23 bp, Homo sapiens
cgttttttcctcagatgttctgg

SEQ ID NO: 9488008 - DNA, 22 bp, Homo sapiens
ttctttctctccacaaggcttg

SEQ ID NO: 9488009 - DNA, 22 bp, Homo sapiens
ttctttctctactagcagagct

SEQ ID NO: 9488010 - DNA, 22 bp, Homo sapiens
ctcactgcaagctccacctctt

SEQ ID NO: 9488011 - DNA, 22 bp, Homo sapiens
ctcactgcaagctcagcctccc

SEQ ID NO: 9488012 - DNA, 22 bp, Homo sapiens
ctcactgcaagctcagcctccc

SEQ ID NO: 9488013 - DNA, 22 bp, Homo sapiens
ctcagagaagatggatgaggta

SEQ ID NO: 9488014 - DNA, 22 bp, Homo sapiens
ctcagagaagatggatgaggta

SEQ ID NO: 9488015 - DNA, 22 bp, Homo sapiens
ctcagagaaaaggagcaagggt

SEQ ID NO: 9488016 - DNA, 22 bp, Homo sapiens
ctcagagaaaaggagcaagggt

SEQ ID NO: 9488017 - DNA, 21 bp, Homo sapiens
ctcagagaaatgtctgggagc

SEQ ID NO: 9488018 - DNA, 22 bp, Homo sapiens
ctcagaaaggtgccatttatgt

SEQ ID NO: 9488019 - DNA, 22 bp, Homo sapiens
ttctttctgtccataatgagac

SEQ ID NO: 9488020 - DNA, 19 bp, Homo sapiens
ctcagagaggggcagtgcc

SEQ ID NO: 9488021 - DNA, 22 bp, Homo sapiens
ctcagagagttaagtgaattac

SEQ ID NO: 9488022 - DNA, 22 bp, Homo sapiens
ctcagagagacaatgtgggaca

SEQ ID NO: 9488023 - DNA, 22 bp, Homo sapiens
ctcagagagggcaccagggcca

SEQ ID NO: 9488024 - DNA, 22 bp, Homo sapiens
ctcagagcaatgaacatgcaaa

SEQ ID NO: 9488025 - DNA, 17 bp, Homo sapiens
ctcagagcaggacagaa

SEQ ID NO: 9488026 - DNA, 22 bp, Homo sapiens
ctcagagcacagtttatgacag

SEQ ID NO: 9488027 - DNA, 17 bp, Homo sapiens
ctcagagcaggacagaa

SEQ ID NO: 9488028 - DNA, 17 bp, Homo sapiens
ctcagagcaggacagaa

SEQ ID NO: 9488029 - DNA, 21 bp, Homo sapiens
ctcagagcagttcagagggat

SEQ ID NO: 9488030 - DNA, 22 bp, Homo sapiens
ctcagagctcagctttgttagt

SEQ ID NO: 9488031 - DNA, 22 bp, Homo sapiens
ctcagaggcaagcaaggagctg

SEQ ID NO: 9488032 - DNA, 22 bp, Homo sapiens
ctcagaggcaagcaaggagctg

SEQ ID NO: 9488033 - DNA, 22 bp, Homo sapiens
ctcagaggcaagcaaggagctg

SEQ ID NO: 9488034 - DNA, 22 bp, Homo sapiens
ctcagaggcaagcaaggagctg

SEQ ID NO: 9488035 - DNA, 22 bp, Homo sapiens
ctcagagctgaggccagggaca

SEQ ID NO: 9488036 - DNA, 22 bp, Homo sapiens
ctcagagctgaggccagggaca

SEQ ID NO: 9488037 - DNA, 22 bp, Homo sapiens
ctatacagagcatccttaactt

SEQ ID NO: 9488038 - DNA, 22 bp, Homo sapiens
ctatacagcagcttactagtta

SEQ ID NO: 9488039 - DNA, 22 bp, Homo sapiens
ctataagacagatactgacttt

SEQ ID NO: 9488040 - DNA, 22 bp, Homo sapiens
ctataagacagatactgacttt

SEQ ID NO: 9488041 - DNA, 22 bp, Homo sapiens
ctataaatctacccagcattgg

SEQ ID NO: 9488042 - DNA, 22 bp, Homo sapiens
ctataaatctacccagcattgg

SEQ ID NO: 9488043 - DNA, 22 bp, Homo sapiens
ctataaatctacccagcattgg

SEQ ID NO: 9488044 - DNA, 22 bp, Homo sapiens
ctataaatctacccagcattgg

SEQ ID NO: 9488045 - DNA, 22 bp, Homo sapiens
ctataaatctacccagcattgg

SEQ ID NO: 9488046 - DNA, 22 bp, Homo sapiens
ttctggcttgacccctacttcc

SEQ ID NO: 9488047 - DNA, 22 bp, Homo sapiens
ttctggctttaggcttttcaag

SEQ ID NO: 9488048 - DNA, 22 bp, Homo sapiens
ttctggcttacttcactcattt

SEQ ID NO: 9488049 - DNA, 23 bp, Homo sapiens
ttctggctgtgggtggcgtctct

SEQ ID NO: 9488050 - DNA, 22 bp, Homo sapiens
ttctggcaaggcaagcctggct

SEQ ID NO: 9488051 - DNA, 22 bp, Homo sapiens
ttctggcatctgggggaggcct

SEQ ID NO: 9488052 - DNA, 22 bp, Homo sapiens
ttctggcatgagagatgggggt

SEQ ID NO: 9488053 - DNA, 22 bp, Homo sapiens
ttctggcatgagagatgggggt

SEQ ID NO: 9488054 - DNA, 22 bp, Homo sapiens
ttctggccaaggctgccagatt

SEQ ID NO: 9488055 - DNA, 22 bp, Homo sapiens
ttctggctcatatgctaagaag

SEQ ID NO: 9488056 - DNA, 22 bp, Homo sapiens
ttctggctgaaagtttatttga

SEQ ID NO: 9488057 - DNA, 23 bp, Homo sapiens
ttctggctccgagctccatcttc

SEQ ID NO: 9488058 - DNA, 22 bp, Homo sapiens
ttctggctccagatgcttctgt

SEQ ID NO: 9488059 - DNA, 22 bp, Homo sapiens
ctatacagtgactagaagtaat

SEQ ID NO: 9488060 - DNA, 22 bp, Homo sapiens
ctatacagtaaccacagtgatt

SEQ ID NO: 9488061 - DNA, 22 bp, Homo sapiens
ctatacagcagcttactagtta

SEQ ID NO: 9488062 - DNA, 19 bp, Homo sapiens
ctatacagcctctgaggaa

SEQ ID NO: 9488063 - DNA, 22 bp, Homo sapiens
ctatactactatacagatgtaa

SEQ ID NO: 9488064 - DNA, 22 bp, Homo sapiens
ctatacatcccaatttcagaga

SEQ ID NO: 9488065 - DNA, 22 bp, Homo sapiens
ctatacagtgactagaagtaat

SEQ ID NO: 9488066 - DNA, 22 bp, Homo sapiens
ctatagaaaattgtatcacacg

SEQ ID NO: 9488067 - DNA, 22 bp, Homo sapiens
ctcacaggttctgcagctcaca

SEQ ID NO: 9488068 - DNA, 22 bp, Homo sapiens
ctcacaggttctgcagctcaca

SEQ ID NO: 9488069 - DNA, 22 bp, Homo sapiens
ctatagaaacaacctctctttc

SEQ ID NO: 9488070 - DNA, 22 bp, Homo sapiens
ctatagaaaattgtatcacacg

SEQ ID NO: 9488071 - DNA, 22 bp, Homo sapiens
ctatagaaacaacctctctttc

SEQ ID NO: 9488072 - DNA, 22 bp, Homo sapiens
ctcacccatatctccatgactc

SEQ ID NO: 9488073 - DNA, 22 bp, Homo sapiens
ctcacccagaggctttccccct

SEQ ID NO: 9488074 - DNA, 22 bp, Homo sapiens
ctcacaggttctgcagctcaca

SEQ ID NO: 9488075 - DNA, 22 bp, Homo sapiens
ctcactgcaacctccgcctcct

SEQ ID NO: 9488076 - DNA, 22 bp, Homo sapiens
ctcactgcaacctctgcctccc

SEQ ID NO: 9488077 - DNA, 22 bp, Homo sapiens
ctcactgcaacctctgcctccc

SEQ ID NO: 9488078 - DNA, 22 bp, Homo sapiens
ctcactgcaacctctgcctccc

SEQ ID NO: 9488079 - DNA, 22 bp, Homo sapiens
ctcactgcaagctcagcctccc

SEQ ID NO: 9488080 - DNA, 22 bp, Homo sapiens
ctcaccccactaccccttggtg

SEQ ID NO: 9488081 - DNA, 22 bp, Homo sapiens
ctcaccccactaccccttggtg

SEQ ID NO: 9488082 - DNA, 22 bp, Homo sapiens
ctcacccatatctccatgactc

SEQ ID NO: 9488083 - DNA, 22 bp, Homo sapiens
ctcacccatatctccatgactc

SEQ ID NO: 9488084 - DNA, 22 bp, Homo sapiens
ctcacccctgtaattccagcac

SEQ ID NO: 9488085 - DNA, 22 bp, Homo sapiens
ctcacccctgtaattccagcac

SEQ ID NO: 9488086 - DNA, 22 bp, Homo sapiens
ctcacccctgtaattccagcac

SEQ ID NO: 9488087 - DNA, 22 bp, Homo sapiens
ctcacctccaggagctgctggc

SEQ ID NO: 9488088 - DNA, 19 bp, Homo sapiens
ctcacctggaggtgctgat

SEQ ID NO: 9488089 - DNA, 22 bp, Homo sapiens
ttgcatatatttctaaggaggt

SEQ ID NO: 9488090 - DNA, 22 bp, Homo sapiens
ttgcatatcctccaacacatgg

SEQ ID NO: 9488091 - DNA, 22 bp, Homo sapiens
ttgcatatgaagctgacttaaa

SEQ ID NO: 9488092 - DNA, 22 bp, Homo sapiens
ttgcatatcctccaacacatgg

SEQ ID NO: 9488093 - DNA, 22 bp, Homo sapiens
ttgcatcagaaaatatgggaag

SEQ ID NO: 9488094 - DNA, 22 bp, Homo sapiens
ttgcccagagtccacagcgtac

SEQ ID NO: 9488095 - DNA, 22 bp, Homo sapiens
ttgcccagagtccacagcgtac

SEQ ID NO: 9488096 - DNA, 22 bp, Homo sapiens
ttgccctgaagaacgtcccaga

SEQ ID NO: 9488097 - DNA, 22 bp, Homo sapiens
ttgccctgcctccctgaggtga

SEQ ID NO: 9488098 - DNA, 22 bp, Homo sapiens
ttgccctgcagcggtgagtggt

SEQ ID NO: 9488099 - DNA, 22 bp, Homo sapiens
ttgcccatctcagtgcctcgct

SEQ ID NO: 9488100 - DNA, 22 bp, Homo sapiens
ttgccctgtggggcctccagcc

SEQ ID NO: 9488101 - DNA, 22 bp, Homo sapiens
ttgccctgtcagtagaagtgca

SEQ ID NO: 9488102 - DNA, 22 bp, Homo sapiens
ttgccctggggctggcctggca

SEQ ID NO: 9488103 - DNA, 22 bp, Homo sapiens
ttgccctggggctggcctggca

SEQ ID NO: 9488104 - DNA, 22 bp, Homo sapiens
ttgccctgcgttaccatctctt

SEQ ID NO: 9488105 - DNA, 22 bp, Homo sapiens
ttgccctgcgggtcctgcgcaa

SEQ ID NO: 9488106 - DNA, 22 bp, Homo sapiens
ctcaggtcacaggatggccagg

SEQ ID NO: 9488107 - DNA, 22 bp, Homo sapiens
ctcaggtagagtctgcatgggg

SEQ ID NO: 9488108 - DNA, 22 bp, Homo sapiens
ctcagtactttatgtatatgat

SEQ ID NO: 9488109 - DNA, 22 bp, Homo sapiens
ctcagtcagtttttgtgagaga

SEQ ID NO: 9488110 - DNA, 22 bp, Homo sapiens
ctcagtaaggatgcttcagcgg

SEQ ID NO: 9488111 - DNA, 20 bp, Homo sapiens
ctcagtaaaagcacagggtc

SEQ ID NO: 9488112 - DNA, 22 bp, Homo sapiens
ctcaggtcttagttctgtcatc

SEQ ID NO: 9488113 - DNA, 18 bp, Homo sapiens
ctcagggtgaccaatgca

SEQ ID NO: 9488114 - DNA, 22 bp, Homo sapiens
ctcagggcttgagtgtccagga

SEQ ID NO: 9488115 - DNA, 22 bp, Homo sapiens
ctcagggctggaaagccaggaa

SEQ ID NO: 9488116 - DNA, 23 bp, Homo sapiens
ctcagggatagaaaggaagacag

SEQ ID NO: 9488117 - DNA, 22 bp, Homo sapiens
ctcagggatggtgaagcaccca

SEQ ID NO: 9488118 - DNA, 22 bp, Homo sapiens
ctcagggaattatttctgtcct

SEQ ID NO: 9488119 - DNA, 22 bp, Homo sapiens
ctcagggaagctatggtgaggg

SEQ ID NO: 9488120 - DNA, 22 bp, Homo sapiens
ctcagggagtagcacatgtgga

SEQ ID NO: 9488121 - DNA, 22 bp, Homo sapiens
ctcagggcggcgggcagcccag

SEQ ID NO: 9488122 - DNA, 22 bp, Homo sapiens
ctcagggcggcgggcagcccag

SEQ ID NO: 9488123 - DNA, 22 bp, Homo sapiens
ctcagggctctgcatgcacacg

SEQ ID NO: 9488124 - DNA, 22 bp, Homo sapiens
ctcagggctggaaagccaggaa

SEQ ID NO: 9488125 - DNA, 22 bp, Homo sapiens
ctcagggccaaggatgctgttg

SEQ ID NO: 9488126 - DNA, 18 bp, Homo sapiens
ctcagggcatcagtctgg

SEQ ID NO: 9488127 - DNA, 18 bp, Homo sapiens
ctcagggcatcagtctgg

SEQ ID NO: 9488128 - DNA, 22 bp, Homo sapiens
ctcaggaaccgcggcagcagcc

SEQ ID NO: 9488129 - DNA, 22 bp, Homo sapiens
ctcaggaaaggccatgcaaggg

SEQ ID NO: 9488130 - DNA, 22 bp, Homo sapiens
ctcaggaaaatattgaagaagt

SEQ ID NO: 9488131 - DNA, 22 bp, Homo sapiens
ctcaggaaaatattgaagaagt

SEQ ID NO: 9488132 - DNA, 22 bp, Homo sapiens
ctcaggaaaggccatgcaaggg

SEQ ID NO: 9488133 - DNA, 22 bp, Homo sapiens
ctcaggaaaatattgaagaagt

SEQ ID NO: 9488134 - DNA, 22 bp, Homo sapiens
ctcaggaaaatattgaagaagt

SEQ ID NO: 9488135 - DNA, 22 bp, Homo sapiens
ctcagcttctacctcctgagtg

SEQ ID NO: 9488136 - DNA, 22 bp, Homo sapiens
ctcagcttcatttgttccatga

SEQ ID NO: 9488137 - DNA, 19 bp, Homo sapiens
ctcagctgtagctcatgtg

SEQ ID NO: 9488138 - DNA, 22 bp, Homo sapiens
ctcagccccaatttgccctctt

SEQ ID NO: 9488139 - DNA, 23 bp, Homo sapiens
ctcagaggcctgtccagggtggt

SEQ ID NO: 9488140 - DNA, 23 bp, Homo sapiens
ctcagaggcctgtccagggtggt

SEQ ID NO: 9488141 - DNA, 22 bp, Homo sapiens
ctcagaggcaagcaaggagctg

SEQ ID NO: 9488142 - DNA, 22 bp, Homo sapiens
ctcagaggcaagcaaggagctg

SEQ ID NO: 9488143 - DNA, 22 bp, Homo sapiens
ctcaggactttcaaatagaaat

SEQ ID NO: 9488144 - DNA, 22 bp, Homo sapiens
ctcaggagacagtgtccacatg

SEQ ID NO: 9488145 - DNA, 22 bp, Homo sapiens
ctcaggagacagtgtccacatg

SEQ ID NO: 9488146 - DNA, 22 bp, Homo sapiens
ctcaggacccaccttattagga

SEQ ID NO: 9488147 - DNA, 22 bp, Homo sapiens
ctcaggacttggttagtgtttt

SEQ ID NO: 9488148 - DNA, 22 bp, Homo sapiens
ctcaggactcagagacactctc

SEQ ID NO: 9488149 - DNA, 22 bp, Homo sapiens
ctcaggaaccgcggcagcagcc

SEQ ID NO: 9488150 - DNA, 22 bp, Homo sapiens
ctcaggaaccgcggcagcagcc

SEQ ID NO: 9488151 - DNA, 22 bp, Homo sapiens
ctcaggaagcacaggccctaca

SEQ ID NO: 9488152 - DNA, 22 bp, Homo sapiens
ctcaggaaggaagcagggagcc

SEQ ID NO: 9488153 - DNA, 22 bp, Homo sapiens
ctcaggaagcctgtaatgtggg

SEQ ID NO: 9488154 - DNA, 22 bp, Homo sapiens
ctcaggaggtggtagaggccct

SEQ ID NO: 9488155 - DNA, 22 bp, Homo sapiens
ctcaggaggtggtagaggccct

SEQ ID NO: 9488156 - DNA, 22 bp, Homo sapiens
ctcaggaggtggtagaggccct

SEQ ID NO: 9488157 - DNA, 22 bp, Homo sapiens
ctcaggagatgacagaaggtat

SEQ ID NO: 9488158 - DNA, 22 bp, Homo sapiens
ctcaggaggaggaagttcattg

SEQ ID NO: 9488159 - DNA, 22 bp, Homo sapiens
ttgcataaaagagtatatctta

SEQ ID NO: 9488160 - DNA, 22 bp, Homo sapiens
ttgcataaatgcttaaaatttg

SEQ ID NO: 9488161 - DNA, 22 bp, Homo sapiens
ttgcataaatgcttaaaatttg

SEQ ID NO: 9488162 - DNA, 22 bp, Homo sapiens
ttgcagtttgcttttaatggga

SEQ ID NO: 9488163 - DNA, 22 bp, Homo sapiens
ttgcagtttctggatgccttct

SEQ ID NO: 9488164 - DNA, 22 bp, Homo sapiens
ttgcagtttgtggcaactttga

SEQ ID NO: 9488165 - DNA, 22 bp, Homo sapiens
ttgcagttttctgcctcatttc

SEQ ID NO: 9488166 - DNA, 22 bp, Homo sapiens
ttgcagttttgacagaccaaat

SEQ ID NO: 9488167 - DNA, 22 bp, Homo sapiens
ttgcagttttctgcctcatttc

SEQ ID NO: 9488168 - DNA, 22 bp, Homo sapiens
ttgcataaaagagtatatctta

SEQ ID NO: 9488169 - DNA, 22 bp, Homo sapiens
ttgcataaagattttattgcat

SEQ ID NO: 9488170 - DNA, 22 bp, Homo sapiens
ctcaggagtagttcagcagctg

SEQ ID NO: 9488171 - DNA, 22 bp, Homo sapiens
ttgcagttgctgtatttaagga

SEQ ID NO: 9488172 - DNA, 22 bp, Homo sapiens
ttgcagttgctttctatattga

SEQ ID NO: 9488173 - DNA, 22 bp, Homo sapiens
ttgcagttgctttctatattga

SEQ ID NO: 9488174 - DNA, 19 bp, Homo sapiens
ttgcagttgggtggggagt

SEQ ID NO: 9488175 - DNA, 22 bp, Homo sapiens
ttgcagttgctttctatattga

SEQ ID NO: 9488176 - DNA, 22 bp, Homo sapiens
ttgcagttgtctttcctaattt

SEQ ID NO: 9488177 - DNA, 22 bp, Homo sapiens
ttgcagttgttgccttccctga

SEQ ID NO: 9488178 - DNA, 22 bp, Homo sapiens
ttgcagttgtttagaatatgtg

SEQ ID NO: 9488179 - DNA, 22 bp, Homo sapiens
ttgcagttgtctttcctaattt

SEQ ID NO: 9488180 - DNA, 22 bp, Homo sapiens
ttgcagtttatgttcctgcagt

SEQ ID NO: 9488181 - DNA, 22 bp, Homo sapiens
ttgcagtttctggatgccttct

SEQ ID NO: 9488182 - DNA, 22 bp, Homo sapiens
ttgcagttgtttagaatatgtg

SEQ ID NO: 9488183 - DNA, 22 bp, Homo sapiens
ctcagtcatgacgctcaggacc

SEQ ID NO: 9488184 - DNA, 22 bp, Homo sapiens
ctcagtccacgcagcctcctga

SEQ ID NO: 9488185 - DNA, 22 bp, Homo sapiens
ctcagtccacgcagcctcctga

SEQ ID NO: 9488186 - DNA, 22 bp, Homo sapiens
ctcagtccagggaccggcctcc

SEQ ID NO: 9488187 - DNA, 22 bp, Homo sapiens
ttggaaaatgaggcacagagag

SEQ ID NO: 9488188 - DNA, 22 bp, Homo sapiens
ctcagtgcttctagcttgatga

SEQ ID NO: 9488189 - DNA, 22 bp, Homo sapiens
ttggaaaagtgaaactagatgc

SEQ ID NO: 9488190 - DNA, 22 bp, Homo sapiens
ctcagtgcaaccaaagtgatct

SEQ ID NO: 9488191 - DNA, 21 bp, Homo sapiens
ttggaagataatgcttatgat

SEQ ID NO: 9488192 - DNA, 22 bp, Homo sapiens
ttggaagatctaacagaggcat

SEQ ID NO: 9488193 - DNA, 22 bp, Homo sapiens
ttggaagattacttagttttct

SEQ ID NO: 9488194 - DNA, 22 bp, Homo sapiens
ttggaagattctgtgtctggtg

SEQ ID NO: 9488195 - DNA, 22 bp, Homo sapiens
ttggaagcagtgtacactgtac

SEQ ID NO: 9488196 - DNA, 22 bp, Homo sapiens
ttggaagcgagcacatggagga

SEQ ID NO: 9488197 - DNA, 22 bp, Homo sapiens
ttggaagccctgtgataggcca

SEQ ID NO: 9488198 - DNA, 23 bp, Homo sapiens
ttggaagccagacagctgtgcag

SEQ ID NO: 9488199 - DNA, 22 bp, Homo sapiens
ttggaaggatttagagatgtct

SEQ ID NO: 9488200 - DNA, 22 bp, Homo sapiens
ttggaaggagtctttggggatg

SEQ ID NO: 9488201 - DNA, 22 bp, Homo sapiens
ttggaggggccactgcagagct

SEQ ID NO: 9488202 - DNA, 22 bp, Homo sapiens
ttggaggggccactgcagagct

SEQ ID NO: 9488203 - DNA, 22 bp, Homo sapiens
ttggagggactgagcttcagtc

SEQ ID NO: 9488204 - DNA, 22 bp, Homo sapiens
ttggagggactgagcttcagtc

SEQ ID NO: 9488205 - DNA, 22 bp, Homo sapiens
ttggagggacagatggctaggc

SEQ ID NO: 9488206 - DNA, 22 bp, Homo sapiens
ttggagggtcttccacagccat

SEQ ID NO: 9488207 - DNA, 22 bp, Homo sapiens
ttggagggtcttccacagccat

SEQ ID NO: 9488208 - DNA, 22 bp, Homo sapiens
ttggagggtcttccacagccat

SEQ ID NO: 9488209 - DNA, 22 bp, Homo sapiens
ttggaggggccactgcagagct

SEQ ID NO: 9488210 - DNA, 22 bp, Homo sapiens
ttggatccatctcaggcatagg

SEQ ID NO: 9488211 - DNA, 22 bp, Homo sapiens
ttggatccatctcaggcatagg

SEQ ID NO: 9488212 - DNA, 22 bp, Homo sapiens
ctccactcaccagatgccagga

SEQ ID NO: 9488213 - DNA, 22 bp, Homo sapiens
ctccactcaccagatgccagga

SEQ ID NO: 9488214 - DNA, 22 bp, Homo sapiens
ctccactcaacaagcccagtgt

SEQ ID NO: 9488215 - DNA, 22 bp, Homo sapiens
ctccactcaacaagcccagtgt

SEQ ID NO: 9488216 - DNA, 20 bp, Homo sapiens
ttggagtctaaagactgggg

SEQ ID NO: 9488217 - DNA, 22 bp, Homo sapiens
ttggatacagatgaaaggaagg

SEQ ID NO: 9488218 - DNA, 22 bp, Homo sapiens
ttggctgccttcacccctggcc

SEQ ID NO: 9488219 - DNA, 22 bp, Homo sapiens
ctccagcctcatctcctggctg

SEQ ID NO: 9488220 - DNA, 22 bp, Homo sapiens
ttggctgctaatggctgacagc

SEQ ID NO: 9488221 - DNA, 22 bp, Homo sapiens
ctccagcctcatctcctggctg

SEQ ID NO: 9488222 - DNA, 22 bp, Homo sapiens
ctccagcctcatctcctggctg

SEQ ID NO: 9488223 - DNA, 22 bp, Homo sapiens
ttggctgccgagcgcatcccgg

SEQ ID NO: 9488224 - DNA, 22 bp, Homo sapiens
ttggctgcaatcacagggactc

SEQ ID NO: 9488225 - DNA, 22 bp, Homo sapiens
ttggctctgtgtctccactcaa

SEQ ID NO: 9488226 - DNA, 22 bp, Homo sapiens
ttggctgacaaatggaatctct

SEQ ID NO: 9488227 - DNA, 22 bp, Homo sapiens
ctccaggacccagtggctccag

SEQ ID NO: 9488228 - DNA, 22 bp, Homo sapiens
ctccaggactcaggcccctggg

SEQ ID NO: 9488229 - DNA, 22 bp, Homo sapiens
ctccaggactgaggacagagct

SEQ ID NO: 9488230 - DNA, 22 bp, Homo sapiens
ctccaggacactaacccaggct

SEQ ID NO: 9488231 - DNA, 22 bp, Homo sapiens
ctccaggacactaacccaggct

SEQ ID NO: 9488232 - DNA, 22 bp, Homo sapiens
ctccaggacagattcagggcca

SEQ ID NO: 9488233 - DNA, 22 bp, Homo sapiens
ctccaggaccagggctcctgga

SEQ ID NO: 9488234 - DNA, 22 bp, Homo sapiens
ctccaggacatgactttcttgc

SEQ ID NO: 9488235 - DNA, 22 bp, Homo sapiens
ttggctctaggaaccaaagtga

SEQ ID NO: 9488236 - DNA, 17 bp, Homo sapiens
ttggctctattgcctct

SEQ ID NO: 9488237 - DNA, 22 bp, Homo sapiens
ttggctctgaaacccaagctct

SEQ ID NO: 9488238 - DNA, 22 bp, Homo sapiens
ttggctctgaaacccaagctct

SEQ ID NO: 9488239 - DNA, 20 bp, Homo sapiens
ttggctctgatcagtggagc

SEQ ID NO: 9488240 - DNA, 22 bp, Homo sapiens
ttggctctgatggggatcagga

SEQ ID NO: 9488241 - DNA, 22 bp, Homo sapiens
ttggctctggaactatttctga

SEQ ID NO: 9488242 - DNA, 22 bp, Homo sapiens
ttggctctggaactatttctga

SEQ ID NO: 9488243 - DNA, 22 bp, Homo sapiens
ttggctctgtgtctccactcaa

SEQ ID NO: 9488244 - DNA, 22 bp, Homo sapiens
ctccagaggttctcatctggga

SEQ ID NO: 9488245 - DNA, 22 bp, Homo sapiens
ctccagaggttctcatctggga

SEQ ID NO: 9488246 - DNA, 22 bp, Homo sapiens
ctccagaggttctcatctggga

SEQ ID NO: 9488247 - DNA, 22 bp, Homo sapiens
ctccagagtcacactgcctggg

SEQ ID NO: 9488248 - DNA, 22 bp, Homo sapiens
ctccagagtcatcgagcattcc

SEQ ID NO: 9488249 - DNA, 22 bp, Homo sapiens
ctccagaggatgcaggtgaggg

SEQ ID NO: 9488250 - DNA, 22 bp, Homo sapiens
ctccagaggatgcaggtgaggg

SEQ ID NO: 9488251 - DNA, 18 bp, Homo sapiens
ctccagagctgtgagaca

SEQ ID NO: 9488252 - DNA, 18 bp, Homo sapiens
ctccagagctgtgagaca

SEQ ID NO: 9488253 - DNA, 22 bp, Homo sapiens
ctccagaggtccccgcggcact

SEQ ID NO: 9488254 - DNA, 22 bp, Homo sapiens
ctccagaggtccccgcggcact

SEQ ID NO: 9488255 - DNA, 22 bp, Homo sapiens
ctccagagggtcagactctgag

SEQ ID NO: 9488256 - DNA, 22 bp, Homo sapiens
ctccagaggccctatcccacta

SEQ ID NO: 9488257 - DNA, 22 bp, Homo sapiens
ctccagaggcgacttgcatcac

SEQ ID NO: 9488258 - DNA, 22 bp, Homo sapiens
cggcacagggtaaacgttaccc

SEQ ID NO: 9488259 - DNA, 22 bp, Homo sapiens
cggcaaagaacgctttttcaga

SEQ ID NO: 9488260 - DNA, 22 bp, Homo sapiens
cggatcctcagtcgtgcgggag

SEQ ID NO: 9488261 - DNA, 22 bp, Homo sapiens
cggatatgttttgattgaagga

SEQ ID NO: 9488262 - DNA, 22 bp, Homo sapiens
cggcagagccctgagtcagcct

SEQ ID NO: 9488263 - DNA, 22 bp, Homo sapiens
cggcagagcttcctgctcagcg

SEQ ID NO: 9488264 - DNA, 22 bp, Homo sapiens
cggcagagcggcgagcccctcc

SEQ ID NO: 9488265 - DNA, 22 bp, Homo sapiens
cggcagagcttcctgctcagcg

SEQ ID NO: 9488266 - DNA, 22 bp, Homo sapiens
cggcagcaaaggaagccaggtc

SEQ ID NO: 9488267 - DNA, 22 bp, Homo sapiens
cggcagggctccatgcatttct

SEQ ID NO: 9488268 - DNA, 22 bp, Homo sapiens
cggcagggttggttttctctga

SEQ ID NO: 9488269 - DNA, 22 bp, Homo sapiens
cggcaggacctcatttccttct

SEQ ID NO: 9488270 - DNA, 22 bp, Homo sapiens
cggcagcatcgaaactacattc

SEQ ID NO: 9488271 - DNA, 22 bp, Homo sapiens
cggaggttgaggctgcagtgag

SEQ ID NO: 9488272 - DNA, 22 bp, Homo sapiens
cggagtcttgctatgttgccca

SEQ ID NO: 9488273 - DNA, 22 bp, Homo sapiens
cggagtcttgctatgttgccca

SEQ ID NO: 9488274 - DNA, 22 bp, Homo sapiens
ttcaaatggttagactgttagc

SEQ ID NO: 9488275 - DNA, 22 bp, Homo sapiens
ttcaaatggttagactgttagc

SEQ ID NO: 9488276 - DNA, 22 bp, Homo sapiens
cggaggttgaggctgcagtgag

SEQ ID NO: 9488277 - DNA, 20 bp, Homo sapiens
cggactttcttctcagggca

SEQ ID NO: 9488278 - DNA, 21 bp, Homo sapiens
ttcaaagtttgcctaaagatt

SEQ ID NO: 9488279 - DNA, 21 bp, Homo sapiens
ttcaaagtttgcctaaagatt

SEQ ID NO: 9488280 - DNA, 22 bp, Homo sapiens
ttcaaagtttcaatctgtatca

SEQ ID NO: 9488281 - DNA, 22 bp, Homo sapiens
ttcaaatacattctttgccact

SEQ ID NO: 9488282 - DNA, 22 bp, Homo sapiens
ttcaaatacattctttgccact

SEQ ID NO: 9488283 - DNA, 22 bp, Homo sapiens
ttcaaatcctgcttatgctacc

SEQ ID NO: 9488284 - DNA, 22 bp, Homo sapiens
ttcaaatgatggcagtcctggc

SEQ ID NO: 9488285 - DNA, 22 bp, Homo sapiens
ttcaaatccctgctccactatt

SEQ ID NO: 9488286 - DNA, 22 bp, Homo sapiens
ttcaaatcctagccctgtggcc

SEQ ID NO: 9488287 - DNA, 22 bp, Homo sapiens
ttcaaagtgcttttaaccttta

SEQ ID NO: 9488288 - DNA, 22 bp, Homo sapiens
ttcaaagtgtgacctgacaagc

SEQ ID NO: 9488289 - DNA, 22 bp, Homo sapiens
ttcaaagttgcatgacagctta

SEQ ID NO: 9488290 - DNA, 22 bp, Homo sapiens
ttcaaagtgtgacctgacaagc

SEQ ID NO: 9488291 - DNA, 22 bp, Homo sapiens
ttcaaagtttcaatctgtatca

SEQ ID NO: 9488292 - DNA, 22 bp, Homo sapiens
cggggctgacagcaggtgtgct

SEQ ID NO: 9488293 - DNA, 22 bp, Homo sapiens
cggggctgacagcaggtgtgct

SEQ ID NO: 9488294 - DNA, 22 bp, Homo sapiens
cggggctgacagcaggtgtgct

SEQ ID NO: 9488295 - DNA, 22 bp, Homo sapiens
cggggctgacagcaggtgtgct

SEQ ID NO: 9488296 - DNA, 22 bp, Homo sapiens
cggggctgaggcaacgcggaga

SEQ ID NO: 9488297 - DNA, 22 bp, Homo sapiens
cggggccctggggctgaaggtc

SEQ ID NO: 9488298 - DNA, 22 bp, Homo sapiens
cggggccctggggctgaaggtc

SEQ ID NO: 9488299 - DNA, 22 bp, Homo sapiens
cggggccctggggctgaaggtc

SEQ ID NO: 9488300 - DNA, 22 bp, Homo sapiens
cggggccctggggctgaaggtc

SEQ ID NO: 9488301 - DNA, 22 bp, Homo sapiens
cggggcctagtctacctcggca

SEQ ID NO: 9488302 - DNA, 22 bp, Homo sapiens
cgtggtctcccacagaaagaag

SEQ ID NO: 9488303 - DNA, 22 bp, Homo sapiens
cgtgggctgcgcccagttcttc

SEQ ID NO: 9488304 - DNA, 22 bp, Homo sapiens
cgtgggagtggtgggtgctcag

SEQ ID NO: 9488305 - DNA, 22 bp, Homo sapiens
cgtggctggtggacctgagggc

SEQ ID NO: 9488306 - DNA, 22 bp, Homo sapiens
cgtggctggtggacctgagggc

SEQ ID NO: 9488307 - DNA, 22 bp, Homo sapiens
cggggctgctcgtcctcctgtg

SEQ ID NO: 9488308 - DNA, 21 bp, Homo sapiens
cgtgactgggtccgtctggct

SEQ ID NO: 9488309 - DNA, 21 bp, Homo sapiens
cgtgactgggtccgtctggct

SEQ ID NO: 9488310 - DNA, 22 bp, Homo sapiens
cgtgagcaaaatggacactccc

SEQ ID NO: 9488311 - DNA, 22 bp, Homo sapiens
cgtgagcaaaatggacactccc

SEQ ID NO: 9488312 - DNA, 22 bp, Homo sapiens
cgtggctggggcgactccacgg

SEQ ID NO: 9488313 - DNA, 22 bp, Homo sapiens
cgtgagcaaaatggacactccc

SEQ ID NO: 9488314 - DNA, 22 bp, Homo sapiens
cgggaggaaaggcgaggctctg

SEQ ID NO: 9488315 - DNA, 21 bp, Homo sapiens
cgggctggccgggccctcacc

SEQ ID NO: 9488316 - DNA, 22 bp, Homo sapiens
cgggctggctgcagctgctgga

SEQ ID NO: 9488317 - DNA, 22 bp, Homo sapiens
cgggctggctgcagctgctgga

SEQ ID NO: 9488318 - DNA, 22 bp, Homo sapiens
cgggctggctgcagctgctgga

SEQ ID NO: 9488319 - DNA, 22 bp, Homo sapiens
cgggctggctgcagctgctgga

SEQ ID NO: 9488320 - DNA, 22 bp, Homo sapiens
cgggctggctgcagctgctgga

SEQ ID NO: 9488321 - DNA, 22 bp, Homo sapiens
cggggaggcttcggattaaagc

SEQ ID NO: 9488322 - DNA, 22 bp, Homo sapiens
cggggaagcggttctggcggta

SEQ ID NO: 9488323 - DNA, 22 bp, Homo sapiens
cggggagggcagaggctccctc

SEQ ID NO: 9488324 - DNA, 22 bp, Homo sapiens
cggggagggcagaggctccctc

SEQ ID NO: 9488325 - DNA, 22 bp, Homo sapiens
cggggagggcagaggctccctc

SEQ ID NO: 9488326 - DNA, 22 bp, Homo sapiens
cggggagggcagaggctccctc

SEQ ID NO: 9488327 - DNA, 22 bp, Homo sapiens
cggggcagagggtcttctccag

SEQ ID NO: 9488328 - DNA, 22 bp, Homo sapiens
cggggccctggggctgaaggtc

SEQ ID NO: 9488329 - DNA, 22 bp, Homo sapiens
cggggccctggggctgaaggtc

SEQ ID NO: 9488330 - DNA, 23 bp, Homo sapiens
cggggccagggtcaggaccggtc

SEQ ID NO: 9488331 - DNA, 22 bp, Homo sapiens
cgctctggagaatagtagcttt

SEQ ID NO: 9488332 - DNA, 22 bp, Homo sapiens
cgctctggagaatagtagcttt

SEQ ID NO: 9488333 - DNA, 22 bp, Homo sapiens
cgctgataaacgtcacgttccc

SEQ ID NO: 9488334 - DNA, 19 bp, Homo sapiens
cgctctgggtttcgtgtca

SEQ ID NO: 9488335 - DNA, 22 bp, Homo sapiens
cgcctctctttttctcccagac

SEQ ID NO: 9488336 - DNA, 16 bp, Homo sapiens
cgcctccctccctcgc

SEQ ID NO: 9488337 - DNA, 22 bp, Homo sapiens
ttatttcatgtaaaatttatgt

SEQ ID NO: 9488338 - DNA, 22 bp, Homo sapiens
ttatttcatgtaaaatttatgt

SEQ ID NO: 9488339 - DNA, 22 bp, Homo sapiens
cgcctcagccgtggtcatcttc

SEQ ID NO: 9488340 - DNA, 16 bp, Homo sapiens
cgcctccctccctcgc

SEQ ID NO: 9488341 - DNA, 16 bp, Homo sapiens
cgcctccctccctcgc

SEQ ID NO: 9488342 - DNA, 22 bp, Homo sapiens
cgctggccatagcctcctgtgt

SEQ ID NO: 9488343 - DNA, 22 bp, Homo sapiens
cgctggcttcctcctggggcca

SEQ ID NO: 9488344 - DNA, 22 bp, Homo sapiens
ttcaaagtaccgtacttaatgg

SEQ ID NO: 9488345 - DNA, 22 bp, Homo sapiens
cgctgcgaggcgcccttgttgc

SEQ ID NO: 9488346 - DNA, 22 bp, Homo sapiens
cgctgccttcatcccacgccta

SEQ ID NO: 9488347 - DNA, 22 bp, Homo sapiens
cgctgcagatgggagctggttg

SEQ ID NO: 9488348 - DNA, 22 bp, Homo sapiens
cgctgcacgtgtcacactaacc

SEQ ID NO: 9488349 - DNA, 22 bp, Homo sapiens
cgctgcagacgcgctggcgaaa

SEQ ID NO: 9488350 - DNA, 22 bp, Homo sapiens
cgctgccttcatcccacgccta

SEQ ID NO: 9488351 - DNA, 22 bp, Homo sapiens
ttattgcagatggtgtgagaga

SEQ ID NO: 9488352 - DNA, 17 bp, Homo sapiens
ttattgcagtgctgaag

SEQ ID NO: 9488353 - DNA, 22 bp, Homo sapiens
ttattgccatcctggaacctag

SEQ ID NO: 9488354 - DNA, 17 bp, Homo sapiens
ttattgctataagctga

SEQ ID NO: 9488355 - DNA, 22 bp, Homo sapiens
ttattgctagtgtcatttcaca

SEQ ID NO: 9488356 - DNA, 22 bp, Homo sapiens
ttattgcactattgattttcta

SEQ ID NO: 9488357 - DNA, 22 bp, Homo sapiens
ttattgcactattgattttcta

SEQ ID NO: 9488358 - DNA, 23 bp, Homo sapiens
ttattgcaaggtaaaattgctga

SEQ ID NO: 9488359 - DNA, 22 bp, Homo sapiens
ttattgcaccatgcctcagttt

SEQ ID NO: 9488360 - DNA, 22 bp, Homo sapiens
ttattgcaactcctaaatagag

SEQ ID NO: 9488361 - DNA, 22 bp, Homo sapiens
ttatttcatataatgttatcaa

SEQ ID NO: 9488362 - DNA, 20 bp, Homo sapiens
ttatttcagttgctagattg

SEQ ID NO: 9488363 - DNA, 20 bp, Homo sapiens
ttatttcagttgctagattg

SEQ ID NO: 9488364 - DNA, 20 bp, Homo sapiens
ttatttcagttgctagattg

SEQ ID NO: 9488365 - DNA, 20 bp, Homo sapiens
ttatttcagttgctagattg

SEQ ID NO: 9488366 - DNA, 22 bp, Homo sapiens
ttatttattgtgtacctactgt

SEQ ID NO: 9488367 - DNA, 22 bp, Homo sapiens
ttatttattgtgtacctactgt

SEQ ID NO: 9488368 - DNA, 22 bp, Homo sapiens
ttatttattcattctgtctgtc

SEQ ID NO: 9488369 - DNA, 22 bp, Homo sapiens
ttatttattcattctgtctgtc

SEQ ID NO: 9488370 - DNA, 22 bp, Homo sapiens
ttatttattgtgtacctactgt

SEQ ID NO: 9488371 - DNA, 22 bp, Homo sapiens
ttatttattgtgtacctactgt

SEQ ID NO: 9488372 - DNA, 22 bp, Homo sapiens
ttatttatgttaacagtcgaga

SEQ ID NO: 9488373 - DNA, 22 bp, Homo sapiens
ttattgagtttacagctttaga

SEQ ID NO: 9488374 - DNA, 22 bp, Homo sapiens
ttattgcaaaggaagagcttga

SEQ ID NO: 9488375 - DNA, 23 bp, Homo sapiens
ttattgagggtgtagattggtgt

SEQ ID NO: 9488376 - DNA, 22 bp, Homo sapiens
ttattgcaaaggaagagcttga

SEQ ID NO: 9488377 - DNA, 22 bp, Homo sapiens
ttattgcaaccttttctggtgt

SEQ ID NO: 9488378 - DNA, 22 bp, Homo sapiens
ttattgagttgtaagagctctt

SEQ ID NO: 9488379 - DNA, 22 bp, Homo sapiens
cgagatccttcagagcgcggac

SEQ ID NO: 9488380 - DNA, 22 bp, Homo sapiens
cgagagttagctaggagtcaca

SEQ ID NO: 9488381 - DNA, 22 bp, Homo sapiens
cgagagttagctaggagtcaca

SEQ ID NO: 9488382 - DNA, 22 bp, Homo sapiens
ttattcagcagggacttccttt

SEQ ID NO: 9488383 - DNA, 22 bp, Homo sapiens
ttattcagattggctacaggat

SEQ ID NO: 9488384 - DNA, 19 bp, Homo sapiens
ccttttttaacttcagcaa

SEQ ID NO: 9488385 - DNA, 19 bp, Homo sapiens
ccttttttaacttcagcaa

SEQ ID NO: 9488386 - DNA, 19 bp, Homo sapiens
ccttttttaacttcagcaa

SEQ ID NO: 9488387 - DNA, 19 bp, Homo sapiens
ccttttttaacttcagcaa

SEQ ID NO: 9488388 - DNA, 22 bp, Homo sapiens
cctttttctgagttgtagcttc

SEQ ID NO: 9488389 - DNA, 22 bp, Homo sapiens
cctttttctgagttgtagcttc

SEQ ID NO: 9488390 - DNA, 22 bp, Homo sapiens
cctttttctgagttgtagcttc

SEQ ID NO: 9488391 - DNA, 22 bp, Homo sapiens
cgaacacacttgggagttctga

SEQ ID NO: 9488392 - DNA, 22 bp, Homo sapiens
cgaaatcagcatcttgaggcaa

SEQ ID NO: 9488393 - DNA, 22 bp, Homo sapiens
cgaaaatagatctgtttcccag

SEQ ID NO: 9488394 - DNA, 22 bp, Homo sapiens
ccttttttctatgccaactctg

SEQ ID NO: 9488395 - DNA, 22 bp, Homo sapiens
ccttttttctatgccaactctg

SEQ ID NO: 9488396 - DNA, 22 bp, Homo sapiens
cgagaaatgagaaacccatttt

SEQ ID NO: 9488397 - DNA, 21 bp, Homo sapiens
cgacaggagaggcagccagcc

SEQ ID NO: 9488398 - DNA, 22 bp, Homo sapiens
cgacagcagaagaagcaagcca

SEQ ID NO: 9488399 - DNA, 22 bp, Homo sapiens
cgacagcagaagaagcaagcca

SEQ ID NO: 9488400 - DNA, 22 bp, Homo sapiens
cgagaaggtcttcccacagagc

SEQ ID NO: 9488401 - DNA, 22 bp, Homo sapiens
cgagagatgggttggcaggggc

SEQ ID NO: 9488402 - DNA, 22 bp, Homo sapiens
cgagagatgggttggcaggggc

SEQ ID NO: 9488403 - DNA, 22 bp, Homo sapiens
ccttttctaatcttaagaatgt

SEQ ID NO: 9488404 - DNA, 22 bp, Homo sapiens
ccttttctacaagcaaatgtgc

SEQ ID NO: 9488405 - DNA, 22 bp, Homo sapiens
ccttttctacaagcaaatgtgc

SEQ ID NO: 9488406 - DNA, 22 bp, Homo sapiens
ccttttctagaaagggaggcaa

SEQ ID NO: 9488407 - DNA, 22 bp, Homo sapiens
ccttttctaggatgctttatag

SEQ ID NO: 9488408 - DNA, 22 bp, Homo sapiens
ccttttctaggatgctttatag

SEQ ID NO: 9488409 - DNA, 22 bp, Homo sapiens
ccttttctatccttctaggttc

SEQ ID NO: 9488410 - DNA, 16 bp, Homo sapiens
ccttttctcatctcta

SEQ ID NO: 9488411 - DNA, 22 bp, Homo sapiens
ccttttctatgtaccagcagtg

SEQ ID NO: 9488412 - DNA, 22 bp, Homo sapiens
ccttttctatgtaccagcagtg

SEQ ID NO: 9488413 - DNA, 22 bp, Homo sapiens
cctttgggtgaattcctctctt

SEQ ID NO: 9488414 - DNA, 22 bp, Homo sapiens
cctttggtaacattccaacctt

SEQ ID NO: 9488415 - DNA, 22 bp, Homo sapiens
ttatccaagcagaagctgcaca

SEQ ID NO: 9488416 - DNA, 16 bp, Homo sapiens
ttatccaatcagttga

SEQ ID NO: 9488417 - DNA, 22 bp, Homo sapiens
ttatccaacatgacttatgtcc

SEQ ID NO: 9488418 - DNA, 22 bp, Homo sapiens
ttatccaaactggtgaatcatt

SEQ ID NO: 9488419 - DNA, 22 bp, Homo sapiens
ccttttctggccaccaagcgct

SEQ ID NO: 9488420 - DNA, 22 bp, Homo sapiens
ccttttctgaaccacttaaata

SEQ ID NO: 9488421 - DNA, 22 bp, Homo sapiens
ccttttctgtgtgggtaattta

SEQ ID NO: 9488422 - DNA, 22 bp, Homo sapiens
ccttttctggccaccaagcgct

SEQ ID NO: 9488423 - DNA, 22 bp, Homo sapiens
ccttttctgtgtgggtaattta

SEQ ID NO: 9488424 - DNA, 22 bp, Homo sapiens
ccttttgaaggtgttgttaagt

SEQ ID NO: 9488425 - DNA, 22 bp, Homo sapiens
ccttttctgtttcctgtcactg

SEQ ID NO: 9488426 - DNA, 22 bp, Homo sapiens
ccttttcttgccactgactcgg

SEQ ID NO: 9488427 - DNA, 22 bp, Homo sapiens
ccttttgctctcccatccagaa

SEQ ID NO: 9488428 - DNA, 22 bp, Homo sapiens
ccttttggccaggtcagtgcag

SEQ ID NO: 9488429 - DNA, 22 bp, Homo sapiens
cctttttctgagttgtagcttc

SEQ ID NO: 9488430 - DNA, 16 bp, Homo sapiens
cctttttctcttgctg

SEQ ID NO: 9488431 - DNA, 22 bp, Homo sapiens
cctttttccctggagggacagc

SEQ ID NO: 9488432 - DNA, 22 bp, Homo sapiens
ccttttgttggggtgtattcaa

SEQ ID NO: 9488433 - DNA, 22 bp, Homo sapiens
cctttttcaatatagaattgca

SEQ ID NO: 9488434 - DNA, 22 bp, Homo sapiens
cctttttcagcttctagaggct

SEQ ID NO: 9488435 - DNA, 22 bp, Homo sapiens
ttaaatagtaggtctattttgg

SEQ ID NO: 9488436 - DNA, 22 bp, Homo sapiens
ttaaatagtaggtctattttgg

SEQ ID NO: 9488437 - DNA, 22 bp, Homo sapiens
ttaaatagctcttgtagaagaa

SEQ ID NO: 9488438 - DNA, 22 bp, Homo sapiens
ttaaattagtcaagcttctctg

SEQ ID NO: 9488439 - DNA, 22 bp, Homo sapiens
ttaaattagtcaagcttctctg

SEQ ID NO: 9488440 - DNA, 22 bp, Homo sapiens
ttaaattattgagggattgtca

SEQ ID NO: 9488441 - DNA, 22 bp, Homo sapiens
tgtcagcagctggtttgctgtt

SEQ ID NO: 9488442 - DNA, 22 bp, Homo sapiens
tgtcagcagatctcctgcagcc

SEQ ID NO: 9488443 - DNA, 22 bp, Homo sapiens
tgtcagcagaagtggtgcactc

SEQ ID NO: 9488444 - DNA, 22 bp, Homo sapiens
tgtcagcagtatctctatctca

SEQ ID NO: 9488445 - DNA, 22 bp, Homo sapiens
tgtcagcaggacattaaaagct

SEQ ID NO: 9488446 - DNA, 22 bp, Homo sapiens
tgtcagcatcatttgttgaagg

SEQ ID NO: 9488447 - DNA, 22 bp, Homo sapiens
tgtcagcatgaaccctgaatta

SEQ ID NO: 9488448 - DNA, 22 bp, Homo sapiens
tgtcagcatgtcagccaaagat

SEQ ID NO: 9488449 - DNA, 22 bp, Homo sapiens
tgtcagctcccagtcagagaga

SEQ ID NO: 9488450 - DNA, 22 bp, Homo sapiens
tgtcagcattgcgtcactgagc

SEQ ID NO: 9488451 - DNA, 22 bp, Homo sapiens
tgtcagcaccatgggtagtgat

SEQ ID NO: 9488452 - DNA, 22 bp, Homo sapiens
tgtcagcaattctggcttactc

SEQ ID NO: 9488453 - DNA, 22 bp, Homo sapiens
tgtcagcaattctggcttactc

SEQ ID NO: 9488454 - DNA, 20 bp, Homo sapiens
tgtcagcaattaggagaaaa

SEQ ID NO: 9488455 - DNA, 21 bp, Homo sapiens
tgtcagcaacaatactttctc

SEQ ID NO: 9488456 - DNA, 22 bp, Homo sapiens
tgtcagcaagacatcagagtga

SEQ ID NO: 9488457 - DNA, 22 bp, Homo sapiens
tgtcagcaacccatcactccca

SEQ ID NO: 9488458 - DNA, 21 bp, Homo sapiens
tgtcagagcttgtaggacatt

SEQ ID NO: 9488459 - DNA, 21 bp, Homo sapiens
tgtcagagcttgtaggacatt

SEQ ID NO: 9488460 - DNA, 22 bp, Homo sapiens
tgtcagacctgtgatttcagca

SEQ ID NO: 9488461 - DNA, 21 bp, Homo sapiens
tgtcagagcttgtaggacatt

SEQ ID NO: 9488462 - DNA, 22 bp, Homo sapiens
tgtcaatagttttgagttctct

SEQ ID NO: 9488463 - DNA, 20 bp, Homo sapiens
tgtcaatagcactgaggctg

SEQ ID NO: 9488464 - DNA, 22 bp, Homo sapiens
tgtcaatatgtaataactgaat

SEQ ID NO: 9488465 - DNA, 22 bp, Homo sapiens
tgtcaatatcaggcagacctaa

SEQ ID NO: 9488466 - DNA, 22 bp, Homo sapiens
ttaaattccagcctcataatag

SEQ ID NO: 9488467 - DNA, 22 bp, Homo sapiens
ttaaattccagcctcataatag

SEQ ID NO: 9488468 - DNA, 22 bp, Homo sapiens
ttaaattccagcctcataatag

SEQ ID NO: 9488469 - DNA, 22 bp, Homo sapiens
ttaaattccagcctcataatag

SEQ ID NO: 9488470 - DNA, 22 bp, Homo sapiens
ttaaattgtcatttgagcaatg

SEQ ID NO: 9488471 - DNA, 22 bp, Homo sapiens
ttaaattgtcatttgagcaatg

SEQ ID NO: 9488472 - DNA, 22 bp, Homo sapiens
ttaaatttctacgtgatccagg

SEQ ID NO: 9488473 - DNA, 22 bp, Homo sapiens
ttaaattcattccaacttttga

SEQ ID NO: 9488474 - DNA, 22 bp, Homo sapiens
ttaaattcattccaacttttga

SEQ ID NO: 9488475 - DNA, 22 bp, Homo sapiens
ttaaattcattccaacttttga

SEQ ID NO: 9488476 - DNA, 22 bp, Homo sapiens
ttaaattccagcctcataatag

SEQ ID NO: 9488477 - DNA, 22 bp, Homo sapiens
ttaaattccagcctcataatag

SEQ ID NO: 9488478 - DNA, 22 bp, Homo sapiens
ttaaattccagcctcataatag

SEQ ID NO: 9488479 - DNA, 22 bp, Homo sapiens
ttaaattatttctagtgaggtg

SEQ ID NO: 9488480 - DNA, 22 bp, Homo sapiens
ttaaattattgagggattgtca

SEQ ID NO: 9488481 - DNA, 22 bp, Homo sapiens
ttaaattatttctagtgaggtg

SEQ ID NO: 9488482 - DNA, 22 bp, Homo sapiens
ttaaattatttctagtgaggtg

SEQ ID NO: 9488483 - DNA, 22 bp, Homo sapiens
ttaaattatttctagtgaggtg

SEQ ID NO: 9488484 - DNA, 22 bp, Homo sapiens
ttaagattttcttcagtattat

SEQ ID NO: 9488485 - DNA, 22 bp, Homo sapiens
ttaagatgttcagataatttgg

SEQ ID NO: 9488486 - DNA, 22 bp, Homo sapiens
ttaagatttgtagagaaaaagc

SEQ ID NO: 9488487 - DNA, 22 bp, Homo sapiens
ttaagaggtgaggcctttaaga

SEQ ID NO: 9488488 - DNA, 22 bp, Homo sapiens
ttaaattttagaaacagactct

SEQ ID NO: 9488489 - DNA, 22 bp, Homo sapiens
ttacaaagcgctttacctctga

SEQ ID NO: 9488490 - DNA, 22 bp, Homo sapiens
ttacaaagcgctttacctctga

SEQ ID NO: 9488491 - DNA, 22 bp, Homo sapiens
ttacagaagtattgagagatcc

SEQ ID NO: 9488492 - DNA, 22 bp, Homo sapiens
ttacaaagcgttgagacaagta

SEQ ID NO: 9488493 - DNA, 22 bp, Homo sapiens
ttacaaagcgttgagacaagta

SEQ ID NO: 9488494 - DNA, 22 bp, Homo sapiens
ttacagaagtgaaggcctttaa

SEQ ID NO: 9488495 - DNA, 22 bp, Homo sapiens
ttacaaagcgctttacctctga

SEQ ID NO: 9488496 - DNA, 22 bp, Homo sapiens
ttacaaagcaggtcagctgaaa

SEQ ID NO: 9488497 - DNA, 22 bp, Homo sapiens
ttacaaagcaggtcagctgaaa

SEQ ID NO: 9488498 - DNA, 21 bp, Homo sapiens
ttacaaagcaagtgctgtgtc

SEQ ID NO: 9488499 - DNA, 21 bp, Homo sapiens
ttacaaagcaagtgctgtgtc

SEQ ID NO: 9488500 - DNA, 22 bp, Homo sapiens
ttacaaagattatattcagtta

SEQ ID NO: 9488501 - DNA, 22 bp, Homo sapiens
ttacaaagattatattcagtta

SEQ ID NO: 9488502 - DNA, 22 bp, Homo sapiens
ttacaaagattatattcagtta

SEQ ID NO: 9488503 - DNA, 22 bp, Homo sapiens
ttacaaagattatattcagtta

SEQ ID NO: 9488504 - DNA, 22 bp, Homo sapiens
ttacaaagattatattcagtta

SEQ ID NO: 9488505 - DNA, 22 bp, Homo sapiens
ttacaaagagtgttcttttcca

SEQ ID NO: 9488506 - DNA, 22 bp, Homo sapiens
ttacaaagagtgttcttttcca

SEQ ID NO: 9488507 - DNA, 22 bp, Homo sapiens
ttacagttgttctatcagcatg

SEQ ID NO: 9488508 - DNA, 22 bp, Homo sapiens
ttacagaagtttcagcgtttta

SEQ ID NO: 9488509 - DNA, 21 bp, Homo sapiens
ttacagaatccatgggaagtc

SEQ ID NO: 9488510 - DNA, 22 bp, Homo sapiens
ccttaaattctccatttgaaag

SEQ ID NO: 9488511 - DNA, 22 bp, Homo sapiens
ccttaagaaatagcatttaaat

SEQ ID NO: 9488512 - DNA, 22 bp, Homo sapiens
ccttacacctaaaatgagagtt

SEQ ID NO: 9488513 - DNA, 22 bp, Homo sapiens
ccttaaaagaactatctcttct

SEQ ID NO: 9488514 - DNA, 22 bp, Homo sapiens
ccttaaaagaactatctcttct

SEQ ID NO: 9488515 - DNA, 22 bp, Homo sapiens
ccttaaaagaactatctcttct

SEQ ID NO: 9488516 - DNA, 22 bp, Homo sapiens
ccttaaaagaactatctcttct

SEQ ID NO: 9488517 - DNA, 22 bp, Homo sapiens
ccttaaagaataagtcttatct

SEQ ID NO: 9488518 - DNA, 22 bp, Homo sapiens
ccttaaaagaactatctcttct

SEQ ID NO: 9488519 - DNA, 22 bp, Homo sapiens
ttaagcaacacacattaattat

SEQ ID NO: 9488520 - DNA, 22 bp, Homo sapiens
ttaagcataattaaagtgaaat

SEQ ID NO: 9488521 - DNA, 22 bp, Homo sapiens
ttaagcataattaaagtgaaat

SEQ ID NO: 9488522 - DNA, 22 bp, Homo sapiens
ttaagcatggaagtgaaataat

SEQ ID NO: 9488523 - DNA, 22 bp, Homo sapiens
ttaagcatggaagtgaaataat

SEQ ID NO: 9488524 - DNA, 17 bp, Homo sapiens
ttaagcatgtaatctgc

SEQ ID NO: 9488525 - DNA, 17 bp, Homo sapiens
ttaagcatgtaatctgc

SEQ ID NO: 9488526 - DNA, 22 bp, Homo sapiens
cctgtttggtacaatctgccaa

SEQ ID NO: 9488527 - DNA, 21 bp, Homo sapiens
cctgtgtgtgtccctttaaga

SEQ ID NO: 9488528 - DNA, 18 bp, Homo sapiens
cctgtgtgtgttgcaggc

SEQ ID NO: 9488529 - DNA, 22 bp, Homo sapiens
ccttacaatgcagtttacttag

SEQ ID NO: 9488530 - DNA, 22 bp, Homo sapiens
ccttagaaatgtaccaaaggaa

SEQ ID NO: 9488531 - DNA, 22 bp, Homo sapiens
ccttagaaaatcatggaatatt

SEQ ID NO: 9488532 - DNA, 22 bp, Homo sapiens
ccttagaagaaagttacttttt

SEQ ID NO: 9488533 - DNA, 22 bp, Homo sapiens
ccttagaaggctgaataattct

SEQ ID NO: 9488534 - DNA, 22 bp, Homo sapiens
ccttagtgtgcctgaggcagat

SEQ ID NO: 9488535 - DNA, 22 bp, Homo sapiens
ttacaaagagtgccagagtgtg

SEQ ID NO: 9488536 - DNA, 22 bp, Homo sapiens
ttacaaagagtgttcttttcca

SEQ ID NO: 9488537 - DNA, 22 bp, Homo sapiens
ttacaaagagtgccagagtgtg

SEQ ID NO: 9488538 - DNA, 22 bp, Homo sapiens
ccttagtgtgaggggatacccc

SEQ ID NO: 9488539 - DNA, 17 bp, Homo sapiens
ccttagggcagtgtggt

SEQ ID NO: 9488540 - DNA, 22 bp, Homo sapiens
ccttagtgaaacagaggcaatt

SEQ ID NO: 9488541 - DNA, 22 bp, Homo sapiens
ccttagcattagaagctgtggg

SEQ ID NO: 9488542 - DNA, 22 bp, Homo sapiens
ccttagcatggctgtgctgtgt

SEQ ID NO: 9488543 - DNA, 22 bp, Homo sapiens
ccttagctggagtggtggaatg

SEQ ID NO: 9488544 - DNA, 22 bp, Homo sapiens
ttagacagagctccttgagggc

SEQ ID NO: 9488545 - DNA, 22 bp, Homo sapiens
ttagcaaactctgttagattct

SEQ ID NO: 9488546 - DNA, 22 bp, Homo sapiens
ttagcaaactctgttagattct

SEQ ID NO: 9488547 - DNA, 22 bp, Homo sapiens
ccttcagcgtcccctttacccg

SEQ ID NO: 9488548 - DNA, 18 bp, Homo sapiens
ccttcagctctgccagta

SEQ ID NO: 9488549 - DNA, 18 bp, Homo sapiens
ccttcagctctgccagta

SEQ ID NO: 9488550 - DNA, 22 bp, Homo sapiens
ttagcaaagtttgccatctagt

SEQ ID NO: 9488551 - DNA, 22 bp, Homo sapiens
ttagcaaagtttgccatctagt

SEQ ID NO: 9488552 - DNA, 21 bp, Homo sapiens
ttagcaaagcaaacacatgct

SEQ ID NO: 9488553 - DNA, 22 bp, Homo sapiens
ttagcaaagtttgccatctagt

SEQ ID NO: 9488554 - DNA, 21 bp, Homo sapiens
ttagcaaagcaaacacatgct

SEQ ID NO: 9488555 - DNA, 21 bp, Homo sapiens
ttagcaaagcaaacacatgct

SEQ ID NO: 9488556 - DNA, 21 bp, Homo sapiens
ttagcaaagcaaacacatgct

SEQ ID NO: 9488557 - DNA, 22 bp, Homo sapiens
ttagcaagataacagtaatttt

SEQ ID NO: 9488558 - DNA, 22 bp, Homo sapiens
ttagcaatatgaatgcatttgc

SEQ ID NO: 9488559 - DNA, 22 bp, Homo sapiens
ttagcaatcctaggctggatca

SEQ ID NO: 9488560 - DNA, 22 bp, Homo sapiens
ttagcaattccaggtaagttat

SEQ ID NO: 9488561 - DNA, 22 bp, Homo sapiens
ttagcaatgtatgattaaaata

SEQ ID NO: 9488562 - DNA, 22 bp, Homo sapiens
ttagcaaatatcttgaaacagg

SEQ ID NO: 9488563 - DNA, 22 bp, Homo sapiens
ttagcaaatatcttgaaacagg

SEQ ID NO: 9488564 - DNA, 22 bp, Homo sapiens
ttagcaaatatcttgaaacagg

SEQ ID NO: 9488565 - DNA, 22 bp, Homo sapiens
ttagcaagaaagattgcagcac

SEQ ID NO: 9488566 - DNA, 22 bp, Homo sapiens
ttagcaaatatcttgaaacagg

SEQ ID NO: 9488567 - DNA, 22 bp, Homo sapiens
ttagcaaatttccaggtgatgc

SEQ ID NO: 9488568 - DNA, 22 bp, Homo sapiens
ccttgaaagtatatgctcaatt

SEQ ID NO: 9488569 - DNA, 22 bp, Homo sapiens
ttacataacggtatgaaaaatg

SEQ ID NO: 9488570 - DNA, 22 bp, Homo sapiens
ttacataacggtatgaaaaatg

SEQ ID NO: 9488571 - DNA, 22 bp, Homo sapiens
ttacataacggtatgaaaaatg

SEQ ID NO: 9488572 - DNA, 22 bp, Homo sapiens
ttacataaaagttcacgtaggc

SEQ ID NO: 9488573 - DNA, 22 bp, Homo sapiens
ttacataaaagttcacgtaggc

SEQ ID NO: 9488574 - DNA, 22 bp, Homo sapiens
ttacataaaagttcacgtaggc

SEQ ID NO: 9488575 - DNA, 22 bp, Homo sapiens
ttacagtttatccaggaagagc

SEQ ID NO: 9488576 - DNA, 22 bp, Homo sapiens
ttacatacctcatagactcagg

SEQ ID NO: 9488577 - DNA, 22 bp, Homo sapiens
ttacatacttactagatctatg

SEQ ID NO: 9488578 - DNA, 22 bp, Homo sapiens
ttacatacttactagatctatg

SEQ ID NO: 9488579 - DNA, 22 bp, Homo sapiens
ttacataacggtatgaaaaatg

SEQ ID NO: 9488580 - DNA, 22 bp, Homo sapiens
ttacataactttaaaatgccgt

SEQ ID NO: 9488581 - DNA, 22 bp, Homo sapiens
ttacataactttaaaatgccgt

SEQ ID NO: 9488582 - DNA, 22 bp, Homo sapiens
ttacataactttaaaatgccgt

SEQ ID NO: 9488583 - DNA, 22 bp, Homo sapiens
ccttcaaagtacacatctttat

SEQ ID NO: 9488584 - DNA, 22 bp, Homo sapiens
ccttcaaagagtatttcctgag

SEQ ID NO: 9488585 - DNA, 22 bp, Homo sapiens
ccttcaaattctcttagctgaa

SEQ ID NO: 9488586 - DNA, 22 bp, Homo sapiens
ccttcaaactttcattaaccag

SEQ ID NO: 9488587 - DNA, 22 bp, Homo sapiens
ccttcaaaacactagtttttga

SEQ ID NO: 9488588 - DNA, 22 bp, Homo sapiens
ttacatagattcatttagttaa

SEQ ID NO: 9488589 - DNA, 22 bp, Homo sapiens
ccttcaaaacactagtttttga

SEQ ID NO: 9488590 - DNA, 23 bp, Homo sapiens
ccttcagaagaagtaacaggggc

SEQ ID NO: 9488591 - DNA, 22 bp, Homo sapiens
ccttcaagttcctggtccctgg

SEQ ID NO: 9488592 - DNA, 22 bp, Homo sapiens
ccttcaagttcctggtccctgg

SEQ ID NO: 9488593 - DNA, 22 bp, Homo sapiens
ccttcaaattctcttagctgaa

SEQ ID NO: 9488594 - DNA, 22 bp, Homo sapiens
ccttcaaatttagaacaagtga

SEQ ID NO: 9488595 - DNA, 22 bp, Homo sapiens
ccttcaaggcaaggagggctgg

SEQ ID NO: 9488596 - DNA, 22 bp, Homo sapiens
ttatcagagtccccaaaagaaa

SEQ ID NO: 9488597 - DNA, 22 bp, Homo sapiens
ttatcataagtaattgaaataa

SEQ ID NO: 9488598 - DNA, 22 bp, Homo sapiens
ttatcattgtcgcagtctaatt

SEQ ID NO: 9488599 - DNA, 22 bp, Homo sapiens
ttatccaaactggtgaatcatt

SEQ ID NO: 9488600 - DNA, 22 bp, Homo sapiens
ttatcatgacttcaagcatcca

SEQ ID NO: 9488601 - DNA, 22 bp, Homo sapiens
ttatcattgtcgcagtctaatt

SEQ ID NO: 9488602 - DNA, 22 bp, Homo sapiens
ttatcaactagtttaggtttga

SEQ ID NO: 9488603 - DNA, 22 bp, Homo sapiens
ttatatttctggtagccttcag

SEQ ID NO: 9488604 - DNA, 22 bp, Homo sapiens
ttatattgtgtaataagtgaag

SEQ ID NO: 9488605 - DNA, 22 bp, Homo sapiens
ttatattagttagacttgctgt

SEQ ID NO: 9488606 - DNA, 22 bp, Homo sapiens
ttataacactgccttgtcacca

SEQ ID NO: 9488607 - DNA, 22 bp, Homo sapiens
ttataacactgccttgtcacca

SEQ ID NO: 9488608 - DNA, 22 bp, Homo sapiens
ttataacaacagtttactttaa

SEQ ID NO: 9488609 - DNA, 22 bp, Homo sapiens
ttataacaacagtttactttaa

SEQ ID NO: 9488610 - DNA, 22 bp, Homo sapiens
ttataacatcaatcagagttaa

SEQ ID NO: 9488611 - DNA, 23 bp, Homo sapiens
ttataaatattttcaggtgtgtt

SEQ ID NO: 9488612 - DNA, 23 bp, Homo sapiens
ttataaatattttcaggtgtgtt

SEQ ID NO: 9488613 - DNA, 23 bp, Homo sapiens
ttataaatattttcaggtgtgtt

SEQ ID NO: 9488614 - DNA, 22 bp, Homo sapiens
ttataaagtgagaagtgctatg

SEQ ID NO: 9488615 - DNA, 23 bp, Homo sapiens
ttataaatattttcaggtgtgtt

SEQ ID NO: 9488616 - DNA, 22 bp, Homo sapiens
ttataaaggtttgtgcatattt

SEQ ID NO: 9488617 - DNA, 22 bp, Homo sapiens
ttataaaggtttgtgcatattt

SEQ ID NO: 9488618 - DNA, 22 bp, Homo sapiens
ccttgcatttaaaggcgtaggg

SEQ ID NO: 9488619 - DNA, 22 bp, Homo sapiens
ccttgcagacatcagtagtggc

SEQ ID NO: 9488620 - DNA, 20 bp, Homo sapiens
ccttgatcttggacttccag

SEQ ID NO: 9488621 - DNA, 22 bp, Homo sapiens
ccttgatggtgagagctgcaga

SEQ ID NO: 9488622 - DNA, 22 bp, Homo sapiens
ccttgcccgctgcctctgagtt

SEQ ID NO: 9488623 - DNA, 22 bp, Homo sapiens
ttagggaaacaaacattttctt

SEQ ID NO: 9488624 - DNA, 22 bp, Homo sapiens
ttagttttcccatctttatggt

SEQ ID NO: 9488625 - DNA, 22 bp, Homo sapiens
ttagtttccaccacacatgttc

SEQ ID NO: 9488626 - DNA, 22 bp, Homo sapiens
ttagtttataattcatttctgt

SEQ ID NO: 9488627 - DNA, 22 bp, Homo sapiens
ttagtttataattcatttctgt

SEQ ID NO: 9488628 - DNA, 22 bp, Homo sapiens
ttagggaaataaaattatcagt

SEQ ID NO: 9488629 - DNA, 22 bp, Homo sapiens
ttagggaaagcagcattccctt

SEQ ID NO: 9488630 - DNA, 22 bp, Homo sapiens
ttagttttctcatctatctcac

SEQ ID NO: 9488631 - DNA, 22 bp, Homo sapiens
ttataaagatccttccagagtt

SEQ ID NO: 9488632 - DNA, 22 bp, Homo sapiens
ttataaagattgttatgtatct

SEQ ID NO: 9488633 - DNA, 22 bp, Homo sapiens
ttataaagattgttatgtatct

SEQ ID NO: 9488634 - DNA, 22 bp, Homo sapiens
ttataaagattgttatgtatct

SEQ ID NO: 9488635 - DNA, 22 bp, Homo sapiens
ttataaaggtttgtgcatattt

SEQ ID NO: 9488636 - DNA, 22 bp, Homo sapiens
ttataaagattgttatgtatct

SEQ ID NO: 9488637 - DNA, 22 bp, Homo sapiens
gaggccagaatgagctgaatgc

SEQ ID NO: 9488638 - DNA, 22 bp, Homo sapiens
gaggccagaatgagctgaatgc

SEQ ID NO: 9488639 - DNA, 22 bp, Homo sapiens
gaggccagaagtgcctcgggct

SEQ ID NO: 9488640 - DNA, 22 bp, Homo sapiens
gaggccagaagtgcctcgggct

SEQ ID NO: 9488641 - DNA, 22 bp, Homo sapiens
gaggccagaagtgcctcgggct

SEQ ID NO: 9488642 - DNA, 22 bp, Homo sapiens
gaggccacttcctactggagga

SEQ ID NO: 9488643 - DNA, 22 bp, Homo sapiens
gaggccacttcctactggagga

SEQ ID NO: 9488644 - DNA, 22 bp, Homo sapiens
gaggccagaagtgcctcgggct

SEQ ID NO: 9488645 - DNA, 22 bp, Homo sapiens
gaggccagaagtctgagatcag

SEQ ID NO: 9488646 - DNA, 22 bp, Homo sapiens
gaggccagaagtctgagatcag

SEQ ID NO: 9488647 - DNA, 22 bp, Homo sapiens
gaggccagaagtctgagatcag

SEQ ID NO: 9488648 - DNA, 22 bp, Homo sapiens
gaggccagaagtctgagatcag

SEQ ID NO: 9488649 - DNA, 22 bp, Homo sapiens
gaggccagaagtctgagatcag

SEQ ID NO: 9488650 - DNA, 22 bp, Homo sapiens
gaggcctggaccagccacagag

SEQ ID NO: 9488651 - DNA, 22 bp, Homo sapiens
gaggccagatactctcttctgc

SEQ ID NO: 9488652 - DNA, 22 bp, Homo sapiens
gaggcctggaattccagcctgg

SEQ ID NO: 9488653 - DNA, 22 bp, Homo sapiens
gaggcctggaattccagcctgg

SEQ ID NO: 9488654 - DNA, 22 bp, Homo sapiens
gaggcctggaattccagcctgg

SEQ ID NO: 9488655 - DNA, 22 bp, Homo sapiens
gaggccagactgccttttatga

SEQ ID NO: 9488656 - DNA, 22 bp, Homo sapiens
gaggccagagttccccgagtca

SEQ ID NO: 9488657 - DNA, 22 bp, Homo sapiens
gaggccagagttccccgagtca

SEQ ID NO: 9488658 - DNA, 22 bp, Homo sapiens
gaggccagaatgagtctctggg

SEQ ID NO: 9488659 - DNA, 22 bp, Homo sapiens
gaggccagaatgagtctctggg

SEQ ID NO: 9488660 - DNA, 22 bp, Homo sapiens
gaggccagaatgagtctctggg

SEQ ID NO: 9488661 - DNA, 22 bp, Homo sapiens
gaggccagaatgagtctctggg

SEQ ID NO: 9488662 - DNA, 22 bp, Homo sapiens
gaggatgtaaaatagacaaaat

SEQ ID NO: 9488663 - DNA, 22 bp, Homo sapiens
gaggatttgatggctttctccc

SEQ ID NO: 9488664 - DNA, 22 bp, Homo sapiens
gaggcaaagcatgtggctcagg

SEQ ID NO: 9488665 - DNA, 22 bp, Homo sapiens
gaggcaaagcatgtggctcagg

SEQ ID NO: 9488666 - DNA, 22 bp, Homo sapiens
gaggatggtatgaggcaagcaa

SEQ ID NO: 9488667 - DNA, 22 bp, Homo sapiens
gaggatggtgagcaggacccag

SEQ ID NO: 9488668 - DNA, 22 bp, Homo sapiens
gaggatggtgagcaggacccag

SEQ ID NO: 9488669 - DNA, 22 bp, Homo sapiens
gaggcaagaaaggactttctag

SEQ ID NO: 9488670 - DNA, 22 bp, Homo sapiens
gaggcatgcagagctggagcag

SEQ ID NO: 9488671 - DNA, 22 bp, Homo sapiens
gaggcatggcctgaggctagga

SEQ ID NO: 9488672 - DNA, 22 bp, Homo sapiens
gaggccacggaagggagctgtg

SEQ ID NO: 9488673 - DNA, 22 bp, Homo sapiens
gaggcatggcctgaggctagga

SEQ ID NO: 9488674 - DNA, 22 bp, Homo sapiens
gaggccacggaagggagctgtg

SEQ ID NO: 9488675 - DNA, 22 bp, Homo sapiens
gaggccacggaagggagctgtg

SEQ ID NO: 9488676 - DNA, 22 bp, Homo sapiens
gaggccacggttttccttgggg

SEQ ID NO: 9488677 - DNA, 22 bp, Homo sapiens
gaggccacggttttccttgggg

SEQ ID NO: 9488678 - DNA, 22 bp, Homo sapiens
gaggccacgtgcttatgtttct

SEQ ID NO: 9488679 - DNA, 22 bp, Homo sapiens
gaggccacgtgcttatgtttct

SEQ ID NO: 9488680 - DNA, 21 bp, Homo sapiens
gaggccactaataggggcaga

SEQ ID NO: 9488681 - DNA, 22 bp, Homo sapiens
gaggccactgtccctgccttcc

SEQ ID NO: 9488682 - DNA, 22 bp, Homo sapiens
gaggccactgtccctgccttcc

SEQ ID NO: 9488683 - DNA, 21 bp, Homo sapiens
gaggccactaataggggcaga

SEQ ID NO: 9488684 - DNA, 21 bp, Homo sapiens
gaggccactaataggggcaga

SEQ ID NO: 9488685 - DNA, 22 bp, Homo sapiens
gaggatggaggcagttagggcc

SEQ ID NO: 9488686 - DNA, 22 bp, Homo sapiens
gaggatggaggcagttagggcc

SEQ ID NO: 9488687 - DNA, 22 bp, Homo sapiens
gaggatggaggcagttagggcc

SEQ ID NO: 9488688 - DNA, 18 bp, Homo sapiens
gaggatggaaggagatgc

SEQ ID NO: 9488689 - DNA, 22 bp, Homo sapiens
gaggatggaggcagttagggcc

SEQ ID NO: 9488690 - DNA, 18 bp, Homo sapiens
gaggatggaaggagatgc

SEQ ID NO: 9488691 - DNA, 18 bp, Homo sapiens
gaggatggaaggagatgc

SEQ ID NO: 9488692 - DNA, 18 bp, Homo sapiens
gaggatggaaggagatgc

SEQ ID NO: 9488693 - DNA, 22 bp, Homo sapiens
gaggatcatttgagcctaggag

SEQ ID NO: 9488694 - DNA, 22 bp, Homo sapiens
gaggagtgtattccacaccact

SEQ ID NO: 9488695 - DNA, 22 bp, Homo sapiens
gaggaggttccgggtggagaag

SEQ ID NO: 9488696 - DNA, 22 bp, Homo sapiens
gaggaggttgacggcactgtga

SEQ ID NO: 9488697 - DNA, 22 bp, Homo sapiens
gaggagtctagtttatggcttc

SEQ ID NO: 9488698 - DNA, 22 bp, Homo sapiens
gaggagtctttttagggcctga

SEQ ID NO: 9488699 - DNA, 22 bp, Homo sapiens
gaggagtgccagccgtggagtc

SEQ ID NO: 9488700 - DNA, 22 bp, Homo sapiens
gaggagtgccagccgtggagtc

SEQ ID NO: 9488701 - DNA, 22 bp, Homo sapiens
gaggagagagggactgtctgca

SEQ ID NO: 9488702 - DNA, 22 bp, Homo sapiens
gaggagagagggactgtctgca

SEQ ID NO: 9488703 - DNA, 22 bp, Homo sapiens
gaggaggttccgggtggagaag

SEQ ID NO: 9488704 - DNA, 22 bp, Homo sapiens
gaggaggtggagtcatgcagag

SEQ ID NO: 9488705 - DNA, 22 bp, Homo sapiens
gaggaccacagatgagcctgca

SEQ ID NO: 9488706 - DNA, 22 bp, Homo sapiens
gaggactctgcaggctgctcct

SEQ ID NO: 9488707 - DNA, 22 bp, Homo sapiens
gaggactctgcaggctgctcct

SEQ ID NO: 9488708 - DNA, 22 bp, Homo sapiens
gaggacctggaatccaagagtc

SEQ ID NO: 9488709 - DNA, 22 bp, Homo sapiens
gaggacctttagtagaagtgca

SEQ ID NO: 9488710 - DNA, 22 bp, Homo sapiens
gaggacctttagtagaagtgca

SEQ ID NO: 9488711 - DNA, 22 bp, Homo sapiens
gaggacagtgtgatctgccagc

SEQ ID NO: 9488712 - DNA, 22 bp, Homo sapiens
gaggacagtgtgatctgccagc

SEQ ID NO: 9488713 - DNA, 22 bp, Homo sapiens
gaggacagtgtgatctgccagc

SEQ ID NO: 9488714 - DNA, 17 bp, Homo sapiens
gaggacagggaagtagg

SEQ ID NO: 9488715 - DNA, 22 bp, Homo sapiens
gaggagacatatttttgaagca

SEQ ID NO: 9488716 - DNA, 22 bp, Homo sapiens
gaggagaaagcagtgatttgtg

SEQ ID NO: 9488717 - DNA, 22 bp, Homo sapiens
gaggagaaagcagtgatttgtg

SEQ ID NO: 9488718 - DNA, 22 bp, Homo sapiens
gaggactgcagatgggtgcatc

SEQ ID NO: 9488719 - DNA, 22 bp, Homo sapiens
gaggactgcagatgggtgcatc

SEQ ID NO: 9488720 - DNA, 21 bp, Homo sapiens
gaggactgcacactctgattg

SEQ ID NO: 9488721 - DNA, 22 bp, Homo sapiens
gaggagactgacagcagattct

SEQ ID NO: 9488722 - DNA, 22 bp, Homo sapiens
gaggagagaacattcctccata

SEQ ID NO: 9488723 - DNA, 22 bp, Homo sapiens
gaggagagaagctaacggtgct

SEQ ID NO: 9488724 - DNA, 22 bp, Homo sapiens
gagctggtgatcagctggagga

SEQ ID NO: 9488725 - DNA, 22 bp, Homo sapiens
gagctggtcgaaatgggctgac

SEQ ID NO: 9488726 - DNA, 22 bp, Homo sapiens
gagctggtgtgtgcccaagcac

SEQ ID NO: 9488727 - DNA, 22 bp, Homo sapiens
gagctggtgatcagctggagga

SEQ ID NO: 9488728 - DNA, 22 bp, Homo sapiens
gagctggtcagtttcaggagag

SEQ ID NO: 9488729 - DNA, 22 bp, Homo sapiens
gagctggtcagtttcagggcca

SEQ ID NO: 9488730 - DNA, 22 bp, Homo sapiens
gagctggtcagtttcagggcca

SEQ ID NO: 9488731 - DNA, 22 bp, Homo sapiens
gagctgggtatatggctttatg

SEQ ID NO: 9488732 - DNA, 22 bp, Homo sapiens
gagctgggtatatggctttatg

SEQ ID NO: 9488733 - DNA, 22 bp, Homo sapiens
gagctgggtctccaccttggca

SEQ ID NO: 9488734 - DNA, 22 bp, Homo sapiens
gagctgggcacacgccacttga

SEQ ID NO: 9488735 - DNA, 22 bp, Homo sapiens
gagctgggatttgaacctggga

SEQ ID NO: 9488736 - DNA, 22 bp, Homo sapiens
gagctgggcacacgccacttga

SEQ ID NO: 9488737 - DNA, 22 bp, Homo sapiens
gagctgggcacacgccacttga

SEQ ID NO: 9488738 - DNA, 22 bp, Homo sapiens
gagctgggattcatctatgtct

SEQ ID NO: 9488739 - DNA, 22 bp, Homo sapiens
gagctcctcccagggtagcact

SEQ ID NO: 9488740 - DNA, 22 bp, Homo sapiens
gagctcccaggccccagcaagg

SEQ ID NO: 9488741 - DNA, 22 bp, Homo sapiens
gagctgtgattggtgtctcact

SEQ ID NO: 9488742 - DNA, 22 bp, Homo sapiens
gagctgtgagggacacattgct

SEQ ID NO: 9488743 - DNA, 22 bp, Homo sapiens
gagctgtgacacgcagcccagg

SEQ ID NO: 9488744 - DNA, 22 bp, Homo sapiens
gagctgtgacacgcagcccagg

SEQ ID NO: 9488745 - DNA, 22 bp, Homo sapiens
gagctgtgaaaagtgcctgggg

SEQ ID NO: 9488746 - DNA, 22 bp, Homo sapiens
gagctgtgaaaagtgcctgggg

SEQ ID NO: 9488747 - DNA, 22 bp, Homo sapiens
gagctgtgaaaagtgcctgggg

SEQ ID NO: 9488748 - DNA, 22 bp, Homo sapiens
gagctgtgacacgcagcccagg

SEQ ID NO: 9488749 - DNA, 22 bp, Homo sapiens
gagctggtgtgtgcccgagcac

SEQ ID NO: 9488750 - DNA, 22 bp, Homo sapiens
gagctggtgtgtgcccgagcac

SEQ ID NO: 9488751 - DNA, 22 bp, Homo sapiens
gagctggttctgtccagggaat

SEQ ID NO: 9488752 - DNA, 22 bp, Homo sapiens
gagctggttctgtccagggaat

SEQ ID NO: 9488753 - DNA, 17 bp, Homo sapiens
gaggacagggaagtagg

SEQ ID NO: 9488754 - DNA, 17 bp, Homo sapiens
gaggacagggaagtagg

SEQ ID NO: 9488755 - DNA, 17 bp, Homo sapiens
gaggacagggaagtagg

SEQ ID NO: 9488756 - DNA, 22 bp, Homo sapiens
gaggacaggagactcactgttt

SEQ ID NO: 9488757 - DNA, 22 bp, Homo sapiens
gagctgtgtgcctggatggtct

SEQ ID NO: 9488758 - DNA, 22 bp, Homo sapiens
gagctgtgtgcctggatggtct

SEQ ID NO: 9488759 - DNA, 22 bp, Homo sapiens
gagctgtgtatgcatcattctg

SEQ ID NO: 9488760 - DNA, 22 bp, Homo sapiens
gaggacaggagactcactgttt

SEQ ID NO: 9488761 - DNA, 22 bp, Homo sapiens
gaggacaggagactcactgttt

SEQ ID NO: 9488762 - DNA, 22 bp, Homo sapiens
gaggacaggagactcactgttt

SEQ ID NO: 9488763 - DNA, 22 bp, Homo sapiens
gagctgtggtcaacaggaaatt

SEQ ID NO: 9488764 - DNA, 22 bp, Homo sapiens
gagctgtggtcaacaggaaatt

SEQ ID NO: 9488765 - DNA, 22 bp, Homo sapiens
gagctgtgtatgcatcattctg

SEQ ID NO: 9488766 - DNA, 22 bp, Homo sapiens
gagctgtggaaggcagggacca

SEQ ID NO: 9488767 - DNA, 22 bp, Homo sapiens
gagctgtggaaggcagggacca

SEQ ID NO: 9488768 - DNA, 22 bp, Homo sapiens
gagctgtggaaggcagggacca

SEQ ID NO: 9488769 - DNA, 22 bp, Homo sapiens
gagctgtggaaggcagggacca

SEQ ID NO: 9488770 - DNA, 22 bp, Homo sapiens
gagctgtgcttataccaattca

SEQ ID NO: 9488771 - DNA, 20 bp, Homo sapiens
gagctgtgctctcaggagcc

SEQ ID NO: 9488772 - DNA, 20 bp, Homo sapiens
gagctgtgctctcaggagcc

SEQ ID NO: 9488773 - DNA, 20 bp, Homo sapiens
gagctgtgctctcaggagcc

SEQ ID NO: 9488774 - DNA, 20 bp, Homo sapiens
gagctgtgctctcaggagcc

SEQ ID NO: 9488775 - DNA, 22 bp, Homo sapiens
gagctgtgccaatctgtctggg

SEQ ID NO: 9488776 - DNA, 22 bp, Homo sapiens
gagctgtgccaatctgtctggg

SEQ ID NO: 9488777 - DNA, 22 bp, Homo sapiens
gagctgtgattggtgtctcact

SEQ ID NO: 9488778 - DNA, 22 bp, Homo sapiens
gagctgtgattggtgtctcact

SEQ ID NO: 9488779 - DNA, 22 bp, Homo sapiens
gagctgtgattggtgtctcact

SEQ ID NO: 9488780 - DNA, 22 bp, Homo sapiens
gagctgtgccaatctgtctggg

SEQ ID NO: 9488781 - DNA, 18 bp, Homo sapiens
gagctcagcgtgtttcta

SEQ ID NO: 9488782 - DNA, 22 bp, Homo sapiens
gagctcaggagcatcagaagaa

SEQ ID NO: 9488783 - DNA, 22 bp, Homo sapiens
gagctcagcctgaggcctggct

SEQ ID NO: 9488784 - DNA, 22 bp, Homo sapiens
gagctcagcccaaagagcagtg

SEQ ID NO: 9488785 - DNA, 22 bp, Homo sapiens
gagctcagcccaaagagcagtg

SEQ ID NO: 9488786 - DNA, 22 bp, Homo sapiens
gagctcagcccaaagagcagtg

SEQ ID NO: 9488787 - DNA, 22 bp, Homo sapiens
gagctcagcccaaagagcagtg

SEQ ID NO: 9488788 - DNA, 22 bp, Homo sapiens
gagctcagcaaaggtctgtgtg

SEQ ID NO: 9488789 - DNA, 22 bp, Homo sapiens
gagctcagattctggtgtcaga

SEQ ID NO: 9488790 - DNA, 22 bp, Homo sapiens
gagctcagattctggtgtcaga

SEQ ID NO: 9488791 - DNA, 22 bp, Homo sapiens
gagctcagcaaaggtctgtgtg

SEQ ID NO: 9488792 - DNA, 22 bp, Homo sapiens
gagctcagtgtagtcatggctt

SEQ ID NO: 9488793 - DNA, 22 bp, Homo sapiens
gagctcagtgtagtcatggctt

SEQ ID NO: 9488794 - DNA, 22 bp, Homo sapiens
gagctcagtgtagtcatggctt

SEQ ID NO: 9488795 - DNA, 22 bp, Homo sapiens
gagctcagggcattgagcaaga

SEQ ID NO: 9488796 - DNA, 22 bp, Homo sapiens
gagctcagcccaaagagcagtg

SEQ ID NO: 9488797 - DNA, 22 bp, Homo sapiens
gagctcagggcattgagcaaga

SEQ ID NO: 9488798 - DNA, 22 bp, Homo sapiens
gagctccagagttagacacccg

SEQ ID NO: 9488799 - DNA, 22 bp, Homo sapiens
gagctcatccccatggtccgtc

SEQ ID NO: 9488800 - DNA, 19 bp, Homo sapiens
gagcaggccacacatgtgt

SEQ ID NO: 9488801 - DNA, 22 bp, Homo sapiens
gagcaggcattctagtggctga

SEQ ID NO: 9488802 - DNA, 22 bp, Homo sapiens
gagcaggcattctagtggctga

SEQ ID NO: 9488803 - DNA, 22 bp, Homo sapiens
gagcaggcattctagtggctga

SEQ ID NO: 9488804 - DNA, 22 bp, Homo sapiens
gagcaggcaactctgcagtgcc

SEQ ID NO: 9488805 - DNA, 22 bp, Homo sapiens
gagcaggatgggagctggggcc

SEQ ID NO: 9488806 - DNA, 22 bp, Homo sapiens
gagcaggatggcacttctgtga

SEQ ID NO: 9488807 - DNA, 22 bp, Homo sapiens
gagcaggatgggagctggggcc

SEQ ID NO: 9488808 - DNA, 22 bp, Homo sapiens
gagcaggatggcacttctgtga

SEQ ID NO: 9488809 - DNA, 22 bp, Homo sapiens
gagcaggcaaagatgaaaggag

SEQ ID NO: 9488810 - DNA, 22 bp, Homo sapiens
gagcaggatgggagctggggcc

SEQ ID NO: 9488811 - DNA, 22 bp, Homo sapiens
gagcaggatgggagctggggcc

SEQ ID NO: 9488812 - DNA, 22 bp, Homo sapiens
gagcaggccagcaatggaaggg

SEQ ID NO: 9488813 - DNA, 22 bp, Homo sapiens
gagcaggccagcaatggaaggg

SEQ ID NO: 9488814 - DNA, 22 bp, Homo sapiens
gagcaggcctggggtgaggcct

SEQ ID NO: 9488815 - DNA, 22 bp, Homo sapiens
gagcaggcctggggtgaggcct

SEQ ID NO: 9488816 - DNA, 22 bp, Homo sapiens
gagcaggcctggggtgaggcct

SEQ ID NO: 9488817 - DNA, 22 bp, Homo sapiens
gagcaggcctggggtgaggcct

SEQ ID NO: 9488818 - DNA, 22 bp, Homo sapiens
gagcaggcctggggtgaggcct

SEQ ID NO: 9488819 - DNA, 22 bp, Homo sapiens
gagcaggctctgcctgtgtgtc

SEQ ID NO: 9488820 - DNA, 22 bp, Homo sapiens
gagcaggctctgcctgtgtgtc

SEQ ID NO: 9488821 - DNA, 22 bp, Homo sapiens
gagctcagactcgggcctgggg

SEQ ID NO: 9488822 - DNA, 22 bp, Homo sapiens
gagcaggcctggggtgaggcct

SEQ ID NO: 9488823 - DNA, 22 bp, Homo sapiens
gagcaggctctgcctgtgtgtc

SEQ ID NO: 9488824 - DNA, 22 bp, Homo sapiens
gagctcagagcctatagttggt

SEQ ID NO: 9488825 - DNA, 22 bp, Homo sapiens
gagctcagagcctatagttggt

SEQ ID NO: 9488826 - DNA, 22 bp, Homo sapiens
gagctcagaggcgtctttgtcc

SEQ ID NO: 9488827 - DNA, 22 bp, Homo sapiens
gagctcagaggcgtctttgtcc

SEQ ID NO: 9488828 - DNA, 22 bp, Homo sapiens
gaggcctgtcgctaggcctctg

SEQ ID NO: 9488829 - DNA, 22 bp, Homo sapiens
gaggcctgtcgctaggcctctg

SEQ ID NO: 9488830 - DNA, 22 bp, Homo sapiens
gaggcctgtcgctaggcctctg

SEQ ID NO: 9488831 - DNA, 22 bp, Homo sapiens
gaggcctggtttgcatgagaat

SEQ ID NO: 9488832 - DNA, 22 bp, Homo sapiens
gaggccttcctctcaagcacat

SEQ ID NO: 9488833 - DNA, 22 bp, Homo sapiens
gaggcctgtcgctaggcctctg

SEQ ID NO: 9488834 - DNA, 22 bp, Homo sapiens
gaggcctgtagtcatggatgta

SEQ ID NO: 9488835 - DNA, 22 bp, Homo sapiens
gaggcgagaagctggagatggt

SEQ ID NO: 9488836 - DNA, 22 bp, Homo sapiens
gaggccttgggatgtgccacgg

SEQ ID NO: 9488837 - DNA, 22 bp, Homo sapiens
gaggcgagaagctggagatggt

SEQ ID NO: 9488838 - DNA, 22 bp, Homo sapiens
gaggcctggtgtgtctcccgct

SEQ ID NO: 9488839 - DNA, 22 bp, Homo sapiens
gaggcctggtgctgtgtccaca

SEQ ID NO: 9488840 - DNA, 22 bp, Homo sapiens
gaggcctggtgctgtgtccaca

SEQ ID NO: 9488841 - DNA, 22 bp, Homo sapiens
gaggcctggtctatgagatgtt

SEQ ID NO: 9488842 - DNA, 22 bp, Homo sapiens
gaggcctggtagccgagcccca

SEQ ID NO: 9488843 - DNA, 22 bp, Homo sapiens
gaggcctggtagccgagcccca

SEQ ID NO: 9488844 - DNA, 22 bp, Homo sapiens
gaggcctgtagtcatggatgta

SEQ ID NO: 9488845 - DNA, 22 bp, Homo sapiens
gaggcctggtttccagcatcct

SEQ ID NO: 9488846 - DNA, 22 bp, Homo sapiens
gaggcctggtttccagcatcct

SEQ ID NO: 9488847 - DNA, 22 bp, Homo sapiens
gaggctaagcactggcatttct

SEQ ID NO: 9488848 - DNA, 22 bp, Homo sapiens
gaggctaagtaactgtccatgg

SEQ ID NO: 9488849 - DNA, 22 bp, Homo sapiens
gaggcggcggccgagcctggct

SEQ ID NO: 9488850 - DNA, 22 bp, Homo sapiens
gaggctggggtctgcctttctg

SEQ ID NO: 9488851 - DNA, 22 bp, Homo sapiens
gaggctggtaggaaaggaaaca

SEQ ID NO: 9488852 - DNA, 22 bp, Homo sapiens
gaggctggtaggaaaggaaaca

SEQ ID NO: 9488853 - DNA, 22 bp, Homo sapiens
gaggctggggtctgcctttctg

SEQ ID NO: 9488854 - DNA, 22 bp, Homo sapiens
gaggctggggtctgcctttctg

SEQ ID NO: 9488855 - DNA, 22 bp, Homo sapiens
gaggctggttcccttgatcttt

SEQ ID NO: 9488856 - DNA, 22 bp, Homo sapiens
gaggctggttcccttgatcttt

SEQ ID NO: 9488857 - DNA, 22 bp, Homo sapiens
gaggctggttcccttgatcttt

SEQ ID NO: 9488858 - DNA, 22 bp, Homo sapiens
gaggctggttcccttgatcttt

SEQ ID NO: 9488859 - DNA, 22 bp, Homo sapiens
gaggctggttctgaagtactgt

SEQ ID NO: 9488860 - DNA, 22 bp, Homo sapiens
gaggctggtcagccctaagatc

SEQ ID NO: 9488861 - DNA, 22 bp, Homo sapiens
gaggctggtcagccctaagatc

SEQ ID NO: 9488862 - DNA, 22 bp, Homo sapiens
gaggctggtggttagttccatt

SEQ ID NO: 9488863 - DNA, 22 bp, Homo sapiens
gaggctggtggttagttccatt

SEQ ID NO: 9488864 - DNA, 22 bp, Homo sapiens
gagggccagcctgccaagggcc

SEQ ID NO: 9488865 - DNA, 22 bp, Homo sapiens
gagggccagcctgccaagggcc

SEQ ID NO: 9488866 - DNA, 22 bp, Homo sapiens
gagggccaggcggagacaggcg

SEQ ID NO: 9488867 - DNA, 22 bp, Homo sapiens
gagggccagcagcctcagcatg

SEQ ID NO: 9488868 - DNA, 22 bp, Homo sapiens
gagggccagcagcctcagcatg

SEQ ID NO: 9488869 - DNA, 22 bp, Homo sapiens
gagggccagcagcctcagcatg

SEQ ID NO: 9488870 - DNA, 22 bp, Homo sapiens
gagggccagatcccaggaggaa

SEQ ID NO: 9488871 - DNA, 22 bp, Homo sapiens
gagggcctctgctgctccacat

SEQ ID NO: 9488872 - DNA, 22 bp, Homo sapiens
gagggcctctgtgggtgctcac

SEQ ID NO: 9488873 - DNA, 22 bp, Homo sapiens
gagggccattctgagggggtga

SEQ ID NO: 9488874 - DNA, 22 bp, Homo sapiens
gagggccctggctggctccagc

SEQ ID NO: 9488875 - DNA, 22 bp, Homo sapiens
gagggccctggctggctccagc

SEQ ID NO: 9488876 - DNA, 22 bp, Homo sapiens
gagggctgataacaggaataca

SEQ ID NO: 9488877 - DNA, 22 bp, Homo sapiens
gagggctgataaatgcgcatgg

SEQ ID NO: 9488878 - DNA, 22 bp, Homo sapiens
gagggctgataaatgcgcatgg

SEQ ID NO: 9488879 - DNA, 22 bp, Homo sapiens
gagggctgataaatgcgcatgg

SEQ ID NO: 9488880 - DNA, 22 bp, Homo sapiens
gagggctgataaatgcgcatgg

SEQ ID NO: 9488881 - DNA, 22 bp, Homo sapiens
gagggccaatgtgtccctgagc

SEQ ID NO: 9488882 - DNA, 22 bp, Homo sapiens
gagggagaattgcagccagcgt

SEQ ID NO: 9488883 - DNA, 22 bp, Homo sapiens
gagggccacgttcagggctctc

SEQ ID NO: 9488884 - DNA, 22 bp, Homo sapiens
gagggccacgttcagggctctc

SEQ ID NO: 9488885 - DNA, 22 bp, Homo sapiens
gagggccacttgaatgttttca

SEQ ID NO: 9488886 - DNA, 22 bp, Homo sapiens
gagggccagaaagttattgaga

SEQ ID NO: 9488887 - DNA, 22 bp, Homo sapiens
gagggagaaggactatcaggct

SEQ ID NO: 9488888 - DNA, 22 bp, Homo sapiens
gagggagaaggactatcaggct

SEQ ID NO: 9488889 - DNA, 22 bp, Homo sapiens
gagggaatggtgtgcaagaggt

SEQ ID NO: 9488890 - DNA, 22 bp, Homo sapiens
gagggaagtcataatgttctag

SEQ ID NO: 9488891 - DNA, 22 bp, Homo sapiens
gagggaagtcataatgttctag

SEQ ID NO: 9488892 - DNA, 22 bp, Homo sapiens
gagggaagtcataatgttctag

SEQ ID NO: 9488893 - DNA, 22 bp, Homo sapiens
gagggaagaggcctgacatttt

SEQ ID NO: 9488894 - DNA, 22 bp, Homo sapiens
gaggctggtttgccttttggca

SEQ ID NO: 9488895 - DNA, 22 bp, Homo sapiens
gaggctggtttgccttttggca

SEQ ID NO: 9488896 - DNA, 22 bp, Homo sapiens
gaggctggtttgccttttggca

SEQ ID NO: 9488897 - DNA, 22 bp, Homo sapiens
gagggaaggtcacccttgtagc

SEQ ID NO: 9488898 - DNA, 22 bp, Homo sapiens
gagggaaggtcacccttgtagc

SEQ ID NO: 9488899 - DNA, 22 bp, Homo sapiens
gagggaaggtcacccttgtagc

SEQ ID NO: 9488900 - DNA, 22 bp, Homo sapiens
gagggaaggagagttgtagctg

SEQ ID NO: 9488901 - DNA, 22 bp, Homo sapiens
gagggaaggacccattttaagt

SEQ ID NO: 9488902 - DNA, 22 bp, Homo sapiens
gagggaaggacccattttaagt

SEQ ID NO: 9488903 - DNA, 22 bp, Homo sapiens
gagggaaggagagttgtagctg

SEQ ID NO: 9488904 - DNA, 22 bp, Homo sapiens
gagggaagattccccatatggg

SEQ ID NO: 9488905 - DNA, 22 bp, Homo sapiens
gagggaagattccccatatggg

SEQ ID NO: 9488906 - DNA, 22 bp, Homo sapiens
gagggaagagggtttgaattca

SEQ ID NO: 9488907 - DNA, 22 bp, Homo sapiens
gagggaagagggtttgaattca

SEQ ID NO: 9488908 - DNA, 22 bp, Homo sapiens
gagggaagaggcctgacatttt

SEQ ID NO: 9488909 - DNA, 22 bp, Homo sapiens
gagggaagaggcctgacatttt

SEQ ID NO: 9488910 - DNA, 22 bp, Homo sapiens
gagggaagattccccatatggg

SEQ ID NO: 9488911 - DNA, 22 bp, Homo sapiens
gagggaagattccccatatggg

SEQ ID NO: 9488912 - DNA, 22 bp, Homo sapiens
gagggaagagggtttgaattca

SEQ ID NO: 9488913 - DNA, 22 bp, Homo sapiens
gagtacagctcttttgttttca

SEQ ID NO: 9488914 - DNA, 22 bp, Homo sapiens
gagtaattccttagtgtgctta

SEQ ID NO: 9488915 - DNA, 22 bp, Homo sapiens
gagtaattgtgtctggcacact

SEQ ID NO: 9488916 - DNA, 22 bp, Homo sapiens
gagtaaaagttggattacaaag

SEQ ID NO: 9488917 - DNA, 22 bp, Homo sapiens
gagtaacataccaaaattcaca

SEQ ID NO: 9488918 - DNA, 22 bp, Homo sapiens
gagtaacatgtattggaaggcc

SEQ ID NO: 9488919 - DNA, 22 bp, Homo sapiens
gagtaacataccaaaattcaca

SEQ ID NO: 9488920 - DNA, 22 bp, Homo sapiens
gaggtggcttagtctctggaca

SEQ ID NO: 9488921 - DNA, 22 bp, Homo sapiens
gaggtgggagggcagtccctaa

SEQ ID NO: 9488922 - DNA, 22 bp, Homo sapiens
gaggtgggagggcagtccctaa

SEQ ID NO: 9488923 - DNA, 22 bp, Homo sapiens
gaggtgggagggcagtccctaa

SEQ ID NO: 9488924 - DNA, 22 bp, Homo sapiens
gaggtttcttatcaagaaagct

SEQ ID NO: 9488925 - DNA, 19 bp, Homo sapiens
gaggtttctgaagtgggct

SEQ ID NO: 9488926 - DNA, 23 bp, Homo sapiens
gaggtgtgaattctgggtgctgc

SEQ ID NO: 9488927 - DNA, 22 bp, Homo sapiens
gaggttggtgaggggacacggt

SEQ ID NO: 9488928 - DNA, 22 bp, Homo sapiens
gaggttggttccaaccctccca

SEQ ID NO: 9488929 - DNA, 22 bp, Homo sapiens
gaggtttcactgtgttgtccag

SEQ ID NO: 9488930 - DNA, 22 bp, Homo sapiens
gaggtttcactgtgttgtccag

SEQ ID NO: 9488931 - DNA, 23 bp, Homo sapiens
gaggtgtgaattctgggtgctgc

SEQ ID NO: 9488932 - DNA, 23 bp, Homo sapiens
gaggtgtgaattctgggtgctgc

SEQ ID NO: 9488933 - DNA, 22 bp, Homo sapiens
gaggtgctgctgtacttcttgc

SEQ ID NO: 9488934 - DNA, 22 bp, Homo sapiens
gaggtgcttcctttgggctctg

SEQ ID NO: 9488935 - DNA, 22 bp, Homo sapiens
gaggtgcctggcgatgtctctg

SEQ ID NO: 9488936 - DNA, 22 bp, Homo sapiens
gaggtgagtggatcacgaggtc

SEQ ID NO: 9488937 - DNA, 22 bp, Homo sapiens
gaggtgagtggatcacgaggtc

SEQ ID NO: 9488938 - DNA, 22 bp, Homo sapiens
gaggtgagaagggggtcagatg

SEQ ID NO: 9488939 - DNA, 22 bp, Homo sapiens
gaggtgagtggatcacgaggtc

SEQ ID NO: 9488940 - DNA, 22 bp, Homo sapiens
gaggtgagtggatcacgaggtc

SEQ ID NO: 9488941 - DNA, 22 bp, Homo sapiens
gaggtgagaagggggtcagatg

SEQ ID NO: 9488942 - DNA, 22 bp, Homo sapiens
gaggtggctggctcagagccag

SEQ ID NO: 9488943 - DNA, 22 bp, Homo sapiens
gaggtggctgcttgctgggaaa

SEQ ID NO: 9488944 - DNA, 22 bp, Homo sapiens
gaggtggctgcttgctgggaaa

SEQ ID NO: 9488945 - DNA, 22 bp, Homo sapiens
gaggtggctgcttgctgggaaa

SEQ ID NO: 9488946 - DNA, 22 bp, Homo sapiens
gaggtggctgtcagcttcactt

SEQ ID NO: 9488947 - DNA, 22 bp, Homo sapiens
gaggtggctgggagtagggaat

SEQ ID NO: 9488948 - DNA, 22 bp, Homo sapiens
gaggtggctccaggagcaatgc

SEQ ID NO: 9488949 - DNA, 22 bp, Homo sapiens
gaggtggatgttgcagtgagct

SEQ ID NO: 9488950 - DNA, 22 bp, Homo sapiens
gaggtggaaggcaggaacaaat

SEQ ID NO: 9488951 - DNA, 22 bp, Homo sapiens
gaggtggctgcttgctgggaaa

SEQ ID NO: 9488952 - DNA, 22 bp, Homo sapiens
gaggtggctgcttgctgggaaa

SEQ ID NO: 9488953 - DNA, 22 bp, Homo sapiens
gaggtggctccttcagggaata

SEQ ID NO: 9488954 - DNA, 22 bp, Homo sapiens
gagggtgcaggaggatggtagt

SEQ ID NO: 9488955 - DNA, 22 bp, Homo sapiens
gagggtgcagctgggccccacg

SEQ ID NO: 9488956 - DNA, 22 bp, Homo sapiens
gagggctgataacaggaataca

SEQ ID NO: 9488957 - DNA, 22 bp, Homo sapiens
gagggtcctggctaagtctgac

SEQ ID NO: 9488958 - DNA, 22 bp, Homo sapiens
gagggtcctggctaagtctgac

SEQ ID NO: 9488959 - DNA, 22 bp, Homo sapiens
gagggtggaagagctgctgaga

SEQ ID NO: 9488960 - DNA, 22 bp, Homo sapiens
gagggtggaagagctgctgaga

SEQ ID NO: 9488961 - DNA, 22 bp, Homo sapiens
gagggtggagctccagaatctg

SEQ ID NO: 9488962 - DNA, 22 bp, Homo sapiens
gagggtggcctttagagcccat

SEQ ID NO: 9488963 - DNA, 22 bp, Homo sapiens
gagggtggctcctccctgggcc

SEQ ID NO: 9488964 - DNA, 22 bp, Homo sapiens
gagggtggctcctccctgggcc

SEQ ID NO: 9488965 - DNA, 20 bp, Homo sapiens
gagggtgggacttcctaggc

SEQ ID NO: 9488966 - DNA, 22 bp, Homo sapiens
gagggtggtggcttaaggtgct

SEQ ID NO: 9488967 - DNA, 22 bp, Homo sapiens
gaggtctcactatgttgcccag

SEQ ID NO: 9488968 - DNA, 22 bp, Homo sapiens
gagggtggtggcttaaggtgct

SEQ ID NO: 9488969 - DNA, 22 bp, Homo sapiens
gagggtggtggcttaaggtgct

SEQ ID NO: 9488970 - DNA, 22 bp, Homo sapiens
gagggtgggtttcttgcacgtc

SEQ ID NO: 9488971 - DNA, 22 bp, Homo sapiens
gagggtggtggcttaaggtgct

SEQ ID NO: 9488972 - DNA, 22 bp, Homo sapiens
gaggtctgggcttgggcctggt

SEQ ID NO: 9488973 - DNA, 22 bp, Homo sapiens
gaggtctgggcttgggcctggt

SEQ ID NO: 9488974 - DNA, 22 bp, Homo sapiens
gaggtctgggatggggcctgaa

SEQ ID NO: 9488975 - DNA, 22 bp, Homo sapiens
gaggtctgggatggggcctgaa

SEQ ID NO: 9488976 - DNA, 22 bp, Homo sapiens
gaggtctgccttcaggagagtt

SEQ ID NO: 9488977 - DNA, 22 bp, Homo sapiens
gaggtctggaccaagtcgcccc

SEQ ID NO: 9488978 - DNA, 22 bp, Homo sapiens
gaggtctgccttcaggagagtt

SEQ ID NO: 9488979 - DNA, 22 bp, Homo sapiens
gaggtctgccttcaggagagtt

SEQ ID NO: 9488980 - DNA, 22 bp, Homo sapiens
gagggtgggtacaccagccctc

SEQ ID NO: 9488981 - DNA, 22 bp, Homo sapiens
gagggtggggaatagactgcta

SEQ ID NO: 9488982 - DNA, 22 bp, Homo sapiens
gagggtggggaatagactgcta

SEQ ID NO: 9488983 - DNA, 22 bp, Homo sapiens
gagggtggggaatagactgcta

SEQ ID NO: 9488984 - DNA, 22 bp, Homo sapiens
gagggtgggccagatatgaggg

SEQ ID NO: 9488985 - DNA, 22 bp, Homo sapiens
gagggtgggccagatatgaggg

SEQ ID NO: 9488986 - DNA, 22 bp, Homo sapiens
gagggtgggccagatatgaggg

SEQ ID NO: 9488987 - DNA, 22 bp, Homo sapiens
gagggtgggctcctatctgggt

SEQ ID NO: 9488988 - DNA, 22 bp, Homo sapiens
gagggtgggctcctatctgggt

SEQ ID NO: 9488989 - DNA, 22 bp, Homo sapiens
gagggtggggaatagactgcta

SEQ ID NO: 9488990 - DNA, 22 bp, Homo sapiens
gacaacacatgtatgccactct

SEQ ID NO: 9488991 - DNA, 22 bp, Homo sapiens
gacagcagcatgtttacaggcc

SEQ ID NO: 9488992 - DNA, 22 bp, Homo sapiens
gacagcagccacagggagaggg

SEQ ID NO: 9488993 - DNA, 22 bp, Homo sapiens
gacagcagccacagggagaggg

SEQ ID NO: 9488994 - DNA, 18 bp, Homo sapiens
gacagcagcttttgttct

SEQ ID NO: 9488995 - DNA, 22 bp, Homo sapiens
gacagcagccacagggagaggg

SEQ ID NO: 9488996 - DNA, 22 bp, Homo sapiens
gacagcagccacagggagaggg

SEQ ID NO: 9488997 - DNA, 22 bp, Homo sapiens
gacagcagccacagggagaggg

SEQ ID NO: 9488998 - DNA, 22 bp, Homo sapiens
gacagcaggagatcatgataga

SEQ ID NO: 9488999 - DNA, 22 bp, Homo sapiens
gacagcaggatgtgaggggatg

SEQ ID NO: 9489000 - DNA, 22 bp, Homo sapiens
gacagcaggatgtgaggggatg

SEQ ID NO: 9489001 - DNA, 22 bp, Homo sapiens
gacagcaggatgtgaggggatg

SEQ ID NO: 9489002 - DNA, 22 bp, Homo sapiens
gacagcagggaaagtccagacc

SEQ ID NO: 9489003 - DNA, 22 bp, Homo sapiens
gacagcagggaaagtccagacc

SEQ ID NO: 9489004 - DNA, 22 bp, Homo sapiens
gacagcaggatgtgaggggatg

SEQ ID NO: 9489005 - DNA, 22 bp, Homo sapiens
gacagcagggaaagtccagacc

SEQ ID NO: 9489006 - DNA, 22 bp, Homo sapiens
gacagcagggacatgtaggaag

SEQ ID NO: 9489007 - DNA, 22 bp, Homo sapiens
gacagcagggaaagtccagacc

SEQ ID NO: 9489008 - DNA, 22 bp, Homo sapiens
gacagcagggaaagtccagacc

SEQ ID NO: 9489009 - DNA, 22 bp, Homo sapiens
gacaaatgtacccctagagtct

SEQ ID NO: 9489010 - DNA, 22 bp, Homo sapiens
gacaacaataatgtggagctga

SEQ ID NO: 9489011 - DNA, 22 bp, Homo sapiens
gacaaagcagacaagataattc

SEQ ID NO: 9489012 - DNA, 23 bp, Homo sapiens
gacaaagcacttgaaatgtgtac

SEQ ID NO: 9489013 - DNA, 22 bp, Homo sapiens
gacaaagcagacaagataattc

SEQ ID NO: 9489014 - DNA, 22 bp, Homo sapiens
gacaaagcctaagaagtattta

SEQ ID NO: 9489015 - DNA, 22 bp, Homo sapiens
gacaaagctttggcatccttac

SEQ ID NO: 9489016 - DNA, 22 bp, Homo sapiens
gacaaagcgcctgctcgcgggc

SEQ ID NO: 9489017 - DNA, 21 bp, Homo sapiens
gacaaagtgaagcaggcagga

SEQ ID NO: 9489018 - DNA, 22 bp, Homo sapiens
gacaaagtgctaaaccacagag

SEQ ID NO: 9489019 - DNA, 22 bp, Homo sapiens
gacaaatcattctctgtgtctg

SEQ ID NO: 9489020 - DNA, 22 bp, Homo sapiens
gacaaagtgctaaaccacagag

SEQ ID NO: 9489021 - DNA, 22 bp, Homo sapiens
gacaaagagaagtaacagtacc

SEQ ID NO: 9489022 - DNA, 22 bp, Homo sapiens
gacaaagagaagtaacagtacc

SEQ ID NO: 9489023 - DNA, 21 bp, Homo sapiens
gacaaacatttcatagcttta

SEQ ID NO: 9489024 - DNA, 22 bp, Homo sapiens
gacaaactgaagtatatttaga

SEQ ID NO: 9489025 - DNA, 21 bp, Homo sapiens
gacaaacatttcatagcttta

SEQ ID NO: 9489026 - DNA, 22 bp, Homo sapiens
gacaaaagtgttttgaacaagg

SEQ ID NO: 9489027 - DNA, 22 bp, Homo sapiens
gacaaaagtgttttgaacaagg

SEQ ID NO: 9489028 - DNA, 18 bp, Homo sapiens
gacaaaagtacagacaga

SEQ ID NO: 9489029 - DNA, 22 bp, Homo sapiens
gacaaaactgagatcacactgt

SEQ ID NO: 9489030 - DNA, 22 bp, Homo sapiens
gacaaaactgagatcacactgt

SEQ ID NO: 9489031 - DNA, 18 bp, Homo sapiens
gacaaaagtacagacaga

SEQ ID NO: 9489032 - DNA, 18 bp, Homo sapiens
gacaaaagtacagacaga

SEQ ID NO: 9489033 - DNA, 18 bp, Homo sapiens
gacaaaagtacagacaga

SEQ ID NO: 9489034 - DNA, 22 bp, Homo sapiens
gacaaaacacattagtttaaaa

SEQ ID NO: 9489035 - DNA, 22 bp, Homo sapiens
gaatttttctggaagcaattat

SEQ ID NO: 9489036 - DNA, 22 bp, Homo sapiens
gaatttttctggaagcaattat

SEQ ID NO: 9489037 - DNA, 22 bp, Homo sapiens
gacaaaacacattagtttaaaa

SEQ ID NO: 9489038 - DNA, 22 bp, Homo sapiens
gaattttattactagtcaactg

SEQ ID NO: 9489039 - DNA, 22 bp, Homo sapiens
gaattttgcttttatgtcaagt

SEQ ID NO: 9489040 - DNA, 22 bp, Homo sapiens
gaattttcaggtagcaatttca

SEQ ID NO: 9489041 - DNA, 22 bp, Homo sapiens
gaatttacaagttgaataacaa

SEQ ID NO: 9489042 - DNA, 22 bp, Homo sapiens
gaatttacaagttgaataacaa

SEQ ID NO: 9489043 - DNA, 22 bp, Homo sapiens
gaatttatctacgttaagtatg

SEQ ID NO: 9489044 - DNA, 22 bp, Homo sapiens
gaatttatctacgttaagtatg

SEQ ID NO: 9489045 - DNA, 20 bp, Homo sapiens
gaattttatgaacactacca

SEQ ID NO: 9489046 - DNA, 22 bp, Homo sapiens
gaattttattactagtcaactg

SEQ ID NO: 9489047 - DNA, 22 bp, Homo sapiens
gaatgcattccacggtagtgat

SEQ ID NO: 9489048 - DNA, 22 bp, Homo sapiens
gaatgcagtggtgagatcttgg

SEQ ID NO: 9489049 - DNA, 22 bp, Homo sapiens
gaatgcattctcttagcatcta

SEQ ID NO: 9489050 - DNA, 22 bp, Homo sapiens
gaatgctaagcatgtgggagtt

SEQ ID NO: 9489051 - DNA, 22 bp, Homo sapiens
gaatgctctcattttccaacat

SEQ ID NO: 9489052 - DNA, 19 bp, Homo sapiens
gaatgcagaagagagtgga

SEQ ID NO: 9489053 - DNA, 22 bp, Homo sapiens
gaatgcagctgacagtcgtttt

SEQ ID NO: 9489054 - DNA, 22 bp, Homo sapiens
gaatgcagatggctggtgtatg

SEQ ID NO: 9489055 - DNA, 21 bp, Homo sapiens
gaagacaaatgggaatagctg

SEQ ID NO: 9489056 - DNA, 22 bp, Homo sapiens
gaagaaggtgccagaggcttac

SEQ ID NO: 9489057 - DNA, 22 bp, Homo sapiens
gaagaagggagtgacaaatgca

SEQ ID NO: 9489058 - DNA, 22 bp, Homo sapiens
gaagaatctgaggacagtcatt

SEQ ID NO: 9489059 - DNA, 22 bp, Homo sapiens
gaagaattgcccatttctgtct

SEQ ID NO: 9489060 - DNA, 22 bp, Homo sapiens
gaagaattgaggatgtttacct

SEQ ID NO: 9489061 - DNA, 22 bp, Homo sapiens
gaagaatccatgctaatttacc

SEQ ID NO: 9489062 - DNA, 22 bp, Homo sapiens
gaagaatcaagcagtaatttgt

SEQ ID NO: 9489063 - DNA, 22 bp, Homo sapiens
gaagaatattcttgatcttaga

SEQ ID NO: 9489064 - DNA, 22 bp, Homo sapiens
gaagaatcctgtcctctttagg

SEQ ID NO: 9489065 - DNA, 22 bp, Homo sapiens
gaagaatattcttgatcttaga

SEQ ID NO: 9489066 - DNA, 22 bp, Homo sapiens
gaagaatatataatgattttgt

SEQ ID NO: 9489067 - DNA, 22 bp, Homo sapiens
gaagaagtgtaagtctgtttca

SEQ ID NO: 9489068 - DNA, 21 bp, Homo sapiens
gaatggcaccattagcatata

SEQ ID NO: 9489069 - DNA, 22 bp, Homo sapiens
gaatggcatagctttctttaca

SEQ ID NO: 9489070 - DNA, 22 bp, Homo sapiens
gaatgcttggaacctgaagttc

SEQ ID NO: 9489071 - DNA, 22 bp, Homo sapiens
gaatgctgtagacagactctat

SEQ ID NO: 9489072 - DNA, 22 bp, Homo sapiens
gaatgctgagtcttatctctta

SEQ ID NO: 9489073 - DNA, 22 bp, Homo sapiens
gaatgctctttggtcctagact

SEQ ID NO: 9489074 - DNA, 22 bp, Homo sapiens
gaatgctggcttacaggcagtt

SEQ ID NO: 9489075 - DNA, 22 bp, Homo sapiens
gaatgtaaaattgcctacaaga

SEQ ID NO: 9489076 - DNA, 22 bp, Homo sapiens
gaatgtaaaattgcctacaaga

SEQ ID NO: 9489077 - DNA, 22 bp, Homo sapiens
gaatgtaagtgggcagaagaca

SEQ ID NO: 9489078 - DNA, 19 bp, Homo sapiens
gaatgggaatgggaaagct

SEQ ID NO: 9489079 - DNA, 22 bp, Homo sapiens
gaatggctgaatgtcttaaatt

SEQ ID NO: 9489080 - DNA, 21 bp, Homo sapiens
gaatggctcgcgcgccacact

SEQ ID NO: 9489081 - DNA, 19 bp, Homo sapiens
gaatgggaatgggaaagct

SEQ ID NO: 9489082 - DNA, 22 bp, Homo sapiens
gaatggctatcggattattagg

SEQ ID NO: 9489083 - DNA, 23 bp, Homo sapiens
gaatggctaagcacatagacttg

SEQ ID NO: 9489084 - DNA, 22 bp, Homo sapiens
gaatgtttttataagtgttaca

SEQ ID NO: 9489085 - DNA, 22 bp, Homo sapiens
gaattaaaatagttttggtcga

SEQ ID NO: 9489086 - DNA, 22 bp, Homo sapiens
gaattaaaatagttttggtcga

SEQ ID NO: 9489087 - DNA, 22 bp, Homo sapiens
gaattacagccagaagaatgaa

SEQ ID NO: 9489088 - DNA, 22 bp, Homo sapiens
gaattacagccagaagaatgaa

SEQ ID NO: 9489089 - DNA, 22 bp, Homo sapiens
gaattacaaagtgagacaagct

SEQ ID NO: 9489090 - DNA, 22 bp, Homo sapiens
gaatttaaggaccaagcatttt

SEQ ID NO: 9489091 - DNA, 22 bp, Homo sapiens
gaatttaaggaccaagcatttt

SEQ ID NO: 9489092 - DNA, 22 bp, Homo sapiens
gaattacatagtttctaggttc

SEQ ID NO: 9489093 - DNA, 22 bp, Homo sapiens
gaattacataataaaatgagag

SEQ ID NO: 9489094 - DNA, 22 bp, Homo sapiens
gaatttaaggaccaagcatttt

SEQ ID NO: 9489095 - DNA, 22 bp, Homo sapiens
gaattacataataaaatgagag

SEQ ID NO: 9489096 - DNA, 22 bp, Homo sapiens
gaattacagccagaagaatgaa

SEQ ID NO: 9489097 - DNA, 22 bp, Homo sapiens
gaattacataataaaatgagag

SEQ ID NO: 9489098 - DNA, 22 bp, Homo sapiens
gacatacagaatctgcagactt

SEQ ID NO: 9489099 - DNA, 22 bp, Homo sapiens
gacagtgcatttcctggcatgg

SEQ ID NO: 9489100 - DNA, 22 bp, Homo sapiens
gacagtctggcctaaagggtta

SEQ ID NO: 9489101 - DNA, 22 bp, Homo sapiens
gacagtgagtacctcaaaggcc

SEQ ID NO: 9489102 - DNA, 22 bp, Homo sapiens
gacagtgattagttactataaa

SEQ ID NO: 9489103 - DNA, 22 bp, Homo sapiens
gacagtgagagtctacaccctc

SEQ ID NO: 9489104 - DNA, 17 bp, Homo sapiens
gacagctggttcctggc

SEQ ID NO: 9489105 - DNA, 17 bp, Homo sapiens
gacagctggttcctggc

SEQ ID NO: 9489106 - DNA, 22 bp, Homo sapiens
gacagctgtacactcctggtta

SEQ ID NO: 9489107 - DNA, 17 bp, Homo sapiens
gacagctgggcgcacgc

SEQ ID NO: 9489108 - DNA, 22 bp, Homo sapiens
gacagtcctgcaggttgaactc

SEQ ID NO: 9489109 - DNA, 22 bp, Homo sapiens
gacagctgtacactcctggtta

SEQ ID NO: 9489110 - DNA, 17 bp, Homo sapiens
gacagctgggcgcacgc

SEQ ID NO: 9489111 - DNA, 22 bp, Homo sapiens
gacagctgggaggatgacataa

SEQ ID NO: 9489112 - DNA, 22 bp, Homo sapiens
gacagctgggaggatgacataa

SEQ ID NO: 9489113 - DNA, 17 bp, Homo sapiens
gacagctggttcctggc

SEQ ID NO: 9489114 - DNA, 17 bp, Homo sapiens
gacagctgggcgcacgc

SEQ ID NO: 9489115 - DNA, 22 bp, Homo sapiens
gacatagactgagtttagctga

SEQ ID NO: 9489116 - DNA, 22 bp, Homo sapiens
gacatatgtgtacatggagatt

SEQ ID NO: 9489117 - DNA, 21 bp, Homo sapiens
gacatccatgtgagtggcagt

SEQ ID NO: 9489118 - DNA, 22 bp, Homo sapiens
gacatctgaatattagagagaa

SEQ ID NO: 9489119 - DNA, 22 bp, Homo sapiens
gacatctgaggccctcagagcc

SEQ ID NO: 9489120 - DNA, 22 bp, Homo sapiens
gacatctgaggccctcagagcc

SEQ ID NO: 9489121 - DNA, 22 bp, Homo sapiens
gacagctgaacaggtgggataa

SEQ ID NO: 9489122 - DNA, 22 bp, Homo sapiens
gacagctgaaaaatgtaaggta

SEQ ID NO: 9489123 - DNA, 22 bp, Homo sapiens
gacagctccagctcctccaggc

SEQ ID NO: 9489124 - DNA, 22 bp, Homo sapiens
gacagcctcatgtgcatgaact

SEQ ID NO: 9489125 - DNA, 22 bp, Homo sapiens
gacagcctcatgaggagcaaaa

SEQ ID NO: 9489126 - DNA, 22 bp, Homo sapiens
gacagctggcagtggaaaggtg

SEQ ID NO: 9489127 - DNA, 22 bp, Homo sapiens
gacagctggacagacactgatg

SEQ ID NO: 9489128 - DNA, 22 bp, Homo sapiens
gacagctgctcccgtttctgct

SEQ ID NO: 9489129 - DNA, 22 bp, Homo sapiens
gacagctgcttatgaaccaacg

SEQ ID NO: 9489130 - DNA, 22 bp, Homo sapiens
gacagctggacagacactgatg

SEQ ID NO: 9489131 - DNA, 22 bp, Homo sapiens
gacagctgcttatgaaccaacg

SEQ ID NO: 9489132 - DNA, 22 bp, Homo sapiens
gacagctgaaggatgattcagg

SEQ ID NO: 9489133 - DNA, 22 bp, Homo sapiens
gacagctgaacaggtgggataa

SEQ ID NO: 9489134 - DNA, 22 bp, Homo sapiens
gacagctgcatcctcagacaca

SEQ ID NO: 9489135 - DNA, 22 bp, Homo sapiens
gacagctgcatcctcagacaca

SEQ ID NO: 9489136 - DNA, 22 bp, Homo sapiens
gacagctgcctctgtgtagatc

SEQ ID NO: 9489137 - DNA, 22 bp, Homo sapiens
gacagctgctcccgtttctgct

SEQ ID NO: 9489138 - DNA, 22 bp, Homo sapiens
gacagctgcctctgtgtagatc

SEQ ID NO: 9489139 - DNA, 22 bp, Homo sapiens
gacagccaactggggagggcat

SEQ ID NO: 9489140 - DNA, 22 bp, Homo sapiens
gacagccaggcatagggagtat

SEQ ID NO: 9489141 - DNA, 22 bp, Homo sapiens
gacagccagtgcgatggattca

SEQ ID NO: 9489142 - DNA, 22 bp, Homo sapiens
gacagcatctgtgtggcaggag

SEQ ID NO: 9489143 - DNA, 22 bp, Homo sapiens
gacagcatgatcaaggagccca

SEQ ID NO: 9489144 - DNA, 22 bp, Homo sapiens
gacagcagtttttctctagggt

SEQ ID NO: 9489145 - DNA, 22 bp, Homo sapiens
gacagcaggtgcttgggaaagg

SEQ ID NO: 9489146 - DNA, 22 bp, Homo sapiens
gacagcaggtgcttgggaaagg

SEQ ID NO: 9489147 - DNA, 22 bp, Homo sapiens
gacagcagtcctggagttccca

SEQ ID NO: 9489148 - DNA, 22 bp, Homo sapiens
gacagcagtcctggagttccca

SEQ ID NO: 9489149 - DNA, 22 bp, Homo sapiens
gacagcagtcctggagttccca

SEQ ID NO: 9489150 - DNA, 22 bp, Homo sapiens
gacagcaggtaattagttaaca

SEQ ID NO: 9489151 - DNA, 22 bp, Homo sapiens
gacagcaggtgcttgggaaagg

SEQ ID NO: 9489152 - DNA, 22 bp, Homo sapiens
gacagcagggacatgtaggaag

SEQ ID NO: 9489153 - DNA, 22 bp, Homo sapiens
gacagcaggtaattagttaaca

SEQ ID NO: 9489154 - DNA, 22 bp, Homo sapiens
gacagcagggacatgtaggaag

SEQ ID NO: 9489155 - DNA, 22 bp, Homo sapiens
gacagcagggacatgtaggaag

SEQ ID NO: 9489156 - DNA, 22 bp, Homo sapiens
gacagcagggacatgtaggaag

SEQ ID NO: 9489157 - DNA, 22 bp, Homo sapiens
gacatgaacctaccataatgat

SEQ ID NO: 9489158 - DNA, 22 bp, Homo sapiens
gacatgaacctaccataatgat

SEQ ID NO: 9489159 - DNA, 22 bp, Homo sapiens
gacatgaatgttatactttatt

SEQ ID NO: 9489160 - DNA, 22 bp, Homo sapiens
gacatgcatgaatgcaggtctc

SEQ ID NO: 9489161 - DNA, 22 bp, Homo sapiens
gacatgcattaagacacactga

SEQ ID NO: 9489162 - DNA, 22 bp, Homo sapiens
gacatgcattaagacacactga

SEQ ID NO: 9489163 - DNA, 22 bp, Homo sapiens
gacatggatacttgataagggg

SEQ ID NO: 9489164 - DNA, 22 bp, Homo sapiens
gacatgctgaataactatatga

SEQ ID NO: 9489165 - DNA, 22 bp, Homo sapiens
gacatggcttctaggaagcttt

SEQ ID NO: 9489166 - DNA, 22 bp, Homo sapiens
gacatggatacttgataagggg

SEQ ID NO: 9489167 - DNA, 22 bp, Homo sapiens
gacatgtaaatggcaattatgg

SEQ ID NO: 9489168 - DNA, 22 bp, Homo sapiens
gacatgggatgagatgaagcat

SEQ ID NO: 9489169 - DNA, 22 bp, Homo sapiens
gacatgtacttcaatttctctt

SEQ ID NO: 9489170 - DNA, 22 bp, Homo sapiens
gacatgtattagtacatatggt

SEQ ID NO: 9489171 - DNA, 22 bp, Homo sapiens
gacatgtattagtacatatggt

SEQ ID NO: 9489172 - DNA, 22 bp, Homo sapiens
gacatgtcggatagaatgagtt

SEQ ID NO: 9489173 - DNA, 22 bp, Homo sapiens
gacatgtattagtcatgcacag

SEQ ID NO: 9489174 - DNA, 22 bp, Homo sapiens
gacctgagattttgaggctcat

SEQ ID NO: 9489175 - DNA, 22 bp, Homo sapiens
gacctgaaatttgtggtagaac

SEQ ID NO: 9489176 - DNA, 22 bp, Homo sapiens
gacattagactaatgtagcatt

SEQ ID NO: 9489177 - DNA, 22 bp, Homo sapiens
gacatgttatctctggcttcaa

SEQ ID NO: 9489178 - DNA, 22 bp, Homo sapiens
gacctgctccacgacaagtggt

SEQ ID NO: 9489179 - DNA, 22 bp, Homo sapiens
gacctggaatttgtgtgtgttc

SEQ ID NO: 9489180 - DNA, 22 bp, Homo sapiens
gacctggaagaactgaggcctt

SEQ ID NO: 9489181 - DNA, 22 bp, Homo sapiens
gacctgcccactctgaggacat

SEQ ID NO: 9489182 - DNA, 22 bp, Homo sapiens
gacctgcctgagctgcctctgc

SEQ ID NO: 9489183 - DNA, 22 bp, Homo sapiens
gactatttatttacagaaagct

SEQ ID NO: 9489184 - DNA, 22 bp, Homo sapiens
gactatctgccaggtcccaggg

SEQ ID NO: 9489185 - DNA, 22 bp, Homo sapiens
gactagggaatcattcttggat

SEQ ID NO: 9489186 - DNA, 22 bp, Homo sapiens
gaccttgtgatccacccgcctt

SEQ ID NO: 9489187 - DNA, 22 bp, Homo sapiens
gaccttgtgatccacccgcctt

SEQ ID NO: 9489188 - DNA, 22 bp, Homo sapiens
gaccttgtgatccacccgcctt

SEQ ID NO: 9489189 - DNA, 22 bp, Homo sapiens
gactactcaaactttctctata

SEQ ID NO: 9489190 - DNA, 22 bp, Homo sapiens
gactacaggtgtgtgccaccat

SEQ ID NO: 9489191 - DNA, 22 bp, Homo sapiens
gaccttcttgctgtgtcctaac

SEQ ID NO: 9489192 - DNA, 22 bp, Homo sapiens
gacctggctttgggccccggca

SEQ ID NO: 9489193 - DNA, 22 bp, Homo sapiens
gacctggggtaagcttggcaac

SEQ ID NO: 9489194 - DNA, 22 bp, Homo sapiens
gacctggcctgcacagccctta

SEQ ID NO: 9489195 - DNA, 22 bp, Homo sapiens
gacctggtccttgtactttgaa

SEQ ID NO: 9489196 - DNA, 22 bp, Homo sapiens
gacctggggtggaaggaaggca

SEQ ID NO: 9489197 - DNA, 22 bp, Homo sapiens
gaccttccttctttgctccggg

SEQ ID NO: 9489198 - DNA, 22 bp, Homo sapiens
gaccttcttgctgtgtcctaac

SEQ ID NO: 9489199 - DNA, 22 bp, Homo sapiens
gaccttccatgccttcttccaa

SEQ ID NO: 9489200 - DNA, 22 bp, Homo sapiens
gaccttcagtgtgtttctcaca

SEQ ID NO: 9489201 - DNA, 22 bp, Homo sapiens
gacctggtccttgtactttgaa

SEQ ID NO: 9489202 - DNA, 22 bp, Homo sapiens
gacctggtgctagctggtgtgt

SEQ ID NO: 9489203 - DNA, 22 bp, Homo sapiens
gacctggttgactgtgagcagg

SEQ ID NO: 9489204 - DNA, 22 bp, Homo sapiens
gagaggcagaggcctgaaaccg

SEQ ID NO: 9489205 - DNA, 22 bp, Homo sapiens
gagaggcaggaatcctgggtga

SEQ ID NO: 9489206 - DNA, 22 bp, Homo sapiens
gagaggcaggaatcctgggtga

SEQ ID NO: 9489207 - DNA, 22 bp, Homo sapiens
gagaggagtccctatcacagtt

SEQ ID NO: 9489208 - DNA, 22 bp, Homo sapiens
gagatttcacccctcttaacct

SEQ ID NO: 9489209 - DNA, 22 bp, Homo sapiens
gagaggcaggcgctgcaatggt

SEQ ID NO: 9489210 - DNA, 22 bp, Homo sapiens
gagaggcaggaatcctgggtga

SEQ ID NO: 9489211 - DNA, 22 bp, Homo sapiens
gagatttagctgcttaactcct

SEQ ID NO: 9489212 - DNA, 22 bp, Homo sapiens
gagatttattgacttaacagta

SEQ ID NO: 9489213 - DNA, 22 bp, Homo sapiens
gagcaacactccacattgctag

SEQ ID NO: 9489214 - DNA, 22 bp, Homo sapiens
gagcaacagggcgaggagaact

SEQ ID NO: 9489215 - DNA, 22 bp, Homo sapiens
gagcaacttcaatagtactatt

SEQ ID NO: 9489216 - DNA, 22 bp, Homo sapiens
gagcaagaccctgggttctctc

SEQ ID NO: 9489217 - DNA, 22 bp, Homo sapiens
gagcaagactacaggcagatga

SEQ ID NO: 9489218 - DNA, 22 bp, Homo sapiens
gagcaaaataaattctgacaaa

SEQ ID NO: 9489219 - DNA, 22 bp, Homo sapiens
gagcaaaataaattctgacaaa

SEQ ID NO: 9489220 - DNA, 23 bp, Homo sapiens
gagcaaacccgtctatgccctcc

SEQ ID NO: 9489221 - DNA, 22 bp, Homo sapiens
gagcaaagcttttagggccttt

SEQ ID NO: 9489222 - DNA, 22 bp, Homo sapiens
gagcaaaggtgcagtttgaaat

SEQ ID NO: 9489223 - DNA, 22 bp, Homo sapiens
gagcaacaaattagggggattt

SEQ ID NO: 9489224 - DNA, 22 bp, Homo sapiens
gagcacagaatcttcccatgca

SEQ ID NO: 9489225 - DNA, 22 bp, Homo sapiens
gagcacagaaggagaaatatgg

SEQ ID NO: 9489226 - DNA, 22 bp, Homo sapiens
gagcacagatcctggagccaca

SEQ ID NO: 9489227 - DNA, 22 bp, Homo sapiens
gagcaatacatggcatgaaatt

SEQ ID NO: 9489228 - DNA, 22 bp, Homo sapiens
gagcaaggtagctctctggggc

SEQ ID NO: 9489229 - DNA, 22 bp, Homo sapiens
gagcaatagaaagaatactgct

SEQ ID NO: 9489230 - DNA, 22 bp, Homo sapiens
gagcaaggtagctctctggggc

SEQ ID NO: 9489231 - DNA, 22 bp, Homo sapiens
gagcaatagcaccaattaactc

SEQ ID NO: 9489232 - DNA, 22 bp, Homo sapiens
gagcaatggaagatagataaca

SEQ ID NO: 9489233 - DNA, 22 bp, Homo sapiens
gagcaatgcccttcaccagccc

SEQ ID NO: 9489234 - DNA, 22 bp, Homo sapiens
gagcacagaactaaatgctggt

SEQ ID NO: 9489235 - DNA, 22 bp, Homo sapiens
gagcacagaactaaatgctggt

SEQ ID NO: 9489236 - DNA, 22 bp, Homo sapiens
gagcacagaactaaatgctggt

SEQ ID NO: 9489237 - DNA, 22 bp, Homo sapiens
gagcaaggatggccggggccgt

SEQ ID NO: 9489238 - DNA, 22 bp, Homo sapiens
gagcaaggatgggtctatagta

SEQ ID NO: 9489239 - DNA, 22 bp, Homo sapiens
gagcaaggatggccggggccgt

SEQ ID NO: 9489240 - DNA, 22 bp, Homo sapiens
gagcaaggagggtggggccttt

SEQ ID NO: 9489241 - DNA, 22 bp, Homo sapiens
gagcaaggagggtggggccttt

SEQ ID NO: 9489242 - DNA, 22 bp, Homo sapiens
gagcaaggtagctctctggggc

SEQ ID NO: 9489243 - DNA, 22 bp, Homo sapiens
gagcaaggtagctctctggggc

SEQ ID NO: 9489244 - DNA, 22 bp, Homo sapiens
gagcaaggatgggtctatagta

SEQ ID NO: 9489245 - DNA, 22 bp, Homo sapiens
gagcaaggcggcatctctctga

SEQ ID NO: 9489246 - DNA, 22 bp, Homo sapiens
gagcaaggcggcatctctctga

SEQ ID NO: 9489247 - DNA, 22 bp, Homo sapiens
gagcaagactacaggcagatga

SEQ ID NO: 9489248 - DNA, 22 bp, Homo sapiens
gagcaagattaaaaggctgggt

SEQ ID NO: 9489249 - DNA, 22 bp, Homo sapiens
gagcaagatcctgtttttctat

SEQ ID NO: 9489250 - DNA, 22 bp, Homo sapiens
gagcaagattaaaaggctgggt

SEQ ID NO: 9489251 - DNA, 22 bp, Homo sapiens
gagcagagaatccagctaagtg

SEQ ID NO: 9489252 - DNA, 22 bp, Homo sapiens
gagcagacgctgcagtcttggg

SEQ ID NO: 9489253 - DNA, 22 bp, Homo sapiens
gagcagaacaggccgggtggga

SEQ ID NO: 9489254 - DNA, 22 bp, Homo sapiens
gagcagaaagttatgtcttgca

SEQ ID NO: 9489255 - DNA, 22 bp, Homo sapiens
gagcacttagatgctatgaatg

SEQ ID NO: 9489256 - DNA, 22 bp, Homo sapiens
gagcactgaggaaagctggtta

SEQ ID NO: 9489257 - DNA, 22 bp, Homo sapiens
gagcactgatttatttttgtct

SEQ ID NO: 9489258 - DNA, 22 bp, Homo sapiens
gagcacctcaaatgaacataaa

SEQ ID NO: 9489259 - DNA, 22 bp, Homo sapiens
gagcacctcaatttgctatttg

SEQ ID NO: 9489260 - DNA, 22 bp, Homo sapiens
gagcacctgcctcctcatttga

SEQ ID NO: 9489261 - DNA, 22 bp, Homo sapiens
gagcacctgctaaatgacagtt

SEQ ID NO: 9489262 - DNA, 22 bp, Homo sapiens
gagcacctgggacacagcttgt

SEQ ID NO: 9489263 - DNA, 22 bp, Homo sapiens
gagcactcaggacactcatagg

SEQ ID NO: 9489264 - DNA, 20 bp, Homo sapiens
gagcacagtaatgactgcta

SEQ ID NO: 9489265 - DNA, 22 bp, Homo sapiens
gagcacagtaaagcagtgtcac

SEQ ID NO: 9489266 - DNA, 22 bp, Homo sapiens
gagcacagtaaagcagtgtcac

SEQ ID NO: 9489267 - DNA, 22 bp, Homo sapiens
gagcacagatcctggagccaca

SEQ ID NO: 9489268 - DNA, 22 bp, Homo sapiens
gagcacagtaaagcagtgtcac

SEQ ID NO: 9489269 - DNA, 22 bp, Homo sapiens
gagcacagtaaagcagtgtcac

SEQ ID NO: 9489270 - DNA, 22 bp, Homo sapiens
gagcacagtgcagtttctgcta

SEQ ID NO: 9489271 - DNA, 22 bp, Homo sapiens
gagcacagtccttttgttaaaa

SEQ ID NO: 9489272 - DNA, 22 bp, Homo sapiens
gagcacagtccttttgttaaaa

SEQ ID NO: 9489273 - DNA, 22 bp, Homo sapiens
gagcacagtccttttgttaaaa

SEQ ID NO: 9489274 - DNA, 20 bp, Homo sapiens
gagcacagtaatgactgcta

SEQ ID NO: 9489275 - DNA, 22 bp, Homo sapiens
gagcacccgtcggtggtaggaa

SEQ ID NO: 9489276 - DNA, 22 bp, Homo sapiens
gagcacccatgcagagggaaca

SEQ ID NO: 9489277 - DNA, 22 bp, Homo sapiens
gagcaccctacctgccactgag

SEQ ID NO: 9489278 - DNA, 22 bp, Homo sapiens
gagcacagtgtgttgtgatttc

SEQ ID NO: 9489279 - DNA, 22 bp, Homo sapiens
gagcacagtgtgttgtgatttc

SEQ ID NO: 9489280 - DNA, 22 bp, Homo sapiens
gagcagcttgcgctgtcttcac

SEQ ID NO: 9489281 - DNA, 22 bp, Homo sapiens
gagcagcttgcgctgtcttcac

SEQ ID NO: 9489282 - DNA, 15 bp, Homo sapiens
gagcaggaaacttgg

SEQ ID NO: 9489283 - DNA, 22 bp, Homo sapiens
gagcaggaacagatcccttgga

SEQ ID NO: 9489284 - DNA, 22 bp, Homo sapiens
gagcaggaacagatcccttgga

SEQ ID NO: 9489285 - DNA, 22 bp, Homo sapiens
gagcaggaactgaaaatgagac

SEQ ID NO: 9489286 - DNA, 22 bp, Homo sapiens
gagcaggaactgaaaatgagac

SEQ ID NO: 9489287 - DNA, 22 bp, Homo sapiens
gagcaggaacagatcccttgga

SEQ ID NO: 9489288 - DNA, 22 bp, Homo sapiens
gagcaggaaggccagaagggtc

SEQ ID NO: 9489289 - DNA, 22 bp, Homo sapiens
gagcaggaactgaaaatgagac

SEQ ID NO: 9489290 - DNA, 22 bp, Homo sapiens
gagcaggaactgaaaatgagac

SEQ ID NO: 9489291 - DNA, 22 bp, Homo sapiens
gagcaggacagcagcttcctgg

SEQ ID NO: 9489292 - DNA, 22 bp, Homo sapiens
gagcaggacagcagcttcctgg

SEQ ID NO: 9489293 - DNA, 22 bp, Homo sapiens
gagcaggacgtgggaatgggaa

SEQ ID NO: 9489294 - DNA, 22 bp, Homo sapiens
gagcaggacgtgggaatgggaa

SEQ ID NO: 9489295 - DNA, 22 bp, Homo sapiens
gagcaggacgtgggaatgggaa

SEQ ID NO: 9489296 - DNA, 22 bp, Homo sapiens
gagcaggaaggccagaagggtc

SEQ ID NO: 9489297 - DNA, 22 bp, Homo sapiens
gagcaggaaggccagaagggtc

SEQ ID NO: 9489298 - DNA, 22 bp, Homo sapiens
gagcaggaaggccagaagggtc

SEQ ID NO: 9489299 - DNA, 22 bp, Homo sapiens
gagcaggaaggccagaagggtc

SEQ ID NO: 9489300 - DNA, 22 bp, Homo sapiens
gagcaggaaggccagaagggtc

SEQ ID NO: 9489301 - DNA, 22 bp, Homo sapiens
gagcagagaatccagctaagtg

SEQ ID NO: 9489302 - DNA, 22 bp, Homo sapiens
gagcagagacagtacaactggc

SEQ ID NO: 9489303 - DNA, 22 bp, Homo sapiens
gagcagagacagtacaactggc

SEQ ID NO: 9489304 - DNA, 22 bp, Homo sapiens
gagcagagacagtacaactggc

SEQ ID NO: 9489305 - DNA, 23 bp, Homo sapiens
gagcagagcgggcgggggtcctg

SEQ ID NO: 9489306 - DNA, 22 bp, Homo sapiens
gagcagagacagtacaactggc

SEQ ID NO: 9489307 - DNA, 22 bp, Homo sapiens
gagcagagacagtacaactggc

SEQ ID NO: 9489308 - DNA, 18 bp, Homo sapiens
gagcagaggctcaactgg

SEQ ID NO: 9489309 - DNA, 19 bp, Homo sapiens
gagcagcttcctatctggt

SEQ ID NO: 9489310 - DNA, 19 bp, Homo sapiens
gagcagcttcctatctggt

SEQ ID NO: 9489311 - DNA, 22 bp, Homo sapiens
gagcagcttgcgctgtcttcac

SEQ ID NO: 9489312 - DNA, 19 bp, Homo sapiens
gagcagcttcctatctggt

SEQ ID NO: 9489313 - DNA, 22 bp, Homo sapiens
gagcagagcttctcaaagtaaa

SEQ ID NO: 9489314 - DNA, 18 bp, Homo sapiens
gagcagaggagggttttt

SEQ ID NO: 9489315 - DNA, 22 bp, Homo sapiens
gagcagagcttctcaaagtaaa

SEQ ID NO: 9489316 - DNA, 22 bp, Homo sapiens
gagcagagcttctcaaagtaaa

SEQ ID NO: 9489317 - DNA, 22 bp, Homo sapiens
gagcagagcttctcaaagtaaa

SEQ ID NO: 9489318 - DNA, 16 bp, Homo sapiens
gagcagagcggttcca

SEQ ID NO: 9489319 - DNA, 22 bp, Homo sapiens
gagagctgtaatagtcatgtct

SEQ ID NO: 9489320 - DNA, 22 bp, Homo sapiens
gagagccctcactccttccctg

SEQ ID NO: 9489321 - DNA, 22 bp, Homo sapiens
gagagctgtccggctgagcagc

SEQ ID NO: 9489322 - DNA, 22 bp, Homo sapiens
gagagctgtcagcgtagcaccg

SEQ ID NO: 9489323 - DNA, 22 bp, Homo sapiens
gagaggagacttatccagattg

SEQ ID NO: 9489324 - DNA, 18 bp, Homo sapiens
gagaggagccagaatttt

SEQ ID NO: 9489325 - DNA, 22 bp, Homo sapiens
gagaggagacttatccagattg

SEQ ID NO: 9489326 - DNA, 22 bp, Homo sapiens
gagaggagacttatccagattg

SEQ ID NO: 9489327 - DNA, 22 bp, Homo sapiens
gagaggagaagcctgcgcttca

SEQ ID NO: 9489328 - DNA, 22 bp, Homo sapiens
gagaggagaagcctgcgcttca

SEQ ID NO: 9489329 - DNA, 22 bp, Homo sapiens
gagaggagacttatccagattg

SEQ ID NO: 9489330 - DNA, 22 bp, Homo sapiens
gagaggagacttatccagattg

SEQ ID NO: 9489331 - DNA, 22 bp, Homo sapiens
gagaggagaagcctgcgcttca

SEQ ID NO: 9489332 - DNA, 22 bp, Homo sapiens
gagaggaggtggctatgacagc

SEQ ID NO: 9489333 - DNA, 18 bp, Homo sapiens
gagaggagccagaatttt

SEQ ID NO: 9489334 - DNA, 22 bp, Homo sapiens
gagaggagtagacactttggtt

SEQ ID NO: 9489335 - DNA, 22 bp, Homo sapiens
gagaggagtagacactttggtt

SEQ ID NO: 9489336 - DNA, 22 bp, Homo sapiens
gagaggaggtggctatgacagc

SEQ ID NO: 9489337 - DNA, 22 bp, Homo sapiens
gagaggaggtggctatgacagc

SEQ ID NO: 9489338 - DNA, 22 bp, Homo sapiens
gagaggaggtggctatgacagc

SEQ ID NO: 9489339 - DNA, 22 bp, Homo sapiens
gagaggagtccctatcacagtt

SEQ ID NO: 9489340 - DNA, 22 bp, Homo sapiens
gagaggagtaggctgatggtgc

SEQ ID NO: 9489341 - DNA, 22 bp, Homo sapiens
gagaggagtaggctgatggtgc

SEQ ID NO: 9489342 - DNA, 22 bp, Homo sapiens
gagaggagtaggctgatggtgc

SEQ ID NO: 9489343 - DNA, 22 bp, Homo sapiens
gagagccagcagtaaagacatt

SEQ ID NO: 9489344 - DNA, 22 bp, Homo sapiens
gagagccatggtggagatgggg

SEQ ID NO: 9489345 - DNA, 22 bp, Homo sapiens
gagagccatggtggagatgggg

SEQ ID NO: 9489346 - DNA, 22 bp, Homo sapiens
gagagcccaaaatttagcaaga

SEQ ID NO: 9489347 - DNA, 22 bp, Homo sapiens
gagagccctacaaggcgttttg

SEQ ID NO: 9489348 - DNA, 22 bp, Homo sapiens
gagagcaggaggcagcgggacg

SEQ ID NO: 9489349 - DNA, 22 bp, Homo sapiens
gagagcaggaggcagcgggacg

SEQ ID NO: 9489350 - DNA, 22 bp, Homo sapiens
gagagcaggaggcagcgggacg

SEQ ID NO: 9489351 - DNA, 22 bp, Homo sapiens
gagagccagcagtaaagacatt

SEQ ID NO: 9489352 - DNA, 22 bp, Homo sapiens
gagagcatgtggtctagtttta

SEQ ID NO: 9489353 - DNA, 22 bp, Homo sapiens
gagagacagcacacagtgtggg

SEQ ID NO: 9489354 - DNA, 22 bp, Homo sapiens
gagagacagcacacagtgtggg

SEQ ID NO: 9489355 - DNA, 22 bp, Homo sapiens
gagagacagcagaacgtgcagc

SEQ ID NO: 9489356 - DNA, 22 bp, Homo sapiens
gagagactgatgtggctatgta

SEQ ID NO: 9489357 - DNA, 22 bp, Homo sapiens
gagagacagcagaacgtgcagc

SEQ ID NO: 9489358 - DNA, 22 bp, Homo sapiens
gagagagaaaatgactccggac

SEQ ID NO: 9489359 - DNA, 22 bp, Homo sapiens
gagagagaaaatgactccggac

SEQ ID NO: 9489360 - DNA, 22 bp, Homo sapiens
gagagactgatgtggctatgta

SEQ ID NO: 9489361 - DNA, 22 bp, Homo sapiens
gagagactggaatgggctgtgg

SEQ ID NO: 9489362 - DNA, 22 bp, Homo sapiens
gagagactgggcagggccggca

SEQ ID NO: 9489363 - DNA, 22 bp, Homo sapiens
gagagagaaggcctgtgggtgt

SEQ ID NO: 9489364 - DNA, 22 bp, Homo sapiens
gagagagaaccccgtgcccttc

SEQ ID NO: 9489365 - DNA, 22 bp, Homo sapiens
gagagaccttgctaagtgcctt

SEQ ID NO: 9489366 - DNA, 22 bp, Homo sapiens
gagagagaaccccgtgcccttc

SEQ ID NO: 9489367 - DNA, 16 bp, Homo sapiens
gagaagagcccggcag

SEQ ID NO: 9489368 - DNA, 22 bp, Homo sapiens
gagaagaacttgggcaaagtca

SEQ ID NO: 9489369 - DNA, 22 bp, Homo sapiens
gagaagcaatcagcagccaccc

SEQ ID NO: 9489370 - DNA, 22 bp, Homo sapiens
gagaagcaatcagcagccaccc

SEQ ID NO: 9489371 - DNA, 16 bp, Homo sapiens
gagaagagcccggcag

SEQ ID NO: 9489372 - DNA, 16 bp, Homo sapiens
gagaagagcccggcag

SEQ ID NO: 9489373 - DNA, 22 bp, Homo sapiens
gagaagaaaattccgtgaacac

SEQ ID NO: 9489374 - DNA, 22 bp, Homo sapiens
gagaagaaatagaatcacattt

SEQ ID NO: 9489375 - DNA, 22 bp, Homo sapiens
gagaagaacttgggcaaagtca

SEQ ID NO: 9489376 - DNA, 22 bp, Homo sapiens
gagaagaaatagaatcacattt

SEQ ID NO: 9489377 - DNA, 22 bp, Homo sapiens
gagaactaatcatgcatggagt

SEQ ID NO: 9489378 - DNA, 22 bp, Homo sapiens
gagaacatgtttagtgacagtc

SEQ ID NO: 9489379 - DNA, 22 bp, Homo sapiens
gagaacattgggaaagctagac

SEQ ID NO: 9489380 - DNA, 22 bp, Homo sapiens
gagaactcagacgcaggtcatg

SEQ ID NO: 9489381 - DNA, 21 bp, Homo sapiens
gagaactgaaccagagcagct

SEQ ID NO: 9489382 - DNA, 21 bp, Homo sapiens
gagaactgaaccagagcagct

SEQ ID NO: 9489383 - DNA, 22 bp, Homo sapiens
gagaaagggaacttacagagtg

SEQ ID NO: 9489384 - DNA, 22 bp, Homo sapiens
gactccagagtgactatttgtc

SEQ ID NO: 9489385 - DNA, 22 bp, Homo sapiens
gagaaagggaacttacagagtg

SEQ ID NO: 9489386 - DNA, 22 bp, Homo sapiens
gagaaagggaacttacagagtg

SEQ ID NO: 9489387 - DNA, 22 bp, Homo sapiens
gagaaagggataatttgaagag

SEQ ID NO: 9489388 - DNA, 22 bp, Homo sapiens
gagaacaggctctggagtcaga

SEQ ID NO: 9489389 - DNA, 22 bp, Homo sapiens
gagaacaggctctggagtcaga

SEQ ID NO: 9489390 - DNA, 22 bp, Homo sapiens
gagaacaggctctggagtcaga

SEQ ID NO: 9489391 - DNA, 22 bp, Homo sapiens
gagaacaggctctggagtcaga

SEQ ID NO: 9489392 - DNA, 22 bp, Homo sapiens
gagaacagtgtcatcctataat

SEQ ID NO: 9489393 - DNA, 22 bp, Homo sapiens
gactcagagatccctggaggtc

SEQ ID NO: 9489394 - DNA, 22 bp, Homo sapiens
gactcagatttagagggtaaga

SEQ ID NO: 9489395 - DNA, 19 bp, Homo sapiens
gactccaactttaagcatg

SEQ ID NO: 9489396 - DNA, 19 bp, Homo sapiens
gactccaactttaagcatg

SEQ ID NO: 9489397 - DNA, 19 bp, Homo sapiens
gactccaactttaagcatg

SEQ ID NO: 9489398 - DNA, 22 bp, Homo sapiens
gactccagagtgactatttgtc

SEQ ID NO: 9489399 - DNA, 22 bp, Homo sapiens
gactccagaatctggacggtcc

SEQ ID NO: 9489400 - DNA, 22 bp, Homo sapiens
gagaagcaatttccaactgtgc

SEQ ID NO: 9489401 - DNA, 22 bp, Homo sapiens
gagaagcaggtttagcagacaa

SEQ ID NO: 9489402 - DNA, 22 bp, Homo sapiens
gagaagcaggtttagcagacaa

SEQ ID NO: 9489403 - DNA, 22 bp, Homo sapiens
gagaagcaggtttagcagacaa

SEQ ID NO: 9489404 - DNA, 22 bp, Homo sapiens
gagaagcaatcagcagccaccc

SEQ ID NO: 9489405 - DNA, 22 bp, Homo sapiens
gagaagcaatcagtggccaccc

SEQ ID NO: 9489406 - DNA, 22 bp, Homo sapiens
gagaagcaatcagtggccaccc

SEQ ID NO: 9489407 - DNA, 22 bp, Homo sapiens
gagaagcaatcagtggccaccc

SEQ ID NO: 9489408 - DNA, 22 bp, Homo sapiens
gagaagcaatcgtgacatctcc

SEQ ID NO: 9489409 - DNA, 22 bp, Homo sapiens
gagaagcaatcgtgacatctcc

SEQ ID NO: 9489410 - DNA, 22 bp, Homo sapiens
gagaagcaatcgtgacatctcc

SEQ ID NO: 9489411 - DNA, 22 bp, Homo sapiens
gagagaagggggatatgagcct

SEQ ID NO: 9489412 - DNA, 22 bp, Homo sapiens
gagagaatgtacatgctagggg

SEQ ID NO: 9489413 - DNA, 22 bp, Homo sapiens
gagagaagggggatatgagcct

SEQ ID NO: 9489414 - DNA, 22 bp, Homo sapiens
gagagaagggacttctacactt

SEQ ID NO: 9489415 - DNA, 22 bp, Homo sapiens
gagagaagggacttctacactt

SEQ ID NO: 9489416 - DNA, 22 bp, Homo sapiens
gagagaagaatgttccgaggcc

SEQ ID NO: 9489417 - DNA, 22 bp, Homo sapiens
gagagaagaatgttccgaggcc

SEQ ID NO: 9489418 - DNA, 22 bp, Homo sapiens
gagagaagaaagccatggtcct

SEQ ID NO: 9489419 - DNA, 22 bp, Homo sapiens
gagagaagaaagccatggtcct

SEQ ID NO: 9489420 - DNA, 22 bp, Homo sapiens
gagaagctggactttccaaact

SEQ ID NO: 9489421 - DNA, 22 bp, Homo sapiens
gaaatacagaaagggctgaatg

SEQ ID NO: 9489422 - DNA, 22 bp, Homo sapiens
gaaagagaacctgggcctagat

SEQ ID NO: 9489423 - DNA, 22 bp, Homo sapiens
gaaatacaggaatgccacacag

SEQ ID NO: 9489424 - DNA, 22 bp, Homo sapiens
gaaatatacattgcaggaagag

SEQ ID NO: 9489425 - DNA, 22 bp, Homo sapiens
gaaatatacattgcaggaagag

SEQ ID NO: 9489426 - DNA, 22 bp, Homo sapiens
gaaagacatagttgcaagatgg

SEQ ID NO: 9489427 - DNA, 22 bp, Homo sapiens
gaaagagaacctgggcctagat

SEQ ID NO: 9489428 - DNA, 22 bp, Homo sapiens
gaaagacatagttgcaagatgg

SEQ ID NO: 9489429 - DNA, 22 bp, Homo sapiens
gaaagacatagttgcaagatgg

SEQ ID NO: 9489430 - DNA, 22 bp, Homo sapiens
gaaatattacagtggaggggat

SEQ ID NO: 9489431 - DNA, 22 bp, Homo sapiens
gaaatattacagtggaggggat

SEQ ID NO: 9489432 - DNA, 22 bp, Homo sapiens
gaaatattacagtggaggggat

SEQ ID NO: 9489433 - DNA, 22 bp, Homo sapiens
gaaatattacagtggaggggat

SEQ ID NO: 9489434 - DNA, 22 bp, Homo sapiens
gaaatattacagtggaggggat

SEQ ID NO: 9489435 - DNA, 22 bp, Homo sapiens
gaaatattacagtggaggggat

SEQ ID NO: 9489436 - DNA, 22 bp, Homo sapiens
gaaatatacattgcaggaagag

SEQ ID NO: 9489437 - DNA, 22 bp, Homo sapiens
gaaatatacattgcaggaagag

SEQ ID NO: 9489438 - DNA, 22 bp, Homo sapiens
gaaatattcttgtcttgttttc

SEQ ID NO: 9489439 - DNA, 22 bp, Homo sapiens
gaaatattcttgtcttgttttc

SEQ ID NO: 9489440 - DNA, 22 bp, Homo sapiens
gaaatattcttgtcttgttttc

SEQ ID NO: 9489441 - DNA, 22 bp, Homo sapiens
gaaatattcttgtcttgttttc

SEQ ID NO: 9489442 - DNA, 22 bp, Homo sapiens
gaaatattcttgtcttgttttc

SEQ ID NO: 9489443 - DNA, 22 bp, Homo sapiens
gaaatattcttgtcttgttttc

SEQ ID NO: 9489444 - DNA, 22 bp, Homo sapiens
gaaatattcttgtcttgttttc

SEQ ID NO: 9489445 - DNA, 22 bp, Homo sapiens
gaaatattgtactggagatgtt

SEQ ID NO: 9489446 - DNA, 22 bp, Homo sapiens
gaaatattgtactggagatgtt

SEQ ID NO: 9489447 - DNA, 22 bp, Homo sapiens
gaaatattgtactggagatgtt

SEQ ID NO: 9489448 - DNA, 22 bp, Homo sapiens
gaaatattgggactcagagctt

SEQ ID NO: 9489449 - DNA, 22 bp, Homo sapiens
gaaatattgggactcagagctt

SEQ ID NO: 9489450 - DNA, 22 bp, Homo sapiens
gaaatattgggactcagagctt

SEQ ID NO: 9489451 - DNA, 22 bp, Homo sapiens
gaaatattgggactcagagctt

SEQ ID NO: 9489452 - DNA, 22 bp, Homo sapiens
gaaatattgggactcagagctt

SEQ ID NO: 9489453 - DNA, 22 bp, Homo sapiens
gaaatattgggactcagagctt

SEQ ID NO: 9489454 - DNA, 22 bp, Homo sapiens
gaaatattgtactggagatgtt

SEQ ID NO: 9489455 - DNA, 22 bp, Homo sapiens
gaaatattgtactggagatgtt

SEQ ID NO: 9489456 - DNA, 22 bp, Homo sapiens
gaaatattgtactggagatgtt

SEQ ID NO: 9489457 - DNA, 22 bp, Homo sapiens
gaaatattgtactggagatgtt

SEQ ID NO: 9489458 - DNA, 22 bp, Homo sapiens
gaaatgtagagtatctgaggat

SEQ ID NO: 9489459 - DNA, 22 bp, Homo sapiens
gaaatgtagagtatctgaggat

SEQ ID NO: 9489460 - DNA, 22 bp, Homo sapiens
gaaatgtaggcataattatttt

SEQ ID NO: 9489461 - DNA, 22 bp, Homo sapiens
gaaatgtaggcataattatttt

SEQ ID NO: 9489462 - DNA, 22 bp, Homo sapiens
gaaatgtagaattgcttaactg

SEQ ID NO: 9489463 - DNA, 22 bp, Homo sapiens
gaaatgtagaattgcttaactg

SEQ ID NO: 9489464 - DNA, 22 bp, Homo sapiens
gaaatgtagaattgcttaactg

SEQ ID NO: 9489465 - DNA, 22 bp, Homo sapiens
gaaatgtatttgacagtccttg

SEQ ID NO: 9489466 - DNA, 22 bp, Homo sapiens
gaaatgtatttgacagtccttg

SEQ ID NO: 9489467 - DNA, 22 bp, Homo sapiens
gaaatgtatttgacagtccttg

SEQ ID NO: 9489468 - DNA, 22 bp, Homo sapiens
gaaatgtatgtcttcccccatt

SEQ ID NO: 9489469 - DNA, 22 bp, Homo sapiens
gaaatgtatgtcttcccccatt

SEQ ID NO: 9489470 - DNA, 20 bp, Homo sapiens
gaaatgtatctcttgattct

SEQ ID NO: 9489471 - DNA, 22 bp, Homo sapiens
gaaatgtataagctggtctttt

SEQ ID NO: 9489472 - DNA, 22 bp, Homo sapiens
gaaatgtataagctggtctttt

SEQ ID NO: 9489473 - DNA, 22 bp, Homo sapiens
gaaatgtaggcataattatttt

SEQ ID NO: 9489474 - DNA, 22 bp, Homo sapiens
gaaatgtaggcataattatttt

SEQ ID NO: 9489475 - DNA, 20 bp, Homo sapiens
gaaatgtatctcttgattct

SEQ ID NO: 9489476 - DNA, 20 bp, Homo sapiens
gaaatgtatctcttgattct

SEQ ID NO: 9489477 - DNA, 22 bp, Homo sapiens
gaaatgtcattgccttcagccc

SEQ ID NO: 9489478 - DNA, 20 bp, Homo sapiens
gaaatgtgacctcttctgtg

SEQ ID NO: 9489479 - DNA, 18 bp, Homo sapiens
gaaatgtgattctagggc

SEQ ID NO: 9489480 - DNA, 22 bp, Homo sapiens
gaaatgtgcagaatgtgttaga

SEQ ID NO: 9489481 - DNA, 22 bp, Homo sapiens
gaaatgtgtgacaagtttcaat

SEQ ID NO: 9489482 - DNA, 22 bp, Homo sapiens
gaagaagagataatggggagca

SEQ ID NO: 9489483 - DNA, 22 bp, Homo sapiens
gaagaagcaggagtgtgtagca

SEQ ID NO: 9489484 - DNA, 22 bp, Homo sapiens
gaagaagacatggaacaatagt

SEQ ID NO: 9489485 - DNA, 22 bp, Homo sapiens
gaagaagacatggaacaatagt

SEQ ID NO: 9489486 - DNA, 22 bp, Homo sapiens
gaagaactttagggcagaattt

SEQ ID NO: 9489487 - DNA, 22 bp, Homo sapiens
gaagaactgtgacagaagcagt

SEQ ID NO: 9489488 - DNA, 22 bp, Homo sapiens
gaagaactgacaaactagatca

SEQ ID NO: 9489489 - DNA, 22 bp, Homo sapiens
gaagaactgtgacagaagcagt

SEQ ID NO: 9489490 - DNA, 19 bp, Homo sapiens
gaagaagcttgagaagtag

SEQ ID NO: 9489491 - DNA, 22 bp, Homo sapiens
gaagaagcctctgtggatctga

SEQ ID NO: 9489492 - DNA, 22 bp, Homo sapiens
gaagaagcattctgctgttttg

SEQ ID NO: 9489493 - DNA, 19 bp, Homo sapiens
gaagaagcttgagaagtag

SEQ ID NO: 9489494 - DNA, 22 bp, Homo sapiens
gaagaagggagtgacaaatgca

SEQ ID NO: 9489495 - DNA, 17 bp, Homo sapiens
gaagaaggaatctagaa

SEQ ID NO: 9489496 - DNA, 22 bp, Homo sapiens
gaagaagggagtgacaaatgca

SEQ ID NO: 9489497 - DNA, 22 bp, Homo sapiens
gaagaaggaagatcatgcttga

SEQ ID NO: 9489498 - DNA, 17 bp, Homo sapiens
gaagaaggaatctagaa

SEQ ID NO: 9489499 - DNA, 22 bp, Homo sapiens
gaacttcagaatcagcatatct

SEQ ID NO: 9489500 - DNA, 22 bp, Homo sapiens
gaacttcagaatcagcatatct

SEQ ID NO: 9489501 - DNA, 22 bp, Homo sapiens
gaacttcacgatagccaaagct

SEQ ID NO: 9489502 - DNA, 22 bp, Homo sapiens
gaacttcacgatagccaaagct

SEQ ID NO: 9489503 - DNA, 20 bp, Homo sapiens
gaacttgggcaagtggctta

SEQ ID NO: 9489504 - DNA, 22 bp, Homo sapiens
gaacttgggagaagggagtgtg

SEQ ID NO: 9489505 - DNA, 22 bp, Homo sapiens
gaagaaatgtgttcaaggtagg

SEQ ID NO: 9489506 - DNA, 22 bp, Homo sapiens
gaagaacacttcatgattcatt

SEQ ID NO: 9489507 - DNA, 22 bp, Homo sapiens
gaagaactgacaaactagatca

SEQ ID NO: 9489508 - DNA, 22 bp, Homo sapiens
gaagaactgacaaactagatca

SEQ ID NO: 9489509 - DNA, 22 bp, Homo sapiens
gaagaactaactgaccatgaat

SEQ ID NO: 9489510 - DNA, 22 bp, Homo sapiens
gaagaaattgaattcatgagct

SEQ ID NO: 9489511 - DNA, 22 bp, Homo sapiens
gaagaaattgaattcatgagct

SEQ ID NO: 9489512 - DNA, 22 bp, Homo sapiens
gaagaaattgaattcatgagct

SEQ ID NO: 9489513 - DNA, 22 bp, Homo sapiens
gaagaacaagcagtgctttcct

SEQ ID NO: 9489514 - DNA, 22 bp, Homo sapiens
gaagaacacctgctgcccagtg

SEQ ID NO: 9489515 - DNA, 22 bp, Homo sapiens
gaaattcactgtatttcttggg

SEQ ID NO: 9489516 - DNA, 22 bp, Homo sapiens
gaaattcaggacaaagactctt

SEQ ID NO: 9489517 - DNA, 22 bp, Homo sapiens
gaaattcaggacaaagactctt

SEQ ID NO: 9489518 - DNA, 22 bp, Homo sapiens
gaaattgaaaccgatctgtgtt

SEQ ID NO: 9489519 - DNA, 22 bp, Homo sapiens
gaaattgaaagaccaactgcat

SEQ ID NO: 9489520 - DNA, 22 bp, Homo sapiens
gaaattgccagatctagtagat

SEQ ID NO: 9489521 - DNA, 22 bp, Homo sapiens
gaaattcaaataagatatgtag

SEQ ID NO: 9489522 - DNA, 22 bp, Homo sapiens
gaaattcaaataagatatgtag

SEQ ID NO: 9489523 - DNA, 22 bp, Homo sapiens
gaaattcactgtatttcttggg

SEQ ID NO: 9489524 - DNA, 22 bp, Homo sapiens
gaaattaagcaggggtctgtgg

SEQ ID NO: 9489525 - DNA, 22 bp, Homo sapiens
gaaattaagcaggggtctgtgg

SEQ ID NO: 9489526 - DNA, 22 bp, Homo sapiens
gaaattcaaaatgtcagtatag

SEQ ID NO: 9489527 - DNA, 22 bp, Homo sapiens
gaaattcaaaatgtcagtatag

SEQ ID NO: 9489528 - DNA, 22 bp, Homo sapiens
gaaattcaaaatgtcagtatag

SEQ ID NO: 9489529 - DNA, 22 bp, Homo sapiens
gaaattattgctagagactgca

SEQ ID NO: 9489530 - DNA, 22 bp, Homo sapiens
gaaattattgctagagactgca

SEQ ID NO: 9489531 - DNA, 22 bp, Homo sapiens
gaaatgttgtctctgcagcaat

SEQ ID NO: 9489532 - DNA, 22 bp, Homo sapiens
gaaatgtgttgttcatttctaa

SEQ ID NO: 9489533 - DNA, 22 bp, Homo sapiens
gaaatgtgttgttcatttctaa

SEQ ID NO: 9489534 - DNA, 22 bp, Homo sapiens
gaaattaagcaggggtctgtgg

SEQ ID NO: 9489535 - DNA, 22 bp, Homo sapiens
gaaattaaccacctttggcttt

SEQ ID NO: 9489536 - DNA, 22 bp, Homo sapiens
gaaattaaccacctttggcttt

SEQ ID NO: 9489537 - DNA, 22 bp, Homo sapiens
ctttttcctcgtagagcctaat

SEQ ID NO: 9489538 - DNA, 22 bp, Homo sapiens
ctttttcctcgtagagcctaat

SEQ ID NO: 9489539 - DNA, 22 bp, Homo sapiens
ctttttcctcgtagagcctaat

SEQ ID NO: 9489540 - DNA, 22 bp, Homo sapiens
ctttttctaatcataattgtct

SEQ ID NO: 9489541 - DNA, 22 bp, Homo sapiens
ctttttcctcgtagagcctaat

SEQ ID NO: 9489542 - DNA, 22 bp, Homo sapiens
ctttttctaatcataattgtct

SEQ ID NO: 9489543 - DNA, 22 bp, Homo sapiens
ctttttctaatcataattgtct

SEQ ID NO: 9489544 - DNA, 20 bp, Homo sapiens
ctttttctccagctctgagc

SEQ ID NO: 9489545 - DNA, 20 bp, Homo sapiens
ctttttctccagctctgagc

SEQ ID NO: 9489546 - DNA, 20 bp, Homo sapiens
ctttttctccagctctgagc

SEQ ID NO: 9489547 - DNA, 16 bp, Homo sapiens
ctttttctcccctctt

SEQ ID NO: 9489548 - DNA, 16 bp, Homo sapiens
ctttttctcccctctt

SEQ ID NO: 9489549 - DNA, 16 bp, Homo sapiens
ctttttctcccctctt

SEQ ID NO: 9489550 - DNA, 22 bp, Homo sapiens
ctttttctgatgttccatgatt

SEQ ID NO: 9489551 - DNA, 22 bp, Homo sapiens
ctttttctgatgttccatgatt

SEQ ID NO: 9489552 - DNA, 22 bp, Homo sapiens
ctttttctgatgttccatgatt

SEQ ID NO: 9489553 - DNA, 22 bp, Homo sapiens
ctttttcttctaggtgtgcctg

SEQ ID NO: 9489554 - DNA, 22 bp, Homo sapiens
ctttttcttctaggtgtgcctg

SEQ ID NO: 9489555 - DNA, 22 bp, Homo sapiens
ctttttctgatgttccatgatt

SEQ ID NO: 9489556 - DNA, 22 bp, Homo sapiens
ctttttcttctaggtgtgcctg

SEQ ID NO: 9489557 - DNA, 22 bp, Homo sapiens
ctttttgtctctgtcctgatga

SEQ ID NO: 9489558 - DNA, 22 bp, Homo sapiens
ctttggcactgcgcagccattt

SEQ ID NO: 9489559 - DNA, 20 bp, Homo sapiens
ctttggcaatgagaacaggg

SEQ ID NO: 9489560 - DNA, 22 bp, Homo sapiens
cttttgcagccattattgctgc

SEQ ID NO: 9489561 - DNA, 22 bp, Homo sapiens
cttttgcagccattattgctgc

SEQ ID NO: 9489562 - DNA, 22 bp, Homo sapiens
ctttttcccaggtggagagagg

SEQ ID NO: 9489563 - DNA, 22 bp, Homo sapiens
ctttttcccaggtggagagagg

SEQ ID NO: 9489564 - DNA, 22 bp, Homo sapiens
ctttttcccaggtggagagagg

SEQ ID NO: 9489565 - DNA, 22 bp, Homo sapiens
cttttgttctacagctggggaa

SEQ ID NO: 9489566 - DNA, 22 bp, Homo sapiens
cttttgttaggagaaaacatca

SEQ ID NO: 9489567 - DNA, 22 bp, Homo sapiens
ctttggcaatgaaacacaagaa

SEQ ID NO: 9489568 - DNA, 22 bp, Homo sapiens
ctttggcaatgaaacacaagaa

SEQ ID NO: 9489569 - DNA, 22 bp, Homo sapiens
ctttggcaacacatgtgggaca

SEQ ID NO: 9489570 - DNA, 22 bp, Homo sapiens
ctttggatttttatcaggcaat

SEQ ID NO: 9489571 - DNA, 22 bp, Homo sapiens
ctttggaggtcatagccaagag

SEQ ID NO: 9489572 - DNA, 22 bp, Homo sapiens
ctttggaggtcatagccaagag

SEQ ID NO: 9489573 - DNA, 22 bp, Homo sapiens
ctttggatgactggtgcaggtt

SEQ ID NO: 9489574 - DNA, 22 bp, Homo sapiens
ctttggaatgcacagaggtgta

SEQ ID NO: 9489575 - DNA, 22 bp, Homo sapiens
ctttggaatgcacagaggtgta

SEQ ID NO: 9489576 - DNA, 22 bp, Homo sapiens
ctttggaatcattgcttattca

SEQ ID NO: 9489577 - DNA, 20 bp, Homo sapiens
ctttggagaaagatgcaata

SEQ ID NO: 9489578 - DNA, 22 bp, Homo sapiens
ctttggaggacctatgtgcaat

SEQ ID NO: 9489579 - DNA, 22 bp, Homo sapiens
ctttggaatattttattgagaa

SEQ ID NO: 9489580 - DNA, 22 bp, Homo sapiens
ctttggaataatttcctggagt

SEQ ID NO: 9489581 - DNA, 22 bp, Homo sapiens
ctttggaataatcaagctctga

SEQ ID NO: 9489582 - DNA, 22 bp, Homo sapiens
ctttggaagtaaagtcagcagg

SEQ ID NO: 9489583 - DNA, 22 bp, Homo sapiens
ctttggaacatactgctgagct

SEQ ID NO: 9489584 - DNA, 22 bp, Homo sapiens
ctttggaagccaggcagttcac

SEQ ID NO: 9489585 - DNA, 22 bp, Homo sapiens
ctttggaactgtaaggagatgg

SEQ ID NO: 9489586 - DNA, 22 bp, Homo sapiens
ctttggaactgtaaggagatgg

SEQ ID NO: 9489587 - DNA, 22 bp, Homo sapiens
ctttggaaggaacaggattctc

SEQ ID NO: 9489588 - DNA, 22 bp, Homo sapiens
ctttggaaggaacaggattctc

SEQ ID NO: 9489589 - DNA, 22 bp, Homo sapiens
ctttggaaggcagagctctgtg

SEQ ID NO: 9489590 - DNA, 22 bp, Homo sapiens
gaaactgtgaggatcttaactt

SEQ ID NO: 9489591 - DNA, 22 bp, Homo sapiens
gaaacttcttgtctcacagttc

SEQ ID NO: 9489592 - DNA, 22 bp, Homo sapiens
gaaacttacttactcacatttc

SEQ ID NO: 9489593 - DNA, 22 bp, Homo sapiens
gaaacttcttgtctcacagttc

SEQ ID NO: 9489594 - DNA, 22 bp, Homo sapiens
gaaactgtttctggctttggtg

SEQ ID NO: 9489595 - DNA, 22 bp, Homo sapiens
gaaactttcatgaatataagat

SEQ ID NO: 9489596 - DNA, 22 bp, Homo sapiens
gaaacttgcctgaagtcaacca

SEQ ID NO: 9489597 - DNA, 22 bp, Homo sapiens
gaaactttggctaaaagccaga

SEQ ID NO: 9489598 - DNA, 22 bp, Homo sapiens
gaaactttggctaaaagccaga

SEQ ID NO: 9489599 - DNA, 22 bp, Homo sapiens
gaaactttcatgaatataagat

SEQ ID NO: 9489600 - DNA, 22 bp, Homo sapiens
gaaacttttaaacctcatgagt

SEQ ID NO: 9489601 - DNA, 22 bp, Homo sapiens
gaaactgagtaggctagagcac

SEQ ID NO: 9489602 - DNA, 22 bp, Homo sapiens
gaaactgagtaggctagagcac

SEQ ID NO: 9489603 - DNA, 22 bp, Homo sapiens
gaaactgaatataagaaaggta

SEQ ID NO: 9489604 - DNA, 22 bp, Homo sapiens
gaaactctcgcatcctgggaac

SEQ ID NO: 9489605 - DNA, 22 bp, Homo sapiens
gaaacgttgtggaaaatcctct

SEQ ID NO: 9489606 - DNA, 22 bp, Homo sapiens
gaaacccaaactaagacagtag

SEQ ID NO: 9489607 - DNA, 22 bp, Homo sapiens
gaaaccctgagaggtggtctgg

SEQ ID NO: 9489608 - DNA, 22 bp, Homo sapiens
gaaaccagctagaggcagaggg

SEQ ID NO: 9489609 - DNA, 21 bp, Homo sapiens
gaaaccaggttatcaatcaca

SEQ ID NO: 9489610 - DNA, 22 bp, Homo sapiens
gaaaccagtttgtaccaagatc

SEQ ID NO: 9489611 - DNA, 22 bp, Homo sapiens
gaaacgttaaaccatatgtaat

SEQ ID NO: 9489612 - DNA, 22 bp, Homo sapiens
gaaacgttggcataagtttatg

SEQ ID NO: 9489613 - DNA, 22 bp, Homo sapiens
cttttttcctaaggcaacatga

SEQ ID NO: 9489614 - DNA, 22 bp, Homo sapiens
gaaaaaggataaatacagtgtt

SEQ ID NO: 9489615 - DNA, 22 bp, Homo sapiens
gaaaaaggataaatacagtgtt

SEQ ID NO: 9489616 - DNA, 22 bp, Homo sapiens
cttttttcctaaggcaacatga

SEQ ID NO: 9489617 - DNA, 22 bp, Homo sapiens
cttttttcctaaggcaacatga

SEQ ID NO: 9489618 - DNA, 22 bp, Homo sapiens
cttttttcctaaggcaacatga

SEQ ID NO: 9489619 - DNA, 22 bp, Homo sapiens
cttttttcctaaggcaacatga

SEQ ID NO: 9489620 - DNA, 22 bp, Homo sapiens
gaaaaatgagctgatgtcaggg

SEQ ID NO: 9489621 - DNA, 22 bp, Homo sapiens
gaaaaagtgaccttggtagcta

SEQ ID NO: 9489622 - DNA, 22 bp, Homo sapiens
gaaaaagtgaccttggtagcta

SEQ ID NO: 9489623 - DNA, 22 bp, Homo sapiens
gaaaaagtgaccttggtagcta

SEQ ID NO: 9489624 - DNA, 22 bp, Homo sapiens
gaaaaaggataaatacagtgtt

SEQ ID NO: 9489625 - DNA, 22 bp, Homo sapiens
gaaaaaggataaatacagtgtt

SEQ ID NO: 9489626 - DNA, 22 bp, Homo sapiens
cttttttcctaaggcaacatga

SEQ ID NO: 9489627 - DNA, 22 bp, Homo sapiens
ctttttgttgtccacactagga

SEQ ID NO: 9489628 - DNA, 22 bp, Homo sapiens
cttttttaaggtagctcctcct

SEQ ID NO: 9489629 - DNA, 22 bp, Homo sapiens
ctttttgtctctgtcctgatga

SEQ ID NO: 9489630 - DNA, 22 bp, Homo sapiens
gaaaaatgctccaaatctgtgg

SEQ ID NO: 9489631 - DNA, 22 bp, Homo sapiens
gaaacagcccctgtgtgaagca

SEQ ID NO: 9489632 - DNA, 22 bp, Homo sapiens
gaaacagcacgtttggagagat

SEQ ID NO: 9489633 - DNA, 22 bp, Homo sapiens
gaaacagctagaaagccattgg

SEQ ID NO: 9489634 - DNA, 22 bp, Homo sapiens
gaaacagctttaagtgatactg

SEQ ID NO: 9489635 - DNA, 22 bp, Homo sapiens
gaaaccagataagggaggctga

SEQ ID NO: 9489636 - DNA, 22 bp, Homo sapiens
gaaaccagctagaggcagaggg

SEQ ID NO: 9489637 - DNA, 22 bp, Homo sapiens
gaaaccagcatttaaaccagga

SEQ ID NO: 9489638 - DNA, 22 bp, Homo sapiens
gaaaaatgctccaaatctgtgg

SEQ ID NO: 9489639 - DNA, 22 bp, Homo sapiens
gaaaaatgctccaaatctgtgg

SEQ ID NO: 9489640 - DNA, 22 bp, Homo sapiens
gaaaaatgagctgatgtcaggg

SEQ ID NO: 9489641 - DNA, 22 bp, Homo sapiens
gaaaaatgagctgatgtcaggg

SEQ ID NO: 9489642 - DNA, 22 bp, Homo sapiens
gaaaaatgagctgatgtcaggg

SEQ ID NO: 9489643 - DNA, 22 bp, Homo sapiens
cttccctttctggtgacttctc

SEQ ID NO: 9489644 - DNA, 22 bp, Homo sapiens
cttccctttagcatatagtagt

SEQ ID NO: 9489645 - DNA, 22 bp, Homo sapiens
cttctgtagccagtaacatata

SEQ ID NO: 9489646 - DNA, 22 bp, Homo sapiens
cttctgtagccagtaacatata

SEQ ID NO: 9489647 - DNA, 22 bp, Homo sapiens
cttcccttctgcagatctttgg

SEQ ID NO: 9489648 - DNA, 22 bp, Homo sapiens
cttcccttggtgaacagagcat

SEQ ID NO: 9489649 - DNA, 20 bp, Homo sapiens
cttcttcagtagtttgttct

SEQ ID NO: 9489650 - DNA, 22 bp, Homo sapiens
cttcttcatctgtaaaacttgg

SEQ ID NO: 9489651 - DNA, 22 bp, Homo sapiens
cttcttcatctgtaaaacttgg

SEQ ID NO: 9489652 - DNA, 22 bp, Homo sapiens
cttcttcataggcagtcctgtt

SEQ ID NO: 9489653 - DNA, 22 bp, Homo sapiens
cttcttcaatagcaagcgcata

SEQ ID NO: 9489654 - DNA, 22 bp, Homo sapiens
cttcttcaatagcaagcgcata

SEQ ID NO: 9489655 - DNA, 22 bp, Homo sapiens
cttcttcagaggccagcctctg

SEQ ID NO: 9489656 - DNA, 20 bp, Homo sapiens
cttcttcagcctatgcttca

SEQ ID NO: 9489657 - DNA, 22 bp, Homo sapiens
cttcccttcctggggcaattta

SEQ ID NO: 9489658 - DNA, 22 bp, Homo sapiens
cttccctggtgttagcccaatg

SEQ ID NO: 9489659 - DNA, 22 bp, Homo sapiens
cttccctgataagagcctcaga

SEQ ID NO: 9489660 - DNA, 22 bp, Homo sapiens
cttccctctgctccttggtcca

SEQ ID NO: 9489661 - DNA, 22 bp, Homo sapiens
cttccctctgctccttggtcca

SEQ ID NO: 9489662 - DNA, 19 bp, Homo sapiens
cttcccctgttacctcact

SEQ ID NO: 9489663 - DNA, 19 bp, Homo sapiens
cttcccctgttacctcact

SEQ ID NO: 9489664 - DNA, 22 bp, Homo sapiens
cttcccccaaatcaagagacct

SEQ ID NO: 9489665 - DNA, 19 bp, Homo sapiens
cttcccctgttacctcact

SEQ ID NO: 9489666 - DNA, 21 bp, Homo sapiens
cttccccaggctggtctgtat

SEQ ID NO: 9489667 - DNA, 22 bp, Homo sapiens
cttcccatataactaatttctg

SEQ ID NO: 9489668 - DNA, 22 bp, Homo sapiens
cttcccaggtgctcttagcatg

SEQ ID NO: 9489669 - DNA, 22 bp, Homo sapiens
cttcccagttctgcttgagggg

SEQ ID NO: 9489670 - DNA, 22 bp, Homo sapiens
cttcccagacggggtggcagcc

SEQ ID NO: 9489671 - DNA, 22 bp, Homo sapiens
cttcccagacggggtggcagcc

SEQ ID NO: 9489672 - DNA, 22 bp, Homo sapiens
cttcccagcacctcagtctggc

SEQ ID NO: 9489673 - DNA, 22 bp, Homo sapiens
cttcccagaacaatgtaggctt

SEQ ID NO: 9489674 - DNA, 22 bp, Homo sapiens
cttccaggtccttcttgagaag

SEQ ID NO: 9489675 - DNA, 22 bp, Homo sapiens
cttcccagaccttagagtgcag

SEQ ID NO: 9489676 - DNA, 22 bp, Homo sapiens
ctgttaaagatagttaagcttc

SEQ ID NO: 9489677 - DNA, 22 bp, Homo sapiens
ctgttaaaatgtggtcttaaaa

SEQ ID NO: 9489678 - DNA, 22 bp, Homo sapiens
ctgttaaaatgtggtcttaaaa

SEQ ID NO: 9489679 - DNA, 20 bp, Homo sapiens
ctgttaaaaggtatgaattc

SEQ ID NO: 9489680 - DNA, 20 bp, Homo sapiens
ctgttaaaaggtatgaattc

SEQ ID NO: 9489681 - DNA, 22 bp, Homo sapiens
ctgttaaaaagaccaatggatt

SEQ ID NO: 9489682 - DNA, 22 bp, Homo sapiens
ctgttaaatgagaaagcagact

SEQ ID NO: 9489683 - DNA, 23 bp, Homo sapiens
ctgttaaattccttaagagcagg

SEQ ID NO: 9489684 - DNA, 22 bp, Homo sapiens
cttcaaagattattgaaaacaa

SEQ ID NO: 9489685 - DNA, 22 bp, Homo sapiens
cttcaaagggtcactatttatc

SEQ ID NO: 9489686 - DNA, 22 bp, Homo sapiens
cttcaaatacaagtagattatg

SEQ ID NO: 9489687 - DNA, 22 bp, Homo sapiens
cttcaaatccccctgagtttga

SEQ ID NO: 9489688 - DNA, 22 bp, Homo sapiens
cttcaaatacaagtagattatg

SEQ ID NO: 9489689 - DNA, 16 bp, Homo sapiens
cttcacagaggagagt

SEQ ID NO: 9489690 - DNA, 22 bp, Homo sapiens
cttcacagatgctgagagggct

SEQ ID NO: 9489691 - DNA, 22 bp, Homo sapiens
cttcacagcatgagctttggag

SEQ ID NO: 9489692 - DNA, 22 bp, Homo sapiens
cttcacagcatgagctttggag

SEQ ID NO: 9489693 - DNA, 22 bp, Homo sapiens
cttcacagatgctgagagggct

SEQ ID NO: 9489694 - DNA, 22 bp, Homo sapiens
cttcacagccaacatgggcaca

SEQ ID NO: 9489695 - DNA, 22 bp, Homo sapiens
cttcacagtataggtccctgag

SEQ ID NO: 9489696 - DNA, 22 bp, Homo sapiens
cttcacagtcaccctgctgtgt

SEQ ID NO: 9489697 - DNA, 22 bp, Homo sapiens
cttcacagtaaatccagaagaa

SEQ ID NO: 9489698 - DNA, 23 bp, Homo sapiens
cttcacaggttcaggggattaag

SEQ ID NO: 9489699 - DNA, 22 bp, Homo sapiens
cttcacagccaacatgggcaca

SEQ ID NO: 9489700 - DNA, 22 bp, Homo sapiens
cttcacaggcaagtctgttttt

SEQ ID NO: 9489701 - DNA, 22 bp, Homo sapiens
cttcactgggctcctgagaggg

SEQ ID NO: 9489702 - DNA, 22 bp, Homo sapiens
cttcactgtgcttcaagcagct

SEQ ID NO: 9489703 - DNA, 22 bp, Homo sapiens
cttcactgtgcttcaagcagct

SEQ ID NO: 9489704 - DNA, 22 bp, Homo sapiens
cttcactttaagccaatcatga

SEQ ID NO: 9489705 - DNA, 22 bp, Homo sapiens
cttcacttgctcatcatgctat

SEQ ID NO: 9489706 - DNA, 22 bp, Homo sapiens
cttccaggacaccagggtagta

SEQ ID NO: 9489707 - DNA, 22 bp, Homo sapiens
cttccagggtccaggaagagcc

SEQ ID NO: 9489708 - DNA, 22 bp, Homo sapiens
cttcagaaccagccagaagagg

SEQ ID NO: 9489709 - DNA, 22 bp, Homo sapiens
cttccaggacaccagggtagta

SEQ ID NO: 9489710 - DNA, 22 bp, Homo sapiens
cttcagaaataacaacaattac

SEQ ID NO: 9489711 - DNA, 22 bp, Homo sapiens
cttcacctcctcctctgtgggc

SEQ ID NO: 9489712 - DNA, 22 bp, Homo sapiens
cttcacctgtacgctggagcta

SEQ ID NO: 9489713 - DNA, 22 bp, Homo sapiens
cttcactgcagtcatggctctg

SEQ ID NO: 9489714 - DNA, 22 bp, Homo sapiens
cttcactgagtagtctagactc

SEQ ID NO: 9489715 - DNA, 22 bp, Homo sapiens
cttcactgatgggacagctcaa

SEQ ID NO: 9489716 - DNA, 22 bp, Homo sapiens
cttcacattgggcttgatatga

SEQ ID NO: 9489717 - DNA, 22 bp, Homo sapiens
cttcacattgggcttgatatga

SEQ ID NO: 9489718 - DNA, 22 bp, Homo sapiens
cttcacatttgcgaaggccaaa

SEQ ID NO: 9489719 - DNA, 22 bp, Homo sapiens
cttcacatttgcgaaggccaaa

SEQ ID NO: 9489720 - DNA, 22 bp, Homo sapiens
cttcacattagtttggatcaaa

SEQ ID NO: 9489721 - DNA, 22 bp, Homo sapiens
cttcacattagtttggatcaaa

SEQ ID NO: 9489722 - DNA, 22 bp, Homo sapiens
cttcacattgggcttgatatga

SEQ ID NO: 9489723 - DNA, 22 bp, Homo sapiens
cttcacagtctttatttcctcc

SEQ ID NO: 9489724 - DNA, 22 bp, Homo sapiens
cttcacataaacaaagggccat

SEQ ID NO: 9489725 - DNA, 22 bp, Homo sapiens
cttcacataaacaaagggccat

SEQ ID NO: 9489726 - DNA, 22 bp, Homo sapiens
cttcacatctccctaaaacagc

SEQ ID NO: 9489727 - DNA, 22 bp, Homo sapiens
cttcacatctccctaaaacagc

SEQ ID NO: 9489728 - DNA, 19 bp, Homo sapiens
cttcacatctgtgagggga

SEQ ID NO: 9489729 - DNA, 22 bp, Homo sapiens
cttcacatgggtactgctgatc

SEQ ID NO: 9489730 - DNA, 22 bp, Homo sapiens
cttcacatgatgtccgtgctgt

SEQ ID NO: 9489731 - DNA, 22 bp, Homo sapiens
cttcacatgatgtccgtgctgt

SEQ ID NO: 9489732 - DNA, 22 bp, Homo sapiens
cttcacatgggtactgctgatc

SEQ ID NO: 9489733 - DNA, 22 bp, Homo sapiens
cttcacatgttggagtcctttg

SEQ ID NO: 9489734 - DNA, 20 bp, Homo sapiens
ctttctctaatttataagta

SEQ ID NO: 9489735 - DNA, 22 bp, Homo sapiens
ctttctctggaggggagtggtt

SEQ ID NO: 9489736 - DNA, 22 bp, Homo sapiens
ctttctctgtgtggtaaagggc

SEQ ID NO: 9489737 - DNA, 22 bp, Homo sapiens
ctttctctgtggtgaggagggt

SEQ ID NO: 9489738 - DNA, 22 bp, Homo sapiens
ctttctccagagctgcttattt

SEQ ID NO: 9489739 - DNA, 22 bp, Homo sapiens
ctttctccctgtcccaaactgg

SEQ ID NO: 9489740 - DNA, 20 bp, Homo sapiens
ctttctctaatttataagta

SEQ ID NO: 9489741 - DNA, 22 bp, Homo sapiens
ctttctcagtgttaattacttt

SEQ ID NO: 9489742 - DNA, 22 bp, Homo sapiens
ctttctcagtgttaattacttt

SEQ ID NO: 9489743 - DNA, 22 bp, Homo sapiens
ctttctcaatgccggaaggcac

SEQ ID NO: 9489744 - DNA, 22 bp, Homo sapiens
ctttctagttgacagcatgcca

SEQ ID NO: 9489745 - DNA, 22 bp, Homo sapiens
ctttctaattctcccatagtct

SEQ ID NO: 9489746 - DNA, 22 bp, Homo sapiens
ctttctaattctcccatagtct

SEQ ID NO: 9489747 - DNA, 22 bp, Homo sapiens
ctttctcttcactgtcatgatc

SEQ ID NO: 9489748 - DNA, 22 bp, Homo sapiens
ctttctcttcactgtcatgatc

SEQ ID NO: 9489749 - DNA, 22 bp, Homo sapiens
ctttctcttacccaaggatctg

SEQ ID NO: 9489750 - DNA, 22 bp, Homo sapiens
ctttctcttacccaaggatctg

SEQ ID NO: 9489751 - DNA, 22 bp, Homo sapiens
ctttctctgtgtttcacatgct

SEQ ID NO: 9489752 - DNA, 22 bp, Homo sapiens
ctttctctgtgtttcacatgct

SEQ ID NO: 9489753 - DNA, 22 bp, Homo sapiens
ctttctctgtgtttcacatgct

SEQ ID NO: 9489754 - DNA, 22 bp, Homo sapiens
ctttctctgtgtttcacatgct

SEQ ID NO: 9489755 - DNA, 22 bp, Homo sapiens
ctttggaacaagaagaaatggc

SEQ ID NO: 9489756 - DNA, 22 bp, Homo sapiens
ctttggaacacccagctctgtg

SEQ ID NO: 9489757 - DNA, 22 bp, Homo sapiens
ctttggaacacatgggcatggt

SEQ ID NO: 9489758 - DNA, 22 bp, Homo sapiens
cttggaggaaggggctcttctg

SEQ ID NO: 9489759 - DNA, 22 bp, Homo sapiens
cttggaggaaaggcagggagac

SEQ ID NO: 9489760 - DNA, 22 bp, Homo sapiens
cttggaggaggtggtgcttgat

SEQ ID NO: 9489761 - DNA, 22 bp, Homo sapiens
cttggagattcattgcctgaaa

SEQ ID NO: 9489762 - DNA, 22 bp, Homo sapiens
cttggagatacagaggacattt

SEQ ID NO: 9489763 - DNA, 22 bp, Homo sapiens
cttggagcccagcaggcctgga

SEQ ID NO: 9489764 - DNA, 22 bp, Homo sapiens
ctttccaagaatgcagatacct

SEQ ID NO: 9489765 - DNA, 22 bp, Homo sapiens
ctttccaccaactcacttccct

SEQ ID NO: 9489766 - DNA, 22 bp, Homo sapiens
cttggaggtggaagttgcagtg

SEQ ID NO: 9489767 - DNA, 22 bp, Homo sapiens
ctttccagatttgtccagttat

SEQ ID NO: 9489768 - DNA, 22 bp, Homo sapiens
ctttccagacctccttgtagct

SEQ ID NO: 9489769 - DNA, 22 bp, Homo sapiens
ctttccagatttgtccagttat

SEQ ID NO: 9489770 - DNA, 23 bp, Homo sapiens
ctttcctttctttgacacccagc

SEQ ID NO: 9489771 - DNA, 23 bp, Homo sapiens
ctttcctttctttgacacccagc

SEQ ID NO: 9489772 - DNA, 22 bp, Homo sapiens
ctttccttctcgtggttctcac

SEQ ID NO: 9489773 - DNA, 22 bp, Homo sapiens
ctttccttctcgtggttctcac

SEQ ID NO: 9489774 - DNA, 22 bp, Homo sapiens
ctttccttctcgtggttctcac

SEQ ID NO: 9489775 - DNA, 22 bp, Homo sapiens
ctttccttaataagcaggtata

SEQ ID NO: 9489776 - DNA, 22 bp, Homo sapiens
ctttccttaataagcaggtata

SEQ ID NO: 9489777 - DNA, 22 bp, Homo sapiens
ctttcctctggcactgtctggt

SEQ ID NO: 9489778 - DNA, 22 bp, Homo sapiens
ctttcctctggcactgtctggt

SEQ ID NO: 9489779 - DNA, 22 bp, Homo sapiens
ctttcctccactccctaggctt

SEQ ID NO: 9489780 - DNA, 22 bp, Homo sapiens
ctttcctccactccctaggctt

SEQ ID NO: 9489781 - DNA, 19 bp, Homo sapiens
cttcttcttggcagccaag

SEQ ID NO: 9489782 - DNA, 22 bp, Homo sapiens
cttcttcttcccccttcagggg

SEQ ID NO: 9489783 - DNA, 22 bp, Homo sapiens
cttcttcttcccccttcagggg

SEQ ID NO: 9489784 - DNA, 22 bp, Homo sapiens
cttcttctggacaggcagctcc

SEQ ID NO: 9489785 - DNA, 22 bp, Homo sapiens
cttcttctggtttatgtggcaa

SEQ ID NO: 9489786 - DNA, 22 bp, Homo sapiens
cttgcctacttgtcaaccagca

SEQ ID NO: 9489787 - DNA, 22 bp, Homo sapiens
cttgcctacttgtcaaccagca

SEQ ID NO: 9489788 - DNA, 22 bp, Homo sapiens
cttgcctccctcagctcacagc

SEQ ID NO: 9489789 - DNA, 19 bp, Homo sapiens
cttgctgggtggtttctgc

SEQ ID NO: 9489790 - DNA, 22 bp, Homo sapiens
cttgctggtattttctctctca

SEQ ID NO: 9489791 - DNA, 22 bp, Homo sapiens
cttgctggtgtcgtgccttcac

SEQ ID NO: 9489792 - DNA, 22 bp, Homo sapiens
cttgctggggtaagtctgtgct

SEQ ID NO: 9489793 - DNA, 22 bp, Homo sapiens
cttgcctgccactacagctgaa

SEQ ID NO: 9489794 - DNA, 22 bp, Homo sapiens
cttcttccaagcttatgctcaa

SEQ ID NO: 9489795 - DNA, 22 bp, Homo sapiens
cttcttccaagcttatgctcaa

SEQ ID NO: 9489796 - DNA, 22 bp, Homo sapiens
cttcttccaagcttatgctcaa

SEQ ID NO: 9489797 - DNA, 22 bp, Homo sapiens
cttcttccagttataagagctt

SEQ ID NO: 9489798 - DNA, 22 bp, Homo sapiens
cttcttcctgctgcagcctcca

SEQ ID NO: 9489799 - DNA, 22 bp, Homo sapiens
cttcttcctgaaagctggctct

SEQ ID NO: 9489800 - DNA, 22 bp, Homo sapiens
cttcttcctgaaagctggctct

SEQ ID NO: 9489801 - DNA, 22 bp, Homo sapiens
cttcttctctacatcctttgat

SEQ ID NO: 9489802 - DNA, 22 bp, Homo sapiens
cttcttctcaaggggcaggtgg

SEQ ID NO: 9489803 - DNA, 22 bp, Homo sapiens
cttggacccactcccagaattg

SEQ ID NO: 9489804 - DNA, 22 bp, Homo sapiens
cttggactttagtctctctcca

SEQ ID NO: 9489805 - DNA, 21 bp, Homo sapiens
cttggaacgggtagaactcac

SEQ ID NO: 9489806 - DNA, 21 bp, Homo sapiens
cttggaacgggtagaactcac

SEQ ID NO: 9489807 - DNA, 22 bp, Homo sapiens
cttggaacttagtaatatgaca

SEQ ID NO: 9489808 - DNA, 22 bp, Homo sapiens
cttggaaggacgggctgtatct

SEQ ID NO: 9489809 - DNA, 22 bp, Homo sapiens
cttggaaggctggttctccctc

SEQ ID NO: 9489810 - DNA, 22 bp, Homo sapiens
cttggagacaggacaggcagaa

SEQ ID NO: 9489811 - DNA, 22 bp, Homo sapiens
cttggagacaggacaggcagaa

SEQ ID NO: 9489812 - DNA, 22 bp, Homo sapiens
cttggagagagcctcagctgtt

SEQ ID NO: 9489813 - DNA, 22 bp, Homo sapiens
cttggagatacaagtggtacct

SEQ ID NO: 9489814 - DNA, 22 bp, Homo sapiens
cttgcttacctagttagctcca

SEQ ID NO: 9489815 - DNA, 22 bp, Homo sapiens
cttgcttgttttgaagaaagat

SEQ ID NO: 9489816 - DNA, 22 bp, Homo sapiens
cttgctttccaaatgactcact

SEQ ID NO: 9489817 - DNA, 22 bp, Homo sapiens
cttggaacaaattaaacaatac

SEQ ID NO: 9489818 - DNA, 22 bp, Homo sapiens
ctgggatgtctatagaacactt

SEQ ID NO: 9489819 - DNA, 22 bp, Homo sapiens
ctgggatgtctatagaacactt

SEQ ID NO: 9489820 - DNA, 22 bp, Homo sapiens
ctgggatgggaactgagaatca

SEQ ID NO: 9489821 - DNA, 22 bp, Homo sapiens
ctgggatggctttcctgcatta

SEQ ID NO: 9489822 - DNA, 22 bp, Homo sapiens
ctgggatggctccgctgctgct

SEQ ID NO: 9489823 - DNA, 22 bp, Homo sapiens
ctgggatggctccgctgctgct

SEQ ID NO: 9489824 - DNA, 22 bp, Homo sapiens
ctgggatggctccgctgctgct

SEQ ID NO: 9489825 - DNA, 22 bp, Homo sapiens
ctgggcccacgagggctctggg

SEQ ID NO: 9489826 - DNA, 22 bp, Homo sapiens
ctgggcccacgagggctctggg

SEQ ID NO: 9489827 - DNA, 22 bp, Homo sapiens
ctgggcccacgagggctctggg

SEQ ID NO: 9489828 - DNA, 22 bp, Homo sapiens
ctgggcccacgagggctctggg

SEQ ID NO: 9489829 - DNA, 22 bp, Homo sapiens
ctgggcccaggcggctctcgga

SEQ ID NO: 9489830 - DNA, 22 bp, Homo sapiens
ctgggccaggaccagggttgaa

SEQ ID NO: 9489831 - DNA, 22 bp, Homo sapiens
ctgggccaggaccagggttgaa

SEQ ID NO: 9489832 - DNA, 22 bp, Homo sapiens
ctgggagttgacgaggcttgta

SEQ ID NO: 9489833 - DNA, 22 bp, Homo sapiens
ctgggagtttctagagaaagac

SEQ ID NO: 9489834 - DNA, 19 bp, Homo sapiens
ctgggagttcactgctgcc

SEQ ID NO: 9489835 - DNA, 19 bp, Homo sapiens
ctgggagttcactgctgcc

SEQ ID NO: 9489836 - DNA, 22 bp, Homo sapiens
ctgggagtgttctaggtcacat

SEQ ID NO: 9489837 - DNA, 22 bp, Homo sapiens
ctgggagtgttctaggtcacat

SEQ ID NO: 9489838 - DNA, 22 bp, Homo sapiens
ctgggatgctccggcctggatg

SEQ ID NO: 9489839 - DNA, 22 bp, Homo sapiens
ctgggatgctccggcctggatg

SEQ ID NO: 9489840 - DNA, 22 bp, Homo sapiens
ctgggatgctccggcctggatg

SEQ ID NO: 9489841 - DNA, 22 bp, Homo sapiens
ctgggatgcggaggttgcggtg

SEQ ID NO: 9489842 - DNA, 22 bp, Homo sapiens
ctgggatccacgggctcccaag

SEQ ID NO: 9489843 - DNA, 22 bp, Homo sapiens
ctgggatccacgggctcccaag

SEQ ID NO: 9489844 - DNA, 22 bp, Homo sapiens
ctgggatcagcagtagtgatga

SEQ ID NO: 9489845 - DNA, 22 bp, Homo sapiens
ctgggagtttgttagtaatgca

SEQ ID NO: 9489846 - DNA, 22 bp, Homo sapiens
ctgggagtttgttagtaatgca

SEQ ID NO: 9489847 - DNA, 22 bp, Homo sapiens
ctgggagtcagtataagaagca

SEQ ID NO: 9489848 - DNA, 22 bp, Homo sapiens
ctgggagtcagtataagaagca

SEQ ID NO: 9489849 - DNA, 22 bp, Homo sapiens
ctgggagtcaccaggagcaagg

SEQ ID NO: 9489850 - DNA, 22 bp, Homo sapiens
ctgggaggcggaggttgcagtg

SEQ ID NO: 9489851 - DNA, 22 bp, Homo sapiens
ctgggagtctaagctagcaccg

SEQ ID NO: 9489852 - DNA, 22 bp, Homo sapiens
ctgggagtggtgacagctctcg

SEQ ID NO: 9489853 - DNA, 22 bp, Homo sapiens
ctgggagtctggcctctggtcc

SEQ ID NO: 9489854 - DNA, 22 bp, Homo sapiens
ctggagctccagggtctcctct

SEQ ID NO: 9489855 - DNA, 22 bp, Homo sapiens
ctggagctcagcccaggttcca

SEQ ID NO: 9489856 - DNA, 22 bp, Homo sapiens
ctggagctcagcccaggttcca

SEQ ID NO: 9489857 - DNA, 22 bp, Homo sapiens
ctggagctccagggtctcctct

SEQ ID NO: 9489858 - DNA, 22 bp, Homo sapiens
ctggagctccagggtctcctct

SEQ ID NO: 9489859 - DNA, 22 bp, Homo sapiens
ctggagctccagggtctcctct

SEQ ID NO: 9489860 - DNA, 22 bp, Homo sapiens
ctgggaggcggagcttgcagtg

SEQ ID NO: 9489861 - DNA, 22 bp, Homo sapiens
ctgggaggcggagcttgcagtg

SEQ ID NO: 9489862 - DNA, 22 bp, Homo sapiens
ctgggaggcggagcttgcagtg

SEQ ID NO: 9489863 - DNA, 22 bp, Homo sapiens
ctggagctccagggtctcctct

SEQ ID NO: 9489864 - DNA, 22 bp, Homo sapiens
ctggagctccagggtctcctct

SEQ ID NO: 9489865 - DNA, 22 bp, Homo sapiens
ctggagccttcaccaggggaaa

SEQ ID NO: 9489866 - DNA, 22 bp, Homo sapiens
ctggagccttcaccaggggaaa

SEQ ID NO: 9489867 - DNA, 22 bp, Homo sapiens
ctggagccttcaccaggggaaa

SEQ ID NO: 9489868 - DNA, 22 bp, Homo sapiens
ctggagcctgcagttttcactt

SEQ ID NO: 9489869 - DNA, 22 bp, Homo sapiens
ctggagctcagcccaggttcca

SEQ ID NO: 9489870 - DNA, 22 bp, Homo sapiens
ctggagctaggaagtccaagat

SEQ ID NO: 9489871 - DNA, 22 bp, Homo sapiens
ctgggcctaacccacagcgttt

SEQ ID NO: 9489872 - DNA, 22 bp, Homo sapiens
ctgggccctgaagacagtcagg

SEQ ID NO: 9489873 - DNA, 22 bp, Homo sapiens
ctgggcctagaggaagctgaca

SEQ ID NO: 9489874 - DNA, 22 bp, Homo sapiens
ctgggcctaacccacagcgttt

SEQ ID NO: 9489875 - DNA, 22 bp, Homo sapiens
ctgggcccaggcggctctcgga

SEQ ID NO: 9489876 - DNA, 22 bp, Homo sapiens
ctgggcccaggcggctctcgga

SEQ ID NO: 9489877 - DNA, 22 bp, Homo sapiens
ctgggccctatggaagaaaggg

SEQ ID NO: 9489878 - DNA, 22 bp, Homo sapiens
ctgggccctatggaagaaaggg

SEQ ID NO: 9489879 - DNA, 22 bp, Homo sapiens
ctgggccctgaagacagtcagg

SEQ ID NO: 9489880 - DNA, 22 bp, Homo sapiens
ctgggcctagaggaagctgaca

SEQ ID NO: 9489881 - DNA, 22 bp, Homo sapiens
ctgggcctagaggaagctgaca

SEQ ID NO: 9489882 - DNA, 22 bp, Homo sapiens
ctgggcctagcaacagaggagt

SEQ ID NO: 9489883 - DNA, 22 bp, Homo sapiens
ctgggcctaggatggaagggcc

SEQ ID NO: 9489884 - DNA, 22 bp, Homo sapiens
ctgggcctagcaacagaggagt

SEQ ID NO: 9489885 - DNA, 22 bp, Homo sapiens
ctgggcctagcaacagaggagt

SEQ ID NO: 9489886 - DNA, 22 bp, Homo sapiens
ctgggcctcatccccagagttt

SEQ ID NO: 9489887 - DNA, 22 bp, Homo sapiens
ctgggcctcatccagccacaac

SEQ ID NO: 9489888 - DNA, 22 bp, Homo sapiens
ctgggcctcatccagccacaac

SEQ ID NO: 9489889 - DNA, 22 bp, Homo sapiens
ctgggcctcatccccagagttt

SEQ ID NO: 9489890 - DNA, 22 bp, Homo sapiens
ctgggcctcatcctcagagttt

SEQ ID NO: 9489891 - DNA, 22 bp, Homo sapiens
ctgggcctcatcctcagagttt

SEQ ID NO: 9489892 - DNA, 22 bp, Homo sapiens
ctgggcctcaatctcagagttt

SEQ ID NO: 9489893 - DNA, 22 bp, Homo sapiens
ctgggcctcaatctcagagttt

SEQ ID NO: 9489894 - DNA, 23 bp, Homo sapiens
ctgggcctatggtctgaatccaa

SEQ ID NO: 9489895 - DNA, 22 bp, Homo sapiens
ctgggcctcaagctcagatttc

SEQ ID NO: 9489896 - DNA, 22 bp, Homo sapiens
ctgggcctcaccctagaccaat

SEQ ID NO: 9489897 - DNA, 22 bp, Homo sapiens
ctgggcctcaccctagaccaat

SEQ ID NO: 9489898 - DNA, 22 bp, Homo sapiens
ctgggcctcacacccaccaaat

SEQ ID NO: 9489899 - DNA, 22 bp, Homo sapiens
ctgggcctcacacccaccaaat

SEQ ID NO: 9489900 - DNA, 22 bp, Homo sapiens
ctgggctcaagaagtcttccct

SEQ ID NO: 9489901 - DNA, 22 bp, Homo sapiens
ctgggctcaaatcctggccctg

SEQ ID NO: 9489902 - DNA, 22 bp, Homo sapiens
ctgggctcaaatcctggccctg

SEQ ID NO: 9489903 - DNA, 22 bp, Homo sapiens
ctgggctcaaatcctggccctg

SEQ ID NO: 9489904 - DNA, 22 bp, Homo sapiens
ctgggctcaaatcctggccctg

SEQ ID NO: 9489905 - DNA, 22 bp, Homo sapiens
ctgggctcagcaggccaaggcc

SEQ ID NO: 9489906 - DNA, 22 bp, Homo sapiens
ctgggctcagcaggccaaggcc

SEQ ID NO: 9489907 - DNA, 22 bp, Homo sapiens
ctgggctcagcaggccaaggcc

SEQ ID NO: 9489908 - DNA, 22 bp, Homo sapiens
ctgggcctccacgggccatcac

SEQ ID NO: 9489909 - DNA, 22 bp, Homo sapiens
ctgggcctccacgggccatcac

SEQ ID NO: 9489910 - DNA, 22 bp, Homo sapiens
ctgggcctcatgcacagagatg

SEQ ID NO: 9489911 - DNA, 22 bp, Homo sapiens
ctgggcctcatgcacagagatg

SEQ ID NO: 9489912 - DNA, 22 bp, Homo sapiens
ctgggcctcatgcacagagatg

SEQ ID NO: 9489913 - DNA, 22 bp, Homo sapiens
ctgggctcaaatcctatctcca

SEQ ID NO: 9489914 - DNA, 22 bp, Homo sapiens
ctgggctcaaatcctatctcca

SEQ ID NO: 9489915 - DNA, 22 bp, Homo sapiens
ctgggcctccacgggccatcac

SEQ ID NO: 9489916 - DNA, 22 bp, Homo sapiens
ctgggctcagtggctcatggct

SEQ ID NO: 9489917 - DNA, 22 bp, Homo sapiens
ctgggctcagtggctcatggct

SEQ ID NO: 9489918 - DNA, 22 bp, Homo sapiens
ctgggctcagtggctcatggct

SEQ ID NO: 9489919 - DNA, 22 bp, Homo sapiens
ctgggctcagtgtctcactcct

SEQ ID NO: 9489920 - DNA, 22 bp, Homo sapiens
ctgggctcagtgtctcactcct

SEQ ID NO: 9489921 - DNA, 22 bp, Homo sapiens
ctgggctcagtgtctcactcct

SEQ ID NO: 9489922 - DNA, 22 bp, Homo sapiens
ctgggctcagtgtctcactcct

SEQ ID NO: 9489923 - DNA, 22 bp, Homo sapiens
ctgggctcagcccatgctgtcc

SEQ ID NO: 9489924 - DNA, 22 bp, Homo sapiens
ctgggctcagcccatgctgtcc

SEQ ID NO: 9489925 - DNA, 22 bp, Homo sapiens
ctgggctcagtggctcatggct

SEQ ID NO: 9489926 - DNA, 22 bp, Homo sapiens
ctgggctcagtggctcatggct

SEQ ID NO: 9489927 - DNA, 22 bp, Homo sapiens
ctgggctcagtggctcatggct

SEQ ID NO: 9489928 - DNA, 22 bp, Homo sapiens
ctgggctccactcccacagtgt

SEQ ID NO: 9489929 - DNA, 22 bp, Homo sapiens
ctgggctccactcccacagtgt

SEQ ID NO: 9489930 - DNA, 22 bp, Homo sapiens
ctgggctccactcccacagtgt

SEQ ID NO: 9489931 - DNA, 22 bp, Homo sapiens
ctgggctccactcccacagtgt

SEQ ID NO: 9489932 - DNA, 22 bp, Homo sapiens
ctgggctccactacttgctaac

SEQ ID NO: 9489933 - DNA, 22 bp, Homo sapiens
ctgggctcagtgtctcactcct

SEQ ID NO: 9489934 - DNA, 22 bp, Homo sapiens
ctggggtggaggagctcccctg

SEQ ID NO: 9489935 - DNA, 22 bp, Homo sapiens
ctggggtggagattggcaatct

SEQ ID NO: 9489936 - DNA, 22 bp, Homo sapiens
ctggggtgagcagaaacagggg

SEQ ID NO: 9489937 - DNA, 22 bp, Homo sapiens
ctggggtggatgggtccaagtt

SEQ ID NO: 9489938 - DNA, 22 bp, Homo sapiens
ctggggtggatgggtccaagtt

SEQ ID NO: 9489939 - DNA, 22 bp, Homo sapiens
ctggggtgtctcgtctgccatt

SEQ ID NO: 9489940 - DNA, 22 bp, Homo sapiens
ctggggtggtgcaggcctcatg

SEQ ID NO: 9489941 - DNA, 22 bp, Homo sapiens
ctggggtggatgggtccaagtt

SEQ ID NO: 9489942 - DNA, 22 bp, Homo sapiens
ctgggtggaaagtgctgagaat

SEQ ID NO: 9489943 - DNA, 22 bp, Homo sapiens
ctggggtgtctcgtctgccatt

SEQ ID NO: 9489944 - DNA, 22 bp, Homo sapiens
ctggggtgtctcgtctgccatt

SEQ ID NO: 9489945 - DNA, 22 bp, Homo sapiens
ctggggggctactgacagagga

SEQ ID NO: 9489946 - DNA, 22 bp, Homo sapiens
ctggggggctactgacagagga

SEQ ID NO: 9489947 - DNA, 22 bp, Homo sapiens
ctgggggtcgcgcctctgggca

SEQ ID NO: 9489948 - DNA, 19 bp, Homo sapiens
ctgggggtgctcacgctct

SEQ ID NO: 9489949 - DNA, 22 bp, Homo sapiens
ctggggctggtgaggcaggctc

SEQ ID NO: 9489950 - DNA, 22 bp, Homo sapiens
ctgggctctagaaaggaaagaa

SEQ ID NO: 9489951 - DNA, 22 bp, Homo sapiens
ctgggctctagaaaggaaagaa

SEQ ID NO: 9489952 - DNA, 22 bp, Homo sapiens
ctgggctctagaaaggaaagaa

SEQ ID NO: 9489953 - DNA, 22 bp, Homo sapiens
ctggggctggtgaggcaggctc

SEQ ID NO: 9489954 - DNA, 22 bp, Homo sapiens
ctggggctgtaggaggacttat

SEQ ID NO: 9489955 - DNA, 22 bp, Homo sapiens
ctgggggcagcaagaagccatg

SEQ ID NO: 9489956 - DNA, 22 bp, Homo sapiens
ctgggggcagcaagaagccatg

SEQ ID NO: 9489957 - DNA, 22 bp, Homo sapiens
ctgggggccttacggaactcca

SEQ ID NO: 9489958 - DNA, 22 bp, Homo sapiens
ctgggggccttacggaactcca

SEQ ID NO: 9489959 - DNA, 22 bp, Homo sapiens
ctggggggagctgcgtccagca

SEQ ID NO: 9489960 - DNA, 18 bp, Homo sapiens
ctgggctcgagagatcct

SEQ ID NO: 9489961 - DNA, 18 bp, Homo sapiens
ctgggctcgagagatcct

SEQ ID NO: 9489962 - DNA, 18 bp, Homo sapiens
ctgggctcgagagatcct

SEQ ID NO: 9489963 - DNA, 18 bp, Homo sapiens
ctgggctcgagagatcct

SEQ ID NO: 9489964 - DNA, 20 bp, Homo sapiens
ctgggctcggtggccctggc

SEQ ID NO: 9489965 - DNA, 20 bp, Homo sapiens
ctgggctcggtggccctggc

SEQ ID NO: 9489966 - DNA, 20 bp, Homo sapiens
ctgggctcggtggccctggc

SEQ ID NO: 9489967 - DNA, 22 bp, Homo sapiens
ctgggctctaagggagcaccgt

SEQ ID NO: 9489968 - DNA, 22 bp, Homo sapiens
ctgggctctaagggagcaccgt

SEQ ID NO: 9489969 - DNA, 22 bp, Homo sapiens
ctgggctctaagggagcaccgt

SEQ ID NO: 9489970 - DNA, 22 bp, Homo sapiens
ctgggctctaagggagcaccgt

SEQ ID NO: 9489971 - DNA, 22 bp, Homo sapiens
ctgggctcctaaccatccaggt

SEQ ID NO: 9489972 - DNA, 22 bp, Homo sapiens
ctgggctcctaaccatccaggt

SEQ ID NO: 9489973 - DNA, 22 bp, Homo sapiens
ctgggctccctcatgtgtctgc

SEQ ID NO: 9489974 - DNA, 22 bp, Homo sapiens
ctgggctccctcatgtgtctgc

SEQ ID NO: 9489975 - DNA, 22 bp, Homo sapiens
ctgggttcttggcacagcagga

SEQ ID NO: 9489976 - DNA, 22 bp, Homo sapiens
ctgggttctatttttggcttca

SEQ ID NO: 9489977 - DNA, 22 bp, Homo sapiens
ctgggttctctgcttagggcct

SEQ ID NO: 9489978 - DNA, 22 bp, Homo sapiens
ctgggttccatgtagccaagag

SEQ ID NO: 9489979 - DNA, 22 bp, Homo sapiens
ctgggttccatgtagccaagag

SEQ ID NO: 9489980 - DNA, 22 bp, Homo sapiens
ctgggtgttcacccgaggcgct

SEQ ID NO: 9489981 - DNA, 22 bp, Homo sapiens
ctgggtgtgggtcaagcaacca

SEQ ID NO: 9489982 - DNA, 22 bp, Homo sapiens
ctgggtggttttgatgtgaatt

SEQ ID NO: 9489983 - DNA, 22 bp, Homo sapiens
ctgggtggttttgatgtgaatt

SEQ ID NO: 9489984 - DNA, 22 bp, Homo sapiens
ctgggtggttctaactgttgat

SEQ ID NO: 9489985 - DNA, 22 bp, Homo sapiens
ctgggtggttctaactgttgat

SEQ ID NO: 9489986 - DNA, 22 bp, Homo sapiens
ctgggtggttttgatgtgaatt

SEQ ID NO: 9489987 - DNA, 22 bp, Homo sapiens
ctgggtggaaagtgctgagaat

SEQ ID NO: 9489988 - DNA, 22 bp, Homo sapiens
ctgggtggaaagtgctgagaat

SEQ ID NO: 9489989 - DNA, 22 bp, Homo sapiens
ctgggtggaaagtgctgagaat

SEQ ID NO: 9489990 - DNA, 22 bp, Homo sapiens
ctggtgctggagcctagtccct

SEQ ID NO: 9489991 - DNA, 22 bp, Homo sapiens
ctggtggggagtcctggtctcc

SEQ ID NO: 9489992 - DNA, 22 bp, Homo sapiens
ctggtggggagtcctggtctcc

SEQ ID NO: 9489993 - DNA, 22 bp, Homo sapiens
ctggtgggtagagggcatcagg

SEQ ID NO: 9489994 - DNA, 22 bp, Homo sapiens
ctggtgccctgtgtggcaggag

SEQ ID NO: 9489995 - DNA, 22 bp, Homo sapiens
ctggtcacctccttcccagcta

SEQ ID NO: 9489996 - DNA, 22 bp, Homo sapiens
ctggtgcctcctccctgtgctt

SEQ ID NO: 9489997 - DNA, 22 bp, Homo sapiens
ctggtgcctcctccctgtgctt

SEQ ID NO: 9489998 - DNA, 22 bp, Homo sapiens
ctggtagtttgcaaaatggtgt

SEQ ID NO: 9489999 - DNA, 22 bp, Homo sapiens
ctggtagcagtgaagctgttga

SEQ ID NO: 9490000 - DNA, 22 bp, Homo sapiens
ctggtcaataatcatgtagtac

SEQ ID NO: 9490001 - DNA, 22 bp, Homo sapiens
ctggtcaagagctagcagagct

SEQ ID NO: 9490002 - DNA, 22 bp, Homo sapiens
ctggtcaaaaattatgcttact

SEQ ID NO: 9490003 - DNA, 22 bp, Homo sapiens
ctggtcaccaggtagcattgta

SEQ ID NO: 9490004 - DNA, 22 bp, Homo sapiens
ctggtcacctccttcccagcta

SEQ ID NO: 9490005 - DNA, 22 bp, Homo sapiens
ctggtgtccagcatgtgtggaa

SEQ ID NO: 9490006 - DNA, 22 bp, Homo sapiens
ctggtgtctgattctcccctga

SEQ ID NO: 9490007 - DNA, 22 bp, Homo sapiens
ctggtgtctgctccctcacagc

SEQ ID NO: 9490008 - DNA, 22 bp, Homo sapiens
ctggtgtctgctccctcacagc

SEQ ID NO: 9490009 - DNA, 22 bp, Homo sapiens
ctggtgtggcggcgccctgtag

SEQ ID NO: 9490010 - DNA, 22 bp, Homo sapiens
ctggtgttgtccgggtgagagt

SEQ ID NO: 9490011 - DNA, 22 bp, Homo sapiens
ctggtgtggcggcgccctgtag

SEQ ID NO: 9490012 - DNA, 22 bp, Homo sapiens
ctggttaaatgaaaaagtatta

SEQ ID NO: 9490013 - DNA, 22 bp, Homo sapiens
ctggtgtttattacaggtgctc

SEQ ID NO: 9490014 - DNA, 22 bp, Homo sapiens
ctggttatggctgtggctatgg

SEQ ID NO: 9490015 - DNA, 22 bp, Homo sapiens
ctggttatcctgcctattttgt

SEQ ID NO: 9490016 - DNA, 22 bp, Homo sapiens
ctggttatcctgcctattttgt

SEQ ID NO: 9490017 - DNA, 22 bp, Homo sapiens
ctggttatctcggccacagaga

SEQ ID NO: 9490018 - DNA, 22 bp, Homo sapiens
ctggttattattcttggaatgc

SEQ ID NO: 9490019 - DNA, 22 bp, Homo sapiens
ctggttattttgtttggcagag

SEQ ID NO: 9490020 - DNA, 22 bp, Homo sapiens
ctggttattattcttggaatgc

SEQ ID NO: 9490021 - DNA, 22 bp, Homo sapiens
ctggttcaagtcctggctctgt

SEQ ID NO: 9490022 - DNA, 22 bp, Homo sapiens
ctgtgagggcagggaccagagg

SEQ ID NO: 9490023 - DNA, 22 bp, Homo sapiens
ctgtgaggcgggtggagtggag

SEQ ID NO: 9490024 - DNA, 22 bp, Homo sapiens
ctgtgagggcagggaccagagg

SEQ ID NO: 9490025 - DNA, 22 bp, Homo sapiens
ctgtgaggcctttggccagata

SEQ ID NO: 9490026 - DNA, 22 bp, Homo sapiens
ctgtgagctgggtggccaggac

SEQ ID NO: 9490027 - DNA, 22 bp, Homo sapiens
ctgtgaggcctttggccagata

SEQ ID NO: 9490028 - DNA, 20 bp, Homo sapiens
ctgtggaattttaccatgcg

SEQ ID NO: 9490029 - DNA, 21 bp, Homo sapiens
ctgtggacaggctggggcatg

SEQ ID NO: 9490030 - DNA, 22 bp, Homo sapiens
ctgtggagttccatcaggggag

SEQ ID NO: 9490031 - DNA, 22 bp, Homo sapiens
ctgtggaatcgggaaaagacag

SEQ ID NO: 9490032 - DNA, 22 bp, Homo sapiens
ctgtggaatcgggaaaagacag

SEQ ID NO: 9490033 - DNA, 22 bp, Homo sapiens
ctgtggaattgatgcttagtgt

SEQ ID NO: 9490034 - DNA, 22 bp, Homo sapiens
ctgtgagggcagggaccagagg

SEQ ID NO: 9490035 - DNA, 22 bp, Homo sapiens
ctgtgagggcagggaccagagg

SEQ ID NO: 9490036 - DNA, 22 bp, Homo sapiens
ctgtggaaggtttagataggta

SEQ ID NO: 9490037 - DNA, 22 bp, Homo sapiens
ctgtgacttagagtgagtagag

SEQ ID NO: 9490038 - DNA, 22 bp, Homo sapiens
ctgtgactgggtgacagtcctc

SEQ ID NO: 9490039 - DNA, 22 bp, Homo sapiens
ctgtgactgggtgacagtcctc

SEQ ID NO: 9490040 - DNA, 22 bp, Homo sapiens
ctgtgactccttctacctgtct

SEQ ID NO: 9490041 - DNA, 22 bp, Homo sapiens
ctgtgactgcagcaccaagtaa

SEQ ID NO: 9490042 - DNA, 18 bp, Homo sapiens
ctgtgactcctagatctc

SEQ ID NO: 9490043 - DNA, 22 bp, Homo sapiens
ctgtgagaaaggtgatggaggt

SEQ ID NO: 9490044 - DNA, 22 bp, Homo sapiens
ctgtgagactgatagggaagag

SEQ ID NO: 9490045 - DNA, 22 bp, Homo sapiens
ctgtgagactgatagggaagag

SEQ ID NO: 9490046 - DNA, 22 bp, Homo sapiens
ctgtgagaagaatcccacctga

SEQ ID NO: 9490047 - DNA, 22 bp, Homo sapiens
ctgtgagacctgatttcttcat

SEQ ID NO: 9490048 - DNA, 22 bp, Homo sapiens
ctgtgagatttttaaataactt

SEQ ID NO: 9490049 - DNA, 22 bp, Homo sapiens
ctgtgagatgtttctggttaga

SEQ ID NO: 9490050 - DNA, 22 bp, Homo sapiens
ctgtgagatgtttctggttaga

SEQ ID NO: 9490051 - DNA, 22 bp, Homo sapiens
ctgtgagatgtttctggttaga

SEQ ID NO: 9490052 - DNA, 22 bp, Homo sapiens
ctgtgagatgaccaactgactg

SEQ ID NO: 9490053 - DNA, 22 bp, Homo sapiens
ctgtgagatgaccaactgactg

SEQ ID NO: 9490054 - DNA, 22 bp, Homo sapiens
ctgtgagagtggtggcctaggc

SEQ ID NO: 9490055 - DNA, 22 bp, Homo sapiens
ctgtgaagggacggatgctgct

SEQ ID NO: 9490056 - DNA, 22 bp, Homo sapiens
ctgtgaaatgctttgcgatggt

SEQ ID NO: 9490057 - DNA, 22 bp, Homo sapiens
ctgtgaatgctagtaagagtgc

SEQ ID NO: 9490058 - DNA, 22 bp, Homo sapiens
ctgtgaatttaaagcacacatc

SEQ ID NO: 9490059 - DNA, 22 bp, Homo sapiens
ctgtgaattgaatatgactatg

SEQ ID NO: 9490060 - DNA, 22 bp, Homo sapiens
ctgtgaattgaatatgactatg

SEQ ID NO: 9490061 - DNA, 22 bp, Homo sapiens
ctgtgaatgttatatctcaatg

SEQ ID NO: 9490062 - DNA, 22 bp, Homo sapiens
ctgtgaatgttgaataaatcct

SEQ ID NO: 9490063 - DNA, 22 bp, Homo sapiens
ctgtgacagagcttgagtgaga

SEQ ID NO: 9490064 - DNA, 22 bp, Homo sapiens
ctgtgaattttccaatattccg

SEQ ID NO: 9490065 - DNA, 22 bp, Homo sapiens
ctgtgacctccaggaaggggtg

SEQ ID NO: 9490066 - DNA, 22 bp, Homo sapiens
ctgtgacccagttcctggcacc

SEQ ID NO: 9490067 - DNA, 22 bp, Homo sapiens
ctgtgacccagttcctggcacc

SEQ ID NO: 9490068 - DNA, 22 bp, Homo sapiens
ctgtgacagtttctcagacttt

SEQ ID NO: 9490069 - DNA, 22 bp, Homo sapiens
ctgtgaaatcaaccttgagccc

SEQ ID NO: 9490070 - DNA, 22 bp, Homo sapiens
ctgtgaaactggacagcacttg

SEQ ID NO: 9490071 - DNA, 22 bp, Homo sapiens
ctgtctgttgaccatagtttgc

SEQ ID NO: 9490072 - DNA, 22 bp, Homo sapiens
ctgtctgttcagattcattact

SEQ ID NO: 9490073 - DNA, 22 bp, Homo sapiens
ctgtctgttatctcaccagtcc

SEQ ID NO: 9490074 - DNA, 22 bp, Homo sapiens
ctgtctgttatctcaccagtcc

SEQ ID NO: 9490075 - DNA, 22 bp, Homo sapiens
ctgtctgtggtctcagtaggcc

SEQ ID NO: 9490076 - DNA, 22 bp, Homo sapiens
ctgtctgtgtggacacggctgc

SEQ ID NO: 9490077 - DNA, 21 bp, Homo sapiens
ctgtccctctttgcttccctc

SEQ ID NO: 9490078 - DNA, 22 bp, Homo sapiens
ctgtccctcatcacctctgggt

SEQ ID NO: 9490079 - DNA, 22 bp, Homo sapiens
ctgtccctcatcacctctgggt

SEQ ID NO: 9490080 - DNA, 19 bp, Homo sapiens
ctgtccctcccaggtatga

SEQ ID NO: 9490081 - DNA, 22 bp, Homo sapiens
ctggttttaatgttatgtttat

SEQ ID NO: 9490082 - DNA, 22 bp, Homo sapiens
ctggtttgcccacaccagccac

SEQ ID NO: 9490083 - DNA, 22 bp, Homo sapiens
ctgtcattcttacataatgtga

SEQ ID NO: 9490084 - DNA, 22 bp, Homo sapiens
ctgtcatggtcagattgtcatc

SEQ ID NO: 9490085 - DNA, 22 bp, Homo sapiens
ctggttttgtcagaagctttat

SEQ ID NO: 9490086 - DNA, 22 bp, Homo sapiens
ctggtttagctgtaaggttccc

SEQ ID NO: 9490087 - DNA, 22 bp, Homo sapiens
ctggttggaggagaagtttgga

SEQ ID NO: 9490088 - DNA, 22 bp, Homo sapiens
ctggttcctccatcagcaggaa

SEQ ID NO: 9490089 - DNA, 22 bp, Homo sapiens
ctggttctgatgttcttggctt

SEQ ID NO: 9490090 - DNA, 22 bp, Homo sapiens
ctggttctgatgttcttggctt

SEQ ID NO: 9490091 - DNA, 22 bp, Homo sapiens
ctggttctgattttgctgcatt

SEQ ID NO: 9490092 - DNA, 22 bp, Homo sapiens
ctggttcatggtggaatgacat

SEQ ID NO: 9490093 - DNA, 22 bp, Homo sapiens
ctggttccagaattgcctgtgg

SEQ ID NO: 9490094 - DNA, 22 bp, Homo sapiens
ctggttcatataggcaagttta

SEQ ID NO: 9490095 - DNA, 23 bp, Homo sapiens
ctggttcatagtcaagagattga

SEQ ID NO: 9490096 - DNA, 22 bp, Homo sapiens
ctggttcagtgaaaggcatggg

SEQ ID NO: 9490097 - DNA, 22 bp, Homo sapiens
ctggttcaatactaaacttctt

SEQ ID NO: 9490098 - DNA, 20 bp, Homo sapiens
ctgtccccgaggtcaccagg

SEQ ID NO: 9490099 - DNA, 22 bp, Homo sapiens
ctgtccccgcgagtccagagct

SEQ ID NO: 9490100 - DNA, 22 bp, Homo sapiens
ctgtccccgcgagtccagagct

SEQ ID NO: 9490101 - DNA, 22 bp, Homo sapiens
ctgtcccctgtgctttcacttg

SEQ ID NO: 9490102 - DNA, 22 bp, Homo sapiens
ctgtcccctgtgctttcacttg

SEQ ID NO: 9490103 - DNA, 22 bp, Homo sapiens
ctgtccctcagttctgggcaaa

SEQ ID NO: 9490104 - DNA, 21 bp, Homo sapiens
ctgtccccagtgagcaccccc

SEQ ID NO: 9490105 - DNA, 19 bp, Homo sapiens
ctgtcccagactctgctct

SEQ ID NO: 9490106 - DNA, 22 bp, Homo sapiens
ctgtcccacaagcagtgtgcac

SEQ ID NO: 9490107 - DNA, 22 bp, Homo sapiens
ctgtcccaggagctgtaagaca

SEQ ID NO: 9490108 - DNA, 22 bp, Homo sapiens
ctgtcccaggatcctgactcca

SEQ ID NO: 9490109 - DNA, 22 bp, Homo sapiens
ctgtcccagatgttctcagcac

SEQ ID NO: 9490110 - DNA, 22 bp, Homo sapiens
ctgtgggagggtgagagaacca

SEQ ID NO: 9490111 - DNA, 22 bp, Homo sapiens
ctgtggctttctctgcctcctt

SEQ ID NO: 9490112 - DNA, 22 bp, Homo sapiens
ctgtggcttctgggtcagttca

SEQ ID NO: 9490113 - DNA, 22 bp, Homo sapiens
ctgtggcttctgcttgggcctc

SEQ ID NO: 9490114 - DNA, 22 bp, Homo sapiens
ctgtggcattgtgaggactgca

SEQ ID NO: 9490115 - DNA, 23 bp, Homo sapiens
ctgtggccacccctagctggagg

SEQ ID NO: 9490116 - DNA, 22 bp, Homo sapiens
ctgtgggctcccagcttctctc

SEQ ID NO: 9490117 - DNA, 22 bp, Homo sapiens
ctgtgggctcccagcttctctc

SEQ ID NO: 9490118 - DNA, 22 bp, Homo sapiens
ctgtgggcctgatgttcttctc

SEQ ID NO: 9490119 - DNA, 22 bp, Homo sapiens
ctgtggcagggaagaggccatg

SEQ ID NO: 9490120 - DNA, 22 bp, Homo sapiens
ctgtggcagggaagaggccatg

SEQ ID NO: 9490121 - DNA, 22 bp, Homo sapiens
ctgtggcagggaagaggccatg

SEQ ID NO: 9490122 - DNA, 22 bp, Homo sapiens
ctgtggcaggaagggactagca

SEQ ID NO: 9490123 - DNA, 20 bp, Homo sapiens
ctgtggcatctgtcatggtg

SEQ ID NO: 9490124 - DNA, 20 bp, Homo sapiens
ctgtggcatctgtcatggtg

SEQ ID NO: 9490125 - DNA, 22 bp, Homo sapiens
ctgtggcaggtgtctggggcag

SEQ ID NO: 9490126 - DNA, 22 bp, Homo sapiens
ctgtggcaggtgtctggggcag

SEQ ID NO: 9490127 - DNA, 22 bp, Homo sapiens
ctgtggcaggtgtctggggcag

SEQ ID NO: 9490128 - DNA, 22 bp, Homo sapiens
ctgtggcattgccgaggctggc

SEQ ID NO: 9490129 - DNA, 22 bp, Homo sapiens
ctgtggcattgccgaggctggc

SEQ ID NO: 9490130 - DNA, 22 bp, Homo sapiens
ctgtggcattgccgaggctggc

SEQ ID NO: 9490131 - DNA, 20 bp, Homo sapiens
ctgtggcatctgtcatggtg

SEQ ID NO: 9490132 - DNA, 20 bp, Homo sapiens
ctgtggcatctgtcatggtg

SEQ ID NO: 9490133 - DNA, 22 bp, Homo sapiens
ctgtggcattgccgaggctggc

SEQ ID NO: 9490134 - DNA, 22 bp, Homo sapiens
ctgtggcacatgtggcaaggcc

SEQ ID NO: 9490135 - DNA, 22 bp, Homo sapiens
ctgtggcacatgtggcaaggcc

SEQ ID NO: 9490136 - DNA, 22 bp, Homo sapiens
ctgtggcaccaatacatttttc

SEQ ID NO: 9490137 - DNA, 22 bp, Homo sapiens
ctgtggcaccaatacatttttc

SEQ ID NO: 9490138 - DNA, 22 bp, Homo sapiens
ctgtggcaagtctgcctgtcac

SEQ ID NO: 9490139 - DNA, 22 bp, Homo sapiens
ctgtggcaagtctgcctgtcac

SEQ ID NO: 9490140 - DNA, 22 bp, Homo sapiens
ctgtggcaagtctgcctgtcac

SEQ ID NO: 9490141 - DNA, 22 bp, Homo sapiens
ctgtggcagaggtgacacctct

SEQ ID NO: 9490142 - DNA, 22 bp, Homo sapiens
ctgtggcactcaagaagcctcc

SEQ ID NO: 9490143 - DNA, 22 bp, Homo sapiens
ctgtggcactcaagaagcctcc

SEQ ID NO: 9490144 - DNA, 22 bp, Homo sapiens
ctgtggcaaatgatacctccca

SEQ ID NO: 9490145 - DNA, 22 bp, Homo sapiens
ctgtggatcagtttggaaactt

SEQ ID NO: 9490146 - DNA, 23 bp, Homo sapiens
ctgtggcaagtcctgcacctgcc

SEQ ID NO: 9490147 - DNA, 23 bp, Homo sapiens
ctgtggcaagtcctgcacctgcc

SEQ ID NO: 9490148 - DNA, 22 bp, Homo sapiens
ctgtggagtttgtggcgctgac

SEQ ID NO: 9490149 - DNA, 22 bp, Homo sapiens
ctgtggatttaggcagagctga

SEQ ID NO: 9490150 - DNA, 22 bp, Homo sapiens
ctgtggagtttgtggcgctgac

SEQ ID NO: 9490151 - DNA, 22 bp, Homo sapiens
ctgtggagtttgtggcgctgac

SEQ ID NO: 9490152 - DNA, 22 bp, Homo sapiens
ctgtgtcttgagtaattcggtg

SEQ ID NO: 9490153 - DNA, 22 bp, Homo sapiens
ctgtgtctttcctactttgtgg

SEQ ID NO: 9490154 - DNA, 22 bp, Homo sapiens
ctgtggtggcacagcgggctgg

SEQ ID NO: 9490155 - DNA, 22 bp, Homo sapiens
ctgtgtcttctgttttgaagtt

SEQ ID NO: 9490156 - DNA, 22 bp, Homo sapiens
ctgtgtgacaagtgaggacgcc

SEQ ID NO: 9490157 - DNA, 22 bp, Homo sapiens
ctgtgtgtgaacacagcccagc

SEQ ID NO: 9490158 - DNA, 22 bp, Homo sapiens
ctgtgtgatgggaagaatgttt

SEQ ID NO: 9490159 - DNA, 22 bp, Homo sapiens
ctgtggtggcacagcgggctgg

SEQ ID NO: 9490160 - DNA, 20 bp, Homo sapiens
ctgtggtgagcaggagagta

SEQ ID NO: 9490161 - DNA, 20 bp, Homo sapiens
ctgtggtgagcaggagagta

SEQ ID NO: 9490162 - DNA, 22 bp, Homo sapiens
ctgtggtgagcaactgactgaa

SEQ ID NO: 9490163 - DNA, 22 bp, Homo sapiens
ctgtggggaagatagaaccgac

SEQ ID NO: 9490164 - DNA, 22 bp, Homo sapiens
ctgtggggagctgatcagatca

SEQ ID NO: 9490165 - DNA, 22 bp, Homo sapiens
ctgtggggccaaattctcctct

SEQ ID NO: 9490166 - DNA, 22 bp, Homo sapiens
ctgtgggtgaagacaagggaga

SEQ ID NO: 9490167 - DNA, 22 bp, Homo sapiens
ctgtggggaaagggtcctgctc

SEQ ID NO: 9490168 - DNA, 22 bp, Homo sapiens
ctgtggggaaagggtcctgctc

SEQ ID NO: 9490169 - DNA, 22 bp, Homo sapiens
ctgtgtgtgctacaggcttcca

SEQ ID NO: 9490170 - DNA, 22 bp, Homo sapiens
ctgtgtgtgctacaggcttcca

SEQ ID NO: 9490171 - DNA, 22 bp, Homo sapiens
ctgtgtgtgctacaggcttcca

SEQ ID NO: 9490172 - DNA, 22 bp, Homo sapiens
ctgtgtgtgctacaggcttcca

SEQ ID NO: 9490173 - DNA, 22 bp, Homo sapiens
ctgtgtgtgctacaggcttcca

SEQ ID NO: 9490174 - DNA, 22 bp, Homo sapiens
ctgtgtgtgtctgcagcatact

SEQ ID NO: 9490175 - DNA, 22 bp, Homo sapiens
ctgtgtgtgtctgcagcatact

SEQ ID NO: 9490176 - DNA, 22 bp, Homo sapiens
ctgtgtgtgtctgcagcatact

SEQ ID NO: 9490177 - DNA, 22 bp, Homo sapiens
ctgtgtgtgtctgcagcatact

SEQ ID NO: 9490178 - DNA, 22 bp, Homo sapiens
ctgtgtgtgtctgcagcatact

SEQ ID NO: 9490179 - DNA, 22 bp, Homo sapiens
ctgtgtgtgaacacagcccagc

SEQ ID NO: 9490180 - DNA, 22 bp, Homo sapiens
ctgtgtgtgaacacagcccagc

SEQ ID NO: 9490181 - DNA, 22 bp, Homo sapiens
ctgtgtgtgagaagcaggttga

SEQ ID NO: 9490182 - DNA, 22 bp, Homo sapiens
ctgtgtgtgagaagcaggttga

SEQ ID NO: 9490183 - DNA, 22 bp, Homo sapiens
ctgtgtgtgagaagcaggttga

SEQ ID NO: 9490184 - DNA, 23 bp, Homo sapiens
ctgtgtgtgccgagggtggccac

SEQ ID NO: 9490185 - DNA, 23 bp, Homo sapiens
ctgtgtgtgccgagggtggccac

SEQ ID NO: 9490186 - DNA, 23 bp, Homo sapiens
ctgtgtgtgccgagggtggccac

SEQ ID NO: 9490187 - DNA, 23 bp, Homo sapiens
ctgtgtgtgccgagggtggccac

SEQ ID NO: 9490188 - DNA, 23 bp, Homo sapiens
ctgtgtgtgccgagggtggccac

SEQ ID NO: 9490189 - DNA, 22 bp, Homo sapiens
ctgtgtgtgagaagcaggttga

SEQ ID NO: 9490190 - DNA, 23 bp, Homo sapiens
ctgtgtgtgccgagggtggccac

SEQ ID NO: 9490191 - DNA, 22 bp, Homo sapiens
ctgtgtgtttatatcatttcct

SEQ ID NO: 9490192 - DNA, 22 bp, Homo sapiens
ctgtgtgtttatatcatttcct

SEQ ID NO: 9490193 - DNA, 22 bp, Homo sapiens
ctgtgtgtttatatcatttcct

SEQ ID NO: 9490194 - DNA, 22 bp, Homo sapiens
ctgtgtgtttatatcatttcct

SEQ ID NO: 9490195 - DNA, 22 bp, Homo sapiens
ctgtgtttctcttgacccaagt

SEQ ID NO: 9490196 - DNA, 22 bp, Homo sapiens
ctgtgtttctaagtaaaggagc

SEQ ID NO: 9490197 - DNA, 22 bp, Homo sapiens
ctgtgttttgattaaaaagcaa

SEQ ID NO: 9490198 - DNA, 22 bp, Homo sapiens
ctgtgtttggacaacttttcag

SEQ ID NO: 9490199 - DNA, 22 bp, Homo sapiens
ctgtgtttttggtctgatctat

SEQ ID NO: 9490200 - DNA, 22 bp, Homo sapiens
ctgtgtttttggtctgatctat

SEQ ID NO: 9490201 - DNA, 22 bp, Homo sapiens
ctgtgtttgatgagaagccacc

SEQ ID NO: 9490202 - DNA, 22 bp, Homo sapiens
ctgtgtttgatgagaagccacc

SEQ ID NO: 9490203 - DNA, 22 bp, Homo sapiens
ctgtgtttgctatgcaaagaca

SEQ ID NO: 9490204 - DNA, 22 bp, Homo sapiens
tcctgcctcttgccttcttcac

SEQ ID NO: 9490205 - DNA, 22 bp, Homo sapiens
tcctgcctcttgccttcttcac

SEQ ID NO: 9490206 - DNA, 22 bp, Homo sapiens
tcctgcctcttttcttattcca

SEQ ID NO: 9490207 - DNA, 22 bp, Homo sapiens
tcctgcctgcaatcccagcact

SEQ ID NO: 9490208 - DNA, 22 bp, Homo sapiens
tcctgcctgcaatcccagcact

SEQ ID NO: 9490209 - DNA, 22 bp, Homo sapiens
tcctgcctgcaatcccagcact

SEQ ID NO: 9490210 - DNA, 22 bp, Homo sapiens
tcctgcctgcaatcccagcact

SEQ ID NO: 9490211 - DNA, 22 bp, Homo sapiens
tcctgcctgagcgtggaggagg

SEQ ID NO: 9490212 - DNA, 22 bp, Homo sapiens
tcctgcctgagcgtggaggagg

SEQ ID NO: 9490213 - DNA, 22 bp, Homo sapiens
tcctgcctagcaggtgacctat

SEQ ID NO: 9490214 - DNA, 22 bp, Homo sapiens
tcctgcctagcaggtgacctat

SEQ ID NO: 9490215 - DNA, 22 bp, Homo sapiens
tcctgcctaccttgcggaggtg

SEQ ID NO: 9490216 - DNA, 22 bp, Homo sapiens
tcctgcctcacagttgaagttt

SEQ ID NO: 9490217 - DNA, 22 bp, Homo sapiens
tcctgcctcacagttgaagttt

SEQ ID NO: 9490218 - DNA, 22 bp, Homo sapiens
tcctgcctcaggctctggagta

SEQ ID NO: 9490219 - DNA, 22 bp, Homo sapiens
tcctgcctcaggctctggagta

SEQ ID NO: 9490220 - DNA, 22 bp, Homo sapiens
tcctgcctctccatgctaacta

SEQ ID NO: 9490221 - DNA, 22 bp, Homo sapiens
tcctgcctcaggctctggagta

SEQ ID NO: 9490222 - DNA, 22 bp, Homo sapiens
tcctgcagccttgggctggagc

SEQ ID NO: 9490223 - DNA, 22 bp, Homo sapiens
tcctgcagctgcagacctgggg

SEQ ID NO: 9490224 - DNA, 22 bp, Homo sapiens
tcctgcagctgaagctcatgtg

SEQ ID NO: 9490225 - DNA, 22 bp, Homo sapiens
tcctgcagctgcagacctgggg

SEQ ID NO: 9490226 - DNA, 22 bp, Homo sapiens
tcctgcagctgcagacctgggg

SEQ ID NO: 9490227 - DNA, 18 bp, Homo sapiens
tcctgcagcttctatgta

SEQ ID NO: 9490228 - DNA, 21 bp, Homo sapiens
tcctgcaggaggcctgagagg

SEQ ID NO: 9490229 - DNA, 21 bp, Homo sapiens
tcctgcaggaggcctgagagg

SEQ ID NO: 9490230 - DNA, 22 bp, Homo sapiens
tcctgcaggccagaggggtgag

SEQ ID NO: 9490231 - DNA, 22 bp, Homo sapiens
tcctgcaggccagaggggtgag

SEQ ID NO: 9490232 - DNA, 22 bp, Homo sapiens
tcctgcaggcctgttcccagta

SEQ ID NO: 9490233 - DNA, 22 bp, Homo sapiens
tcctgcaggcttgagtcctcag

SEQ ID NO: 9490234 - DNA, 22 bp, Homo sapiens
tcctgcaggggctgaggaacca

SEQ ID NO: 9490235 - DNA, 19 bp, Homo sapiens
tcctgcaggtggcttgcag

SEQ ID NO: 9490236 - DNA, 19 bp, Homo sapiens
tcctgcaggtggcttgcag

SEQ ID NO: 9490237 - DNA, 22 bp, Homo sapiens
tcctgcaggcttgagtcctcag

SEQ ID NO: 9490238 - DNA, 22 bp, Homo sapiens
tcctgcaggcttgagtcctcag

SEQ ID NO: 9490239 - DNA, 21 bp, Homo sapiens
tcctgcagggcagcagagtgg

SEQ ID NO: 9490240 - DNA, 21 bp, Homo sapiens
tcctgcagggcagcagagtgg

SEQ ID NO: 9490241 - DNA, 21 bp, Homo sapiens
tcctgcagggcagcagagtgg

SEQ ID NO: 9490242 - DNA, 22 bp, Homo sapiens
tcctgccctcgggggtgttcca

SEQ ID NO: 9490243 - DNA, 22 bp, Homo sapiens
tcctgccctgaaaagtcagtct

SEQ ID NO: 9490244 - DNA, 20 bp, Homo sapiens
tcctgcagtcgctagcgccc

SEQ ID NO: 9490245 - DNA, 20 bp, Homo sapiens
tcctgcagtcgctagcgccc

SEQ ID NO: 9490246 - DNA, 22 bp, Homo sapiens
tcctgcccagagctctccactc

SEQ ID NO: 9490247 - DNA, 22 bp, Homo sapiens
tcctgcagccactgcaggcaga

SEQ ID NO: 9490248 - DNA, 22 bp, Homo sapiens
tcctgcagccactgcaggcaga

SEQ ID NO: 9490249 - DNA, 22 bp, Homo sapiens
tcctgcagccttgggctggagc

SEQ ID NO: 9490250 - DNA, 22 bp, Homo sapiens
tcctgcagccattagaggtcaa

SEQ ID NO: 9490251 - DNA, 22 bp, Homo sapiens
tcctgcagccaagggtcatcga

SEQ ID NO: 9490252 - DNA, 22 bp, Homo sapiens
tcctgcagccactgcaggcaga

SEQ ID NO: 9490253 - DNA, 22 bp, Homo sapiens
tcctgcagccaagggtcatcga

SEQ ID NO: 9490254 - DNA, 22 bp, Homo sapiens
tcctgcagagacagaggcctca

SEQ ID NO: 9490255 - DNA, 22 bp, Homo sapiens
tcctgcagagacagaggcctca

SEQ ID NO: 9490256 - DNA, 22 bp, Homo sapiens
tcctgcagagacagaggcctca

SEQ ID NO: 9490257 - DNA, 22 bp, Homo sapiens
tcctgcagagccgccctcaggt

SEQ ID NO: 9490258 - DNA, 22 bp, Homo sapiens
tcctgcagagtcccactgattt

SEQ ID NO: 9490259 - DNA, 22 bp, Homo sapiens
tcctgcagatcaaagcctttga

SEQ ID NO: 9490260 - DNA, 22 bp, Homo sapiens
tcctgcacactgatgagatcac

SEQ ID NO: 9490261 - DNA, 22 bp, Homo sapiens
tcctgcacagttggtgcttgaa

SEQ ID NO: 9490262 - DNA, 22 bp, Homo sapiens
tcctgcacaccttgagcttgga

SEQ ID NO: 9490263 - DNA, 21 bp, Homo sapiens
tcctgcagaatgccttcctac

SEQ ID NO: 9490264 - DNA, 22 bp, Homo sapiens
tcctgcagacatttacaccttt

SEQ ID NO: 9490265 - DNA, 19 bp, Homo sapiens
tcctgcagaccagacctgt

SEQ ID NO: 9490266 - DNA, 19 bp, Homo sapiens
tcctgcagaccagacctgt

SEQ ID NO: 9490267 - DNA, 19 bp, Homo sapiens
tcctgcagaccagacctgt

SEQ ID NO: 9490268 - DNA, 22 bp, Homo sapiens
tcctgcagacctcagtcaggtc

SEQ ID NO: 9490269 - DNA, 22 bp, Homo sapiens
tcctgcagacctcagtcaggtc

SEQ ID NO: 9490270 - DNA, 22 bp, Homo sapiens
tcctgcagagacagaggcctca

SEQ ID NO: 9490271 - DNA, 22 bp, Homo sapiens
tcctgcagacctcagtcaggtc

SEQ ID NO: 9490272 - DNA, 22 bp, Homo sapiens
tcctgagctgacacttggggag

SEQ ID NO: 9490273 - DNA, 22 bp, Homo sapiens
tcctgagctgacacttggggag

SEQ ID NO: 9490274 - DNA, 22 bp, Homo sapiens
tcctgaggaaagttcatgaatg

SEQ ID NO: 9490275 - DNA, 23 bp, Homo sapiens
tcctgaggaatggcatctcacat

SEQ ID NO: 9490276 - DNA, 23 bp, Homo sapiens
tcctgaggaatggcatctcacat

SEQ ID NO: 9490277 - DNA, 22 bp, Homo sapiens
tcctgaggactaacaggaagga

SEQ ID NO: 9490278 - DNA, 22 bp, Homo sapiens
tcctgatggaggggtcatcttt

SEQ ID NO: 9490279 - DNA, 22 bp, Homo sapiens
tcctgagtgagagctgggaggt

SEQ ID NO: 9490280 - DNA, 22 bp, Homo sapiens
tcctgagtgagagctgggaggt

SEQ ID NO: 9490281 - DNA, 22 bp, Homo sapiens
tcctgaggctaaagtgcagtgg

SEQ ID NO: 9490282 - DNA, 22 bp, Homo sapiens
tcctgaggctaaagtgcagtgg

SEQ ID NO: 9490283 - DNA, 22 bp, Homo sapiens
tcctgaggtggattgagcagag

SEQ ID NO: 9490284 - DNA, 22 bp, Homo sapiens
tcctgagtgagagctgggaggt

SEQ ID NO: 9490285 - DNA, 22 bp, Homo sapiens
tcctgaggcctctgtgatgtga

SEQ ID NO: 9490286 - DNA, 22 bp, Homo sapiens
tcctgaggctaaagtgcagtgg

SEQ ID NO: 9490287 - DNA, 22 bp, Homo sapiens
tcctgaggctaaagtgcagtgg

SEQ ID NO: 9490288 - DNA, 22 bp, Homo sapiens
tcctgaggcacaatcctagaat

SEQ ID NO: 9490289 - DNA, 22 bp, Homo sapiens
tcctgaggagaagagtgctagg

SEQ ID NO: 9490290 - DNA, 22 bp, Homo sapiens
tcctgagctacagtagtatgat

SEQ ID NO: 9490291 - DNA, 22 bp, Homo sapiens
tcctgagccctggggtcagtgt

SEQ ID NO: 9490292 - DNA, 22 bp, Homo sapiens
tcctgagccctgtaggaccctg

SEQ ID NO: 9490293 - DNA, 20 bp, Homo sapiens
tcctgagcctccaccatgtc

SEQ ID NO: 9490294 - DNA, 22 bp, Homo sapiens
tcctgagccctggggtcagtgt

SEQ ID NO: 9490295 - DNA, 22 bp, Homo sapiens
tcctgagccctggggtcagtgt

SEQ ID NO: 9490296 - DNA, 22 bp, Homo sapiens
tcctgagccccagggaggttgg

SEQ ID NO: 9490297 - DNA, 20 bp, Homo sapiens
tcctgagatttaaggggttc

SEQ ID NO: 9490298 - DNA, 20 bp, Homo sapiens
tcctgagatttaaggggttc

SEQ ID NO: 9490299 - DNA, 22 bp, Homo sapiens
tcctgagatgtggagctccatg

SEQ ID NO: 9490300 - DNA, 22 bp, Homo sapiens
tcctgagattctgcatttctaa

SEQ ID NO: 9490301 - DNA, 22 bp, Homo sapiens
tcctgagatgagacagtgctgc

SEQ ID NO: 9490302 - DNA, 23 bp, Homo sapiens
tcctgagatgagacagtgctgcc

SEQ ID NO: 9490303 - DNA, 23 bp, Homo sapiens
tcctgagatgagacagtgctgcc

SEQ ID NO: 9490304 - DNA, 23 bp, Homo sapiens
tcctgagatgagacagtgctgcc

SEQ ID NO: 9490305 - DNA, 22 bp, Homo sapiens
tcctgagatgagacagtgctgc

SEQ ID NO: 9490306 - DNA, 22 bp, Homo sapiens
tcctgagatgagacagtgctgc

SEQ ID NO: 9490307 - DNA, 22 bp, Homo sapiens
tcctgagatccttttagggatc

SEQ ID NO: 9490308 - DNA, 22 bp, Homo sapiens
tcctgagatccttttagggatc

SEQ ID NO: 9490309 - DNA, 22 bp, Homo sapiens
tcctgagatccttttagggatc

SEQ ID NO: 9490310 - DNA, 22 bp, Homo sapiens
tcctgagataaatctcatgtga

SEQ ID NO: 9490311 - DNA, 22 bp, Homo sapiens
tcctgagataaatctcatgtga

SEQ ID NO: 9490312 - DNA, 22 bp, Homo sapiens
tcctgagaggtttataacgcag

SEQ ID NO: 9490313 - DNA, 22 bp, Homo sapiens
tcctctggttatacttgcaccc

SEQ ID NO: 9490314 - DNA, 22 bp, Homo sapiens
tcctcttcaaaaggatttcctt

SEQ ID NO: 9490315 - DNA, 22 bp, Homo sapiens
tcctcttcagagggacctcggg

SEQ ID NO: 9490316 - DNA, 22 bp, Homo sapiens
tcctcttcaaaatagctctgaa

SEQ ID NO: 9490317 - DNA, 22 bp, Homo sapiens
tcctcttcaaaatagctctgaa

SEQ ID NO: 9490318 - DNA, 22 bp, Homo sapiens
tcctctttctcaacattagtta

SEQ ID NO: 9490319 - DNA, 22 bp, Homo sapiens
tcctcttctgtggattccctga

SEQ ID NO: 9490320 - DNA, 22 bp, Homo sapiens
tcctcttctgcctatatctgcc

SEQ ID NO: 9490321 - DNA, 22 bp, Homo sapiens
tcctcttctgcctatatctgcc

SEQ ID NO: 9490322 - DNA, 22 bp, Homo sapiens
tcctctggggtcagggcactac

SEQ ID NO: 9490323 - DNA, 22 bp, Homo sapiens
tcctctggtacttaaagtgctt

SEQ ID NO: 9490324 - DNA, 22 bp, Homo sapiens
tcctctggtcctgcagcagatc

SEQ ID NO: 9490325 - DNA, 22 bp, Homo sapiens
tcctctggttatacttgcaccc

SEQ ID NO: 9490326 - DNA, 22 bp, Homo sapiens
tcctctgggctccctgcaacag

SEQ ID NO: 9490327 - DNA, 22 bp, Homo sapiens
tcctctggggcgtggtcctgga

SEQ ID NO: 9490328 - DNA, 22 bp, Homo sapiens
tcctctggggcgtggtcctgga

SEQ ID NO: 9490329 - DNA, 22 bp, Homo sapiens
tcctctgggctccctgcaacag

SEQ ID NO: 9490330 - DNA, 22 bp, Homo sapiens
tcctcagtaaggatcgtcagct

SEQ ID NO: 9490331 - DNA, 22 bp, Homo sapiens
tcctcaggtgactaggtatctt

SEQ ID NO: 9490332 - DNA, 22 bp, Homo sapiens
tcctctgggcctatttgttcac

SEQ ID NO: 9490333 - DNA, 22 bp, Homo sapiens
tcctcaggtgactaggtatctt

SEQ ID NO: 9490334 - DNA, 22 bp, Homo sapiens
tcctcaggtgactaggtatctt

SEQ ID NO: 9490335 - DNA, 22 bp, Homo sapiens
tcctcaggtcaaagcaggagaa

SEQ ID NO: 9490336 - DNA, 22 bp, Homo sapiens
tcctgaaattctggttgtcact

SEQ ID NO: 9490337 - DNA, 22 bp, Homo sapiens
tcctgaaatttgttttaattct

SEQ ID NO: 9490338 - DNA, 22 bp, Homo sapiens
tcctgaaatgtgcacatgacat

SEQ ID NO: 9490339 - DNA, 22 bp, Homo sapiens
tcctgaaaataatttcacaaga

SEQ ID NO: 9490340 - DNA, 19 bp, Homo sapiens
tcctgaaaacttctggaat

SEQ ID NO: 9490341 - DNA, 19 bp, Homo sapiens
tcctgaaaacttctggaat

SEQ ID NO: 9490342 - DNA, 22 bp, Homo sapiens
tcctgaaaaattacatgttcag

SEQ ID NO: 9490343 - DNA, 22 bp, Homo sapiens
tcctgaagaacgaagtcatgta

SEQ ID NO: 9490344 - DNA, 22 bp, Homo sapiens
tcctgaagagccctgctctgtg

SEQ ID NO: 9490345 - DNA, 22 bp, Homo sapiens
tcctgaagaaggcagatatttg

SEQ ID NO: 9490346 - DNA, 22 bp, Homo sapiens
tcctgaagaaggcagatatttg

SEQ ID NO: 9490347 - DNA, 22 bp, Homo sapiens
tcctgaagatgaaaagagaggt

SEQ ID NO: 9490348 - DNA, 22 bp, Homo sapiens
tcctgaagcagttagcatgagc

SEQ ID NO: 9490349 - DNA, 22 bp, Homo sapiens
tcctgaagcctgagtgatgact

SEQ ID NO: 9490350 - DNA, 22 bp, Homo sapiens
tcctgaagctctcttaaggaaa

SEQ ID NO: 9490351 - DNA, 22 bp, Homo sapiens
tcctgaaggcagatggggatca

SEQ ID NO: 9490352 - DNA, 22 bp, Homo sapiens
tcctgaaggagcagttgctggg

SEQ ID NO: 9490353 - DNA, 22 bp, Homo sapiens
tcctgaaggcctgagttccacc

SEQ ID NO: 9490354 - DNA, 22 bp, Homo sapiens
tcctgagaatagagttgcatgt

SEQ ID NO: 9490355 - DNA, 22 bp, Homo sapiens
tcctgagacatctctgctggtc

SEQ ID NO: 9490356 - DNA, 22 bp, Homo sapiens
tcctgagagcagctgctttgga

SEQ ID NO: 9490357 - DNA, 22 bp, Homo sapiens
tcctgagagcagctgctttgga

SEQ ID NO: 9490358 - DNA, 20 bp, Homo sapiens
tcctgagaggctcttggaga

SEQ ID NO: 9490359 - DNA, 22 bp, Homo sapiens
tcctgagagccttggcttcaga

SEQ ID NO: 9490360 - DNA, 22 bp, Homo sapiens
tcctgagagccttggcttcaga

SEQ ID NO: 9490361 - DNA, 22 bp, Homo sapiens
tcctgagacatctctgctggtc

SEQ ID NO: 9490362 - DNA, 22 bp, Homo sapiens
tcctgagacatctctgctggtc

SEQ ID NO: 9490363 - DNA, 20 bp, Homo sapiens
tcctgagacctgggaaggtt

SEQ ID NO: 9490364 - DNA, 22 bp, Homo sapiens
tccctcagacagatgtgttcct

SEQ ID NO: 9490365 - DNA, 22 bp, Homo sapiens
tccctcagacagatgtgttcct

SEQ ID NO: 9490366 - DNA, 18 bp, Homo sapiens
tccctcagaattatagaa

SEQ ID NO: 9490367 - DNA, 18 bp, Homo sapiens
tccctcagaattatagaa

SEQ ID NO: 9490368 - DNA, 21 bp, Homo sapiens
tccctcagaaggtagccaagc

SEQ ID NO: 9490369 - DNA, 22 bp, Homo sapiens
tcccgcttcttccgaatcgcga

SEQ ID NO: 9490370 - DNA, 21 bp, Homo sapiens
tccctcagaagctcttggtca

SEQ ID NO: 9490371 - DNA, 22 bp, Homo sapiens
tcccgataggcagggctctggc

SEQ ID NO: 9490372 - DNA, 22 bp, Homo sapiens
tccccttggcttggtcaagagg

SEQ ID NO: 9490373 - DNA, 22 bp, Homo sapiens
tccccttggcttggtcaagagg

SEQ ID NO: 9490374 - DNA, 22 bp, Homo sapiens
tcccagggacccagcctgatac

SEQ ID NO: 9490375 - DNA, 22 bp, Homo sapiens
tcccagggacccagcctgatac

SEQ ID NO: 9490376 - DNA, 22 bp, Homo sapiens
tcccagggacaccaagctgttt

SEQ ID NO: 9490377 - DNA, 22 bp, Homo sapiens
tcccagggactggatgatgcag

SEQ ID NO: 9490378 - DNA, 22 bp, Homo sapiens
tcccagggactctctgccttcc

SEQ ID NO: 9490379 - DNA, 22 bp, Homo sapiens
tcccctggcacctagtcctact

SEQ ID NO: 9490380 - DNA, 22 bp, Homo sapiens
tccctcagattggcaattagat

SEQ ID NO: 9490381 - DNA, 22 bp, Homo sapiens
tccctcagattggcaattagat

SEQ ID NO: 9490382 - DNA, 20 bp, Homo sapiens
tccctcagcacttctacctc

SEQ ID NO: 9490383 - DNA, 22 bp, Homo sapiens
tccctcagattggcaattagat

SEQ ID NO: 9490384 - DNA, 22 bp, Homo sapiens
tccctcagcaggaactggcctg

SEQ ID NO: 9490385 - DNA, 22 bp, Homo sapiens
tccctcagcaggaactggcctg

SEQ ID NO: 9490386 - DNA, 22 bp, Homo sapiens
tccctcagcaggaactggcctg

SEQ ID NO: 9490387 - DNA, 22 bp, Homo sapiens
tccctcagcaggaatgtggcag

SEQ ID NO: 9490388 - DNA, 22 bp, Homo sapiens
tccctcagcaggaatgtggcag

SEQ ID NO: 9490389 - DNA, 22 bp, Homo sapiens
tccctcagcaggaatgtggcag

SEQ ID NO: 9490390 - DNA, 22 bp, Homo sapiens
tccctcagcaggaactggcctg

SEQ ID NO: 9490391 - DNA, 21 bp, Homo sapiens
tccctcagacagggtgcctat

SEQ ID NO: 9490392 - DNA, 21 bp, Homo sapiens
tccctcagacagggtgcctat

SEQ ID NO: 9490393 - DNA, 21 bp, Homo sapiens
tccctcagacagggtgcctat

SEQ ID NO: 9490394 - DNA, 22 bp, Homo sapiens
tccctcagagaccgtggtgcag

SEQ ID NO: 9490395 - DNA, 21 bp, Homo sapiens
tccctcagacagggtgcctat

SEQ ID NO: 9490396 - DNA, 22 bp, Homo sapiens
tccctcagagggcaagcgcaga

SEQ ID NO: 9490397 - DNA, 22 bp, Homo sapiens
tccctcagatgagctcctagca

SEQ ID NO: 9490398 - DNA, 22 bp, Homo sapiens
tccctcagatgagctcctagca

SEQ ID NO: 9490399 - DNA, 22 bp, Homo sapiens
tccctcagatgagctcctagca

SEQ ID NO: 9490400 - DNA, 22 bp, Homo sapiens
tccctcagatgagctcctagca

SEQ ID NO: 9490401 - DNA, 22 bp, Homo sapiens
tcccaggctggggccaggtgac

SEQ ID NO: 9490402 - DNA, 22 bp, Homo sapiens
tcccaggctggggccaggtgac

SEQ ID NO: 9490403 - DNA, 22 bp, Homo sapiens
tcccaggctggggccaggtgac

SEQ ID NO: 9490404 - DNA, 20 bp, Homo sapiens
tcccaggctgggctccagct

SEQ ID NO: 9490405 - DNA, 20 bp, Homo sapiens
tcccaggctgggctccagct

SEQ ID NO: 9490406 - DNA, 20 bp, Homo sapiens
tcccaggctgggctccagct

SEQ ID NO: 9490407 - DNA, 20 bp, Homo sapiens
tcccaggctgggctccagct

SEQ ID NO: 9490408 - DNA, 22 bp, Homo sapiens
tcccaggctgggggcctgaagt

SEQ ID NO: 9490409 - DNA, 22 bp, Homo sapiens
tcccaggctgggggcctgaagt

SEQ ID NO: 9490410 - DNA, 23 bp, Homo sapiens
tcccagggaaggtgagcgaggct

SEQ ID NO: 9490411 - DNA, 23 bp, Homo sapiens
tcccagggaaggtgagcgaggct

SEQ ID NO: 9490412 - DNA, 23 bp, Homo sapiens
tcccagggaaggtgagcgaggct

SEQ ID NO: 9490413 - DNA, 23 bp, Homo sapiens
tcccagggaaggtgagcgaggct

SEQ ID NO: 9490414 - DNA, 23 bp, Homo sapiens
tcccagggaaggtgagcgaggct

SEQ ID NO: 9490415 - DNA, 22 bp, Homo sapiens
tcccagggacaccaagctgttt

SEQ ID NO: 9490416 - DNA, 22 bp, Homo sapiens
tcccagggacaccaagctgttt

SEQ ID NO: 9490417 - DNA, 22 bp, Homo sapiens
tcccaggctaccagtgaggtca

SEQ ID NO: 9490418 - DNA, 22 bp, Homo sapiens
tcccaggctaccagtgaggtca

SEQ ID NO: 9490419 - DNA, 22 bp, Homo sapiens
tcccaggctaggcctctgcgtt

SEQ ID NO: 9490420 - DNA, 22 bp, Homo sapiens
tcccaggctaggcctctgcgtt

SEQ ID NO: 9490421 - DNA, 22 bp, Homo sapiens
tcccaggctaggcctctgcgtt

SEQ ID NO: 9490422 - DNA, 20 bp, Homo sapiens
tcccaggctccaccctagac

SEQ ID NO: 9490423 - DNA, 20 bp, Homo sapiens
tcccaggctccaccctagac

SEQ ID NO: 9490424 - DNA, 22 bp, Homo sapiens
tcccaggctggcaggcagcagt

SEQ ID NO: 9490425 - DNA, 22 bp, Homo sapiens
tcccaggctggcaggcagcagt

SEQ ID NO: 9490426 - DNA, 20 bp, Homo sapiens
tcccaggctccaccctagac

SEQ ID NO: 9490427 - DNA, 20 bp, Homo sapiens
tcccaggctccaccctagac

SEQ ID NO: 9490428 - DNA, 20 bp, Homo sapiens
tccctccctccagctctggg

SEQ ID NO: 9490429 - DNA, 18 bp, Homo sapiens
tccctccctgctgtggcc

SEQ ID NO: 9490430 - DNA, 20 bp, Homo sapiens
tccctccctccagctctggg

SEQ ID NO: 9490431 - DNA, 18 bp, Homo sapiens
tccctccctgctgtggcc

SEQ ID NO: 9490432 - DNA, 19 bp, Homo sapiens
tccctccctgtaatctcac

SEQ ID NO: 9490433 - DNA, 18 bp, Homo sapiens
tccctccctgctgtggcc

SEQ ID NO: 9490434 - DNA, 22 bp, Homo sapiens
tccctctggaggctctagggga

SEQ ID NO: 9490435 - DNA, 22 bp, Homo sapiens
tccctctgctagtgcttgagct

SEQ ID NO: 9490436 - DNA, 22 bp, Homo sapiens
tccctgaaatttgaagaggaat

SEQ ID NO: 9490437 - DNA, 22 bp, Homo sapiens
tccctgaaatttgaagaggaat

SEQ ID NO: 9490438 - DNA, 22 bp, Homo sapiens
tccctgaaacatctctgtggat

SEQ ID NO: 9490439 - DNA, 22 bp, Homo sapiens
tccctgaagccagggaaggaag

SEQ ID NO: 9490440 - DNA, 22 bp, Homo sapiens
tccctctgtggttggttctgtc

SEQ ID NO: 9490441 - DNA, 22 bp, Homo sapiens
tccctgccctgccttcatggtt

SEQ ID NO: 9490442 - DNA, 22 bp, Homo sapiens
tccctgccctgccttcatggtt

SEQ ID NO: 9490443 - DNA, 22 bp, Homo sapiens
tccctgccctgccttcatggtt

SEQ ID NO: 9490444 - DNA, 22 bp, Homo sapiens
tccctgcctcctggcagtgcca

SEQ ID NO: 9490445 - DNA, 22 bp, Homo sapiens
tccctgcctcctggcagtgcca

SEQ ID NO: 9490446 - DNA, 22 bp, Homo sapiens
tccctgagagcactggggagcc

SEQ ID NO: 9490447 - DNA, 22 bp, Homo sapiens
tccctgagagcactggggagcc

SEQ ID NO: 9490448 - DNA, 22 bp, Homo sapiens
tccctgagactctggagtgtaa

SEQ ID NO: 9490449 - DNA, 22 bp, Homo sapiens
tccctgagactctggagtgtaa

SEQ ID NO: 9490450 - DNA, 22 bp, Homo sapiens
tccctgagaaagcccaggaggt

SEQ ID NO: 9490451 - DNA, 22 bp, Homo sapiens
tccctgagaaagcccaggaggt

SEQ ID NO: 9490452 - DNA, 22 bp, Homo sapiens
tccctccataacagaggtgagc

SEQ ID NO: 9490453 - DNA, 22 bp, Homo sapiens
tccctccccacttctgagcttt

SEQ ID NO: 9490454 - DNA, 20 bp, Homo sapiens
tccctccctccagctctggg

SEQ ID NO: 9490455 - DNA, 20 bp, Homo sapiens
tccctccctccagctctggg

SEQ ID NO: 9490456 - DNA, 22 bp, Homo sapiens
tccctccccacttctgagcttt

SEQ ID NO: 9490457 - DNA, 20 bp, Homo sapiens
tccctcagtttccagccctg

SEQ ID NO: 9490458 - DNA, 20 bp, Homo sapiens
tccctcagtttccagccctg

SEQ ID NO: 9490459 - DNA, 22 bp, Homo sapiens
tccctccagaatggtgaggaag

SEQ ID NO: 9490460 - DNA, 22 bp, Homo sapiens
tccctccagaatggtgaggaag

SEQ ID NO: 9490461 - DNA, 22 bp, Homo sapiens
tccctccacacctgctggtacc

SEQ ID NO: 9490462 - DNA, 20 bp, Homo sapiens
tccctcagtcctggctttgt

SEQ ID NO: 9490463 - DNA, 20 bp, Homo sapiens
tccctcagtcctggctttgt

SEQ ID NO: 9490464 - DNA, 19 bp, Homo sapiens
tccctcagtctgccaggcc

SEQ ID NO: 9490465 - DNA, 19 bp, Homo sapiens
tccctcagtctgccaggcc

SEQ ID NO: 9490466 - DNA, 19 bp, Homo sapiens
tccctcagtctgccaggcc

SEQ ID NO: 9490467 - DNA, 23 bp, Homo sapiens
tccctcaggccttatctccatct

SEQ ID NO: 9490468 - DNA, 23 bp, Homo sapiens
tccctcaggccttatctccatct

SEQ ID NO: 9490469 - DNA, 22 bp, Homo sapiens
tccctcagggtgcagttgcttt

SEQ ID NO: 9490470 - DNA, 20 bp, Homo sapiens
tccctcaggtcattgggctg

SEQ ID NO: 9490471 - DNA, 20 bp, Homo sapiens
tccctcaggtcattgggctg

SEQ ID NO: 9490472 - DNA, 22 bp, Homo sapiens
tccctcagggtgcagttgcttt

SEQ ID NO: 9490473 - DNA, 22 bp, Homo sapiens
tccctcagtccctggacaggca

SEQ ID NO: 9490474 - DNA, 22 bp, Homo sapiens
tccctcagtccctggacaggca

SEQ ID NO: 9490475 - DNA, 22 bp, Homo sapiens
tccctcagtccctggacaggca

SEQ ID NO: 9490476 - DNA, 22 bp, Homo sapiens
tccctcagtccctggacaggca

SEQ ID NO: 9490477 - DNA, 22 bp, Homo sapiens
tccctcaggtggttcttgtttc

SEQ ID NO: 9490478 - DNA, 22 bp, Homo sapiens
tccctcaggtggttcttgtttc

SEQ ID NO: 9490479 - DNA, 22 bp, Homo sapiens
tccctcaggacccaacttgtaa

SEQ ID NO: 9490480 - DNA, 23 bp, Homo sapiens
tccctcaggccttatctccatct

SEQ ID NO: 9490481 - DNA, 23 bp, Homo sapiens
tccctcaggccttatctccatct

SEQ ID NO: 9490482 - DNA, 22 bp, Homo sapiens
tccctcagcttgtctccatgca

SEQ ID NO: 9490483 - DNA, 22 bp, Homo sapiens
tccctcagcttgtctccatgca

SEQ ID NO: 9490484 - DNA, 22 bp, Homo sapiens
tccctcagctcatatttatgcc

SEQ ID NO: 9490485 - DNA, 15 bp, Homo sapiens
tccctcagctaaaga

SEQ ID NO: 9490486 - DNA, 22 bp, Homo sapiens
tccctcagctcatatttatgcc

SEQ ID NO: 9490487 - DNA, 22 bp, Homo sapiens
tccctcagcttgtctccatgca

SEQ ID NO: 9490488 - DNA, 22 bp, Homo sapiens
tccctcagcttgtctccatgca

SEQ ID NO: 9490489 - DNA, 22 bp, Homo sapiens
tccctcagcttgtctccatgca

SEQ ID NO: 9490490 - DNA, 19 bp, Homo sapiens
tcctcaggggctcacagac

SEQ ID NO: 9490491 - DNA, 19 bp, Homo sapiens
tcctcaggggctcacagac

SEQ ID NO: 9490492 - DNA, 19 bp, Homo sapiens
tcctcaggggctcacagac

SEQ ID NO: 9490493 - DNA, 22 bp, Homo sapiens
tcctcagggcggcctccgtctt

SEQ ID NO: 9490494 - DNA, 21 bp, Homo sapiens
tcctcagggccccagagcact

SEQ ID NO: 9490495 - DNA, 22 bp, Homo sapiens
tcctcagggaagatgagcctca

SEQ ID NO: 9490496 - DNA, 21 bp, Homo sapiens
tcctcagggccccagagcact

SEQ ID NO: 9490497 - DNA, 21 bp, Homo sapiens
tcctcagggccccagagcact

SEQ ID NO: 9490498 - DNA, 21 bp, Homo sapiens
tcctcagggccccagagcact

SEQ ID NO: 9490499 - DNA, 19 bp, Homo sapiens
tcctcaggggctcacagac

SEQ ID NO: 9490500 - DNA, 19 bp, Homo sapiens
tcctcaggggctcacagac

SEQ ID NO: 9490501 - DNA, 22 bp, Homo sapiens
tcctcaggggtttcaggtgtac

SEQ ID NO: 9490502 - DNA, 22 bp, Homo sapiens
tcctcaggtcaaagcaggagaa

SEQ ID NO: 9490503 - DNA, 22 bp, Homo sapiens
tcctcaggtcaaagcaggagaa

SEQ ID NO: 9490504 - DNA, 22 bp, Homo sapiens
tcctcaggtcaaagcaggagaa

SEQ ID NO: 9490505 - DNA, 22 bp, Homo sapiens
tcctcaggggtttcaggtgtac

SEQ ID NO: 9490506 - DNA, 22 bp, Homo sapiens
tcctcaggggtttcaggtgtac

SEQ ID NO: 9490507 - DNA, 23 bp, Homo sapiens
tcctcagcatgttttgtcatgta

SEQ ID NO: 9490508 - DNA, 23 bp, Homo sapiens
tcctcagcatgttttgtcatgta

SEQ ID NO: 9490509 - DNA, 23 bp, Homo sapiens
tcctcagcatgttttgtcatgta

SEQ ID NO: 9490510 - DNA, 22 bp, Homo sapiens
tcctcagcaggtctgtgtacca

SEQ ID NO: 9490511 - DNA, 22 bp, Homo sapiens
tcctcagcaggtctgtgtacca

SEQ ID NO: 9490512 - DNA, 22 bp, Homo sapiens
tcctcagacaccctgctggctt

SEQ ID NO: 9490513 - DNA, 22 bp, Homo sapiens
tcctcagagatgggcatctaag

SEQ ID NO: 9490514 - DNA, 22 bp, Homo sapiens
tcctcagatataaatgagggtg

SEQ ID NO: 9490515 - DNA, 22 bp, Homo sapiens
tcctcacatggtgagccacaca

SEQ ID NO: 9490516 - DNA, 22 bp, Homo sapiens
tcctcactgcagtgctccgagc

SEQ ID NO: 9490517 - DNA, 22 bp, Homo sapiens
tcctcacagtcaacactttgag

SEQ ID NO: 9490518 - DNA, 22 bp, Homo sapiens
tcctcacagggcaggaaggagg

SEQ ID NO: 9490519 - DNA, 22 bp, Homo sapiens
tcctcagaaacccctgtgaggt

SEQ ID NO: 9490520 - DNA, 22 bp, Homo sapiens
tcctcagaatcacctggcagct

SEQ ID NO: 9490521 - DNA, 22 bp, Homo sapiens
tcctcagaatcacctggcagct

SEQ ID NO: 9490522 - DNA, 22 bp, Homo sapiens
tcctcagaatggatggcagggg

SEQ ID NO: 9490523 - DNA, 22 bp, Homo sapiens
tcctcacagcatgaccaggcag

SEQ ID NO: 9490524 - DNA, 22 bp, Homo sapiens
tcctcacagctggttcattcag

SEQ ID NO: 9490525 - DNA, 22 bp, Homo sapiens
tcctcacagagtggcaggcaat

SEQ ID NO: 9490526 - DNA, 22 bp, Homo sapiens
tcctcacagatgggtgcatagc

SEQ ID NO: 9490527 - DNA, 22 bp, Homo sapiens
tcctcacactatagatgaggat

SEQ ID NO: 9490528 - DNA, 22 bp, Homo sapiens
tcctcacaagcatcctgtctca

SEQ ID NO: 9490529 - DNA, 22 bp, Homo sapiens
tcctcacaagcaagcacaggta

SEQ ID NO: 9490530 - DNA, 22 bp, Homo sapiens
tcctcaaagttgtataaatatt

SEQ ID NO: 9490531 - DNA, 22 bp, Homo sapiens
tcctatgttttcccctagagaa

SEQ ID NO: 9490532 - DNA, 22 bp, Homo sapiens
tccctggaacagagagacaacg

SEQ ID NO: 9490533 - DNA, 22 bp, Homo sapiens
tccctggacaacagacttcact

SEQ ID NO: 9490534 - DNA, 22 bp, Homo sapiens
tccctggacaacagacttcact

SEQ ID NO: 9490535 - DNA, 22 bp, Homo sapiens
tccctggaacagagagacaacg

SEQ ID NO: 9490536 - DNA, 22 bp, Homo sapiens
tccctggagataacttctggga

SEQ ID NO: 9490537 - DNA, 22 bp, Homo sapiens
tccctggacaacagacttcact

SEQ ID NO: 9490538 - DNA, 20 bp, Homo sapiens
tccctggaggtggtggcatc

SEQ ID NO: 9490539 - DNA, 20 bp, Homo sapiens
tccctggaggtggtggcatc

SEQ ID NO: 9490540 - DNA, 23 bp, Homo sapiens
tccctggaggcaggtccagggcc

SEQ ID NO: 9490541 - DNA, 22 bp, Homo sapiens
tccctggaggtgtttgctcagg

SEQ ID NO: 9490542 - DNA, 20 bp, Homo sapiens
tccctggaggtggtggcatc

SEQ ID NO: 9490543 - DNA, 22 bp, Homo sapiens
tccctggccattcctctaggcc

SEQ ID NO: 9490544 - DNA, 22 bp, Homo sapiens
tccctggccattcctctaggcc

SEQ ID NO: 9490545 - DNA, 23 bp, Homo sapiens
tccctggccgcaatggccgcctt

SEQ ID NO: 9490546 - DNA, 22 bp, Homo sapiens
tccctggctgtgttcaggtgcg

SEQ ID NO: 9490547 - DNA, 22 bp, Homo sapiens
tccctgggaaatgtcagtttca

SEQ ID NO: 9490548 - DNA, 22 bp, Homo sapiens
tccctgggaacaaaggatgaga

SEQ ID NO: 9490549 - DNA, 22 bp, Homo sapiens
tccctgggaacaaaggatgaga

SEQ ID NO: 9490550 - DNA, 22 bp, Homo sapiens
tccctgggaccggcagctcaca

SEQ ID NO: 9490551 - DNA, 22 bp, Homo sapiens
tccctgggaccggcagctcaca

SEQ ID NO: 9490552 - DNA, 22 bp, Homo sapiens
tccctgggactcagacatggaa

SEQ ID NO: 9490553 - DNA, 22 bp, Homo sapiens
tccctgggagatgatgatgagg

SEQ ID NO: 9490554 - DNA, 22 bp, Homo sapiens
tccctgggactcagacatggaa

SEQ ID NO: 9490555 - DNA, 22 bp, Homo sapiens
tccctgggactcagacatggaa

SEQ ID NO: 9490556 - DNA, 22 bp, Homo sapiens
tccctgggacggccttttggag

SEQ ID NO: 9490557 - DNA, 22 bp, Homo sapiens
tccctgggacggccttttggag

SEQ ID NO: 9490558 - DNA, 22 bp, Homo sapiens
tccctgggaccggcagctcaca

SEQ ID NO: 9490559 - DNA, 22 bp, Homo sapiens
tccctgggcaagtttactcttc

SEQ ID NO: 9490560 - DNA, 22 bp, Homo sapiens
tccgtgagattaagcagaattc

SEQ ID NO: 9490561 - DNA, 22 bp, Homo sapiens
tccgtggagattttgtgcaggg

SEQ ID NO: 9490562 - DNA, 22 bp, Homo sapiens
tccgtgttccaagacagggtgg

SEQ ID NO: 9490563 - DNA, 22 bp, Homo sapiens
tcctaaaggctgcttttatatt

SEQ ID NO: 9490564 - DNA, 22 bp, Homo sapiens
tcctaaaggctgcttttatatt

SEQ ID NO: 9490565 - DNA, 22 bp, Homo sapiens
tcctaggaagtggaggcacctg

SEQ ID NO: 9490566 - DNA, 22 bp, Homo sapiens
tcctaggcctggcctggtggat

SEQ ID NO: 9490567 - DNA, 22 bp, Homo sapiens
tcctagggttggagacagtgac

SEQ ID NO: 9490568 - DNA, 22 bp, Homo sapiens
tcctagggttggagacagtgac

SEQ ID NO: 9490569 - DNA, 22 bp, Homo sapiens
tcctagaataatctttgactgc

SEQ ID NO: 9490570 - DNA, 22 bp, Homo sapiens
tcctagaatagtgtgtctggag

SEQ ID NO: 9490571 - DNA, 22 bp, Homo sapiens
tcctagaatctttgtaagattg

SEQ ID NO: 9490572 - DNA, 22 bp, Homo sapiens
tcctagaatgcacctctgctgt

SEQ ID NO: 9490573 - DNA, 22 bp, Homo sapiens
tcccagcctttctttctccagc

SEQ ID NO: 9490574 - DNA, 22 bp, Homo sapiens
tcccagcctttctttctccagc

SEQ ID NO: 9490575 - DNA, 22 bp, Homo sapiens
tcccagcctttctttctccagc

SEQ ID NO: 9490576 - DNA, 22 bp, Homo sapiens
tcccagccttccttgtggtgaa

SEQ ID NO: 9490577 - DNA, 22 bp, Homo sapiens
tcccagccttccttgtggtgaa

SEQ ID NO: 9490578 - DNA, 22 bp, Homo sapiens
tcccagccttccttgtggtgaa

SEQ ID NO: 9490579 - DNA, 22 bp, Homo sapiens
tcccagccttccttgtggtgaa

SEQ ID NO: 9490580 - DNA, 22 bp, Homo sapiens
tcccagcctttctttctccagc

SEQ ID NO: 9490581 - DNA, 16 bp, Homo sapiens
tcccaggccaggtgga

SEQ ID NO: 9490582 - DNA, 22 bp, Homo sapiens
tcccaggccataaaactcagag

SEQ ID NO: 9490583 - DNA, 22 bp, Homo sapiens
tcccaggcgcctggtggggagc

SEQ ID NO: 9490584 - DNA, 22 bp, Homo sapiens
tcccaggcgcctggtggggagc

SEQ ID NO: 9490585 - DNA, 22 bp, Homo sapiens
tcccagccttatctcccctggc

SEQ ID NO: 9490586 - DNA, 22 bp, Homo sapiens
tcccagccttatctcccctggc

SEQ ID NO: 9490587 - DNA, 22 bp, Homo sapiens
tcccagccttatctcccctggc

SEQ ID NO: 9490588 - DNA, 22 bp, Homo sapiens
tcccagccttatctcccctggc

SEQ ID NO: 9490589 - DNA, 22 bp, Homo sapiens
tcccagccttccagtctggttt

SEQ ID NO: 9490590 - DNA, 22 bp, Homo sapiens
tcccagccttatctcccctggc

SEQ ID NO: 9490591 - DNA, 22 bp, Homo sapiens
tcccagccttccagtctggttt

SEQ ID NO: 9490592 - DNA, 22 bp, Homo sapiens
tcccagccttccagtctggttt

SEQ ID NO: 9490593 - DNA, 22 bp, Homo sapiens
tcccagcctgacagtgcatcaa

SEQ ID NO: 9490594 - DNA, 22 bp, Homo sapiens
tcccagcctgacagtgcatcaa

SEQ ID NO: 9490595 - DNA, 22 bp, Homo sapiens
tcccagcctgacagtgcatcaa

SEQ ID NO: 9490596 - DNA, 22 bp, Homo sapiens
tcccagcctggaccctgccagt

SEQ ID NO: 9490597 - DNA, 22 bp, Homo sapiens
tcccagcctggaccctgccagt

SEQ ID NO: 9490598 - DNA, 22 bp, Homo sapiens
tcccagcctggaccctgccagt

SEQ ID NO: 9490599 - DNA, 22 bp, Homo sapiens
tcccagcctggaccctgccagt

SEQ ID NO: 9490600 - DNA, 22 bp, Homo sapiens
tcccagaggttgagtcacttat

SEQ ID NO: 9490601 - DNA, 22 bp, Homo sapiens
tcccagaggttgagtcacttat

SEQ ID NO: 9490602 - DNA, 22 bp, Homo sapiens
tcccagaggttgagtcacttat

SEQ ID NO: 9490603 - DNA, 22 bp, Homo sapiens
tcccagagtattagcaattgct

SEQ ID NO: 9490604 - DNA, 22 bp, Homo sapiens
tcccagaggttgagtcacttat

SEQ ID NO: 9490605 - DNA, 22 bp, Homo sapiens
tcccagcataacaaactgcccg

SEQ ID NO: 9490606 - DNA, 22 bp, Homo sapiens
tcccagagtattagcaattgct

SEQ ID NO: 9490607 - DNA, 22 bp, Homo sapiens
tcccagaggttgagtcacttat

SEQ ID NO: 9490608 - DNA, 22 bp, Homo sapiens
tcccagaggtctctgctggttc

SEQ ID NO: 9490609 - DNA, 22 bp, Homo sapiens
tcccagaggcagttggtaactt

SEQ ID NO: 9490610 - DNA, 22 bp, Homo sapiens
tcccagaggactgttggtgcta

SEQ ID NO: 9490611 - DNA, 22 bp, Homo sapiens
tcccagagccaagctatggatg

SEQ ID NO: 9490612 - DNA, 22 bp, Homo sapiens
tcccagagccaagctatggatg

SEQ ID NO: 9490613 - DNA, 22 bp, Homo sapiens
tcccagagccaagctatggatg

SEQ ID NO: 9490614 - DNA, 22 bp, Homo sapiens
tcccagaggctccagtctctat

SEQ ID NO: 9490615 - DNA, 22 bp, Homo sapiens
tcccagaggctccagtctctat

SEQ ID NO: 9490616 - DNA, 22 bp, Homo sapiens
tcccagaggctccagtctctat

SEQ ID NO: 9490617 - DNA, 22 bp, Homo sapiens
tcccagaggctccagtctctat

SEQ ID NO: 9490618 - DNA, 22 bp, Homo sapiens
tcccagccggtgcctgggtccc

SEQ ID NO: 9490619 - DNA, 22 bp, Homo sapiens
tcccagccggtgcctgggtccc

SEQ ID NO: 9490620 - DNA, 22 bp, Homo sapiens
tcccagcccaggtatgatgata

SEQ ID NO: 9490621 - DNA, 22 bp, Homo sapiens
tcccagcccaggtatgatgata

SEQ ID NO: 9490622 - DNA, 22 bp, Homo sapiens
tcccagccacaggtgtagccct

SEQ ID NO: 9490623 - DNA, 22 bp, Homo sapiens
tcccagcccaggtatgatgata

SEQ ID NO: 9490624 - DNA, 22 bp, Homo sapiens
tcccagcattaatgcctgtcag

SEQ ID NO: 9490625 - DNA, 22 bp, Homo sapiens
tcccagccggtgcctgggtccc

SEQ ID NO: 9490626 - DNA, 22 bp, Homo sapiens
tcccagccggtgcctgggtccc

SEQ ID NO: 9490627 - DNA, 22 bp, Homo sapiens
tcccagccggtgcctgggtccc

SEQ ID NO: 9490628 - DNA, 22 bp, Homo sapiens
tcccagcctcctgacagttttg

SEQ ID NO: 9490629 - DNA, 22 bp, Homo sapiens
tcccagcctcctgacagttttg

SEQ ID NO: 9490630 - DNA, 23 bp, Homo sapiens
tcccagcctcttctcttgcatac

SEQ ID NO: 9490631 - DNA, 22 bp, Homo sapiens
tcccagcctcctgacagttttg

SEQ ID NO: 9490632 - DNA, 22 bp, Homo sapiens
tcccagcctcctgacagttttg

SEQ ID NO: 9490633 - DNA, 23 bp, Homo sapiens
tcccagcctcttctcttgcatac

SEQ ID NO: 9490634 - DNA, 22 bp, Homo sapiens
tcccagagatttcctctccttc

SEQ ID NO: 9490635 - DNA, 22 bp, Homo sapiens
tcccagagatttcctctccttc

SEQ ID NO: 9490636 - DNA, 22 bp, Homo sapiens
tcccagagatttcctctccttc

SEQ ID NO: 9490637 - DNA, 22 bp, Homo sapiens
tcccagagacatcatttctccg

SEQ ID NO: 9490638 - DNA, 22 bp, Homo sapiens
tcccagagacagagcctcctcc

SEQ ID NO: 9490639 - DNA, 22 bp, Homo sapiens
tcccagagacagagcctcctcc

SEQ ID NO: 9490640 - DNA, 22 bp, Homo sapiens
tcccagagacatcatttctccg

SEQ ID NO: 9490641 - DNA, 22 bp, Homo sapiens
tcccagagacatcatttctccg

SEQ ID NO: 9490642 - DNA, 22 bp, Homo sapiens
tcccagagacagagcctcctcc

SEQ ID NO: 9490643 - DNA, 22 bp, Homo sapiens
tcccagagcagtactccaggag

SEQ ID NO: 9490644 - DNA, 22 bp, Homo sapiens
tcccagagcagatgtgctaaag

SEQ ID NO: 9490645 - DNA, 22 bp, Homo sapiens
tcccagagcagatgtgctaaag

SEQ ID NO: 9490646 - DNA, 22 bp, Homo sapiens
tcccagagcagatgtgctaaag

SEQ ID NO: 9490647 - DNA, 22 bp, Homo sapiens
tcccagagcagatgtgctaaag

SEQ ID NO: 9490648 - DNA, 22 bp, Homo sapiens
tcccagagcagtactccaggag

SEQ ID NO: 9490649 - DNA, 22 bp, Homo sapiens
tcccagagcagtactccaggag

SEQ ID NO: 9490650 - DNA, 22 bp, Homo sapiens
tcccagagcagtactccaggag

SEQ ID NO: 9490651 - DNA, 22 bp, Homo sapiens
tcccagagccaagctatggatg

SEQ ID NO: 9490652 - DNA, 22 bp, Homo sapiens
tcccagagccaagctatggatg

SEQ ID NO: 9490653 - DNA, 22 bp, Homo sapiens
tcccaagatgacacagtggacg

SEQ ID NO: 9490654 - DNA, 22 bp, Homo sapiens
tcccaagatgacacagtggacg

SEQ ID NO: 9490655 - DNA, 22 bp, Homo sapiens
tcccaagagctctgggataagg

SEQ ID NO: 9490656 - DNA, 22 bp, Homo sapiens
tcccagagaagagctggatgga

SEQ ID NO: 9490657 - DNA, 22 bp, Homo sapiens
tcccagagaagagctggatgga

SEQ ID NO: 9490658 - DNA, 22 bp, Homo sapiens
tcccagagaaagtcaaggtctt

SEQ ID NO: 9490659 - DNA, 22 bp, Homo sapiens
tcccaagattattgagggaggg

SEQ ID NO: 9490660 - DNA, 22 bp, Homo sapiens
tcccagagaaagtcaaggtctt

SEQ ID NO: 9490661 - DNA, 22 bp, Homo sapiens
tcccaagagctactcaatggaa

SEQ ID NO: 9490662 - DNA, 22 bp, Homo sapiens
tcccaagacgatgtgcttggcc

SEQ ID NO: 9490663 - DNA, 22 bp, Homo sapiens
tcccaagacgatgtgcttggcc

SEQ ID NO: 9490664 - DNA, 22 bp, Homo sapiens
tcccaaagtcaagctgtgtctt

SEQ ID NO: 9490665 - DNA, 22 bp, Homo sapiens
tcccaaatataatgcaagagac

SEQ ID NO: 9490666 - DNA, 22 bp, Homo sapiens
tcccaaagctactcttctgact

SEQ ID NO: 9490667 - DNA, 22 bp, Homo sapiens
tcccaaagtattagcatttcaa

SEQ ID NO: 9490668 - DNA, 22 bp, Homo sapiens
tcccaaagtattagcatttcaa

SEQ ID NO: 9490669 - DNA, 22 bp, Homo sapiens
tccattggtctctgtgcccagg

SEQ ID NO: 9490670 - DNA, 22 bp, Homo sapiens
tccattgctcaatatagagttt

SEQ ID NO: 9490671 - DNA, 22 bp, Homo sapiens
tccattgtgttacagagcattc

SEQ ID NO: 9490672 - DNA, 22 bp, Homo sapiens
tcccaaagctactcttctgact

SEQ ID NO: 9490673 - DNA, 22 bp, Homo sapiens
tcccaaaggtccgagcgggaat

SEQ ID NO: 9490674 - DNA, 22 bp, Homo sapiens
tccatttagctggcaaacaatg

SEQ ID NO: 9490675 - DNA, 22 bp, Homo sapiens
tccattatacttctgattcaaa

SEQ ID NO: 9490676 - DNA, 22 bp, Homo sapiens
tccattatacttctgattcaaa

SEQ ID NO: 9490677 - DNA, 22 bp, Homo sapiens
tccattctttttacctctcaga

SEQ ID NO: 9490678 - DNA, 22 bp, Homo sapiens
tccattcttttgctgtcttcct

SEQ ID NO: 9490679 - DNA, 22 bp, Homo sapiens
tccattctatgcttacatttat

SEQ ID NO: 9490680 - DNA, 22 bp, Homo sapiens
tccattcttttgctgtcttcct

SEQ ID NO: 9490681 - DNA, 19 bp, Homo sapiens
tccatgtgtttcagacctg

SEQ ID NO: 9490682 - DNA, 22 bp, Homo sapiens
tccatgtgttttcctgtccaca

SEQ ID NO: 9490683 - DNA, 22 bp, Homo sapiens
tccattatacttctgattcaaa

SEQ ID NO: 9490684 - DNA, 22 bp, Homo sapiens
tccattaatgattatttctgtg

SEQ ID NO: 9490685 - DNA, 22 bp, Homo sapiens
tccatgggtagccctggttgag

SEQ ID NO: 9490686 - DNA, 22 bp, Homo sapiens
tccatggagatggatgactgta

SEQ ID NO: 9490687 - DNA, 22 bp, Homo sapiens
tccatggagatggatgactgta

SEQ ID NO: 9490688 - DNA, 22 bp, Homo sapiens
tccatggagatggatgactgta

SEQ ID NO: 9490689 - DNA, 22 bp, Homo sapiens
tccatgggaagattttgagtgg

SEQ ID NO: 9490690 - DNA, 22 bp, Homo sapiens
tccatggggcccaggatgagag

SEQ ID NO: 9490691 - DNA, 22 bp, Homo sapiens
tccaggctaattttgcattgtt

SEQ ID NO: 9490692 - DNA, 22 bp, Homo sapiens
tccaggctaattttgcattgtt

SEQ ID NO: 9490693 - DNA, 20 bp, Homo sapiens
tccaggccttgttctcagat

SEQ ID NO: 9490694 - DNA, 22 bp, Homo sapiens
tccaggcctttgcacatgttgt

SEQ ID NO: 9490695 - DNA, 22 bp, Homo sapiens
tccaggctaattttgcattgtt

SEQ ID NO: 9490696 - DNA, 22 bp, Homo sapiens
tccaggcctgcctggtgtttgc

SEQ ID NO: 9490697 - DNA, 22 bp, Homo sapiens
tccaggcctggctccattcagt

SEQ ID NO: 9490698 - DNA, 22 bp, Homo sapiens
tccaggccttgacaggtcagtt

SEQ ID NO: 9490699 - DNA, 22 bp, Homo sapiens
tccaggccttgacaggtcagtt

SEQ ID NO: 9490700 - DNA, 20 bp, Homo sapiens
tccaggccttgttctcagat

SEQ ID NO: 9490701 - DNA, 22 bp, Homo sapiens
tccaggcctctagcccctatct

SEQ ID NO: 9490702 - DNA, 22 bp, Homo sapiens
tccaggcctctagccctctctt

SEQ ID NO: 9490703 - DNA, 22 bp, Homo sapiens
tccacaagatgataaagagagg

SEQ ID NO: 9490704 - DNA, 21 bp, Homo sapiens
tccacaagttagaaggaaatt

SEQ ID NO: 9490705 - DNA, 18 bp, Homo sapiens
tccaggcctgaagtgtcc

SEQ ID NO: 9490706 - DNA, 18 bp, Homo sapiens
tccaggcctgaagtgtcc

SEQ ID NO: 9490707 - DNA, 22 bp, Homo sapiens
tccaggcctgactataaatgta

SEQ ID NO: 9490708 - DNA, 22 bp, Homo sapiens
tccaggcctgcaatgacaaagc

SEQ ID NO: 9490709 - DNA, 22 bp, Homo sapiens
tccaggctggcctcgcgtgaca

SEQ ID NO: 9490710 - DNA, 22 bp, Homo sapiens
tccaggctggctcttcaaaatt

SEQ ID NO: 9490711 - DNA, 22 bp, Homo sapiens
tccaggctggctcttcaaaatt

SEQ ID NO: 9490712 - DNA, 22 bp, Homo sapiens
tccaggctggcctcgcgtgaca

SEQ ID NO: 9490713 - DNA, 22 bp, Homo sapiens
tccaggctggagtgcagtggcg

SEQ ID NO: 9490714 - DNA, 22 bp, Homo sapiens
tccaggctggagtgcagtggcg

SEQ ID NO: 9490715 - DNA, 22 bp, Homo sapiens
tccaggctggagtgcagtggcg

SEQ ID NO: 9490716 - DNA, 22 bp, Homo sapiens
tccaggctggagtgcagtggcg

SEQ ID NO: 9490717 - DNA, 22 bp, Homo sapiens
tccaggctggagtgcagtggca

SEQ ID NO: 9490718 - DNA, 22 bp, Homo sapiens
tccaggctggagtgcagtggca

SEQ ID NO: 9490719 - DNA, 22 bp, Homo sapiens
tccaggctggagtgcagtggca

SEQ ID NO: 9490720 - DNA, 22 bp, Homo sapiens
tccaggctggagtgcagtggca

SEQ ID NO: 9490721 - DNA, 22 bp, Homo sapiens
tccaggctggacatgaggcggg

SEQ ID NO: 9490722 - DNA, 22 bp, Homo sapiens
tccaggctggacatgaggcggg

SEQ ID NO: 9490723 - DNA, 22 bp, Homo sapiens
tccaggctggacatgaggcggg

SEQ ID NO: 9490724 - DNA, 21 bp, Homo sapiens
tccaggctggaaggggcgttg

SEQ ID NO: 9490725 - DNA, 21 bp, Homo sapiens
tccaggctggaaggggcgttg

SEQ ID NO: 9490726 - DNA, 21 bp, Homo sapiens
tccaggctggaaggggcgttg

SEQ ID NO: 9490727 - DNA, 22 bp, Homo sapiens
tccaggctagagtgcagtggcc

SEQ ID NO: 9490728 - DNA, 22 bp, Homo sapiens
tccaggctagagtgcagtggcc

SEQ ID NO: 9490729 - DNA, 22 bp, Homo sapiens
tccaggctagagtgcagtggcc

SEQ ID NO: 9490730 - DNA, 22 bp, Homo sapiens
tccaggctagcctggtagagaa

SEQ ID NO: 9490731 - DNA, 22 bp, Homo sapiens
tccaggctagcctggtagagaa

SEQ ID NO: 9490732 - DNA, 22 bp, Homo sapiens
tccaggctagaagtcacaggcc

SEQ ID NO: 9490733 - DNA, 22 bp, Homo sapiens
tccaggctagagtgcagtggcc

SEQ ID NO: 9490734 - DNA, 22 bp, Homo sapiens
tccaggctagaagtcacaggcc

SEQ ID NO: 9490735 - DNA, 22 bp, Homo sapiens
tccaggctagaagtcacaggcc

SEQ ID NO: 9490736 - DNA, 22 bp, Homo sapiens
tccagggaagagcagaggctac

SEQ ID NO: 9490737 - DNA, 22 bp, Homo sapiens
tccaggctttttcatgctgtct

SEQ ID NO: 9490738 - DNA, 21 bp, Homo sapiens
tccagggaacttctcaggaat

SEQ ID NO: 9490739 - DNA, 22 bp, Homo sapiens
tccaggctgggctgaagggtgc

SEQ ID NO: 9490740 - DNA, 22 bp, Homo sapiens
tccaggctttttcatgctgtct

SEQ ID NO: 9490741 - DNA, 22 bp, Homo sapiens
tccaggctttttcatgctgtct

SEQ ID NO: 9490742 - DNA, 23 bp, Homo sapiens
tccaggctgggacttcaactggc

SEQ ID NO: 9490743 - DNA, 22 bp, Homo sapiens
tccagggaaggtgtgaggctgg

SEQ ID NO: 9490744 - DNA, 22 bp, Homo sapiens
tccagggaagagcagaggctac

SEQ ID NO: 9490745 - DNA, 22 bp, Homo sapiens
tccagggaagagcagaggctac

SEQ ID NO: 9490746 - DNA, 22 bp, Homo sapiens
tccagggaaggtgtgaggctgg

SEQ ID NO: 9490747 - DNA, 22 bp, Homo sapiens
tccagggacacagagtccttct

SEQ ID NO: 9490748 - DNA, 22 bp, Homo sapiens
tccagggctccccaacatccag

SEQ ID NO: 9490749 - DNA, 22 bp, Homo sapiens
tccagggctccccaacatccag

SEQ ID NO: 9490750 - DNA, 22 bp, Homo sapiens
tccagggacagcgctggagcta

SEQ ID NO: 9490751 - DNA, 22 bp, Homo sapiens
tccagggctgacttgggagagg

SEQ ID NO: 9490752 - DNA, 23 bp, Homo sapiens
tccagggctggccagacctcggt

SEQ ID NO: 9490753 - DNA, 23 bp, Homo sapiens
tccagggctggccagacctcggt

SEQ ID NO: 9490754 - DNA, 23 bp, Homo sapiens
tccagggctggccagacctcggt

SEQ ID NO: 9490755 - DNA, 22 bp, Homo sapiens
tccagggctgggttggctcagc

SEQ ID NO: 9490756 - DNA, 22 bp, Homo sapiens
tccagggctgggttggctcagc

SEQ ID NO: 9490757 - DNA, 22 bp, Homo sapiens
tccagggctgggttggctcagc

SEQ ID NO: 9490758 - DNA, 22 bp, Homo sapiens
tccagggctgggttggctcagc

SEQ ID NO: 9490759 - DNA, 22 bp, Homo sapiens
tccagggctgttactttacata

SEQ ID NO: 9490760 - DNA, 18 bp, Homo sapiens
tccagggcttcctcctct

SEQ ID NO: 9490761 - DNA, 22 bp, Homo sapiens
tccagggctgttactttacata

SEQ ID NO: 9490762 - DNA, 22 bp, Homo sapiens
tccaggtttcgctacaggagag

SEQ ID NO: 9490763 - DNA, 22 bp, Homo sapiens
tccagtacaggtctctcatttc

SEQ ID NO: 9490764 - DNA, 22 bp, Homo sapiens
tccaggtcttcctattccaggt

SEQ ID NO: 9490765 - DNA, 22 bp, Homo sapiens
tccaggtcttcctattccaggt

SEQ ID NO: 9490766 - DNA, 22 bp, Homo sapiens
tccaggtctggttggacaggtt

SEQ ID NO: 9490767 - DNA, 22 bp, Homo sapiens
tccaggtctggttggacaggtt

SEQ ID NO: 9490768 - DNA, 22 bp, Homo sapiens
tccaggtctggttggacaggtt

SEQ ID NO: 9490769 - DNA, 22 bp, Homo sapiens
tccagggcttgacagggtgcct

SEQ ID NO: 9490770 - DNA, 22 bp, Homo sapiens
tccagggcttgacagggtgcct

SEQ ID NO: 9490771 - DNA, 22 bp, Homo sapiens
tccagggcttgacagggtgcct

SEQ ID NO: 9490772 - DNA, 18 bp, Homo sapiens
tccagggcttcctcctct

SEQ ID NO: 9490773 - DNA, 18 bp, Homo sapiens
tccagggcttcctcctct

SEQ ID NO: 9490774 - DNA, 18 bp, Homo sapiens
tccagggcttcctcctct

SEQ ID NO: 9490775 - DNA, 22 bp, Homo sapiens
tccagggcttggctgggacggt

SEQ ID NO: 9490776 - DNA, 22 bp, Homo sapiens
tccagggcttggctgggacggt

SEQ ID NO: 9490777 - DNA, 22 bp, Homo sapiens
tccagggcttggctgggacggt

SEQ ID NO: 9490778 - DNA, 19 bp, Homo sapiens
tccagggctttatggcttt

SEQ ID NO: 9490779 - DNA, 19 bp, Homo sapiens
tccagggctttatggcttt

SEQ ID NO: 9490780 - DNA, 21 bp, Homo sapiens
tccagggctttgattctctca

SEQ ID NO: 9490781 - DNA, 21 bp, Homo sapiens
tccagggctttgattctctca

SEQ ID NO: 9490782 - DNA, 19 bp, Homo sapiens
tccagggctttatggcttt

SEQ ID NO: 9490783 - DNA, 21 bp, Homo sapiens
tccagggctttgattctctca

SEQ ID NO: 9490784 - DNA, 22 bp, Homo sapiens
tccaggtcctactggcccatag

SEQ ID NO: 9490785 - DNA, 22 bp, Homo sapiens
tccaggtctggcctgctaggca

SEQ ID NO: 9490786 - DNA, 22 bp, Homo sapiens
tcatttacatagaaacaatata

SEQ ID NO: 9490787 - DNA, 22 bp, Homo sapiens
tcatttacatagaaacaatata

SEQ ID NO: 9490788 - DNA, 22 bp, Homo sapiens
tcatttacatgtctttctctga

SEQ ID NO: 9490789 - DNA, 22 bp, Homo sapiens
tcatttacgcgcctccttcctt

SEQ ID NO: 9490790 - DNA, 19 bp, Homo sapiens
tcatttacggttttgatga

SEQ ID NO: 9490791 - DNA, 22 bp, Homo sapiens
tcatttactgtaggagtgaacc

SEQ ID NO: 9490792 - DNA, 22 bp, Homo sapiens
tcatttactggatccataagca

SEQ ID NO: 9490793 - DNA, 22 bp, Homo sapiens
tcatttactgtaggcaaaaatt

SEQ ID NO: 9490794 - DNA, 22 bp, Homo sapiens
tcatttactgtaggcaaaaatt

SEQ ID NO: 9490795 - DNA, 22 bp, Homo sapiens
tcatttacttctatgacaacat

SEQ ID NO: 9490796 - DNA, 22 bp, Homo sapiens
tcatttacttggttttaatctt

SEQ ID NO: 9490797 - DNA, 19 bp, Homo sapiens
tcatttactttctgggtga

SEQ ID NO: 9490798 - DNA, 22 bp, Homo sapiens
tcatttataaggatgcaattaa

SEQ ID NO: 9490799 - DNA, 22 bp, Homo sapiens
tcatttataaggatgcaattaa

SEQ ID NO: 9490800 - DNA, 22 bp, Homo sapiens
tcatttataaggatgcaattaa

SEQ ID NO: 9490801 - DNA, 22 bp, Homo sapiens
tcatttatagctaaccttgaat

SEQ ID NO: 9490802 - DNA, 22 bp, Homo sapiens
tcatttatagctaaccttgaat

SEQ ID NO: 9490803 - DNA, 22 bp, Homo sapiens
tcatttatagaagtgggcagta

SEQ ID NO: 9490804 - DNA, 19 bp, Homo sapiens
tcattgttggtttgtcggg

SEQ ID NO: 9490805 - DNA, 22 bp, Homo sapiens
tcatttaaaatgtaccaggatt

SEQ ID NO: 9490806 - DNA, 22 bp, Homo sapiens
tcatttaaaatgtaccaggatt

SEQ ID NO: 9490807 - DNA, 22 bp, Homo sapiens
tcattgtttctgcttttcatga

SEQ ID NO: 9490808 - DNA, 22 bp, Homo sapiens
tcatttacatagaaacaatata

SEQ ID NO: 9490809 - DNA, 22 bp, Homo sapiens
tcatttacatagaaacaatata

SEQ ID NO: 9490810 - DNA, 22 bp, Homo sapiens
tcatttacatagaaacaatata

SEQ ID NO: 9490811 - DNA, 22 bp, Homo sapiens
tcatttacaggtgaagcaacta

SEQ ID NO: 9490812 - DNA, 22 bp, Homo sapiens
tcatttacagactgtgtgggtg

SEQ ID NO: 9490813 - DNA, 22 bp, Homo sapiens
tcatttacacttcacaaatgga

SEQ ID NO: 9490814 - DNA, 22 bp, Homo sapiens
tcatttacacttcacaaatgga

SEQ ID NO: 9490815 - DNA, 22 bp, Homo sapiens
tcatttacacttcacaaatgga

SEQ ID NO: 9490816 - DNA, 22 bp, Homo sapiens
tcatttaattggttttgctcgt

SEQ ID NO: 9490817 - DNA, 22 bp, Homo sapiens
tcatttaatagcttttgtcttt

SEQ ID NO: 9490818 - DNA, 22 bp, Homo sapiens
tcattgctctaggttccttgga

SEQ ID NO: 9490819 - DNA, 16 bp, Homo sapiens
tcattgctcatgggtc

SEQ ID NO: 9490820 - DNA, 22 bp, Homo sapiens
tcattgtatactttatttatga

SEQ ID NO: 9490821 - DNA, 22 bp, Homo sapiens
tcattgtatactttatttatga

SEQ ID NO: 9490822 - DNA, 22 bp, Homo sapiens
tcattgttactgtttagttgcc

SEQ ID NO: 9490823 - DNA, 22 bp, Homo sapiens
tcattgttcctatttggcaaga

SEQ ID NO: 9490824 - DNA, 22 bp, Homo sapiens
tcattgtattcagaactgaaga

SEQ ID NO: 9490825 - DNA, 23 bp, Homo sapiens
tcattgtgactgtgccacataac

SEQ ID NO: 9490826 - DNA, 22 bp, Homo sapiens
tcatgcatatttgtagtagttc

SEQ ID NO: 9490827 - DNA, 22 bp, Homo sapiens
tcatgcaggtttccagccagat

SEQ ID NO: 9490828 - DNA, 22 bp, Homo sapiens
tcatgcagtttcttatctgcca

SEQ ID NO: 9490829 - DNA, 22 bp, Homo sapiens
tcatgcagatttggaggtattt

SEQ ID NO: 9490830 - DNA, 23 bp, Homo sapiens
tcatgcagcctggaacctcccag

SEQ ID NO: 9490831 - DNA, 22 bp, Homo sapiens
tcatgcaggacttacaagagat

SEQ ID NO: 9490832 - DNA, 22 bp, Homo sapiens
tcatgcaggacttacaagagat

SEQ ID NO: 9490833 - DNA, 22 bp, Homo sapiens
tcatttctccgacctgctgtcc

SEQ ID NO: 9490834 - DNA, 22 bp, Homo sapiens
tcatttctccgacctgctgtcc

SEQ ID NO: 9490835 - DNA, 22 bp, Homo sapiens
tcatttctccgacctgctgtcc

SEQ ID NO: 9490836 - DNA, 22 bp, Homo sapiens
tcatttctccgacctgctgtcc

SEQ ID NO: 9490837 - DNA, 22 bp, Homo sapiens
tcatttctattgctactgtctg

SEQ ID NO: 9490838 - DNA, 22 bp, Homo sapiens
tcatttctatctatgcagcttc

SEQ ID NO: 9490839 - DNA, 22 bp, Homo sapiens
tcatttctcccggccaaaaact

SEQ ID NO: 9490840 - DNA, 22 bp, Homo sapiens
tcatttctcccggccaaaaact

SEQ ID NO: 9490841 - DNA, 22 bp, Homo sapiens
tcatttctcctaagtgaaatat

SEQ ID NO: 9490842 - DNA, 22 bp, Homo sapiens
tcatttctcctaagtgaaatat

SEQ ID NO: 9490843 - DNA, 22 bp, Homo sapiens
tcatttctcctaagtgaaatat

SEQ ID NO: 9490844 - DNA, 22 bp, Homo sapiens
tcatttctcctaagtgaaatat

SEQ ID NO: 9490845 - DNA, 21 bp, Homo sapiens
tcatttctctatgtatttcac

SEQ ID NO: 9490846 - DNA, 21 bp, Homo sapiens
tcatttctctatgtatttcac

SEQ ID NO: 9490847 - DNA, 22 bp, Homo sapiens
tcatttctctgagtctgataat

SEQ ID NO: 9490848 - DNA, 22 bp, Homo sapiens
tcatttctctgagtctgataat

SEQ ID NO: 9490849 - DNA, 22 bp, Homo sapiens
tcatttctctgagtctgataat

SEQ ID NO: 9490850 - DNA, 22 bp, Homo sapiens
tcatttctgagccttccatgat

SEQ ID NO: 9490851 - DNA, 22 bp, Homo sapiens
tcatttctgagccttccatgat

SEQ ID NO: 9490852 - DNA, 22 bp, Homo sapiens
tcatttctgagccttccatgat

SEQ ID NO: 9490853 - DNA, 22 bp, Homo sapiens
tcatttctgagccttccatgat

SEQ ID NO: 9490854 - DNA, 22 bp, Homo sapiens
tcatttctgagccttccatgat

SEQ ID NO: 9490855 - DNA, 22 bp, Homo sapiens
tcatttctgttgtgcatcactg

SEQ ID NO: 9490856 - DNA, 22 bp, Homo sapiens
tcatttctgttgtgcatcactg

SEQ ID NO: 9490857 - DNA, 22 bp, Homo sapiens
tcatttctgttgtgcatcactg

SEQ ID NO: 9490858 - DNA, 22 bp, Homo sapiens
tcatttctgttgtgcatcactg

SEQ ID NO: 9490859 - DNA, 22 bp, Homo sapiens
tcatttcttaactagagtgaac

SEQ ID NO: 9490860 - DNA, 22 bp, Homo sapiens
tcatttcttaactagagtgaac

SEQ ID NO: 9490861 - DNA, 22 bp, Homo sapiens
tcatttcttaactagagtgaac

SEQ ID NO: 9490862 - DNA, 22 bp, Homo sapiens
tcatttggagccttcctgtttt

SEQ ID NO: 9490863 - DNA, 23 bp, Homo sapiens
tcatttcatccagccttgagagt

SEQ ID NO: 9490864 - DNA, 22 bp, Homo sapiens
tcatttcagtggcacagaagat

SEQ ID NO: 9490865 - DNA, 22 bp, Homo sapiens
tcatttcagttcagaggccttt

SEQ ID NO: 9490866 - DNA, 22 bp, Homo sapiens
tcatttcagtggcacagaagat

SEQ ID NO: 9490867 - DNA, 22 bp, Homo sapiens
tcatttcagtggcacagaagat

SEQ ID NO: 9490868 - DNA, 22 bp, Homo sapiens
tcatttcagtcctctgtgtgag

SEQ ID NO: 9490869 - DNA, 17 bp, Homo sapiens
tcatttcagtaaatcca

SEQ ID NO: 9490870 - DNA, 23 bp, Homo sapiens
tcatttcaggttgcatggtacca

SEQ ID NO: 9490871 - DNA, 22 bp, Homo sapiens
tcatttcctcaaattcaaggtt

SEQ ID NO: 9490872 - DNA, 17 bp, Homo sapiens
tcatttctaggcactcc

SEQ ID NO: 9490873 - DNA, 22 bp, Homo sapiens
tcatttctatctatgcagcttc

SEQ ID NO: 9490874 - DNA, 22 bp, Homo sapiens
tcatttcatgtctcaggcactg

SEQ ID NO: 9490875 - DNA, 22 bp, Homo sapiens
tcatttccctcctacaaagagg

SEQ ID NO: 9490876 - DNA, 22 bp, Homo sapiens
tcatttcaatgatactactaag

SEQ ID NO: 9490877 - DNA, 23 bp, Homo sapiens
tcatttcacagtgagcttcctag

SEQ ID NO: 9490878 - DNA, 23 bp, Homo sapiens
tcatttcacagtgagcttcctag

SEQ ID NO: 9490879 - DNA, 22 bp, Homo sapiens
tcatttcaatgatactactaag

SEQ ID NO: 9490880 - DNA, 22 bp, Homo sapiens
tcatttatattgtattctgtag

SEQ ID NO: 9490881 - DNA, 22 bp, Homo sapiens
tcatttatattgtattctgtag

SEQ ID NO: 9490882 - DNA, 22 bp, Homo sapiens
tcatttatattgtattctgtag

SEQ ID NO: 9490883 - DNA, 22 bp, Homo sapiens
tcatttatattgtattctgtag

SEQ ID NO: 9490884 - DNA, 22 bp, Homo sapiens
tcatttatattgtattctgtag

SEQ ID NO: 9490885 - DNA, 22 bp, Homo sapiens
tcatttcagatgcatttagaat

SEQ ID NO: 9490886 - DNA, 22 bp, Homo sapiens
tcatttcacttctctagggaga

SEQ ID NO: 9490887 - DNA, 22 bp, Homo sapiens
tcatttcagccatttttaaatg

SEQ ID NO: 9490888 - DNA, 22 bp, Homo sapiens
tcatttcagccatttttaaatg

SEQ ID NO: 9490889 - DNA, 22 bp, Homo sapiens
tccaagttgatgtttcttaaat

SEQ ID NO: 9490890 - DNA, 22 bp, Homo sapiens
tccaataaccacaatcagatag

SEQ ID NO: 9490891 - DNA, 22 bp, Homo sapiens
tccaatatttctcacatatgga

SEQ ID NO: 9490892 - DNA, 20 bp, Homo sapiens
tccaatttaagaatttagag

SEQ ID NO: 9490893 - DNA, 22 bp, Homo sapiens
tccaatgttcctgctttcagct

SEQ ID NO: 9490894 - DNA, 19 bp, Homo sapiens
tccaatttctattcatgtt

SEQ ID NO: 9490895 - DNA, 22 bp, Homo sapiens
tccaatttgaaatggtatatgt

SEQ ID NO: 9490896 - DNA, 19 bp, Homo sapiens
tccaatttctattcatgtt

SEQ ID NO: 9490897 - DNA, 22 bp, Homo sapiens
tccaattttacgtctgtataaa

SEQ ID NO: 9490898 - DNA, 22 bp, Homo sapiens
tccaattttacgtctgtataaa

SEQ ID NO: 9490899 - DNA, 22 bp, Homo sapiens
tccaatttgtttgatgatggaa

SEQ ID NO: 9490900 - DNA, 22 bp, Homo sapiens
tccaagggctttggcgtgaagt

SEQ ID NO: 9490901 - DNA, 22 bp, Homo sapiens
tccaagggctcatggacacttt

SEQ ID NO: 9490902 - DNA, 23 bp, Homo sapiens
tccaagggctacaaacacagacc

SEQ ID NO: 9490903 - DNA, 22 bp, Homo sapiens
tccaagggcatgctgaaataag

SEQ ID NO: 9490904 - DNA, 22 bp, Homo sapiens
tccaagtataaattagatactg

SEQ ID NO: 9490905 - DNA, 22 bp, Homo sapiens
tccaagtcttccttcccaaacc

SEQ ID NO: 9490906 - DNA, 22 bp, Homo sapiens
tccaagtcttccttcccaaacc

SEQ ID NO: 9490907 - DNA, 23 bp, Homo sapiens
tccaaggttgttgtggaaggggc

SEQ ID NO: 9490908 - DNA, 22 bp, Homo sapiens
tccaaggtcagcgagagtcact

SEQ ID NO: 9490909 - DNA, 22 bp, Homo sapiens
tccaagggttcatgtgcattca

SEQ ID NO: 9490910 - DNA, 22 bp, Homo sapiens
tccaagggcagcagccatagcc

SEQ ID NO: 9490911 - DNA, 22 bp, Homo sapiens
tccaagggaatgtgggcaatgc

SEQ ID NO: 9490912 - DNA, 22 bp, Homo sapiens
tccaagggaatttaaagttgct

SEQ ID NO: 9490913 - DNA, 22 bp, Homo sapiens
tccaagggcaacaatggaacac

SEQ ID NO: 9490914 - DNA, 22 bp, Homo sapiens
tccaaggccgcaggctgggcct

SEQ ID NO: 9490915 - DNA, 22 bp, Homo sapiens
tccaaggccgcaggctgggcct

SEQ ID NO: 9490916 - DNA, 22 bp, Homo sapiens
tccaaggcatggtgggagagag

SEQ ID NO: 9490917 - DNA, 22 bp, Homo sapiens
tccaaggctccggccctggcgt

SEQ ID NO: 9490918 - DNA, 22 bp, Homo sapiens
tccaagggaaactgcacttcta

SEQ ID NO: 9490919 - DNA, 22 bp, Homo sapiens
tccaaggagtcttaagttacat

SEQ ID NO: 9490920 - DNA, 22 bp, Homo sapiens
tccaaggcatagacacagtgcc

SEQ ID NO: 9490921 - DNA, 22 bp, Homo sapiens
tccaaggcatagacacagtgcc

SEQ ID NO: 9490922 - DNA, 19 bp, Homo sapiens
tccaaggcatggcccagtg

SEQ ID NO: 9490923 - DNA, 19 bp, Homo sapiens
tccaaggcatggcccagtg

SEQ ID NO: 9490924 - DNA, 22 bp, Homo sapiens
tccaaggaggagctggagattg

SEQ ID NO: 9490925 - DNA, 22 bp, Homo sapiens
tccaaggactcttgtcagctgt

SEQ ID NO: 9490926 - DNA, 22 bp, Homo sapiens
tccaaggagcagatccagagga

SEQ ID NO: 9490927 - DNA, 22 bp, Homo sapiens
tccaaggagcagatccagagga

SEQ ID NO: 9490928 - DNA, 22 bp, Homo sapiens
tccaaggaagtcatttaaactg

SEQ ID NO: 9490929 - DNA, 22 bp, Homo sapiens
tccaaggacattgttctagttg

SEQ ID NO: 9490930 - DNA, 22 bp, Homo sapiens
tccaaggactaaattctagatt

SEQ ID NO: 9490931 - DNA, 22 bp, Homo sapiens
tccaagaagctcagcaaacatc

SEQ ID NO: 9490932 - DNA, 22 bp, Homo sapiens
tccaaatataggatgtgatata

SEQ ID NO: 9490933 - DNA, 22 bp, Homo sapiens
tccaaatattatgattatagga

SEQ ID NO: 9490934 - DNA, 22 bp, Homo sapiens
tccaaatattcatctacttctg

SEQ ID NO: 9490935 - DNA, 22 bp, Homo sapiens
tccaagaacccaagcgaatgcc

SEQ ID NO: 9490936 - DNA, 22 bp, Homo sapiens
tccaacttctgcaatcagtttg

SEQ ID NO: 9490937 - DNA, 22 bp, Homo sapiens
tccaactttctcctccggcttg

SEQ ID NO: 9490938 - DNA, 22 bp, Homo sapiens
tccaaatttaccttacagatat

SEQ ID NO: 9490939 - DNA, 22 bp, Homo sapiens
tccaaatttaccttacagatat

SEQ ID NO: 9490940 - DNA, 22 bp, Homo sapiens
tccaaatttaccttacagatat

SEQ ID NO: 9490941 - DNA, 22 bp, Homo sapiens
tccaacatttatcaaggttgtt

SEQ ID NO: 9490942 - DNA, 22 bp, Homo sapiens
tcatttgtgtgagtgatttgac

SEQ ID NO: 9490943 - DNA, 21 bp, Homo sapiens
tcatttttattgctaccttgc

SEQ ID NO: 9490944 - DNA, 21 bp, Homo sapiens
tcatttttattgctaccttgc

SEQ ID NO: 9490945 - DNA, 22 bp, Homo sapiens
tcatttgtaccattttttaaga

SEQ ID NO: 9490946 - DNA, 22 bp, Homo sapiens
tcatttttgaccatgggtagga

SEQ ID NO: 9490947 - DNA, 22 bp, Homo sapiens
tcatttttgtctccggtttgtg

SEQ ID NO: 9490948 - DNA, 22 bp, Homo sapiens
tcattttttgcatacctgtgtc

SEQ ID NO: 9490949 - DNA, 22 bp, Homo sapiens
tcattttttgcatacctgtgtc

SEQ ID NO: 9490950 - DNA, 22 bp, Homo sapiens
tcatttttttccggtaggaata

SEQ ID NO: 9490951 - DNA, 22 bp, Homo sapiens
tccaaaaaacgtttgaatagtt

SEQ ID NO: 9490952 - DNA, 22 bp, Homo sapiens
tcatttttttccggtaggaata

SEQ ID NO: 9490953 - DNA, 22 bp, Homo sapiens
tccaaaaaacgtttgaatagtt

SEQ ID NO: 9490954 - DNA, 18 bp, Homo sapiens
tccaaaatcatgtatttt

SEQ ID NO: 9490955 - DNA, 22 bp, Homo sapiens
tccaaatacatttactgtattt

SEQ ID NO: 9490956 - DNA, 22 bp, Homo sapiens
tccaaatacatttactgtattt

SEQ ID NO: 9490957 - DNA, 23 bp, Homo sapiens
tccaaatacctgtcaccttgtct

SEQ ID NO: 9490958 - DNA, 22 bp, Homo sapiens
tccaaatatagatgagttgtaa

SEQ ID NO: 9490959 - DNA, 22 bp, Homo sapiens
tccaaaggcaaaactgtggtgt

SEQ ID NO: 9490960 - DNA, 21 bp, Homo sapiens
tccaaaggagactgagtgtgt

SEQ ID NO: 9490961 - DNA, 22 bp, Homo sapiens
tccaaagtgttgggattatagg

SEQ ID NO: 9490962 - DNA, 22 bp, Homo sapiens
tccaaaggggcagtgtccagcc

SEQ ID NO: 9490963 - DNA, 22 bp, Homo sapiens
tccaaagtaatttcacttctgt

SEQ ID NO: 9490964 - DNA, 22 bp, Homo sapiens
tccaaacaccctccatgctgca

SEQ ID NO: 9490965 - DNA, 18 bp, Homo sapiens
tccaaaatcatgtatttt

SEQ ID NO: 9490966 - DNA, 18 bp, Homo sapiens
tccaaaatcatgtatttt

SEQ ID NO: 9490967 - DNA, 22 bp, Homo sapiens
tccaaagaacctggctactgtc

SEQ ID NO: 9490968 - DNA, 23 bp, Homo sapiens
tccaaactcaagacattaataag

SEQ ID NO: 9490969 - DNA, 22 bp, Homo sapiens
tccaaagaacattgctgagacc

SEQ ID NO: 9490970 - DNA, 22 bp, Homo sapiens
tccaaagaacattgctgagacc

SEQ ID NO: 9490971 - DNA, 22 bp, Homo sapiens
tccaaagcatttggctcccacc

SEQ ID NO: 9490972 - DNA, 20 bp, Homo sapiens
tccaaagaagttcacattta

SEQ ID NO: 9490973 - DNA, 22 bp, Homo sapiens
tccaaagagcttaggagagaaa

SEQ ID NO: 9490974 - DNA, 22 bp, Homo sapiens
tccaaagagcttaggagagaaa

SEQ ID NO: 9490975 - DNA, 22 bp, Homo sapiens
tcagggcatcatcatgaatata

SEQ ID NO: 9490976 - DNA, 22 bp, Homo sapiens
tcagggcatactcttcaaggtc

SEQ ID NO: 9490977 - DNA, 22 bp, Homo sapiens
tcagggcatactcttcaaggtc

SEQ ID NO: 9490978 - DNA, 21 bp, Homo sapiens
tcagggcagtgggaggttcct

SEQ ID NO: 9490979 - DNA, 22 bp, Homo sapiens
tcagggctccggaagtggcctc

SEQ ID NO: 9490980 - DNA, 22 bp, Homo sapiens
tcagggctgactgctactctcc

SEQ ID NO: 9490981 - DNA, 22 bp, Homo sapiens
tcagggctcaccagcctctgcc

SEQ ID NO: 9490982 - DNA, 22 bp, Homo sapiens
tcagggctgcagaagaggcagg

SEQ ID NO: 9490983 - DNA, 22 bp, Homo sapiens
tcagggctgcatacaggagata

SEQ ID NO: 9490984 - DNA, 22 bp, Homo sapiens
tcagtagttttgatctgagcag

SEQ ID NO: 9490985 - DNA, 23 bp, Homo sapiens
tcagtagtgcattgaataagtgc

SEQ ID NO: 9490986 - DNA, 22 bp, Homo sapiens
tcagtagttcagcaaatatttt

SEQ ID NO: 9490987 - DNA, 22 bp, Homo sapiens
tcagtagttttaagtctgttaa

SEQ ID NO: 9490988 - DNA, 22 bp, Homo sapiens
tcagtagcccttgagttcatgt

SEQ ID NO: 9490989 - DNA, 22 bp, Homo sapiens
tcagtagtctaggatttcacct

SEQ ID NO: 9490990 - DNA, 22 bp, Homo sapiens
tcagtaattacctatgactcga

SEQ ID NO: 9490991 - DNA, 22 bp, Homo sapiens
tcagtaaatgagcaaaaatttc

SEQ ID NO: 9490992 - DNA, 22 bp, Homo sapiens
tcagtaaatgagcaaaaatttc

SEQ ID NO: 9490993 - DNA, 22 bp, Homo sapiens
tcagtaaccctgctgttcagag

SEQ ID NO: 9490994 - DNA, 22 bp, Homo sapiens
tcagtaacttacttattcacct

SEQ ID NO: 9490995 - DNA, 22 bp, Homo sapiens
tcagtaacttcatgaccaagca

SEQ ID NO: 9490996 - DNA, 19 bp, Homo sapiens
tcagtaacttttaagagga

SEQ ID NO: 9490997 - DNA, 22 bp, Homo sapiens
tcagtaaacaggtttaagtcct

SEQ ID NO: 9490998 - DNA, 22 bp, Homo sapiens
tcaggagagaaagaatacaatt

SEQ ID NO: 9490999 - DNA, 22 bp, Homo sapiens
tcaggagagaaagaatacaatt

SEQ ID NO: 9491000 - DNA, 22 bp, Homo sapiens
tcaggagagaaagaatacaatt

SEQ ID NO: 9491001 - DNA, 22 bp, Homo sapiens
tcaggagacttatgtcacagtg

SEQ ID NO: 9491002 - DNA, 22 bp, Homo sapiens
tcaggagacttatgtcacagtg

SEQ ID NO: 9491003 - DNA, 22 bp, Homo sapiens
tcaggagagagttgggtaggct

SEQ ID NO: 9491004 - DNA, 22 bp, Homo sapiens
tcaggagagagaaattggggct

SEQ ID NO: 9491005 - DNA, 17 bp, Homo sapiens
tcaggctgggtgcagtg

SEQ ID NO: 9491006 - DNA, 17 bp, Homo sapiens
tcaggctgggtgcagtg

SEQ ID NO: 9491007 - DNA, 17 bp, Homo sapiens
tcaggctgggtgcagtg

SEQ ID NO: 9491008 - DNA, 21 bp, Homo sapiens
tcaggagagcccatctacaaa

SEQ ID NO: 9491009 - DNA, 21 bp, Homo sapiens
tcaggagagcccatctacaaa

SEQ ID NO: 9491010 - DNA, 21 bp, Homo sapiens
tcaggagagcccatctacaaa

SEQ ID NO: 9491011 - DNA, 17 bp, Homo sapiens
tcaggctgggtgcagtg

SEQ ID NO: 9491012 - DNA, 22 bp, Homo sapiens
tcaggctgtaaatggtgtgggt

SEQ ID NO: 9491013 - DNA, 22 bp, Homo sapiens
tcaggctggtggtcagatggct

SEQ ID NO: 9491014 - DNA, 22 bp, Homo sapiens
tcaggctggtggtcagatggct

SEQ ID NO: 9491015 - DNA, 22 bp, Homo sapiens
tcaggctggtggtcagatggct

SEQ ID NO: 9491016 - DNA, 22 bp, Homo sapiens
tcaggctggtggtcagatggct

SEQ ID NO: 9491017 - DNA, 22 bp, Homo sapiens
tcaggctggtggtcagatggct

SEQ ID NO: 9491018 - DNA, 22 bp, Homo sapiens
tcaggctggtccccacagtgga

SEQ ID NO: 9491019 - DNA, 20 bp, Homo sapiens
tcaggctggtgggctttccc

SEQ ID NO: 9491020 - DNA, 19 bp, Homo sapiens
tcagggcagtccggtcccc

SEQ ID NO: 9491021 - DNA, 21 bp, Homo sapiens
tcagggcagtgggaggttcct

SEQ ID NO: 9491022 - DNA, 22 bp, Homo sapiens
tcagggcaggttaacttgggtg

SEQ ID NO: 9491023 - DNA, 22 bp, Homo sapiens
tcagggcaggcgagcagctgct

SEQ ID NO: 9491024 - DNA, 22 bp, Homo sapiens
tcagggcaggcgagcagctgct

SEQ ID NO: 9491025 - DNA, 22 bp, Homo sapiens
tcagggcaggacagtgtaggcc

SEQ ID NO: 9491026 - DNA, 21 bp, Homo sapiens
tcagggcagctgctcttcaga

SEQ ID NO: 9491027 - DNA, 22 bp, Homo sapiens
tcaggctttgctctgttgattt

SEQ ID NO: 9491028 - DNA, 22 bp, Homo sapiens
tcaggcttccaacaatgatgtt

SEQ ID NO: 9491029 - DNA, 22 bp, Homo sapiens
tcaggcttccaacaatgatgtt

SEQ ID NO: 9491030 - DNA, 22 bp, Homo sapiens
tcaggcttcttctgagcaggga

SEQ ID NO: 9491031 - DNA, 22 bp, Homo sapiens
tcaggctttgaagtctagctgg

SEQ ID NO: 9491032 - DNA, 22 bp, Homo sapiens
tcaggctgtagggcccctggag

SEQ ID NO: 9491033 - DNA, 22 bp, Homo sapiens
tcaggctgttcctgtccaaaat

SEQ ID NO: 9491034 - DNA, 22 bp, Homo sapiens
tcaggctgttagccacctcctc

SEQ ID NO: 9491035 - DNA, 22 bp, Homo sapiens
tcaggcttataggtagtggtta

SEQ ID NO: 9491036 - DNA, 22 bp, Homo sapiens
tcaggcttcactcctgtccaag

SEQ ID NO: 9491037 - DNA, 22 bp, Homo sapiens
tcatctgaaattgtatatgtag

SEQ ID NO: 9491038 - DNA, 22 bp, Homo sapiens
tcatctgaccactttatctctc

SEQ ID NO: 9491039 - DNA, 22 bp, Homo sapiens
tcatctgaccactttatctctc

SEQ ID NO: 9491040 - DNA, 22 bp, Homo sapiens
tcatctgaaattgtatatgtag

SEQ ID NO: 9491041 - DNA, 22 bp, Homo sapiens
tcatctgaagattgctgttcaa

SEQ ID NO: 9491042 - DNA, 22 bp, Homo sapiens
tcatctgaacatgcagcctgtg

SEQ ID NO: 9491043 - DNA, 22 bp, Homo sapiens
tcatagaagtagtatccacatt

SEQ ID NO: 9491044 - DNA, 22 bp, Homo sapiens
tcatagaagcaccagaagatat

SEQ ID NO: 9491045 - DNA, 22 bp, Homo sapiens
tcatacattcagcagatatttg

SEQ ID NO: 9491046 - DNA, 22 bp, Homo sapiens
tcatagaaatatcacgtctttt

SEQ ID NO: 9491047 - DNA, 22 bp, Homo sapiens
tcatacattcagcagatatttg

SEQ ID NO: 9491048 - DNA, 22 bp, Homo sapiens
tcatagaaatggaaagtatatt

SEQ ID NO: 9491049 - DNA, 22 bp, Homo sapiens
tcataaattagctgtctttgaa

SEQ ID NO: 9491050 - DNA, 22 bp, Homo sapiens
tcataaatgcagtgtcataaat

SEQ ID NO: 9491051 - DNA, 22 bp, Homo sapiens
tcataaattatctatttggcta

SEQ ID NO: 9491052 - DNA, 22 bp, Homo sapiens
tcataaatgcagtgtcataaat

SEQ ID NO: 9491053 - DNA, 22 bp, Homo sapiens
tcataaatgcagtgtcataaat

SEQ ID NO: 9491054 - DNA, 22 bp, Homo sapiens
tcataaatgcagtgtcataaat

SEQ ID NO: 9491055 - DNA, 22 bp, Homo sapiens
tcataaattatctatttggcta

SEQ ID NO: 9491056 - DNA, 22 bp, Homo sapiens
tcataaattatctatttggcta

SEQ ID NO: 9491057 - DNA, 22 bp, Homo sapiens
tcataaattgattatgtgcttt

SEQ ID NO: 9491058 - DNA, 22 bp, Homo sapiens
tcatacatctgtcctggagctc

SEQ ID NO: 9491059 - DNA, 22 bp, Homo sapiens
tcatacatctgtcctggagctc

SEQ ID NO: 9491060 - DNA, 22 bp, Homo sapiens
tcataaattgattatgtgcttt

SEQ ID NO: 9491061 - DNA, 22 bp, Homo sapiens
tcataaattgattatgtgcttt

SEQ ID NO: 9491062 - DNA, 22 bp, Homo sapiens
tcataaattgattatgtgcttt

SEQ ID NO: 9491063 - DNA, 22 bp, Homo sapiens
tcatacatcttgtatatctatc

SEQ ID NO: 9491064 - DNA, 22 bp, Homo sapiens
tcatacatcttgtatatctatc

SEQ ID NO: 9491065 - DNA, 22 bp, Homo sapiens
tcatacatgttgtgttcaaatg

SEQ ID NO: 9491066 - DNA, 22 bp, Homo sapiens
tcatacatgttgtgttcaaatg

SEQ ID NO: 9491067 - DNA, 22 bp, Homo sapiens
tcatacatcttgtatatctatc

SEQ ID NO: 9491068 - DNA, 21 bp, Homo sapiens
tcatcttacagtcctttcttt

SEQ ID NO: 9491069 - DNA, 21 bp, Homo sapiens
tcatcttacagtcctttcttt

SEQ ID NO: 9491070 - DNA, 22 bp, Homo sapiens
tcatctgttgattttaagtctt

SEQ ID NO: 9491071 - DNA, 22 bp, Homo sapiens
tcatcttgcagtgtgtgttctg

SEQ ID NO: 9491072 - DNA, 22 bp, Homo sapiens
tcatctgttcatacacatgcgt

SEQ ID NO: 9491073 - DNA, 22 bp, Homo sapiens
tcatctgttcatacacatgcgt

SEQ ID NO: 9491074 - DNA, 20 bp, Homo sapiens
tcatctgattaacctcgaag

SEQ ID NO: 9491075 - DNA, 22 bp, Homo sapiens
tcatctgaggtttgaggcagtt

SEQ ID NO: 9491076 - DNA, 22 bp, Homo sapiens
tcatctgaggcaccagagcata

SEQ ID NO: 9491077 - DNA, 22 bp, Homo sapiens
tcatctgaccccatctattctc

SEQ ID NO: 9491078 - DNA, 22 bp, Homo sapiens
tcatctgaccccatctattctc

SEQ ID NO: 9491079 - DNA, 22 bp, Homo sapiens
tcatctgtctgagagacttctg

SEQ ID NO: 9491080 - DNA, 23 bp, Homo sapiens
tcatctgtaacagcctatgaaat

SEQ ID NO: 9491081 - DNA, 22 bp, Homo sapiens
tcatctttaccccttgcttcaa

SEQ ID NO: 9491082 - DNA, 22 bp, Homo sapiens
tcatctttcctcaaaagatcca

SEQ ID NO: 9491083 - DNA, 22 bp, Homo sapiens
tcatctttcctcaaaagatcca

SEQ ID NO: 9491084 - DNA, 22 bp, Homo sapiens
tcatctttcctcaaaagatcca

SEQ ID NO: 9491085 - DNA, 22 bp, Homo sapiens
tcatgaaaaattttccatgtca

SEQ ID NO: 9491086 - DNA, 22 bp, Homo sapiens
tcatgcagaggaaggctagttt

SEQ ID NO: 9491087 - DNA, 22 bp, Homo sapiens
tcagtcctgggccggcatcctc

SEQ ID NO: 9491088 - DNA, 22 bp, Homo sapiens
tcagtcctgggccggcatcctc

SEQ ID NO: 9491089 - DNA, 23 bp, Homo sapiens
tcagtcctgtaggggctccaggt

SEQ ID NO: 9491090 - DNA, 22 bp, Homo sapiens
tcagtccttggcatttaggagc

SEQ ID NO: 9491091 - DNA, 22 bp, Homo sapiens
tcagtattcctggaaatacaag

SEQ ID NO: 9491092 - DNA, 22 bp, Homo sapiens
tcagtctcatcaactctattcc

SEQ ID NO: 9491093 - DNA, 22 bp, Homo sapiens
tcagtgttcttatttaattagg

SEQ ID NO: 9491094 - DNA, 22 bp, Homo sapiens
tcagtgtttattcaatgttatt

SEQ ID NO: 9491095 - DNA, 22 bp, Homo sapiens
tcagtgtttacatgcatccttg

SEQ ID NO: 9491096 - DNA, 22 bp, Homo sapiens
tcagtgttggtcaagaatcagt

SEQ ID NO: 9491097 - DNA, 22 bp, Homo sapiens
tcagtgttgtgcacatacaaaa

SEQ ID NO: 9491098 - DNA, 23 bp, Homo sapiens
tcataaatattagcacagtagga

SEQ ID NO: 9491099 - DNA, 23 bp, Homo sapiens
tcataaatattagcacagtagga

SEQ ID NO: 9491100 - DNA, 22 bp, Homo sapiens
tcataaatcatactccatttgc

SEQ ID NO: 9491101 - DNA, 22 bp, Homo sapiens
tcataaatatttgtgggggctt

SEQ ID NO: 9491102 - DNA, 22 bp, Homo sapiens
tcataaatatttgtgggggctt

SEQ ID NO: 9491103 - DNA, 22 bp, Homo sapiens
tcataaatcatactccatttgc

SEQ ID NO: 9491104 - DNA, 22 bp, Homo sapiens
tcataaatcatactccatttgc

SEQ ID NO: 9491105 - DNA, 22 bp, Homo sapiens
tcataaatcatactccatttgc

SEQ ID NO: 9491106 - DNA, 23 bp, Homo sapiens
tcataaatattagcacagtagga

SEQ ID NO: 9491107 - DNA, 23 bp, Homo sapiens
tcataaatattagcacagtagga

SEQ ID NO: 9491108 - DNA, 23 bp, Homo sapiens
tcataaatattagcacagtagga

SEQ ID NO: 9491109 - DNA, 23 bp, Homo sapiens
tcataaatattagcacagtagga

SEQ ID NO: 9491110 - DNA, 23 bp, Homo sapiens
tcataaatattagcacagtagga

SEQ ID NO: 9491111 - DNA, 22 bp, Homo sapiens
tcataaatagttgtgcctgaat

SEQ ID NO: 9491112 - DNA, 22 bp, Homo sapiens
tcataaatagttgtgcctgaat

SEQ ID NO: 9491113 - DNA, 22 bp, Homo sapiens
tcataaagttatcaccaaatcc

SEQ ID NO: 9491114 - DNA, 22 bp, Homo sapiens
tcataaagttctaagaattgta

SEQ ID NO: 9491115 - DNA, 22 bp, Homo sapiens
tcataaagttctaagaattgta

SEQ ID NO: 9491116 - DNA, 22 bp, Homo sapiens
tcataaagttgttttaatggga

SEQ ID NO: 9491117 - DNA, 22 bp, Homo sapiens
tcataaagttacccaaatttta

SEQ ID NO: 9491118 - DNA, 22 bp, Homo sapiens
tcataaagcttgcctgcagtgt

SEQ ID NO: 9491119 - DNA, 22 bp, Homo sapiens
tcagttaacaactatttattga

SEQ ID NO: 9491120 - DNA, 22 bp, Homo sapiens
tcagtgttttaactgtctttta

SEQ ID NO: 9491121 - DNA, 22 bp, Homo sapiens
tcagtgtttgtggcaaatgtta

SEQ ID NO: 9491122 - DNA, 22 bp, Homo sapiens
tcagtgtttcctgtggtacagc

SEQ ID NO: 9491123 - DNA, 22 bp, Homo sapiens
tcagaattctacaatagatcag

SEQ ID NO: 9491124 - DNA, 22 bp, Homo sapiens
tcagaattctagctcttccctt

SEQ ID NO: 9491125 - DNA, 22 bp, Homo sapiens
tcagaattagagctcttcttga

SEQ ID NO: 9491126 - DNA, 21 bp, Homo sapiens
tcagaattacccctggatctg

SEQ ID NO: 9491127 - DNA, 22 bp, Homo sapiens
tcagaattgattttcaaaacag

SEQ ID NO: 9491128 - DNA, 19 bp, Homo sapiens
tcagaattctgtctcttga

SEQ ID NO: 9491129 - DNA, 22 bp, Homo sapiens
tcagaattgattttcaaaacag

SEQ ID NO: 9491130 - DNA, 22 bp, Homo sapiens
tcagaattgattttcaaaacag

SEQ ID NO: 9491131 - DNA, 22 bp, Homo sapiens
tcagaattggacaatagaagca

SEQ ID NO: 9491132 - DNA, 22 bp, Homo sapiens
tcagaattggaacgtgaagatt

SEQ ID NO: 9491133 - DNA, 22 bp, Homo sapiens
tcagaatttaaaatgtgtagat

SEQ ID NO: 9491134 - DNA, 22 bp, Homo sapiens
tcagacagagaagtacaatgag

SEQ ID NO: 9491135 - DNA, 22 bp, Homo sapiens
tcagacagaaggactatttgaa

SEQ ID NO: 9491136 - DNA, 22 bp, Homo sapiens
tcagacagaaagatgagtatgg

SEQ ID NO: 9491137 - DNA, 22 bp, Homo sapiens
tcagacaccgtctattttgcct

SEQ ID NO: 9491138 - DNA, 18 bp, Homo sapiens
tcagacaagttagacagg

SEQ ID NO: 9491139 - DNA, 22 bp, Homo sapiens
tcagacacagatgagacaagga

SEQ ID NO: 9491140 - DNA, 21 bp, Homo sapiens
tcagagtgtgttacagcaagc

SEQ ID NO: 9491141 - DNA, 22 bp, Homo sapiens
tcagacagaggagctcgtgcag

SEQ ID NO: 9491142 - DNA, 22 bp, Homo sapiens
tcagacagaggagctcgtgcag

SEQ ID NO: 9491143 - DNA, 22 bp, Homo sapiens
tcagatggatttatactatttc

SEQ ID NO: 9491144 - DNA, 22 bp, Homo sapiens
tcagatggaaaggttactgtcc

SEQ ID NO: 9491145 - DNA, 22 bp, Homo sapiens
tcagatggaatgatgccactgc

SEQ ID NO: 9491146 - DNA, 22 bp, Homo sapiens
tcagatggattcattacatgac

SEQ ID NO: 9491147 - DNA, 22 bp, Homo sapiens
tcagatggaggcaatgttacct

SEQ ID NO: 9491148 - DNA, 18 bp, Homo sapiens
tcagatttaactgtatcc

SEQ ID NO: 9491149 - DNA, 22 bp, Homo sapiens
tcagatttactgcagagcagat

SEQ ID NO: 9491150 - DNA, 20 bp, Homo sapiens
tcagattaaatgttctgtct

SEQ ID NO: 9491151 - DNA, 20 bp, Homo sapiens
tcagattaaatgttctgtct

SEQ ID NO: 9491152 - DNA, 22 bp, Homo sapiens
tcagatggtcattcactagggt

SEQ ID NO: 9491153 - DNA, 22 bp, Homo sapiens
tcagatggtcattcactagggt

SEQ ID NO: 9491154 - DNA, 22 bp, Homo sapiens
tcagatggtactaatttaagga

SEQ ID NO: 9491155 - DNA, 22 bp, Homo sapiens
tcagatgggttttgaaggatgt

SEQ ID NO: 9491156 - DNA, 22 bp, Homo sapiens
tcagatgggttttgaaggatgt

SEQ ID NO: 9491157 - DNA, 20 bp, Homo sapiens
tcagatgggagtgagccatc

SEQ ID NO: 9491158 - DNA, 22 bp, Homo sapiens
tcagatgttgaaaaggaaaagt

SEQ ID NO: 9491159 - DNA, 22 bp, Homo sapiens
tcagatggttccatcatttttc

SEQ ID NO: 9491160 - DNA, 22 bp, Homo sapiens
tcagatttccttgcagtttgga

SEQ ID NO: 9491161 - DNA, 22 bp, Homo sapiens
tcagatttccttgcagtttgga

SEQ ID NO: 9491162 - DNA, 22 bp, Homo sapiens
tcagatttatgaatatactatg

SEQ ID NO: 9491163 - DNA, 22 bp, Homo sapiens
tcagatttatgtggctaggctc

SEQ ID NO: 9491164 - DNA, 22 bp, Homo sapiens
tcagatttatgaatatactatg

SEQ ID NO: 9491165 - DNA, 20 bp, Homo sapiens
tcagattttgggtcactgat

SEQ ID NO: 9491166 - DNA, 22 bp, Homo sapiens
tcagattttccagcctttctct

SEQ ID NO: 9491167 - DNA, 22 bp, Homo sapiens
tcagattttgcacgaggttttg

SEQ ID NO: 9491168 - DNA, 22 bp, Homo sapiens
tcagattttccagcctttctct

SEQ ID NO: 9491169 - DNA, 22 bp, Homo sapiens
tcagattttccagcctttctct

SEQ ID NO: 9491170 - DNA, 22 bp, Homo sapiens
tcagattttccacagactggaa

SEQ ID NO: 9491171 - DNA, 22 bp, Homo sapiens
tcagatttgaatattcctttcg

SEQ ID NO: 9491172 - DNA, 22 bp, Homo sapiens
tcagatttgaatattcctttcg

SEQ ID NO: 9491173 - DNA, 22 bp, Homo sapiens
tcagcaggctgtcagcaggggc

SEQ ID NO: 9491174 - DNA, 22 bp, Homo sapiens
tcagcaggctgtcagcaggggc

SEQ ID NO: 9491175 - DNA, 22 bp, Homo sapiens
tcagcaggctgtcagcaggggc

SEQ ID NO: 9491176 - DNA, 22 bp, Homo sapiens
tcagcaggctgtcagcaggggc

SEQ ID NO: 9491177 - DNA, 22 bp, Homo sapiens
tcagcaggcggttccttgtggg

SEQ ID NO: 9491178 - DNA, 22 bp, Homo sapiens
tcagcaggcggttccttgtggg

SEQ ID NO: 9491179 - DNA, 22 bp, Homo sapiens
tcagcaggctctggttgaccat

SEQ ID NO: 9491180 - DNA, 22 bp, Homo sapiens
tcagcaggcaggaggcatgcca

SEQ ID NO: 9491181 - DNA, 22 bp, Homo sapiens
tcagcaggcaggaggcatgcca

SEQ ID NO: 9491182 - DNA, 22 bp, Homo sapiens
tcagcaggcagtgggtcacaat

SEQ ID NO: 9491183 - DNA, 22 bp, Homo sapiens
tcagcaggcccatcctccaggc

SEQ ID NO: 9491184 - DNA, 22 bp, Homo sapiens
tcagcaggcccatcctccaggc

SEQ ID NO: 9491185 - DNA, 22 bp, Homo sapiens
tcagcaggcggttccttgtggg

SEQ ID NO: 9491186 - DNA, 22 bp, Homo sapiens
tcagcaggcaggaggcatgcca

SEQ ID NO: 9491187 - DNA, 22 bp, Homo sapiens
tcagcaagaagctgtgggcttc

SEQ ID NO: 9491188 - DNA, 22 bp, Homo sapiens
tcagcaagaagtcatttgtagc

SEQ ID NO: 9491189 - DNA, 22 bp, Homo sapiens
tcagcaagaagtcatttgtagc

SEQ ID NO: 9491190 - DNA, 21 bp, Homo sapiens
tcagcaaaataagcaaatgga

SEQ ID NO: 9491191 - DNA, 22 bp, Homo sapiens
tcagcagggctgtggtgtggct

SEQ ID NO: 9491192 - DNA, 22 bp, Homo sapiens
tcagcagggctgtggtgtggct

SEQ ID NO: 9491193 - DNA, 22 bp, Homo sapiens
tcagcagggctgtggtgtggct

SEQ ID NO: 9491194 - DNA, 22 bp, Homo sapiens
tcagcagggctgggagctgtga

SEQ ID NO: 9491195 - DNA, 22 bp, Homo sapiens
tcagcagggcctccttgtgcag

SEQ ID NO: 9491196 - DNA, 22 bp, Homo sapiens
tcagcagggctgggagctgtga

SEQ ID NO: 9491197 - DNA, 22 bp, Homo sapiens
tcagcagggctgggagctgtga

SEQ ID NO: 9491198 - DNA, 17 bp, Homo sapiens
tcagcaggggccaagct

SEQ ID NO: 9491199 - DNA, 17 bp, Homo sapiens
tcagcaggggccaagct

SEQ ID NO: 9491200 - DNA, 22 bp, Homo sapiens
tcagcagtgtagtttatcattc

SEQ ID NO: 9491201 - DNA, 22 bp, Homo sapiens
tcagcaggggccgttgggtgga

SEQ ID NO: 9491202 - DNA, 17 bp, Homo sapiens
tcagcaggggccaagct

SEQ ID NO: 9491203 - DNA, 22 bp, Homo sapiens
tcagcaggggccgttgggtgga

SEQ ID NO: 9491204 - DNA, 22 bp, Homo sapiens
tcagcagggagaggagaatgca

SEQ ID NO: 9491205 - DNA, 22 bp, Homo sapiens
tcagcaggctgtcagcaggggc

SEQ ID NO: 9491206 - DNA, 22 bp, Homo sapiens
tcagcagggagaggagaatgca

SEQ ID NO: 9491207 - DNA, 22 bp, Homo sapiens
tcagcagggaggctctgtgccc

SEQ ID NO: 9491208 - DNA, 22 bp, Homo sapiens
tcagcagggaggctctgtgccc

SEQ ID NO: 9491209 - DNA, 22 bp, Homo sapiens
tcagcagggccatgctctctct

SEQ ID NO: 9491210 - DNA, 22 bp, Homo sapiens
tcagcagggcatactgagccta

SEQ ID NO: 9491211 - DNA, 22 bp, Homo sapiens
tcagcagggcatactgagccta

SEQ ID NO: 9491212 - DNA, 22 bp, Homo sapiens
tcagcagggcatactgagccta

SEQ ID NO: 9491213 - DNA, 22 bp, Homo sapiens
tcagcagggccatgctctctct

SEQ ID NO: 9491214 - DNA, 22 bp, Homo sapiens
tcagcagggccatgctctctct

SEQ ID NO: 9491215 - DNA, 22 bp, Homo sapiens
tcagcagggcctccttgtgcag

SEQ ID NO: 9491216 - DNA, 22 bp, Homo sapiens
tcagctggagatgagaaccgaa

SEQ ID NO: 9491217 - DNA, 22 bp, Homo sapiens
tcagctggagatccttgttgtg

SEQ ID NO: 9491218 - DNA, 22 bp, Homo sapiens
tcagctggagatccttgttgtg

SEQ ID NO: 9491219 - DNA, 19 bp, Homo sapiens
tcagctggcaggcctcctc

SEQ ID NO: 9491220 - DNA, 19 bp, Homo sapiens
tcagctggcaggcctcctc

SEQ ID NO: 9491221 - DNA, 22 bp, Homo sapiens
tcagctggaagatggtgcagaa

SEQ ID NO: 9491222 - DNA, 23 bp, Homo sapiens
tcagctgcttcctcctgcctgcc

SEQ ID NO: 9491223 - DNA, 22 bp, Homo sapiens
tcagctggaagatggtgcagaa

SEQ ID NO: 9491224 - DNA, 22 bp, Homo sapiens
tcagctggcaggttctgggaag

SEQ ID NO: 9491225 - DNA, 22 bp, Homo sapiens
tcagctggcaggttctgggaag

SEQ ID NO: 9491226 - DNA, 22 bp, Homo sapiens
tcagctggcaggttctgggaag

SEQ ID NO: 9491227 - DNA, 22 bp, Homo sapiens
tcagctggcatcggctcaccca

SEQ ID NO: 9491228 - DNA, 22 bp, Homo sapiens
tcagctggggccccctctgtcc

SEQ ID NO: 9491229 - DNA, 22 bp, Homo sapiens
tcagctgtactgtgccatagct

SEQ ID NO: 9491230 - DNA, 21 bp, Homo sapiens
tcagctgtagagattacattc

SEQ ID NO: 9491231 - DNA, 22 bp, Homo sapiens
tcaggaagggctcagtctgtgc

SEQ ID NO: 9491232 - DNA, 22 bp, Homo sapiens
tcaggaagggctcagtctgtgc

SEQ ID NO: 9491233 - DNA, 22 bp, Homo sapiens
tcaggaagggctcagtctgtgc

SEQ ID NO: 9491234 - DNA, 22 bp, Homo sapiens
tcaggaagggtggtccacaggg

SEQ ID NO: 9491235 - DNA, 22 bp, Homo sapiens
tcaggaagggtggtccacaggg

SEQ ID NO: 9491236 - DNA, 22 bp, Homo sapiens
tcaggaatgaggataaacattg

SEQ ID NO: 9491237 - DNA, 22 bp, Homo sapiens
tcaggaattttgttctgtatcc

SEQ ID NO: 9491238 - DNA, 22 bp, Homo sapiens
tcaggaagtataatcagattca

SEQ ID NO: 9491239 - DNA, 22 bp, Homo sapiens
tcagctggtgtttcttctcctt

SEQ ID NO: 9491240 - DNA, 22 bp, Homo sapiens
tcagctgtactgtgccatagct

SEQ ID NO: 9491241 - DNA, 21 bp, Homo sapiens
tcagctgtagagattacattc

SEQ ID NO: 9491242 - DNA, 22 bp, Homo sapiens
tcagctggtgccactcagtcaa

SEQ ID NO: 9491243 - DNA, 22 bp, Homo sapiens
tcagctggtgccactcagtcaa

SEQ ID NO: 9491244 - DNA, 22 bp, Homo sapiens
tcagctggtgagtggatagaca

SEQ ID NO: 9491245 - DNA, 22 bp, Homo sapiens
tcagctggtgagtggatagaca

SEQ ID NO: 9491246 - DNA, 22 bp, Homo sapiens
tcagctggtgaatggactcatc

SEQ ID NO: 9491247 - DNA, 22 bp, Homo sapiens
tcagctggtgaatggactcatc

SEQ ID NO: 9491248 - DNA, 18 bp, Homo sapiens
tcagctggggctgcagcc

SEQ ID NO: 9491249 - DNA, 22 bp, Homo sapiens
tcaggacagagatcagaacttc

SEQ ID NO: 9491250 - DNA, 22 bp, Homo sapiens
tcaggacagactagactagcgt

SEQ ID NO: 9491251 - DNA, 22 bp, Homo sapiens
tcaggacaggttcgggtgggta

SEQ ID NO: 9491252 - DNA, 22 bp, Homo sapiens
tcaggacagggatcacatcatc

SEQ ID NO: 9491253 - DNA, 22 bp, Homo sapiens
tcaggacagccagggtgcagac

SEQ ID NO: 9491254 - DNA, 22 bp, Homo sapiens
tcaggacagttccctgcaaatt

SEQ ID NO: 9491255 - DNA, 22 bp, Homo sapiens
tcaggacagttccctgcaaatt

SEQ ID NO: 9491256 - DNA, 22 bp, Homo sapiens
tcaggacacttggcacaaggtc

SEQ ID NO: 9491257 - DNA, 22 bp, Homo sapiens
tcaggacagaaggctgccaggg

SEQ ID NO: 9491258 - DNA, 22 bp, Homo sapiens
tcaggacagaaggctgccaggg

SEQ ID NO: 9491259 - DNA, 22 bp, Homo sapiens
tcaggacagactagactagcgt

SEQ ID NO: 9491260 - DNA, 22 bp, Homo sapiens
tcaggacagactagactagcgt

SEQ ID NO: 9491261 - DNA, 22 bp, Homo sapiens
tcaggacaccctgtgcttcctt

SEQ ID NO: 9491262 - DNA, 22 bp, Homo sapiens
tcaggacaccctgtgcttcctt

SEQ ID NO: 9491263 - DNA, 22 bp, Homo sapiens
tcaggacaatagtgatttttac

SEQ ID NO: 9491264 - DNA, 22 bp, Homo sapiens
tcaggacaatagtgatttttac

SEQ ID NO: 9491265 - DNA, 22 bp, Homo sapiens
tcaggacaacctgttttcagac

SEQ ID NO: 9491266 - DNA, 22 bp, Homo sapiens
tcaggacaacctgttttcagac

SEQ ID NO: 9491267 - DNA, 22 bp, Homo sapiens
tcaggacaacaagacttgttta

SEQ ID NO: 9491268 - DNA, 22 bp, Homo sapiens
tcaggacaacatgttgctaatc

SEQ ID NO: 9491269 - DNA, 22 bp, Homo sapiens
tcaggagactggcagtgcccac

SEQ ID NO: 9491270 - DNA, 22 bp, Homo sapiens
tcaggagactggcagtgcccac

SEQ ID NO: 9491271 - DNA, 22 bp, Homo sapiens
tcaggagacattcttaaagtag

SEQ ID NO: 9491272 - DNA, 18 bp, Homo sapiens
tcaggagacacagacgca

SEQ ID NO: 9491273 - DNA, 22 bp, Homo sapiens
tcaggagacaaagggtgcggag

SEQ ID NO: 9491274 - DNA, 18 bp, Homo sapiens
tcaggagacacagacgca

SEQ ID NO: 9491275 - DNA, 22 bp, Homo sapiens
tcaggagaatcagggctgtcct

SEQ ID NO: 9491276 - DNA, 22 bp, Homo sapiens
tcaggagaacttccttctaccc

SEQ ID NO: 9491277 - DNA, 22 bp, Homo sapiens
tcaggagaacttccttctaccc

SEQ ID NO: 9491278 - DNA, 22 bp, Homo sapiens
tcaggagaaagccaattagagt

SEQ ID NO: 9491279 - DNA, 22 bp, Homo sapiens
tcaggagaaggcaatgtggaaa

SEQ ID NO: 9491280 - DNA, 22 bp, Homo sapiens
tcaggagaaaatatcaggaagt

SEQ ID NO: 9491281 - DNA, 22 bp, Homo sapiens
tcaggagaaaatatcaggaagt

SEQ ID NO: 9491282 - DNA, 22 bp, Homo sapiens
tcaggagaaagccaattagagt

SEQ ID NO: 9491283 - DNA, 22 bp, Homo sapiens
tcaggacatttgtcagcaggag

SEQ ID NO: 9491284 - DNA, 22 bp, Homo sapiens
tcagccagctcttggactctga

SEQ ID NO: 9491285 - DNA, 22 bp, Homo sapiens
tcagccagctgtgtgcttctgc

SEQ ID NO: 9491286 - DNA, 22 bp, Homo sapiens
tcagccagctgtgtgcttctgc

SEQ ID NO: 9491287 - DNA, 20 bp, Homo sapiens
tcagccagctaacatgggga

SEQ ID NO: 9491288 - DNA, 22 bp, Homo sapiens
tcagccagccagctacaggctt

SEQ ID NO: 9491289 - DNA, 22 bp, Homo sapiens
tcagccaggcacaatggcagct

SEQ ID NO: 9491290 - DNA, 22 bp, Homo sapiens
tcagccaggcacaatggcagct

SEQ ID NO: 9491291 - DNA, 22 bp, Homo sapiens
tcagccaggccaccttcagctt

SEQ ID NO: 9491292 - DNA, 22 bp, Homo sapiens
tcagccaggcagccccctggtc

SEQ ID NO: 9491293 - DNA, 22 bp, Homo sapiens
tcagctctgcactccactgtgg

SEQ ID NO: 9491294 - DNA, 22 bp, Homo sapiens
tcagctctgcactccactgtgg

SEQ ID NO: 9491295 - DNA, 22 bp, Homo sapiens
tcagctctgcctgtggaggcac

SEQ ID NO: 9491296 - DNA, 22 bp, Homo sapiens
tcagctgcgacaggggcctgag

SEQ ID NO: 9491297 - DNA, 23 bp, Homo sapiens
tcagctgcttcctcctgcctgcc

SEQ ID NO: 9491298 - DNA, 22 bp, Homo sapiens
tcagctgcttcatgttctgaat

SEQ ID NO: 9491299 - DNA, 22 bp, Homo sapiens
tcagctgctgtggtatgtacat

SEQ ID NO: 9491300 - DNA, 22 bp, Homo sapiens
tcagctgccccgggcactgccc

SEQ ID NO: 9491301 - DNA, 22 bp, Homo sapiens
tcagctgcctctccctggaaga

SEQ ID NO: 9491302 - DNA, 19 bp, Homo sapiens
tcagctctggggtcagtgg

SEQ ID NO: 9491303 - DNA, 22 bp, Homo sapiens
tcagctgccccgggcactgccc

SEQ ID NO: 9491304 - DNA, 22 bp, Homo sapiens
tcagccagcatcagctaagtgc

SEQ ID NO: 9491305 - DNA, 22 bp, Homo sapiens
tcagccagcatcagctaagtgc

SEQ ID NO: 9491306 - DNA, 22 bp, Homo sapiens
tcagccagaggcttcttggttt

SEQ ID NO: 9491307 - DNA, 22 bp, Homo sapiens
tcagccagagggggcaaaggaa

SEQ ID NO: 9491308 - DNA, 22 bp, Homo sapiens
tcagccagaggtggatgagtca

SEQ ID NO: 9491309 - DNA, 22 bp, Homo sapiens
tcagccagaaagtgattttcag

SEQ ID NO: 9491310 - DNA, 22 bp, Homo sapiens
tcagccagaggcttcttggttt

SEQ ID NO: 9491311 - DNA, 22 bp, Homo sapiens
tcagcatttcagaagtggcata

SEQ ID NO: 9491312 - DNA, 20 bp, Homo sapiens
tcagcatgctcctcagacat

SEQ ID NO: 9491313 - DNA, 22 bp, Homo sapiens
tcagcatgtacttctcctccat

SEQ ID NO: 9491314 - DNA, 22 bp, Homo sapiens
tcagcagttttatatgcagctt

SEQ ID NO: 9491315 - DNA, 22 bp, Homo sapiens
tcagcagttttatatgcagctt

SEQ ID NO: 9491316 - DNA, 19 bp, Homo sapiens
tcagcatcaatttggtcct

SEQ ID NO: 9491317 - DNA, 22 bp, Homo sapiens
tcagcagtgtgcccagaggctg

SEQ ID NO: 9491318 - DNA, 22 bp, Homo sapiens
tcagcagtgtgcccagaggctg

SEQ ID NO: 9491319 - DNA, 22 bp, Homo sapiens
tcagcagtgtcagttcccagag

SEQ ID NO: 9491320 - DNA, 22 bp, Homo sapiens
tcagcagtgtcagttcccagag

SEQ ID NO: 9491321 - DNA, 22 bp, Homo sapiens
tcagcagttattcccctacaga

SEQ ID NO: 9491322 - DNA, 22 bp, Homo sapiens
tcagcagtgtgcttggaatgga

SEQ ID NO: 9491323 - DNA, 22 bp, Homo sapiens
tcagcagttgccccctcccagc

SEQ ID NO: 9491324 - DNA, 22 bp, Homo sapiens
tcagcagttcaaccccgtcaga

SEQ ID NO: 9491325 - DNA, 22 bp, Homo sapiens
tcacagtgcaggatcagttaat

SEQ ID NO: 9491326 - DNA, 22 bp, Homo sapiens
tcacagtgcacccctcacaggg

SEQ ID NO: 9491327 - DNA, 22 bp, Homo sapiens
tcacagtgcacccctcacaggg

SEQ ID NO: 9491328 - DNA, 22 bp, Homo sapiens
tcacagtgctctgggtggcaga

SEQ ID NO: 9491329 - DNA, 18 bp, Homo sapiens
tcacagtgctcttgccta

SEQ ID NO: 9491330 - DNA, 22 bp, Homo sapiens
tcacagtggagccaccaaggta

SEQ ID NO: 9491331 - DNA, 22 bp, Homo sapiens
tcacagtggagccaccaaggta

SEQ ID NO: 9491332 - DNA, 22 bp, Homo sapiens
tcacagtgggacttttatcgct

SEQ ID NO: 9491333 - DNA, 22 bp, Homo sapiens
tcacagtgaggagttacagttt

SEQ ID NO: 9491334 - DNA, 22 bp, Homo sapiens
tcacagtgaggagttacagttt

SEQ ID NO: 9491335 - DNA, 22 bp, Homo sapiens
tcacagtgagccatgtcagaga

SEQ ID NO: 9491336 - DNA, 22 bp, Homo sapiens
tcacagtgatgacgtgggagca

SEQ ID NO: 9491337 - DNA, 22 bp, Homo sapiens
tcacagtgatgacgtgggagca

SEQ ID NO: 9491338 - DNA, 22 bp, Homo sapiens
tcacagtgcacagcaggcgtgg

SEQ ID NO: 9491339 - DNA, 22 bp, Homo sapiens
tcacagtgcacagcaggcgtgg

SEQ ID NO: 9491340 - DNA, 22 bp, Homo sapiens
tcacagttttagctgttaaata

SEQ ID NO: 9491341 - DNA, 22 bp, Homo sapiens
tcacagttttagaaaatagata

SEQ ID NO: 9491342 - DNA, 22 bp, Homo sapiens
tcacataaattatacaatttca

SEQ ID NO: 9491343 - DNA, 23 bp, Homo sapiens
tcacataatccttcatccacagg

SEQ ID NO: 9491344 - DNA, 23 bp, Homo sapiens
tcacataatccttcatccacagg

SEQ ID NO: 9491345 - DNA, 22 bp, Homo sapiens
tcacatactgaaagtccagtga

SEQ ID NO: 9491346 - DNA, 22 bp, Homo sapiens
tcacatacactaggatattttt

SEQ ID NO: 9491347 - DNA, 22 bp, Homo sapiens
tcacatacactaggatattttt

SEQ ID NO: 9491348 - DNA, 22 bp, Homo sapiens
tcacagtttccataggtcagca

SEQ ID NO: 9491349 - DNA, 22 bp, Homo sapiens
tcacagtgtgaaggtcagtcac

SEQ ID NO: 9491350 - DNA, 22 bp, Homo sapiens
tcacagtgtcgtccttgggtgt

SEQ ID NO: 9491351 - DNA, 22 bp, Homo sapiens
tcacagtttccataggtcagca

SEQ ID NO: 9491352 - DNA, 22 bp, Homo sapiens
tcacagtttcttttctgataaa

SEQ ID NO: 9491353 - DNA, 22 bp, Homo sapiens
tcacagttttagaaaatagata

SEQ ID NO: 9491354 - DNA, 22 bp, Homo sapiens
tcacatttctcagcactgatga

SEQ ID NO: 9491355 - DNA, 22 bp, Homo sapiens
tcacatttctcagcactgatga

SEQ ID NO: 9491356 - DNA, 22 bp, Homo sapiens
tcacatttatttcaaagttact

SEQ ID NO: 9491357 - DNA, 22 bp, Homo sapiens
tcacatttatttcaaagttact

SEQ ID NO: 9491358 - DNA, 22 bp, Homo sapiens
tcacatttctcagcactgatga

SEQ ID NO: 9491359 - DNA, 22 bp, Homo sapiens
tcacatttgataatgcccattg

SEQ ID NO: 9491360 - DNA, 22 bp, Homo sapiens
tcacatttctgattataccaaa

SEQ ID NO: 9491361 - DNA, 22 bp, Homo sapiens
tcacatttctgattataccaaa

SEQ ID NO: 9491362 - DNA, 22 bp, Homo sapiens
tcacatttctgattataccaaa

SEQ ID NO: 9491363 - DNA, 22 bp, Homo sapiens
tcacatttctgattataccaaa

SEQ ID NO: 9491364 - DNA, 22 bp, Homo sapiens
tcacatttctttatgtagtctt

SEQ ID NO: 9491365 - DNA, 21 bp, Homo sapiens
tcacatgcttattcctggaat

SEQ ID NO: 9491366 - DNA, 22 bp, Homo sapiens
tcacatgctactgagccagacc

SEQ ID NO: 9491367 - DNA, 22 bp, Homo sapiens
tcacatgctactgagccagacc

SEQ ID NO: 9491368 - DNA, 22 bp, Homo sapiens
tcacatttatttcaaagttact

SEQ ID NO: 9491369 - DNA, 22 bp, Homo sapiens
tcacatttatactccatttgca

SEQ ID NO: 9491370 - DNA, 22 bp, Homo sapiens
tcacattgttcttagtttacct

SEQ ID NO: 9491371 - DNA, 22 bp, Homo sapiens
tcacattgccgtctgtgcactt

SEQ ID NO: 9491372 - DNA, 22 bp, Homo sapiens
tcacattggaccttcctgacaa

SEQ ID NO: 9491373 - DNA, 22 bp, Homo sapiens
tcacagtgacttacagagattg

SEQ ID NO: 9491374 - DNA, 22 bp, Homo sapiens
tcacagtgacagccaatgtttt

SEQ ID NO: 9491375 - DNA, 22 bp, Homo sapiens
tcacagtgagaaatttgttggc

SEQ ID NO: 9491376 - DNA, 22 bp, Homo sapiens
tcacagtgacttacagagattg

SEQ ID NO: 9491377 - DNA, 23 bp, Homo sapiens
tcacagtatctctggagccatag

SEQ ID NO: 9491378 - DNA, 22 bp, Homo sapiens
tcacagtcggtgacttcttgct

SEQ ID NO: 9491379 - DNA, 22 bp, Homo sapiens
tcacagtcggtgacttcttgct

SEQ ID NO: 9491380 - DNA, 22 bp, Homo sapiens
tcacagtatcacacaaggatta

SEQ ID NO: 9491381 - DNA, 22 bp, Homo sapiens
tcacagtatcacacaaggatta

SEQ ID NO: 9491382 - DNA, 22 bp, Homo sapiens
tcacagtatcaggtggagtgga

SEQ ID NO: 9491383 - DNA, 22 bp, Homo sapiens
tcacagtatctagaaatgaggg

SEQ ID NO: 9491384 - DNA, 22 bp, Homo sapiens
tcacagtatctagaaatgaggg

SEQ ID NO: 9491385 - DNA, 22 bp, Homo sapiens
tcaagaaagggcttcaccagga

SEQ ID NO: 9491386 - DNA, 22 bp, Homo sapiens
tcaagaagataatgtctagggt

SEQ ID NO: 9491387 - DNA, 21 bp, Homo sapiens
tcaacccttgcgtcaccaagc

SEQ ID NO: 9491388 - DNA, 22 bp, Homo sapiens
tcaacccttcctccatatttcc

SEQ ID NO: 9491389 - DNA, 22 bp, Homo sapiens
tcaaccttgtgagaactgagtc

SEQ ID NO: 9491390 - DNA, 22 bp, Homo sapiens
tcaaccttgtgagaactgagtc

SEQ ID NO: 9491391 - DNA, 22 bp, Homo sapiens
tcaacctctggagaaatcagga

SEQ ID NO: 9491392 - DNA, 22 bp, Homo sapiens
tcaacgcatgctccaagaaaga

SEQ ID NO: 9491393 - DNA, 22 bp, Homo sapiens
tcaacttggagcacatttggct

SEQ ID NO: 9491394 - DNA, 23 bp, Homo sapiens
tcaactgctctgggaaggtcccc

SEQ ID NO: 9491395 - DNA, 22 bp, Homo sapiens
tcaactgcaagtttgcttagtt

SEQ ID NO: 9491396 - DNA, 22 bp, Homo sapiens
tcaacttggctttttaaagtcc

SEQ ID NO: 9491397 - DNA, 22 bp, Homo sapiens
tcaagaaaatgcctgctggtgt

SEQ ID NO: 9491398 - DNA, 22 bp, Homo sapiens
tcaagaaactgtagcaatgggt

SEQ ID NO: 9491399 - DNA, 22 bp, Homo sapiens
tcaagaaagggcttcaccagga

SEQ ID NO: 9491400 - DNA, 22 bp, Homo sapiens
tcaagaaactgtgctacagagt

SEQ ID NO: 9491401 - DNA, 22 bp, Homo sapiens
tcaagaaactgtgctacagagt

SEQ ID NO: 9491402 - DNA, 22 bp, Homo sapiens
tcaacacttttgtctttgtccc

SEQ ID NO: 9491403 - DNA, 22 bp, Homo sapiens
tcaacactggctacagttatgc

SEQ ID NO: 9491404 - DNA, 22 bp, Homo sapiens
tcaacactctttggcacagtta

SEQ ID NO: 9491405 - DNA, 22 bp, Homo sapiens
tcaacactatccaggcaatctt

SEQ ID NO: 9491406 - DNA, 22 bp, Homo sapiens
tcaacagacatttttaagcact

SEQ ID NO: 9491407 - DNA, 22 bp, Homo sapiens
tcaacagacatttttaagcact

SEQ ID NO: 9491408 - DNA, 22 bp, Homo sapiens
tcaacagaagtgatagctatta

SEQ ID NO: 9491409 - DNA, 22 bp, Homo sapiens
tcaacatataggcaacctgtaa

SEQ ID NO: 9491410 - DNA, 22 bp, Homo sapiens
tcaaccacagtcccatgtctcc

SEQ ID NO: 9491411 - DNA, 22 bp, Homo sapiens
tcaaccacagtcccatgtctcc

SEQ ID NO: 9491412 - DNA, 22 bp, Homo sapiens
tcaacattcatatatagccaca

SEQ ID NO: 9491413 - DNA, 22 bp, Homo sapiens
tcaacagctagaaatatagaga

SEQ ID NO: 9491414 - DNA, 22 bp, Homo sapiens
tcaacaagagcccatgcttttt

SEQ ID NO: 9491415 - DNA, 22 bp, Homo sapiens
tcaaatgcacctctcatttgtt

SEQ ID NO: 9491416 - DNA, 22 bp, Homo sapiens
tcaaatgaggctgatgaatgtg

SEQ ID NO: 9491417 - DNA, 22 bp, Homo sapiens
tcaaatgagtgactcacacagg

SEQ ID NO: 9491418 - DNA, 22 bp, Homo sapiens
tcaacaataggatatagcaggt

SEQ ID NO: 9491419 - DNA, 22 bp, Homo sapiens
tcaacaataggatatagcaggt

SEQ ID NO: 9491420 - DNA, 22 bp, Homo sapiens
tcaacactatccaggcaatctt

SEQ ID NO: 9491421 - DNA, 22 bp, Homo sapiens
tcaacaattttgagatgagaca

SEQ ID NO: 9491422 - DNA, 22 bp, Homo sapiens
tcaacaattttgagatgagaca

SEQ ID NO: 9491423 - DNA, 22 bp, Homo sapiens
tcagaagtttcaatcccagctg

SEQ ID NO: 9491424 - DNA, 20 bp, Homo sapiens
tcagaagtttcctggagcat

SEQ ID NO: 9491425 - DNA, 23 bp, Homo sapiens
tcagaagtttggttgtaacatgg

SEQ ID NO: 9491426 - DNA, 23 bp, Homo sapiens
tcagaataataacctagtaactg

SEQ ID NO: 9491427 - DNA, 22 bp, Homo sapiens
tcagaatatattcatgttgtca

SEQ ID NO: 9491428 - DNA, 22 bp, Homo sapiens
tcagaatatattcatgttgtca

SEQ ID NO: 9491429 - DNA, 22 bp, Homo sapiens
tcagaatatattcatgttgtca

SEQ ID NO: 9491430 - DNA, 22 bp, Homo sapiens
tcagaatctaaataggctccag

SEQ ID NO: 9491431 - DNA, 22 bp, Homo sapiens
tcagaatctctggaggcttggc

SEQ ID NO: 9491432 - DNA, 22 bp, Homo sapiens
tcagaatatgctaatgacattt

SEQ ID NO: 9491433 - DNA, 22 bp, Homo sapiens
tcagaatctgaaaagcgcttgg

SEQ ID NO: 9491434 - DNA, 22 bp, Homo sapiens
tcagaatctttctagagtctag

SEQ ID NO: 9491435 - DNA, 22 bp, Homo sapiens
tcagaacaggttgtactatgtc

SEQ ID NO: 9491436 - DNA, 22 bp, Homo sapiens
tcagaacaggttgtactatgtc

SEQ ID NO: 9491437 - DNA, 22 bp, Homo sapiens
tcagaacaggttgtactatgtc

SEQ ID NO: 9491438 - DNA, 22 bp, Homo sapiens
tcagaacaggttgtactatgtc

SEQ ID NO: 9491439 - DNA, 22 bp, Homo sapiens
tcagaacagctctcagatatcc

SEQ ID NO: 9491440 - DNA, 22 bp, Homo sapiens
tcagaacaggactggctgccat

SEQ ID NO: 9491441 - DNA, 22 bp, Homo sapiens
tcagaacaggactggctgccat

SEQ ID NO: 9491442 - DNA, 22 bp, Homo sapiens
tcagaacagcgagaatattcac

SEQ ID NO: 9491443 - DNA, 22 bp, Homo sapiens
tcagaacagctctcagatatcc

SEQ ID NO: 9491444 - DNA, 22 bp, Homo sapiens
tcagaacagctctcagatatcc

SEQ ID NO: 9491445 - DNA, 22 bp, Homo sapiens
tcagaacagcgagaatattcac

SEQ ID NO: 9491446 - DNA, 22 bp, Homo sapiens
tcagaagccttgattatctaga

SEQ ID NO: 9491447 - DNA, 23 bp, Homo sapiens
tcagaagtgggatacaaagctga

SEQ ID NO: 9491448 - DNA, 22 bp, Homo sapiens
tcagaagccttgattatctaga

SEQ ID NO: 9491449 - DNA, 22 bp, Homo sapiens
tcagaagttaatacgaggagaa

SEQ ID NO: 9491450 - DNA, 22 bp, Homo sapiens
tcagaagttaatatataaattt

SEQ ID NO: 9491451 - DNA, 22 bp, Homo sapiens
tcagaagttgaaggctcttttt

SEQ ID NO: 9491452 - DNA, 22 bp, Homo sapiens
tcagaagttgagatattcaggg

SEQ ID NO: 9491453 - DNA, 22 bp, Homo sapiens
tcagaagccgggcaggttttgg

SEQ ID NO: 9491454 - DNA, 22 bp, Homo sapiens
tcagaagccaccttttgttggg

SEQ ID NO: 9491455 - DNA, 22 bp, Homo sapiens
tcagaaagctatatggtgtgtc

SEQ ID NO: 9491456 - DNA, 22 bp, Homo sapiens
tcagaaagacgaaacagatggg

SEQ ID NO: 9491457 - DNA, 22 bp, Homo sapiens
tcagaaagacgaaacagatggg

SEQ ID NO: 9491458 - DNA, 22 bp, Homo sapiens
tcagaaagctatatggtgtgtc

SEQ ID NO: 9491459 - DNA, 22 bp, Homo sapiens
tcagaaagcttagtgtcttgca

SEQ ID NO: 9491460 - DNA, 22 bp, Homo sapiens
tcagaaagaacacaggcagtag

SEQ ID NO: 9491461 - DNA, 22 bp, Homo sapiens
tcagaaagaacacaggcagtag

SEQ ID NO: 9491462 - DNA, 22 bp, Homo sapiens
tcagaaaatgaaatggactctc

SEQ ID NO: 9491463 - DNA, 22 bp, Homo sapiens
tcagaaaatgaaatggactctc

SEQ ID NO: 9491464 - DNA, 22 bp, Homo sapiens
tcagaaacagaaactaagaacc

SEQ ID NO: 9491465 - DNA, 22 bp, Homo sapiens
tcagaaaccagctctctcaatt

SEQ ID NO: 9491466 - DNA, 22 bp, Homo sapiens
tcagaaacagaaactaagaacc

SEQ ID NO: 9491467 - DNA, 22 bp, Homo sapiens
tcagaaaggagttagaggtctc

SEQ ID NO: 9491468 - DNA, 22 bp, Homo sapiens
tcagaaagcttttacttaaaca

SEQ ID NO: 9491469 - DNA, 22 bp, Homo sapiens
tcagaaaggttctatgttttac

SEQ ID NO: 9491470 - DNA, 22 bp, Homo sapiens
tcagaaaggccacatggtgcag

SEQ ID NO: 9491471 - DNA, 22 bp, Homo sapiens
tcagaaaggccacatggtgcag

SEQ ID NO: 9491472 - DNA, 22 bp, Homo sapiens
tcagaaaggttctatgttttac

SEQ ID NO: 9491473 - DNA, 22 bp, Homo sapiens
tcagaacagaagctggctataa

SEQ ID NO: 9491474 - DNA, 22 bp, Homo sapiens
tcagaacagcacagggtgattt

SEQ ID NO: 9491475 - DNA, 22 bp, Homo sapiens
tcagaacagaagctggctataa

SEQ ID NO: 9491476 - DNA, 22 bp, Homo sapiens
tcagaacagaagaaggaacacg

SEQ ID NO: 9491477 - DNA, 22 bp, Homo sapiens
tcagaacaattcctttataaca

SEQ ID NO: 9491478 - DNA, 22 bp, Homo sapiens
tcagaacaattgggaaccatta

SEQ ID NO: 9491479 - DNA, 22 bp, Homo sapiens
tcagaacaattgggaaccatta

SEQ ID NO: 9491480 - DNA, 22 bp, Homo sapiens
tcagaacagaagaaggaacacg

SEQ ID NO: 9491481 - DNA, 22 bp, Homo sapiens
tcagaacactttctctactgac

SEQ ID NO: 9491482 - DNA, 22 bp, Homo sapiens
tcactgcaacctccacctcccg

SEQ ID NO: 9491483 - DNA, 22 bp, Homo sapiens
tcactgcaacctccacctcccg

SEQ ID NO: 9491484 - DNA, 22 bp, Homo sapiens
tcactgcaacctccacctcccg

SEQ ID NO: 9491485 - DNA, 22 bp, Homo sapiens
tcactgcaacctccacctcccg

SEQ ID NO: 9491486 - DNA, 22 bp, Homo sapiens
tcactgcaacctccacctcccg

SEQ ID NO: 9491487 - DNA, 22 bp, Homo sapiens
tcactgcaacctccacctcccg

SEQ ID NO: 9491488 - DNA, 22 bp, Homo sapiens
tcactgatttgcccttatcctg

SEQ ID NO: 9491489 - DNA, 22 bp, Homo sapiens
tcactgattatgaaaatgaagg

SEQ ID NO: 9491490 - DNA, 22 bp, Homo sapiens
tcactgattatgaaaatgaagg

SEQ ID NO: 9491491 - DNA, 22 bp, Homo sapiens
tcactgattatgaaaatgaagg

SEQ ID NO: 9491492 - DNA, 22 bp, Homo sapiens
tcacattttatatctctggttt

SEQ ID NO: 9491493 - DNA, 22 bp, Homo sapiens
tcacattttatctattttaagt

SEQ ID NO: 9491494 - DNA, 22 bp, Homo sapiens
tcacattttatctattttaagt

SEQ ID NO: 9491495 - DNA, 22 bp, Homo sapiens
tcacattttatctattttaagt

SEQ ID NO: 9491496 - DNA, 22 bp, Homo sapiens
tcacatttggagaaagcctgcc

SEQ ID NO: 9491497 - DNA, 22 bp, Homo sapiens
tcacatttgtgttttattagag

SEQ ID NO: 9491498 - DNA, 22 bp, Homo sapiens
tcacatttgataatgcccattg

SEQ ID NO: 9491499 - DNA, 22 bp, Homo sapiens
tcacatttgcaattgcattgtt

SEQ ID NO: 9491500 - DNA, 22 bp, Homo sapiens
tcacatttgctatcccactcct

SEQ ID NO: 9491501 - DNA, 22 bp, Homo sapiens
tcacatttgcaattgcattgtt

SEQ ID NO: 9491502 - DNA, 22 bp, Homo sapiens
tcacatttgcaattgcattgtt

SEQ ID NO: 9491503 - DNA, 22 bp, Homo sapiens
tcacattttatatctctggttt

SEQ ID NO: 9491504 - DNA, 22 bp, Homo sapiens
tcacattttagtaccatgattt

SEQ ID NO: 9491505 - DNA, 22 bp, Homo sapiens
tcacattttagtaccatgattt

SEQ ID NO: 9491506 - DNA, 22 bp, Homo sapiens
tcacattttagtaccatgattt

SEQ ID NO: 9491507 - DNA, 22 bp, Homo sapiens
tcacatttgttcctctgcactt

SEQ ID NO: 9491508 - DNA, 22 bp, Homo sapiens
tcacatttgttcctctgcactt

SEQ ID NO: 9491509 - DNA, 22 bp, Homo sapiens
tcacatttgttcctctgcactt

SEQ ID NO: 9491510 - DNA, 22 bp, Homo sapiens
tcactgcttaactcaagatctc

SEQ ID NO: 9491511 - DNA, 22 bp, Homo sapiens
tcactgctctctaagcatcgcc

SEQ ID NO: 9491512 - DNA, 22 bp, Homo sapiens
tcactgctgctgccatgatgga

SEQ ID NO: 9491513 - DNA, 22 bp, Homo sapiens
tcactgcttcttggagaatgtc

SEQ ID NO: 9491514 - DNA, 22 bp, Homo sapiens
tcagaaaatgaaatggactctc

SEQ ID NO: 9491515 - DNA, 22 bp, Homo sapiens
tcactgctctgaaagtacaggg

SEQ ID NO: 9491516 - DNA, 22 bp, Homo sapiens
tcactgctctctaagcatcgcc

SEQ ID NO: 9491517 - DNA, 22 bp, Homo sapiens
tcactgctgctgccatgatgga

SEQ ID NO: 9491518 - DNA, 22 bp, Homo sapiens
tcactgctctgaaagtacaggg

SEQ ID NO: 9491519 - DNA, 22 bp, Homo sapiens
tcactgctgctgccatgatgga

SEQ ID NO: 9491520 - DNA, 22 bp, Homo sapiens
tcactgctcagtctgtactaca

SEQ ID NO: 9491521 - DNA, 22 bp, Homo sapiens
tcactgctcgataacatgatta

SEQ ID NO: 9491522 - DNA, 22 bp, Homo sapiens
tcactgctcagtctgtactaca

SEQ ID NO: 9491523 - DNA, 22 bp, Homo sapiens
tcactgctctccaatgtggagt

SEQ ID NO: 9491524 - DNA, 22 bp, Homo sapiens
tcactgctcgataacatgatta

SEQ ID NO: 9491525 - DNA, 22 bp, Homo sapiens
tcactgctctccaatgtggagt

SEQ ID NO: 9491526 - DNA, 23 bp, Homo sapiens
tcactgctactcagcctgagatt

SEQ ID NO: 9491527 - DNA, 23 bp, Homo sapiens
tcactgctactcagcctgagatt

SEQ ID NO: 9491528 - DNA, 23 bp, Homo sapiens
tcactgctactcagcctgagatt

SEQ ID NO: 9491529 - DNA, 23 bp, Homo sapiens
tcactgctactcagcctgagatt

SEQ ID NO: 9491530 - DNA, 22 bp, Homo sapiens
tcactgctatattggatactga

SEQ ID NO: 9491531 - DNA, 22 bp, Homo sapiens
tcactgctatattggatactga

SEQ ID NO: 9491532 - DNA, 23 bp, Homo sapiens
tcactgctactcagcctgagatt

SEQ ID NO: 9491533 - DNA, 22 bp, Homo sapiens
tcactgctatattggatactga

SEQ ID NO: 9491534 - DNA, 22 bp, Homo sapiens
tcactgcaacctccacctcctg

SEQ ID NO: 9491535 - DNA, 22 bp, Homo sapiens
tcactgctacacaagtttctgc

SEQ ID NO: 9491536 - DNA, 22 bp, Homo sapiens
tcactgcaacctccacctcctg

SEQ ID NO: 9491537 - DNA, 22 bp, Homo sapiens
tcactgcaacctccacctcccg

SEQ ID NO: 9491538 - DNA, 22 bp, Homo sapiens
tcactgcaacctccacctcccg

SEQ ID NO: 9491539 - DNA, 22 bp, Homo sapiens
tcactgcaacctccacctcccg

SEQ ID NO: 9491540 - DNA, 22 bp, Homo sapiens
tcactgcaacctccacctcccg

SEQ ID NO: 9491541 - DNA, 22 bp, Homo sapiens
tcactgcaacctccacctcctg

SEQ ID NO: 9491542 - DNA, 22 bp, Homo sapiens
tcactgcaacctccacctcctg

SEQ ID NO: 9491543 - DNA, 22 bp, Homo sapiens
tcactgcaacctccacctcctg

SEQ ID NO: 9491544 - DNA, 22 bp, Homo sapiens
tcactgcaacctccacctcctg

SEQ ID NO: 9491545 - DNA, 22 bp, Homo sapiens
tactgaaagaatacataatttc

SEQ ID NO: 9491546 - DNA, 22 bp, Homo sapiens
tactgtgtgcccagccgagctg

SEQ ID NO: 9491547 - DNA, 22 bp, Homo sapiens
tactgtgtgcccagccgagctg

SEQ ID NO: 9491548 - DNA, 22 bp, Homo sapiens
tactgttaatgttaaattcagg

SEQ ID NO: 9491549 - DNA, 22 bp, Homo sapiens
tactcctgctgatcctgccagc

SEQ ID NO: 9491550 - DNA, 22 bp, Homo sapiens
tactctaaaaagaagcagatct

SEQ ID NO: 9491551 - DNA, 22 bp, Homo sapiens
tactccagacattctgtcctcg

SEQ ID NO: 9491552 - DNA, 22 bp, Homo sapiens
tactcctgctgatcctgccagc

SEQ ID NO: 9491553 - DNA, 22 bp, Homo sapiens
tactccaggactccatttgaaa

SEQ ID NO: 9491554 - DNA, 22 bp, Homo sapiens
tactgttttctttatagtacag

SEQ ID NO: 9491555 - DNA, 22 bp, Homo sapiens
tactgttttctttatagtacag

SEQ ID NO: 9491556 - DNA, 22 bp, Homo sapiens
tactgttttctttatagtacag

SEQ ID NO: 9491557 - DNA, 22 bp, Homo sapiens
tacttaaaaattatcaaagtgg

SEQ ID NO: 9491558 - DNA, 22 bp, Homo sapiens
tactgttttttagactcatggt

SEQ ID NO: 9491559 - DNA, 22 bp, Homo sapiens
tacttaaaaattatcaaagtgg

SEQ ID NO: 9491560 - DNA, 18 bp, Homo sapiens
tactgtttaattgattac

SEQ ID NO: 9491561 - DNA, 22 bp, Homo sapiens
tactgttcatgccttcataaag

SEQ ID NO: 9491562 - DNA, 22 bp, Homo sapiens
tactgttatatatagcagcagt

SEQ ID NO: 9491563 - DNA, 22 bp, Homo sapiens
tactgtttgaaattggcttgtt

SEQ ID NO: 9491564 - DNA, 22 bp, Homo sapiens
tacttaatgccactgaattgta

SEQ ID NO: 9491565 - DNA, 22 bp, Homo sapiens
tacttaaataattgctgctatt

SEQ ID NO: 9491566 - DNA, 22 bp, Homo sapiens
tacttaaaactgatagaatctc

SEQ ID NO: 9491567 - DNA, 22 bp, Homo sapiens
tacttaaaactgatagaatctc

SEQ ID NO: 9491568 - DNA, 22 bp, Homo sapiens
tacttaaaactgatagaatctc

SEQ ID NO: 9491569 - DNA, 22 bp, Homo sapiens
tacttaaaactgatagaatctc

SEQ ID NO: 9491570 - DNA, 22 bp, Homo sapiens
tacttaaaaattatcaaagtgg

SEQ ID NO: 9491571 - DNA, 22 bp, Homo sapiens
tacttacagagcttataagtta

SEQ ID NO: 9491572 - DNA, 22 bp, Homo sapiens
tacttacagttacggcaagtgg

SEQ ID NO: 9491573 - DNA, 22 bp, Homo sapiens
tacttacagttacggcaagtgg

SEQ ID NO: 9491574 - DNA, 22 bp, Homo sapiens
tacttacagagcttataagtta

SEQ ID NO: 9491575 - DNA, 22 bp, Homo sapiens
tacttacagagcttataagtta

SEQ ID NO: 9491576 - DNA, 22 bp, Homo sapiens
tacttacataaaaactgaatgt

SEQ ID NO: 9491577 - DNA, 22 bp, Homo sapiens
tacttacataaaaactgaatgt

SEQ ID NO: 9491578 - DNA, 22 bp, Homo sapiens
tacttacataaaaactgaatgt

SEQ ID NO: 9491579 - DNA, 22 bp, Homo sapiens
tacttacactgaagcaaagata

SEQ ID NO: 9491580 - DNA, 22 bp, Homo sapiens
tacttacacagctgtagaaggt

SEQ ID NO: 9491581 - DNA, 22 bp, Homo sapiens
tacttacacagctgtagaaggt

SEQ ID NO: 9491582 - DNA, 22 bp, Homo sapiens
tacttacacagctgtagaaggt

SEQ ID NO: 9491583 - DNA, 22 bp, Homo sapiens
tacttacagaaggaagcaattg

SEQ ID NO: 9491584 - DNA, 22 bp, Homo sapiens
tacttacagaaggaagcaattg

SEQ ID NO: 9491585 - DNA, 22 bp, Homo sapiens
tacttacagaaggaagcaattg

SEQ ID NO: 9491586 - DNA, 22 bp, Homo sapiens
tacttacagaaggaagcaattg

SEQ ID NO: 9491587 - DNA, 22 bp, Homo sapiens
taccatgtcttcaataagtcta

SEQ ID NO: 9491588 - DNA, 22 bp, Homo sapiens
taccatgatcaggctcatcctt

SEQ ID NO: 9491589 - DNA, 22 bp, Homo sapiens
taccatttcagtaaaaacttag

SEQ ID NO: 9491590 - DNA, 22 bp, Homo sapiens
taccatttcagtaaaaacttag

SEQ ID NO: 9491591 - DNA, 22 bp, Homo sapiens
taccatttacttgaaaataaaa

SEQ ID NO: 9491592 - DNA, 22 bp, Homo sapiens
taccatttacttgaaaataaaa

SEQ ID NO: 9491593 - DNA, 22 bp, Homo sapiens
taccattattcacatgatcttt

SEQ ID NO: 9491594 - DNA, 22 bp, Homo sapiens
taccaggcagctgcacagaggc

SEQ ID NO: 9491595 - DNA, 22 bp, Homo sapiens
taccaggtctgtgcaggtgtca

SEQ ID NO: 9491596 - DNA, 22 bp, Homo sapiens
taccataacgtaatgaacttga

SEQ ID NO: 9491597 - DNA, 20 bp, Homo sapiens
taccatcatatgcatttaat

SEQ ID NO: 9491598 - DNA, 22 bp, Homo sapiens
taccaattctattttggattga

SEQ ID NO: 9491599 - DNA, 21 bp, Homo sapiens
taccaattgccttctagttgt

SEQ ID NO: 9491600 - DNA, 22 bp, Homo sapiens
taccacctcaacctcatctgac

SEQ ID NO: 9491601 - DNA, 20 bp, Homo sapiens
taccacttatttgaataatt

SEQ ID NO: 9491602 - DNA, 22 bp, Homo sapiens
taccagatgcaaagcgattgtg

SEQ ID NO: 9491603 - DNA, 22 bp, Homo sapiens
taccactgctccctgcctgtga

SEQ ID NO: 9491604 - DNA, 22 bp, Homo sapiens
taccacctccatcctcctttca

SEQ ID NO: 9491605 - DNA, 22 bp, Homo sapiens
taccagcttccttcaagatgtg

SEQ ID NO: 9491606 - DNA, 15 bp, Homo sapiens
taccagctgatccgt

SEQ ID NO: 9491607 - DNA, 22 bp, Homo sapiens
taccaggaattattttacattt

SEQ ID NO: 9491608 - DNA, 22 bp, Homo sapiens
taccagcatcacagcatgttgg

SEQ ID NO: 9491609 - DNA, 22 bp, Homo sapiens
taccagcctcagttgtgagccc

SEQ ID NO: 9491610 - DNA, 22 bp, Homo sapiens
taccagctcacacaatctttgt

SEQ ID NO: 9491611 - DNA, 22 bp, Homo sapiens
taccagccttttaacatgggcc

SEQ ID NO: 9491612 - DNA, 22 bp, Homo sapiens
taccagcctctgttgggggtgg

SEQ ID NO: 9491613 - DNA, 22 bp, Homo sapiens
tactacaaggccgaagctctca

SEQ ID NO: 9491614 - DNA, 22 bp, Homo sapiens
tactacaagggccctaaaaggt

SEQ ID NO: 9491615 - DNA, 22 bp, Homo sapiens
tactacaagggccctaaaaggt

SEQ ID NO: 9491616 - DNA, 22 bp, Homo sapiens
taccattttgaaacatttcatc

SEQ ID NO: 9491617 - DNA, 22 bp, Homo sapiens
taccattttgaaacatttcatc

SEQ ID NO: 9491618 - DNA, 22 bp, Homo sapiens
taccatttgagagagaacataa

SEQ ID NO: 9491619 - DNA, 22 bp, Homo sapiens
taccatttctacatatcttgtc

SEQ ID NO: 9491620 - DNA, 22 bp, Homo sapiens
taccatttgagagagaacataa

SEQ ID NO: 9491621 - DNA, 22 bp, Homo sapiens
taccatttgagagagaacataa

SEQ ID NO: 9491622 - DNA, 22 bp, Homo sapiens
taccatttcattctttcctcat

SEQ ID NO: 9491623 - DNA, 22 bp, Homo sapiens
taccatttctacatatcttgtc

SEQ ID NO: 9491624 - DNA, 22 bp, Homo sapiens
taccatttctacatatcttgtc

SEQ ID NO: 9491625 - DNA, 22 bp, Homo sapiens
tactacatacagaatttagaga

SEQ ID NO: 9491626 - DNA, 21 bp, Homo sapiens
tactacagtctctttatcagt

SEQ ID NO: 9491627 - DNA, 22 bp, Homo sapiens
tactacattaataaaacattca

SEQ ID NO: 9491628 - DNA, 17 bp, Homo sapiens
tactatgagaaagtagg

SEQ ID NO: 9491629 - DNA, 19 bp, Homo sapiens
tactccaatcaggaacaca

SEQ ID NO: 9491630 - DNA, 23 bp, Homo sapiens
tactataacgctgtgtcagctcc

SEQ ID NO: 9491631 - DNA, 22 bp, Homo sapiens
tactagttctcatatgaaataa

SEQ ID NO: 9491632 - DNA, 22 bp, Homo sapiens
tactagctaacattctcaccaa

SEQ ID NO: 9491633 - DNA, 17 bp, Homo sapiens
tactagaatagagacag

SEQ ID NO: 9491634 - DNA, 17 bp, Homo sapiens
tactagaatagagacag

SEQ ID NO: 9491635 - DNA, 22 bp, Homo sapiens
tactagaacctcacaacaatcc

SEQ ID NO: 9491636 - DNA, 22 bp, Homo sapiens
tactagaaattaccttctcact

SEQ ID NO: 9491637 - DNA, 22 bp, Homo sapiens
tactagaacctcacaacaatcc

SEQ ID NO: 9491638 - DNA, 22 bp, Homo sapiens
tacagacagtttttcagatatt

SEQ ID NO: 9491639 - DNA, 22 bp, Homo sapiens
tacagagatactctagatcaaa

SEQ ID NO: 9491640 - DNA, 22 bp, Homo sapiens
tacagtatatactgtgtgtaga

SEQ ID NO: 9491641 - DNA, 22 bp, Homo sapiens
tacagtatatactgtgtgtaga

SEQ ID NO: 9491642 - DNA, 22 bp, Homo sapiens
tacagtatggaaaatgtatagt

SEQ ID NO: 9491643 - DNA, 22 bp, Homo sapiens
tacagtatggaaaatgtatagt

SEQ ID NO: 9491644 - DNA, 22 bp, Homo sapiens
tacagtatgttcttgaatttgg

SEQ ID NO: 9491645 - DNA, 22 bp, Homo sapiens
tacagtattactgtgttgtttt

SEQ ID NO: 9491646 - DNA, 22 bp, Homo sapiens
tacagtattactgtgttgtttt

SEQ ID NO: 9491647 - DNA, 22 bp, Homo sapiens
tacagtattatgagtgattgaa

SEQ ID NO: 9491648 - DNA, 22 bp, Homo sapiens
tacagtatagaatgtgtattaa

SEQ ID NO: 9491649 - DNA, 22 bp, Homo sapiens
tacagagtaatttgcatgggga

SEQ ID NO: 9491650 - DNA, 22 bp, Homo sapiens
tacagtgacctagaataaatac

SEQ ID NO: 9491651 - DNA, 22 bp, Homo sapiens
tacagtgactggactttgtcat

SEQ ID NO: 9491652 - DNA, 21 bp, Homo sapiens
tacagtgaggtgttaggatgt

SEQ ID NO: 9491653 - DNA, 22 bp, Homo sapiens
tacagtgaccctatttccaaat

SEQ ID NO: 9491654 - DNA, 22 bp, Homo sapiens
tacagtctttggaaagagatag

SEQ ID NO: 9491655 - DNA, 22 bp, Homo sapiens
tacagtctttggaaagagatag

SEQ ID NO: 9491656 - DNA, 21 bp, Homo sapiens
tacagtctcccctgttgtcca

SEQ ID NO: 9491657 - DNA, 22 bp, Homo sapiens
tacagtctctgataactgtcag

SEQ ID NO: 9491658 - DNA, 22 bp, Homo sapiens
tacagtgcatagaggcatgata

SEQ ID NO: 9491659 - DNA, 22 bp, Homo sapiens
tacagtgatagagagtagctat

SEQ ID NO: 9491660 - DNA, 22 bp, Homo sapiens
tacagtgcttggtatctagtaa

SEQ ID NO: 9491661 - DNA, 22 bp, Homo sapiens
tacagtgcatagaggcatgata

SEQ ID NO: 9491662 - DNA, 20 bp, Homo sapiens
tacagtgtatgtatttaggc

SEQ ID NO: 9491663 - DNA, 22 bp, Homo sapiens
tacagtgtatgtatttgtaggt

SEQ ID NO: 9491664 - DNA, 22 bp, Homo sapiens
tacatgctcagtaactttcagt

SEQ ID NO: 9491665 - DNA, 22 bp, Homo sapiens
tacatgctcagtaactttcagt

SEQ ID NO: 9491666 - DNA, 22 bp, Homo sapiens
tacatgctccttatgagaatct

SEQ ID NO: 9491667 - DNA, 22 bp, Homo sapiens
tacatgctccactttctcctgt

SEQ ID NO: 9491668 - DNA, 22 bp, Homo sapiens
tacatgctccactttctcctgt

SEQ ID NO: 9491669 - DNA, 22 bp, Homo sapiens
tacatgcattggatggcaatag

SEQ ID NO: 9491670 - DNA, 22 bp, Homo sapiens
tacatgtaagacatgagactct

SEQ ID NO: 9491671 - DNA, 22 bp, Homo sapiens
tacatgtaattttcatagtaag

SEQ ID NO: 9491672 - DNA, 22 bp, Homo sapiens
tacatgtaagacatgagactct

SEQ ID NO: 9491673 - DNA, 22 bp, Homo sapiens
tacatggtggtggcacttgact

SEQ ID NO: 9491674 - DNA, 22 bp, Homo sapiens
tacatgtaagacatgagactct

SEQ ID NO: 9491675 - DNA, 22 bp, Homo sapiens
tacatggatgttatccttactg

SEQ ID NO: 9491676 - DNA, 22 bp, Homo sapiens
tacatgcttctatatgtgaagt

SEQ ID NO: 9491677 - DNA, 22 bp, Homo sapiens
tacatgctggtgactgtagaca

SEQ ID NO: 9491678 - DNA, 22 bp, Homo sapiens
tacatgtaggtgacattttaat

SEQ ID NO: 9491679 - DNA, 22 bp, Homo sapiens
tacatgtacatgcataggtaga

SEQ ID NO: 9491680 - DNA, 22 bp, Homo sapiens
tacatgtacatgcataggtaga

SEQ ID NO: 9491681 - DNA, 22 bp, Homo sapiens
tacatgtaattttcatagtaag

SEQ ID NO: 9491682 - DNA, 22 bp, Homo sapiens
tacatgtaattttcatagtaag

SEQ ID NO: 9491683 - DNA, 22 bp, Homo sapiens
tacatgtatgtgtacgtgcatg

SEQ ID NO: 9491684 - DNA, 22 bp, Homo sapiens
tacatgtatgtgttaatatctg

SEQ ID NO: 9491685 - DNA, 22 bp, Homo sapiens
tacatgtatgtgtacgtgcatg

SEQ ID NO: 9491686 - DNA, 22 bp, Homo sapiens
tacatgtatgtgttaatatctg

SEQ ID NO: 9491687 - DNA, 22 bp, Homo sapiens
tacatgtatgtgttaatatctg

SEQ ID NO: 9491688 - DNA, 22 bp, Homo sapiens
tacatgtatgtgttaatatctg

SEQ ID NO: 9491689 - DNA, 22 bp, Homo sapiens
taccaagtgtattatgctttgt

SEQ ID NO: 9491690 - DNA, 18 bp, Homo sapiens
taccaaaggctttctttt

SEQ ID NO: 9491691 - DNA, 22 bp, Homo sapiens
taccaaagattaaatagcaaca

SEQ ID NO: 9491692 - DNA, 22 bp, Homo sapiens
taccaaatgtaatcattctaat

SEQ ID NO: 9491693 - DNA, 22 bp, Homo sapiens
taccaaatgtaatcattctaat

SEQ ID NO: 9491694 - DNA, 19 bp, Homo sapiens
taccaaattgcattatggc

SEQ ID NO: 9491695 - DNA, 19 bp, Homo sapiens
taccaaattgcattatggc

SEQ ID NO: 9491696 - DNA, 22 bp, Homo sapiens
tacatgaagaaaattaagcagt

SEQ ID NO: 9491697 - DNA, 22 bp, Homo sapiens
tacatgaagaaaattaagcagt

SEQ ID NO: 9491698 - DNA, 22 bp, Homo sapiens
tacatgaatgtttcaatattgt

SEQ ID NO: 9491699 - DNA, 22 bp, Homo sapiens
tacatgaagttgtctaaactgg

SEQ ID NO: 9491700 - DNA, 22 bp, Homo sapiens
tacatgaatgtttcaatattgt

SEQ ID NO: 9491701 - DNA, 22 bp, Homo sapiens
tacagttaaaaagttcaatggt

SEQ ID NO: 9491702 - DNA, 22 bp, Homo sapiens
tacatgaacaaaatagcagaaa

SEQ ID NO: 9491703 - DNA, 22 bp, Homo sapiens
tacatgaacaaaatagcagaaa

SEQ ID NO: 9491704 - DNA, 22 bp, Homo sapiens
tacatgaacaaaatagcagaaa

SEQ ID NO: 9491705 - DNA, 22 bp, Homo sapiens
tacatgaacaaaatagcagaaa

SEQ ID NO: 9491706 - DNA, 22 bp, Homo sapiens
taatataccaaactgtaatttt

SEQ ID NO: 9491707 - DNA, 22 bp, Homo sapiens
taatataccaaactgtaatttt

SEQ ID NO: 9491708 - DNA, 22 bp, Homo sapiens
taatagttgtgactttgtaaag

SEQ ID NO: 9491709 - DNA, 22 bp, Homo sapiens
taatagttgtgactttgtaaag

SEQ ID NO: 9491710 - DNA, 22 bp, Homo sapiens
taatagttgtgactttgtaaag

SEQ ID NO: 9491711 - DNA, 19 bp, Homo sapiens
taatatacagacccatctg

SEQ ID NO: 9491712 - DNA, 22 bp, Homo sapiens
taatagtttcataatgtgcttc

SEQ ID NO: 9491713 - DNA, 22 bp, Homo sapiens
taatatacttcccatagtttga

SEQ ID NO: 9491714 - DNA, 22 bp, Homo sapiens
taatatacttcccatagtttga

SEQ ID NO: 9491715 - DNA, 22 bp, Homo sapiens
taatataccaaactgtaatttt

SEQ ID NO: 9491716 - DNA, 22 bp, Homo sapiens
taatatatacctttgttaggaa

SEQ ID NO: 9491717 - DNA, 22 bp, Homo sapiens
taatatatacctttgttaggaa

SEQ ID NO: 9491718 - DNA, 22 bp, Homo sapiens
taatatatacctttgttaggaa

SEQ ID NO: 9491719 - DNA, 21 bp, Homo sapiens
taatataggttcacaactagt

SEQ ID NO: 9491720 - DNA, 21 bp, Homo sapiens
taatataggttcacaactagt

SEQ ID NO: 9491721 - DNA, 22 bp, Homo sapiens
taatatatacctttgttaggaa

SEQ ID NO: 9491722 - DNA, 22 bp, Homo sapiens
taatatacttcccatagtttga

SEQ ID NO: 9491723 - DNA, 22 bp, Homo sapiens
taatatacttcccatagtttga

SEQ ID NO: 9491724 - DNA, 22 bp, Homo sapiens
taaggaatgcttgaatgttcct

SEQ ID NO: 9491725 - DNA, 22 bp, Homo sapiens
taaggaatagtgctatgaaaaa

SEQ ID NO: 9491726 - DNA, 22 bp, Homo sapiens
taaggaatatcataagaagtag

SEQ ID NO: 9491727 - DNA, 22 bp, Homo sapiens
taaggagagaatttagaggttt

SEQ ID NO: 9491728 - DNA, 22 bp, Homo sapiens
taaggacattggttttgagtaa

SEQ ID NO: 9491729 - DNA, 22 bp, Homo sapiens
taaggaggctgctgtgaagaaa

SEQ ID NO: 9491730 - DNA, 22 bp, Homo sapiens
taatagttatggttggttctca

SEQ ID NO: 9491731 - DNA, 22 bp, Homo sapiens
taatagttgtgactttgtaaag

SEQ ID NO: 9491732 - DNA, 22 bp, Homo sapiens
taatagtcattgtataccttgg

SEQ ID NO: 9491733 - DNA, 22 bp, Homo sapiens
taaggattaaataagaatattt

SEQ ID NO: 9491734 - DNA, 22 bp, Homo sapiens
taaggaaacaacttgtattttt

SEQ ID NO: 9491735 - DNA, 22 bp, Homo sapiens
taaggaaacaacttgtattttt

SEQ ID NO: 9491736 - DNA, 22 bp, Homo sapiens
taaggaaacaacttgtattttt

SEQ ID NO: 9491737 - DNA, 22 bp, Homo sapiens
taaggaaaatggacatcaaaca

SEQ ID NO: 9491738 - DNA, 22 bp, Homo sapiens
taaggaaaatggacatcaaaca

SEQ ID NO: 9491739 - DNA, 22 bp, Homo sapiens
taaggaaaatggacatcaaaca

SEQ ID NO: 9491740 - DNA, 22 bp, Homo sapiens
taaggaaagtacatgttttgac

SEQ ID NO: 9491741 - DNA, 22 bp, Homo sapiens
taaggaaagtacatgttttgac

SEQ ID NO: 9491742 - DNA, 22 bp, Homo sapiens
taaggaaagtgccatgatttct

SEQ ID NO: 9491743 - DNA, 22 bp, Homo sapiens
taaggaaagtgccatgatttct

SEQ ID NO: 9491744 - DNA, 22 bp, Homo sapiens
taaggaaagtgccatgatttct

SEQ ID NO: 9491745 - DNA, 22 bp, Homo sapiens
taaggaagagcttggtaatagg

SEQ ID NO: 9491746 - DNA, 22 bp, Homo sapiens
taaggaaggggaaagacatgtc

SEQ ID NO: 9491747 - DNA, 22 bp, Homo sapiens
taaggaagtacccattcttagg

SEQ ID NO: 9491748 - DNA, 22 bp, Homo sapiens
taaggaagtcacaagaatcgct

SEQ ID NO: 9491749 - DNA, 21 bp, Homo sapiens
taagcatatcagatagactct

SEQ ID NO: 9491750 - DNA, 22 bp, Homo sapiens
taagcattatggtaaagaagta

SEQ ID NO: 9491751 - DNA, 22 bp, Homo sapiens
taagcattatggtaaagaagta

SEQ ID NO: 9491752 - DNA, 22 bp, Homo sapiens
taagcattatggtaaagaagta

SEQ ID NO: 9491753 - DNA, 21 bp, Homo sapiens
taagccaccatgtgaaaccag

SEQ ID NO: 9491754 - DNA, 22 bp, Homo sapiens
taagccaaaatcaggacacaga

SEQ ID NO: 9491755 - DNA, 22 bp, Homo sapiens
taagccactagtctgttatgaa

SEQ ID NO: 9491756 - DNA, 22 bp, Homo sapiens
taagcctgcatgaaccatgaga

SEQ ID NO: 9491757 - DNA, 22 bp, Homo sapiens
taagcctgcatgaaccatgaga

SEQ ID NO: 9491758 - DNA, 22 bp, Homo sapiens
taagcctgcatgaaccatgaga

SEQ ID NO: 9491759 - DNA, 22 bp, Homo sapiens
taagctaacgtccatggaaatg

SEQ ID NO: 9491760 - DNA, 22 bp, Homo sapiens
taagctattcctgaagaaggtt

SEQ ID NO: 9491761 - DNA, 21 bp, Homo sapiens
taagctaaacattcagttaac

SEQ ID NO: 9491762 - DNA, 22 bp, Homo sapiens
taagctaacgtccatggaaatg

SEQ ID NO: 9491763 - DNA, 22 bp, Homo sapiens
taaggaaaatggacatcaaaca

SEQ ID NO: 9491764 - DNA, 22 bp, Homo sapiens
taaggaaaatggacatcaaaca

SEQ ID NO: 9491765 - DNA, 22 bp, Homo sapiens
taagcttcaaagaacatattgg

SEQ ID NO: 9491766 - DNA, 22 bp, Homo sapiens
taagctctgttatccagagccc

SEQ ID NO: 9491767 - DNA, 22 bp, Homo sapiens
taatatctacttcatagagttt

SEQ ID NO: 9491768 - DNA, 18 bp, Homo sapiens
taatccatatgctttgcc

SEQ ID NO: 9491769 - DNA, 22 bp, Homo sapiens
taatcctgatcaattttagctt

SEQ ID NO: 9491770 - DNA, 22 bp, Homo sapiens
taatcctgcttcttctcccttt

SEQ ID NO: 9491771 - DNA, 22 bp, Homo sapiens
taatatatttctgctaagctca

SEQ ID NO: 9491772 - DNA, 22 bp, Homo sapiens
taatatatttctgctaagctca

SEQ ID NO: 9491773 - DNA, 22 bp, Homo sapiens
taatctctttatgagaagaagg

SEQ ID NO: 9491774 - DNA, 22 bp, Homo sapiens
taatctctagcccatgcaaaga

SEQ ID NO: 9491775 - DNA, 22 bp, Homo sapiens
taatcctgtgctgtgtaagtac

SEQ ID NO: 9491776 - DNA, 22 bp, Homo sapiens
taatctaccactattgcaatat

SEQ ID NO: 9491777 - DNA, 22 bp, Homo sapiens
taatctgtattcctactttgca

SEQ ID NO: 9491778 - DNA, 22 bp, Homo sapiens
taatctgtaatttttgcaatag

SEQ ID NO: 9491779 - DNA, 22 bp, Homo sapiens
taatctgttaatatttgtatcc

SEQ ID NO: 9491780 - DNA, 22 bp, Homo sapiens
taatctgttgttaatattgact

SEQ ID NO: 9491781 - DNA, 21 bp, Homo sapiens
taatcttcgaaaatgtattag

SEQ ID NO: 9491782 - DNA, 22 bp, Homo sapiens
taatgaacacagaatttcactt

SEQ ID NO: 9491783 - DNA, 22 bp, Homo sapiens
taatgaacaatatatcaatagc

SEQ ID NO: 9491784 - DNA, 18 bp, Homo sapiens
taatcttacagacaggat

SEQ ID NO: 9491785 - DNA, 22 bp, Homo sapiens
taatcttagcaacctccagtgt

SEQ ID NO: 9491786 - DNA, 22 bp, Homo sapiens
taattattatgacaacaattgc

SEQ ID NO: 9491787 - DNA, 22 bp, Homo sapiens
taattattatgacaacaattgc

SEQ ID NO: 9491788 - DNA, 22 bp, Homo sapiens
taattattatgacaacaattgc

SEQ ID NO: 9491789 - DNA, 22 bp, Homo sapiens
taattattatgacaacaattgc

SEQ ID NO: 9491790 - DNA, 22 bp, Homo sapiens
taattattatgacaacaattgc

SEQ ID NO: 9491791 - DNA, 22 bp, Homo sapiens
taattattctagtcacatagca

SEQ ID NO: 9491792 - DNA, 22 bp, Homo sapiens
taattattctagtcacatagca

SEQ ID NO: 9491793 - DNA, 22 bp, Homo sapiens
taattattgtctgaagagttat

SEQ ID NO: 9491794 - DNA, 22 bp, Homo sapiens
taattattctagtcacatagca

SEQ ID NO: 9491795 - DNA, 23 bp, Homo sapiens
taattcacatatacattgcttca

SEQ ID NO: 9491796 - DNA, 22 bp, Homo sapiens
taattcatgggcccagtgatat

SEQ ID NO: 9491797 - DNA, 22 bp, Homo sapiens
taattattgtctgaagagttat

SEQ ID NO: 9491798 - DNA, 22 bp, Homo sapiens
taattattgtctgaagagttat

SEQ ID NO: 9491799 - DNA, 22 bp, Homo sapiens
taattatttgaagacattagag

SEQ ID NO: 9491800 - DNA, 22 bp, Homo sapiens
taattatttgaagacattagag

SEQ ID NO: 9491801 - DNA, 22 bp, Homo sapiens
taattatttgaagacattagag

SEQ ID NO: 9491802 - DNA, 22 bp, Homo sapiens
taattcttcaggccttttgtct

SEQ ID NO: 9491803 - DNA, 22 bp, Homo sapiens
taattgaaatcatttcaattca

SEQ ID NO: 9491804 - DNA, 22 bp, Homo sapiens
taattcatgggcccagtgatat

SEQ ID NO: 9491805 - DNA, 22 bp, Homo sapiens
taattccttaagctgaagactt

SEQ ID NO: 9491806 - DNA, 22 bp, Homo sapiens
taattgctccaaggagaactaa

SEQ ID NO: 9491807 - DNA, 22 bp, Homo sapiens
taattgcagggtgtcagaatac

SEQ ID NO: 9491808 - DNA, 22 bp, Homo sapiens
taatttatatggaattgttgct

SEQ ID NO: 9491809 - DNA, 22 bp, Homo sapiens
taatttatgatgcaaagaaaag

SEQ ID NO: 9491810 - DNA, 22 bp, Homo sapiens
taatttacttgcaaataacaat

SEQ ID NO: 9491811 - DNA, 22 bp, Homo sapiens
taatttagtccaatgtgaatat

SEQ ID NO: 9491812 - DNA, 21 bp, Homo sapiens
taatttattcagcacagtgtt

SEQ ID NO: 9491813 - DNA, 21 bp, Homo sapiens
taatttattcagcacagtgtt

SEQ ID NO: 9491814 - DNA, 21 bp, Homo sapiens
taatttattcagcacagtgtt

SEQ ID NO: 9491815 - DNA, 22 bp, Homo sapiens
taatttatggtatgtgtgtaat

SEQ ID NO: 9491816 - DNA, 22 bp, Homo sapiens
taatttatgatgcaaagaaaag

SEQ ID NO: 9491817 - DNA, 22 bp, Homo sapiens
tacaacatgtggtcctttatga

SEQ ID NO: 9491818 - DNA, 22 bp, Homo sapiens
tacaagaaatttctgcatatat

SEQ ID NO: 9491819 - DNA, 22 bp, Homo sapiens
tacaagaagaggcagagctgga

SEQ ID NO: 9491820 - DNA, 22 bp, Homo sapiens
tacaagaaactacatgaatgca

SEQ ID NO: 9491821 - DNA, 22 bp, Homo sapiens
tacaagaaactacatgaatgca

SEQ ID NO: 9491822 - DNA, 22 bp, Homo sapiens
tacaaccagatcctctaagtca

SEQ ID NO: 9491823 - DNA, 22 bp, Homo sapiens
tacaaccatagacatatactag

SEQ ID NO: 9491824 - DNA, 22 bp, Homo sapiens
tacaaccatagacatatactag

SEQ ID NO: 9491825 - DNA, 22 bp, Homo sapiens
tacaactgcacatctgaatcac

SEQ ID NO: 9491826 - DNA, 22 bp, Homo sapiens
tacaacttacttgaatggcttt

SEQ ID NO: 9491827 - DNA, 22 bp, Homo sapiens
tacaaccagatcctctaagtca

SEQ ID NO: 9491828 - DNA, 22 bp, Homo sapiens
tacaacatttacgttaggctgt

SEQ ID NO: 9491829 - DNA, 22 bp, Homo sapiens
tacaacatttacgttaggctgt

SEQ ID NO: 9491830 - DNA, 22 bp, Homo sapiens
tacaacattgtgttgcttcata

SEQ ID NO: 9491831 - DNA, 22 bp, Homo sapiens
tacaacattgtgttgcttcata

SEQ ID NO: 9491832 - DNA, 22 bp, Homo sapiens
tacaagagacaccagggaggct

SEQ ID NO: 9491833 - DNA, 22 bp, Homo sapiens
tacaagagcagtaagcttgtcc

SEQ ID NO: 9491834 - DNA, 22 bp, Homo sapiens
tacaagagaactaatgtaagtc

SEQ ID NO: 9491835 - DNA, 22 bp, Homo sapiens
tacaagagaactaatgtaagtc

SEQ ID NO: 9491836 - DNA, 22 bp, Homo sapiens
tacaagacgagggaagttcttt

SEQ ID NO: 9491837 - DNA, 22 bp, Homo sapiens
tacaagaatttctttctggttg

SEQ ID NO: 9491838 - DNA, 22 bp, Homo sapiens
tacaagaatgtcttaaaagctc

SEQ ID NO: 9491839 - DNA, 22 bp, Homo sapiens
tacaagaatgtcttaaaagctc

SEQ ID NO: 9491840 - DNA, 22 bp, Homo sapiens
tacaagaaggaaaactagcaat

SEQ ID NO: 9491841 - DNA, 22 bp, Homo sapiens
tacacaatgacttaagatgtca

SEQ ID NO: 9491842 - DNA, 22 bp, Homo sapiens
tacacaatctgtttttccattt

SEQ ID NO: 9491843 - DNA, 22 bp, Homo sapiens
tacaagattaaaacttatacca

SEQ ID NO: 9491844 - DNA, 22 bp, Homo sapiens
tacaagatgtactaaaaattat

SEQ ID NO: 9491845 - DNA, 22 bp, Homo sapiens
tacaagaggatgtggacatgga

SEQ ID NO: 9491846 - DNA, 22 bp, Homo sapiens
tacaagaggatgtggacatgga

SEQ ID NO: 9491847 - DNA, 22 bp, Homo sapiens
tacaagaggtatatagaaacag

SEQ ID NO: 9491848 - DNA, 22 bp, Homo sapiens
tacaagaggtatatagaaacag

SEQ ID NO: 9491849 - DNA, 21 bp, Homo sapiens
tacaagatagaggtaatatat

SEQ ID NO: 9491850 - DNA, 21 bp, Homo sapiens
tacaagatagaggtaatatat

SEQ ID NO: 9491851 - DNA, 22 bp, Homo sapiens
tacagacagacttcccaccctc

SEQ ID NO: 9491852 - DNA, 22 bp, Homo sapiens
tacagacaaagagcatgcggta

SEQ ID NO: 9491853 - DNA, 22 bp, Homo sapiens
tacagaattagattattagaga

SEQ ID NO: 9491854 - DNA, 21 bp, Homo sapiens
tacagaatgcgcttcagtctg

SEQ ID NO: 9491855 - DNA, 21 bp, Homo sapiens
tacagaatgcgcttcagtctg

SEQ ID NO: 9491856 - DNA, 22 bp, Homo sapiens
tacagaatgtgtatcattacca

SEQ ID NO: 9491857 - DNA, 22 bp, Homo sapiens
tacagaatgtgtatcattacca

SEQ ID NO: 9491858 - DNA, 22 bp, Homo sapiens
tacagaatgttatgaagcatag

SEQ ID NO: 9491859 - DNA, 22 bp, Homo sapiens
tacagaattagattattagaga

SEQ ID NO: 9491860 - DNA, 22 bp, Homo sapiens
tacagaattagattattagaga

SEQ ID NO: 9491861 - DNA, 22 bp, Homo sapiens
tacacataggtctgaataaaaa

SEQ ID NO: 9491862 - DNA, 22 bp, Homo sapiens
tacacataggtctgaataaaaa

SEQ ID NO: 9491863 - DNA, 22 bp, Homo sapiens
tacagaataaagcgtgaagctt

SEQ ID NO: 9491864 - DNA, 22 bp, Homo sapiens
tacagaatagaatagggacagg

SEQ ID NO: 9491865 - DNA, 22 bp, Homo sapiens
tacacataggagggtaataaaa

SEQ ID NO: 9491866 - DNA, 22 bp, Homo sapiens
tacacataggagggtaataaaa

SEQ ID NO: 9491867 - DNA, 22 bp, Homo sapiens
tacacatacattgcttacaagg

SEQ ID NO: 9491868 - DNA, 22 bp, Homo sapiens
tacagaatgatgtgtttaaata

SEQ ID NO: 9491869 - DNA, 22 bp, Homo sapiens
tacagaatgatgtgtttaaata

SEQ ID NO: 9491870 - DNA, 20 bp, Homo sapiens
tacagaatgcaataaaatgg

SEQ ID NO: 9491871 - DNA, 20 bp, Homo sapiens
tacagaatgcaataaaatgg

SEQ ID NO: 9491872 - DNA, 20 bp, Homo sapiens
tacagaatgcaataaaatgg

SEQ ID NO: 9491873 - DNA, 20 bp, Homo sapiens
tacagaatgcaataaaatgg

SEQ ID NO: 9491874 - DNA, 20 bp, Homo sapiens
tacagaatgcaataaaatgg

SEQ ID NO: 9491875 - DNA, 22 bp, Homo sapiens
tacagaatctatgcttcacagt

SEQ ID NO: 9491876 - DNA, 22 bp, Homo sapiens
tacagaatgatgtgtttaaata

SEQ ID NO: 9491877 - DNA, 22 bp, Homo sapiens
tacagaatctatgcttcacagt

SEQ ID NO: 9491878 - DNA, 22 bp, Homo sapiens
tacagaatatttctgccctgag

SEQ ID NO: 9491879 - DNA, 22 bp, Homo sapiens
tacagaatatagaagctggaag

SEQ ID NO: 9491880 - DNA, 22 bp, Homo sapiens
tacacaattagttgcaaagtga

SEQ ID NO: 9491881 - DNA, 22 bp, Homo sapiens
tacacaatgacttaagatgtca

SEQ ID NO: 9491882 - DNA, 22 bp, Homo sapiens
tacacaattagttgcaaagtga

SEQ ID NO: 9491883 - DNA, 22 bp, Homo sapiens
tacacaattagttgcaaagtga

SEQ ID NO: 9491884 - DNA, 22 bp, Homo sapiens
tacacaattagttgcaaagtga

SEQ ID NO: 9491885 - DNA, 22 bp, Homo sapiens
tacacacagaggccatgggatt

SEQ ID NO: 9491886 - DNA, 22 bp, Homo sapiens
tacacacatgcatttgccttat

SEQ ID NO: 9491887 - DNA, 22 bp, Homo sapiens
tacacacagaggccatgggatt

SEQ ID NO: 9491888 - DNA, 22 bp, Homo sapiens
tacacacagaggccatgggatt

SEQ ID NO: 9491889 - DNA, 22 bp, Homo sapiens
tacacactgtgataatgaagca

SEQ ID NO: 9491890 - DNA, 22 bp, Homo sapiens
tacacacctgcctgcagactct

SEQ ID NO: 9491891 - DNA, 22 bp, Homo sapiens
tacacactgtgataatgaagca

SEQ ID NO: 9491892 - DNA, 22 bp, Homo sapiens
tacacacatgcatttgccttat

SEQ ID NO: 9491893 - DNA, 22 bp, Homo sapiens
tacacacatgcatttgccttat

SEQ ID NO: 9491894 - DNA, 22 bp, Homo sapiens
tacacacatgcatttgccttat

SEQ ID NO: 9491895 - DNA, 22 bp, Homo sapiens
tacacatacattgcttacaagg

SEQ ID NO: 9491896 - DNA, 22 bp, Homo sapiens
tacacatacattgcttacaagg

SEQ ID NO: 9491897 - DNA, 22 bp, Homo sapiens
tacacacttactggagatgaag

SEQ ID NO: 9491898 - DNA, 22 bp, Homo sapiens
tacacagtaaatggtaaataca

SEQ ID NO: 9491899 - DNA, 20 bp, Homo sapiens
gttttaaggcacaggccttt

SEQ ID NO: 9491900 - DNA, 22 bp, Homo sapiens
gtttgttttaagataggatgga

SEQ ID NO: 9491901 - DNA, 22 bp, Homo sapiens
gtttgttttaagataggatgga

SEQ ID NO: 9491902 - DNA, 22 bp, Homo sapiens
gtttgtttgtagggaagccgtg

SEQ ID NO: 9491903 - DNA, 22 bp, Homo sapiens
gtttgtttgtagggaagccgtg

SEQ ID NO: 9491904 - DNA, 22 bp, Homo sapiens
gtttgtttatacaaaagatcct

SEQ ID NO: 9491905 - DNA, 22 bp, Homo sapiens
gtttgtttatacaaaagatcct

SEQ ID NO: 9491906 - DNA, 22 bp, Homo sapiens
gtttgtttatacaaaagatcct

SEQ ID NO: 9491907 - DNA, 22 bp, Homo sapiens
gtttgtttatacaaaagatcct

SEQ ID NO: 9491908 - DNA, 22 bp, Homo sapiens
gtttgtgtcaatgacttctgca

SEQ ID NO: 9491909 - DNA, 22 bp, Homo sapiens
gtttgtgtaacatgatgatgat

SEQ ID NO: 9491910 - DNA, 22 bp, Homo sapiens
gtttgtgtaacatgatgatgat

SEQ ID NO: 9491911 - DNA, 22 bp, Homo sapiens
gtttgtgtaacatgatgatgat

SEQ ID NO: 9491912 - DNA, 22 bp, Homo sapiens
gtttgtgtaacatgatgatgat

SEQ ID NO: 9491913 - DNA, 21 bp, Homo sapiens
gtttgcagttgagtccttccc

SEQ ID NO: 9491914 - DNA, 22 bp, Homo sapiens
gtttgattcaagaacaaagagt

SEQ ID NO: 9491915 - DNA, 22 bp, Homo sapiens
gtttgatttgatccggagagat

SEQ ID NO: 9491916 - DNA, 22 bp, Homo sapiens
gtttgcaaagatcattttctcc

SEQ ID NO: 9491917 - DNA, 22 bp, Homo sapiens
gtttgcaaattatgttaaaagt

SEQ ID NO: 9491918 - DNA, 22 bp, Homo sapiens
gtttgcaacatagtcctatgta

SEQ ID NO: 9491919 - DNA, 22 bp, Homo sapiens
gtttgcaaattgtgttaaagct

SEQ ID NO: 9491920 - DNA, 22 bp, Homo sapiens
gtttgaaagaccaattagattt

SEQ ID NO: 9491921 - DNA, 22 bp, Homo sapiens
gtttgaaatgtctgcaagggaa

SEQ ID NO: 9491922 - DNA, 22 bp, Homo sapiens
gtttgaaagttcaacaggaaaa

SEQ ID NO: 9491923 - DNA, 22 bp, Homo sapiens
gtttcttatttcaactggaaca

SEQ ID NO: 9491924 - DNA, 22 bp, Homo sapiens
gtttcttatttcaactggaaca

SEQ ID NO: 9491925 - DNA, 22 bp, Homo sapiens
gtttctttctattgactgaaca

SEQ ID NO: 9491926 - DNA, 22 bp, Homo sapiens
gtttctttctattgactgaaca

SEQ ID NO: 9491927 - DNA, 22 bp, Homo sapiens
gtttctttctattgactgaaca

SEQ ID NO: 9491928 - DNA, 22 bp, Homo sapiens
gtttcttatttcaactggaaca

SEQ ID NO: 9491929 - DNA, 22 bp, Homo sapiens
gtttcttaggtaaattctttga

SEQ ID NO: 9491930 - DNA, 22 bp, Homo sapiens
gtttcttagacagacattatct

SEQ ID NO: 9491931 - DNA, 22 bp, Homo sapiens
gtttcttagacagacattatct

SEQ ID NO: 9491932 - DNA, 22 bp, Homo sapiens
gtttcttttgtgatcaccaacc

SEQ ID NO: 9491933 - DNA, 22 bp, Homo sapiens
gtttgaaaaaagcagtatgtaa

SEQ ID NO: 9491934 - DNA, 22 bp, Homo sapiens
gtttgaaaaaagcagtatgtaa

SEQ ID NO: 9491935 - DNA, 22 bp, Homo sapiens
gtttcttttgtgatcaccaacc

SEQ ID NO: 9491936 - DNA, 22 bp, Homo sapiens
gtttcttttgtgatcaccaacc

SEQ ID NO: 9491937 - DNA, 22 bp, Homo sapiens
gtttcttttaaaatatgtagac

SEQ ID NO: 9491938 - DNA, 22 bp, Homo sapiens
gtttcttttaaaatatgtagac

SEQ ID NO: 9491939 - DNA, 22 bp, Homo sapiens
gtttcttttaaaatatgtagac

SEQ ID NO: 9491940 - DNA, 22 bp, Homo sapiens
gtttcacagatggggagacacg

SEQ ID NO: 9491941 - DNA, 22 bp, Homo sapiens
gtttcaaataggtttcagcaaa

SEQ ID NO: 9491942 - DNA, 22 bp, Homo sapiens
gtttcacagggccatggaggaa

SEQ ID NO: 9491943 - DNA, 22 bp, Homo sapiens
gtttcacagatggtgttcatat

SEQ ID NO: 9491944 - DNA, 22 bp, Homo sapiens
gtttcacataattttaaattgt

SEQ ID NO: 9491945 - DNA, 22 bp, Homo sapiens
gtttatcagagagcagaggtgg

SEQ ID NO: 9491946 - DNA, 22 bp, Homo sapiens
gtttatcattattattagcaac

SEQ ID NO: 9491947 - DNA, 22 bp, Homo sapiens
gtttatctagtgaagtgaagaa

SEQ ID NO: 9491948 - DNA, 22 bp, Homo sapiens
gtttatgaaatttcaggcattt

SEQ ID NO: 9491949 - DNA, 22 bp, Homo sapiens
gtttatcttaatggactcagag

SEQ ID NO: 9491950 - DNA, 22 bp, Homo sapiens
gtttatcacaataaataattct

SEQ ID NO: 9491951 - DNA, 22 bp, Homo sapiens
gttgagcaaggccagagaagcc

SEQ ID NO: 9491952 - DNA, 22 bp, Homo sapiens
gttgagagttaagcgggctaat

SEQ ID NO: 9491953 - DNA, 22 bp, Homo sapiens
gttgagcaaggccagagaagcc

SEQ ID NO: 9491954 - DNA, 22 bp, Homo sapiens
gtttatgaatgttactatagag

SEQ ID NO: 9491955 - DNA, 22 bp, Homo sapiens
gtttatgaatgtgtcagacata

SEQ ID NO: 9491956 - DNA, 22 bp, Homo sapiens
gtttatgaatgtgtcagacata

SEQ ID NO: 9491957 - DNA, 21 bp, Homo sapiens
gtttatgaatcttgtcctgct

SEQ ID NO: 9491958 - DNA, 22 bp, Homo sapiens
gtttatgaggaaaagttatgat

SEQ ID NO: 9491959 - DNA, 22 bp, Homo sapiens
gtttatgaattgcattcccttt

SEQ ID NO: 9491960 - DNA, 22 bp, Homo sapiens
gtttatgaatgttactatagag

SEQ ID NO: 9491961 - DNA, 22 bp, Homo sapiens
gtttatgagttacgtaggggtt

SEQ ID NO: 9491962 - DNA, 22 bp, Homo sapiens
gtttatgaggaaaagttatgat

SEQ ID NO: 9491963 - DNA, 22 bp, Homo sapiens
gtttattagagttttctgtctg

SEQ ID NO: 9491964 - DNA, 22 bp, Homo sapiens
gtttattagagttttctgtctg

SEQ ID NO: 9491965 - DNA, 22 bp, Homo sapiens
gtttattagagttttctgtctg

SEQ ID NO: 9491966 - DNA, 22 bp, Homo sapiens
gtttattaactgtcaagtgatt

SEQ ID NO: 9491967 - DNA, 22 bp, Homo sapiens
gtttattaactgtcaagtgatt

SEQ ID NO: 9491968 - DNA, 22 bp, Homo sapiens
gtttattaactgtcaagtgatt

SEQ ID NO: 9491969 - DNA, 22 bp, Homo sapiens
gtttattatacaacaaaagcta

SEQ ID NO: 9491970 - DNA, 22 bp, Homo sapiens
gtttcaaagcacagctcacatt

SEQ ID NO: 9491971 - DNA, 22 bp, Homo sapiens
gtttattatacaacaaaagcta

SEQ ID NO: 9491972 - DNA, 22 bp, Homo sapiens
gtttcaaagcacagctcacatt

SEQ ID NO: 9491973 - DNA, 22 bp, Homo sapiens
gtttcaaagggaagacgctgga

SEQ ID NO: 9491974 - DNA, 22 bp, Homo sapiens
gtttcaaagggaagacgctgga

SEQ ID NO: 9491975 - DNA, 22 bp, Homo sapiens
gtttcaaaggtgtcaggcagtt

SEQ ID NO: 9491976 - DNA, 22 bp, Homo sapiens
gtttcaaagtcagaaaaggagg

SEQ ID NO: 9491977 - DNA, 22 bp, Homo sapiens
gttgaaatcctaaccccctagt

SEQ ID NO: 9491978 - DNA, 22 bp, Homo sapiens
gttgaaatgagggattaatcag

SEQ ID NO: 9491979 - DNA, 22 bp, Homo sapiens
gttgaaatttgtgataatttag

SEQ ID NO: 9491980 - DNA, 22 bp, Homo sapiens
gttgaaaatacagattcctagg

SEQ ID NO: 9491981 - DNA, 22 bp, Homo sapiens
gttgaactatgttttatctgac

SEQ ID NO: 9491982 - DNA, 19 bp, Homo sapiens
gttcttttcacctctgtgc

SEQ ID NO: 9491983 - DNA, 22 bp, Homo sapiens
gttcttctcttgtaatggaatc

SEQ ID NO: 9491984 - DNA, 22 bp, Homo sapiens
gttcttcctggaagtggatttc

SEQ ID NO: 9491985 - DNA, 22 bp, Homo sapiens
gttcttccctttggggattgtg

SEQ ID NO: 9491986 - DNA, 22 bp, Homo sapiens
gttcttcctcattgctttgaag

SEQ ID NO: 9491987 - DNA, 22 bp, Homo sapiens
gttctttaagtggagaaggaaa

SEQ ID NO: 9491988 - DNA, 22 bp, Homo sapiens
gttatattcaaaatgaggctgt

SEQ ID NO: 9491989 - DNA, 22 bp, Homo sapiens
gttataaatacctaataggatt

SEQ ID NO: 9491990 - DNA, 22 bp, Homo sapiens
gttataaatgactgcaaaagtt

SEQ ID NO: 9491991 - DNA, 22 bp, Homo sapiens
gttataaatgactgcaaaagtt

SEQ ID NO: 9491992 - DNA, 22 bp, Homo sapiens
gttataaatgactgcaaaagtt

SEQ ID NO: 9491993 - DNA, 22 bp, Homo sapiens
gttatacacattcctggtgagg

SEQ ID NO: 9491994 - DNA, 21 bp, Homo sapiens
gttatacattctatggatttg

SEQ ID NO: 9491995 - DNA, 22 bp, Homo sapiens
gttatacatatgtgttaacaaa

SEQ ID NO: 9491996 - DNA, 22 bp, Homo sapiens
gttatacttatgtgcaaaaata

SEQ ID NO: 9491997 - DNA, 22 bp, Homo sapiens
gttatacatatgtgttaacaaa

SEQ ID NO: 9491998 - DNA, 22 bp, Homo sapiens
gttatattgccaagtatattgt

SEQ ID NO: 9491999 - DNA, 22 bp, Homo sapiens
gttatattgccaagtatattgt

SEQ ID NO: 9492000 - DNA, 22 bp, Homo sapiens
gttatattggcagaagagaaga

SEQ ID NO: 9492001 - DNA, 22 bp, Homo sapiens
gttatattggcagaagagaaga

SEQ ID NO: 9492002 - DNA, 22 bp, Homo sapiens
gttatcttccctttgatgattt

SEQ ID NO: 9492003 - DNA, 22 bp, Homo sapiens
gttatcttctatttctcatact

SEQ ID NO: 9492004 - DNA, 22 bp, Homo sapiens
gttatctagaccaaaagcctaa

SEQ ID NO: 9492005 - DNA, 22 bp, Homo sapiens
gttatgtatgagggaatgatta

SEQ ID NO: 9492006 - DNA, 22 bp, Homo sapiens
gttatgtatcttgattgggtgg

SEQ ID NO: 9492007 - DNA, 22 bp, Homo sapiens
gttatgaaataaatatagatca

SEQ ID NO: 9492008 - DNA, 22 bp, Homo sapiens
gttatgaaataaatatagatca

SEQ ID NO: 9492009 - DNA, 22 bp, Homo sapiens
gttatgaagtcattcacaaata

SEQ ID NO: 9492010 - DNA, 22 bp, Homo sapiens
gttatgtactttttaaatcttg

SEQ ID NO: 9492011 - DNA, 22 bp, Homo sapiens
gttatgtactttttaaatcttg

SEQ ID NO: 9492012 - DNA, 22 bp, Homo sapiens
gttatgtaatctaacactcagt

SEQ ID NO: 9492013 - DNA, 22 bp, Homo sapiens
gttattgtttatcctgcacccc

SEQ ID NO: 9492014 - DNA, 22 bp, Homo sapiens
gttattgtgtttgttcagggca

SEQ ID NO: 9492015 - DNA, 22 bp, Homo sapiens
gttattgtccatttatttagca

SEQ ID NO: 9492016 - DNA, 22 bp, Homo sapiens
gttattgtccatttatttagca

SEQ ID NO: 9492017 - DNA, 22 bp, Homo sapiens
gttattgtttatcctgcacccc

SEQ ID NO: 9492018 - DNA, 22 bp, Homo sapiens
gttattgtttatcctgcacccc

SEQ ID NO: 9492019 - DNA, 22 bp, Homo sapiens
gttatttaactttgtagcatgg

SEQ ID NO: 9492020 - DNA, 22 bp, Homo sapiens
gttatttataaggtgtaactcc

SEQ ID NO: 9492021 - DNA, 22 bp, Homo sapiens
gttatttataaggtgtaactcc

SEQ ID NO: 9492022 - DNA, 22 bp, Homo sapiens
gttattgggtgcctcaggccct

SEQ ID NO: 9492023 - DNA, 20 bp, Homo sapiens
gttattggtcatttttgcca

SEQ ID NO: 9492024 - DNA, 21 bp, Homo sapiens
gttattggttacactgcactt

SEQ ID NO: 9492025 - DNA, 22 bp, Homo sapiens
gttattgtccagcacagttggg

SEQ ID NO: 9492026 - DNA, 22 bp, Homo sapiens
gttattgtccagcacagttggg

SEQ ID NO: 9492027 - DNA, 22 bp, Homo sapiens
gttattggaaagcctggagggc

SEQ ID NO: 9492028 - DNA, 22 bp, Homo sapiens
gttattggcagcatttcagagt

SEQ ID NO: 9492029 - DNA, 20 bp, Homo sapiens
gttattggaaatattgtgtg

SEQ ID NO: 9492030 - DNA, 22 bp, Homo sapiens
gttattgctggatagatacatc

SEQ ID NO: 9492031 - DNA, 22 bp, Homo sapiens
gttcttcagtaaaattaaatgt

SEQ ID NO: 9492032 - DNA, 22 bp, Homo sapiens
gttcttcaggctgtgctctaga

SEQ ID NO: 9492033 - DNA, 22 bp, Homo sapiens
gttcttcagtcacatcacagaa

SEQ ID NO: 9492034 - DNA, 22 bp, Homo sapiens
gttcttcatcttaaccatctgt

SEQ ID NO: 9492035 - DNA, 22 bp, Homo sapiens
gttcttcatcattttagatagg

SEQ ID NO: 9492036 - DNA, 22 bp, Homo sapiens
gttctggaagcttttgagcaac

SEQ ID NO: 9492037 - DNA, 22 bp, Homo sapiens
gttctggaattgtctgaaatcc

SEQ ID NO: 9492038 - DNA, 22 bp, Homo sapiens
gttctggaggagagcctggtgt

SEQ ID NO: 9492039 - DNA, 22 bp, Homo sapiens
gttctggagtggtgccaggcct

SEQ ID NO: 9492040 - DNA, 22 bp, Homo sapiens
gttctggagtggtgccaggcct

SEQ ID NO: 9492041 - DNA, 21 bp, Homo sapiens
gttctggaggctgcaagtcca

SEQ ID NO: 9492042 - DNA, 22 bp, Homo sapiens
gttctggaaagcaagaaagagt

SEQ ID NO: 9492043 - DNA, 22 bp, Homo sapiens
gttctgcttccttgcttgcgca

SEQ ID NO: 9492044 - DNA, 22 bp, Homo sapiens
gttctgcttaaattattgatcc

SEQ ID NO: 9492045 - DNA, 22 bp, Homo sapiens
gttctgctgtaatatctctgct

SEQ ID NO: 9492046 - DNA, 22 bp, Homo sapiens
gttctgctgtgtctcagcaggt

SEQ ID NO: 9492047 - DNA, 22 bp, Homo sapiens
gtgctggctgccaggaggctgc

SEQ ID NO: 9492048 - DNA, 22 bp, Homo sapiens
gtgctggctgccaggaggctgc

SEQ ID NO: 9492049 - DNA, 22 bp, Homo sapiens
gtgctggctgccaggaggctgc

SEQ ID NO: 9492050 - DNA, 22 bp, Homo sapiens
gtgctggctggacatggagcac

SEQ ID NO: 9492051 - DNA, 22 bp, Homo sapiens
gtgctggcctcagagggtcatg

SEQ ID NO: 9492052 - DNA, 17 bp, Homo sapiens
gtgctggcctggggctc

SEQ ID NO: 9492053 - DNA, 17 bp, Homo sapiens
gtgctggcctggggctc

SEQ ID NO: 9492054 - DNA, 21 bp, Homo sapiens
gtgctgggacacagccaggct

SEQ ID NO: 9492055 - DNA, 22 bp, Homo sapiens
gtgctggctggggcatcaggca

SEQ ID NO: 9492056 - DNA, 21 bp, Homo sapiens
gtgctgggacacagccaggct

SEQ ID NO: 9492057 - DNA, 22 bp, Homo sapiens
gtgctggctggacatggagcac

SEQ ID NO: 9492058 - DNA, 22 bp, Homo sapiens
gtgttattagagcattaatttt

SEQ ID NO: 9492059 - DNA, 22 bp, Homo sapiens
gtgttattagagcattaatttt

SEQ ID NO: 9492060 - DNA, 21 bp, Homo sapiens
gtgctgggacacagccaggct

SEQ ID NO: 9492061 - DNA, 21 bp, Homo sapiens
gtgctgggacacagccaggct

SEQ ID NO: 9492062 - DNA, 21 bp, Homo sapiens
gtgctgggacacagccaggct

SEQ ID NO: 9492063 - DNA, 21 bp, Homo sapiens
gtgctgggacacagccaggct

SEQ ID NO: 9492064 - DNA, 22 bp, Homo sapiens
gtgttcttttgcttcacagaaa

SEQ ID NO: 9492065 - DNA, 22 bp, Homo sapiens
gtgttgatgacattttagaaac

SEQ ID NO: 9492066 - DNA, 22 bp, Homo sapiens
gtgtttaacatctggtttatac

SEQ ID NO: 9492067 - DNA, 22 bp, Homo sapiens
gtgttgtggagcttgtcagggg

SEQ ID NO: 9492068 - DNA, 22 bp, Homo sapiens
gtgttctgcagaccagcatcat

SEQ ID NO: 9492069 - DNA, 22 bp, Homo sapiens
gtgttctgggatgattgtagtg

SEQ ID NO: 9492070 - DNA, 22 bp, Homo sapiens
gtgttcattgctagtgaggtgt

SEQ ID NO: 9492071 - DNA, 22 bp, Homo sapiens
gtgttctctagagctgtacaaa

SEQ ID NO: 9492072 - DNA, 22 bp, Homo sapiens
gtgttccatgtttgaggtagtt

SEQ ID NO: 9492073 - DNA, 22 bp, Homo sapiens
gtgttcatgccccagtgcagga

SEQ ID NO: 9492074 - DNA, 22 bp, Homo sapiens
gtgttcatgccccagtgcagga

SEQ ID NO: 9492075 - DNA, 22 bp, Homo sapiens
gtgttcatggatgtcaatttga

SEQ ID NO: 9492076 - DNA, 22 bp, Homo sapiens
gtgttatttgagtgggagcgtg

SEQ ID NO: 9492077 - DNA, 17 bp, Homo sapiens
gtgttcacaatgactgt

SEQ ID NO: 9492078 - DNA, 17 bp, Homo sapiens
gtgttcacaatgactgt

SEQ ID NO: 9492079 - DNA, 22 bp, Homo sapiens
gtgttcatcccaatgctgatag

SEQ ID NO: 9492080 - DNA, 22 bp, Homo sapiens
gtgtttcttgcactccccggac

SEQ ID NO: 9492081 - DNA, 22 bp, Homo sapiens
gtgtttgctggagctctgggtc

SEQ ID NO: 9492082 - DNA, 22 bp, Homo sapiens
gttaaataacctcatgtccgtt

SEQ ID NO: 9492083 - DNA, 22 bp, Homo sapiens
gttaaataacctcatgtccgtt

SEQ ID NO: 9492084 - DNA, 22 bp, Homo sapiens
gtgtttcctctagaagccatgg

SEQ ID NO: 9492085 - DNA, 22 bp, Homo sapiens
gtgtttcccctcctggagaagg

SEQ ID NO: 9492086 - DNA, 22 bp, Homo sapiens
gtgtttaataggtagctgaatc

SEQ ID NO: 9492087 - DNA, 22 bp, Homo sapiens
gtgtttaataggtagctgaatc

SEQ ID NO: 9492088 - DNA, 22 bp, Homo sapiens
gtgtttaatgcagatgtgggtg

SEQ ID NO: 9492089 - DNA, 20 bp, Homo sapiens
gtgtttcatgtgatacaatg

SEQ ID NO: 9492090 - DNA, 20 bp, Homo sapiens
gtgtttcatgtgatacaatg

SEQ ID NO: 9492091 - DNA, 22 bp, Homo sapiens
gttaacataggagtttgttgta

SEQ ID NO: 9492092 - DNA, 22 bp, Homo sapiens
gttaacataggcttaggggttt

SEQ ID NO: 9492093 - DNA, 23 bp, Homo sapiens
gttaacatggtccatggaagagc

SEQ ID NO: 9492094 - DNA, 23 bp, Homo sapiens
gttaacatggtccatggaagagc

SEQ ID NO: 9492095 - DNA, 22 bp, Homo sapiens
gttaacattcaattaaacagtc

SEQ ID NO: 9492096 - DNA, 22 bp, Homo sapiens
gttataaatacctaataggatt

SEQ ID NO: 9492097 - DNA, 22 bp, Homo sapiens
gttaacaaccaaacagaagttc

SEQ ID NO: 9492098 - DNA, 22 bp, Homo sapiens
gttaacacaggactctctgcct

SEQ ID NO: 9492099 - DNA, 22 bp, Homo sapiens
gttaaatgcagattctgactca

SEQ ID NO: 9492100 - DNA, 22 bp, Homo sapiens
gttaaatgcagattctgactca

SEQ ID NO: 9492101 - DNA, 22 bp, Homo sapiens
gttaaatgcactattgaaagct

SEQ ID NO: 9492102 - DNA, 22 bp, Homo sapiens
gttaaataacctcatgtccgtt

SEQ ID NO: 9492103 - DNA, 22 bp, Homo sapiens
gttaaatgcattttccaagcac

SEQ ID NO: 9492104 - DNA, 22 bp, Homo sapiens
gttaaattcgatgatggataaa

SEQ ID NO: 9492105 - DNA, 22 bp, Homo sapiens
gttaaattcgatgatggataaa

SEQ ID NO: 9492106 - DNA, 22 bp, Homo sapiens
taacagtgtgtccagtcagttt

SEQ ID NO: 9492107 - DNA, 22 bp, Homo sapiens
taacagtgacctgaatgtcaat

SEQ ID NO: 9492108 - DNA, 22 bp, Homo sapiens
taacagtattgaagataaacta

SEQ ID NO: 9492109 - DNA, 22 bp, Homo sapiens
taacagtattgaagataaacta

SEQ ID NO: 9492110 - DNA, 22 bp, Homo sapiens
taacagtatagcctaacatttc

SEQ ID NO: 9492111 - DNA, 22 bp, Homo sapiens
taacagtatagcctaacatttc

SEQ ID NO: 9492112 - DNA, 20 bp, Homo sapiens
taacagtaagtgatgttaca

SEQ ID NO: 9492113 - DNA, 20 bp, Homo sapiens
taacagtaagtgatgttaca

SEQ ID NO: 9492114 - DNA, 22 bp, Homo sapiens
taacagtaaagtaagttagctt

SEQ ID NO: 9492115 - DNA, 22 bp, Homo sapiens
taacagtatagcctaacatttc

SEQ ID NO: 9492116 - DNA, 22 bp, Homo sapiens
taacagtaccattaactttgat

SEQ ID NO: 9492117 - DNA, 22 bp, Homo sapiens
taacagtaccattaactttgat

SEQ ID NO: 9492118 - DNA, 22 bp, Homo sapiens
taacatgagagctaagacatta

SEQ ID NO: 9492119 - DNA, 22 bp, Homo sapiens
taacatctttagcagctcgaac

SEQ ID NO: 9492120 - DNA, 22 bp, Homo sapiens
taacatcaaactgcattttcta

SEQ ID NO: 9492121 - DNA, 22 bp, Homo sapiens
taacatcaaacatgttttaaag

SEQ ID NO: 9492122 - DNA, 20 bp, Homo sapiens
taacatagtccagagaacga

SEQ ID NO: 9492123 - DNA, 20 bp, Homo sapiens
taacagttgaagaacaagga

SEQ ID NO: 9492124 - DNA, 22 bp, Homo sapiens
taacagttggtgtaatttcttg

SEQ ID NO: 9492125 - DNA, 20 bp, Homo sapiens
taacagttgtagagggtttt

SEQ ID NO: 9492126 - DNA, 22 bp, Homo sapiens
taaatgttgtaagtacatctaa

SEQ ID NO: 9492127 - DNA, 22 bp, Homo sapiens
taaatgttgtaagtacatctaa

SEQ ID NO: 9492128 - DNA, 22 bp, Homo sapiens
taaatgtttagtcttatttggg

SEQ ID NO: 9492129 - DNA, 22 bp, Homo sapiens
taacagctggcgttataggaat

SEQ ID NO: 9492130 - DNA, 22 bp, Homo sapiens
taacaggatgacagcagacatt

SEQ ID NO: 9492131 - DNA, 22 bp, Homo sapiens
taacaggatgacagcagacatt

SEQ ID NO: 9492132 - DNA, 22 bp, Homo sapiens
taacagctctgtgtggctgtaa

SEQ ID NO: 9492133 - DNA, 22 bp, Homo sapiens
taacagcatttgaatgagtaac

SEQ ID NO: 9492134 - DNA, 18 bp, Homo sapiens
taaatgcatgttaataac

SEQ ID NO: 9492135 - DNA, 18 bp, Homo sapiens
taaatgcatgttaataac

SEQ ID NO: 9492136 - DNA, 22 bp, Homo sapiens
taaatgctatcgcataaaacct

SEQ ID NO: 9492137 - DNA, 22 bp, Homo sapiens
taaatgctcaataaatgttgct

SEQ ID NO: 9492138 - DNA, 22 bp, Homo sapiens
taaatgtgcactttacttttca

SEQ ID NO: 9492139 - DNA, 22 bp, Homo sapiens
taaatgctcaataaatgttgct

SEQ ID NO: 9492140 - DNA, 22 bp, Homo sapiens
taaatgctcagaccttattcca

SEQ ID NO: 9492141 - DNA, 22 bp, Homo sapiens
taaatgttatgcccatcatcca

SEQ ID NO: 9492142 - DNA, 22 bp, Homo sapiens
taaatgttactttcctttcaca

SEQ ID NO: 9492143 - DNA, 22 bp, Homo sapiens
taaatgtgtgtagccatctgtg

SEQ ID NO: 9492144 - DNA, 22 bp, Homo sapiens
taaatgtgttagtcatggtttt

SEQ ID NO: 9492145 - DNA, 22 bp, Homo sapiens
taagagctaggattttaaatca

SEQ ID NO: 9492146 - DNA, 18 bp, Homo sapiens
taagagcagactgtaggc

SEQ ID NO: 9492147 - DNA, 18 bp, Homo sapiens
taagagcagactgtaggc

SEQ ID NO: 9492148 - DNA, 22 bp, Homo sapiens
taagagctccaatatttgtggc

SEQ ID NO: 9492149 - DNA, 22 bp, Homo sapiens
taagagctcccttctccttgca

SEQ ID NO: 9492150 - DNA, 22 bp, Homo sapiens
taagagcactgaagtcttctta

SEQ ID NO: 9492151 - DNA, 22 bp, Homo sapiens
taagagattctaaagctactgg

SEQ ID NO: 9492152 - DNA, 22 bp, Homo sapiens
taagagcactgaagtcttctta

SEQ ID NO: 9492153 - DNA, 22 bp, Homo sapiens
taagagacttaagaataattga

SEQ ID NO: 9492154 - DNA, 22 bp, Homo sapiens
taagagatgcttttctaaataa

SEQ ID NO: 9492155 - DNA, 22 bp, Homo sapiens
taagagaactggatagatagga

SEQ ID NO: 9492156 - DNA, 22 bp, Homo sapiens
taagacttcattagtaatatgg

SEQ ID NO: 9492157 - DNA, 22 bp, Homo sapiens
taagagaaggatctgttccagg

SEQ ID NO: 9492158 - DNA, 22 bp, Homo sapiens
taagagaaggatctgttccagg

SEQ ID NO: 9492159 - DNA, 22 bp, Homo sapiens
taagagaaggatctgttccagg

SEQ ID NO: 9492160 - DNA, 22 bp, Homo sapiens
taagagaatgttgtggctaggt

SEQ ID NO: 9492161 - DNA, 22 bp, Homo sapiens
taagacatgagactcagccagt

SEQ ID NO: 9492162 - DNA, 22 bp, Homo sapiens
taagacatcctggatgttcaaa

SEQ ID NO: 9492163 - DNA, 22 bp, Homo sapiens
taagacatcctggatgttcaaa

SEQ ID NO: 9492164 - DNA, 22 bp, Homo sapiens
taagactagttgaatggttttc

SEQ ID NO: 9492165 - DNA, 22 bp, Homo sapiens
taagacaattcttcagtcacaa

SEQ ID NO: 9492166 - DNA, 19 bp, Homo sapiens
taagacagattcctagagt

SEQ ID NO: 9492167 - DNA, 22 bp, Homo sapiens
taagacaattcttcagtcacaa

SEQ ID NO: 9492168 - DNA, 22 bp, Homo sapiens
taagacaaatactatttcaaga

SEQ ID NO: 9492169 - DNA, 18 bp, Homo sapiens
taacatgttttcattaag

SEQ ID NO: 9492170 - DNA, 22 bp, Homo sapiens
taagacaaatactatttcaaga

SEQ ID NO: 9492171 - DNA, 22 bp, Homo sapiens
taacatgcatagatttgtatta

SEQ ID NO: 9492172 - DNA, 22 bp, Homo sapiens
taacatgcagagtttagctttt

SEQ ID NO: 9492173 - DNA, 22 bp, Homo sapiens
taacatgttaagaaattagata

SEQ ID NO: 9492174 - DNA, 22 bp, Homo sapiens
taacatgttcagactacctgtg

SEQ ID NO: 9492175 - DNA, 22 bp, Homo sapiens
taacatgtttgtacactgaaac

SEQ ID NO: 9492176 - DNA, 22 bp, Homo sapiens
taaaagagaatggataacagag

SEQ ID NO: 9492177 - DNA, 22 bp, Homo sapiens
taaaagagaatggataacagag

SEQ ID NO: 9492178 - DNA, 22 bp, Homo sapiens
taaaagaccctctagagtccca

SEQ ID NO: 9492179 - DNA, 22 bp, Homo sapiens
taaaagagaatggataacagag

SEQ ID NO: 9492180 - DNA, 22 bp, Homo sapiens
taaaagacatataactgtagga

SEQ ID NO: 9492181 - DNA, 22 bp, Homo sapiens
taaaagaccacaaggtggtaat

SEQ ID NO: 9492182 - DNA, 22 bp, Homo sapiens
taaaagaagcttcaaggccggc

SEQ ID NO: 9492183 - DNA, 22 bp, Homo sapiens
taaaagacatataactgtagga

SEQ ID NO: 9492184 - DNA, 22 bp, Homo sapiens
taaaagacatataactgtagga

SEQ ID NO: 9492185 - DNA, 22 bp, Homo sapiens
taaaagaagcttcaaggccggc

SEQ ID NO: 9492186 - DNA, 21 bp, Homo sapiens
taaaagatgacaagacagctc

SEQ ID NO: 9492187 - DNA, 21 bp, Homo sapiens
taaaagatgacaagacagctc

SEQ ID NO: 9492188 - DNA, 21 bp, Homo sapiens
taaaagatgacaagacagctc

SEQ ID NO: 9492189 - DNA, 22 bp, Homo sapiens
taaaagatcactggctgcttta

SEQ ID NO: 9492190 - DNA, 21 bp, Homo sapiens
taaaagatgacaagacagctc

SEQ ID NO: 9492191 - DNA, 22 bp, Homo sapiens
taaaagagaatggataacagag

SEQ ID NO: 9492192 - DNA, 22 bp, Homo sapiens
taaaagatcactggctgcttta

SEQ ID NO: 9492193 - DNA, 22 bp, Homo sapiens
taaaagatatcttagggatttg

SEQ ID NO: 9492194 - DNA, 21 bp, Homo sapiens
gttttaagggagaaaacctag

SEQ ID NO: 9492195 - DNA, 22 bp, Homo sapiens
taaaactgcttggtatggtcta

SEQ ID NO: 9492196 - DNA, 22 bp, Homo sapiens
taaaacttctcatttttatggt

SEQ ID NO: 9492197 - DNA, 22 bp, Homo sapiens
taaaacttctcatttttatggt

SEQ ID NO: 9492198 - DNA, 22 bp, Homo sapiens
taaaactttgaaggtgctcagt

SEQ ID NO: 9492199 - DNA, 22 bp, Homo sapiens
taaaacttaactatccagatta

SEQ ID NO: 9492200 - DNA, 22 bp, Homo sapiens
taaaacttctcatttttatggt

SEQ ID NO: 9492201 - DNA, 22 bp, Homo sapiens
taaaacttaactatccagatta

SEQ ID NO: 9492202 - DNA, 21 bp, Homo sapiens
taaaactgtaactttgtcctg

SEQ ID NO: 9492203 - DNA, 21 bp, Homo sapiens
taaaactgtaactttgtcctg

SEQ ID NO: 9492204 - DNA, 19 bp, Homo sapiens
taaaaggatgtggaaggat

SEQ ID NO: 9492205 - DNA, 22 bp, Homo sapiens
taaaaggattagcaggatgggc

SEQ ID NO: 9492206 - DNA, 19 bp, Homo sapiens
taaaaggatgtggaaggat

SEQ ID NO: 9492207 - DNA, 22 bp, Homo sapiens
taaaaggaggttgaagctgtca

SEQ ID NO: 9492208 - DNA, 22 bp, Homo sapiens
taaaaggaggttgaagctgtca

SEQ ID NO: 9492209 - DNA, 22 bp, Homo sapiens
taaaagattttataggaacaag

SEQ ID NO: 9492210 - DNA, 22 bp, Homo sapiens
taaaagattttataggaacaag

SEQ ID NO: 9492211 - DNA, 22 bp, Homo sapiens
taaaagctgagatatcctgtac

SEQ ID NO: 9492212 - DNA, 22 bp, Homo sapiens
taaaaggcaatactagatgagt

SEQ ID NO: 9492213 - DNA, 22 bp, Homo sapiens
taaaaggcaatactagatgagt

SEQ ID NO: 9492214 - DNA, 22 bp, Homo sapiens
taaaaggattagcaggatgggc

SEQ ID NO: 9492215 - DNA, 22 bp, Homo sapiens
taaaaggcacttggatgctgag

SEQ ID NO: 9492216 - DNA, 22 bp, Homo sapiens
taaaaggcacttggatgctgag

SEQ ID NO: 9492217 - DNA, 22 bp, Homo sapiens
taaaagtaggaatgaaacgcat

SEQ ID NO: 9492218 - DNA, 22 bp, Homo sapiens
taaaagtatactttcaaaggag

SEQ ID NO: 9492219 - DNA, 22 bp, Homo sapiens
taaagacatgcaaagtctaatt

SEQ ID NO: 9492220 - DNA, 22 bp, Homo sapiens
taaagacataggatcagggaga

SEQ ID NO: 9492221 - DNA, 22 bp, Homo sapiens
taaagacatgcaaagtctaatt

SEQ ID NO: 9492222 - DNA, 22 bp, Homo sapiens
taaagacatgcaaagtctaatt

SEQ ID NO: 9492223 - DNA, 20 bp, Homo sapiens
taaagacataagctactatc

SEQ ID NO: 9492224 - DNA, 22 bp, Homo sapiens
taaaagtggataagctgtagga

SEQ ID NO: 9492225 - DNA, 22 bp, Homo sapiens
taaaagttagctaggacaaagt

SEQ ID NO: 9492226 - DNA, 22 bp, Homo sapiens
taaagacactggttttaatcat

SEQ ID NO: 9492227 - DNA, 23 bp, Homo sapiens
taaagacagccttcaggattctg

SEQ ID NO: 9492228 - DNA, 23 bp, Homo sapiens
taaagacagccttcaggattctg

SEQ ID NO: 9492229 - DNA, 22 bp, Homo sapiens
taaagacagatggaccagccat

SEQ ID NO: 9492230 - DNA, 22 bp, Homo sapiens
taaagacactggttttaatcat

SEQ ID NO: 9492231 - DNA, 18 bp, Homo sapiens
taaatgcatgttaataac

SEQ ID NO: 9492232 - DNA, 18 bp, Homo sapiens
taaatgcatgttaataac

SEQ ID NO: 9492233 - DNA, 20 bp, Homo sapiens
taaatgcatgaatgtaaggc

SEQ ID NO: 9492234 - DNA, 20 bp, Homo sapiens
taaatgcatgaatgtaaggc

SEQ ID NO: 9492235 - DNA, 20 bp, Homo sapiens
taaatgcatgaatgtaaggc

SEQ ID NO: 9492236 - DNA, 20 bp, Homo sapiens
taaatgcatgaatgtaaggc

SEQ ID NO: 9492237 - DNA, 22 bp, Homo sapiens
taaatgcagttagtacttgcca

SEQ ID NO: 9492238 - DNA, 22 bp, Homo sapiens
taaatgcagttagtacttgcca

SEQ ID NO: 9492239 - DNA, 22 bp, Homo sapiens
taaatgcagttagtacttgcca

SEQ ID NO: 9492240 - DNA, 22 bp, Homo sapiens
taaatgcagttagtacttgcca

SEQ ID NO: 9492241 - DNA, 20 bp, Homo sapiens
taaatgcatgaatgtaaggc

SEQ ID NO: 9492242 - DNA, 22 bp, Homo sapiens
taaatgcagcagtttctgttct

SEQ ID NO: 9492243 - DNA, 22 bp, Homo sapiens
taaatgcagattcctgagccta

SEQ ID NO: 9492244 - DNA, 22 bp, Homo sapiens
taaatgcaatgtgctttaccag

SEQ ID NO: 9492245 - DNA, 22 bp, Homo sapiens
taaatgcaatgtgctttaccag

SEQ ID NO: 9492246 - DNA, 22 bp, Homo sapiens
taaatgcagtacaaattgttct

SEQ ID NO: 9492247 - DNA, 22 bp, Homo sapiens
taaatgcagtacaaattgttct

SEQ ID NO: 9492248 - DNA, 22 bp, Homo sapiens
taaatgcagcagtttctgttct

SEQ ID NO: 9492249 - DNA, 22 bp, Homo sapiens
taaatgcagcagtttctgttct

SEQ ID NO: 9492250 - DNA, 22 bp, Homo sapiens
taaatgcagtacaaattgttct

SEQ ID NO: 9492251 - DNA, 22 bp, Homo sapiens
taaatgatttatgtatgtgaaa

SEQ ID NO: 9492252 - DNA, 22 bp, Homo sapiens
taaatgcaaagcttggcgctta

SEQ ID NO: 9492253 - DNA, 22 bp, Homo sapiens
taaatgatttatgtatgtgaaa

SEQ ID NO: 9492254 - DNA, 22 bp, Homo sapiens
taaatgcaagggaaaggcaaga

SEQ ID NO: 9492255 - DNA, 22 bp, Homo sapiens
taaatgcaagggaaaggcaaga

SEQ ID NO: 9492256 - DNA, 22 bp, Homo sapiens
taaatgcaagggaaaggcaaga

SEQ ID NO: 9492257 - DNA, 22 bp, Homo sapiens
taaatgcaagggaaaggcaaga

SEQ ID NO: 9492258 - DNA, 22 bp, Homo sapiens
taaatgcaaagcttggcgctta

SEQ ID NO: 9492259 - DNA, 22 bp, Homo sapiens
taaatgcaagggaaaggcaaga

SEQ ID NO: 9492260 - DNA, 22 bp, Homo sapiens
taaatgcaagtgctcctgggag

SEQ ID NO: 9492261 - DNA, 22 bp, Homo sapiens
taaatgcaatgtgctttaccag

SEQ ID NO: 9492262 - DNA, 22 bp, Homo sapiens
taaatgatttatgtatgtgaaa

SEQ ID NO: 9492263 - DNA, 22 bp, Homo sapiens
taaatgataataatgctagtgt

SEQ ID NO: 9492264 - DNA, 20 bp, Homo sapiens
taaagcagccgtggagggta

SEQ ID NO: 9492265 - DNA, 20 bp, Homo sapiens
taaagcagccgtggagggta

SEQ ID NO: 9492266 - DNA, 19 bp, Homo sapiens
taaagcacatagcaaaagt

SEQ ID NO: 9492267 - DNA, 22 bp, Homo sapiens
taaagcagccagggtctaagcc

SEQ ID NO: 9492268 - DNA, 22 bp, Homo sapiens
taaagcaatgaaagttttgcag

SEQ ID NO: 9492269 - DNA, 22 bp, Homo sapiens
taaagcaaggcaaattgttggt

SEQ ID NO: 9492270 - DNA, 22 bp, Homo sapiens
taaagcaattactcagtggctt

SEQ ID NO: 9492271 - DNA, 22 bp, Homo sapiens
taaagcaattactcagtggctt

SEQ ID NO: 9492272 - DNA, 22 bp, Homo sapiens
taaagcaatgaaagttttgcag

SEQ ID NO: 9492273 - DNA, 22 bp, Homo sapiens
taaagcaatttgagcaagttct

SEQ ID NO: 9492274 - DNA, 22 bp, Homo sapiens
taaagcaatttgagcaagttct

SEQ ID NO: 9492275 - DNA, 22 bp, Homo sapiens
taaagcaatttgagcaagttct

SEQ ID NO: 9492276 - DNA, 22 bp, Homo sapiens
taaagcaaggcaaattgttggt

SEQ ID NO: 9492277 - DNA, 22 bp, Homo sapiens
taaagcaaggcaaattgttggt

SEQ ID NO: 9492278 - DNA, 22 bp, Homo sapiens
taaagcaaggaatagagtagtc

SEQ ID NO: 9492279 - DNA, 22 bp, Homo sapiens
taaagcaaggaatagagtagtc

SEQ ID NO: 9492280 - DNA, 22 bp, Homo sapiens
taaagcaaggaatagagtagtc

SEQ ID NO: 9492281 - DNA, 22 bp, Homo sapiens
taaagcaaggaatagagtagtc

SEQ ID NO: 9492282 - DNA, 22 bp, Homo sapiens
taaagcaagacacacccatagc

SEQ ID NO: 9492283 - DNA, 23 bp, Homo sapiens
taaagcaaagtcaagtgcactcc

SEQ ID NO: 9492284 - DNA, 22 bp, Homo sapiens
taaagcaaaaatgaactgccat

SEQ ID NO: 9492285 - DNA, 22 bp, Homo sapiens
taaagcaaaaatgaactgccat

SEQ ID NO: 9492286 - DNA, 22 bp, Homo sapiens
taaagcaaaaatgaactgccat

SEQ ID NO: 9492287 - DNA, 23 bp, Homo sapiens
taaagcaaagtcaagtgcactcc

SEQ ID NO: 9492288 - DNA, 23 bp, Homo sapiens
taaagcaaagtcaagtgcactcc

SEQ ID NO: 9492289 - DNA, 22 bp, Homo sapiens
taaagatgttctcatttcatag

SEQ ID NO: 9492290 - DNA, 22 bp, Homo sapiens
taaagatgttctcatttcatag

SEQ ID NO: 9492291 - DNA, 22 bp, Homo sapiens
taaagatgctatagtgaaggag

SEQ ID NO: 9492292 - DNA, 22 bp, Homo sapiens
taaagatgcccacattgcaggt

SEQ ID NO: 9492293 - DNA, 22 bp, Homo sapiens
taaagatggagatgacctagga

SEQ ID NO: 9492294 - DNA, 22 bp, Homo sapiens
taaagacatggtgtaggtgaac

SEQ ID NO: 9492295 - DNA, 19 bp, Homo sapiens
taaagagaataccggtggc

SEQ ID NO: 9492296 - DNA, 22 bp, Homo sapiens
taaagacatggtgtaggtgaac

SEQ ID NO: 9492297 - DNA, 17 bp, Homo sapiens
taaagatcagccatgta

SEQ ID NO: 9492298 - DNA, 22 bp, Homo sapiens
taaagataagacatcaactgag

SEQ ID NO: 9492299 - DNA, 22 bp, Homo sapiens
taggccagtggcaggttgtgtg

SEQ ID NO: 9492300 - DNA, 23 bp, Homo sapiens
taggccagggtgacctggggaga

SEQ ID NO: 9492301 - DNA, 23 bp, Homo sapiens
taggccagggtgacctggggaga

SEQ ID NO: 9492302 - DNA, 23 bp, Homo sapiens
taggccagggtgacctggggaga

SEQ ID NO: 9492303 - DNA, 22 bp, Homo sapiens
taggccaggacagagcttccag

SEQ ID NO: 9492304 - DNA, 22 bp, Homo sapiens
taggccaggaatcagcaagctt

SEQ ID NO: 9492305 - DNA, 22 bp, Homo sapiens
taggccagattactagagtagg

SEQ ID NO: 9492306 - DNA, 22 bp, Homo sapiens
taggcagattccatattttggc

SEQ ID NO: 9492307 - DNA, 22 bp, Homo sapiens
taggcagattccatattttggc

SEQ ID NO: 9492308 - DNA, 22 bp, Homo sapiens
taggcagatgttaacaggaaaa

SEQ ID NO: 9492309 - DNA, 22 bp, Homo sapiens
taggcagatgttaacaggaaaa

SEQ ID NO: 9492310 - DNA, 22 bp, Homo sapiens
taggcagatgttaacaggaaaa

SEQ ID NO: 9492311 - DNA, 21 bp, Homo sapiens
taggcagaggagcaggtatct

SEQ ID NO: 9492312 - DNA, 22 bp, Homo sapiens
taggcagaggtatggtaaggac

SEQ ID NO: 9492313 - DNA, 22 bp, Homo sapiens
taggcagagtttaatggttaag

SEQ ID NO: 9492314 - DNA, 22 bp, Homo sapiens
taggcagattccatattttggc

SEQ ID NO: 9492315 - DNA, 22 bp, Homo sapiens
taggcagctgcaaacttcggtc

SEQ ID NO: 9492316 - DNA, 23 bp, Homo sapiens
taggcaggactcagatatgacag

SEQ ID NO: 9492317 - DNA, 22 bp, Homo sapiens
taggcaggctgaatgtagattt

SEQ ID NO: 9492318 - DNA, 22 bp, Homo sapiens
taggcagcttaggttagaagtg

SEQ ID NO: 9492319 - DNA, 23 bp, Homo sapiens
taggcaggactcagatatgacag

SEQ ID NO: 9492320 - DNA, 22 bp, Homo sapiens
tagctgtgaaacagcagaagag

SEQ ID NO: 9492321 - DNA, 22 bp, Homo sapiens
tagctgtgaaacagcagaagag

SEQ ID NO: 9492322 - DNA, 22 bp, Homo sapiens
tagctgtcagctgcaggcaggc

SEQ ID NO: 9492323 - DNA, 22 bp, Homo sapiens
tagctgtcagctgcaggcaggc

SEQ ID NO: 9492324 - DNA, 22 bp, Homo sapiens
tagctgtgcccagggaagttgt

SEQ ID NO: 9492325 - DNA, 22 bp, Homo sapiens
tagctgtgcccgccacccaacg

SEQ ID NO: 9492326 - DNA, 22 bp, Homo sapiens
tagctgtggccttgctggtctg

SEQ ID NO: 9492327 - DNA, 22 bp, Homo sapiens
tagctgtggagcagaggtctcc

SEQ ID NO: 9492328 - DNA, 21 bp, Homo sapiens
tagctgtgcaactttgggcaa

SEQ ID NO: 9492329 - DNA, 22 bp, Homo sapiens
tagctgtgagcacccaggctgt

SEQ ID NO: 9492330 - DNA, 22 bp, Homo sapiens
tagctgtgaagagctaaaaaat

SEQ ID NO: 9492331 - DNA, 22 bp, Homo sapiens
tagctgtgacgtatctctatgg

SEQ ID NO: 9492332 - DNA, 22 bp, Homo sapiens
tagctgggttgaggtcatctac

SEQ ID NO: 9492333 - DNA, 22 bp, Homo sapiens
tagctgggtctctgttttctca

SEQ ID NO: 9492334 - DNA, 22 bp, Homo sapiens
tagctgggagtgtctgatgggt

SEQ ID NO: 9492335 - DNA, 22 bp, Homo sapiens
tagctgggactactggccctgc

SEQ ID NO: 9492336 - DNA, 20 bp, Homo sapiens
taggcagagctgtgcagcct

SEQ ID NO: 9492337 - DNA, 20 bp, Homo sapiens
taggcagagctgtgcagcct

SEQ ID NO: 9492338 - DNA, 20 bp, Homo sapiens
taggcagagctgtgcagcct

SEQ ID NO: 9492339 - DNA, 22 bp, Homo sapiens
taggcagagaggccataagaat

SEQ ID NO: 9492340 - DNA, 22 bp, Homo sapiens
taggcagagaggccataagaat

SEQ ID NO: 9492341 - DNA, 22 bp, Homo sapiens
taggcagaattcattgtgctgc

SEQ ID NO: 9492342 - DNA, 22 bp, Homo sapiens
taggcagaattgtgggctctaa

SEQ ID NO: 9492343 - DNA, 22 bp, Homo sapiens
taggcagaattcattgtgctgc

SEQ ID NO: 9492344 - DNA, 22 bp, Homo sapiens
taggcagaattgttgaatgaag

SEQ ID NO: 9492345 - DNA, 22 bp, Homo sapiens
taggcagagaggccataagaat

SEQ ID NO: 9492346 - DNA, 22 bp, Homo sapiens
taggcagaattgttgaatgaag

SEQ ID NO: 9492347 - DNA, 22 bp, Homo sapiens
tagctgtgtagacactcagagc

SEQ ID NO: 9492348 - DNA, 22 bp, Homo sapiens
tagctgtgtatggtttacaaat

SEQ ID NO: 9492349 - DNA, 22 bp, Homo sapiens
tagctgtgtgatgggaaacctt

SEQ ID NO: 9492350 - DNA, 22 bp, Homo sapiens
tagctgtgtaagcttggtaaga

SEQ ID NO: 9492351 - DNA, 23 bp, Homo sapiens
tagctgtggcgtaaggctcagct

SEQ ID NO: 9492352 - DNA, 22 bp, Homo sapiens
tagctgtgtaacatgagaatgt

SEQ ID NO: 9492353 - DNA, 22 bp, Homo sapiens
tagctgtgtgtccttgggcaaa

SEQ ID NO: 9492354 - DNA, 17 bp, Homo sapiens
tagctgtgtttcagcta

SEQ ID NO: 9492355 - DNA, 22 bp, Homo sapiens
tagctgttaagttgtttggaaa

SEQ ID NO: 9492356 - DNA, 22 bp, Homo sapiens
tagctgttaatatacaaatggt

SEQ ID NO: 9492357 - DNA, 22 bp, Homo sapiens
tagctgttacccataaaagcca

SEQ ID NO: 9492358 - DNA, 22 bp, Homo sapiens
tagctgttacccataaaagcca

SEQ ID NO: 9492359 - DNA, 16 bp, Homo sapiens
tagggctgggaaggag

SEQ ID NO: 9492360 - DNA, 16 bp, Homo sapiens
tagggctgggaaggag

SEQ ID NO: 9492361 - DNA, 22 bp, Homo sapiens
tagggctgtgtctccaggacca

SEQ ID NO: 9492362 - DNA, 22 bp, Homo sapiens
tagggctgtttaaaagtgaggt

SEQ ID NO: 9492363 - DNA, 22 bp, Homo sapiens
tagggctgtttaaaagtgaggt

SEQ ID NO: 9492364 - DNA, 22 bp, Homo sapiens
tagggcttcaggtgtgaggcag

SEQ ID NO: 9492365 - DNA, 19 bp, Homo sapiens
tagggctggccgggcggtg

SEQ ID NO: 9492366 - DNA, 22 bp, Homo sapiens
tagggctggcgtgctcagggaa

SEQ ID NO: 9492367 - DNA, 22 bp, Homo sapiens
tagggctgctttgtattctgct

SEQ ID NO: 9492368 - DNA, 22 bp, Homo sapiens
tagggctgctttgtattctgct

SEQ ID NO: 9492369 - DNA, 22 bp, Homo sapiens
tagggctgcagaacaatggcct

SEQ ID NO: 9492370 - DNA, 22 bp, Homo sapiens
tagggctgcctatggctagata

SEQ ID NO: 9492371 - DNA, 22 bp, Homo sapiens
tagggctgctgcagatgacagg

SEQ ID NO: 9492372 - DNA, 22 bp, Homo sapiens
tagggctgcctatggctagata

SEQ ID NO: 9492373 - DNA, 22 bp, Homo sapiens
tagggctgccatttgcttttct

SEQ ID NO: 9492374 - DNA, 22 bp, Homo sapiens
tagggcagagtccaggatgggc

SEQ ID NO: 9492375 - DNA, 22 bp, Homo sapiens
tagggcagagtccaggatgggc

SEQ ID NO: 9492376 - DNA, 22 bp, Homo sapiens
tagggcagagtccaggatgggc

SEQ ID NO: 9492377 - DNA, 22 bp, Homo sapiens
tagggcagagtccaggatgggc

SEQ ID NO: 9492378 - DNA, 22 bp, Homo sapiens
tagggcagagtccaggatgggc

SEQ ID NO: 9492379 - DNA, 22 bp, Homo sapiens
taggccattgatttttataagt

SEQ ID NO: 9492380 - DNA, 22 bp, Homo sapiens
taggccagttggtggccctgga

SEQ ID NO: 9492381 - DNA, 22 bp, Homo sapiens
tagggcagccacccaggctgct

SEQ ID NO: 9492382 - DNA, 22 bp, Homo sapiens
tagggcagccacccaggctgct

SEQ ID NO: 9492383 - DNA, 22 bp, Homo sapiens
tagggcagccacccaggctgct

SEQ ID NO: 9492384 - DNA, 22 bp, Homo sapiens
tagggcagccacccaggctgct

SEQ ID NO: 9492385 - DNA, 22 bp, Homo sapiens
tagggcagattcggtggagttt

SEQ ID NO: 9492386 - DNA, 22 bp, Homo sapiens
tagggcagattcggtggagttt

SEQ ID NO: 9492387 - DNA, 22 bp, Homo sapiens
tagggcagattcggtggagttt

SEQ ID NO: 9492388 - DNA, 22 bp, Homo sapiens
tagggcagattcggtggagttt

SEQ ID NO: 9492389 - DNA, 22 bp, Homo sapiens
tagggctctggtgggctctgtt

SEQ ID NO: 9492390 - DNA, 18 bp, Homo sapiens
tagggctctagggagtga

SEQ ID NO: 9492391 - DNA, 23 bp, Homo sapiens
tagggcagctgggagggacatgc

SEQ ID NO: 9492392 - DNA, 23 bp, Homo sapiens
tagggcagctgggagggacatgc

SEQ ID NO: 9492393 - DNA, 23 bp, Homo sapiens
tagggcagctgggagggacatgc

SEQ ID NO: 9492394 - DNA, 23 bp, Homo sapiens
tagggcagctgggagggacatgc

SEQ ID NO: 9492395 - DNA, 22 bp, Homo sapiens
tagggcagctgcatcaggcact

SEQ ID NO: 9492396 - DNA, 22 bp, Homo sapiens
tagggcagccttatagctccca

SEQ ID NO: 9492397 - DNA, 22 bp, Homo sapiens
tagggcagccttatagctccca

SEQ ID NO: 9492398 - DNA, 23 bp, Homo sapiens
tagggcagctgggagggacatgc

SEQ ID NO: 9492399 - DNA, 22 bp, Homo sapiens
tagggcagctgcatcaggcact

SEQ ID NO: 9492400 - DNA, 22 bp, Homo sapiens
tagggcagctgcatcaggcact

SEQ ID NO: 9492401 - DNA, 22 bp, Homo sapiens
tagggcagctgcatcaggcact

SEQ ID NO: 9492402 - DNA, 22 bp, Homo sapiens
tagtgccaccactgtctttggc

SEQ ID NO: 9492403 - DNA, 22 bp, Homo sapiens
tagtgccaaagcctggtgtcat

SEQ ID NO: 9492404 - DNA, 22 bp, Homo sapiens
tagtgccaagctaatgccagaa

SEQ ID NO: 9492405 - DNA, 22 bp, Homo sapiens
tagtgcaggttaataggacttc

SEQ ID NO: 9492406 - DNA, 22 bp, Homo sapiens
tagtgcacacgcatgtagcagt

SEQ ID NO: 9492407 - DNA, 22 bp, Homo sapiens
tagtctctggagactctagggg

SEQ ID NO: 9492408 - DNA, 22 bp, Homo sapiens
tagtctctgctttgcccttggc

SEQ ID NO: 9492409 - DNA, 23 bp, Homo sapiens
taggggctggcgtggagcctgcg

SEQ ID NO: 9492410 - DNA, 21 bp, Homo sapiens
tagggggcagtgggatgctta

SEQ ID NO: 9492411 - DNA, 22 bp, Homo sapiens
tagggggctttgctgcttgaca

SEQ ID NO: 9492412 - DNA, 22 bp, Homo sapiens
tagggggctgtcctgtgcatta

SEQ ID NO: 9492413 - DNA, 22 bp, Homo sapiens
taggggaactggcacagggcag

SEQ ID NO: 9492414 - DNA, 22 bp, Homo sapiens
taggggaactggcacagggcag

SEQ ID NO: 9492415 - DNA, 23 bp, Homo sapiens
taggggaaaaatcttctgcaatt

SEQ ID NO: 9492416 - DNA, 22 bp, Homo sapiens
taggggcagaagcggcggtcca

SEQ ID NO: 9492417 - DNA, 22 bp, Homo sapiens
taggggcagaagcggcggtcca

SEQ ID NO: 9492418 - DNA, 22 bp, Homo sapiens
taggggagctcgggtgcaatcg

SEQ ID NO: 9492419 - DNA, 22 bp, Homo sapiens
tagtgccatcttgagctgcttt

SEQ ID NO: 9492420 - DNA, 22 bp, Homo sapiens
tagtgccatagataggaccatt

SEQ ID NO: 9492421 - DNA, 22 bp, Homo sapiens
tagtgcccaaatcccagctctg

SEQ ID NO: 9492422 - DNA, 22 bp, Homo sapiens
tagtgcttaataaatttcagaa

SEQ ID NO: 9492423 - DNA, 22 bp, Homo sapiens
tagtgcttaataaatttcagaa

SEQ ID NO: 9492424 - DNA, 22 bp, Homo sapiens
tagtgctattaaggatacagag

SEQ ID NO: 9492425 - DNA, 22 bp, Homo sapiens
tagtgcttaaaagtggaagaga

SEQ ID NO: 9492426 - DNA, 22 bp, Homo sapiens
tagtgctttaagtttacagaga

SEQ ID NO: 9492427 - DNA, 22 bp, Homo sapiens
tagtgcttggtggagatggaga

SEQ ID NO: 9492428 - DNA, 22 bp, Homo sapiens
tagtgcttggccctaccagata

SEQ ID NO: 9492429 - DNA, 22 bp, Homo sapiens
tagtgcttgagtctctccgtac

SEQ ID NO: 9492430 - DNA, 22 bp, Homo sapiens
tagtgcttctaccctaggcagg

SEQ ID NO: 9492431 - DNA, 22 bp, Homo sapiens
tagtgcttattactgtgctgtc

SEQ ID NO: 9492432 - DNA, 22 bp, Homo sapiens
tagtgctttattgttcctgaaa

SEQ ID NO: 9492433 - DNA, 22 bp, Homo sapiens
tagtgctttattgttcctgaaa

SEQ ID NO: 9492434 - DNA, 22 bp, Homo sapiens
tagtgctttaggcctgagtgtc

SEQ ID NO: 9492435 - DNA, 22 bp, Homo sapiens
tagtgctttggagctttctcct

SEQ ID NO: 9492436 - DNA, 22 bp, Homo sapiens
tagtggagaagtggagtctgtg

SEQ ID NO: 9492437 - DNA, 22 bp, Homo sapiens
tagtgctttggagctttctcct

SEQ ID NO: 9492438 - DNA, 18 bp, Homo sapiens
tagtggaactgctctggg

SEQ ID NO: 9492439 - DNA, 22 bp, Homo sapiens
tagtggaggtggtctgtgaact

SEQ ID NO: 9492440 - DNA, 22 bp, Homo sapiens
tagtggaggtggtctgtgaact

SEQ ID NO: 9492441 - DNA, 22 bp, Homo sapiens
tagtggagtagaaaccaaagaa

SEQ ID NO: 9492442 - DNA, 22 bp, Homo sapiens
tagtggagggtgtagctgctgg

SEQ ID NO: 9492443 - DNA, 22 bp, Homo sapiens
tagtggaggtggtctgtgaact

SEQ ID NO: 9492444 - DNA, 22 bp, Homo sapiens
tagtggaggcctgttgtgtgca

SEQ ID NO: 9492445 - DNA, 22 bp, Homo sapiens
tagtggagagttgttttgtgca

SEQ ID NO: 9492446 - DNA, 22 bp, Homo sapiens
tagtggaggggatgcaaagctt

SEQ ID NO: 9492447 - DNA, 22 bp, Homo sapiens
tagtggagaggatgtggagaaa

SEQ ID NO: 9492448 - DNA, 22 bp, Homo sapiens
tagtggagaggatgtggagaaa

SEQ ID NO: 9492449 - DNA, 22 bp, Homo sapiens
tagtggagaggatgtggagaaa

SEQ ID NO: 9492450 - DNA, 22 bp, Homo sapiens
tagttacaatgggttctgtgac

SEQ ID NO: 9492451 - DNA, 22 bp, Homo sapiens
tagttacagcaggcaggatata

SEQ ID NO: 9492452 - DNA, 22 bp, Homo sapiens
tagtttactgttcactttgccc

SEQ ID NO: 9492453 - DNA, 22 bp, Homo sapiens
tagtttaatggtcaactaatga

SEQ ID NO: 9492454 - DNA, 22 bp, Homo sapiens
tagtttaccaaattgatcttcc

SEQ ID NO: 9492455 - DNA, 22 bp, Homo sapiens
tagtttactcatctataaaatg

SEQ ID NO: 9492456 - DNA, 22 bp, Homo sapiens
tagtttaatggtcaactaatga

SEQ ID NO: 9492457 - DNA, 22 bp, Homo sapiens
tagtttaatggtcaactaatga

SEQ ID NO: 9492458 - DNA, 22 bp, Homo sapiens
tagttgaaagggattattgtgg

SEQ ID NO: 9492459 - DNA, 22 bp, Homo sapiens
tagttctttgacggtgctttga

SEQ ID NO: 9492460 - DNA, 22 bp, Homo sapiens
tagttctataagcagatagagt

SEQ ID NO: 9492461 - DNA, 22 bp, Homo sapiens
tagttctagccagtgaaatgta

SEQ ID NO: 9492462 - DNA, 22 bp, Homo sapiens
tagttattattgttactatcag

SEQ ID NO: 9492463 - DNA, 22 bp, Homo sapiens
tagttattattgttactatcag

SEQ ID NO: 9492464 - DNA, 23 bp, Homo sapiens
tagttattttctctgtaatttgc

SEQ ID NO: 9492465 - DNA, 22 bp, Homo sapiens
tagttacttttgctcttcatta

SEQ ID NO: 9492466 - DNA, 22 bp, Homo sapiens
tagttatatccagtctttaaaa

SEQ ID NO: 9492467 - DNA, 18 bp, Homo sapiens
tagtttctaatggccttt

SEQ ID NO: 9492468 - DNA, 22 bp, Homo sapiens
tagttttataatgttaacatct

SEQ ID NO: 9492469 - DNA, 22 bp, Homo sapiens
tagtttctaaagcttcctaggt

SEQ ID NO: 9492470 - DNA, 22 bp, Homo sapiens
tagttttatgaattggtataat

SEQ ID NO: 9492471 - DNA, 22 bp, Homo sapiens
tagttttataatgttaacatct

SEQ ID NO: 9492472 - DNA, 22 bp, Homo sapiens
tagttttataatgttaacatct

SEQ ID NO: 9492473 - DNA, 22 bp, Homo sapiens
tagttttataatgttaacatct

SEQ ID NO: 9492474 - DNA, 22 bp, Homo sapiens
tagttttataatgttaacatct

SEQ ID NO: 9492475 - DNA, 22 bp, Homo sapiens
tagtttttactgcgagttataa

SEQ ID NO: 9492476 - DNA, 22 bp, Homo sapiens
tagtttttaagtgtacaatttc

SEQ ID NO: 9492477 - DNA, 22 bp, Homo sapiens
tagttttatgaattggtataat

SEQ ID NO: 9492478 - DNA, 22 bp, Homo sapiens
tagttttatgaattggtataat

SEQ ID NO: 9492479 - DNA, 22 bp, Homo sapiens
tagttttatgaattggtataat

SEQ ID NO: 9492480 - DNA, 22 bp, Homo sapiens
tagtttatgctgctgcagtgag

SEQ ID NO: 9492481 - DNA, 22 bp, Homo sapiens
tagtttatgattttttggaagg

SEQ ID NO: 9492482 - DNA, 22 bp, Homo sapiens
tagtttatgattttttggaagg

SEQ ID NO: 9492483 - DNA, 22 bp, Homo sapiens
tagtttatgctgctgcagtgag

SEQ ID NO: 9492484 - DNA, 22 bp, Homo sapiens
tagtttatgctgctgcagtgag

SEQ ID NO: 9492485 - DNA, 22 bp, Homo sapiens
tagtttcatatgcaaaatagta

SEQ ID NO: 9492486 - DNA, 22 bp, Homo sapiens
tagtttcatatgcaaaatagta

SEQ ID NO: 9492487 - DNA, 22 bp, Homo sapiens
tagtttccatgttatacagttt

SEQ ID NO: 9492488 - DNA, 22 bp, Homo sapiens
tagtttcatctccaccctgccc

SEQ ID NO: 9492489 - DNA, 22 bp, Homo sapiens
tagtttcctaggctgtattgtt

SEQ ID NO: 9492490 - DNA, 22 bp, Homo sapiens
tagtttccttggctattaggca

SEQ ID NO: 9492491 - DNA, 22 bp, Homo sapiens
tagagacaccagtaccattctg

SEQ ID NO: 9492492 - DNA, 22 bp, Homo sapiens
tagagacagaaagtagaatggt

SEQ ID NO: 9492493 - DNA, 22 bp, Homo sapiens
tagagagagctgtggtggctct

SEQ ID NO: 9492494 - DNA, 20 bp, Homo sapiens
tagagagaggatattaaagt

SEQ ID NO: 9492495 - DNA, 20 bp, Homo sapiens
tagagagaggatattaaagt

SEQ ID NO: 9492496 - DNA, 22 bp, Homo sapiens
tagagacagaaagtagaatggt

SEQ ID NO: 9492497 - DNA, 20 bp, Homo sapiens
tagagagatatgggggttcc

SEQ ID NO: 9492498 - DNA, 22 bp, Homo sapiens
tagagagccagttgtcatagtt

SEQ ID NO: 9492499 - DNA, 22 bp, Homo sapiens
tagagagctgtttgaaagcagg

SEQ ID NO: 9492500 - DNA, 22 bp, Homo sapiens
tagagaggtttgaattggctgc

SEQ ID NO: 9492501 - DNA, 22 bp, Homo sapiens
tagagaggtttgaattggctgc

SEQ ID NO: 9492502 - DNA, 23 bp, Homo sapiens
tagagaaagccaccgagtctctc

SEQ ID NO: 9492503 - DNA, 22 bp, Homo sapiens
tagagaaaagcagggatcagga

SEQ ID NO: 9492504 - DNA, 22 bp, Homo sapiens
tagagaaaagcagggatcagga

SEQ ID NO: 9492505 - DNA, 22 bp, Homo sapiens
tagagaaacagaaccaacaggg

SEQ ID NO: 9492506 - DNA, 22 bp, Homo sapiens
tagagaaacagaaccaacaggg

SEQ ID NO: 9492507 - DNA, 22 bp, Homo sapiens
tagagaaaaccactggtgagct

SEQ ID NO: 9492508 - DNA, 22 bp, Homo sapiens
tagagaaaaccactggtgagct

SEQ ID NO: 9492509 - DNA, 22 bp, Homo sapiens
tagagaaaagcagggatcagga

SEQ ID NO: 9492510 - DNA, 21 bp, Homo sapiens
tagagaaaagaagctgttcct

SEQ ID NO: 9492511 - DNA, 21 bp, Homo sapiens
tagagaaaagaagctgttcct

SEQ ID NO: 9492512 - DNA, 22 bp, Homo sapiens
tagatacttataatcttccaag

SEQ ID NO: 9492513 - DNA, 22 bp, Homo sapiens
tagatactcagaaatgctttca

SEQ ID NO: 9492514 - DNA, 22 bp, Homo sapiens
tagagtctagtgtatacaaagt

SEQ ID NO: 9492515 - DNA, 22 bp, Homo sapiens
tagagtccttcattctgtgcag

SEQ ID NO: 9492516 - DNA, 22 bp, Homo sapiens
tagatacatacattttaaaatg

SEQ ID NO: 9492517 - DNA, 20 bp, Homo sapiens
tagatacccaatgctcatca

SEQ ID NO: 9492518 - DNA, 22 bp, Homo sapiens
tagatacatttttctttcctgt

SEQ ID NO: 9492519 - DNA, 22 bp, Homo sapiens
tagatacatacattttaaaatg

SEQ ID NO: 9492520 - DNA, 22 bp, Homo sapiens
tagatacatgaaatggcagata

SEQ ID NO: 9492521 - DNA, 22 bp, Homo sapiens
tagatcatatttgtggagaaaa

SEQ ID NO: 9492522 - DNA, 22 bp, Homo sapiens
tagatcatggagtaaaatggaa

SEQ ID NO: 9492523 - DNA, 21 bp, Homo sapiens
tagatcatggtattctttggc

SEQ ID NO: 9492524 - DNA, 22 bp, Homo sapiens
tagatcatgggtactgcatatg

SEQ ID NO: 9492525 - DNA, 22 bp, Homo sapiens
tagatcctgagccctatctact

SEQ ID NO: 9492526 - DNA, 22 bp, Homo sapiens
tagatccagctgttatgttatg

SEQ ID NO: 9492527 - DNA, 22 bp, Homo sapiens
tagatataaggtccttagaaca

SEQ ID NO: 9492528 - DNA, 22 bp, Homo sapiens
tagatataaggtccttagaaca

SEQ ID NO: 9492529 - DNA, 22 bp, Homo sapiens
tagatatggccgtctgttttaa

SEQ ID NO: 9492530 - DNA, 22 bp, Homo sapiens
tagaagaacatgtcaaactata

SEQ ID NO: 9492531 - DNA, 22 bp, Homo sapiens
tagaagataagacaagtgctgc

SEQ ID NO: 9492532 - DNA, 22 bp, Homo sapiens
tagaagagacatagcctgtggt

SEQ ID NO: 9492533 - DNA, 22 bp, Homo sapiens
tagaagagacatagcctgtggt

SEQ ID NO: 9492534 - DNA, 22 bp, Homo sapiens
tagaagagacatagcctgtggt

SEQ ID NO: 9492535 - DNA, 22 bp, Homo sapiens
tagaagaaaagcacttagagat

SEQ ID NO: 9492536 - DNA, 22 bp, Homo sapiens
tagaagaaagtgaagctgggga

SEQ ID NO: 9492537 - DNA, 22 bp, Homo sapiens
tagaagattccagaggcaaagc

SEQ ID NO: 9492538 - DNA, 22 bp, Homo sapiens
tagaagattctaaagtggagag

SEQ ID NO: 9492539 - DNA, 22 bp, Homo sapiens
tagaagattccagaggcaaagc

SEQ ID NO: 9492540 - DNA, 22 bp, Homo sapiens
tagaagataagacaagtgctgc

SEQ ID NO: 9492541 - DNA, 22 bp, Homo sapiens
tagaagatgccttaaagttgaa

SEQ ID NO: 9492542 - DNA, 22 bp, Homo sapiens
tagaagattctaaagtggagag

SEQ ID NO: 9492543 - DNA, 21 bp, Homo sapiens
tagaagcacataggttcaaag

SEQ ID NO: 9492544 - DNA, 22 bp, Homo sapiens
tagacaggaaacattaggatgg

SEQ ID NO: 9492545 - DNA, 22 bp, Homo sapiens
tagacaggagtcaggctagaat

SEQ ID NO: 9492546 - DNA, 22 bp, Homo sapiens
tagacaggaaacattaggatgg

SEQ ID NO: 9492547 - DNA, 22 bp, Homo sapiens
tagaccattttacaatagtgtg

SEQ ID NO: 9492548 - DNA, 22 bp, Homo sapiens
tagaccattttacaatagtgtg

SEQ ID NO: 9492549 - DNA, 22 bp, Homo sapiens
tagacgtggccgtgttcccaat

SEQ ID NO: 9492550 - DNA, 19 bp, Homo sapiens
tagactctaatgttaagct

SEQ ID NO: 9492551 - DNA, 22 bp, Homo sapiens
tagactcttggggaaatctgca

SEQ ID NO: 9492552 - DNA, 22 bp, Homo sapiens
tagactctgcatttacctccca

SEQ ID NO: 9492553 - DNA, 22 bp, Homo sapiens
tagactggtgaattagggggaa

SEQ ID NO: 9492554 - DNA, 22 bp, Homo sapiens
tagactggtgaattagggggaa

SEQ ID NO: 9492555 - DNA, 22 bp, Homo sapiens
tagaactacaagcattaaaagt

SEQ ID NO: 9492556 - DNA, 22 bp, Homo sapiens
tagaactagaacaaggatttga

SEQ ID NO: 9492557 - DNA, 22 bp, Homo sapiens
tagaactgctctcatacttgct

SEQ ID NO: 9492558 - DNA, 22 bp, Homo sapiens
tagaacttatttggcattattt

SEQ ID NO: 9492559 - DNA, 22 bp, Homo sapiens
tagaacttgatagacagtacaa

SEQ ID NO: 9492560 - DNA, 22 bp, Homo sapiens
tagaacatgacttatttttgga

SEQ ID NO: 9492561 - DNA, 22 bp, Homo sapiens
tagaacatgacttatttttgga

SEQ ID NO: 9492562 - DNA, 22 bp, Homo sapiens
tagaacatgctcatgtataaat

SEQ ID NO: 9492563 - DNA, 23 bp, Homo sapiens
tagaacatcggtgtcttggagca

SEQ ID NO: 9492564 - DNA, 22 bp, Homo sapiens
tagaacatcaggttgaatttgg

SEQ ID NO: 9492565 - DNA, 22 bp, Homo sapiens
tagaacatgtgaaaatatagcc

SEQ ID NO: 9492566 - DNA, 22 bp, Homo sapiens
tagaacatgggatagagttttt

SEQ ID NO: 9492567 - DNA, 22 bp, Homo sapiens
tagaacatgctcatgtataaat

SEQ ID NO: 9492568 - DNA, 22 bp, Homo sapiens
tagaacatgtgaaaatatagcc

SEQ ID NO: 9492569 - DNA, 22 bp, Homo sapiens
tacttacattagcaaacaaggt

SEQ ID NO: 9492570 - DNA, 22 bp, Homo sapiens
tagaaatggagaacagattaat

SEQ ID NO: 9492571 - DNA, 22 bp, Homo sapiens
tacttacatgaattcaagagca

SEQ ID NO: 9492572 - DNA, 22 bp, Homo sapiens
tacttacatgaattcaagagca

SEQ ID NO: 9492573 - DNA, 22 bp, Homo sapiens
tagaaatggagaacagattaat

SEQ ID NO: 9492574 - DNA, 22 bp, Homo sapiens
tagaaatggagaacagattaat

SEQ ID NO: 9492575 - DNA, 22 bp, Homo sapiens
tagaaatggggaagtagttagg

SEQ ID NO: 9492576 - DNA, 22 bp, Homo sapiens
tagaaatgggttacatttagag

SEQ ID NO: 9492577 - DNA, 22 bp, Homo sapiens
tagctgcctttgggctcctgct

SEQ ID NO: 9492578 - DNA, 22 bp, Homo sapiens
tagctgcctttgggctcctgct

SEQ ID NO: 9492579 - DNA, 22 bp, Homo sapiens
tagctgcctttgggctcctgct

SEQ ID NO: 9492580 - DNA, 22 bp, Homo sapiens
tagctggcttatataaaagggc

SEQ ID NO: 9492581 - DNA, 22 bp, Homo sapiens
tagctggccctgggactcccgg

SEQ ID NO: 9492582 - DNA, 22 bp, Homo sapiens
tagctgggaattatctggttgc

SEQ ID NO: 9492583 - DNA, 22 bp, Homo sapiens
tagctgacgctaaataaatgtt

SEQ ID NO: 9492584 - DNA, 22 bp, Homo sapiens
tagcagggtctcaggagtcagg

SEQ ID NO: 9492585 - DNA, 22 bp, Homo sapiens
tagcagggtctcaggagtcagg

SEQ ID NO: 9492586 - DNA, 22 bp, Homo sapiens
tagctgatgaataattattctt

SEQ ID NO: 9492587 - DNA, 19 bp, Homo sapiens
tagctgatagctactttat

SEQ ID NO: 9492588 - DNA, 22 bp, Homo sapiens
tagctgcacaggaagtaagatt

SEQ ID NO: 9492589 - DNA, 20 bp, Homo sapiens
tagctgcacagccctaggag

SEQ ID NO: 9492590 - DNA, 22 bp, Homo sapiens
tagcagggtaaatgtagatgga

SEQ ID NO: 9492591 - DNA, 22 bp, Homo sapiens
tagcaggggtagatagagtgtg

SEQ ID NO: 9492592 - DNA, 22 bp, Homo sapiens
tagcagggtccaatgtgaggca

SEQ ID NO: 9492593 - DNA, 22 bp, Homo sapiens
tagcagggtccaatgtgaggca

SEQ ID NO: 9492594 - DNA, 22 bp, Homo sapiens
tagcagggtaaatgtagatgga

SEQ ID NO: 9492595 - DNA, 22 bp, Homo sapiens
tagcagggtccaatgtgaggca

SEQ ID NO: 9492596 - DNA, 21 bp, Homo sapiens
tagcaggatttggtttatttt

SEQ ID NO: 9492597 - DNA, 21 bp, Homo sapiens
tagcaggatttggtttatttt

SEQ ID NO: 9492598 - DNA, 22 bp, Homo sapiens
tagcaggaggcagttcctcgct

SEQ ID NO: 9492599 - DNA, 21 bp, Homo sapiens
tagcaggaggcccctgcttgc

SEQ ID NO: 9492600 - DNA, 21 bp, Homo sapiens
tagcaggagcgaattttgatg

SEQ ID NO: 9492601 - DNA, 22 bp, Homo sapiens
tagcaggagcagcctgcctaga

SEQ ID NO: 9492602 - DNA, 21 bp, Homo sapiens
tagcaggagcgaattttgatg

SEQ ID NO: 9492603 - DNA, 22 bp, Homo sapiens
tagcaggagtgtgttctatttt

SEQ ID NO: 9492604 - DNA, 22 bp, Homo sapiens
tagcaggagtgatgttgtgtga

SEQ ID NO: 9492605 - DNA, 21 bp, Homo sapiens
tagcaggaggcccctgcttgc

SEQ ID NO: 9492606 - DNA, 22 bp, Homo sapiens
tagcaggatcacagggagagcc

SEQ ID NO: 9492607 - DNA, 22 bp, Homo sapiens
tagcaggatttgaagaagatct

SEQ ID NO: 9492608 - DNA, 22 bp, Homo sapiens
tagcagggccaggctgggaacc

SEQ ID NO: 9492609 - DNA, 22 bp, Homo sapiens
tagcagggagggccagtgtcaa

SEQ ID NO: 9492610 - DNA, 22 bp, Homo sapiens
tagcaggacatgtgcagagaag

SEQ ID NO: 9492611 - DNA, 22 bp, Homo sapiens
tagcaggaccatgacaagaaaa

SEQ ID NO: 9492612 - DNA, 22 bp, Homo sapiens
tagcaggaccctgagcatccca

SEQ ID NO: 9492613 - DNA, 22 bp, Homo sapiens
tagcaggagagaagttttaagt

SEQ ID NO: 9492614 - DNA, 22 bp, Homo sapiens
tagcaggaataaaaatgtaccc

SEQ ID NO: 9492615 - DNA, 22 bp, Homo sapiens
tagcaggaatatgaggttaata

SEQ ID NO: 9492616 - DNA, 22 bp, Homo sapiens
tagcaggaatgaagttctgagg

SEQ ID NO: 9492617 - DNA, 22 bp, Homo sapiens
tagcaggaattggctgcagctg

SEQ ID NO: 9492618 - DNA, 22 bp, Homo sapiens
tagcaggaagaaagctactcag

SEQ ID NO: 9492619 - DNA, 22 bp, Homo sapiens
tagcaggaaggttcagggccct

SEQ ID NO: 9492620 - DNA, 22 bp, Homo sapiens
tagcaggaataaaaatgtaccc

SEQ ID NO: 9492621 - DNA, 22 bp, Homo sapiens
tagcaggaaacctgtgttgagg

SEQ ID NO: 9492622 - DNA, 22 bp, Homo sapiens
tagcagcttccagagagggcag

SEQ ID NO: 9492623 - DNA, 22 bp, Homo sapiens
tagcagcttccagagagggcag

SEQ ID NO: 9492624 - DNA, 22 bp, Homo sapiens
tagcagcttaagtaattagaat

SEQ ID NO: 9492625 - DNA, 22 bp, Homo sapiens
tagcagctgtggaggggctgtg

SEQ ID NO: 9492626 - DNA, 22 bp, Homo sapiens
tagcagctgtgagtaaaagcca

SEQ ID NO: 9492627 - DNA, 22 bp, Homo sapiens
tagcagctgtcagtttcacata

SEQ ID NO: 9492628 - DNA, 22 bp, Homo sapiens
tagcagctctttactaaccagt

SEQ ID NO: 9492629 - DNA, 22 bp, Homo sapiens
tagcagctgcatcattttacag

SEQ ID NO: 9492630 - DNA, 19 bp, Homo sapiens
tagcagctgccaaaggaga

SEQ ID NO: 9492631 - DNA, 22 bp, Homo sapiens
tagcagctggggctattcatca

SEQ ID NO: 9492632 - DNA, 19 bp, Homo sapiens
tagcagctgccaaaggaga

SEQ ID NO: 9492633 - DNA, 22 bp, Homo sapiens
tagcaaagaccaaagctagttg

SEQ ID NO: 9492634 - DNA, 22 bp, Homo sapiens
tagcaaagcgaaagagatttat

SEQ ID NO: 9492635 - DNA, 22 bp, Homo sapiens
tagcaaagctccgtagttattt

SEQ ID NO: 9492636 - DNA, 22 bp, Homo sapiens
tagcaaagcgaaagagatttat

SEQ ID NO: 9492637 - DNA, 21 bp, Homo sapiens
tagcaaagccagatgtatatt

SEQ ID NO: 9492638 - DNA, 22 bp, Homo sapiens
tagcaaagcccttgctgtgtaa

SEQ ID NO: 9492639 - DNA, 22 bp, Homo sapiens
tagcaaaagctcaacaggaagg

SEQ ID NO: 9492640 - DNA, 22 bp, Homo sapiens
tagcaaaagctcaacaggaagg

SEQ ID NO: 9492641 - DNA, 22 bp, Homo sapiens
tagcaaaatgtggatgtagttg

SEQ ID NO: 9492642 - DNA, 22 bp, Homo sapiens
tagcaaaatgtggatgtagttg

SEQ ID NO: 9492643 - DNA, 22 bp, Homo sapiens
tagcaaaatgtggatgtagttg

SEQ ID NO: 9492644 - DNA, 22 bp, Homo sapiens
tagcaaaatgtggatgtagttg

SEQ ID NO: 9492645 - DNA, 22 bp, Homo sapiens
tagcaaaagctcaacaggaagg

SEQ ID NO: 9492646 - DNA, 22 bp, Homo sapiens
tagatgaattagcaattatctt

SEQ ID NO: 9492647 - DNA, 22 bp, Homo sapiens
tagatgaccttgtgttaggcaa

SEQ ID NO: 9492648 - DNA, 22 bp, Homo sapiens
tagatgaccttgtgttaggcaa

SEQ ID NO: 9492649 - DNA, 22 bp, Homo sapiens
tagatgaatgacttatatgtca

SEQ ID NO: 9492650 - DNA, 22 bp, Homo sapiens
tagatgaaggggttcagcatgg

SEQ ID NO: 9492651 - DNA, 20 bp, Homo sapiens
tagatcctggggatttattg

SEQ ID NO: 9492652 - DNA, 22 bp, Homo sapiens
tagatctgatacaattcatctg

SEQ ID NO: 9492653 - DNA, 22 bp, Homo sapiens
tagatctgatacaattcatctg

SEQ ID NO: 9492654 - DNA, 21 bp, Homo sapiens
tagatgaaatcagagtatttc

SEQ ID NO: 9492655 - DNA, 22 bp, Homo sapiens
tagatcttgttacagatttcct

SEQ ID NO: 9492656 - DNA, 23 bp, Homo sapiens
tagcaaagttgtttgggaaattt

SEQ ID NO: 9492657 - DNA, 22 bp, Homo sapiens
tagcaaataaaacagtattgaa

SEQ ID NO: 9492658 - DNA, 22 bp, Homo sapiens
tagcaaataaaacagtattgaa

SEQ ID NO: 9492659 - DNA, 22 bp, Homo sapiens
tagcaaaggatgactatgtacc

SEQ ID NO: 9492660 - DNA, 22 bp, Homo sapiens
tagcaaaggatgactatgtacc

SEQ ID NO: 9492661 - DNA, 22 bp, Homo sapiens
tagcaaagctccgtagttattt

SEQ ID NO: 9492662 - DNA, 22 bp, Homo sapiens
tagcaaatgtaaaatgcctaca

SEQ ID NO: 9492663 - DNA, 22 bp, Homo sapiens
tagcaaatgtaaaatgcctaca

SEQ ID NO: 9492664 - DNA, 22 bp, Homo sapiens
tagcaaatgtgttatgctatgc

SEQ ID NO: 9492665 - DNA, 22 bp, Homo sapiens
tagcaaatgtctgaaggaatag

SEQ ID NO: 9492666 - DNA, 22 bp, Homo sapiens
tagcaaatgcctggttaattag

SEQ ID NO: 9492667 - DNA, 21 bp, Homo sapiens
tagcaaatggagagtaagaga

SEQ ID NO: 9492668 - DNA, 21 bp, Homo sapiens
tagcaaatggagagtaagaga

SEQ ID NO: 9492669 - DNA, 22 bp, Homo sapiens
tagcaaatgcctggttaattag

SEQ ID NO: 9492670 - DNA, 22 bp, Homo sapiens
tagcaaatacatgatgtaattt

SEQ ID NO: 9492671 - DNA, 22 bp, Homo sapiens
tagcaaatacatgatgtaattt

SEQ ID NO: 9492672 - DNA, 22 bp, Homo sapiens
tagcaacatggttatcacatta

SEQ ID NO: 9492673 - DNA, 22 bp, Homo sapiens
tagcaactgcctttactatatt

SEQ ID NO: 9492674 - DNA, 22 bp, Homo sapiens
tagcaagaagggagatggggtt

SEQ ID NO: 9492675 - DNA, 22 bp, Homo sapiens
tagcagctcctaaacagtggtg

SEQ ID NO: 9492676 - DNA, 22 bp, Homo sapiens
tagcagctctgattctgggccc

SEQ ID NO: 9492677 - DNA, 22 bp, Homo sapiens
tagcagctctgattctgggccc

SEQ ID NO: 9492678 - DNA, 22 bp, Homo sapiens
tagcaacataagaaacattttg

SEQ ID NO: 9492679 - DNA, 22 bp, Homo sapiens
tagcaacatggttatcacatta

SEQ ID NO: 9492680 - DNA, 22 bp, Homo sapiens
tagcaacaatggaagtaacttc

SEQ ID NO: 9492681 - DNA, 22 bp, Homo sapiens
tagcaacaatggaagtaacttc

SEQ ID NO: 9492682 - DNA, 21 bp, Homo sapiens
tagcaaattgctattaaggca

SEQ ID NO: 9492683 - DNA, 22 bp, Homo sapiens
tagcaacaagtgactatctata

SEQ ID NO: 9492684 - DNA, 22 bp, Homo sapiens
tagcaaatgtgttatgctatgc

SEQ ID NO: 9492685 - DNA, 22 bp, Homo sapiens
tagcaaatgtgttatgctatgc

SEQ ID NO: 9492686 - DNA, 22 bp, Homo sapiens
tcaaagacagacatcagtcaaa

SEQ ID NO: 9492687 - DNA, 22 bp, Homo sapiens
tcaaagacatggggaagctgag

SEQ ID NO: 9492688 - DNA, 22 bp, Homo sapiens
tcaaagacatggggaagctgag

SEQ ID NO: 9492689 - DNA, 21 bp, Homo sapiens
tcaaagactggggctgtgtgc

SEQ ID NO: 9492690 - DNA, 22 bp, Homo sapiens
tcaaagagctattcagttgtgg

SEQ ID NO: 9492691 - DNA, 22 bp, Homo sapiens
tcaaagactatatattttattt

SEQ ID NO: 9492692 - DNA, 22 bp, Homo sapiens
tcaaagatagatgttgagaaat

SEQ ID NO: 9492693 - DNA, 22 bp, Homo sapiens
tcaaagagctctatcttcaaaa

SEQ ID NO: 9492694 - DNA, 22 bp, Homo sapiens
tcaaagagctctatcttcaaaa

SEQ ID NO: 9492695 - DNA, 22 bp, Homo sapiens
tcaaagatgataggaaatcata

SEQ ID NO: 9492696 - DNA, 22 bp, Homo sapiens
tcaaagatgataggaaatcata

SEQ ID NO: 9492697 - DNA, 22 bp, Homo sapiens
tcaaagatagatgttgagaaat

SEQ ID NO: 9492698 - DNA, 22 bp, Homo sapiens
tcaaagatagatgttgagaaat

SEQ ID NO: 9492699 - DNA, 22 bp, Homo sapiens
tcaaagatgataggaaatcata

SEQ ID NO: 9492700 - DNA, 19 bp, Homo sapiens
tcaaagcaagcatgttctg

SEQ ID NO: 9492701 - DNA, 22 bp, Homo sapiens
tcaaagatgatgctgaagttat

SEQ ID NO: 9492702 - DNA, 22 bp, Homo sapiens
tcaaagaatgttatgagggtag

SEQ ID NO: 9492703 - DNA, 20 bp, Homo sapiens
tcaaagacaagctctcatcc

SEQ ID NO: 9492704 - DNA, 17 bp, Homo sapiens
tcaaagaatgcatgcag

SEQ ID NO: 9492705 - DNA, 17 bp, Homo sapiens
tcaaagaatgcatgcag

SEQ ID NO: 9492706 - DNA, 22 bp, Homo sapiens
tcaaagaacatcatctgaaatg

SEQ ID NO: 9492707 - DNA, 22 bp, Homo sapiens
tcaaagaagattaccctcccat

SEQ ID NO: 9492708 - DNA, 20 bp, Homo sapiens
tcaaagaagattcagctcaa

SEQ ID NO: 9492709 - DNA, 20 bp, Homo sapiens
tcaaagaagattcagctcaa

SEQ ID NO: 9492710 - DNA, 22 bp, Homo sapiens
tcaaagaagtgcaaacctcatc

SEQ ID NO: 9492711 - DNA, 22 bp, Homo sapiens
tcaaagaagtgcaaacctcatc

SEQ ID NO: 9492712 - DNA, 22 bp, Homo sapiens
tcaaactggcagacttctactt

SEQ ID NO: 9492713 - DNA, 22 bp, Homo sapiens
tcaaacttggtaagagaaatac

SEQ ID NO: 9492714 - DNA, 22 bp, Homo sapiens
tattttgcaaacctgagtttga

SEQ ID NO: 9492715 - DNA, 22 bp, Homo sapiens
tattttgacgattttatgcaaa

SEQ ID NO: 9492716 - DNA, 22 bp, Homo sapiens
tattttgacgattttatgcaaa

SEQ ID NO: 9492717 - DNA, 22 bp, Homo sapiens
tattttgacgattttatgcaaa

SEQ ID NO: 9492718 - DNA, 22 bp, Homo sapiens
tattttgacgattttatgcaaa

SEQ ID NO: 9492719 - DNA, 22 bp, Homo sapiens
tattttgactattaaaccaaca

SEQ ID NO: 9492720 - DNA, 22 bp, Homo sapiens
tattttgaggtatttttgagct

SEQ ID NO: 9492721 - DNA, 22 bp, Homo sapiens
tattttgaggtatttttgagct

SEQ ID NO: 9492722 - DNA, 22 bp, Homo sapiens
tcaaaaataagatattctggac

SEQ ID NO: 9492723 - DNA, 22 bp, Homo sapiens
tcaaaaataagatattctggac

SEQ ID NO: 9492724 - DNA, 22 bp, Homo sapiens
tcaaaaataagatattctggac

SEQ ID NO: 9492725 - DNA, 22 bp, Homo sapiens
tcaaaaataagatattctggac

SEQ ID NO: 9492726 - DNA, 22 bp, Homo sapiens
tcaaaaataagatattctggac

SEQ ID NO: 9492727 - DNA, 22 bp, Homo sapiens
tatttttgcctctcagataaaa

SEQ ID NO: 9492728 - DNA, 22 bp, Homo sapiens
tcaaaaagttgaagagttgggg

SEQ ID NO: 9492729 - DNA, 22 bp, Homo sapiens
tatttttgcctctcagataaaa

SEQ ID NO: 9492730 - DNA, 22 bp, Homo sapiens
tattttgttaataatccagtcc

SEQ ID NO: 9492731 - DNA, 19 bp, Homo sapiens
tcaaagtctgagtcacttt

SEQ ID NO: 9492732 - DNA, 22 bp, Homo sapiens
tcaaataaggagtcatgaccat

SEQ ID NO: 9492733 - DNA, 22 bp, Homo sapiens
tcaaataaggagtcatgaccat

SEQ ID NO: 9492734 - DNA, 22 bp, Homo sapiens
tcaaataatgccattcatcatc

SEQ ID NO: 9492735 - DNA, 22 bp, Homo sapiens
tcaaataatgccattcatcatc

SEQ ID NO: 9492736 - DNA, 17 bp, Homo sapiens
tcaaagtattctgatgc

SEQ ID NO: 9492737 - DNA, 22 bp, Homo sapiens
tcaaagtataattgcttttttg

SEQ ID NO: 9492738 - DNA, 23 bp, Homo sapiens
tcaaagtagttttatccaataaa

SEQ ID NO: 9492739 - DNA, 22 bp, Homo sapiens
tcaaagtattttaactgtatcc

SEQ ID NO: 9492740 - DNA, 22 bp, Homo sapiens
tcaaagtattttaactgtatcc

SEQ ID NO: 9492741 - DNA, 22 bp, Homo sapiens
tcaaagtcatggcaggctcaga

SEQ ID NO: 9492742 - DNA, 19 bp, Homo sapiens
tcaaagtctgagtcacttt

SEQ ID NO: 9492743 - DNA, 22 bp, Homo sapiens
tcaaagggtaatgtaatagtct

SEQ ID NO: 9492744 - DNA, 22 bp, Homo sapiens
tcaaagtaaaagtatagagttt

SEQ ID NO: 9492745 - DNA, 22 bp, Homo sapiens
tcaaagtaaacgctttgggcca

SEQ ID NO: 9492746 - DNA, 22 bp, Homo sapiens
tcaaaggttaactctgttgttc

SEQ ID NO: 9492747 - DNA, 22 bp, Homo sapiens
tcaaagtactactcagttcagc

SEQ ID NO: 9492748 - DNA, 22 bp, Homo sapiens
tcaaagtaccattatcagtgga

SEQ ID NO: 9492749 - DNA, 22 bp, Homo sapiens
tcaaagtaccagagtgaactga

SEQ ID NO: 9492750 - DNA, 22 bp, Homo sapiens
tcaaagtaccattatcagtgga

SEQ ID NO: 9492751 - DNA, 22 bp, Homo sapiens
tcaaagtaagaatttattacaa

SEQ ID NO: 9492752 - DNA, 22 bp, Homo sapiens
tcaaagtaagaatttattacaa

SEQ ID NO: 9492753 - DNA, 23 bp, Homo sapiens
tcaaagtagttttatccaataaa

SEQ ID NO: 9492754 - DNA, 22 bp, Homo sapiens
tcaaagtaggggtaagccaggc

SEQ ID NO: 9492755 - DNA, 22 bp, Homo sapiens
tcaaagtagccggatggaattt

SEQ ID NO: 9492756 - DNA, 22 bp, Homo sapiens
tcaaagtagccggatggaattt

SEQ ID NO: 9492757 - DNA, 22 bp, Homo sapiens
tcaaagtagccggatggaattt

SEQ ID NO: 9492758 - DNA, 22 bp, Homo sapiens
tcaaagtagagttcagtgcagc

SEQ ID NO: 9492759 - DNA, 22 bp, Homo sapiens
tcaaatatgtgatagaagctaa

SEQ ID NO: 9492760 - DNA, 22 bp, Homo sapiens
tcaaatatgtgatagaagctaa

SEQ ID NO: 9492761 - DNA, 22 bp, Homo sapiens
tcaaatatgtgatagaagctaa

SEQ ID NO: 9492762 - DNA, 22 bp, Homo sapiens
tcaaatatgtgatagaagctaa

SEQ ID NO: 9492763 - DNA, 22 bp, Homo sapiens
tcaaatatgtgatagaagctaa

SEQ ID NO: 9492764 - DNA, 22 bp, Homo sapiens
tcaaatatgtgatagaagctaa

SEQ ID NO: 9492765 - DNA, 22 bp, Homo sapiens
tcaaataccagcaatttcatgt

SEQ ID NO: 9492766 - DNA, 22 bp, Homo sapiens
tcaaatatgtgatagaagctaa

SEQ ID NO: 9492767 - DNA, 22 bp, Homo sapiens
tcaaataggtatgagtagaaat

SEQ ID NO: 9492768 - DNA, 22 bp, Homo sapiens
tcaaatacatggtcaatcaact

SEQ ID NO: 9492769 - DNA, 22 bp, Homo sapiens
tcaaataccagcaatttcatgt

SEQ ID NO: 9492770 - DNA, 22 bp, Homo sapiens
tcaaataccagcaatttcatgt

SEQ ID NO: 9492771 - DNA, 22 bp, Homo sapiens
tcaaataccagcaatttcatgt

SEQ ID NO: 9492772 - DNA, 22 bp, Homo sapiens
tcaaataatgccattcatcatc

SEQ ID NO: 9492773 - DNA, 22 bp, Homo sapiens
tcaaataatgccattcatcatc

SEQ ID NO: 9492774 - DNA, 22 bp, Homo sapiens
tcaaatacatggtcaatcaact

SEQ ID NO: 9492775 - DNA, 21 bp, Homo sapiens
tcaaatcatgtactgaccaca

SEQ ID NO: 9492776 - DNA, 22 bp, Homo sapiens
tcaaatcccagctcagcctctc

SEQ ID NO: 9492777 - DNA, 22 bp, Homo sapiens
tcaaatctttaacatgtgcaaa

SEQ ID NO: 9492778 - DNA, 22 bp, Homo sapiens
tcaaatgaagacagttgacttg

SEQ ID NO: 9492779 - DNA, 22 bp, Homo sapiens
tcaaatgagaggcagggcagct

SEQ ID NO: 9492780 - DNA, 22 bp, Homo sapiens
tcaaatcaccaaactcactggc

SEQ ID NO: 9492781 - DNA, 21 bp, Homo sapiens
tcaaatcaggtatcactattg

SEQ ID NO: 9492782 - DNA, 22 bp, Homo sapiens
tcaaatcagcaagcagcttccc

SEQ ID NO: 9492783 - DNA, 21 bp, Homo sapiens
tcaaatcaggtatcactattg

SEQ ID NO: 9492784 - DNA, 21 bp, Homo sapiens
tcaaatcatgtactgaccaca

SEQ ID NO: 9492785 - DNA, 22 bp, Homo sapiens
tcaaatattggctatttcacat

SEQ ID NO: 9492786 - DNA, 22 bp, Homo sapiens
tcaaatcaccaaactcactggc

SEQ ID NO: 9492787 - DNA, 22 bp, Homo sapiens
tcaaatattggctatttcacat

SEQ ID NO: 9492788 - DNA, 22 bp, Homo sapiens
tcaaatcaccaaactcactggc

SEQ ID NO: 9492789 - DNA, 22 bp, Homo sapiens
tattgtcttcaactctactttt

SEQ ID NO: 9492790 - DNA, 22 bp, Homo sapiens
tattgtcttcaactctactttt

SEQ ID NO: 9492791 - DNA, 22 bp, Homo sapiens
tattgtctgtttgaatgactat

SEQ ID NO: 9492792 - DNA, 20 bp, Homo sapiens
tattgtgataggtgttaatc

SEQ ID NO: 9492793 - DNA, 22 bp, Homo sapiens
tattgtgagtataactgcattt

SEQ ID NO: 9492794 - DNA, 22 bp, Homo sapiens
tatttaaaaagaggccagctgg

SEQ ID NO: 9492795 - DNA, 22 bp, Homo sapiens
tatttaaaaagaggccagctgg

SEQ ID NO: 9492796 - DNA, 22 bp, Homo sapiens
tatttaaaaagaggccagctgg

SEQ ID NO: 9492797 - DNA, 22 bp, Homo sapiens
tatttaaaaagaggccagctgg

SEQ ID NO: 9492798 - DNA, 22 bp, Homo sapiens
tatttaactggaaacacaatga

SEQ ID NO: 9492799 - DNA, 22 bp, Homo sapiens
tatttaagatgtgtcataaaga

SEQ ID NO: 9492800 - DNA, 22 bp, Homo sapiens
tatttaataaaactatggcatg

SEQ ID NO: 9492801 - DNA, 22 bp, Homo sapiens
tatttaataaaactatggcatg

SEQ ID NO: 9492802 - DNA, 22 bp, Homo sapiens
tatttaagatgtgtcataaaga

SEQ ID NO: 9492803 - DNA, 22 bp, Homo sapiens
tatttaaaaagaggccagctgg

SEQ ID NO: 9492804 - DNA, 22 bp, Homo sapiens
tatttaaaaagaggccagctgg

SEQ ID NO: 9492805 - DNA, 22 bp, Homo sapiens
tatttaaaataagccccagtgg

SEQ ID NO: 9492806 - DNA, 22 bp, Homo sapiens
tatttaaaataagccccagtgg

SEQ ID NO: 9492807 - DNA, 22 bp, Homo sapiens
tatttaaaataagccccagtgg

SEQ ID NO: 9492808 - DNA, 22 bp, Homo sapiens
tatttaaaataagccccagtgg

SEQ ID NO: 9492809 - DNA, 22 bp, Homo sapiens
tatttaaaatagtgctccagca

SEQ ID NO: 9492810 - DNA, 22 bp, Homo sapiens
tatttaaaatagtgctccagca

SEQ ID NO: 9492811 - DNA, 22 bp, Homo sapiens
tatttaaccagttaaatttcca

SEQ ID NO: 9492812 - DNA, 22 bp, Homo sapiens
tatttaaaatagtgctccagca

SEQ ID NO: 9492813 - DNA, 22 bp, Homo sapiens
tatttaaaatagtgctccagca

SEQ ID NO: 9492814 - DNA, 21 bp, Homo sapiens
tattgtcaatctgctttcaga

SEQ ID NO: 9492815 - DNA, 22 bp, Homo sapiens
tattgtctaggaattgtttaaa

SEQ ID NO: 9492816 - DNA, 22 bp, Homo sapiens
tattgtccaataggatgttcct

SEQ ID NO: 9492817 - DNA, 22 bp, Homo sapiens
tattgtctgtccgggtcaaagc

SEQ ID NO: 9492818 - DNA, 22 bp, Homo sapiens
tattgtctgcaaaggtttataa

SEQ ID NO: 9492819 - DNA, 22 bp, Homo sapiens
tattgtctgtttgaatgactat

SEQ ID NO: 9492820 - DNA, 22 bp, Homo sapiens
tattgtctctgcgttgttctat

SEQ ID NO: 9492821 - DNA, 22 bp, Homo sapiens
tattgtctaggaattgtttaaa

SEQ ID NO: 9492822 - DNA, 22 bp, Homo sapiens
tattgtctaggaattgtttaaa

SEQ ID NO: 9492823 - DNA, 22 bp, Homo sapiens
tattgtctcacagttttggagg

SEQ ID NO: 9492824 - DNA, 22 bp, Homo sapiens
tattgtcaagaagtttatagtg

SEQ ID NO: 9492825 - DNA, 22 bp, Homo sapiens
tattgtcacgtcttaattctag

SEQ ID NO: 9492826 - DNA, 21 bp, Homo sapiens
tattgtcaatctgctttcaga

SEQ ID NO: 9492827 - DNA, 22 bp, Homo sapiens
tattgtcaagaagtttatagtg

SEQ ID NO: 9492828 - DNA, 22 bp, Homo sapiens
tattgtatcttaccacatgtat

SEQ ID NO: 9492829 - DNA, 22 bp, Homo sapiens
tattacaatttacattgcactt

SEQ ID NO: 9492830 - DNA, 22 bp, Homo sapiens
tattgtatcttaccacatgtat

SEQ ID NO: 9492831 - DNA, 22 bp, Homo sapiens
tattgtatcttctgtttagaag

SEQ ID NO: 9492832 - DNA, 22 bp, Homo sapiens
tattaatttaatctccatggta

SEQ ID NO: 9492833 - DNA, 21 bp, Homo sapiens
tattaatttttcttcccacta

SEQ ID NO: 9492834 - DNA, 22 bp, Homo sapiens
tattacaaattataatgggaga

SEQ ID NO: 9492835 - DNA, 21 bp, Homo sapiens
tattaatttttcttcccacta

SEQ ID NO: 9492836 - DNA, 22 bp, Homo sapiens
tattacaaattataatgggaga

SEQ ID NO: 9492837 - DNA, 22 bp, Homo sapiens
tattacaagaaagggcatgaat

SEQ ID NO: 9492838 - DNA, 22 bp, Homo sapiens
tattacaaattataatgggaga

SEQ ID NO: 9492839 - DNA, 22 bp, Homo sapiens
tattacaagaaagggcatgaat

SEQ ID NO: 9492840 - DNA, 22 bp, Homo sapiens
tattacaagaaagggcatgaat

SEQ ID NO: 9492841 - DNA, 23 bp, Homo sapiens
tattacaattggtcttattaaga

SEQ ID NO: 9492842 - DNA, 23 bp, Homo sapiens
tattacaattggtcttattaaga

SEQ ID NO: 9492843 - DNA, 23 bp, Homo sapiens
tattacaattggtcttattaaga

SEQ ID NO: 9492844 - DNA, 22 bp, Homo sapiens
tattacaatttacattgcactt

SEQ ID NO: 9492845 - DNA, 23 bp, Homo sapiens
tattacaattggtcttattaaga

SEQ ID NO: 9492846 - DNA, 22 bp, Homo sapiens
tattttccttggtggacccagt

SEQ ID NO: 9492847 - DNA, 22 bp, Homo sapiens
tattttccttggtggacccagt

SEQ ID NO: 9492848 - DNA, 23 bp, Homo sapiens
tattttccaaatgatgactacat

SEQ ID NO: 9492849 - DNA, 22 bp, Homo sapiens
tattttcattctgtgtgactgt

SEQ ID NO: 9492850 - DNA, 23 bp, Homo sapiens
tattttccaaatgatgactacat

SEQ ID NO: 9492851 - DNA, 23 bp, Homo sapiens
tattttcctggcaacaggggaac

SEQ ID NO: 9492852 - DNA, 22 bp, Homo sapiens
tattttcattctgtgtgactgt

SEQ ID NO: 9492853 - DNA, 22 bp, Homo sapiens
tattttgaaagtctgttttgaa

SEQ ID NO: 9492854 - DNA, 22 bp, Homo sapiens
tattttctggggagagtgaacc

SEQ ID NO: 9492855 - DNA, 22 bp, Homo sapiens
tattttctggggagagtgaacc

SEQ ID NO: 9492856 - DNA, 22 bp, Homo sapiens
tattttctggacagtcttgctt

SEQ ID NO: 9492857 - DNA, 23 bp, Homo sapiens
tatttggaaagagggaagaagac

SEQ ID NO: 9492858 - DNA, 22 bp, Homo sapiens
tatttggaaatagggctttgta

SEQ ID NO: 9492859 - DNA, 22 bp, Homo sapiens
tatttgctgaatctgattcaga

SEQ ID NO: 9492860 - DNA, 22 bp, Homo sapiens
tatttgatagagataaatgata

SEQ ID NO: 9492861 - DNA, 22 bp, Homo sapiens
tatttgaaggcatacattttga

SEQ ID NO: 9492862 - DNA, 22 bp, Homo sapiens
tatttgaaggcatacattttga

SEQ ID NO: 9492863 - DNA, 22 bp, Homo sapiens
tatttgaaggcatacattttga

SEQ ID NO: 9492864 - DNA, 22 bp, Homo sapiens
tatttgaagggagaaagtgcca

SEQ ID NO: 9492865 - DNA, 22 bp, Homo sapiens
tatttcttgagtggtcagtttc

SEQ ID NO: 9492866 - DNA, 22 bp, Homo sapiens
tatttcttgttattctcgttga

SEQ ID NO: 9492867 - DNA, 22 bp, Homo sapiens
tatttcttgttattctcgttga

SEQ ID NO: 9492868 - DNA, 22 bp, Homo sapiens
tatttcttgttattctcgttga

SEQ ID NO: 9492869 - DNA, 22 bp, Homo sapiens
tatttgaaggcatacattttga

SEQ ID NO: 9492870 - DNA, 22 bp, Homo sapiens
tatttgaaggcatacattttga

SEQ ID NO: 9492871 - DNA, 22 bp, Homo sapiens
tatttgaaggcatacattttga

SEQ ID NO: 9492872 - DNA, 22 bp, Homo sapiens
tatttcttgttattctcgttga

SEQ ID NO: 9492873 - DNA, 22 bp, Homo sapiens
tatttgatggttctaaaacagc

SEQ ID NO: 9492874 - DNA, 22 bp, Homo sapiens
tatttgatgaaggtaaagtctt

SEQ ID NO: 9492875 - DNA, 22 bp, Homo sapiens
tatttgatgaaggtaaagtctt

SEQ ID NO: 9492876 - DNA, 22 bp, Homo sapiens
tatttgatggttctaaaacagc

SEQ ID NO: 9492877 - DNA, 22 bp, Homo sapiens
tatttgatggttctaaaacagc

SEQ ID NO: 9492878 - DNA, 22 bp, Homo sapiens
tatttgatggttctaaaacagc

SEQ ID NO: 9492879 - DNA, 22 bp, Homo sapiens
tatttgatagagataaatgata

SEQ ID NO: 9492880 - DNA, 22 bp, Homo sapiens
tatttgatagagataaatgata

SEQ ID NO: 9492881 - DNA, 22 bp, Homo sapiens
tatttgatagagataaatgata

SEQ ID NO: 9492882 - DNA, 22 bp, Homo sapiens
tatttgatgaaggtaaagtctt

SEQ ID NO: 9492883 - DNA, 22 bp, Homo sapiens
tatttgcaggcttttgtcatgg

SEQ ID NO: 9492884 - DNA, 22 bp, Homo sapiens
tatttgcaggacatagatatgg

SEQ ID NO: 9492885 - DNA, 22 bp, Homo sapiens
tatggtagaaaaactgagtccc

SEQ ID NO: 9492886 - DNA, 22 bp, Homo sapiens
tatgggctgggtatgagctggt

SEQ ID NO: 9492887 - DNA, 22 bp, Homo sapiens
tatggctttaaattgaaggagt

SEQ ID NO: 9492888 - DNA, 22 bp, Homo sapiens
tatggctttaaacaacttaggt

SEQ ID NO: 9492889 - DNA, 22 bp, Homo sapiens
tatggcttttaaggagatctga

SEQ ID NO: 9492890 - DNA, 22 bp, Homo sapiens
tatggctttcaaaggaactcgg

SEQ ID NO: 9492891 - DNA, 22 bp, Homo sapiens
tatgtacatacatgtgcatacg

SEQ ID NO: 9492892 - DNA, 22 bp, Homo sapiens
tatgtacatacatgtgcatacg

SEQ ID NO: 9492893 - DNA, 22 bp, Homo sapiens
tatgtacaagcacacatgtgac

SEQ ID NO: 9492894 - DNA, 22 bp, Homo sapiens
tatgtacaagcacacatgtgac

SEQ ID NO: 9492895 - DNA, 22 bp, Homo sapiens
tatgtaagttgcaaatgaagga

SEQ ID NO: 9492896 - DNA, 22 bp, Homo sapiens
tatgtaaagtagatggcaggta

SEQ ID NO: 9492897 - DNA, 22 bp, Homo sapiens
tatgtaaaggattgagatgaat

SEQ ID NO: 9492898 - DNA, 22 bp, Homo sapiens
tatgtaaaaattcatcaggctg

SEQ ID NO: 9492899 - DNA, 22 bp, Homo sapiens
tatgtaaaaattcatcaggctg

SEQ ID NO: 9492900 - DNA, 22 bp, Homo sapiens
tatgtactcatcaactattgaa

SEQ ID NO: 9492901 - DNA, 22 bp, Homo sapiens
tatgtactcatcaactattgaa

SEQ ID NO: 9492902 - DNA, 22 bp, Homo sapiens
tatgtactctaatttgtctcat

SEQ ID NO: 9492903 - DNA, 22 bp, Homo sapiens
tatgtactctaatttgtctcat

SEQ ID NO: 9492904 - DNA, 22 bp, Homo sapiens
tatgtactctaatttgtctcat

SEQ ID NO: 9492905 - DNA, 22 bp, Homo sapiens
tatgtacatacatgtgcatacg

SEQ ID NO: 9492906 - DNA, 22 bp, Homo sapiens
tatgtacatacatgtgcatacg

SEQ ID NO: 9492907 - DNA, 22 bp, Homo sapiens
tatgtacatatacacgtgtgtg

SEQ ID NO: 9492908 - DNA, 22 bp, Homo sapiens
tatgtactacactagaacattt

SEQ ID NO: 9492909 - DNA, 22 bp, Homo sapiens
tatgtactacactagaacattt

SEQ ID NO: 9492910 - DNA, 22 bp, Homo sapiens
tatggaaataattagacaagtg

SEQ ID NO: 9492911 - DNA, 22 bp, Homo sapiens
tatggacatctgaagttgcaga

SEQ ID NO: 9492912 - DNA, 22 bp, Homo sapiens
tatggaatggctattttctagg

SEQ ID NO: 9492913 - DNA, 22 bp, Homo sapiens
tatggacatgagtcaaggtgct

SEQ ID NO: 9492914 - DNA, 22 bp, Homo sapiens
tatggaaaaatgtatcttgtca

SEQ ID NO: 9492915 - DNA, 20 bp, Homo sapiens
tatgctttttataagattga

SEQ ID NO: 9492916 - DNA, 22 bp, Homo sapiens
tatggaaaaatgtatcttgtca

SEQ ID NO: 9492917 - DNA, 22 bp, Homo sapiens
tatggaaaaatgtatcttgtca

SEQ ID NO: 9492918 - DNA, 22 bp, Homo sapiens
tatggaaaaatgtatcttgtca

SEQ ID NO: 9492919 - DNA, 22 bp, Homo sapiens
tatggaaactaattcatttttc

SEQ ID NO: 9492920 - DNA, 22 bp, Homo sapiens
tatggaaactaattcatttttc

SEQ ID NO: 9492921 - DNA, 22 bp, Homo sapiens
tatggaaagctctttttgattg

SEQ ID NO: 9492922 - DNA, 22 bp, Homo sapiens
tatggaaactaattcatttttc

SEQ ID NO: 9492923 - DNA, 22 bp, Homo sapiens
tatggaaagctctttttgattg

SEQ ID NO: 9492924 - DNA, 22 bp, Homo sapiens
tatggaaagctctttttgattg

SEQ ID NO: 9492925 - DNA, 22 bp, Homo sapiens
tatggaaagggagtttaatttg

SEQ ID NO: 9492926 - DNA, 22 bp, Homo sapiens
tatggaaagtgttttcttctgt

SEQ ID NO: 9492927 - DNA, 22 bp, Homo sapiens
tatggaaagggagtttaatttg

SEQ ID NO: 9492928 - DNA, 20 bp, Homo sapiens
tatgctttttataagattga

SEQ ID NO: 9492929 - DNA, 22 bp, Homo sapiens
tatgcttttaacctgtaactga

SEQ ID NO: 9492930 - DNA, 22 bp, Homo sapiens
tatgctttggtagagagttgtg

SEQ ID NO: 9492931 - DNA, 22 bp, Homo sapiens
tatgctttgcaattggaaaagg

SEQ ID NO: 9492932 - DNA, 22 bp, Homo sapiens
tatgctttgcaattggaaaagg

SEQ ID NO: 9492933 - DNA, 22 bp, Homo sapiens
tatgctttgcaattggaaaagg

SEQ ID NO: 9492934 - DNA, 22 bp, Homo sapiens
tatgctttaaccctcttatatt

SEQ ID NO: 9492935 - DNA, 22 bp, Homo sapiens
tatgctttaacattaaacaaca

SEQ ID NO: 9492936 - DNA, 22 bp, Homo sapiens
tatgctttaacattaaacaaca

SEQ ID NO: 9492937 - DNA, 19 bp, Homo sapiens
tatgacaagtactagttct

SEQ ID NO: 9492938 - DNA, 22 bp, Homo sapiens
tatgctttcattcatatgtgag

SEQ ID NO: 9492939 - DNA, 22 bp, Homo sapiens
tatgctttacttttcattgtga

SEQ ID NO: 9492940 - DNA, 22 bp, Homo sapiens
tatgctttacttttcattgtga

SEQ ID NO: 9492941 - DNA, 22 bp, Homo sapiens
tatgctttaaccctcttatatt

SEQ ID NO: 9492942 - DNA, 22 bp, Homo sapiens
tatgctttacttttcattgtga

SEQ ID NO: 9492943 - DNA, 22 bp, Homo sapiens
tatgtttggcctggcaatttca

SEQ ID NO: 9492944 - DNA, 22 bp, Homo sapiens
tattaaattatggatttaggag

SEQ ID NO: 9492945 - DNA, 22 bp, Homo sapiens
tattaaattatggatttaggag

SEQ ID NO: 9492946 - DNA, 22 bp, Homo sapiens
tattaaattatggatttaggag

SEQ ID NO: 9492947 - DNA, 22 bp, Homo sapiens
tattaaattatggatttaggag

SEQ ID NO: 9492948 - DNA, 22 bp, Homo sapiens
tattaaattatggatttaggag

SEQ ID NO: 9492949 - DNA, 22 bp, Homo sapiens
tattaaattatggatttaggag

SEQ ID NO: 9492950 - DNA, 22 bp, Homo sapiens
tattaacacgtataaagtgttt

SEQ ID NO: 9492951 - DNA, 22 bp, Homo sapiens
tatgtttatactttgatgtact

SEQ ID NO: 9492952 - DNA, 22 bp, Homo sapiens
tatgtcatgggtcaaaatgaag

SEQ ID NO: 9492953 - DNA, 23 bp, Homo sapiens
tatgtcatgagcatattgaatgt

SEQ ID NO: 9492954 - DNA, 22 bp, Homo sapiens
tatgtcacattgtaacagtgtg

SEQ ID NO: 9492955 - DNA, 22 bp, Homo sapiens
tatgtcaactgtgctggttaat

SEQ ID NO: 9492956 - DNA, 22 bp, Homo sapiens
tatgtcaaagttaagaaatagg

SEQ ID NO: 9492957 - DNA, 22 bp, Homo sapiens
tattaacatgaactgacttttc

SEQ ID NO: 9492958 - DNA, 22 bp, Homo sapiens
tattaagatacgtagttgtaaa

SEQ ID NO: 9492959 - DNA, 22 bp, Homo sapiens
tattaagatacgtagttgtaaa

SEQ ID NO: 9492960 - DNA, 22 bp, Homo sapiens
tattaagagatgtatgaagaga

SEQ ID NO: 9492961 - DNA, 22 bp, Homo sapiens
tattaagtatcttgatgacaaa

SEQ ID NO: 9492962 - DNA, 22 bp, Homo sapiens
tattaataaatatgtaggggcc

SEQ ID NO: 9492963 - DNA, 22 bp, Homo sapiens
tattaataaatatgtaggggcc

SEQ ID NO: 9492964 - DNA, 21 bp, Homo sapiens
tattaatatgtctaagctgat

SEQ ID NO: 9492965 - DNA, 21 bp, Homo sapiens
tattaatatgtctaagctgat

SEQ ID NO: 9492966 - DNA, 21 bp, Homo sapiens
tattaatatgtctaagctgat

SEQ ID NO: 9492967 - DNA, 22 bp, Homo sapiens
tattaataagtgactactagct

SEQ ID NO: 9492968 - DNA, 22 bp, Homo sapiens
tattaataagtgactactagct

SEQ ID NO: 9492969 - DNA, 22 bp, Homo sapiens
tattaataagtgactactagct

SEQ ID NO: 9492970 - DNA, 22 bp, Homo sapiens
tattaattcttgccaattctcc

SEQ ID NO: 9492971 - DNA, 22 bp, Homo sapiens
tattaatatgtgtgtgcatgta

SEQ ID NO: 9492972 - DNA, 22 bp, Homo sapiens
tattaatatgtgtgtgcatgta

SEQ ID NO: 9492973 - DNA, 21 bp, Homo sapiens
tattaatatgtctaagctgat

SEQ ID NO: 9492974 - DNA, 22 bp, Homo sapiens
tatgtcaaaaaagattatgttt

SEQ ID NO: 9492975 - DNA, 22 bp, Homo sapiens
tatgtcaaaaaagattatgttt

SEQ ID NO: 9492976 - DNA, 22 bp, Homo sapiens
tatgtcaaaaaagattatgttt

SEQ ID NO: 9492977 - DNA, 22 bp, Homo sapiens
tatgtattctgagtacaagttc

SEQ ID NO: 9492978 - DNA, 22 bp, Homo sapiens
tatgtatcttttgttttccctg

SEQ ID NO: 9492979 - DNA, 22 bp, Homo sapiens
tatgtatccgtgtgtgtacaga

SEQ ID NO: 9492980 - DNA, 22 bp, Homo sapiens
tatgtatctgttcatcagttaa

SEQ ID NO: 9492981 - DNA, 22 bp, Homo sapiens
tatgtatctgttcatcagttaa

SEQ ID NO: 9492982 - DNA, 22 bp, Homo sapiens
tatgtatatgtgtgttgacaac

SEQ ID NO: 9492983 - DNA, 22 bp, Homo sapiens
tatgtatccgtgtgtgtacaga

SEQ ID NO: 9492984 - DNA, 22 bp, Homo sapiens
tatgtagagataaaatccaaat

SEQ ID NO: 9492985 - DNA, 22 bp, Homo sapiens
tatgtagcaatagcatcatact

SEQ ID NO: 9492986 - DNA, 22 bp, Homo sapiens
tatgtagtgttgagaatgcttg

SEQ ID NO: 9492987 - DNA, 17 bp, Homo sapiens
tatgtagtacttataaa

SEQ ID NO: 9492988 - DNA, 22 bp, Homo sapiens
tatgtagtacttagtgcataca

SEQ ID NO: 9492989 - DNA, 22 bp, Homo sapiens
tatgtataaatgcatgtgtgga

SEQ ID NO: 9492990 - DNA, 18 bp, Homo sapiens
tatgtataacatagttca

SEQ ID NO: 9492991 - DNA, 22 bp, Homo sapiens
tatgtatataggtgtgtgtctc

SEQ ID NO: 9492992 - DNA, 22 bp, Homo sapiens
tatgtatataggtgtgtgtctc

SEQ ID NO: 9492993 - DNA, 22 bp, Homo sapiens
tatgtatagagtcttttaaatt

SEQ ID NO: 9492994 - DNA, 22 bp, Homo sapiens
tatgtatagagtcttttaaatt

SEQ ID NO: 9492995 - DNA, 22 bp, Homo sapiens
tataaacttaatggttccgaat

SEQ ID NO: 9492996 - DNA, 22 bp, Homo sapiens
tataaactttaaccaggatgtc

SEQ ID NO: 9492997 - DNA, 22 bp, Homo sapiens
tataaagaaatgatttccagaa

SEQ ID NO: 9492998 - DNA, 22 bp, Homo sapiens
tataaagaaggcacagcaagac

SEQ ID NO: 9492999 - DNA, 22 bp, Homo sapiens
tataaagaaggcacagcaagac

SEQ ID NO: 9493000 - DNA, 22 bp, Homo sapiens
tataaagaaggcacagcaagac

SEQ ID NO: 9493001 - DNA, 22 bp, Homo sapiens
tataaactcctcttgcattcct

SEQ ID NO: 9493002 - DNA, 22 bp, Homo sapiens
tataaactcctcttgcattcct

SEQ ID NO: 9493003 - DNA, 22 bp, Homo sapiens
tataaactcctcttgcattcct

SEQ ID NO: 9493004 - DNA, 22 bp, Homo sapiens
tataaactatatgttagccaga

SEQ ID NO: 9493005 - DNA, 18 bp, Homo sapiens
tataaacacacttaggtt

SEQ ID NO: 9493006 - DNA, 22 bp, Homo sapiens
tataaaatggcatcagctccaa

SEQ ID NO: 9493007 - DNA, 22 bp, Homo sapiens
tataaaatggcatcagctccaa

SEQ ID NO: 9493008 - DNA, 22 bp, Homo sapiens
tagttttttcaacaaatggtgc

SEQ ID NO: 9493009 - DNA, 22 bp, Homo sapiens
tataaagtgtgaactgtgagta

SEQ ID NO: 9493010 - DNA, 22 bp, Homo sapiens
tataaagttggggctgaagtaa

SEQ ID NO: 9493011 - DNA, 22 bp, Homo sapiens
tataaagttggggctgaagtaa

SEQ ID NO: 9493012 - DNA, 22 bp, Homo sapiens
tatcacagccttttggtgaggg

SEQ ID NO: 9493013 - DNA, 22 bp, Homo sapiens
tatcacaggtgtgatttacatt

SEQ ID NO: 9493014 - DNA, 22 bp, Homo sapiens
tataaagtttcgaaagatgtat

SEQ ID NO: 9493015 - DNA, 22 bp, Homo sapiens
tataaagtttcgaaagatgtat

SEQ ID NO: 9493016 - DNA, 22 bp, Homo sapiens
tataaagttggggctgaagtaa

SEQ ID NO: 9493017 - DNA, 22 bp, Homo sapiens
tataaagagtctcaaagaagtt

SEQ ID NO: 9493018 - DNA, 22 bp, Homo sapiens
tataaagagtctcaaagaagtt

SEQ ID NO: 9493019 - DNA, 22 bp, Homo sapiens
tataaagctgactcatgaaact

SEQ ID NO: 9493020 - DNA, 22 bp, Homo sapiens
tataaagtgtgaactgtgagta

SEQ ID NO: 9493021 - DNA, 22 bp, Homo sapiens
tataaagtgtgaactgtgagta

SEQ ID NO: 9493022 - DNA, 22 bp, Homo sapiens
tataaagagtctatctggtggc

SEQ ID NO: 9493023 - DNA, 22 bp, Homo sapiens
tataaagagtctcaaagaagtt

SEQ ID NO: 9493024 - DNA, 22 bp, Homo sapiens
tataaagaatccagaagagaca

SEQ ID NO: 9493025 - DNA, 22 bp, Homo sapiens
tataaagagtctcaaagaagtt

SEQ ID NO: 9493026 - DNA, 22 bp, Homo sapiens
tataaagagtctcaaagaagtt

SEQ ID NO: 9493027 - DNA, 22 bp, Homo sapiens
tataaagaagtgtaaacaggaa

SEQ ID NO: 9493028 - DNA, 22 bp, Homo sapiens
tataaagaatccagaagagaca

SEQ ID NO: 9493029 - DNA, 22 bp, Homo sapiens
tataaagaagtgtaaacaggaa

SEQ ID NO: 9493030 - DNA, 22 bp, Homo sapiens
tatcacatagtgtttagtaaat

SEQ ID NO: 9493031 - DNA, 21 bp, Homo sapiens
tatcacagtagaataggatct

SEQ ID NO: 9493032 - DNA, 21 bp, Homo sapiens
tatcacagtagaataggatct

SEQ ID NO: 9493033 - DNA, 22 bp, Homo sapiens
tatcacatttggagatttatga

SEQ ID NO: 9493034 - DNA, 22 bp, Homo sapiens
tatcacatcaatgttttaaaat

SEQ ID NO: 9493035 - DNA, 22 bp, Homo sapiens
tatcacatcaatgttttaaaat

SEQ ID NO: 9493036 - DNA, 22 bp, Homo sapiens
tatcactacacctggctaatta

SEQ ID NO: 9493037 - DNA, 22 bp, Homo sapiens
tatcagaaatgccttaaattgg

SEQ ID NO: 9493038 - DNA, 22 bp, Homo sapiens
tatcagaaatgccttaaattgg

SEQ ID NO: 9493039 - DNA, 22 bp, Homo sapiens
tatcagaagacttacagtatcg

SEQ ID NO: 9493040 - DNA, 22 bp, Homo sapiens
tatcactacacttcagctttaa

SEQ ID NO: 9493041 - DNA, 22 bp, Homo sapiens
tatcactgacctgtatcagttg

SEQ ID NO: 9493042 - DNA, 22 bp, Homo sapiens
tatcacttgcgttttggcagag

SEQ ID NO: 9493043 - DNA, 22 bp, Homo sapiens
tatcagcatatttactttcttg

SEQ ID NO: 9493044 - DNA, 22 bp, Homo sapiens
tatcatttaacagaatcattgc

SEQ ID NO: 9493045 - DNA, 22 bp, Homo sapiens
tatcagctcggaatctgttgaa

SEQ ID NO: 9493046 - DNA, 22 bp, Homo sapiens
tatcagctcggaatctgttgaa

SEQ ID NO: 9493047 - DNA, 22 bp, Homo sapiens
tatcagcaactcagagcagtct

SEQ ID NO: 9493048 - DNA, 22 bp, Homo sapiens
tatcagcaccgcggacagcatc

SEQ ID NO: 9493049 - DNA, 21 bp, Homo sapiens
tatcagagacattgagaggca

SEQ ID NO: 9493050 - DNA, 22 bp, Homo sapiens
tatcagataatcttttacaagc

SEQ ID NO: 9493051 - DNA, 22 bp, Homo sapiens
tatcagatatagcattcactgg

SEQ ID NO: 9493052 - DNA, 22 bp, Homo sapiens
tatcagatatagcattcactgg

SEQ ID NO: 9493053 - DNA, 22 bp, Homo sapiens
tatgaagtgatgttgaattttg

SEQ ID NO: 9493054 - DNA, 22 bp, Homo sapiens
tatgaagtctctgatgttgagt

SEQ ID NO: 9493055 - DNA, 22 bp, Homo sapiens
tatgaagtagagcagagatgcc

SEQ ID NO: 9493056 - DNA, 22 bp, Homo sapiens
tatgaagctgataatcactgat

SEQ ID NO: 9493057 - DNA, 22 bp, Homo sapiens
tatgaagctttgaaaagcttac

SEQ ID NO: 9493058 - DNA, 22 bp, Homo sapiens
tatgaagctctcactgtgtgtc

SEQ ID NO: 9493059 - DNA, 22 bp, Homo sapiens
tatgaagattgcggtctggaat

SEQ ID NO: 9493060 - DNA, 22 bp, Homo sapiens
tatgaatgatgcagcctggagt

SEQ ID NO: 9493061 - DNA, 22 bp, Homo sapiens
tatgaatataccacaatttagg

SEQ ID NO: 9493062 - DNA, 22 bp, Homo sapiens
tatgaatgctccagtaactttc

SEQ ID NO: 9493063 - DNA, 22 bp, Homo sapiens
tatgaatataccacaatttagg

SEQ ID NO: 9493064 - DNA, 22 bp, Homo sapiens
tatgaatataccacaatttagg

SEQ ID NO: 9493065 - DNA, 22 bp, Homo sapiens
tatgaattctcttgtgtatagt

SEQ ID NO: 9493066 - DNA, 20 bp, Homo sapiens
tatgaattctggtccctggg

SEQ ID NO: 9493067 - DNA, 22 bp, Homo sapiens
tatgaattctgttcattgatga

SEQ ID NO: 9493068 - DNA, 22 bp, Homo sapiens
tatgaattctgttcattgatga

SEQ ID NO: 9493069 - DNA, 22 bp, Homo sapiens
tatgacaaatgatatatttggc

SEQ ID NO: 9493070 - DNA, 22 bp, Homo sapiens
tatgacaaggtggagtatgagt

SEQ ID NO: 9493071 - DNA, 22 bp, Homo sapiens
tatgaaatggtagtaggaaggg

SEQ ID NO: 9493072 - DNA, 22 bp, Homo sapiens
tatgaaattgccatttttatgg

SEQ ID NO: 9493073 - DNA, 22 bp, Homo sapiens
tatgaaatgatggggaaaatag

SEQ ID NO: 9493074 - DNA, 22 bp, Homo sapiens
tatgaaatgatggggaaaatag

SEQ ID NO: 9493075 - DNA, 22 bp, Homo sapiens
tatgaaatgatggggaaaatag

SEQ ID NO: 9493076 - DNA, 22 bp, Homo sapiens
tatgaaatggtagtaggaaggg

SEQ ID NO: 9493077 - DNA, 22 bp, Homo sapiens
tatgaaatttctagttctgctt

SEQ ID NO: 9493078 - DNA, 22 bp, Homo sapiens
tatgaacacactttggaagtga

SEQ ID NO: 9493079 - DNA, 20 bp, Homo sapiens
tatgaagatatgtgaacagc

SEQ ID NO: 9493080 - DNA, 22 bp, Homo sapiens
tatgaagattgcggtctggaat

SEQ ID NO: 9493081 - DNA, 22 bp, Homo sapiens
tatgaaatttaaacacagatca

SEQ ID NO: 9493082 - DNA, 22 bp, Homo sapiens
tatgaaatttaaacacagatca

SEQ ID NO: 9493083 - DNA, 22 bp, Homo sapiens
tatgaaatttaaacacagatca

SEQ ID NO: 9493084 - DNA, 22 bp, Homo sapiens
tatgaaatttaaacacagatca

SEQ ID NO: 9493085 - DNA, 22 bp, Homo sapiens
tatgaaatttaaacacagatca

SEQ ID NO: 9493086 - DNA, 23 bp, Homo sapiens
tatctttttcaatgttggaaata

SEQ ID NO: 9493087 - DNA, 22 bp, Homo sapiens
tatcttttgagttctcaagatg

SEQ ID NO: 9493088 - DNA, 23 bp, Homo sapiens
tatctttttcaatgttggaaata

SEQ ID NO: 9493089 - DNA, 18 bp, Homo sapiens
tatcttttccagtggtat

SEQ ID NO: 9493090 - DNA, 18 bp, Homo sapiens
tatcttttccagtggtat

SEQ ID NO: 9493091 - DNA, 22 bp, Homo sapiens
tatcttttgagttctcaagatg

SEQ ID NO: 9493092 - DNA, 22 bp, Homo sapiens
tatgaaagaatctcagagcaca

SEQ ID NO: 9493093 - DNA, 22 bp, Homo sapiens
tatgaaaatttagctgaagcat

SEQ ID NO: 9493094 - DNA, 22 bp, Homo sapiens
tatgaaaatttagctgaagcat

SEQ ID NO: 9493095 - DNA, 22 bp, Homo sapiens
tatgaaaatttagctgaagcat

SEQ ID NO: 9493096 - DNA, 22 bp, Homo sapiens
tatgaaaatttagctgaagcat

SEQ ID NO: 9493097 - DNA, 22 bp, Homo sapiens
tatgaaaaggtggccaatgtag

SEQ ID NO: 9493098 - DNA, 22 bp, Homo sapiens
tatgaaaaggtggccaatgtag

SEQ ID NO: 9493099 - DNA, 22 bp, Homo sapiens
tatgaaaaggtggccaatgtag

SEQ ID NO: 9493100 - DNA, 22 bp, Homo sapiens
tatcatttgttattattagtgg

SEQ ID NO: 9493101 - DNA, 23 bp, Homo sapiens
tatcatttcagctctctgcctgg

SEQ ID NO: 9493102 - DNA, 23 bp, Homo sapiens
tatcatttcagctctctgcctgg

SEQ ID NO: 9493103 - DNA, 22 bp, Homo sapiens
tatcatttgttattattagtgg

SEQ ID NO: 9493104 - DNA, 22 bp, Homo sapiens
tatcatttagagtatttcttca

SEQ ID NO: 9493105 - DNA, 22 bp, Homo sapiens
tatcatttagagtatttcttca

SEQ ID NO: 9493106 - DNA, 23 bp, Homo sapiens
tatcatttcagctctctgcctgg

SEQ ID NO: 9493107 - DNA, 22 bp, Homo sapiens
tatcattttactgtgacatttt

SEQ ID NO: 9493108 - DNA, 22 bp, Homo sapiens
tatcattttactgtgacatttt

SEQ ID NO: 9493109 - DNA, 22 bp, Homo sapiens
tatcattttactgtgacatttt

SEQ ID NO: 9493110 - DNA, 22 bp, Homo sapiens
tatccaaagagattcatgttct

SEQ ID NO: 9493111 - DNA, 22 bp, Homo sapiens
tatccaaagagattcatgttct

SEQ ID NO: 9493112 - DNA, 22 bp, Homo sapiens
tatccaaacatatagtctctct

SEQ ID NO: 9493113 - DNA, 22 bp, Homo sapiens
tatccaaacatatagtctctct

SEQ ID NO: 9493114 - DNA, 22 bp, Homo sapiens
tatccaaacatatagtctctct

SEQ ID NO: 9493115 - DNA, 22 bp, Homo sapiens
gctctgtggcattcatgggcag

SEQ ID NO: 9493116 - DNA, 20 bp, Homo sapiens
gctctgtggtttgagtctcc

SEQ ID NO: 9493117 - DNA, 23 bp, Homo sapiens
gctgaggtacatttacaggaaga

SEQ ID NO: 9493118 - DNA, 22 bp, Homo sapiens
gctgagggtaacacttcgggat

SEQ ID NO: 9493119 - DNA, 18 bp, Homo sapiens
gctgaggtggtgtcagag

SEQ ID NO: 9493120 - DNA, 22 bp, Homo sapiens
gctgaggtgtcaccttgctggg

SEQ ID NO: 9493121 - DNA, 22 bp, Homo sapiens
gctgaggtttcaggagtggcag

SEQ ID NO: 9493122 - DNA, 22 bp, Homo sapiens
gctgaggtggtgatggttcatc

SEQ ID NO: 9493123 - DNA, 18 bp, Homo sapiens
gctgaggtggtgtcagag

SEQ ID NO: 9493124 - DNA, 22 bp, Homo sapiens
gctgagtcttgagcactgagca

SEQ ID NO: 9493125 - DNA, 22 bp, Homo sapiens
gctgaggttttctgcctgctca

SEQ ID NO: 9493126 - DNA, 20 bp, Homo sapiens
gctgaggtttcttcctatat

SEQ ID NO: 9493127 - DNA, 22 bp, Homo sapiens
gctgaggtttcaggagtggcag

SEQ ID NO: 9493128 - DNA, 22 bp, Homo sapiens
gctgcaggcgcctgcggtctct

SEQ ID NO: 9493129 - DNA, 18 bp, Homo sapiens
gctgcaggcgcctgcggt

SEQ ID NO: 9493130 - DNA, 22 bp, Homo sapiens
gctgataagaagacccatcctg

SEQ ID NO: 9493131 - DNA, 23 bp, Homo sapiens
gctgataatgcattctgtttaat

SEQ ID NO: 9493132 - DNA, 22 bp, Homo sapiens
gctgatagactgaatgttggga

SEQ ID NO: 9493133 - DNA, 22 bp, Homo sapiens
gctgcaggatgaggctctgctc

SEQ ID NO: 9493134 - DNA, 22 bp, Homo sapiens
gctgataaatagttgatgtacc

SEQ ID NO: 9493135 - DNA, 22 bp, Homo sapiens
gctgagtgaggctgtcaaaatg

SEQ ID NO: 9493136 - DNA, 22 bp, Homo sapiens
gctgagtgaggtccagagcttg

SEQ ID NO: 9493137 - DNA, 22 bp, Homo sapiens
gctgagtgaggtccagagcttg

SEQ ID NO: 9493138 - DNA, 22 bp, Homo sapiens
gctgagttgaaagcagaggata

SEQ ID NO: 9493139 - DNA, 22 bp, Homo sapiens
gctgagttgaaagcagaggata

SEQ ID NO: 9493140 - DNA, 22 bp, Homo sapiens
gctgagtgtaatgatggcagag

SEQ ID NO: 9493141 - DNA, 22 bp, Homo sapiens
gctgagtgtaatgatggcagag

SEQ ID NO: 9493142 - DNA, 17 bp, Homo sapiens
gctgagtgcagggagtc

SEQ ID NO: 9493143 - DNA, 22 bp, Homo sapiens
gctgagtggagcagtcagcgct

SEQ ID NO: 9493144 - DNA, 22 bp, Homo sapiens
gctgcaggctgtggcaggggag

SEQ ID NO: 9493145 - DNA, 22 bp, Homo sapiens
gctgcaggctgtggcaggggag

SEQ ID NO: 9493146 - DNA, 22 bp, Homo sapiens
gctgcaggctgtggcaggggag

SEQ ID NO: 9493147 - DNA, 22 bp, Homo sapiens
gctgcaggctctgcaggaattg

SEQ ID NO: 9493148 - DNA, 22 bp, Homo sapiens
gctgcaggctctgcaggaattg

SEQ ID NO: 9493149 - DNA, 22 bp, Homo sapiens
gctgcaggcggccgtggtggcg

SEQ ID NO: 9493150 - DNA, 22 bp, Homo sapiens
gctgcaggcggccgtggtggcg

SEQ ID NO: 9493151 - DNA, 22 bp, Homo sapiens
gctgcaggcggccgtggtggcg

SEQ ID NO: 9493152 - DNA, 22 bp, Homo sapiens
gctgcagggagctggaaggctc

SEQ ID NO: 9493153 - DNA, 21 bp, Homo sapiens
gctgcagggcccagggcaccc

SEQ ID NO: 9493154 - DNA, 21 bp, Homo sapiens
gctgcagggcccagggcaccc

SEQ ID NO: 9493155 - DNA, 22 bp, Homo sapiens
gctgcagggagctggaaggctc

SEQ ID NO: 9493156 - DNA, 22 bp, Homo sapiens
gctgcagggagctggaaggctc

SEQ ID NO: 9493157 - DNA, 22 bp, Homo sapiens
gctgcagggctctcacaggggg

SEQ ID NO: 9493158 - DNA, 22 bp, Homo sapiens
gctgcagggctctcacaggggg

SEQ ID NO: 9493159 - DNA, 22 bp, Homo sapiens
gctgcctccaatctgtgccccg

SEQ ID NO: 9493160 - DNA, 22 bp, Homo sapiens
gctgcctctcctgagttgacag

SEQ ID NO: 9493161 - DNA, 22 bp, Homo sapiens
gctgcctctgcacagctcactc

SEQ ID NO: 9493162 - DNA, 22 bp, Homo sapiens
gctgcctctgcgactctgggcg

SEQ ID NO: 9493163 - DNA, 22 bp, Homo sapiens
gctgcctctgcgactctgggcg

SEQ ID NO: 9493164 - DNA, 22 bp, Homo sapiens
gctgcctcctgagatttgggca

SEQ ID NO: 9493165 - DNA, 22 bp, Homo sapiens
gctgcctcctgaaagcgctctg

SEQ ID NO: 9493166 - DNA, 23 bp, Homo sapiens
gctgcctcctacaaaagcccagc

SEQ ID NO: 9493167 - DNA, 22 bp, Homo sapiens
gctgcctcctgaaagcgctctg

SEQ ID NO: 9493168 - DNA, 22 bp, Homo sapiens
gctgcctccgccggctccacag

SEQ ID NO: 9493169 - DNA, 22 bp, Homo sapiens
gctgcctccgccggctccacag

SEQ ID NO: 9493170 - DNA, 23 bp, Homo sapiens
gctgcctcctacaaaagcccagc

SEQ ID NO: 9493171 - DNA, 22 bp, Homo sapiens
gctgcctcccccatggctggaa

SEQ ID NO: 9493172 - DNA, 22 bp, Homo sapiens
gctgcctcccccatggctggaa

SEQ ID NO: 9493173 - DNA, 22 bp, Homo sapiens
gctgcctcccccatggctggaa

SEQ ID NO: 9493174 - DNA, 22 bp, Homo sapiens
gctgcctcccagagccctgcag

SEQ ID NO: 9493175 - DNA, 22 bp, Homo sapiens
gctgcctcccagagccctgcag

SEQ ID NO: 9493176 - DNA, 22 bp, Homo sapiens
gctgcctccactggctcccagt

SEQ ID NO: 9493177 - DNA, 22 bp, Homo sapiens
gctgcctccaatctgtgccccg

SEQ ID NO: 9493178 - DNA, 22 bp, Homo sapiens
gctgcctccactggctcccagt

SEQ ID NO: 9493179 - DNA, 22 bp, Homo sapiens
gctggagtgcagttgcacagtc

SEQ ID NO: 9493180 - DNA, 22 bp, Homo sapiens
gctggagtgatgcctgtgtctc

SEQ ID NO: 9493181 - DNA, 22 bp, Homo sapiens
gctggagtgctgaggtgcagtg

SEQ ID NO: 9493182 - DNA, 22 bp, Homo sapiens
gctggagtgctgaggtgcagtg

SEQ ID NO: 9493183 - DNA, 22 bp, Homo sapiens
gctggagttaggtgggcttgaa

SEQ ID NO: 9493184 - DNA, 22 bp, Homo sapiens
gctggagttagaactagcctgg

SEQ ID NO: 9493185 - DNA, 22 bp, Homo sapiens
gctggagtgctggagtgcagtg

SEQ ID NO: 9493186 - DNA, 22 bp, Homo sapiens
gctggagtgctggagtgcagtg

SEQ ID NO: 9493187 - DNA, 22 bp, Homo sapiens
gctggagtcttgaaagtggact

SEQ ID NO: 9493188 - DNA, 22 bp, Homo sapiens
gctggagtgagtatgtgtagtc

SEQ ID NO: 9493189 - DNA, 22 bp, Homo sapiens
gctggagtctggaggtgtgcca

SEQ ID NO: 9493190 - DNA, 22 bp, Homo sapiens
gctggaggtttcacctgagttt

SEQ ID NO: 9493191 - DNA, 22 bp, Homo sapiens
gctggaggggtaataggatggg

SEQ ID NO: 9493192 - DNA, 22 bp, Homo sapiens
gctggaggtagggaggtcctgt

SEQ ID NO: 9493193 - DNA, 22 bp, Homo sapiens
gctggaggtagggaggtcctgt

SEQ ID NO: 9493194 - DNA, 22 bp, Homo sapiens
gctggaggtagggaggtcctgt

SEQ ID NO: 9493195 - DNA, 22 bp, Homo sapiens
gctggaggtggtgagaaaaggt

SEQ ID NO: 9493196 - DNA, 22 bp, Homo sapiens
gctggaggtttcacctgagttt

SEQ ID NO: 9493197 - DNA, 22 bp, Homo sapiens
gctggaggtggtgagaaaaggt

SEQ ID NO: 9493198 - DNA, 22 bp, Homo sapiens
gctggagttggcaaggcatgta

SEQ ID NO: 9493199 - DNA, 22 bp, Homo sapiens
gctggcagggtggttgagagag

SEQ ID NO: 9493200 - DNA, 22 bp, Homo sapiens
gctggcaggtaaagccccgggg

SEQ ID NO: 9493201 - DNA, 22 bp, Homo sapiens
gctggcagggttctcactgaaa

SEQ ID NO: 9493202 - DNA, 22 bp, Homo sapiens
gctggcaggtaaagccccgggg

SEQ ID NO: 9493203 - DNA, 22 bp, Homo sapiens
gctggcaggtaaagccccgggg

SEQ ID NO: 9493204 - DNA, 22 bp, Homo sapiens
gctggcaggtccaagatagagc

SEQ ID NO: 9493205 - DNA, 22 bp, Homo sapiens
gctggcagtcccatcagctggg

SEQ ID NO: 9493206 - DNA, 22 bp, Homo sapiens
gctggcaggtccaagatagagc

SEQ ID NO: 9493207 - DNA, 22 bp, Homo sapiens
gctggcagtcccatcagctggg

SEQ ID NO: 9493208 - DNA, 22 bp, Homo sapiens
gctggcagtaaagggtttggca

SEQ ID NO: 9493209 - DNA, 22 bp, Homo sapiens
gctggccaaagtgtacctggag

SEQ ID NO: 9493210 - DNA, 22 bp, Homo sapiens
gctggcagtttcctcaccgagg

SEQ ID NO: 9493211 - DNA, 22 bp, Homo sapiens
gctggcagtgtattgttagctg

SEQ ID NO: 9493212 - DNA, 22 bp, Homo sapiens
gctggcagtgtgaatgacaagc

SEQ ID NO: 9493213 - DNA, 22 bp, Homo sapiens
gctggcagtgtgaatgacaagc

SEQ ID NO: 9493214 - DNA, 22 bp, Homo sapiens
gctggcagtttcctcaccgagg

SEQ ID NO: 9493215 - DNA, 22 bp, Homo sapiens
gctggcagtttcctcaccgagg

SEQ ID NO: 9493216 - DNA, 22 bp, Homo sapiens
gctgctgggtccctctgtgcca

SEQ ID NO: 9493217 - DNA, 22 bp, Homo sapiens
gctgctggggtggagaaacgct

SEQ ID NO: 9493218 - DNA, 22 bp, Homo sapiens
gctgctggtcctcagagctcat

SEQ ID NO: 9493219 - DNA, 22 bp, Homo sapiens
gctgctggtcctcagagctcat

SEQ ID NO: 9493220 - DNA, 22 bp, Homo sapiens
gctgctgtcacggtgctaaggg

SEQ ID NO: 9493221 - DNA, 22 bp, Homo sapiens
gctgctgtcagcaggccttgtt

SEQ ID NO: 9493222 - DNA, 22 bp, Homo sapiens
gctgctgtcagcaggccttgtt

SEQ ID NO: 9493223 - DNA, 18 bp, Homo sapiens
gctgctggtggagggagc

SEQ ID NO: 9493224 - DNA, 22 bp, Homo sapiens
gctgctgtaatgtgttaagtca

SEQ ID NO: 9493225 - DNA, 18 bp, Homo sapiens
gctgctggtggagggagc

SEQ ID NO: 9493226 - DNA, 18 bp, Homo sapiens
gctgctggtggagggagc

SEQ ID NO: 9493227 - DNA, 22 bp, Homo sapiens
gctgctgtccttagggagttct

SEQ ID NO: 9493228 - DNA, 22 bp, Homo sapiens
gctgctgtcagtggtggcagtt

SEQ ID NO: 9493229 - DNA, 22 bp, Homo sapiens
gctgctgtcagtggtggcagtt

SEQ ID NO: 9493230 - DNA, 22 bp, Homo sapiens
gctgctgtccttcaagtctgcg

SEQ ID NO: 9493231 - DNA, 22 bp, Homo sapiens
gctggagctgcagcctgggcct

SEQ ID NO: 9493232 - DNA, 22 bp, Homo sapiens
gctggaggggtaataggatggg

SEQ ID NO: 9493233 - DNA, 22 bp, Homo sapiens
gctggaggggtaataggatggg

SEQ ID NO: 9493234 - DNA, 22 bp, Homo sapiens
gctggaggggtaataggatggg

SEQ ID NO: 9493235 - DNA, 22 bp, Homo sapiens
gctgctgtcagtggtggcagtt

SEQ ID NO: 9493236 - DNA, 22 bp, Homo sapiens
gctggaggggtaataggatggg

SEQ ID NO: 9493237 - DNA, 22 bp, Homo sapiens
gctggagcttgagaggacaggg

SEQ ID NO: 9493238 - DNA, 19 bp, Homo sapiens
gctgctggctctggctgga

SEQ ID NO: 9493239 - DNA, 19 bp, Homo sapiens
gctgctggctctggctgga

SEQ ID NO: 9493240 - DNA, 22 bp, Homo sapiens
gctgctgggaatgaacagtgtt

SEQ ID NO: 9493241 - DNA, 22 bp, Homo sapiens
gctgctgggcaccccctgagct

SEQ ID NO: 9493242 - DNA, 22 bp, Homo sapiens
gctgctgggcaccccctgagct

SEQ ID NO: 9493243 - DNA, 22 bp, Homo sapiens
gctgctgggatcctgggtctca

SEQ ID NO: 9493244 - DNA, 22 bp, Homo sapiens
gctgctgggcaccccctgagct

SEQ ID NO: 9493245 - DNA, 22 bp, Homo sapiens
gctgctggggccttccctcggg

SEQ ID NO: 9493246 - DNA, 22 bp, Homo sapiens
gctgcctctgtagctttggacc

SEQ ID NO: 9493247 - DNA, 22 bp, Homo sapiens
gctgcctctgtagctttggacc

SEQ ID NO: 9493248 - DNA, 22 bp, Homo sapiens
gctgcctctgtagctttggacc

SEQ ID NO: 9493249 - DNA, 22 bp, Homo sapiens
gctgcctgaagtgtctacactg

SEQ ID NO: 9493250 - DNA, 22 bp, Homo sapiens
gctgcctgaaatgttgcctagc

SEQ ID NO: 9493251 - DNA, 22 bp, Homo sapiens
gctgcctgaaatgttgcctagc

SEQ ID NO: 9493252 - DNA, 23 bp, Homo sapiens
gctgcctctgttggtcttcagtt

SEQ ID NO: 9493253 - DNA, 22 bp, Homo sapiens
gctgctggaagcatgcgatgaa

SEQ ID NO: 9493254 - DNA, 22 bp, Homo sapiens
gctgctggaagcatgcgatgaa

SEQ ID NO: 9493255 - DNA, 22 bp, Homo sapiens
gctgctggcgctgggcgtccgg

SEQ ID NO: 9493256 - DNA, 22 bp, Homo sapiens
gctgctggcgctgggcgtccgg

SEQ ID NO: 9493257 - DNA, 19 bp, Homo sapiens
gctgctggctctggctgga

SEQ ID NO: 9493258 - DNA, 22 bp, Homo sapiens
gcctggagttcagccaagtccc

SEQ ID NO: 9493259 - DNA, 20 bp, Homo sapiens
gcctggcacccggggctggc

SEQ ID NO: 9493260 - DNA, 22 bp, Homo sapiens
gcctggagtggtcctgctgccc

SEQ ID NO: 9493261 - DNA, 22 bp, Homo sapiens
gctagaaactgtttaatctctt

SEQ ID NO: 9493262 - DNA, 22 bp, Homo sapiens
gcctggcagattgacatagcca

SEQ ID NO: 9493263 - DNA, 22 bp, Homo sapiens
gctaggcttcaaaatctccctg

SEQ ID NO: 9493264 - DNA, 20 bp, Homo sapiens
gctaggctgtgtcctgccca

SEQ ID NO: 9493265 - DNA, 22 bp, Homo sapiens
gctaggcttcaaaatctccctg

SEQ ID NO: 9493266 - DNA, 22 bp, Homo sapiens
gctagggactagggaaggagca

SEQ ID NO: 9493267 - DNA, 22 bp, Homo sapiens
gctagggagacttgtgtcatca

SEQ ID NO: 9493268 - DNA, 22 bp, Homo sapiens
gctagggtggctaataggagag

SEQ ID NO: 9493269 - DNA, 19 bp, Homo sapiens
gctagggttggtggcgtgc

SEQ ID NO: 9493270 - DNA, 22 bp, Homo sapiens
gctaggctcttccatcagggca

SEQ ID NO: 9493271 - DNA, 22 bp, Homo sapiens
gctaggctgaatatggtgctta

SEQ ID NO: 9493272 - DNA, 19 bp, Homo sapiens
gctaggctggccttgaggg

SEQ ID NO: 9493273 - DNA, 19 bp, Homo sapiens
gctaggctggccttgaggg

SEQ ID NO: 9493274 - DNA, 22 bp, Homo sapiens
gctaggcttcaaaatctccctg

SEQ ID NO: 9493275 - DNA, 22 bp, Homo sapiens
gctaggctgtgtttcagaccct

SEQ ID NO: 9493276 - DNA, 22 bp, Homo sapiens
gctaggctcggaagcagcaggg

SEQ ID NO: 9493277 - DNA, 22 bp, Homo sapiens
gctaggagtgggatggaagtcg

SEQ ID NO: 9493278 - DNA, 20 bp, Homo sapiens
gctaggaaggggaaaaagtg

SEQ ID NO: 9493279 - DNA, 22 bp, Homo sapiens
gctaggaagctggggagaagtc

SEQ ID NO: 9493280 - DNA, 22 bp, Homo sapiens
gctagctgggtttcactgtgga

SEQ ID NO: 9493281 - DNA, 22 bp, Homo sapiens
gctagctgggtttcactgtgga

SEQ ID NO: 9493282 - DNA, 17 bp, Homo sapiens
gctaggagagggaggag

SEQ ID NO: 9493283 - DNA, 17 bp, Homo sapiens
gctaggagagggaggag

SEQ ID NO: 9493284 - DNA, 22 bp, Homo sapiens
gctagcctgcagtggctatggt

SEQ ID NO: 9493285 - DNA, 22 bp, Homo sapiens
gctagcctgcagtggctatggt

SEQ ID NO: 9493286 - DNA, 22 bp, Homo sapiens
gctagcaaatgtcatttggaag

SEQ ID NO: 9493287 - DNA, 22 bp, Homo sapiens
gctagcaaatgtcatttggaag

SEQ ID NO: 9493288 - DNA, 22 bp, Homo sapiens
gctagagaccagaggccttgaa

SEQ ID NO: 9493289 - DNA, 22 bp, Homo sapiens
gctagaaatcgacttcagaatt

SEQ ID NO: 9493290 - DNA, 22 bp, Homo sapiens
gctagaaatcgacttcagaatt

SEQ ID NO: 9493291 - DNA, 22 bp, Homo sapiens
gctcagggccatggaccagcag

SEQ ID NO: 9493292 - DNA, 22 bp, Homo sapiens
gctcagggccatggaccagcag

SEQ ID NO: 9493293 - DNA, 22 bp, Homo sapiens
gctcagggagtttcacagtgta

SEQ ID NO: 9493294 - DNA, 22 bp, Homo sapiens
gctcagggagtttcacagtgta

SEQ ID NO: 9493295 - DNA, 22 bp, Homo sapiens
gctcagggagagagggcagccg

SEQ ID NO: 9493296 - DNA, 22 bp, Homo sapiens
gctcagggagagagggcagccg

SEQ ID NO: 9493297 - DNA, 22 bp, Homo sapiens
gctcagggagagagggcagccg

SEQ ID NO: 9493298 - DNA, 22 bp, Homo sapiens
gctcagggagtttcacagtgta

SEQ ID NO: 9493299 - DNA, 22 bp, Homo sapiens
gctcagggcctggctgcggact

SEQ ID NO: 9493300 - DNA, 22 bp, Homo sapiens
gctcagggccatggaccagcag

SEQ ID NO: 9493301 - DNA, 22 bp, Homo sapiens
gctcagggcctggctgcggact

SEQ ID NO: 9493302 - DNA, 22 bp, Homo sapiens
gctcagggcgcgagggacgtgg

SEQ ID NO: 9493303 - DNA, 22 bp, Homo sapiens
gctatacaagtgtagaatagag

SEQ ID NO: 9493304 - DNA, 22 bp, Homo sapiens
gctatacacatttcttggtagt

SEQ ID NO: 9493305 - DNA, 22 bp, Homo sapiens
gctagtgtttgccagcgtagcc

SEQ ID NO: 9493306 - DNA, 22 bp, Homo sapiens
gctagtgcagggaaatctttgg

SEQ ID NO: 9493307 - DNA, 22 bp, Homo sapiens
gctagtccacagccatccaggc

SEQ ID NO: 9493308 - DNA, 22 bp, Homo sapiens
gctaggttggggaagttctcct

SEQ ID NO: 9493309 - DNA, 22 bp, Homo sapiens
gctaggttggggaagttctcct

SEQ ID NO: 9493310 - DNA, 22 bp, Homo sapiens
gctagggatctgatttgctgtt

SEQ ID NO: 9493311 - DNA, 22 bp, Homo sapiens
gctcagggaaggccacgtgaga

SEQ ID NO: 9493312 - DNA, 22 bp, Homo sapiens
gctcagggaatgagaagatgtt

SEQ ID NO: 9493313 - DNA, 22 bp, Homo sapiens
gctcagggagagagggcagccg

SEQ ID NO: 9493314 - DNA, 22 bp, Homo sapiens
gctcagggagagagggcagccg

SEQ ID NO: 9493315 - DNA, 22 bp, Homo sapiens
gctcagggagagagggcagccg

SEQ ID NO: 9493316 - DNA, 22 bp, Homo sapiens
gctcccagactgaccagaggtg

SEQ ID NO: 9493317 - DNA, 22 bp, Homo sapiens
gctcccagactgaccagaggtg

SEQ ID NO: 9493318 - DNA, 22 bp, Homo sapiens
gctcccagcaattgaggcagcc

SEQ ID NO: 9493319 - DNA, 22 bp, Homo sapiens
gctcccagcaattgaggcagcc

SEQ ID NO: 9493320 - DNA, 22 bp, Homo sapiens
gctcccagatttcagccttgtg

SEQ ID NO: 9493321 - DNA, 22 bp, Homo sapiens
gctcccagatttcagccttgtg

SEQ ID NO: 9493322 - DNA, 22 bp, Homo sapiens
gctcccagcaattgaggcagcc

SEQ ID NO: 9493323 - DNA, 22 bp, Homo sapiens
gctcccagatttcagccttgtg

SEQ ID NO: 9493324 - DNA, 22 bp, Homo sapiens
gctcagtttcttctattgtatt

SEQ ID NO: 9493325 - DNA, 23 bp, Homo sapiens
gctcatcaggcttagagtcaagg

SEQ ID NO: 9493326 - DNA, 23 bp, Homo sapiens
gctcatcaggcttagagtcaagg

SEQ ID NO: 9493327 - DNA, 22 bp, Homo sapiens
gctcagtgtgttcaagggctca

SEQ ID NO: 9493328 - DNA, 22 bp, Homo sapiens
gctcagggcgcgagggacgtgg

SEQ ID NO: 9493329 - DNA, 22 bp, Homo sapiens
gctcagtgcatcattccaggct

SEQ ID NO: 9493330 - DNA, 22 bp, Homo sapiens
gctcagtgcagcctttctgtat

SEQ ID NO: 9493331 - DNA, 19 bp, Homo sapiens
gctcagtgatgccagacca

SEQ ID NO: 9493332 - DNA, 22 bp, Homo sapiens
gctctctggaaggtatcattat

SEQ ID NO: 9493333 - DNA, 22 bp, Homo sapiens
gctctctgcctttctcaatgac

SEQ ID NO: 9493334 - DNA, 22 bp, Homo sapiens
gctctctggaaggtatcattat

SEQ ID NO: 9493335 - DNA, 22 bp, Homo sapiens
gctctctgcctttctcaatgac

SEQ ID NO: 9493336 - DNA, 22 bp, Homo sapiens
gctctctggaggccatggacag

SEQ ID NO: 9493337 - DNA, 22 bp, Homo sapiens
gctctctgcctttctcaatgac

SEQ ID NO: 9493338 - DNA, 22 bp, Homo sapiens
gctctctgccatatgaggatac

SEQ ID NO: 9493339 - DNA, 22 bp, Homo sapiens
gctctctggctagtccatcggg

SEQ ID NO: 9493340 - DNA, 22 bp, Homo sapiens
gctctctgggtggtgggcaaca

SEQ ID NO: 9493341 - DNA, 22 bp, Homo sapiens
gctctctgggcgggagctaaga

SEQ ID NO: 9493342 - DNA, 22 bp, Homo sapiens
gctctctggttccagtcaggaa

SEQ ID NO: 9493343 - DNA, 22 bp, Homo sapiens
gctctggggttggaaagtgatc

SEQ ID NO: 9493344 - DNA, 22 bp, Homo sapiens
gctctcttgacagcttgctgtt

SEQ ID NO: 9493345 - DNA, 22 bp, Homo sapiens
gctctctgtcgttatgcttcat

SEQ ID NO: 9493346 - DNA, 22 bp, Homo sapiens
gctctgtatgagggtgagagat

SEQ ID NO: 9493347 - DNA, 22 bp, Homo sapiens
gctctggttctcttagagtagt

SEQ ID NO: 9493348 - DNA, 22 bp, Homo sapiens
gctctggtttcctgttcactca

SEQ ID NO: 9493349 - DNA, 22 bp, Homo sapiens
gctctggtttcctgttcactca

SEQ ID NO: 9493350 - DNA, 22 bp, Homo sapiens
gctctggttctcttagagtagt

SEQ ID NO: 9493351 - DNA, 22 bp, Homo sapiens
gctctggttttagcctttcagg

SEQ ID NO: 9493352 - DNA, 22 bp, Homo sapiens
gctctggtttcctgttcactca

SEQ ID NO: 9493353 - DNA, 22 bp, Homo sapiens
gctctggttttagcctttcagg

SEQ ID NO: 9493354 - DNA, 22 bp, Homo sapiens
gctctgggtagccactgcctgg

SEQ ID NO: 9493355 - DNA, 22 bp, Homo sapiens
gctctgggtagccactgcctgg

SEQ ID NO: 9493356 - DNA, 22 bp, Homo sapiens
gctctgggtagccactgcctgg

SEQ ID NO: 9493357 - DNA, 22 bp, Homo sapiens
gctctgggtagccactgcctgg

SEQ ID NO: 9493358 - DNA, 22 bp, Homo sapiens
gctctgtgcagttcagggacac

SEQ ID NO: 9493359 - DNA, 22 bp, Homo sapiens
gctctgtgccacatgcagtgtt

SEQ ID NO: 9493360 - DNA, 19 bp, Homo sapiens
gctctgtgatgctgagggg

SEQ ID NO: 9493361 - DNA, 22 bp, Homo sapiens
gctctgtgccagggctgggcca

SEQ ID NO: 9493362 - DNA, 22 bp, Homo sapiens
gctctgtggcaggaggtcttgt

SEQ ID NO: 9493363 - DNA, 20 bp, Homo sapiens
gctctgtgctggcggaggct

SEQ ID NO: 9493364 - DNA, 20 bp, Homo sapiens
gctctgtgctggcggaggct

SEQ ID NO: 9493365 - DNA, 22 bp, Homo sapiens
gctctgtgaagggtgttgctca

SEQ ID NO: 9493366 - DNA, 22 bp, Homo sapiens
gctctgtgagccacttgatgta

SEQ ID NO: 9493367 - DNA, 19 bp, Homo sapiens
gctctgtgatgctgagggg

SEQ ID NO: 9493368 - DNA, 22 bp, Homo sapiens
gctctgtgagtattggccctgg

SEQ ID NO: 9493369 - DNA, 22 bp, Homo sapiens
gctctgtccagcgtgcacagaa

SEQ ID NO: 9493370 - DNA, 21 bp, Homo sapiens
gctctgtccctgctgtgtgtc

SEQ ID NO: 9493371 - DNA, 20 bp, Homo sapiens
gctctgtctggcctactttt

SEQ ID NO: 9493372 - DNA, 22 bp, Homo sapiens
gctctgtcttcagcacacagta

SEQ ID NO: 9493373 - DNA, 21 bp, Homo sapiens
gctctgtccctgctgtgtgtc

SEQ ID NO: 9493374 - DNA, 22 bp, Homo sapiens
gctctctcgtgaacaggtggtt

SEQ ID NO: 9493375 - DNA, 22 bp, Homo sapiens
gctctctccctaggcaagtgag

SEQ ID NO: 9493376 - DNA, 22 bp, Homo sapiens
gctctctccctaggcaagtgag

SEQ ID NO: 9493377 - DNA, 22 bp, Homo sapiens
gctctcctgtgcagatgctgct

SEQ ID NO: 9493378 - DNA, 21 bp, Homo sapiens
gctctctgcatggtggctcag

SEQ ID NO: 9493379 - DNA, 22 bp, Homo sapiens
gctctctgcagcctccttggag

SEQ ID NO: 9493380 - DNA, 22 bp, Homo sapiens
gctctctgccatatgaggatac

SEQ ID NO: 9493381 - DNA, 21 bp, Homo sapiens
gctctctgcatggtggctcag

SEQ ID NO: 9493382 - DNA, 22 bp, Homo sapiens
gctctctgcagcctccttggag

SEQ ID NO: 9493383 - DNA, 22 bp, Homo sapiens
gctctctgaggtgctggcagag

SEQ ID NO: 9493384 - DNA, 22 bp, Homo sapiens
gctctctgaggtgctggcagag

SEQ ID NO: 9493385 - DNA, 22 bp, Homo sapiens
gctctctgaggtgctggcagag

SEQ ID NO: 9493386 - DNA, 22 bp, Homo sapiens
gctctctgaggtgctggcagag

SEQ ID NO: 9493387 - DNA, 22 bp, Homo sapiens
gctccctctgctcaggcacttg

SEQ ID NO: 9493388 - DNA, 22 bp, Homo sapiens
gctccctctgctcaggcacttg

SEQ ID NO: 9493389 - DNA, 22 bp, Homo sapiens
gctccctctgctcaggcacttg

SEQ ID NO: 9493390 - DNA, 22 bp, Homo sapiens
gctccctcccaccagcctgcag

SEQ ID NO: 9493391 - DNA, 22 bp, Homo sapiens
gctctccaggggctcccaggat

SEQ ID NO: 9493392 - DNA, 21 bp, Homo sapiens
gctctccagggccagcccagg

SEQ ID NO: 9493393 - DNA, 21 bp, Homo sapiens
gctctccagggccagcccagg

SEQ ID NO: 9493394 - DNA, 22 bp, Homo sapiens
gctctccaggtccaagaatcca

SEQ ID NO: 9493395 - DNA, 22 bp, Homo sapiens
gctctcccgcagcctggtgggc

SEQ ID NO: 9493396 - DNA, 22 bp, Homo sapiens
gctctcccgcagcctggtgggc

SEQ ID NO: 9493397 - DNA, 22 bp, Homo sapiens
gctctccaggtctcatgcactg

SEQ ID NO: 9493398 - DNA, 22 bp, Homo sapiens
gctctccaggtctcatgcactg

SEQ ID NO: 9493399 - DNA, 19 bp, Homo sapiens
gctctccctctcagttgag

SEQ ID NO: 9493400 - DNA, 19 bp, Homo sapiens
gctctccctctcagttgag

SEQ ID NO: 9493401 - DNA, 19 bp, Homo sapiens
gctctccctctcagttgag

SEQ ID NO: 9493402 - DNA, 19 bp, Homo sapiens
gctctccctctcagttgag

SEQ ID NO: 9493403 - DNA, 22 bp, Homo sapiens
gctctcctgtgcagatgctgct

SEQ ID NO: 9493404 - DNA, 22 bp, Homo sapiens
gctctcctgtgcagatgctgct

SEQ ID NO: 9493405 - DNA, 19 bp, Homo sapiens
gctctccctctcagttgag

SEQ ID NO: 9493406 - DNA, 22 bp, Homo sapiens
gctcccagcattgctgctgaat

SEQ ID NO: 9493407 - DNA, 22 bp, Homo sapiens
gctcccagcattgctgctgaat

SEQ ID NO: 9493408 - DNA, 22 bp, Homo sapiens
gctcccagcattgctgctgaat

SEQ ID NO: 9493409 - DNA, 20 bp, Homo sapiens
gctcccagcctgcagtcccc

SEQ ID NO: 9493410 - DNA, 22 bp, Homo sapiens
gctcccaggatgaggagccagg

SEQ ID NO: 9493411 - DNA, 22 bp, Homo sapiens
gctcccaggaagagaagggcca

SEQ ID NO: 9493412 - DNA, 22 bp, Homo sapiens
gctcccagctggagcctcaaca

SEQ ID NO: 9493413 - DNA, 22 bp, Homo sapiens
gctcccagctggagcctcaaca

SEQ ID NO: 9493414 - DNA, 22 bp, Homo sapiens
gctccctccatgaggcagaccg

SEQ ID NO: 9493415 - DNA, 22 bp, Homo sapiens
gctccccttggtcctcctggga

SEQ ID NO: 9493416 - DNA, 22 bp, Homo sapiens
gctccctcccaccagcctgcag

SEQ ID NO: 9493417 - DNA, 22 bp, Homo sapiens
gctccctcccaccagcctgcag

SEQ ID NO: 9493418 - DNA, 22 bp, Homo sapiens
gctccccattgatctgcaggct

SEQ ID NO: 9493419 - DNA, 22 bp, Homo sapiens
gctccccattgatctgcaggct

SEQ ID NO: 9493420 - DNA, 20 bp, Homo sapiens
gctccccttctctgggcctc

SEQ ID NO: 9493421 - DNA, 22 bp, Homo sapiens
gctccccattgatctgcaggct

SEQ ID NO: 9493422 - DNA, 22 bp, Homo sapiens
gctccccaggctggtcccctcg

SEQ ID NO: 9493423 - DNA, 22 bp, Homo sapiens
ggaaggctttctgttctgtgac

SEQ ID NO: 9493424 - DNA, 22 bp, Homo sapiens
ggaaggctgtgcagtgtttgca

SEQ ID NO: 9493425 - DNA, 22 bp, Homo sapiens
ggaaggctctgttccttgactt

SEQ ID NO: 9493426 - DNA, 19 bp, Homo sapiens
ggaaggcagaggggctgtg

SEQ ID NO: 9493427 - DNA, 22 bp, Homo sapiens
ggaaggcagaggtgtcgtgggg

SEQ ID NO: 9493428 - DNA, 22 bp, Homo sapiens
ggaaggcagtgaaggggctgat

SEQ ID NO: 9493429 - DNA, 22 bp, Homo sapiens
ggaaggcagtgaaggggctgat

SEQ ID NO: 9493430 - DNA, 22 bp, Homo sapiens
ggacagagggttgacagagtat

SEQ ID NO: 9493431 - DNA, 22 bp, Homo sapiens
ggacagagggttgacagagtat

SEQ ID NO: 9493432 - DNA, 22 bp, Homo sapiens
ggacagagggttgacagagtat

SEQ ID NO: 9493433 - DNA, 22 bp, Homo sapiens
ggacagagggttgacagagtat

SEQ ID NO: 9493434 - DNA, 22 bp, Homo sapiens
ggacaggagtgaggcgggttcc

SEQ ID NO: 9493435 - DNA, 18 bp, Homo sapiens
ggacaggagacatgggtg

SEQ ID NO: 9493436 - DNA, 18 bp, Homo sapiens
ggacaggagacatgggtg

SEQ ID NO: 9493437 - DNA, 22 bp, Homo sapiens
ggacaggataagagacactgcc

SEQ ID NO: 9493438 - DNA, 22 bp, Homo sapiens
ggacaggataagagacactgcc

SEQ ID NO: 9493439 - DNA, 22 bp, Homo sapiens
ggacaggatgctgaagatgaag

SEQ ID NO: 9493440 - DNA, 22 bp, Homo sapiens
ggacaggatgctgaagatgaag

SEQ ID NO: 9493441 - DNA, 22 bp, Homo sapiens
ggacaggatgctgaagatgaag

SEQ ID NO: 9493442 - DNA, 19 bp, Homo sapiens
ggaaggagagaaatgcatg

SEQ ID NO: 9493443 - DNA, 22 bp, Homo sapiens
ggaaggagcatttgccagttta

SEQ ID NO: 9493444 - DNA, 22 bp, Homo sapiens
ggaaggagcatttgccagttta

SEQ ID NO: 9493445 - DNA, 19 bp, Homo sapiens
ggaaggagagaaatgcatg

SEQ ID NO: 9493446 - DNA, 19 bp, Homo sapiens
ggaaggagagaaatgcatg

SEQ ID NO: 9493447 - DNA, 22 bp, Homo sapiens
ggaaggaattccaagactaaag

SEQ ID NO: 9493448 - DNA, 22 bp, Homo sapiens
ggaaggaattccaagactaaag

SEQ ID NO: 9493449 - DNA, 22 bp, Homo sapiens
ggaaggaattccaagactaaag

SEQ ID NO: 9493450 - DNA, 22 bp, Homo sapiens
ggaaggaattccaagactaaag

SEQ ID NO: 9493451 - DNA, 22 bp, Homo sapiens
ggaaggaattccaagactaaag

SEQ ID NO: 9493452 - DNA, 22 bp, Homo sapiens
ggaaggaagtgcagactttaaa

SEQ ID NO: 9493453 - DNA, 22 bp, Homo sapiens
ggaaaaatgacacatatctcaa

SEQ ID NO: 9493454 - DNA, 22 bp, Homo sapiens
ggaaaaatgacacatatctcaa

SEQ ID NO: 9493455 - DNA, 22 bp, Homo sapiens
ggaaggaagtgcagactttaaa

SEQ ID NO: 9493456 - DNA, 22 bp, Homo sapiens
ggaaaaatgacacatatctcaa

SEQ ID NO: 9493457 - DNA, 22 bp, Homo sapiens
ggaaaaacagtctttattattt

SEQ ID NO: 9493458 - DNA, 22 bp, Homo sapiens
ggaaaaatagagtatactttaa

SEQ ID NO: 9493459 - DNA, 22 bp, Homo sapiens
ggaaaaacagtctttattattt

SEQ ID NO: 9493460 - DNA, 22 bp, Homo sapiens
ggaaggaggggcaaagcagttc

SEQ ID NO: 9493461 - DNA, 22 bp, Homo sapiens
ggaaggagggcggcaatgatga

SEQ ID NO: 9493462 - DNA, 22 bp, Homo sapiens
ggaaggaggggcaaagcagttc

SEQ ID NO: 9493463 - DNA, 22 bp, Homo sapiens
ggaaggaggatgctctggcctt

SEQ ID NO: 9493464 - DNA, 22 bp, Homo sapiens
ggaaggaggatgctctggcctt

SEQ ID NO: 9493465 - DNA, 22 bp, Homo sapiens
ggaaggaggatgctctggcctt

SEQ ID NO: 9493466 - DNA, 22 bp, Homo sapiens
ggaaggagtctttaacacccat

SEQ ID NO: 9493467 - DNA, 22 bp, Homo sapiens
ggaaggaggggcaaagcagttc

SEQ ID NO: 9493468 - DNA, 19 bp, Homo sapiens
ggaaggcagaggggctgtg

SEQ ID NO: 9493469 - DNA, 22 bp, Homo sapiens
ggacaggcctggcacagtactg

SEQ ID NO: 9493470 - DNA, 22 bp, Homo sapiens
ggacaggccgcctcggtggggg

SEQ ID NO: 9493471 - DNA, 22 bp, Homo sapiens
ggacaggcctggcacagtactg

SEQ ID NO: 9493472 - DNA, 22 bp, Homo sapiens
ggacaggctgcatctgagcatg

SEQ ID NO: 9493473 - DNA, 22 bp, Homo sapiens
ggacaggctgcatctgagcatg

SEQ ID NO: 9493474 - DNA, 22 bp, Homo sapiens
ggacaggctgcatctgagcatg

SEQ ID NO: 9493475 - DNA, 22 bp, Homo sapiens
ggacaggctgcatctgagcatg

SEQ ID NO: 9493476 - DNA, 22 bp, Homo sapiens
ggacaggctgcatctgagcatg

SEQ ID NO: 9493477 - DNA, 22 bp, Homo sapiens
ggacaggcccggggagcctgga

SEQ ID NO: 9493478 - DNA, 22 bp, Homo sapiens
ggacaggcccggggagcctgga

SEQ ID NO: 9493479 - DNA, 22 bp, Homo sapiens
ggacaggcccggggagcctgga

SEQ ID NO: 9493480 - DNA, 22 bp, Homo sapiens
ggacaggccatatggaatacat

SEQ ID NO: 9493481 - DNA, 22 bp, Homo sapiens
ggacaggccctctggtcagctt

SEQ ID NO: 9493482 - DNA, 22 bp, Homo sapiens
ggacaggcccggggagcctgga

SEQ ID NO: 9493483 - DNA, 22 bp, Homo sapiens
ggacaggcccggggagcctgga

SEQ ID NO: 9493484 - DNA, 22 bp, Homo sapiens
ggacagggctcttggcactcct

SEQ ID NO: 9493485 - DNA, 22 bp, Homo sapiens
ggacagggctcttggcactcct

SEQ ID NO: 9493486 - DNA, 22 bp, Homo sapiens
ggacagggctcttggcactcct

SEQ ID NO: 9493487 - DNA, 22 bp, Homo sapiens
ggacaggggcgtggggattgtt

SEQ ID NO: 9493488 - DNA, 23 bp, Homo sapiens
ggacagggccctgccctatggcc

SEQ ID NO: 9493489 - DNA, 23 bp, Homo sapiens
ggacagggccctgccctatggcc

SEQ ID NO: 9493490 - DNA, 22 bp, Homo sapiens
ggacagggctcttggcactcct

SEQ ID NO: 9493491 - DNA, 22 bp, Homo sapiens
ggacttgggctggtctgtttct

SEQ ID NO: 9493492 - DNA, 19 bp, Homo sapiens
ggacttggtttccaggctc

SEQ ID NO: 9493493 - DNA, 22 bp, Homo sapiens
ggagaaagaagacgaacattgt

SEQ ID NO: 9493494 - DNA, 22 bp, Homo sapiens
ggagaaagctgtagtggaatgt

SEQ ID NO: 9493495 - DNA, 22 bp, Homo sapiens
ggagaaagctatgtgggggagt

SEQ ID NO: 9493496 - DNA, 22 bp, Homo sapiens
ggagaaagctgtagtggaatgt

SEQ ID NO: 9493497 - DNA, 22 bp, Homo sapiens
ggagaaaggataggaatgtgct

SEQ ID NO: 9493498 - DNA, 22 bp, Homo sapiens
ggagaaaggcatagcagaacct

SEQ ID NO: 9493499 - DNA, 22 bp, Homo sapiens
ggagaaaggcatagcagaacct

SEQ ID NO: 9493500 - DNA, 22 bp, Homo sapiens
ggactgctgtttacctggcttt

SEQ ID NO: 9493501 - DNA, 22 bp, Homo sapiens
ggactgctgtggacagagtcat

SEQ ID NO: 9493502 - DNA, 22 bp, Homo sapiens
ggactgctacaatatacaatta

SEQ ID NO: 9493503 - DNA, 22 bp, Homo sapiens
ggactgggaatcagggagatgc

SEQ ID NO: 9493504 - DNA, 22 bp, Homo sapiens
ggactgggaatcagggagatgc

SEQ ID NO: 9493505 - DNA, 22 bp, Homo sapiens
ggactgggaatcagggagatgc

SEQ ID NO: 9493506 - DNA, 22 bp, Homo sapiens
ggacttcattattgggagaggc

SEQ ID NO: 9493507 - DNA, 21 bp, Homo sapiens
ggacttggatggtggcagtag

SEQ ID NO: 9493508 - DNA, 22 bp, Homo sapiens
ggacttggcttctttcagagac

SEQ ID NO: 9493509 - DNA, 19 bp, Homo sapiens
ggactgttgccaggcctct

SEQ ID NO: 9493510 - DNA, 22 bp, Homo sapiens
ggactgggtcactaagatagta

SEQ ID NO: 9493511 - DNA, 22 bp, Homo sapiens
ggactgggtcactaagatagta

SEQ ID NO: 9493512 - DNA, 22 bp, Homo sapiens
ggactggtggctccttgggcag

SEQ ID NO: 9493513 - DNA, 22 bp, Homo sapiens
ggagctggctacagagaactcc

SEQ ID NO: 9493514 - DNA, 22 bp, Homo sapiens
ggagctggctacagagaactcc

SEQ ID NO: 9493515 - DNA, 22 bp, Homo sapiens
ggagctggctacagagaactcc

SEQ ID NO: 9493516 - DNA, 22 bp, Homo sapiens
ggagctggccgcctatgtgcag

SEQ ID NO: 9493517 - DNA, 22 bp, Homo sapiens
ggagctggccgcctatgtgcag

SEQ ID NO: 9493518 - DNA, 22 bp, Homo sapiens
ggagctgctcagagccagtccc

SEQ ID NO: 9493519 - DNA, 22 bp, Homo sapiens
ggagctgcatttagggagcctt

SEQ ID NO: 9493520 - DNA, 22 bp, Homo sapiens
ggagcctggtatagtgttgcat

SEQ ID NO: 9493521 - DNA, 22 bp, Homo sapiens
ggagcctgggcctcctgccctt

SEQ ID NO: 9493522 - DNA, 22 bp, Homo sapiens
ggagcctgggcattagtaattt

SEQ ID NO: 9493523 - DNA, 22 bp, Homo sapiens
ggagcctggcctggctctgtgt

SEQ ID NO: 9493524 - DNA, 22 bp, Homo sapiens
ggagctgggaattggatcatct

SEQ ID NO: 9493525 - DNA, 21 bp, Homo sapiens
ggagctggggagctggcccca

SEQ ID NO: 9493526 - DNA, 22 bp, Homo sapiens
ggagctgggaccctgtcatctg

SEQ ID NO: 9493527 - DNA, 22 bp, Homo sapiens
ggagctgggaccctgtcatctg

SEQ ID NO: 9493528 - DNA, 18 bp, Homo sapiens
ggagctgggccccactcc

SEQ ID NO: 9493529 - DNA, 21 bp, Homo sapiens
ggaggaaaaaggaatgacttg

SEQ ID NO: 9493530 - DNA, 22 bp, Homo sapiens
ggaggaggcggcagaagttcct

SEQ ID NO: 9493531 - DNA, 21 bp, Homo sapiens
ggaggaaaaaggaatgacttg

SEQ ID NO: 9493532 - DNA, 22 bp, Homo sapiens
ggagctgttgattgtttgagga

SEQ ID NO: 9493533 - DNA, 22 bp, Homo sapiens
ggaggaggggcgctttgtctat

SEQ ID NO: 9493534 - DNA, 22 bp, Homo sapiens
ggaggaggggtgactgaatgct

SEQ ID NO: 9493535 - DNA, 22 bp, Homo sapiens
ggaggaggggtgactgaatgct

SEQ ID NO: 9493536 - DNA, 22 bp, Homo sapiens
ggagctggggttggcatcttcc

SEQ ID NO: 9493537 - DNA, 21 bp, Homo sapiens
ggagctggggagctggcccca

SEQ ID NO: 9493538 - DNA, 21 bp, Homo sapiens
ggagctggggagctggcccca

SEQ ID NO: 9493539 - DNA, 21 bp, Homo sapiens
ggagctggggagctggcccca

SEQ ID NO: 9493540 - DNA, 22 bp, Homo sapiens
ggagctggtcagccttgagcat

SEQ ID NO: 9493541 - DNA, 22 bp, Homo sapiens
ggagctggtcagccttgagcat

SEQ ID NO: 9493542 - DNA, 22 bp, Homo sapiens
ggagctggtcagccttgagcat

SEQ ID NO: 9493543 - DNA, 22 bp, Homo sapiens
ggagctgtgcagtgactacaga

SEQ ID NO: 9493544 - DNA, 22 bp, Homo sapiens
ggagcctggcaatgctgcgtcc

SEQ ID NO: 9493545 - DNA, 22 bp, Homo sapiens
ggagcctggcaatgctgcgtcc

SEQ ID NO: 9493546 - DNA, 22 bp, Homo sapiens
ggagcctggcccggcccttggc

SEQ ID NO: 9493547 - DNA, 22 bp, Homo sapiens
ggagcctggcccggcccttggc

SEQ ID NO: 9493548 - DNA, 23 bp, Homo sapiens
ggagcctggcatatgagacgcat

SEQ ID NO: 9493549 - DNA, 22 bp, Homo sapiens
ggagcccagtcggggtgtaggt

SEQ ID NO: 9493550 - DNA, 18 bp, Homo sapiens
ggagcccagaggtgagtt

SEQ ID NO: 9493551 - DNA, 22 bp, Homo sapiens
ggagccctcaccggcgagtgcc

SEQ ID NO: 9493552 - DNA, 22 bp, Homo sapiens
ggagcctggagtttctgatggg

SEQ ID NO: 9493553 - DNA, 18 bp, Homo sapiens
ggagcccacggcgtccca

SEQ ID NO: 9493554 - DNA, 18 bp, Homo sapiens
ggagcccagaggtgagtt

SEQ ID NO: 9493555 - DNA, 18 bp, Homo sapiens
ggagcccagaggacagga

SEQ ID NO: 9493556 - DNA, 18 bp, Homo sapiens
ggagcccacggcgtccca

SEQ ID NO: 9493557 - DNA, 18 bp, Homo sapiens
ggagcccagaggacagga

SEQ ID NO: 9493558 - DNA, 22 bp, Homo sapiens
ggagccagtatttagtggtctt

SEQ ID NO: 9493559 - DNA, 22 bp, Homo sapiens
ggagccagtgccctctggtgga

SEQ ID NO: 9493560 - DNA, 18 bp, Homo sapiens
ggagccagtctgtctctg

SEQ ID NO: 9493561 - DNA, 22 bp, Homo sapiens
ggagccagtttagacctcagtt

SEQ ID NO: 9493562 - DNA, 22 bp, Homo sapiens
ggagccagtttagacctcagtt

SEQ ID NO: 9493563 - DNA, 22 bp, Homo sapiens
ggagccagtgccctctggtgga

SEQ ID NO: 9493564 - DNA, 22 bp, Homo sapiens
ggagccagtgccctctggtgga

SEQ ID NO: 9493565 - DNA, 22 bp, Homo sapiens
ggagaacatatctcccacattg

SEQ ID NO: 9493566 - DNA, 22 bp, Homo sapiens
ggagaactccaaatccatattt

SEQ ID NO: 9493567 - DNA, 22 bp, Homo sapiens
ggagaacaaatatctggcttct

SEQ ID NO: 9493568 - DNA, 22 bp, Homo sapiens
ggagaacaggcaagcatctggc

SEQ ID NO: 9493569 - DNA, 22 bp, Homo sapiens
ggagaacaggcaagcatctggc

SEQ ID NO: 9493570 - DNA, 22 bp, Homo sapiens
ggagaaagtacagcaggcaaca

SEQ ID NO: 9493571 - DNA, 22 bp, Homo sapiens
ggagaaaggcatagcagaacct

SEQ ID NO: 9493572 - DNA, 22 bp, Homo sapiens
ggagaagaggagctggaagcct

SEQ ID NO: 9493573 - DNA, 22 bp, Homo sapiens
ggagaagaggagctggaagcct

SEQ ID NO: 9493574 - DNA, 22 bp, Homo sapiens
ggagaagaggagctggaagcct

SEQ ID NO: 9493575 - DNA, 22 bp, Homo sapiens
ggagaagaggagctggaagcct

SEQ ID NO: 9493576 - DNA, 22 bp, Homo sapiens
ggagaagaggagctggaagcct

SEQ ID NO: 9493577 - DNA, 22 bp, Homo sapiens
ggagaagaggagctggaagcct

SEQ ID NO: 9493578 - DNA, 22 bp, Homo sapiens
ggagccaggcaatctgtacttt

SEQ ID NO: 9493579 - DNA, 17 bp, Homo sapiens
ggagccaggagcccacc

SEQ ID NO: 9493580 - DNA, 22 bp, Homo sapiens
ggagaagattggaattaagcac

SEQ ID NO: 9493581 - DNA, 22 bp, Homo sapiens
ggagaagcagcttcttgatgaa

SEQ ID NO: 9493582 - DNA, 22 bp, Homo sapiens
ggagaagattggaattaagcac

SEQ ID NO: 9493583 - DNA, 17 bp, Homo sapiens
ggagccaggagcccacc

SEQ ID NO: 9493584 - DNA, 17 bp, Homo sapiens
ggagccaggagcccacc

SEQ ID NO: 9493585 - DNA, 22 bp, Homo sapiens
ggagccagtatttagtggtctt

SEQ ID NO: 9493586 - DNA, 22 bp, Homo sapiens
ggagccaggggaccttcacaga

SEQ ID NO: 9493587 - DNA, 22 bp, Homo sapiens
ggagccaggggaccttcacaga

SEQ ID NO: 9493588 - DNA, 22 bp, Homo sapiens
ggagccagggaagctgcttcct

SEQ ID NO: 9493589 - DNA, 22 bp, Homo sapiens
ggagccagggaagctgcttcct

SEQ ID NO: 9493590 - DNA, 22 bp, Homo sapiens
ggagccaggcatatcggggcac

SEQ ID NO: 9493591 - DNA, 22 bp, Homo sapiens
gctgtctgtggtgtcagctgac

SEQ ID NO: 9493592 - DNA, 22 bp, Homo sapiens
gctgtgtgaccctagccagtag

SEQ ID NO: 9493593 - DNA, 22 bp, Homo sapiens
gctgtgtgaccctagccagtag

SEQ ID NO: 9493594 - DNA, 22 bp, Homo sapiens
gctgtctgtctctgtcccacca

SEQ ID NO: 9493595 - DNA, 22 bp, Homo sapiens
gctgtctgtctctgtcccacca

SEQ ID NO: 9493596 - DNA, 22 bp, Homo sapiens
gctgtctgtcttcacatctcgc

SEQ ID NO: 9493597 - DNA, 22 bp, Homo sapiens
gctgtctgtcttcacatctcgc

SEQ ID NO: 9493598 - DNA, 22 bp, Homo sapiens
gctgtctgggttgagggccctg

SEQ ID NO: 9493599 - DNA, 22 bp, Homo sapiens
gctgtctgggttgagggccctg

SEQ ID NO: 9493600 - DNA, 22 bp, Homo sapiens
gctgtctgtctctgtcccacca

SEQ ID NO: 9493601 - DNA, 23 bp, Homo sapiens
gctgtctgtcatctctgcgggag

SEQ ID NO: 9493602 - DNA, 23 bp, Homo sapiens
gctgtctgtcatctctgcgggag

SEQ ID NO: 9493603 - DNA, 22 bp, Homo sapiens
gctgtctgctgtgcactgagca

SEQ ID NO: 9493604 - DNA, 22 bp, Homo sapiens
gctgtctgctgtgcactgagca

SEQ ID NO: 9493605 - DNA, 22 bp, Homo sapiens
gctgtctgctgtgcactgagca

SEQ ID NO: 9493606 - DNA, 22 bp, Homo sapiens
gctgtctgctgtgcactgagca

SEQ ID NO: 9493607 - DNA, 22 bp, Homo sapiens
gctgtctggatatcttggaatt

SEQ ID NO: 9493608 - DNA, 22 bp, Homo sapiens
gctgtctggaggctctgaggga

SEQ ID NO: 9493609 - DNA, 22 bp, Homo sapiens
gctgtctggaggctctgaggga

SEQ ID NO: 9493610 - DNA, 22 bp, Homo sapiens
gctgtctgggaggcctccactt

SEQ ID NO: 9493611 - DNA, 22 bp, Homo sapiens
gctgtctgggatgtcactgctg

SEQ ID NO: 9493612 - DNA, 22 bp, Homo sapiens
gctgtctgggaggcctccactt

SEQ ID NO: 9493613 - DNA, 22 bp, Homo sapiens
gctgtctggatatcttggaatt

SEQ ID NO: 9493614 - DNA, 18 bp, Homo sapiens
gctgtgtgcacctgataa

SEQ ID NO: 9493615 - DNA, 22 bp, Homo sapiens
gctgtgtgccaggggaaggctg

SEQ ID NO: 9493616 - DNA, 22 bp, Homo sapiens
gctgtgtgactgagagcctggc

SEQ ID NO: 9493617 - DNA, 19 bp, Homo sapiens
gctgtgtgaccttgggcaa

SEQ ID NO: 9493618 - DNA, 22 bp, Homo sapiens
gctgtgtgctaggatatgtttt

SEQ ID NO: 9493619 - DNA, 22 bp, Homo sapiens
gctgtgtgccaggggaaggctg

SEQ ID NO: 9493620 - DNA, 22 bp, Homo sapiens
gctgtgtgctcacgtagtggaa

SEQ ID NO: 9493621 - DNA, 22 bp, Homo sapiens
gctgtgtgctcacgtagtggaa

SEQ ID NO: 9493622 - DNA, 22 bp, Homo sapiens
gctgtgtgctaggatatgtttt

SEQ ID NO: 9493623 - DNA, 22 bp, Homo sapiens
gctgtgtgctaggatatgtttt

SEQ ID NO: 9493624 - DNA, 22 bp, Homo sapiens
gctgtgtgctcacgtagtggaa

SEQ ID NO: 9493625 - DNA, 19 bp, Homo sapiens
gctgtgtgaccttgggcaa

SEQ ID NO: 9493626 - DNA, 19 bp, Homo sapiens
gctgtgtgaccttgggcaa

SEQ ID NO: 9493627 - DNA, 22 bp, Homo sapiens
gctgtctgtggtgtcagctgac

SEQ ID NO: 9493628 - DNA, 22 bp, Homo sapiens
gctgtgtgacctgggcaagtct

SEQ ID NO: 9493629 - DNA, 22 bp, Homo sapiens
gctgtgtgacctgggcaagtct

SEQ ID NO: 9493630 - DNA, 22 bp, Homo sapiens
gctgtgtgactgagagcctggc

SEQ ID NO: 9493631 - DNA, 19 bp, Homo sapiens
gctgtgtgaccttgggcaa

SEQ ID NO: 9493632 - DNA, 22 bp, Homo sapiens
gctgtgtgactgagagcctggc

SEQ ID NO: 9493633 - DNA, 22 bp, Homo sapiens
gctgtgtgactgagagcctggc

SEQ ID NO: 9493634 - DNA, 22 bp, Homo sapiens
gctgtgtgactgagagcctggc

SEQ ID NO: 9493635 - DNA, 22 bp, Homo sapiens
gctgtcccgctgacttccagct

SEQ ID NO: 9493636 - DNA, 22 bp, Homo sapiens
gctgtcccgctgacttccagct

SEQ ID NO: 9493637 - DNA, 17 bp, Homo sapiens
gctgtcccttcaagagt

SEQ ID NO: 9493638 - DNA, 22 bp, Homo sapiens
gctgtccctttcacaaggtttt

SEQ ID NO: 9493639 - DNA, 22 bp, Homo sapiens
gctgtcccttgtcccaccttgc

SEQ ID NO: 9493640 - DNA, 23 bp, Homo sapiens
gctgtcctcctgggcccagcagc

SEQ ID NO: 9493641 - DNA, 22 bp, Homo sapiens
gctgtcctggggagggagaatg

SEQ ID NO: 9493642 - DNA, 22 bp, Homo sapiens
gctgtctgctgtgcactgagca

SEQ ID NO: 9493643 - DNA, 22 bp, Homo sapiens
gctgtctgctgggtcgctcagg

SEQ ID NO: 9493644 - DNA, 22 bp, Homo sapiens
gctgtctgctgggtcgctcagg

SEQ ID NO: 9493645 - DNA, 22 bp, Homo sapiens
gctgtcccatggttgcaagatg

SEQ ID NO: 9493646 - DNA, 20 bp, Homo sapiens
gctgtcccaggccaaagggc

SEQ ID NO: 9493647 - DNA, 23 bp, Homo sapiens
gctgtccccatgctccatccctg

SEQ ID NO: 9493648 - DNA, 22 bp, Homo sapiens
gctgtcccgctgacttccagct

SEQ ID NO: 9493649 - DNA, 22 bp, Homo sapiens
gctgtcccgaacccctggtaat

SEQ ID NO: 9493650 - DNA, 22 bp, Homo sapiens
gctgtccaacctgcactcgcgt

SEQ ID NO: 9493651 - DNA, 22 bp, Homo sapiens
gctgtccagctccagccagcca

SEQ ID NO: 9493652 - DNA, 22 bp, Homo sapiens
gctgtcactggcatgttccggg

SEQ ID NO: 9493653 - DNA, 22 bp, Homo sapiens
gctgtcactcaccaggcctgca

SEQ ID NO: 9493654 - DNA, 22 bp, Homo sapiens
gctgtcactctccggccttccc

SEQ ID NO: 9493655 - DNA, 22 bp, Homo sapiens
gctgtcagtgaggtgagacatg

SEQ ID NO: 9493656 - DNA, 22 bp, Homo sapiens
gctgtcacatcaaggcactaaa

SEQ ID NO: 9493657 - DNA, 22 bp, Homo sapiens
gctgtcaccaaagcaggcactg

SEQ ID NO: 9493658 - DNA, 22 bp, Homo sapiens
gctgtcacatttggagcactgg

SEQ ID NO: 9493659 - DNA, 22 bp, Homo sapiens
gctgtcacacatgggatctcag

SEQ ID NO: 9493660 - DNA, 22 bp, Homo sapiens
gctgtcacacatggccccagct

SEQ ID NO: 9493661 - DNA, 22 bp, Homo sapiens
gctgtcacaagcatctggggca

SEQ ID NO: 9493662 - DNA, 22 bp, Homo sapiens
gctgtcacaaatatttctcagc

SEQ ID NO: 9493663 - DNA, 22 bp, Homo sapiens
gctgtcacaaattgggttcttt

SEQ ID NO: 9493664 - DNA, 22 bp, Homo sapiens
gctgtaggaatgacatgtacct

SEQ ID NO: 9493665 - DNA, 22 bp, Homo sapiens
gctgtaggaagacagaatgcag

SEQ ID NO: 9493666 - DNA, 22 bp, Homo sapiens
gctgtagatggactggcatcca

SEQ ID NO: 9493667 - DNA, 22 bp, Homo sapiens
gctgtaggtaaggatggcaaag

SEQ ID NO: 9493668 - DNA, 22 bp, Homo sapiens
gctgtagggtgtcatatgaagc

SEQ ID NO: 9493669 - DNA, 22 bp, Homo sapiens
gctgtaggtcatttaatcacct

SEQ ID NO: 9493670 - DNA, 22 bp, Homo sapiens
gctgtagtgaatggccgcgttc

SEQ ID NO: 9493671 - DNA, 22 bp, Homo sapiens
gctgtatgtgaggccacagtga

SEQ ID NO: 9493672 - DNA, 22 bp, Homo sapiens
gctgtatgtgaggccacagtga

SEQ ID NO: 9493673 - DNA, 22 bp, Homo sapiens
gctgtatgtgaggccacagtga

SEQ ID NO: 9493674 - DNA, 22 bp, Homo sapiens
gctgtagtgaatggccgcgttc

SEQ ID NO: 9493675 - DNA, 22 bp, Homo sapiens
gctgtattcctgcactgtatag

SEQ ID NO: 9493676 - DNA, 22 bp, Homo sapiens
gctgtattcaacagtgaaaaga

SEQ ID NO: 9493677 - DNA, 19 bp, Homo sapiens
gctgtattaaagatacatg

SEQ ID NO: 9493678 - DNA, 22 bp, Homo sapiens
gctgtatgtttatttgggaatt

SEQ ID NO: 9493679 - DNA, 22 bp, Homo sapiens
gctgtattggaacacatccatg

SEQ ID NO: 9493680 - DNA, 22 bp, Homo sapiens
gctgtatttaacaactggctca

SEQ ID NO: 9493681 - DNA, 22 bp, Homo sapiens
gctggccacattgtgccgtcct

SEQ ID NO: 9493682 - DNA, 22 bp, Homo sapiens
gctggccacattgtgccgtcct

SEQ ID NO: 9493683 - DNA, 19 bp, Homo sapiens
gctggccacgccccagttg

SEQ ID NO: 9493684 - DNA, 19 bp, Homo sapiens
gctggccacgccccagttg

SEQ ID NO: 9493685 - DNA, 22 bp, Homo sapiens
gctggccacattgtgccgtcct

SEQ ID NO: 9493686 - DNA, 22 bp, Homo sapiens
gctggccagccctcttcctcca

SEQ ID NO: 9493687 - DNA, 19 bp, Homo sapiens
gctggccacgccccagttg

SEQ ID NO: 9493688 - DNA, 19 bp, Homo sapiens
gctggccacgccccagttg

SEQ ID NO: 9493689 - DNA, 22 bp, Homo sapiens
gctggccacactgctgatggag

SEQ ID NO: 9493690 - DNA, 22 bp, Homo sapiens
gctggccacactgctgatggag

SEQ ID NO: 9493691 - DNA, 22 bp, Homo sapiens
gctggccaaagtgtacctggag

SEQ ID NO: 9493692 - DNA, 22 bp, Homo sapiens
gctggccacagatccccaggga

SEQ ID NO: 9493693 - DNA, 22 bp, Homo sapiens
gctggccacagatccccaggga

SEQ ID NO: 9493694 - DNA, 22 bp, Homo sapiens
gctggccacagatccccaggga

SEQ ID NO: 9493695 - DNA, 22 bp, Homo sapiens
gctggccacagatccccaggga

SEQ ID NO: 9493696 - DNA, 22 bp, Homo sapiens
gctggccaggaagagtctcaga

SEQ ID NO: 9493697 - DNA, 22 bp, Homo sapiens
gctggccagggctgctcgcgga

SEQ ID NO: 9493698 - DNA, 22 bp, Homo sapiens
gctggtcagagagaaaggaggc

SEQ ID NO: 9493699 - DNA, 22 bp, Homo sapiens
gctggccaggaagagtctcaga

SEQ ID NO: 9493700 - DNA, 22 bp, Homo sapiens
gctggccaggaagagtctcaga

SEQ ID NO: 9493701 - DNA, 22 bp, Homo sapiens
gctggtccacatcctggtacgt

SEQ ID NO: 9493702 - DNA, 22 bp, Homo sapiens
gctggtcagggagggcacccat

SEQ ID NO: 9493703 - DNA, 22 bp, Homo sapiens
gctggtccacatcctggtacgt

SEQ ID NO: 9493704 - DNA, 22 bp, Homo sapiens
gctggtcccaatgtgtttcctt

SEQ ID NO: 9493705 - DNA, 22 bp, Homo sapiens
gctggtccattggcactgctca

SEQ ID NO: 9493706 - DNA, 22 bp, Homo sapiens
gctggtccagggcctctgtggg

SEQ ID NO: 9493707 - DNA, 22 bp, Homo sapiens
gctggtccagggcctctgtggg

SEQ ID NO: 9493708 - DNA, 22 bp, Homo sapiens
gctggtccactccctggaggct

SEQ ID NO: 9493709 - DNA, 22 bp, Homo sapiens
gcttttattgtctttacgacga

SEQ ID NO: 9493710 - DNA, 22 bp, Homo sapiens
gcttttattgtctttacgacga

SEQ ID NO: 9493711 - DNA, 22 bp, Homo sapiens
gcttttatttcttcacaaaagt

SEQ ID NO: 9493712 - DNA, 19 bp, Homo sapiens
gcttttattgctcaggtgc

SEQ ID NO: 9493713 - DNA, 19 bp, Homo sapiens
gcttttattgctcaggtgc

SEQ ID NO: 9493714 - DNA, 22 bp, Homo sapiens
gcttttattgtctttacgacga

SEQ ID NO: 9493715 - DNA, 22 bp, Homo sapiens
gcttttatgcacataagggtca

SEQ ID NO: 9493716 - DNA, 22 bp, Homo sapiens
gcttttatgcacataagggtca

SEQ ID NO: 9493717 - DNA, 22 bp, Homo sapiens
gcttttatttcttcacaaaagt

SEQ ID NO: 9493718 - DNA, 22 bp, Homo sapiens
gcttttatttcttcacaaaagt

SEQ ID NO: 9493719 - DNA, 22 bp, Homo sapiens
gcttttatttcttcacaaaagt

SEQ ID NO: 9493720 - DNA, 22 bp, Homo sapiens
gcttttctagctagaacatccg

SEQ ID NO: 9493721 - DNA, 22 bp, Homo sapiens
gcttttcctgactttccattag

SEQ ID NO: 9493722 - DNA, 22 bp, Homo sapiens
gcttttcatgacaactcagcga

SEQ ID NO: 9493723 - DNA, 22 bp, Homo sapiens
gcttttcatagataaaattcta

SEQ ID NO: 9493724 - DNA, 22 bp, Homo sapiens
gcttttctccttagtgtccctg

SEQ ID NO: 9493725 - DNA, 22 bp, Homo sapiens
gcttttctataagaactttcaa

SEQ ID NO: 9493726 - DNA, 22 bp, Homo sapiens
gcttttctagctagaacatccg

SEQ ID NO: 9493727 - DNA, 22 bp, Homo sapiens
gcttttctataagaactttcaa

SEQ ID NO: 9493728 - DNA, 22 bp, Homo sapiens
gcttttgtcattcaaatgctct

SEQ ID NO: 9493729 - DNA, 22 bp, Homo sapiens
gcttttgtgagctctcactttg

SEQ ID NO: 9493730 - DNA, 22 bp, Homo sapiens
gcttttcttcagcagcctgatg

SEQ ID NO: 9493731 - DNA, 19 bp, Homo sapiens
gcttttctccttcaagcca

SEQ ID NO: 9493732 - DNA, 22 bp, Homo sapiens
gcttttgtcatggtgactcagt

SEQ ID NO: 9493733 - DNA, 22 bp, Homo sapiens
gcttttttaggtaagacccagg

SEQ ID NO: 9493734 - DNA, 22 bp, Homo sapiens
gcttttttgctattgaagtggt

SEQ ID NO: 9493735 - DNA, 22 bp, Homo sapiens
gcttttttgggatgcctgcctt

SEQ ID NO: 9493736 - DNA, 22 bp, Homo sapiens
gcttttttgggatgcctgcctt

SEQ ID NO: 9493737 - DNA, 22 bp, Homo sapiens
gctttttcaaatgaaagctggt

SEQ ID NO: 9493738 - DNA, 20 bp, Homo sapiens
gctttttctaatagcagtcc

SEQ ID NO: 9493739 - DNA, 22 bp, Homo sapiens
gctttaggaatgaataaaaatc

SEQ ID NO: 9493740 - DNA, 22 bp, Homo sapiens
gctttagacataaagttcttca

SEQ ID NO: 9493741 - DNA, 22 bp, Homo sapiens
gctttactgtctggaaagtttg

SEQ ID NO: 9493742 - DNA, 22 bp, Homo sapiens
gctttactgagatgacacaggg

SEQ ID NO: 9493743 - DNA, 22 bp, Homo sapiens
gctttggtcaggtgtccagccc

SEQ ID NO: 9493744 - DNA, 22 bp, Homo sapiens
gctttgggtgtcctctgggcct

SEQ ID NO: 9493745 - DNA, 22 bp, Homo sapiens
gctttgggtgtcctctgggcct

SEQ ID NO: 9493746 - DNA, 22 bp, Homo sapiens
gctttgggggctgcagtgcgtg

SEQ ID NO: 9493747 - DNA, 22 bp, Homo sapiens
gctttgggggctgcagtgcgtg

SEQ ID NO: 9493748 - DNA, 22 bp, Homo sapiens
gcttaaatcccaatgctagacc

SEQ ID NO: 9493749 - DNA, 22 bp, Homo sapiens
gcttaaattgtttgtggatagt

SEQ ID NO: 9493750 - DNA, 22 bp, Homo sapiens
gcttggaagtaggattgggaga

SEQ ID NO: 9493751 - DNA, 22 bp, Homo sapiens
gcttaaattgtttgtggatagt

SEQ ID NO: 9493752 - DNA, 22 bp, Homo sapiens
gcttggagtagaatgcattctt

SEQ ID NO: 9493753 - DNA, 22 bp, Homo sapiens
gcttggaagtaggattgggaga

SEQ ID NO: 9493754 - DNA, 22 bp, Homo sapiens
gcttggagaagatgttctcaat

SEQ ID NO: 9493755 - DNA, 22 bp, Homo sapiens
gcttggggtcatgaggctgctg

SEQ ID NO: 9493756 - DNA, 22 bp, Homo sapiens
gcttggtttggcaaaggaagga

SEQ ID NO: 9493757 - DNA, 22 bp, Homo sapiens
gcttggtttctaacttttcata

SEQ ID NO: 9493758 - DNA, 18 bp, Homo sapiens
gcttggtttccacaaacc

SEQ ID NO: 9493759 - DNA, 22 bp, Homo sapiens
gcttgtctctcagccccagtca

SEQ ID NO: 9493760 - DNA, 23 bp, Homo sapiens
gcttgtctagtgaattcatatct

SEQ ID NO: 9493761 - DNA, 22 bp, Homo sapiens
gctttaatgcaatttcacctca

SEQ ID NO: 9493762 - DNA, 22 bp, Homo sapiens
gcttgtttctatttatcaagta

SEQ ID NO: 9493763 - DNA, 22 bp, Homo sapiens
gcttgtttgtgatttctccaga

SEQ ID NO: 9493764 - DNA, 22 bp, Homo sapiens
gctttaaacctctactctgtcc

SEQ ID NO: 9493765 - DNA, 22 bp, Homo sapiens
gctttaaatggcttgcccaagt

SEQ ID NO: 9493766 - DNA, 22 bp, Homo sapiens
gctttaaacctctactctgtcc

SEQ ID NO: 9493767 - DNA, 22 bp, Homo sapiens
gctttaaacctctactctgtcc

SEQ ID NO: 9493768 - DNA, 22 bp, Homo sapiens
gctttaaatggcttgcccaagt

SEQ ID NO: 9493769 - DNA, 22 bp, Homo sapiens
gctgtgtttgacagtagcagac

SEQ ID NO: 9493770 - DNA, 22 bp, Homo sapiens
gctgtgtgttcaataatgtgat

SEQ ID NO: 9493771 - DNA, 22 bp, Homo sapiens
gctgtgtgttcaataatgtgat

SEQ ID NO: 9493772 - DNA, 22 bp, Homo sapiens
gctgtgtgttcaataatgtgat

SEQ ID NO: 9493773 - DNA, 22 bp, Homo sapiens
gctgtgtgttcaataatgtgat

SEQ ID NO: 9493774 - DNA, 22 bp, Homo sapiens
gctgtgtgctcacgtagtggaa

SEQ ID NO: 9493775 - DNA, 22 bp, Homo sapiens
gctgtgtgctcacgtagtggaa

SEQ ID NO: 9493776 - DNA, 22 bp, Homo sapiens
gctgtgtgctcacgtagtggaa

SEQ ID NO: 9493777 - DNA, 22 bp, Homo sapiens
gctgtgtgctctggtctttctt

SEQ ID NO: 9493778 - DNA, 22 bp, Homo sapiens
gctgtgtgctgggcatggcact

SEQ ID NO: 9493779 - DNA, 22 bp, Homo sapiens
gctgtgtggctgtgccgtcacg

SEQ ID NO: 9493780 - DNA, 22 bp, Homo sapiens
gctgtgtggctgtgccgtcacg

SEQ ID NO: 9493781 - DNA, 22 bp, Homo sapiens
gctgtgtgctgggcatggcact

SEQ ID NO: 9493782 - DNA, 22 bp, Homo sapiens
gctgtgtggcaaagggattaca

SEQ ID NO: 9493783 - DNA, 22 bp, Homo sapiens
gctgtgtggcaaagggattaca

SEQ ID NO: 9493784 - DNA, 22 bp, Homo sapiens
gctgtttctgagtagctaggct

SEQ ID NO: 9493785 - DNA, 22 bp, Homo sapiens
gctgtttctttggcaaactgat

SEQ ID NO: 9493786 - DNA, 22 bp, Homo sapiens
gcttaaaagccacttagtctat

SEQ ID NO: 9493787 - DNA, 22 bp, Homo sapiens
gcttaaaatccatgatttttac

SEQ ID NO: 9493788 - DNA, 22 bp, Homo sapiens
gcttaaaagccacttagtctat

SEQ ID NO: 9493789 - DNA, 22 bp, Homo sapiens
gctgtttccagacaatgtcttt

SEQ ID NO: 9493790 - DNA, 22 bp, Homo sapiens
gctgtttccccttcacagtggc

SEQ ID NO: 9493791 - DNA, 23 bp, Homo sapiens
gctgtttccccatgtgctgaagg

SEQ ID NO: 9493792 - DNA, 22 bp, Homo sapiens
gcagacacttcccactgcagcg

SEQ ID NO: 9493793 - DNA, 22 bp, Homo sapiens
gcagacaatttattagcagatt

SEQ ID NO: 9493794 - DNA, 22 bp, Homo sapiens
gcagacacagggaaggcaagga

SEQ ID NO: 9493795 - DNA, 22 bp, Homo sapiens
gcagacaatttattagcagatt

SEQ ID NO: 9493796 - DNA, 22 bp, Homo sapiens
gcagaagggaataaggagcttt

SEQ ID NO: 9493797 - DNA, 22 bp, Homo sapiens
gcagacagaagctaagtagaca

SEQ ID NO: 9493798 - DNA, 22 bp, Homo sapiens
gcagacagactgcagtgatttt

SEQ ID NO: 9493799 - DNA, 22 bp, Homo sapiens
gcagacagactgcagtgatttt

SEQ ID NO: 9493800 - DNA, 23 bp, Homo sapiens
gcagacagagcagactaagacaa

SEQ ID NO: 9493801 - DNA, 22 bp, Homo sapiens
gcagacacttttattctgcata

SEQ ID NO: 9493802 - DNA, 22 bp, Homo sapiens
gcagacacttcccactgcagcg

SEQ ID NO: 9493803 - DNA, 22 bp, Homo sapiens
gcagacagatgagggtgctggg

SEQ ID NO: 9493804 - DNA, 22 bp, Homo sapiens
gcagacagatgagggtgctggg

SEQ ID NO: 9493805 - DNA, 22 bp, Homo sapiens
gcagacagatgagggtgctggg

SEQ ID NO: 9493806 - DNA, 22 bp, Homo sapiens
gcagacagatgagggtgctggg

SEQ ID NO: 9493807 - DNA, 22 bp, Homo sapiens
gcagacagcatgttgggctatt

SEQ ID NO: 9493808 - DNA, 22 bp, Homo sapiens
gcagacagatgagggtgctggg

SEQ ID NO: 9493809 - DNA, 22 bp, Homo sapiens
gcagacagcatgttgggctatt

SEQ ID NO: 9493810 - DNA, 22 bp, Homo sapiens
gcagacagccagactgcactgg

SEQ ID NO: 9493811 - DNA, 22 bp, Homo sapiens
gcagacagccagactgcactgg

SEQ ID NO: 9493812 - DNA, 22 bp, Homo sapiens
gcagacagccagactgcactgg

SEQ ID NO: 9493813 - DNA, 22 bp, Homo sapiens
gcagacaggattgggttaatag

SEQ ID NO: 9493814 - DNA, 22 bp, Homo sapiens
gcagacaggcccagtggaggga

SEQ ID NO: 9493815 - DNA, 22 bp, Homo sapiens
gcagacaggattgggttaatag

SEQ ID NO: 9493816 - DNA, 22 bp, Homo sapiens
gcagacaggcccagtggaggga

SEQ ID NO: 9493817 - DNA, 22 bp, Homo sapiens
gcagacaggcccagtggaggga

SEQ ID NO: 9493818 - DNA, 22 bp, Homo sapiens
gcacccagatagcaaggattag

SEQ ID NO: 9493819 - DNA, 22 bp, Homo sapiens
gcacccagatagcaaggattag

SEQ ID NO: 9493820 - DNA, 22 bp, Homo sapiens
gcacccagatattgccttgacc

SEQ ID NO: 9493821 - DNA, 22 bp, Homo sapiens
gcacccagaggtcagcagtgct

SEQ ID NO: 9493822 - DNA, 22 bp, Homo sapiens
gcacccagaggtcagcagtgct

SEQ ID NO: 9493823 - DNA, 22 bp, Homo sapiens
gcacccagatattgccttgacc

SEQ ID NO: 9493824 - DNA, 22 bp, Homo sapiens
gcacccagccagcatctcagag

SEQ ID NO: 9493825 - DNA, 22 bp, Homo sapiens
gcacccagccagcatctcagag

SEQ ID NO: 9493826 - DNA, 22 bp, Homo sapiens
gcacccagccagcatctcagag

SEQ ID NO: 9493827 - DNA, 22 bp, Homo sapiens
gcacccagccagcatctcagag

SEQ ID NO: 9493828 - DNA, 21 bp, Homo sapiens
gcacccagccggttctcccag

SEQ ID NO: 9493829 - DNA, 21 bp, Homo sapiens
gcacccagccggttctcccag

SEQ ID NO: 9493830 - DNA, 21 bp, Homo sapiens
gcacccagccggttctcccag

SEQ ID NO: 9493831 - DNA, 20 bp, Homo sapiens
gcacccagcttcttgttcta

SEQ ID NO: 9493832 - DNA, 22 bp, Homo sapiens
gcacccagcccagggcgtgatg

SEQ ID NO: 9493833 - DNA, 22 bp, Homo sapiens
gcacccagcccagggcgtgatg

SEQ ID NO: 9493834 - DNA, 22 bp, Homo sapiens
gcacccagcccagggcgtgatg

SEQ ID NO: 9493835 - DNA, 22 bp, Homo sapiens
gcacccagcccagggcgtgatg

SEQ ID NO: 9493836 - DNA, 20 bp, Homo sapiens
gcacccagcttcttgttcta

SEQ ID NO: 9493837 - DNA, 22 bp, Homo sapiens
gcagaaggatccgcaggtgcaa

SEQ ID NO: 9493838 - DNA, 22 bp, Homo sapiens
gcacccagaggtcagcagtgct

SEQ ID NO: 9493839 - DNA, 22 bp, Homo sapiens
gcacccagaggtcagcagtgct

SEQ ID NO: 9493840 - DNA, 22 bp, Homo sapiens
gcacccagaggtcagcagtgct

SEQ ID NO: 9493841 - DNA, 22 bp, Homo sapiens
gcacccagaggtcagcagtgct

SEQ ID NO: 9493842 - DNA, 22 bp, Homo sapiens
gcacccagagggcagggtctcc

SEQ ID NO: 9493843 - DNA, 22 bp, Homo sapiens
gcacccagagggcagggtctcc

SEQ ID NO: 9493844 - DNA, 22 bp, Homo sapiens
gcaccaggaagctgttatagca

SEQ ID NO: 9493845 - DNA, 22 bp, Homo sapiens
gcaccagctgctgggttctaga

SEQ ID NO: 9493846 - DNA, 22 bp, Homo sapiens
gcaccagctgccttctgtgccc

SEQ ID NO: 9493847 - DNA, 22 bp, Homo sapiens
gcaccagctgccttctgtgccc

SEQ ID NO: 9493848 - DNA, 19 bp, Homo sapiens
gcaccagattgagtgacac

SEQ ID NO: 9493849 - DNA, 19 bp, Homo sapiens
gcaccagattgagtgacac

SEQ ID NO: 9493850 - DNA, 19 bp, Homo sapiens
gcaccagattgagtgacac

SEQ ID NO: 9493851 - DNA, 22 bp, Homo sapiens
gcaccagagggggctctgcagg

SEQ ID NO: 9493852 - DNA, 22 bp, Homo sapiens
gcaccactacactccagcctgg

SEQ ID NO: 9493853 - DNA, 22 bp, Homo sapiens
gcaccactagagtagagatggt

SEQ ID NO: 9493854 - DNA, 22 bp, Homo sapiens
gcacatttgagacatccaggca

SEQ ID NO: 9493855 - DNA, 22 bp, Homo sapiens
gcacatttaactgagctcagga

SEQ ID NO: 9493856 - DNA, 22 bp, Homo sapiens
gcacatttgccactgagctcct

SEQ ID NO: 9493857 - DNA, 22 bp, Homo sapiens
gcacatttgccactgagctcct

SEQ ID NO: 9493858 - DNA, 18 bp, Homo sapiens
gcagagtgcgtctctgtg

SEQ ID NO: 9493859 - DNA, 18 bp, Homo sapiens
gcagagtgcgtctctgtg

SEQ ID NO: 9493860 - DNA, 22 bp, Homo sapiens
gcagagtgatggaatgtgggtg

SEQ ID NO: 9493861 - DNA, 22 bp, Homo sapiens
gcagagtgatggaatgtgggtg

SEQ ID NO: 9493862 - DNA, 22 bp, Homo sapiens
gcagagtgaagggagaggtgtg

SEQ ID NO: 9493863 - DNA, 22 bp, Homo sapiens
gcagagtgagccgaggctgctc

SEQ ID NO: 9493864 - DNA, 22 bp, Homo sapiens
gcagagtgagccgaggctgctc

SEQ ID NO: 9493865 - DNA, 22 bp, Homo sapiens
gcagagtgagccgaggctgctc

SEQ ID NO: 9493866 - DNA, 19 bp, Homo sapiens
gcagagtggggtggagggt

SEQ ID NO: 9493867 - DNA, 22 bp, Homo sapiens
gcagattattattaggctgagt

SEQ ID NO: 9493868 - DNA, 22 bp, Homo sapiens
gcagatttcatttaaacctttc

SEQ ID NO: 9493869 - DNA, 22 bp, Homo sapiens
gcagatttctaataagcaatgt

SEQ ID NO: 9493870 - DNA, 22 bp, Homo sapiens
gcagatgttgttgctgggagtt

SEQ ID NO: 9493871 - DNA, 22 bp, Homo sapiens
gcagattatatgcatatgtggt

SEQ ID NO: 9493872 - DNA, 22 bp, Homo sapiens
gcagattactggactgattcca

SEQ ID NO: 9493873 - DNA, 22 bp, Homo sapiens
gcagattactggactgattcca

SEQ ID NO: 9493874 - DNA, 21 bp, Homo sapiens
gcagcaaatgacaacagtgag

SEQ ID NO: 9493875 - DNA, 22 bp, Homo sapiens
gcagcaacgcggccctactgct

SEQ ID NO: 9493876 - DNA, 22 bp, Homo sapiens
gcagcaagaataatttgggtag

SEQ ID NO: 9493877 - DNA, 22 bp, Homo sapiens
gcagcaaagctcttcatgtgat

SEQ ID NO: 9493878 - DNA, 22 bp, Homo sapiens
gcagcaaacttccacaagtaga

SEQ ID NO: 9493879 - DNA, 22 bp, Homo sapiens
gcagcaaacttccacaagtaga

SEQ ID NO: 9493880 - DNA, 22 bp, Homo sapiens
gcagcaaaaaagtaatatttat

SEQ ID NO: 9493881 - DNA, 19 bp, Homo sapiens
gcagcaaacaaaacaggta

SEQ ID NO: 9493882 - DNA, 22 bp, Homo sapiens
gcagacagggctacagaggtac

SEQ ID NO: 9493883 - DNA, 22 bp, Homo sapiens
gcagacagggctacagaggtac

SEQ ID NO: 9493884 - DNA, 22 bp, Homo sapiens
gcagacaggcccagtggaggga

SEQ ID NO: 9493885 - DNA, 22 bp, Homo sapiens
gcagacagggctacagaggtac

SEQ ID NO: 9493886 - DNA, 22 bp, Homo sapiens
gcagaggtgctcagtggcagaa

SEQ ID NO: 9493887 - DNA, 23 bp, Homo sapiens
gcagaggtttttcagtatggttt

SEQ ID NO: 9493888 - DNA, 19 bp, Homo sapiens
gcagagtcaagagctgctg

SEQ ID NO: 9493889 - DNA, 19 bp, Homo sapiens
gcagagtcaagagctgctg

SEQ ID NO: 9493890 - DNA, 23 bp, Homo sapiens
gcagagtcaagtagtcatgagtg

SEQ ID NO: 9493891 - DNA, 22 bp, Homo sapiens
gcagagtgaagcagtatggaaa

SEQ ID NO: 9493892 - DNA, 22 bp, Homo sapiens
gcagagtctggtaggtgctggt

SEQ ID NO: 9493893 - DNA, 22 bp, Homo sapiens
gcagagtctgggctacctcttg

SEQ ID NO: 9493894 - DNA, 22 bp, Homo sapiens
gcagagtctgggcagcctccat

SEQ ID NO: 9493895 - DNA, 22 bp, Homo sapiens
gcagagtcccagcaggtggtgg

SEQ ID NO: 9493896 - DNA, 22 bp, Homo sapiens
gcagagtcccagcaggtggtgg

SEQ ID NO: 9493897 - DNA, 22 bp, Homo sapiens
gcagagtcattatttatgcaat

SEQ ID NO: 9493898 - DNA, 22 bp, Homo sapiens
gcagagtcaggtccaaggactg

SEQ ID NO: 9493899 - DNA, 22 bp, Homo sapiens
gcagagtcaggtccaaggactg

SEQ ID NO: 9493900 - DNA, 18 bp, Homo sapiens
gcacatgtaagagtaaag

SEQ ID NO: 9493901 - DNA, 22 bp, Homo sapiens
gcacatggcggccagcaggtga

SEQ ID NO: 9493902 - DNA, 22 bp, Homo sapiens
gcacatggacaatggaggtgca

SEQ ID NO: 9493903 - DNA, 22 bp, Homo sapiens
gcacatgtcttattcactgtta

SEQ ID NO: 9493904 - DNA, 18 bp, Homo sapiens
gcacatgtaagagtaaag

SEQ ID NO: 9493905 - DNA, 22 bp, Homo sapiens
gcacatgtcttattcactgtta

SEQ ID NO: 9493906 - DNA, 22 bp, Homo sapiens
gcacatgtcttattcactgtta

SEQ ID NO: 9493907 - DNA, 22 bp, Homo sapiens
gcacatgtgagagtagaggcct

SEQ ID NO: 9493908 - DNA, 22 bp, Homo sapiens
gcacatgtgggaatggtgctga

SEQ ID NO: 9493909 - DNA, 22 bp, Homo sapiens
gcacatgtgagagtagaggcct

SEQ ID NO: 9493910 - DNA, 22 bp, Homo sapiens
gcacatgtgggtaagcacatgg

SEQ ID NO: 9493911 - DNA, 22 bp, Homo sapiens
gcacatgtgggtaagcacatgg

SEQ ID NO: 9493912 - DNA, 22 bp, Homo sapiens
gcacatgtgggaatggtgctga

SEQ ID NO: 9493913 - DNA, 18 bp, Homo sapiens
gcacatgtgtaaggcgac

SEQ ID NO: 9493914 - DNA, 22 bp, Homo sapiens
gcacatgttgctagttacttgc

SEQ ID NO: 9493915 - DNA, 17 bp, Homo sapiens
gcacatgtgttctttta

SEQ ID NO: 9493916 - DNA, 22 bp, Homo sapiens
gcacagcagacttggtggggct

SEQ ID NO: 9493917 - DNA, 22 bp, Homo sapiens
gcacagcacagcaacatgtttt

SEQ ID NO: 9493918 - DNA, 22 bp, Homo sapiens
gcacagcagctgctcagttgct

SEQ ID NO: 9493919 - DNA, 20 bp, Homo sapiens
gcacatgcaacttttattta

SEQ ID NO: 9493920 - DNA, 22 bp, Homo sapiens
gcacagaggtggaggacaaata

SEQ ID NO: 9493921 - DNA, 22 bp, Homo sapiens
gcacagaggtggaggacaaata

SEQ ID NO: 9493922 - DNA, 22 bp, Homo sapiens
gcacagagtcactagctaagca

SEQ ID NO: 9493923 - DNA, 22 bp, Homo sapiens
gcacagagtcactagctaagca

SEQ ID NO: 9493924 - DNA, 22 bp, Homo sapiens
gcacagagtcactagctaagca

SEQ ID NO: 9493925 - DNA, 22 bp, Homo sapiens
gcacagagtgggtgagatgtgg

SEQ ID NO: 9493926 - DNA, 22 bp, Homo sapiens
gcacagatggtactagcttggt

SEQ ID NO: 9493927 - DNA, 20 bp, Homo sapiens
gcacagagatgagcaaagta

SEQ ID NO: 9493928 - DNA, 20 bp, Homo sapiens
gcacagagatgagcaaagta

SEQ ID NO: 9493929 - DNA, 22 bp, Homo sapiens
gcacagagggcagtgagcctct

SEQ ID NO: 9493930 - DNA, 22 bp, Homo sapiens
gcacagagagggaaggtaactt

SEQ ID NO: 9493931 - DNA, 22 bp, Homo sapiens
gcacagagagggaaggtaactt

SEQ ID NO: 9493932 - DNA, 22 bp, Homo sapiens
gcacagagaggctgtgagcgcc

SEQ ID NO: 9493933 - DNA, 22 bp, Homo sapiens
gcacagagaggctgtgagcgcc

SEQ ID NO: 9493934 - DNA, 22 bp, Homo sapiens
gcacagagagcagtgggggaca

SEQ ID NO: 9493935 - DNA, 22 bp, Homo sapiens
gcacagagagcagtgggggaca

SEQ ID NO: 9493936 - DNA, 22 bp, Homo sapiens
gcacagagagcagtgggggaca

SEQ ID NO: 9493937 - DNA, 22 bp, Homo sapiens
gcacagagagcagtgggggaca

SEQ ID NO: 9493938 - DNA, 22 bp, Homo sapiens
gcacagaagtaaaatacaagtc

SEQ ID NO: 9493939 - DNA, 22 bp, Homo sapiens
gcacagaataacactctgggct

SEQ ID NO: 9493940 - DNA, 22 bp, Homo sapiens
gcacagaataacactctgggct

SEQ ID NO: 9493941 - DNA, 22 bp, Homo sapiens
gcacagacagaatccctactcc

SEQ ID NO: 9493942 - DNA, 22 bp, Homo sapiens
gcaatagagcagctaatggaaa

SEQ ID NO: 9493943 - DNA, 22 bp, Homo sapiens
gcaatagactgtttttattgtt

SEQ ID NO: 9493944 - DNA, 22 bp, Homo sapiens
gcaatagacttggttcttctgt

SEQ ID NO: 9493945 - DNA, 22 bp, Homo sapiens
gcacagaaccagacatgaggca

SEQ ID NO: 9493946 - DNA, 22 bp, Homo sapiens
gcacagaaccctatctttcgga

SEQ ID NO: 9493947 - DNA, 22 bp, Homo sapiens
gcacagaaccagacatgaggca

SEQ ID NO: 9493948 - DNA, 22 bp, Homo sapiens
gcacagaacttctcttagtagg

SEQ ID NO: 9493949 - DNA, 22 bp, Homo sapiens
gcacagaagagctttggaatga

SEQ ID NO: 9493950 - DNA, 18 bp, Homo sapiens
gcaaggctcaggccaggc

SEQ ID NO: 9493951 - DNA, 21 bp, Homo sapiens
gcaaggcctatcatggcagct

SEQ ID NO: 9493952 - DNA, 20 bp, Homo sapiens
gcaaggcaggttgaccaaga

SEQ ID NO: 9493953 - DNA, 20 bp, Homo sapiens
gcaaggcaggttgaccaaga

SEQ ID NO: 9493954 - DNA, 20 bp, Homo sapiens
gcaaggcacagtgaggaggg

SEQ ID NO: 9493955 - DNA, 20 bp, Homo sapiens
gcaaggcacagtgaggaggg

SEQ ID NO: 9493956 - DNA, 20 bp, Homo sapiens
gcaaggcacagtgaggaggg

SEQ ID NO: 9493957 - DNA, 21 bp, Homo sapiens
gcaaggcaatgccatgatttc

SEQ ID NO: 9493958 - DNA, 22 bp, Homo sapiens
gcaaggcagcgcggagtagcta

SEQ ID NO: 9493959 - DNA, 18 bp, Homo sapiens
gcaaggcagctctctggg

SEQ ID NO: 9493960 - DNA, 18 bp, Homo sapiens
gcaaggcagctctctggg

SEQ ID NO: 9493961 - DNA, 22 bp, Homo sapiens
gcaaggcagcgcggagtagcta

SEQ ID NO: 9493962 - DNA, 22 bp, Homo sapiens
gcaaggcagcgcggagtagcta

SEQ ID NO: 9493963 - DNA, 22 bp, Homo sapiens
gcaataaataacatggaagaca

SEQ ID NO: 9493964 - DNA, 22 bp, Homo sapiens
gcaataaagtagcagctcatca

SEQ ID NO: 9493965 - DNA, 22 bp, Homo sapiens
gcaataaataacatggaagaca

SEQ ID NO: 9493966 - DNA, 23 bp, Homo sapiens
gcaatacaagactggtcatgagc

SEQ ID NO: 9493967 - DNA, 22 bp, Homo sapiens
gcaatacagtaggtttattggt

SEQ ID NO: 9493968 - DNA, 22 bp, Homo sapiens
gcaatacagttgaagagattga

SEQ ID NO: 9493969 - DNA, 22 bp, Homo sapiens
gcaatacagtaggtttattggt

SEQ ID NO: 9493970 - DNA, 22 bp, Homo sapiens
gcaatacagtaggtttattggt

SEQ ID NO: 9493971 - DNA, 22 bp, Homo sapiens
gcaaggctcccgcagcccaggg

SEQ ID NO: 9493972 - DNA, 22 bp, Homo sapiens
gcaataaaatgtaatgattggg

SEQ ID NO: 9493973 - DNA, 22 bp, Homo sapiens
gcaataaaatgtaatgattggg

SEQ ID NO: 9493974 - DNA, 22 bp, Homo sapiens
gcaataaaatgtaatgattggg

SEQ ID NO: 9493975 - DNA, 22 bp, Homo sapiens
gcaataaactctctcaagccac

SEQ ID NO: 9493976 - DNA, 22 bp, Homo sapiens
gcaataaagattttactgtcag

SEQ ID NO: 9493977 - DNA, 22 bp, Homo sapiens
gcaataaagattttactgtcag

SEQ ID NO: 9493978 - DNA, 22 bp, Homo sapiens
gcaataaactctctcaagccac

SEQ ID NO: 9493979 - DNA, 22 bp, Homo sapiens
gagtattcaatatatacaaatg

SEQ ID NO: 9493980 - DNA, 22 bp, Homo sapiens
gagtagttgctgcagagaatac

SEQ ID NO: 9493981 - DNA, 22 bp, Homo sapiens
gcaaggaagcagagttgctatc

SEQ ID NO: 9493982 - DNA, 22 bp, Homo sapiens
gcaaggaagagcaggtggtgct

SEQ ID NO: 9493983 - DNA, 22 bp, Homo sapiens
gcaaggacctttgagcgtgcca

SEQ ID NO: 9493984 - DNA, 17 bp, Homo sapiens
gcaaggaagttctttgc

SEQ ID NO: 9493985 - DNA, 22 bp, Homo sapiens
gcaaggaagcagagttgctatc

SEQ ID NO: 9493986 - DNA, 21 bp, Homo sapiens
gcaaggcaatgccatgatttc

SEQ ID NO: 9493987 - DNA, 22 bp, Homo sapiens
gcaaggagcctggaggtgagtg

SEQ ID NO: 9493988 - DNA, 22 bp, Homo sapiens
gcaaggagcctggaggtgagtg

SEQ ID NO: 9493989 - DNA, 22 bp, Homo sapiens
gcaaggaggctggtggaggaag

SEQ ID NO: 9493990 - DNA, 22 bp, Homo sapiens
gcaaggagcctggaggtgagtg

SEQ ID NO: 9493991 - DNA, 22 bp, Homo sapiens
gcaaggagactgtagggccaag

SEQ ID NO: 9493992 - DNA, 22 bp, Homo sapiens
gcaaggagactgtagggccaag

SEQ ID NO: 9493993 - DNA, 22 bp, Homo sapiens
gcaaggagactgtagggccaag

SEQ ID NO: 9493994 - DNA, 22 bp, Homo sapiens
gcagcagcccagggctctcaga

SEQ ID NO: 9493995 - DNA, 22 bp, Homo sapiens
gcagccaccctcaaggctgaat

SEQ ID NO: 9493996 - DNA, 22 bp, Homo sapiens
gcagcagccactattctggcat

SEQ ID NO: 9493997 - DNA, 22 bp, Homo sapiens
gcagcagcccagggctctcaga

SEQ ID NO: 9493998 - DNA, 22 bp, Homo sapiens
gcagccagcccctctgacctct

SEQ ID NO: 9493999 - DNA, 22 bp, Homo sapiens
gcagccagcccctctgacctct

SEQ ID NO: 9494000 - DNA, 22 bp, Homo sapiens
gcagccagaagactcagaacaa

SEQ ID NO: 9494001 - DNA, 21 bp, Homo sapiens
gcagccagacgggattcagtt

SEQ ID NO: 9494002 - DNA, 22 bp, Homo sapiens
gcagccagcccctctgacctct

SEQ ID NO: 9494003 - DNA, 22 bp, Homo sapiens
gcagccagccctagtcccactt

SEQ ID NO: 9494004 - DNA, 22 bp, Homo sapiens
gcagccaggaaagctggaccct

SEQ ID NO: 9494005 - DNA, 21 bp, Homo sapiens
gcagccagccgagaccatgcc

SEQ ID NO: 9494006 - DNA, 22 bp, Homo sapiens
gcagccaggaaagctggaccct

SEQ ID NO: 9494007 - DNA, 22 bp, Homo sapiens
gcagccaggaaagctggaccct

SEQ ID NO: 9494008 - DNA, 22 bp, Homo sapiens
gcagcaagaggtgccatcttga

SEQ ID NO: 9494009 - DNA, 22 bp, Homo sapiens
gcagcaagaggtttctgttgac

SEQ ID NO: 9494010 - DNA, 22 bp, Homo sapiens
gcagcaaggatgaagcacttgg

SEQ ID NO: 9494011 - DNA, 22 bp, Homo sapiens
gcagcaagtctagtttgtaggc

SEQ ID NO: 9494012 - DNA, 22 bp, Homo sapiens
gcagcaatcttcacagtgtcat

SEQ ID NO: 9494013 - DNA, 19 bp, Homo sapiens
gcagcaatagaagacaaat

SEQ ID NO: 9494014 - DNA, 22 bp, Homo sapiens
gcagcaatcccaagtctgagtg

SEQ ID NO: 9494015 - DNA, 22 bp, Homo sapiens
gcagcaagtctagtttgtaggc

SEQ ID NO: 9494016 - DNA, 22 bp, Homo sapiens
gcagcacaaagtccccagggac

SEQ ID NO: 9494017 - DNA, 22 bp, Homo sapiens
gcagcacacggtggtgccctgg

SEQ ID NO: 9494018 - DNA, 22 bp, Homo sapiens
gcagcacatataaacaaagaga

SEQ ID NO: 9494019 - DNA, 22 bp, Homo sapiens
gcagcacatataaacaaagaga

SEQ ID NO: 9494020 - DNA, 22 bp, Homo sapiens
gcagcagaaggccaaggggagc

SEQ ID NO: 9494021 - DNA, 22 bp, Homo sapiens
gcagcactgtcttgtcttagga

SEQ ID NO: 9494022 - DNA, 22 bp, Homo sapiens
gcagcagcagggagtctgactt

SEQ ID NO: 9494023 - DNA, 22 bp, Homo sapiens
gcagcagcagggagtctgactt

SEQ ID NO: 9494024 - DNA, 19 bp, Homo sapiens
gcagcagcatttggtaata

SEQ ID NO: 9494025 - DNA, 22 bp, Homo sapiens
gcagcagccactattctggcat

SEQ ID NO: 9494026 - DNA, 22 bp, Homo sapiens
gcagcagcaggcgctcggccgt

SEQ ID NO: 9494027 - DNA, 22 bp, Homo sapiens
gcagcagcaggcgctcggccgt

SEQ ID NO: 9494028 - DNA, 22 bp, Homo sapiens
gcagcagcagcaattttctgtc

SEQ ID NO: 9494029 - DNA, 22 bp, Homo sapiens
gcagcagcaggcgctcggccgt

SEQ ID NO: 9494030 - DNA, 22 bp, Homo sapiens
gcagcagcagcaattttctgtc

SEQ ID NO: 9494031 - DNA, 22 bp, Homo sapiens
gcagcagcaagaaggttggact

SEQ ID NO: 9494032 - DNA, 22 bp, Homo sapiens
gcagcagattgttttttcacct

SEQ ID NO: 9494033 - DNA, 22 bp, Homo sapiens
gcagcagaaggccaaggggagc

SEQ ID NO: 9494034 - DNA, 22 bp, Homo sapiens
gcagcagaagtagaagtacagg

SEQ ID NO: 9494035 - DNA, 22 bp, Homo sapiens
gcagcagaagtagaagtacagg

SEQ ID NO: 9494036 - DNA, 22 bp, Homo sapiens
gcagcagatgtgggcccagagc

SEQ ID NO: 9494037 - DNA, 22 bp, Homo sapiens
gcagctgggacactgaggccag

SEQ ID NO: 9494038 - DNA, 22 bp, Homo sapiens
gcagctggggaggtcgtgggga

SEQ ID NO: 9494039 - DNA, 22 bp, Homo sapiens
gcagctggggaggtcgtgggga

SEQ ID NO: 9494040 - DNA, 22 bp, Homo sapiens
gcagctggggccacacttaggc

SEQ ID NO: 9494041 - DNA, 22 bp, Homo sapiens
gcagctggggccacacttaggc

SEQ ID NO: 9494042 - DNA, 22 bp, Homo sapiens
gcagctgggtctgtgtgggctg

SEQ ID NO: 9494043 - DNA, 22 bp, Homo sapiens
gcagctgggtctgtgtgggctg

SEQ ID NO: 9494044 - DNA, 21 bp, Homo sapiens
gcagctggtctcagagcttgc

SEQ ID NO: 9494045 - DNA, 21 bp, Homo sapiens
gcagctggtctcagagcttgc

SEQ ID NO: 9494046 - DNA, 21 bp, Homo sapiens
gcagctggtctcagagcttgc

SEQ ID NO: 9494047 - DNA, 21 bp, Homo sapiens
gcagctggtctcagagcttgc

SEQ ID NO: 9494048 - DNA, 22 bp, Homo sapiens
gcagctggtgcaaatgtcactc

SEQ ID NO: 9494049 - DNA, 22 bp, Homo sapiens
gcagctggtgcaaatgtcactc

SEQ ID NO: 9494050 - DNA, 22 bp, Homo sapiens
gcagctggtgcaaatgtcactc

SEQ ID NO: 9494051 - DNA, 22 bp, Homo sapiens
gcagctggtctggcctagagta

SEQ ID NO: 9494052 - DNA, 22 bp, Homo sapiens
gcagctggtctggcctagagta

SEQ ID NO: 9494053 - DNA, 22 bp, Homo sapiens
gcagctggttaatgggagaatt

SEQ ID NO: 9494054 - DNA, 22 bp, Homo sapiens
gcagctggttaatgggagaatt

SEQ ID NO: 9494055 - DNA, 22 bp, Homo sapiens
gcagctggttaatgggagaatt

SEQ ID NO: 9494056 - DNA, 22 bp, Homo sapiens
gcagctggtgcaaatgtcactc

SEQ ID NO: 9494057 - DNA, 22 bp, Homo sapiens
gcagctggttaatgggagaatt

SEQ ID NO: 9494058 - DNA, 23 bp, Homo sapiens
gcagctggttagaagggaaggag

SEQ ID NO: 9494059 - DNA, 22 bp, Homo sapiens
gcagcccacagctggaggccta

SEQ ID NO: 9494060 - DNA, 22 bp, Homo sapiens
gcagctggccctgacacgcaga

SEQ ID NO: 9494061 - DNA, 22 bp, Homo sapiens
gcagctggccctgacacgcaga

SEQ ID NO: 9494062 - DNA, 22 bp, Homo sapiens
gcagcccaatggactgagacag

SEQ ID NO: 9494063 - DNA, 22 bp, Homo sapiens
gcagcccaatggactgagacag

SEQ ID NO: 9494064 - DNA, 22 bp, Homo sapiens
gcagctggctctgggaaaaact

SEQ ID NO: 9494065 - DNA, 22 bp, Homo sapiens
gcagctggctcagagaggtggg

SEQ ID NO: 9494066 - DNA, 22 bp, Homo sapiens
gcagctggctcagagaggtggg

SEQ ID NO: 9494067 - DNA, 22 bp, Homo sapiens
gcagctggctcagagaggtggg

SEQ ID NO: 9494068 - DNA, 22 bp, Homo sapiens
gcagctggctctgggaaaaact

SEQ ID NO: 9494069 - DNA, 22 bp, Homo sapiens
gcagctgggacactgaggccag

SEQ ID NO: 9494070 - DNA, 22 bp, Homo sapiens
gcagcccaaaaaagaggtagat

SEQ ID NO: 9494071 - DNA, 22 bp, Homo sapiens
gcagccagtgggatgagaaaga

SEQ ID NO: 9494072 - DNA, 22 bp, Homo sapiens
gcagcccaagcctgagcatcct

SEQ ID NO: 9494073 - DNA, 22 bp, Homo sapiens
gcagccaggaagcccaggacac

SEQ ID NO: 9494074 - DNA, 22 bp, Homo sapiens
gcagccaggtttgaggaccact

SEQ ID NO: 9494075 - DNA, 22 bp, Homo sapiens
gcagccaggaagcccaggacac

SEQ ID NO: 9494076 - DNA, 22 bp, Homo sapiens
gcagccaggaagcccaggacac

SEQ ID NO: 9494077 - DNA, 17 bp, Homo sapiens
gcagccagtgcagcagg

SEQ ID NO: 9494078 - DNA, 22 bp, Homo sapiens
gcagccagtatcctctgagatt

SEQ ID NO: 9494079 - DNA, 22 bp, Homo sapiens
gcagccagtatcctctgagatt

SEQ ID NO: 9494080 - DNA, 17 bp, Homo sapiens
gcagccagtgcagcagg

SEQ ID NO: 9494081 - DNA, 17 bp, Homo sapiens
gcagccagtgcagcagg

SEQ ID NO: 9494082 - DNA, 22 bp, Homo sapiens
gcagggcagcttagtccctgtc

SEQ ID NO: 9494083 - DNA, 22 bp, Homo sapiens
gcagggcagcttagtccctgtc

SEQ ID NO: 9494084 - DNA, 22 bp, Homo sapiens
gcagggcagctgaagctaggtg

SEQ ID NO: 9494085 - DNA, 22 bp, Homo sapiens
gcagggcagctgaagctaggtg

SEQ ID NO: 9494086 - DNA, 22 bp, Homo sapiens
gcagggcagctcactgtggttc

SEQ ID NO: 9494087 - DNA, 22 bp, Homo sapiens
gcagggcagctgaagctaggtg

SEQ ID NO: 9494088 - DNA, 22 bp, Homo sapiens
gcagggcagctcactgtggttc

SEQ ID NO: 9494089 - DNA, 22 bp, Homo sapiens
gcagggcagctcactgtggttc

SEQ ID NO: 9494090 - DNA, 22 bp, Homo sapiens
gcagggcagctcactgtggttc

SEQ ID NO: 9494091 - DNA, 22 bp, Homo sapiens
gcagggcagccacaggccccct

SEQ ID NO: 9494092 - DNA, 22 bp, Homo sapiens
gcagggcagccacaggccccct

SEQ ID NO: 9494093 - DNA, 22 bp, Homo sapiens
gcaggcctcccctgctggagct

SEQ ID NO: 9494094 - DNA, 22 bp, Homo sapiens
gcaggcctcccctgctggagct

SEQ ID NO: 9494095 - DNA, 22 bp, Homo sapiens
gcaggcctcccctgctggagct

SEQ ID NO: 9494096 - DNA, 22 bp, Homo sapiens
gcaggcccttagccttggtggg

SEQ ID NO: 9494097 - DNA, 22 bp, Homo sapiens
gcaggcctaagagaaggcattg

SEQ ID NO: 9494098 - DNA, 22 bp, Homo sapiens
gcaggcctaagagaaggcattg

SEQ ID NO: 9494099 - DNA, 18 bp, Homo sapiens
gcaggcctagaacttggt

SEQ ID NO: 9494100 - DNA, 20 bp, Homo sapiens
gcaggccctctctctagtct

SEQ ID NO: 9494101 - DNA, 22 bp, Homo sapiens
gcaggcccttagccttggtggg

SEQ ID NO: 9494102 - DNA, 18 bp, Homo sapiens
gcaggccctgtttctggg

SEQ ID NO: 9494103 - DNA, 19 bp, Homo sapiens
gcaggcccagtcgggctgg

SEQ ID NO: 9494104 - DNA, 19 bp, Homo sapiens
gcaggcccagtcgggctgg

SEQ ID NO: 9494105 - DNA, 22 bp, Homo sapiens
gcaggccctcctctagcaaggc

SEQ ID NO: 9494106 - DNA, 22 bp, Homo sapiens
gcaggcccagagtcgctggcct

SEQ ID NO: 9494107 - DNA, 22 bp, Homo sapiens
gcaggcccagagtcgctggcct

SEQ ID NO: 9494108 - DNA, 22 bp, Homo sapiens
gcaggccattcaggagatgtgc

SEQ ID NO: 9494109 - DNA, 22 bp, Homo sapiens
gcaggccacagtggagtctctg

SEQ ID NO: 9494110 - DNA, 22 bp, Homo sapiens
gcaggccactgtctcctctggg

SEQ ID NO: 9494111 - DNA, 22 bp, Homo sapiens
gcaggccacagtggagtctctg

SEQ ID NO: 9494112 - DNA, 22 bp, Homo sapiens
gcaggccacagtggagtctctg

SEQ ID NO: 9494113 - DNA, 22 bp, Homo sapiens
gcaggccagctgtgcagatggg

SEQ ID NO: 9494114 - DNA, 22 bp, Homo sapiens
gcaggcatggtcgctgccaggt

SEQ ID NO: 9494115 - DNA, 22 bp, Homo sapiens
gcaggccaagccctcgcagaga

SEQ ID NO: 9494116 - DNA, 22 bp, Homo sapiens
gcaggccaagccctcgcagaga

SEQ ID NO: 9494117 - DNA, 22 bp, Homo sapiens
gcaggcatggtcgctgccaggt

SEQ ID NO: 9494118 - DNA, 22 bp, Homo sapiens
gcagctgtactggcagcattgt

SEQ ID NO: 9494119 - DNA, 22 bp, Homo sapiens
gcagctgtagaggggagaaaga

SEQ ID NO: 9494120 - DNA, 22 bp, Homo sapiens
gcagctgtagaggggagaaaga

SEQ ID NO: 9494121 - DNA, 22 bp, Homo sapiens
gcagctgtaaagcagaaatagt

SEQ ID NO: 9494122 - DNA, 22 bp, Homo sapiens
gcagctgtactggcagcattgt

SEQ ID NO: 9494123 - DNA, 22 bp, Homo sapiens
gcagctgtcagaagttggaatc

SEQ ID NO: 9494124 - DNA, 22 bp, Homo sapiens
gcagctgtcagaagttggaatc

SEQ ID NO: 9494125 - DNA, 22 bp, Homo sapiens
gcagctgtcactttcacaatgc

SEQ ID NO: 9494126 - DNA, 22 bp, Homo sapiens
gcagctgtatcacttttaaaca

SEQ ID NO: 9494127 - DNA, 22 bp, Homo sapiens
gcagctgtatcacttttaaaca

SEQ ID NO: 9494128 - DNA, 22 bp, Homo sapiens
gcagctgtcactttcacaatgc

SEQ ID NO: 9494129 - DNA, 22 bp, Homo sapiens
gcagggcatgggccctgtctgc

SEQ ID NO: 9494130 - DNA, 22 bp, Homo sapiens
gcagggcatgggccctgtctgc

SEQ ID NO: 9494131 - DNA, 22 bp, Homo sapiens
gcagggccagggctcaggctgt

SEQ ID NO: 9494132 - DNA, 22 bp, Homo sapiens
gcagggcagggcaagaactggg

SEQ ID NO: 9494133 - DNA, 22 bp, Homo sapiens
gcagggcagggcaagaactggg

SEQ ID NO: 9494134 - DNA, 22 bp, Homo sapiens
gcagggcagtaagagctagagt

SEQ ID NO: 9494135 - DNA, 22 bp, Homo sapiens
gcagggcagcttagtccctgtc

SEQ ID NO: 9494136 - DNA, 22 bp, Homo sapiens
gcagggcagcttagtccctgtc

SEQ ID NO: 9494137 - DNA, 22 bp, Homo sapiens
gcagggcaggatttgaacccag

SEQ ID NO: 9494138 - DNA, 22 bp, Homo sapiens
gcagggcagggcaagaactggg

SEQ ID NO: 9494139 - DNA, 19 bp, Homo sapiens
gcagggtggcagagctctt

SEQ ID NO: 9494140 - DNA, 19 bp, Homo sapiens
gcagggtggcagagctctt

SEQ ID NO: 9494141 - DNA, 22 bp, Homo sapiens
gcagggccttagcagcggctgc

SEQ ID NO: 9494142 - DNA, 19 bp, Homo sapiens
gcagggtggcagagctctt

SEQ ID NO: 9494143 - DNA, 22 bp, Homo sapiens
gcagggtgtgtctcatacagtt

SEQ ID NO: 9494144 - DNA, 19 bp, Homo sapiens
gcaggtagagacagcagcc

SEQ ID NO: 9494145 - DNA, 19 bp, Homo sapiens
gcaggtagagacagcagcc

SEQ ID NO: 9494146 - DNA, 21 bp, Homo sapiens
gcagggtttgtgctgtgagtt

SEQ ID NO: 9494147 - DNA, 19 bp, Homo sapiens
gcagggtgttgactgtccc

SEQ ID NO: 9494148 - DNA, 19 bp, Homo sapiens
gcagggtgttgactgtccc

SEQ ID NO: 9494149 - DNA, 22 bp, Homo sapiens
gcaggtctagaagctgcctctg

SEQ ID NO: 9494150 - DNA, 22 bp, Homo sapiens
gcaggtctagaagctgcctctg

SEQ ID NO: 9494151 - DNA, 22 bp, Homo sapiens
gcaggtctagaagctgcctctg

SEQ ID NO: 9494152 - DNA, 19 bp, Homo sapiens
gcaggtcattaggctaggt

SEQ ID NO: 9494153 - DNA, 19 bp, Homo sapiens
gcaggtcattaggctaggt

SEQ ID NO: 9494154 - DNA, 22 bp, Homo sapiens
gcaggtccagtcaccagagaga

SEQ ID NO: 9494155 - DNA, 22 bp, Homo sapiens
gcaggtctcaatctgagcaggc

SEQ ID NO: 9494156 - DNA, 22 bp, Homo sapiens
gcaggtctggagggcactgggg

SEQ ID NO: 9494157 - DNA, 22 bp, Homo sapiens
gcaggtctggagggcactgggg

SEQ ID NO: 9494158 - DNA, 22 bp, Homo sapiens
gcaggtctatcaggctgcaggt

SEQ ID NO: 9494159 - DNA, 22 bp, Homo sapiens
gcaggtctcaatctgagcaggc

SEQ ID NO: 9494160 - DNA, 22 bp, Homo sapiens
gcaggtctcaatctgagcaggc

SEQ ID NO: 9494161 - DNA, 22 bp, Homo sapiens
gcaggtctcaatctgagcaggc

SEQ ID NO: 9494162 - DNA, 22 bp, Homo sapiens
gcaggtcttgaaggtgtgattt

SEQ ID NO: 9494163 - DNA, 22 bp, Homo sapiens
gcaggtctggagggcactgggg

SEQ ID NO: 9494164 - DNA, 22 bp, Homo sapiens
gcaggtctgttgattacagtca

SEQ ID NO: 9494165 - DNA, 22 bp, Homo sapiens
gcaggtctggcatagagcctgc

SEQ ID NO: 9494166 - DNA, 22 bp, Homo sapiens
gcaggtgatgtgatgtgagcat

SEQ ID NO: 9494167 - DNA, 22 bp, Homo sapiens
gcaggtgatgtgatgtgagcat

SEQ ID NO: 9494168 - DNA, 22 bp, Homo sapiens
gcaggtgaatgatggactagga

SEQ ID NO: 9494169 - DNA, 22 bp, Homo sapiens
gcaggtgaaagtgagtagtgag

SEQ ID NO: 9494170 - DNA, 22 bp, Homo sapiens
gcaggtgaatgatggactagga

SEQ ID NO: 9494171 - DNA, 22 bp, Homo sapiens
gccagaaacatacacatcactt

SEQ ID NO: 9494172 - DNA, 22 bp, Homo sapiens
gccagaaggggtggatccaggc

SEQ ID NO: 9494173 - DNA, 22 bp, Homo sapiens
gccagaagcacatgagaggtga

SEQ ID NO: 9494174 - DNA, 22 bp, Homo sapiens
gccagaaggggtggatccaggc

SEQ ID NO: 9494175 - DNA, 22 bp, Homo sapiens
gccagaaggggtggatccaggc

SEQ ID NO: 9494176 - DNA, 22 bp, Homo sapiens
gccagaagactggagtcagctg

SEQ ID NO: 9494177 - DNA, 22 bp, Homo sapiens
gccagaagactggagtcagctg

SEQ ID NO: 9494178 - DNA, 22 bp, Homo sapiens
gccagctgaggccgtgcaggct

SEQ ID NO: 9494179 - DNA, 22 bp, Homo sapiens
gccagctgagcaaattccagct

SEQ ID NO: 9494180 - DNA, 22 bp, Homo sapiens
gccagctgagaaatcattgata

SEQ ID NO: 9494181 - DNA, 22 bp, Homo sapiens
gccagacactcccctgggcagg

SEQ ID NO: 9494182 - DNA, 22 bp, Homo sapiens
gccagagacacttggaggtaga

SEQ ID NO: 9494183 - DNA, 22 bp, Homo sapiens
gccagctgtaagctggggtgat

SEQ ID NO: 9494184 - DNA, 22 bp, Homo sapiens
gccagctgtatctttggccagc

SEQ ID NO: 9494185 - DNA, 22 bp, Homo sapiens
gccagctggtaggcacctagcc

SEQ ID NO: 9494186 - DNA, 22 bp, Homo sapiens
gccagctggtaggcacctagcc

SEQ ID NO: 9494187 - DNA, 22 bp, Homo sapiens
gccagctggtaggcacctagcc

SEQ ID NO: 9494188 - DNA, 22 bp, Homo sapiens
gccagctgggccttagggctgg

SEQ ID NO: 9494189 - DNA, 22 bp, Homo sapiens
gccagctggctgcaggtcccag

SEQ ID NO: 9494190 - DNA, 22 bp, Homo sapiens
gccagctggctgcaggtcccag

SEQ ID NO: 9494191 - DNA, 22 bp, Homo sapiens
gccagctggctgcaggtcccag

SEQ ID NO: 9494192 - DNA, 22 bp, Homo sapiens
gccagctgaggccgtgcaggct

SEQ ID NO: 9494193 - DNA, 22 bp, Homo sapiens
gccagctgcaaagtatgttgaa

SEQ ID NO: 9494194 - DNA, 22 bp, Homo sapiens
gccagcttggccagtggccagt

SEQ ID NO: 9494195 - DNA, 22 bp, Homo sapiens
gccagctttggcacagggtggt

SEQ ID NO: 9494196 - DNA, 17 bp, Homo sapiens
gccagcttgagggccat

SEQ ID NO: 9494197 - DNA, 22 bp, Homo sapiens
gccagcttccatggccacgtca

SEQ ID NO: 9494198 - DNA, 22 bp, Homo sapiens
gccagctgtttcagagcccagt

SEQ ID NO: 9494199 - DNA, 22 bp, Homo sapiens
gccaggaaagcaaaatcaccca

SEQ ID NO: 9494200 - DNA, 22 bp, Homo sapiens
gccaggaaagccactggcatac

SEQ ID NO: 9494201 - DNA, 19 bp, Homo sapiens
gccaggaaagaatcaggcg

SEQ ID NO: 9494202 - DNA, 22 bp, Homo sapiens
gccaggaaaaaccggccctgct

SEQ ID NO: 9494203 - DNA, 22 bp, Homo sapiens
gccagcttttgaccccgttgtg

SEQ ID NO: 9494204 - DNA, 23 bp, Homo sapiens
gccagctttggtctgtctcctag

SEQ ID NO: 9494205 - DNA, 22 bp, Homo sapiens
gccaggaaagggaattccctga

SEQ ID NO: 9494206 - DNA, 22 bp, Homo sapiens
gccaggaaattcatgccagatc

SEQ ID NO: 9494207 - DNA, 22 bp, Homo sapiens
gccaggaacacaatgccaagct

SEQ ID NO: 9494208 - DNA, 22 bp, Homo sapiens
gccaggaagagagagccctcca

SEQ ID NO: 9494209 - DNA, 22 bp, Homo sapiens
gccaggaagtgcagccctgcca

SEQ ID NO: 9494210 - DNA, 22 bp, Homo sapiens
gccaggaagtcagccaagccca

SEQ ID NO: 9494211 - DNA, 22 bp, Homo sapiens
gccaggaaggctgaagccagaa

SEQ ID NO: 9494212 - DNA, 22 bp, Homo sapiens
gccaggaaggctccctggtcac

SEQ ID NO: 9494213 - DNA, 22 bp, Homo sapiens
gcccaagactgtacagttaaag

SEQ ID NO: 9494214 - DNA, 22 bp, Homo sapiens
gcccaagacatttagtaaagag

SEQ ID NO: 9494215 - DNA, 22 bp, Homo sapiens
gcccaaagccagtgtgctctcc

SEQ ID NO: 9494216 - DNA, 22 bp, Homo sapiens
gcccaaagtcactcagctagga

SEQ ID NO: 9494217 - DNA, 22 bp, Homo sapiens
gcccaagatcacactggaaatc

SEQ ID NO: 9494218 - DNA, 22 bp, Homo sapiens
gcccaagatctggagctgcagg

SEQ ID NO: 9494219 - DNA, 22 bp, Homo sapiens
gcccaagcagcttcccgagctt

SEQ ID NO: 9494220 - DNA, 22 bp, Homo sapiens
gccattttctgtcttgtttatt

SEQ ID NO: 9494221 - DNA, 22 bp, Homo sapiens
gccattttgaaaaccgttgcta

SEQ ID NO: 9494222 - DNA, 22 bp, Homo sapiens
gcccaaagagctttgatctcag

SEQ ID NO: 9494223 - DNA, 23 bp, Homo sapiens
gccaggctccggtctgtggccac

SEQ ID NO: 9494224 - DNA, 23 bp, Homo sapiens
gccaggctccggtctgtggccac

SEQ ID NO: 9494225 - DNA, 21 bp, Homo sapiens
gccatttcacacagacatttg

SEQ ID NO: 9494226 - DNA, 22 bp, Homo sapiens
gcccaagccggagctgggagag

SEQ ID NO: 9494227 - DNA, 22 bp, Homo sapiens
gcccaagccggagctgggagag

SEQ ID NO: 9494228 - DNA, 22 bp, Homo sapiens
gcccaagccggagctgggagag

SEQ ID NO: 9494229 - DNA, 22 bp, Homo sapiens
gcccaagccgccttccagagac

SEQ ID NO: 9494230 - DNA, 22 bp, Homo sapiens
gcccaagctggactgcagtggc

SEQ ID NO: 9494231 - DNA, 20 bp, Homo sapiens
gcccaagcgccggccgcaga

SEQ ID NO: 9494232 - DNA, 20 bp, Homo sapiens
gcccaagcgccggccgcaga

SEQ ID NO: 9494233 - DNA, 22 bp, Homo sapiens
gcccaaggtatatcagagacag

SEQ ID NO: 9494234 - DNA, 22 bp, Homo sapiens
gcccaaggtatatcagagacag

SEQ ID NO: 9494235 - DNA, 22 bp, Homo sapiens
gcccaaggtatatcagagacag

SEQ ID NO: 9494236 - DNA, 22 bp, Homo sapiens
gcccaaggtcacacacaggaag

SEQ ID NO: 9494237 - DNA, 20 bp, Homo sapiens
gcccaaggtccagaaggggg

SEQ ID NO: 9494238 - DNA, 22 bp, Homo sapiens
gccaggcattattccgatccct

SEQ ID NO: 9494239 - DNA, 22 bp, Homo sapiens
gccaggcattattccgatccct

SEQ ID NO: 9494240 - DNA, 22 bp, Homo sapiens
gccaggcgggtctcaaactcct

SEQ ID NO: 9494241 - DNA, 22 bp, Homo sapiens
gccaggctaagaaaggtgtgat

SEQ ID NO: 9494242 - DNA, 22 bp, Homo sapiens
gccaggctcagcagtcaacctg

SEQ ID NO: 9494243 - DNA, 22 bp, Homo sapiens
gccaggctaagaaaggtgtgat

SEQ ID NO: 9494244 - DNA, 22 bp, Homo sapiens
gccaggctaagaaaggtgtgat

SEQ ID NO: 9494245 - DNA, 22 bp, Homo sapiens
gccaggctccccggatccctgg

SEQ ID NO: 9494246 - DNA, 19 bp, Homo sapiens
gccaggctccatagccggc

SEQ ID NO: 9494247 - DNA, 22 bp, Homo sapiens
gccaggctccaggccctcctga

SEQ ID NO: 9494248 - DNA, 22 bp, Homo sapiens
gccaggctcagtagcgattcct

SEQ ID NO: 9494249 - DNA, 22 bp, Homo sapiens
gccaggctccaggccctcctga

SEQ ID NO: 9494250 - DNA, 22 bp, Homo sapiens
gcagttttattatgatggaaat

SEQ ID NO: 9494251 - DNA, 22 bp, Homo sapiens
gcagtttctgaatttatccaag

SEQ ID NO: 9494252 - DNA, 22 bp, Homo sapiens
gcagtttcagacatatctccat

SEQ ID NO: 9494253 - DNA, 22 bp, Homo sapiens
gcagtttagtagatgacattat

SEQ ID NO: 9494254 - DNA, 21 bp, Homo sapiens
gcagtttatgtaatatgcact

SEQ ID NO: 9494255 - DNA, 21 bp, Homo sapiens
gcagtttatgtaatatgcact

SEQ ID NO: 9494256 - DNA, 21 bp, Homo sapiens
gcagtttatgtaatatgcact

SEQ ID NO: 9494257 - DNA, 19 bp, Homo sapiens
gcataaaatgtcaatgtgt

SEQ ID NO: 9494258 - DNA, 19 bp, Homo sapiens
gcataaaatgtcaatgtgt

SEQ ID NO: 9494259 - DNA, 22 bp, Homo sapiens
gcattagaaactattgctgcaa

SEQ ID NO: 9494260 - DNA, 22 bp, Homo sapiens
gcattcttcgaagtaagtagtg

SEQ ID NO: 9494261 - DNA, 22 bp, Homo sapiens
gcattcttgaggtgtggactca

SEQ ID NO: 9494262 - DNA, 22 bp, Homo sapiens
gcattcttgtttttcctaccct

SEQ ID NO: 9494263 - DNA, 22 bp, Homo sapiens
gcattcttgtttttcctaccct

SEQ ID NO: 9494264 - DNA, 21 bp, Homo sapiens
gcattcttcatgtgattcaga

SEQ ID NO: 9494265 - DNA, 21 bp, Homo sapiens
gcattcttcatgtgattcaga

SEQ ID NO: 9494266 - DNA, 22 bp, Homo sapiens
gcattcttcacagtattcctcc

SEQ ID NO: 9494267 - DNA, 22 bp, Homo sapiens
gcattgaaatggcaaaaagaga

SEQ ID NO: 9494268 - DNA, 22 bp, Homo sapiens
gcaggtgattcaccctgggcct

SEQ ID NO: 9494269 - DNA, 23 bp, Homo sapiens
gcagtgtttgcttcatcttatcc

SEQ ID NO: 9494270 - DNA, 22 bp, Homo sapiens
gcagtgtttacatattagaaac

SEQ ID NO: 9494271 - DNA, 22 bp, Homo sapiens
gcagttggcagggagcccagat

SEQ ID NO: 9494272 - DNA, 22 bp, Homo sapiens
gcagttggcagggagcccagat

SEQ ID NO: 9494273 - DNA, 22 bp, Homo sapiens
gcagtttagtagatgacattat

SEQ ID NO: 9494274 - DNA, 16 bp, Homo sapiens
gcagttggggagagct

SEQ ID NO: 9494275 - DNA, 22 bp, Homo sapiens
gcagtttactgtcaataactct

SEQ ID NO: 9494276 - DNA, 22 bp, Homo sapiens
gcagttcctacagtggaaagcg

SEQ ID NO: 9494277 - DNA, 22 bp, Homo sapiens
gcagtgtttgtgttctcacatg

SEQ ID NO: 9494278 - DNA, 22 bp, Homo sapiens
gccacctgccaacttgctggaa

SEQ ID NO: 9494279 - DNA, 22 bp, Homo sapiens
gccacctggacagctgtgccct

SEQ ID NO: 9494280 - DNA, 22 bp, Homo sapiens
gccacctgcgggccgtggtgga

SEQ ID NO: 9494281 - DNA, 22 bp, Homo sapiens
gccacctgcgggccgtggtgga

SEQ ID NO: 9494282 - DNA, 22 bp, Homo sapiens
gccacctggacagctgtgccct

SEQ ID NO: 9494283 - DNA, 22 bp, Homo sapiens
gccacctggacagctgtgccct

SEQ ID NO: 9494284 - DNA, 22 bp, Homo sapiens
gccacctgtgtgggcctttgtg

SEQ ID NO: 9494285 - DNA, 22 bp, Homo sapiens
gccacctggactcagagccagg

SEQ ID NO: 9494286 - DNA, 22 bp, Homo sapiens
gccactgttgctcctcaggaaa

SEQ ID NO: 9494287 - DNA, 22 bp, Homo sapiens
gccactgttgctcctcaggaaa

SEQ ID NO: 9494288 - DNA, 22 bp, Homo sapiens
gccactgtgttgatctagcctg

SEQ ID NO: 9494289 - DNA, 22 bp, Homo sapiens
gccacctgtttcgcttgcccag

SEQ ID NO: 9494290 - DNA, 22 bp, Homo sapiens
gccacctgtttcagatgtggtt

SEQ ID NO: 9494291 - DNA, 22 bp, Homo sapiens
gccacctgtttcagatgtggtt

SEQ ID NO: 9494292 - DNA, 20 bp, Homo sapiens
gccactgtgcttacactgct

SEQ ID NO: 9494293 - DNA, 21 bp, Homo sapiens
gccactgtgcacactaaccca

SEQ ID NO: 9494294 - DNA, 21 bp, Homo sapiens
gccactgtgcacactaaccca

SEQ ID NO: 9494295 - DNA, 23 bp, Homo sapiens
gccacctcctggtcagaaagagg

SEQ ID NO: 9494296 - DNA, 22 bp, Homo sapiens
gccacctcggctttctctgctc

SEQ ID NO: 9494297 - DNA, 22 bp, Homo sapiens
gccacctccttattccacctgt

SEQ ID NO: 9494298 - DNA, 22 bp, Homo sapiens
gccaccctggacgcactgttcg

SEQ ID NO: 9494299 - DNA, 22 bp, Homo sapiens
gcattgcaactgacagatcatt

SEQ ID NO: 9494300 - DNA, 22 bp, Homo sapiens
gcattgcaactgacagatcatt

SEQ ID NO: 9494301 - DNA, 22 bp, Homo sapiens
gcattgattctgaagtgaaatg

SEQ ID NO: 9494302 - DNA, 22 bp, Homo sapiens
gcattgattctgaagtgaaatg

SEQ ID NO: 9494303 - DNA, 22 bp, Homo sapiens
gcattgatttaaacatctctct

SEQ ID NO: 9494304 - DNA, 23 bp, Homo sapiens
gcattgtagaatgtttagcagca

SEQ ID NO: 9494305 - DNA, 22 bp, Homo sapiens
gcattggcatttctccagcgga

SEQ ID NO: 9494306 - DNA, 22 bp, Homo sapiens
gcattgtcctgcttctgagtgt

SEQ ID NO: 9494307 - DNA, 22 bp, Homo sapiens
gcatttaaatttgaacttcaga

SEQ ID NO: 9494308 - DNA, 22 bp, Homo sapiens
gcatttaaatttgaacttcaga

SEQ ID NO: 9494309 - DNA, 22 bp, Homo sapiens
gcatttagctttaaaatatttc

SEQ ID NO: 9494310 - DNA, 22 bp, Homo sapiens
gcatttagctttaaaatatttc

SEQ ID NO: 9494311 - DNA, 22 bp, Homo sapiens
gcatttacatggagctatctaa

SEQ ID NO: 9494312 - DNA, 23 bp, Homo sapiens
gcatttacagactcacttttcta

SEQ ID NO: 9494313 - DNA, 18 bp, Homo sapiens
gcatttatgcggggctac

SEQ ID NO: 9494314 - DNA, 22 bp, Homo sapiens
gcatttatattctgttcggata

SEQ ID NO: 9494315 - DNA, 22 bp, Homo sapiens
gcatttatttctttactgcatc

SEQ ID NO: 9494316 - DNA, 22 bp, Homo sapiens
gcatttattatctgccaggcac

SEQ ID NO: 9494317 - DNA, 22 bp, Homo sapiens
gcatttcatgccgtggaagtcc

SEQ ID NO: 9494318 - DNA, 19 bp, Homo sapiens
gcatttcaggcatgtttgc

SEQ ID NO: 9494319 - DNA, 18 bp, Homo sapiens
gcctgcaggcacgggggt

SEQ ID NO: 9494320 - DNA, 22 bp, Homo sapiens
gcctgcagcctcagagaatttt

SEQ ID NO: 9494321 - DNA, 22 bp, Homo sapiens
gcctgcagcctcaagggctgag

SEQ ID NO: 9494322 - DNA, 22 bp, Homo sapiens
gcctgcagcccctctgcagtag

SEQ ID NO: 9494323 - DNA, 22 bp, Homo sapiens
gcctgcagcccctctgcagtag

SEQ ID NO: 9494324 - DNA, 22 bp, Homo sapiens
gcctgcagaggtgctgctagct

SEQ ID NO: 9494325 - DNA, 20 bp, Homo sapiens
gcctgcagagaaggtcagag

SEQ ID NO: 9494326 - DNA, 19 bp, Homo sapiens
gcctgcagaaaaggcaggg

SEQ ID NO: 9494327 - DNA, 19 bp, Homo sapiens
gcctgcagaaaaggcaggg

SEQ ID NO: 9494328 - DNA, 21 bp, Homo sapiens
gcctgcacacagtaggtgcac

SEQ ID NO: 9494329 - DNA, 22 bp, Homo sapiens
gcctgcaagatggctggtcact

SEQ ID NO: 9494330 - DNA, 22 bp, Homo sapiens
gcctgagtgcatctgcagacat

SEQ ID NO: 9494331 - DNA, 22 bp, Homo sapiens
gcctgagggctcctagcaggct

SEQ ID NO: 9494332 - DNA, 22 bp, Homo sapiens
gcctgaggaattgagggggtaa

SEQ ID NO: 9494333 - DNA, 22 bp, Homo sapiens
gcctgagtcaagatgtggcacc

SEQ ID NO: 9494334 - DNA, 22 bp, Homo sapiens
gcctgagggctcctagcaggct

SEQ ID NO: 9494335 - DNA, 22 bp, Homo sapiens
gcctccctgttcttccacaata

SEQ ID NO: 9494336 - DNA, 22 bp, Homo sapiens
gcctccctgttcttccacaata

SEQ ID NO: 9494337 - DNA, 22 bp, Homo sapiens
gcctccctgtttcctgctccaa

SEQ ID NO: 9494338 - DNA, 22 bp, Homo sapiens
gcctccctggcccacagcagcg

SEQ ID NO: 9494339 - DNA, 18 bp, Homo sapiens
gcctccctggctacactt

SEQ ID NO: 9494340 - DNA, 22 bp, Homo sapiens
gcctccctccaccactgcaggt

SEQ ID NO: 9494341 - DNA, 22 bp, Homo sapiens
gcctccctccaccactgcaggt

SEQ ID NO: 9494342 - DNA, 22 bp, Homo sapiens
gcctccctggcccacagcagcg

SEQ ID NO: 9494343 - DNA, 22 bp, Homo sapiens
gcctccctggcccacagcagcg

SEQ ID NO: 9494344 - DNA, 22 bp, Homo sapiens
gcctccctgagtcacccaagca

SEQ ID NO: 9494345 - DNA, 22 bp, Homo sapiens
gcctccccaggggtgtcatgag

SEQ ID NO: 9494346 - DNA, 22 bp, Homo sapiens
gcctcccctgcaattgtccttg

SEQ ID NO: 9494347 - DNA, 22 bp, Homo sapiens
gcctccaccgaacgctctcttg

SEQ ID NO: 9494348 - DNA, 22 bp, Homo sapiens
gcctccaccgaacgctctcttg

SEQ ID NO: 9494349 - DNA, 22 bp, Homo sapiens
gcctccacccctggggagtgga

SEQ ID NO: 9494350 - DNA, 22 bp, Homo sapiens
gcctggagcccagtgtggggct

SEQ ID NO: 9494351 - DNA, 22 bp, Homo sapiens
gcctggagtagcatggcaagcc

SEQ ID NO: 9494352 - DNA, 22 bp, Homo sapiens
gcctggagtagcatggcaagcc

SEQ ID NO: 9494353 - DNA, 22 bp, Homo sapiens
gcctggagtgcagtggcgtgat

SEQ ID NO: 9494354 - DNA, 22 bp, Homo sapiens
gcctggagagcactgtgcgctt

SEQ ID NO: 9494355 - DNA, 22 bp, Homo sapiens
gcctggagacagcagaggcggc

SEQ ID NO: 9494356 - DNA, 22 bp, Homo sapiens
gcctggagacagcagaggcggc

SEQ ID NO: 9494357 - DNA, 22 bp, Homo sapiens
gcctggagagcactgtgcgctt

SEQ ID NO: 9494358 - DNA, 21 bp, Homo sapiens
gcctgcagttttgaagccctt

SEQ ID NO: 9494359 - DNA, 22 bp, Homo sapiens
gcctgcagtgagtgcagaaggt

SEQ ID NO: 9494360 - DNA, 22 bp, Homo sapiens
gcctgcagtgagtgcagaaggt

SEQ ID NO: 9494361 - DNA, 20 bp, Homo sapiens
gcctgcaggttggatgggat

SEQ ID NO: 9494362 - DNA, 20 bp, Homo sapiens
gcctgcaggttggatgggat

SEQ ID NO: 9494363 - DNA, 22 bp, Homo sapiens
gcctgcagtgagtgcagaaggt

SEQ ID NO: 9494364 - DNA, 22 bp, Homo sapiens
gcctggagacaaggacaaaggg

SEQ ID NO: 9494365 - DNA, 22 bp, Homo sapiens
gcctggagaattaaaaggaagg

SEQ ID NO: 9494366 - DNA, 22 bp, Homo sapiens
gcctggagaaaggaaggtggga

SEQ ID NO: 9494367 - DNA, 23 bp, Homo sapiens
gcctggagaaaagctgcagttca

SEQ ID NO: 9494368 - DNA, 19 bp, Homo sapiens
gcctcatttccacctcccc

SEQ ID NO: 9494369 - DNA, 19 bp, Homo sapiens
gcctcatttccacctcccc

SEQ ID NO: 9494370 - DNA, 19 bp, Homo sapiens
gcctcatttccacctcccc

SEQ ID NO: 9494371 - DNA, 22 bp, Homo sapiens
gcctcattacagccaggaagca

SEQ ID NO: 9494372 - DNA, 20 bp, Homo sapiens
gcctccacactcacccctta

SEQ ID NO: 9494373 - DNA, 18 bp, Homo sapiens
gcctccaccatggagggt

SEQ ID NO: 9494374 - DNA, 22 bp, Homo sapiens
gcctcagttgatctgtgtgagc

SEQ ID NO: 9494375 - DNA, 22 bp, Homo sapiens
gcctcatgagggatctgccctc

SEQ ID NO: 9494376 - DNA, 22 bp, Homo sapiens
gcctcatgagggatctgccctc

SEQ ID NO: 9494377 - DNA, 22 bp, Homo sapiens
gcctcagtgtcctcctccatgt

SEQ ID NO: 9494378 - DNA, 22 bp, Homo sapiens
gcctcagtgatatgtgggacaa

SEQ ID NO: 9494379 - DNA, 22 bp, Homo sapiens
gcctcagtctcccgagtagctg

SEQ ID NO: 9494380 - DNA, 20 bp, Homo sapiens
gcctcagtcacatggcctac

SEQ ID NO: 9494381 - DNA, 20 bp, Homo sapiens
gccctggacgtggcctcggc

SEQ ID NO: 9494382 - DNA, 22 bp, Homo sapiens
gcctcagggggagaggccagct

SEQ ID NO: 9494383 - DNA, 22 bp, Homo sapiens
gcctcagggggagaggccagct

SEQ ID NO: 9494384 - DNA, 22 bp, Homo sapiens
gcctcaggtaaaacttgagttt

SEQ ID NO: 9494385 - DNA, 22 bp, Homo sapiens
gcctcaggtaaaacttgagttt

SEQ ID NO: 9494386 - DNA, 22 bp, Homo sapiens
gcctcaggtgcatctctcattc

SEQ ID NO: 9494387 - DNA, 22 bp, Homo sapiens
gccctggaaaggaacctgggct

SEQ ID NO: 9494388 - DNA, 22 bp, Homo sapiens
gccctggaaaggaacctgggct

SEQ ID NO: 9494389 - DNA, 22 bp, Homo sapiens
gccctggacagtgacggtgacc

SEQ ID NO: 9494390 - DNA, 22 bp, Homo sapiens
gccctggacagtgacggtgacc

SEQ ID NO: 9494391 - DNA, 22 bp, Homo sapiens
gccctggaatctctccatggga

SEQ ID NO: 9494392 - DNA, 22 bp, Homo sapiens
gccctggaatctctccatggga

SEQ ID NO: 9494393 - DNA, 22 bp, Homo sapiens
gccctgagttgagccttccaaa

SEQ ID NO: 9494394 - DNA, 17 bp, Homo sapiens
gccctgcctgctgccct

SEQ ID NO: 9494395 - DNA, 17 bp, Homo sapiens
gccctgcctgctgccct

SEQ ID NO: 9494396 - DNA, 22 bp, Homo sapiens
gccctgcctgtctgctgggagg

SEQ ID NO: 9494397 - DNA, 22 bp, Homo sapiens
gccctgctcatttcacgtgttt

SEQ ID NO: 9494398 - DNA, 22 bp, Homo sapiens
gccctgctctggtctctgcccg

SEQ ID NO: 9494399 - DNA, 22 bp, Homo sapiens
gccctgctcctccgtcccacga

SEQ ID NO: 9494400 - DNA, 22 bp, Homo sapiens
gccctgctgagtccggctcaga

SEQ ID NO: 9494401 - DNA, 22 bp, Homo sapiens
gccctgctcttttgcccaccca

SEQ ID NO: 9494402 - DNA, 23 bp, Homo sapiens
gccctgctgggacctcctgctac

SEQ ID NO: 9494403 - DNA, 22 bp, Homo sapiens
gcccacaggggacctggtggct

SEQ ID NO: 9494404 - DNA, 22 bp, Homo sapiens
gcccacagctcgttcctctcct

SEQ ID NO: 9494405 - DNA, 22 bp, Homo sapiens
gcccacaggggacctggtggct

SEQ ID NO: 9494406 - DNA, 22 bp, Homo sapiens
gccccaggggaggtgccctgca

SEQ ID NO: 9494407 - DNA, 22 bp, Homo sapiens
gccccaggggaggtgccctgca

SEQ ID NO: 9494408 - DNA, 22 bp, Homo sapiens
gcccaaggtcccatggcagcac

SEQ ID NO: 9494409 - DNA, 22 bp, Homo sapiens
gcccaaggtcccatggcagcac

SEQ ID NO: 9494410 - DNA, 22 bp, Homo sapiens
gcccctcccagtcaggagcact

SEQ ID NO: 9494411 - DNA, 22 bp, Homo sapiens
gcccctctccttgtgcacctgc

SEQ ID NO: 9494412 - DNA, 22 bp, Homo sapiens
gcccctccgggcgcgtcatagc

SEQ ID NO: 9494413 - DNA, 22 bp, Homo sapiens
gccctcagaatgggctctaatc

SEQ ID NO: 9494414 - DNA, 22 bp, Homo sapiens
gccctcagaatgggctctaatc

SEQ ID NO: 9494415 - DNA, 22 bp, Homo sapiens
gccctcagaggacagctgactt

SEQ ID NO: 9494416 - DNA, 22 bp, Homo sapiens
gccctagggggaaccgaggact

SEQ ID NO: 9494417 - DNA, 22 bp, Homo sapiens
gccctaggcttttgtgactgcc

SEQ ID NO: 9494418 - DNA, 22 bp, Homo sapiens
gccctaggcttttgtgactgcc

SEQ ID NO: 9494419 - DNA, 22 bp, Homo sapiens
gccctaggcttttgtgactgcc

SEQ ID NO: 9494420 - DNA, 21 bp, Homo sapiens
gccctaggctacctggagcgc

SEQ ID NO: 9494421 - DNA, 21 bp, Homo sapiens
gccctaggctacctggagcgc

SEQ ID NO: 9494422 - DNA, 22 bp, Homo sapiens
gccctcagaggacagctgactt

SEQ ID NO: 9494423 - DNA, 22 bp, Homo sapiens
gccctcagagttccccacagtg

SEQ ID NO: 9494424 - DNA, 19 bp, Homo sapiens
gccctgagtaagctaggag

SEQ ID NO: 9494425 - DNA, 19 bp, Homo sapiens
gccctgagtaagctaggag

SEQ ID NO: 9494426 - DNA, 22 bp, Homo sapiens
gccctgagtggtacctgtgggt

SEQ ID NO: 9494427 - DNA, 22 bp, Homo sapiens
gccctgagtggtacctgtgggt

SEQ ID NO: 9494428 - DNA, 22 bp, Homo sapiens
gccctgagtggtacctgtgggt

SEQ ID NO: 9494429 - DNA, 22 bp, Homo sapiens
gccctgagtgcctgtgtaagaa

SEQ ID NO: 9494430 - DNA, 22 bp, Homo sapiens
gccctgagtggtacctgtgggt

SEQ ID NO: 9494431 - DNA, 22 bp, Homo sapiens
gccctgagtgcctgtgtaagaa

SEQ ID NO: 9494432 - DNA, 22 bp, Homo sapiens
gccctgagtgcctgtgtaagaa

SEQ ID NO: 9494433 - DNA, 19 bp, Homo sapiens
gccctgagtaagctaggag

SEQ ID NO: 9494434 - DNA, 19 bp, Homo sapiens
gccctgagtaagctaggag

SEQ ID NO: 9494435 - DNA, 22 bp, Homo sapiens
gccctacctcagtccagatctg

SEQ ID NO: 9494436 - DNA, 22 bp, Homo sapiens
gccctagcgccagctcagcacc

SEQ ID NO: 9494437 - DNA, 22 bp, Homo sapiens
gccctagcgccagctcagcacc

SEQ ID NO: 9494438 - DNA, 22 bp, Homo sapiens
gccctagcgccagctcagcacc

SEQ ID NO: 9494439 - DNA, 22 bp, Homo sapiens
gcccgcgccagcctctccatct

SEQ ID NO: 9494440 - DNA, 22 bp, Homo sapiens
gcccggccaggaacagagtata

SEQ ID NO: 9494441 - DNA, 22 bp, Homo sapiens
gcccggccaggaacagagtata

SEQ ID NO: 9494442 - DNA, 22 bp, Homo sapiens
gcccggcagtcacacacccagg

SEQ ID NO: 9494443 - DNA, 22 bp, Homo sapiens
gccccttgggaattcctccact

SEQ ID NO: 9494444 - DNA, 22 bp, Homo sapiens
gccccttgtctccaggccccaa

SEQ ID NO: 9494445 - DNA, 22 bp, Homo sapiens
gcccgcagagatctttaacaaa

SEQ ID NO: 9494446 - DNA, 22 bp, Homo sapiens
gcccctgttgtggctttgtcta

SEQ ID NO: 9494447 - DNA, 22 bp, Homo sapiens
ggcagtgagctggagggaagga

SEQ ID NO: 9494448 - DNA, 22 bp, Homo sapiens
ggcagtgagaggtctcctggtc

SEQ ID NO: 9494449 - DNA, 22 bp, Homo sapiens
ggcagtgagaggtctcctggtc

SEQ ID NO: 9494450 - DNA, 22 bp, Homo sapiens
ggcagtgagaggtctcctggtc

SEQ ID NO: 9494451 - DNA, 19 bp, Homo sapiens
ggcagtgagaagactcctg

SEQ ID NO: 9494452 - DNA, 18 bp, Homo sapiens
ggcaggggtgaaccacag

SEQ ID NO: 9494453 - DNA, 21 bp, Homo sapiens
ggcagtgatgtgaagtgcatc

SEQ ID NO: 9494454 - DNA, 21 bp, Homo sapiens
ggcagtgatgtgaagtgcatc

SEQ ID NO: 9494455 - DNA, 22 bp, Homo sapiens
ggcagtgatgtcaaacagtgaa

SEQ ID NO: 9494456 - DNA, 22 bp, Homo sapiens
ggcagtgatgtcaaacagtgaa

SEQ ID NO: 9494457 - DNA, 22 bp, Homo sapiens
ggcagtgagtcccggagaggcc

SEQ ID NO: 9494458 - DNA, 22 bp, Homo sapiens
ggcagtgagtcccggagaggcc

SEQ ID NO: 9494459 - DNA, 22 bp, Homo sapiens
ggcagtgagtcccggagaggcc

SEQ ID NO: 9494460 - DNA, 22 bp, Homo sapiens
ggcagtgagtcccggagaggcc

SEQ ID NO: 9494461 - DNA, 22 bp, Homo sapiens
ggcagtgccactaagctctgct

SEQ ID NO: 9494462 - DNA, 18 bp, Homo sapiens
ggcagtgcagtctcaggg

SEQ ID NO: 9494463 - DNA, 22 bp, Homo sapiens
ggcagtgcaaggcagcctggat

SEQ ID NO: 9494464 - DNA, 22 bp, Homo sapiens
ggcagtggcagagcttggtcta

SEQ ID NO: 9494465 - DNA, 22 bp, Homo sapiens
ggcagtggcagagcttggtcta

SEQ ID NO: 9494466 - DNA, 22 bp, Homo sapiens
ggcagtggcagagcttggtcta

SEQ ID NO: 9494467 - DNA, 22 bp, Homo sapiens
ggcagtggaggaccctgtgtct

SEQ ID NO: 9494468 - DNA, 22 bp, Homo sapiens
ggcagggccctgattcctgggg

SEQ ID NO: 9494469 - DNA, 20 bp, Homo sapiens
ggcagggcatcaacagctct

SEQ ID NO: 9494470 - DNA, 20 bp, Homo sapiens
ggcagggcatcaacagctct

SEQ ID NO: 9494471 - DNA, 20 bp, Homo sapiens
ggcagggcatcaacagctct

SEQ ID NO: 9494472 - DNA, 22 bp, Homo sapiens
ggcaggggtcctggtgttgact

SEQ ID NO: 9494473 - DNA, 22 bp, Homo sapiens
ggcaggggtcctggtgttgact

SEQ ID NO: 9494474 - DNA, 22 bp, Homo sapiens
ggcaggggtcctggtgttgact

SEQ ID NO: 9494475 - DNA, 22 bp, Homo sapiens
ggcagggcttgtctctgtgatg

SEQ ID NO: 9494476 - DNA, 22 bp, Homo sapiens
ggcagggcttgtctctgtgatg

SEQ ID NO: 9494477 - DNA, 22 bp, Homo sapiens
ggcagggaaacagctgatccca

SEQ ID NO: 9494478 - DNA, 22 bp, Homo sapiens
ggcagggaaacagctgatccca

SEQ ID NO: 9494479 - DNA, 22 bp, Homo sapiens
ggcagggaagctggcatcacgg

SEQ ID NO: 9494480 - DNA, 22 bp, Homo sapiens
ggcagggaagctggcatcacgg

SEQ ID NO: 9494481 - DNA, 22 bp, Homo sapiens
ggcagctattccaagcagcact

SEQ ID NO: 9494482 - DNA, 22 bp, Homo sapiens
ggcagctcacctctggtccagg

SEQ ID NO: 9494483 - DNA, 22 bp, Homo sapiens
ggcagcgcccgagtccgcagct

SEQ ID NO: 9494484 - DNA, 22 bp, Homo sapiens
ggcagcgagtcgccaagtctcg

SEQ ID NO: 9494485 - DNA, 22 bp, Homo sapiens
ggcagccttgagggaggcctgg

SEQ ID NO: 9494486 - DNA, 22 bp, Homo sapiens
ggcagctcctcctagtctgccc

SEQ ID NO: 9494487 - DNA, 22 bp, Homo sapiens
ggcagctcgatgacttctgcat

SEQ ID NO: 9494488 - DNA, 21 bp, Homo sapiens
ggcagctcagcagatggggac

SEQ ID NO: 9494489 - DNA, 22 bp, Homo sapiens
ggcagctcacgggcatggggtg

SEQ ID NO: 9494490 - DNA, 20 bp, Homo sapiens
ggcagctcactactttctgt

SEQ ID NO: 9494491 - DNA, 22 bp, Homo sapiens
ggcaggctgttcacctgctttt

SEQ ID NO: 9494492 - DNA, 22 bp, Homo sapiens
ggcaggctgttcacctgctttt

SEQ ID NO: 9494493 - DNA, 22 bp, Homo sapiens
ggcaggctgttcacctgctttt

SEQ ID NO: 9494494 - DNA, 22 bp, Homo sapiens
ggcaggctgttcacctgctttt

SEQ ID NO: 9494495 - DNA, 22 bp, Homo sapiens
ggcaggctgttcacctgctttt

SEQ ID NO: 9494496 - DNA, 22 bp, Homo sapiens
ggcaggcttgatatggggggac

SEQ ID NO: 9494497 - DNA, 22 bp, Homo sapiens
ggcaggcttggtggcaccggtt

SEQ ID NO: 9494498 - DNA, 20 bp, Homo sapiens
ggcaggctttatatggaggg

SEQ ID NO: 9494499 - DNA, 20 bp, Homo sapiens
ggcaggctttatatggaggg

SEQ ID NO: 9494500 - DNA, 18 bp, Homo sapiens
ggcagggaaaagataggg

SEQ ID NO: 9494501 - DNA, 22 bp, Homo sapiens
ggcaggctttgagaaagagcat

SEQ ID NO: 9494502 - DNA, 22 bp, Homo sapiens
ggcaggctttcagcatcaagtc

SEQ ID NO: 9494503 - DNA, 23 bp, Homo sapiens
ggcagcctctgactctgctttgc

SEQ ID NO: 9494504 - DNA, 21 bp, Homo sapiens
ggcagcctctgtggaagggga

SEQ ID NO: 9494505 - DNA, 21 bp, Homo sapiens
ggcagcctgacccccagagag

SEQ ID NO: 9494506 - DNA, 22 bp, Homo sapiens
ggcagcctccagggcactggtg

SEQ ID NO: 9494507 - DNA, 23 bp, Homo sapiens
ggcagcctctgactctgctttgc

SEQ ID NO: 9494508 - DNA, 22 bp, Homo sapiens
ggcagcctccagggcactggtg

SEQ ID NO: 9494509 - DNA, 22 bp, Homo sapiens
ggcagcctccagggcactggtg

SEQ ID NO: 9494510 - DNA, 22 bp, Homo sapiens
ggcagccttctctcataggtga

SEQ ID NO: 9494511 - DNA, 22 bp, Homo sapiens
ggcagccttgactagtgactta

SEQ ID NO: 9494512 - DNA, 22 bp, Homo sapiens
ggcagccttgactagtgactta

SEQ ID NO: 9494513 - DNA, 22 bp, Homo sapiens
ggcagccttctctcataggtga

SEQ ID NO: 9494514 - DNA, 18 bp, Homo sapiens
ggcagcctggacatgctc

SEQ ID NO: 9494515 - DNA, 18 bp, Homo sapiens
ggcagcctggacatgctc

SEQ ID NO: 9494516 - DNA, 19 bp, Homo sapiens
ggcagcctgcacgggctgc

SEQ ID NO: 9494517 - DNA, 19 bp, Homo sapiens
ggcagcctgcacgggctgc

SEQ ID NO: 9494518 - DNA, 17 bp, Homo sapiens
ggcagcctcaggcgttt

SEQ ID NO: 9494519 - DNA, 18 bp, Homo sapiens
ggcagcctacccacttgt

SEQ ID NO: 9494520 - DNA, 22 bp, Homo sapiens
ggcagcctcaggttttctttga

SEQ ID NO: 9494521 - DNA, 17 bp, Homo sapiens
ggcagcctcaggcgttt

SEQ ID NO: 9494522 - DNA, 21 bp, Homo sapiens
ggcagcccgccctctcctggc

SEQ ID NO: 9494523 - DNA, 22 bp, Homo sapiens
ggcagccatgtcccagggcttc

SEQ ID NO: 9494524 - DNA, 22 bp, Homo sapiens
ggcagccatgtcccagggcttc

SEQ ID NO: 9494525 - DNA, 22 bp, Homo sapiens
ggcagccatgtcccagggcttc

SEQ ID NO: 9494526 - DNA, 21 bp, Homo sapiens
ggcactaggcccggaggaagc

SEQ ID NO: 9494527 - DNA, 21 bp, Homo sapiens
ggcactaggcccggaggaagc

SEQ ID NO: 9494528 - DNA, 22 bp, Homo sapiens
ggcactcaataaatgttgccaa

SEQ ID NO: 9494529 - DNA, 22 bp, Homo sapiens
ggcactcaataaatgttgccaa

SEQ ID NO: 9494530 - DNA, 22 bp, Homo sapiens
ggcactcaataaatgttgccaa

SEQ ID NO: 9494531 - DNA, 22 bp, Homo sapiens
ggcactaggagacctgggggtc

SEQ ID NO: 9494532 - DNA, 23 bp, Homo sapiens
ggcactgaagctacaatggtgag

SEQ ID NO: 9494533 - DNA, 22 bp, Homo sapiens
ggcactgaaccaggacacaagc

SEQ ID NO: 9494534 - DNA, 22 bp, Homo sapiens
ggcactgaatttcttggcatct

SEQ ID NO: 9494535 - DNA, 22 bp, Homo sapiens
ggcactgaagtgggtgttgggt

SEQ ID NO: 9494536 - DNA, 22 bp, Homo sapiens
ggcactgagctgccttggggca

SEQ ID NO: 9494537 - DNA, 22 bp, Homo sapiens
ggcactgagcgggctctgagcg

SEQ ID NO: 9494538 - DNA, 22 bp, Homo sapiens
ggcactgagcgggctctgagcg

SEQ ID NO: 9494539 - DNA, 22 bp, Homo sapiens
ggcactgagcgggctctgagcg

SEQ ID NO: 9494540 - DNA, 21 bp, Homo sapiens
ggcactgagccagatggactc

SEQ ID NO: 9494541 - DNA, 22 bp, Homo sapiens
ggcactgagaggctcttcctaa

SEQ ID NO: 9494542 - DNA, 22 bp, Homo sapiens
ggcactgagaacaggctgactt

SEQ ID NO: 9494543 - DNA, 22 bp, Homo sapiens
ggcactgacactagcatggcac

SEQ ID NO: 9494544 - DNA, 22 bp, Homo sapiens
ggcactgacactagcatggcac

SEQ ID NO: 9494545 - DNA, 22 bp, Homo sapiens
ggcactgacactagcatggcac

SEQ ID NO: 9494546 - DNA, 22 bp, Homo sapiens
ggcactgagaacaggctgactt

SEQ ID NO: 9494547 - DNA, 22 bp, Homo sapiens
ggcactgactgtgcagcgcacc

SEQ ID NO: 9494548 - DNA, 22 bp, Homo sapiens
ggcactgactgtgcagcgcacc

SEQ ID NO: 9494549 - DNA, 22 bp, Homo sapiens
ggcagatggagaagcagcaggt

SEQ ID NO: 9494550 - DNA, 22 bp, Homo sapiens
ggcagatggagaagcagcaggt

SEQ ID NO: 9494551 - DNA, 22 bp, Homo sapiens
ggcagatggggtgacaagagag

SEQ ID NO: 9494552 - DNA, 22 bp, Homo sapiens
ggcagatggaatgagctgtcta

SEQ ID NO: 9494553 - DNA, 22 bp, Homo sapiens
ggcagatggagaagcagcaggt

SEQ ID NO: 9494554 - DNA, 22 bp, Homo sapiens
ggcagatgttatatgatctgag

SEQ ID NO: 9494555 - DNA, 22 bp, Homo sapiens
ggcagatgttatatgatctgag

SEQ ID NO: 9494556 - DNA, 22 bp, Homo sapiens
ggcagatgttatatgatctgag

SEQ ID NO: 9494557 - DNA, 22 bp, Homo sapiens
ggcagatggggtgacaagagag

SEQ ID NO: 9494558 - DNA, 22 bp, Homo sapiens
ggcactgatctgatttccctcc

SEQ ID NO: 9494559 - DNA, 22 bp, Homo sapiens
ggcactgataatgtcctctctc

SEQ ID NO: 9494560 - DNA, 22 bp, Homo sapiens
ggcagatggaatgagctgtcta

SEQ ID NO: 9494561 - DNA, 22 bp, Homo sapiens
ggcagaggtgacagtgtctttt

SEQ ID NO: 9494562 - DNA, 22 bp, Homo sapiens
ggcagcagaactggccctgtat

SEQ ID NO: 9494563 - DNA, 22 bp, Homo sapiens
ggcagcactgcagcttgttggg

SEQ ID NO: 9494564 - DNA, 22 bp, Homo sapiens
ggcagcagaactggccctgtat

SEQ ID NO: 9494565 - DNA, 21 bp, Homo sapiens
ggcagcactacctgaagcata

SEQ ID NO: 9494566 - DNA, 22 bp, Homo sapiens
ggcagcacgacaggagtggaag

SEQ ID NO: 9494567 - DNA, 22 bp, Homo sapiens
ggcagcactgcagcttgttggg

SEQ ID NO: 9494568 - DNA, 22 bp, Homo sapiens
ggcagcactgcagcttgttggg

SEQ ID NO: 9494569 - DNA, 22 bp, Homo sapiens
ggcagcactgcagcttgttggg

SEQ ID NO: 9494570 - DNA, 22 bp, Homo sapiens
ggcagcaatgctgtgcaggcat

SEQ ID NO: 9494571 - DNA, 22 bp, Homo sapiens
ggcagcaatgctgtgcaggcat

SEQ ID NO: 9494572 - DNA, 22 bp, Homo sapiens
ggcagcaattcttcagaatcat

SEQ ID NO: 9494573 - DNA, 22 bp, Homo sapiens
ggcagcaatgctgtgcaggcat

SEQ ID NO: 9494574 - DNA, 22 bp, Homo sapiens
ggcagcaatgctgtgcaggcat

SEQ ID NO: 9494575 - DNA, 18 bp, Homo sapiens
ggcagcaagaagggaggg

SEQ ID NO: 9494576 - DNA, 22 bp, Homo sapiens
ggcagcaactcggagagaagag

SEQ ID NO: 9494577 - DNA, 22 bp, Homo sapiens
ggcagcaactcggagagaagag

SEQ ID NO: 9494578 - DNA, 20 bp, Homo sapiens
ggcagcaaccatatgctaca

SEQ ID NO: 9494579 - DNA, 18 bp, Homo sapiens
ggcagcaagaagggaggg

SEQ ID NO: 9494580 - DNA, 22 bp, Homo sapiens
ggcagcaagagaggttcagctt

SEQ ID NO: 9494581 - DNA, 22 bp, Homo sapiens
ggcagcaagagaggttcagctt

SEQ ID NO: 9494582 - DNA, 22 bp, Homo sapiens
ggcagcaagtggtgggagactt

SEQ ID NO: 9494583 - DNA, 19 bp, Homo sapiens
ggcagcaagctctgaaggc

SEQ ID NO: 9494584 - DNA, 22 bp, Homo sapiens
ggcagcaaatattgtcagctgt

SEQ ID NO: 9494585 - DNA, 22 bp, Homo sapiens
ggcagcaaatattgtcagctgt

SEQ ID NO: 9494586 - DNA, 22 bp, Homo sapiens
ggcagcaaagtcacatggaaaa

SEQ ID NO: 9494587 - DNA, 22 bp, Homo sapiens
ggcagcaaactggcttcaggct

SEQ ID NO: 9494588 - DNA, 22 bp, Homo sapiens
ggcagcaaaaagcctggttgaa

SEQ ID NO: 9494589 - DNA, 22 bp, Homo sapiens
ggcagcaaccaaccaggcattt

SEQ ID NO: 9494590 - DNA, 22 bp, Homo sapiens
ggcagcaaccaaccaggcattt

SEQ ID NO: 9494591 - DNA, 22 bp, Homo sapiens
ggcagcaaccaaccaggcattt

SEQ ID NO: 9494592 - DNA, 23 bp, Homo sapiens
ggcagatttggtttgttttaata

SEQ ID NO: 9494593 - DNA, 22 bp, Homo sapiens
ggcagcaaaaagcctggttgaa

SEQ ID NO: 9494594 - DNA, 22 bp, Homo sapiens
ggcagatgttgcagtgagcaga

SEQ ID NO: 9494595 - DNA, 22 bp, Homo sapiens
ggcagatgttgcagtgagcaga

SEQ ID NO: 9494596 - DNA, 22 bp, Homo sapiens
ggcagatgttgcagtgagcaga

SEQ ID NO: 9494597 - DNA, 22 bp, Homo sapiens
ggcagatgttgcagtgagcaga

SEQ ID NO: 9494598 - DNA, 22 bp, Homo sapiens
ggaggaggggtgactgaatgct

SEQ ID NO: 9494599 - DNA, 22 bp, Homo sapiens
ggaggaggggtgactgaatgct

SEQ ID NO: 9494600 - DNA, 22 bp, Homo sapiens
ggaggaggggtgactgaatgct

SEQ ID NO: 9494601 - DNA, 22 bp, Homo sapiens
ggaggaggggtgactgaatgct

SEQ ID NO: 9494602 - DNA, 22 bp, Homo sapiens
ggaggaggggtgactgaatgct

SEQ ID NO: 9494603 - DNA, 22 bp, Homo sapiens
ggaggaggggtttacattggaa

SEQ ID NO: 9494604 - DNA, 22 bp, Homo sapiens
ggaggaggggtttacattggaa

SEQ ID NO: 9494605 - DNA, 22 bp, Homo sapiens
ggaggagtgtggggcactctgc

SEQ ID NO: 9494606 - DNA, 22 bp, Homo sapiens
ggaggatgagctacgaggagct

SEQ ID NO: 9494607 - DNA, 22 bp, Homo sapiens
ggaggatgagctacgaggagct

SEQ ID NO: 9494608 - DNA, 22 bp, Homo sapiens
ggaggaggtgggttaagttgta

SEQ ID NO: 9494609 - DNA, 22 bp, Homo sapiens
ggaggcaccctatttgaggcct

SEQ ID NO: 9494610 - DNA, 23 bp, Homo sapiens
ggaggcacttaggcagagcagag

SEQ ID NO: 9494611 - DNA, 23 bp, Homo sapiens
ggaggcacttaggcagagcagag

SEQ ID NO: 9494612 - DNA, 22 bp, Homo sapiens
ggaggcacacctcagactggga

SEQ ID NO: 9494613 - DNA, 22 bp, Homo sapiens
ggaggcaacatgcttgtttcta

SEQ ID NO: 9494614 - DNA, 17 bp, Homo sapiens
ggaggcaacagacaggg

SEQ ID NO: 9494615 - DNA, 22 bp, Homo sapiens
ggaggatgccaagctgtgcaca

SEQ ID NO: 9494616 - DNA, 22 bp, Homo sapiens
ggaggcaaagcactttgcttgg

SEQ ID NO: 9494617 - DNA, 22 bp, Homo sapiens
ggaggcaacacagggtgtgttt

SEQ ID NO: 9494618 - DNA, 16 bp, Homo sapiens
ggcaccagtgaacaca

SEQ ID NO: 9494619 - DNA, 22 bp, Homo sapiens
ggcaccaggggatgtaatgtcc

SEQ ID NO: 9494620 - DNA, 16 bp, Homo sapiens
ggcaccagtgaacaca

SEQ ID NO: 9494621 - DNA, 16 bp, Homo sapiens
ggcaccagtgaacaca

SEQ ID NO: 9494622 - DNA, 22 bp, Homo sapiens
ggcacccttggggggccacagc

SEQ ID NO: 9494623 - DNA, 22 bp, Homo sapiens
ggcaccagggaaggaaggctgg

SEQ ID NO: 9494624 - DNA, 22 bp, Homo sapiens
ggcaccagggacaatcctcttc

SEQ ID NO: 9494625 - DNA, 22 bp, Homo sapiens
ggcaccagggacaatcctcttc

SEQ ID NO: 9494626 - DNA, 22 bp, Homo sapiens
ggcaccagggcaagggtctttc

SEQ ID NO: 9494627 - DNA, 22 bp, Homo sapiens
ggcaccaggggatgtaatgtcc

SEQ ID NO: 9494628 - DNA, 22 bp, Homo sapiens
ggcaccagggcaagggtctttc

SEQ ID NO: 9494629 - DNA, 22 bp, Homo sapiens
ggaggcagaacttcccgtcagt

SEQ ID NO: 9494630 - DNA, 22 bp, Homo sapiens
ggaggcacttcccgtctcagcc

SEQ ID NO: 9494631 - DNA, 22 bp, Homo sapiens
ggaggcacttcccgtctcagcc

SEQ ID NO: 9494632 - DNA, 22 bp, Homo sapiens
ggaggcagaacttcccgtcagt

SEQ ID NO: 9494633 - DNA, 22 bp, Homo sapiens
ggaggcagaacttcccgtcagt

SEQ ID NO: 9494634 - DNA, 22 bp, Homo sapiens
ggcaccaggctgggcataggcc

SEQ ID NO: 9494635 - DNA, 22 bp, Homo sapiens
ggcaccaggctgggcataggcc

SEQ ID NO: 9494636 - DNA, 22 bp, Homo sapiens
ggcaccagggaaggaaggctgg

SEQ ID NO: 9494637 - DNA, 22 bp, Homo sapiens
ggcaccaggctgggcataggcc

SEQ ID NO: 9494638 - DNA, 22 bp, Homo sapiens
ggcaccaggctgggcataggcc

SEQ ID NO: 9494639 - DNA, 19 bp, Homo sapiens
ggcaccttggtcttggact

SEQ ID NO: 9494640 - DNA, 22 bp, Homo sapiens
ggcacctttcatcccatctaga

SEQ ID NO: 9494641 - DNA, 19 bp, Homo sapiens
ggcacctttctgctgtgtc

SEQ ID NO: 9494642 - DNA, 19 bp, Homo sapiens
ggcaccttggctatgcctg

SEQ ID NO: 9494643 - DNA, 22 bp, Homo sapiens
ggcacctgtgtaagatctggaa

SEQ ID NO: 9494644 - DNA, 22 bp, Homo sapiens
ggcacctgtctgctcacagtga

SEQ ID NO: 9494645 - DNA, 22 bp, Homo sapiens
ggcacctgtctgctcacagtga

SEQ ID NO: 9494646 - DNA, 22 bp, Homo sapiens
ggcacctgtgtaagatctggaa

SEQ ID NO: 9494647 - DNA, 22 bp, Homo sapiens
ggcacctgtctgctcacagtga

SEQ ID NO: 9494648 - DNA, 22 bp, Homo sapiens
ggcacctggatgtagcagtgaa

SEQ ID NO: 9494649 - DNA, 22 bp, Homo sapiens
ggcacctggtaagtgctcagta

SEQ ID NO: 9494650 - DNA, 22 bp, Homo sapiens
ggcacctggatgtagcagtgaa

SEQ ID NO: 9494651 - DNA, 22 bp, Homo sapiens
ggcacctggatgtagcagtgaa

SEQ ID NO: 9494652 - DNA, 22 bp, Homo sapiens
ggcacctggatgtagcagtgaa

SEQ ID NO: 9494653 - DNA, 22 bp, Homo sapiens
ggcacctgctcatctggactca

SEQ ID NO: 9494654 - DNA, 22 bp, Homo sapiens
ggcacctggaggtttactggat

SEQ ID NO: 9494655 - DNA, 22 bp, Homo sapiens
ggcacctgatgactgcttccct

SEQ ID NO: 9494656 - DNA, 22 bp, Homo sapiens
ggcacctgatgactgcttccct

SEQ ID NO: 9494657 - DNA, 22 bp, Homo sapiens
ggcacctgctcatctggactca

SEQ ID NO: 9494658 - DNA, 22 bp, Homo sapiens
ggcacctgatgactgcttccct

SEQ ID NO: 9494659 - DNA, 22 bp, Homo sapiens
ggcacctctgggctctgttagg

SEQ ID NO: 9494660 - DNA, 22 bp, Homo sapiens
ggcccaggtccagcgagtacct

SEQ ID NO: 9494661 - DNA, 22 bp, Homo sapiens
ggcccaggtccagcgagtacct

SEQ ID NO: 9494662 - DNA, 22 bp, Homo sapiens
ggcccaggtccagcgagtacct

SEQ ID NO: 9494663 - DNA, 22 bp, Homo sapiens
ggcccaggctggagtgcggtgg

SEQ ID NO: 9494664 - DNA, 22 bp, Homo sapiens
ggcccagtgctgttcacccagt

SEQ ID NO: 9494665 - DNA, 20 bp, Homo sapiens
ggcccagtgaaccaggacgg

SEQ ID NO: 9494666 - DNA, 22 bp, Homo sapiens
ggcccatctcttgctctgggtt

SEQ ID NO: 9494667 - DNA, 22 bp, Homo sapiens
ggcccagtgtaccccaggcagt

SEQ ID NO: 9494668 - DNA, 22 bp, Homo sapiens
ggcccagtgtaccccaggcagt

SEQ ID NO: 9494669 - DNA, 22 bp, Homo sapiens
ggcccagctgggcggggacacg

SEQ ID NO: 9494670 - DNA, 22 bp, Homo sapiens
ggcccagctgggcggggacacg

SEQ ID NO: 9494671 - DNA, 22 bp, Homo sapiens
ggcccagctgggcggggacacg

SEQ ID NO: 9494672 - DNA, 22 bp, Homo sapiens
ggcccagctgtatattacagtt

SEQ ID NO: 9494673 - DNA, 22 bp, Homo sapiens
ggcccagctgtgcttccagccc

SEQ ID NO: 9494674 - DNA, 22 bp, Homo sapiens
ggcccagctgtgcttccagccc

SEQ ID NO: 9494675 - DNA, 22 bp, Homo sapiens
ggcccagctttcattccttgct

SEQ ID NO: 9494676 - DNA, 22 bp, Homo sapiens
ggcccaggatgcaagaactgaa

SEQ ID NO: 9494677 - DNA, 22 bp, Homo sapiens
ggcccaggatgcaagaactgaa

SEQ ID NO: 9494678 - DNA, 22 bp, Homo sapiens
ggcccaggatgcaagaactgaa

SEQ ID NO: 9494679 - DNA, 22 bp, Homo sapiens
ggcccaggctggagtgcagtgg

SEQ ID NO: 9494680 - DNA, 22 bp, Homo sapiens
ggcccaggctggagtgcggtgg

SEQ ID NO: 9494681 - DNA, 22 bp, Homo sapiens
ggcccaggctggagtgcagtgg

SEQ ID NO: 9494682 - DNA, 22 bp, Homo sapiens
ggccagcccagtggtcctctct

SEQ ID NO: 9494683 - DNA, 19 bp, Homo sapiens
ggccagccacctcgcctgg

SEQ ID NO: 9494684 - DNA, 19 bp, Homo sapiens
ggccagccacctcgcctgg

SEQ ID NO: 9494685 - DNA, 19 bp, Homo sapiens
ggccagccacctcgcctgg

SEQ ID NO: 9494686 - DNA, 22 bp, Homo sapiens
ggccagcatggcaagaccaact

SEQ ID NO: 9494687 - DNA, 22 bp, Homo sapiens
ggccagcatggcaagaccaact

SEQ ID NO: 9494688 - DNA, 22 bp, Homo sapiens
ggccagcccagtggtcctctct

SEQ ID NO: 9494689 - DNA, 22 bp, Homo sapiens
ggccagctctgcacagcagctg

SEQ ID NO: 9494690 - DNA, 22 bp, Homo sapiens
ggccagctcttgtccacggagg

SEQ ID NO: 9494691 - DNA, 22 bp, Homo sapiens
ggccagctctgcacagcagctg

SEQ ID NO: 9494692 - DNA, 21 bp, Homo sapiens
ggccagcagcgtccactgtgg

SEQ ID NO: 9494693 - DNA, 22 bp, Homo sapiens
ggccagcagtcacagggtcaga

SEQ ID NO: 9494694 - DNA, 22 bp, Homo sapiens
ggccagcagtatatagctaatt

SEQ ID NO: 9494695 - DNA, 22 bp, Homo sapiens
ggccagcagtcacagggtcaga

SEQ ID NO: 9494696 - DNA, 22 bp, Homo sapiens
ggccagcagtcacagggtcaga

SEQ ID NO: 9494697 - DNA, 22 bp, Homo sapiens
ggccagcagtcacagggtcaga

SEQ ID NO: 9494698 - DNA, 22 bp, Homo sapiens
ggccagcagtcacagggtcaga

SEQ ID NO: 9494699 - DNA, 22 bp, Homo sapiens
ggccagctgagctgctgcacag

SEQ ID NO: 9494700 - DNA, 22 bp, Homo sapiens
ggccagctgagctgctgcacag

SEQ ID NO: 9494701 - DNA, 21 bp, Homo sapiens
ggccagctgcatatgtcactg

SEQ ID NO: 9494702 - DNA, 22 bp, Homo sapiens
ggccagctgccaccagccctat

SEQ ID NO: 9494703 - DNA, 20 bp, Homo sapiens
ggccagctgatgcacgatgc

SEQ ID NO: 9494704 - DNA, 21 bp, Homo sapiens
ggccagctgcatatgtcactg

SEQ ID NO: 9494705 - DNA, 20 bp, Homo sapiens
ggccagctgatgcacgatgc

SEQ ID NO: 9494706 - DNA, 22 bp, Homo sapiens
ggccagctgccaccagccctat

SEQ ID NO: 9494707 - DNA, 22 bp, Homo sapiens
ggccagctgcctgaccttctgt

SEQ ID NO: 9494708 - DNA, 22 bp, Homo sapiens
ggccagctgcctgaccttctgt

SEQ ID NO: 9494709 - DNA, 22 bp, Homo sapiens
ggccagctgccaccagccctat

SEQ ID NO: 9494710 - DNA, 22 bp, Homo sapiens
ggccagctgctcagtgtctctg

SEQ ID NO: 9494711 - DNA, 22 bp, Homo sapiens
ggccagctgctcagtgtctctg

SEQ ID NO: 9494712 - DNA, 22 bp, Homo sapiens
ggcccagctctattgaattaca

SEQ ID NO: 9494713 - DNA, 22 bp, Homo sapiens
ggcccagcgaggccacctacag

SEQ ID NO: 9494714 - DNA, 20 bp, Homo sapiens
ggccagctggaggcgccggg

SEQ ID NO: 9494715 - DNA, 20 bp, Homo sapiens
ggccagctggaggcgccggg

SEQ ID NO: 9494716 - DNA, 22 bp, Homo sapiens
ggccagctggagttccgggtgg

SEQ ID NO: 9494717 - DNA, 22 bp, Homo sapiens
ggccagctggatgtgggtgacg

SEQ ID NO: 9494718 - DNA, 22 bp, Homo sapiens
ggccagctggatgtgggtgacg

SEQ ID NO: 9494719 - DNA, 22 bp, Homo sapiens
ggccagcagacctcagggactc

SEQ ID NO: 9494720 - DNA, 21 bp, Homo sapiens
ggccagcagcgtccactgtgg

SEQ ID NO: 9494721 - DNA, 22 bp, Homo sapiens
ggccagcagacctcagggactc

SEQ ID NO: 9494722 - DNA, 22 bp, Homo sapiens
ggccagagttgatggcatcttg

SEQ ID NO: 9494723 - DNA, 19 bp, Homo sapiens
ggccagcacagggctctgt

SEQ ID NO: 9494724 - DNA, 22 bp, Homo sapiens
ggccagagttgatggcatcttg

SEQ ID NO: 9494725 - DNA, 22 bp, Homo sapiens
ggccagagtctatatgcagaca

SEQ ID NO: 9494726 - DNA, 22 bp, Homo sapiens
ggccagagtctatatgcagaca

SEQ ID NO: 9494727 - DNA, 19 bp, Homo sapiens
ggccacctctcttcccagg

SEQ ID NO: 9494728 - DNA, 21 bp, Homo sapiens
ggccacagttagggctcagga

SEQ ID NO: 9494729 - DNA, 21 bp, Homo sapiens
ggccacagttagggctcagga

SEQ ID NO: 9494730 - DNA, 21 bp, Homo sapiens
ggccacagttagggctcagga

SEQ ID NO: 9494731 - DNA, 22 bp, Homo sapiens
ggccacagtgggaaatcctggg

SEQ ID NO: 9494732 - DNA, 22 bp, Homo sapiens
ggccacagtgggaaatcctggg

SEQ ID NO: 9494733 - DNA, 22 bp, Homo sapiens
ggccacagtgggaaatcctggg

SEQ ID NO: 9494734 - DNA, 22 bp, Homo sapiens
ggccacagtgggaaatcctggg

SEQ ID NO: 9494735 - DNA, 22 bp, Homo sapiens
ggccaccaaagtcctgtggctt

SEQ ID NO: 9494736 - DNA, 22 bp, Homo sapiens
ggccaccagtcctctggcaggg

SEQ ID NO: 9494737 - DNA, 22 bp, Homo sapiens
ggccacatgaattcttggacag

SEQ ID NO: 9494738 - DNA, 22 bp, Homo sapiens
ggccacatgaattcttggacag

SEQ ID NO: 9494739 - DNA, 22 bp, Homo sapiens
ggccacatgtggctgctcgtat

SEQ ID NO: 9494740 - DNA, 22 bp, Homo sapiens
ggccaccaaagtcctgtggctt

SEQ ID NO: 9494741 - DNA, 20 bp, Homo sapiens
ggccacagggtgctggtgga

SEQ ID NO: 9494742 - DNA, 20 bp, Homo sapiens
ggccacagggtgctggtgga

SEQ ID NO: 9494743 - DNA, 22 bp, Homo sapiens
ggccacagtctctggaaggatg

SEQ ID NO: 9494744 - DNA, 22 bp, Homo sapiens
ggccacagtctctggaaggatg

SEQ ID NO: 9494745 - DNA, 20 bp, Homo sapiens
ggccacagggtgctggtgga

SEQ ID NO: 9494746 - DNA, 22 bp, Homo sapiens
ggccacagcaatgctgtgatgt

SEQ ID NO: 9494747 - DNA, 22 bp, Homo sapiens
ggccacagcaatgctgtgatgt

SEQ ID NO: 9494748 - DNA, 22 bp, Homo sapiens
ggccacagcaatgctgtgatgt

SEQ ID NO: 9494749 - DNA, 22 bp, Homo sapiens
ggccacagcaatgctgtgatgt

SEQ ID NO: 9494750 - DNA, 22 bp, Homo sapiens
ggccacagcagatgcttcagat

SEQ ID NO: 9494751 - DNA, 22 bp, Homo sapiens
ggccacagcagatgcttcagat

SEQ ID NO: 9494752 - DNA, 22 bp, Homo sapiens
ggccacagcagatgcttcagat

SEQ ID NO: 9494753 - DNA, 22 bp, Homo sapiens
ggccacagagggcgggatgctg

SEQ ID NO: 9494754 - DNA, 22 bp, Homo sapiens
ggccacagagggcgggatgctg

SEQ ID NO: 9494755 - DNA, 17 bp, Homo sapiens
ggccacagagcttgggg

SEQ ID NO: 9494756 - DNA, 17 bp, Homo sapiens
ggccacagagcttgggg

SEQ ID NO: 9494757 - DNA, 17 bp, Homo sapiens
ggccacagagcttgggg

SEQ ID NO: 9494758 - DNA, 17 bp, Homo sapiens
ggccacagagcttgggg

SEQ ID NO: 9494759 - DNA, 22 bp, Homo sapiens
ggcagtgggtggatctcaggga

SEQ ID NO: 9494760 - DNA, 22 bp, Homo sapiens
ggcagtggctcctctctactcc

SEQ ID NO: 9494761 - DNA, 22 bp, Homo sapiens
ggcagtggcatgtgggtagtgg

SEQ ID NO: 9494762 - DNA, 22 bp, Homo sapiens
ggcagtggcatgtgggtagtgg

SEQ ID NO: 9494763 - DNA, 22 bp, Homo sapiens
ggcagtggaggaccctgtgtct

SEQ ID NO: 9494764 - DNA, 22 bp, Homo sapiens
ggctctgaggcagatcgatggg

SEQ ID NO: 9494765 - DNA, 23 bp, Homo sapiens
ggctctgaggatggagctggtgg

SEQ ID NO: 9494766 - DNA, 23 bp, Homo sapiens
ggctctgaggatggagctggtgg

SEQ ID NO: 9494767 - DNA, 22 bp, Homo sapiens
ggctctgacctcccaggcagtt

SEQ ID NO: 9494768 - DNA, 22 bp, Homo sapiens
ggctctgacctcccaggcagtt

SEQ ID NO: 9494769 - DNA, 22 bp, Homo sapiens
ggctctgaagggtgacaggttt

SEQ ID NO: 9494770 - DNA, 22 bp, Homo sapiens
ggctctgaattattcctgagtc

SEQ ID NO: 9494771 - DNA, 22 bp, Homo sapiens
ggctctgaagggtgacaggttt

SEQ ID NO: 9494772 - DNA, 22 bp, Homo sapiens
ggctctgagtttagaagggtgg

SEQ ID NO: 9494773 - DNA, 22 bp, Homo sapiens
ggctctgagtttagaagggtgg

SEQ ID NO: 9494774 - DNA, 22 bp, Homo sapiens
ggctctgcagagggcccagctt

SEQ ID NO: 9494775 - DNA, 22 bp, Homo sapiens
ggctctgcatgtgagtgggtgg

SEQ ID NO: 9494776 - DNA, 22 bp, Homo sapiens
ggctctgcctgcctgagtgtcc

SEQ ID NO: 9494777 - DNA, 22 bp, Homo sapiens
ggctctgccgtgtgctcacatg

SEQ ID NO: 9494778 - DNA, 22 bp, Homo sapiens
ggctcagagacctgcgatctga

SEQ ID NO: 9494779 - DNA, 22 bp, Homo sapiens
ggctcagaggagctggaacggt

SEQ ID NO: 9494780 - DNA, 22 bp, Homo sapiens
ggctcagaaggccatgctctgc

SEQ ID NO: 9494781 - DNA, 23 bp, Homo sapiens
ggctcagaaaaagtcctggcctc

SEQ ID NO: 9494782 - DNA, 22 bp, Homo sapiens
ggctcactgcaacttccgcctc

SEQ ID NO: 9494783 - DNA, 22 bp, Homo sapiens
ggctcactgcaacttccgcctc

SEQ ID NO: 9494784 - DNA, 22 bp, Homo sapiens
ggctcagcaatgatgagcccct

SEQ ID NO: 9494785 - DNA, 22 bp, Homo sapiens
ggctctctccttggctttcaga

SEQ ID NO: 9494786 - DNA, 22 bp, Homo sapiens
ggctcagattccgagtggccct

SEQ ID NO: 9494787 - DNA, 22 bp, Homo sapiens
ggctcagattccgagtggccct

SEQ ID NO: 9494788 - DNA, 22 bp, Homo sapiens
ggctcagagttaggacccatgt

SEQ ID NO: 9494789 - DNA, 22 bp, Homo sapiens
ggctctctgaggaaacccttcc

SEQ ID NO: 9494790 - DNA, 22 bp, Homo sapiens
ggctcagcaatgatgagcccct

SEQ ID NO: 9494791 - DNA, 22 bp, Homo sapiens
ggctctgaaggagacagctgct

SEQ ID NO: 9494792 - DNA, 22 bp, Homo sapiens
ggctctgaacatggggaggagt

SEQ ID NO: 9494793 - DNA, 22 bp, Homo sapiens
ggctctgaaattctcactttta

SEQ ID NO: 9494794 - DNA, 22 bp, Homo sapiens
ggcccatgcatcctgtgcagcc

SEQ ID NO: 9494795 - DNA, 22 bp, Homo sapiens
ggcctcatcacagtgcattagt

SEQ ID NO: 9494796 - DNA, 21 bp, Homo sapiens
ggcctcccggaccgcagcgcc

SEQ ID NO: 9494797 - DNA, 21 bp, Homo sapiens
ggcctcccggaccgcagcgcc

SEQ ID NO: 9494798 - DNA, 22 bp, Homo sapiens
ggcctctgaggacagccttggc

SEQ ID NO: 9494799 - DNA, 22 bp, Homo sapiens
ggcctctgaggacagccttggc

SEQ ID NO: 9494800 - DNA, 20 bp, Homo sapiens
ggcctctgaggacaaggaga

SEQ ID NO: 9494801 - DNA, 20 bp, Homo sapiens
ggcctctgaggacaaggaga

SEQ ID NO: 9494802 - DNA, 22 bp, Homo sapiens
ggcctctctgagagcagacgtt

SEQ ID NO: 9494803 - DNA, 22 bp, Homo sapiens
ggcctctcttgggacagctgtc

SEQ ID NO: 9494804 - DNA, 22 bp, Homo sapiens
ggcctctcttgggacagctgtc

SEQ ID NO: 9494805 - DNA, 22 bp, Homo sapiens
ggcctctgccctcactcctgtc

SEQ ID NO: 9494806 - DNA, 22 bp, Homo sapiens
ggcctctgccccagccacacct

SEQ ID NO: 9494807 - DNA, 21 bp, Homo sapiens
ggcctctgccttgccccactc

SEQ ID NO: 9494808 - DNA, 22 bp, Homo sapiens
ggcctctgcctcatctgggcac

SEQ ID NO: 9494809 - DNA, 22 bp, Homo sapiens
ggcctctgcaactggctgtggc

SEQ ID NO: 9494810 - DNA, 22 bp, Homo sapiens
ggcctctgcaactggctgtggc

SEQ ID NO: 9494811 - DNA, 22 bp, Homo sapiens
ggcctctgccccagccacacct

SEQ ID NO: 9494812 - DNA, 22 bp, Homo sapiens
ggcctctgccccagccacacct

SEQ ID NO: 9494813 - DNA, 22 bp, Homo sapiens
ggcctctgcaggcctcgacaag

SEQ ID NO: 9494814 - DNA, 22 bp, Homo sapiens
ggcctctgcaggcctcgacaag

SEQ ID NO: 9494815 - DNA, 19 bp, Homo sapiens
ggcctctgcaggccgcccc

SEQ ID NO: 9494816 - DNA, 22 bp, Homo sapiens
ggcctctgcttatgctgatgac

SEQ ID NO: 9494817 - DNA, 18 bp, Homo sapiens
ggcctctggactggcagc

SEQ ID NO: 9494818 - DNA, 18 bp, Homo sapiens
ggcctctggactggcagc

SEQ ID NO: 9494819 - DNA, 22 bp, Homo sapiens
ggcctctgcttatgctgatgac

SEQ ID NO: 9494820 - DNA, 22 bp, Homo sapiens
ggcctctggcaggcaggccctc

SEQ ID NO: 9494821 - DNA, 18 bp, Homo sapiens
ggcctctggactggcagc

SEQ ID NO: 9494822 - DNA, 18 bp, Homo sapiens
ggcctctggactggcagc

SEQ ID NO: 9494823 - DNA, 22 bp, Homo sapiens
ggcctctggggtcctgagccca

SEQ ID NO: 9494824 - DNA, 22 bp, Homo sapiens
ggcctctggggtcctgagccca

SEQ ID NO: 9494825 - DNA, 22 bp, Homo sapiens
ggcctctggtgcctgaagcgcc

SEQ ID NO: 9494826 - DNA, 22 bp, Homo sapiens
ggcctctggtgcctgaagcgcc

SEQ ID NO: 9494827 - DNA, 22 bp, Homo sapiens
ggcctctggtcaagacaagcat

SEQ ID NO: 9494828 - DNA, 22 bp, Homo sapiens
ggcctctggttcacagggagga

SEQ ID NO: 9494829 - DNA, 22 bp, Homo sapiens
ggctaggctcacctggagagtt

SEQ ID NO: 9494830 - DNA, 22 bp, Homo sapiens
ggctcacgcaattatcccggcc

SEQ ID NO: 9494831 - DNA, 22 bp, Homo sapiens
ggctcacgcaattatcccggcc

SEQ ID NO: 9494832 - DNA, 22 bp, Homo sapiens
ggctcactgcaaactgtgcctc

SEQ ID NO: 9494833 - DNA, 22 bp, Homo sapiens
ggctcactgcaacttccgcctc

SEQ ID NO: 9494834 - DNA, 22 bp, Homo sapiens
ggctcactgcaacctctgcctc

SEQ ID NO: 9494835 - DNA, 22 bp, Homo sapiens
ggctcactgcaacttccgcctc

SEQ ID NO: 9494836 - DNA, 22 bp, Homo sapiens
ggctagggaaatcctgatccaa

SEQ ID NO: 9494837 - DNA, 22 bp, Homo sapiens
ggctagggaaatcctgatccaa

SEQ ID NO: 9494838 - DNA, 23 bp, Homo sapiens
ggctcacacggagtgcctccacc

SEQ ID NO: 9494839 - DNA, 22 bp, Homo sapiens
ggctcaccatggcctccctgct

SEQ ID NO: 9494840 - DNA, 22 bp, Homo sapiens
ggctagggacacagctctgctc

SEQ ID NO: 9494841 - DNA, 22 bp, Homo sapiens
ggctcaccattttcactctctg

SEQ ID NO: 9494842 - DNA, 22 bp, Homo sapiens
ggctgtggggggagcctgcccg

SEQ ID NO: 9494843 - DNA, 22 bp, Homo sapiens
ggctgtggggaccaacaggact

SEQ ID NO: 9494844 - DNA, 22 bp, Homo sapiens
ggctgtggccagcggggctgag

SEQ ID NO: 9494845 - DNA, 22 bp, Homo sapiens
ggctgtggccagcggggctgag

SEQ ID NO: 9494846 - DNA, 22 bp, Homo sapiens
ggctgtggccagcggggctgag

SEQ ID NO: 9494847 - DNA, 22 bp, Homo sapiens
ggctgtggccagcggggctgag

SEQ ID NO: 9494848 - DNA, 22 bp, Homo sapiens
ggctgtgggatgcataggagct

SEQ ID NO: 9494849 - DNA, 22 bp, Homo sapiens
ggctgtgggccagctagaccct

SEQ ID NO: 9494850 - DNA, 22 bp, Homo sapiens
gggaagagggagctggaatgat

SEQ ID NO: 9494851 - DNA, 22 bp, Homo sapiens
gggaagagggagctggaatgat

SEQ ID NO: 9494852 - DNA, 22 bp, Homo sapiens
gggaagagggagctggaatgat

SEQ ID NO: 9494853 - DNA, 22 bp, Homo sapiens
gggaagagggagctggaatgat

SEQ ID NO: 9494854 - DNA, 22 bp, Homo sapiens
gggaagagggagctggaatgat

SEQ ID NO: 9494855 - DNA, 22 bp, Homo sapiens
ggctgtggtcattaggaggttg

SEQ ID NO: 9494856 - DNA, 22 bp, Homo sapiens
ggctgtggtcattaggaggttg

SEQ ID NO: 9494857 - DNA, 22 bp, Homo sapiens
ggctgtggtctgggtgctcccc

SEQ ID NO: 9494858 - DNA, 22 bp, Homo sapiens
ggctgtggtctgggtgctcccc

SEQ ID NO: 9494859 - DNA, 22 bp, Homo sapiens
ggctgtggcagctggaagtggt

SEQ ID NO: 9494860 - DNA, 22 bp, Homo sapiens
ggctgtggagctgcagagttgg

SEQ ID NO: 9494861 - DNA, 21 bp, Homo sapiens
ggctgtggagccatgactcac

SEQ ID NO: 9494862 - DNA, 21 bp, Homo sapiens
ggctgtggagccatgactcac

SEQ ID NO: 9494863 - DNA, 22 bp, Homo sapiens
ggctgtggcagctggaagtggt

SEQ ID NO: 9494864 - DNA, 22 bp, Homo sapiens
ggctgtggcagctggaagtggt

SEQ ID NO: 9494865 - DNA, 22 bp, Homo sapiens
ggctgtggcagctggaagtggt

SEQ ID NO: 9494866 - DNA, 22 bp, Homo sapiens
ggctgtggcagctggaagtggt

SEQ ID NO: 9494867 - DNA, 22 bp, Homo sapiens
ggctgtggcattaggtgaggcc

SEQ ID NO: 9494868 - DNA, 22 bp, Homo sapiens
ggctgtggcattaggtgaggcc

SEQ ID NO: 9494869 - DNA, 22 bp, Homo sapiens
ggctgtggacactgagctcaga

SEQ ID NO: 9494870 - DNA, 22 bp, Homo sapiens
ggctgtggacactgagctcaga

SEQ ID NO: 9494871 - DNA, 22 bp, Homo sapiens
ggctggccagggccctcgctgg

SEQ ID NO: 9494872 - DNA, 22 bp, Homo sapiens
ggctggccagggccctcgctgg

SEQ ID NO: 9494873 - DNA, 22 bp, Homo sapiens
ggctggccagggccctcgctgg

SEQ ID NO: 9494874 - DNA, 18 bp, Homo sapiens
ggctgtgcgtggaggctg

SEQ ID NO: 9494875 - DNA, 22 bp, Homo sapiens
gggagccagccatccagaacct

SEQ ID NO: 9494876 - DNA, 23 bp, Homo sapiens
gggagccaggacctcgcgcccca

SEQ ID NO: 9494877 - DNA, 22 bp, Homo sapiens
gggagccatgctggtcttcttt

SEQ ID NO: 9494878 - DNA, 23 bp, Homo sapiens
gggagccatgggtggtcatggag

SEQ ID NO: 9494879 - DNA, 23 bp, Homo sapiens
gggagccatgggtggtcatggag

SEQ ID NO: 9494880 - DNA, 22 bp, Homo sapiens
gggagccagcagggcatggagc

SEQ ID NO: 9494881 - DNA, 22 bp, Homo sapiens
gggagccagcagggcatggagc

SEQ ID NO: 9494882 - DNA, 22 bp, Homo sapiens
gggagccagcagggcatggagc

SEQ ID NO: 9494883 - DNA, 22 bp, Homo sapiens
gggagccactcagctgagagtt

SEQ ID NO: 9494884 - DNA, 22 bp, Homo sapiens
gggagccactcagctgagagtt

SEQ ID NO: 9494885 - DNA, 22 bp, Homo sapiens
gggagccactcagctgagagtt

SEQ ID NO: 9494886 - DNA, 22 bp, Homo sapiens
gggagccagagtcacctagaga

SEQ ID NO: 9494887 - DNA, 22 bp, Homo sapiens
gggaaggccggtccagtcaggt

SEQ ID NO: 9494888 - DNA, 22 bp, Homo sapiens
gggagatggctcagaggccgcg

SEQ ID NO: 9494889 - DNA, 22 bp, Homo sapiens
gggagatgactcagtgacctcg

SEQ ID NO: 9494890 - DNA, 22 bp, Homo sapiens
gggagatggctcagaggccgcg

SEQ ID NO: 9494891 - DNA, 22 bp, Homo sapiens
gggagccacagtgaggtgcatg

SEQ ID NO: 9494892 - DNA, 22 bp, Homo sapiens
gggagccacagtgaggtgcatg

SEQ ID NO: 9494893 - DNA, 22 bp, Homo sapiens
gggagccacagtagcagctact

SEQ ID NO: 9494894 - DNA, 23 bp, Homo sapiens
gggagatgggaaatgaaggctct

SEQ ID NO: 9494895 - DNA, 22 bp, Homo sapiens
gggagccacagtagcagctact

SEQ ID NO: 9494896 - DNA, 22 bp, Homo sapiens
gggaaggcagtgggaggaactg

SEQ ID NO: 9494897 - DNA, 22 bp, Homo sapiens
gggaaggcagtgtctggttgaa

SEQ ID NO: 9494898 - DNA, 22 bp, Homo sapiens
gggaaggcagtgggaggaactg

SEQ ID NO: 9494899 - DNA, 22 bp, Homo sapiens
gggaaggcagtgggaggaactg

SEQ ID NO: 9494900 - DNA, 22 bp, Homo sapiens
gggaaggcatacctgagggaga

SEQ ID NO: 9494901 - DNA, 22 bp, Homo sapiens
gggaaggcatacctgagggaga

SEQ ID NO: 9494902 - DNA, 22 bp, Homo sapiens
gggaaggcatacctgagggaga

SEQ ID NO: 9494903 - DNA, 22 bp, Homo sapiens
gggaaggcaggcctctgttgga

SEQ ID NO: 9494904 - DNA, 22 bp, Homo sapiens
gggaaggcaggattctctggtg

SEQ ID NO: 9494905 - DNA, 22 bp, Homo sapiens
gggaaggcaggattctctggtg

SEQ ID NO: 9494906 - DNA, 22 bp, Homo sapiens
gggaaggcaccatggtgttcca

SEQ ID NO: 9494907 - DNA, 22 bp, Homo sapiens
gggaagccatgctcagaggtac

SEQ ID NO: 9494908 - DNA, 22 bp, Homo sapiens
gggaagcatctgagggtccact

SEQ ID NO: 9494909 - DNA, 22 bp, Homo sapiens
gggaagcagcattgtgctggct

SEQ ID NO: 9494910 - DNA, 22 bp, Homo sapiens
gggaagatagtgttgagggccc

SEQ ID NO: 9494911 - DNA, 22 bp, Homo sapiens
gggaagatagtgttgagggccc

SEQ ID NO: 9494912 - DNA, 22 bp, Homo sapiens
gggaagatagtgttgagggccc

SEQ ID NO: 9494913 - DNA, 22 bp, Homo sapiens
gggaagagtaactagcccatgt

SEQ ID NO: 9494914 - DNA, 22 bp, Homo sapiens
gggaagagtaactagcccatgt

SEQ ID NO: 9494915 - DNA, 22 bp, Homo sapiens
gggaagagtaactagcccatgt

SEQ ID NO: 9494916 - DNA, 22 bp, Homo sapiens
gggaagagtgtcggttgaagtg

SEQ ID NO: 9494917 - DNA, 22 bp, Homo sapiens
gggaagagtaactagcccatgt

SEQ ID NO: 9494918 - DNA, 22 bp, Homo sapiens
gggaagagtgtcggttgaagtg

SEQ ID NO: 9494919 - DNA, 17 bp, Homo sapiens
ggctggagcagctcccc

SEQ ID NO: 9494920 - DNA, 17 bp, Homo sapiens
ggctggagcagctcccc

SEQ ID NO: 9494921 - DNA, 17 bp, Homo sapiens
ggctggagcagctcccc

SEQ ID NO: 9494922 - DNA, 22 bp, Homo sapiens
ggctggaggagaatgggtgtga

SEQ ID NO: 9494923 - DNA, 17 bp, Homo sapiens
ggctggagcagctcccc

SEQ ID NO: 9494924 - DNA, 22 bp, Homo sapiens
ggctggaggagaatgggtgtga

SEQ ID NO: 9494925 - DNA, 22 bp, Homo sapiens
ggctggagacaacgtcctgccc

SEQ ID NO: 9494926 - DNA, 22 bp, Homo sapiens
ggctggagacaacgtcctgccc

SEQ ID NO: 9494927 - DNA, 22 bp, Homo sapiens
ggctgcctggacctcctctttc

SEQ ID NO: 9494928 - DNA, 22 bp, Homo sapiens
ggctgcctggacctcctctttc

SEQ ID NO: 9494929 - DNA, 22 bp, Homo sapiens
ggctgcctgctcctcctgcacg

SEQ ID NO: 9494930 - DNA, 22 bp, Homo sapiens
ggctgcctgctcctcctgcacg

SEQ ID NO: 9494931 - DNA, 22 bp, Homo sapiens
ggctgcctgctcctcctgcacg

SEQ ID NO: 9494932 - DNA, 22 bp, Homo sapiens
ggctgcctgctcaggtgcggcg

SEQ ID NO: 9494933 - DNA, 22 bp, Homo sapiens
ggctgcctgctcaggtgcggcg

SEQ ID NO: 9494934 - DNA, 22 bp, Homo sapiens
ggctgcctgctcctcctgcacg

SEQ ID NO: 9494935 - DNA, 22 bp, Homo sapiens
ggctgcctgctcctcctgcacg

SEQ ID NO: 9494936 - DNA, 22 bp, Homo sapiens
ggctgcctgcctccaagccggg

SEQ ID NO: 9494937 - DNA, 22 bp, Homo sapiens
ggctgcctgaggctgaggcccg

SEQ ID NO: 9494938 - DNA, 22 bp, Homo sapiens
ggctgcctgccgcccacttggc

SEQ ID NO: 9494939 - DNA, 22 bp, Homo sapiens
ggctgcctgccgcccacttggc

SEQ ID NO: 9494940 - DNA, 22 bp, Homo sapiens
ggctgcctgaggctgaggcccg

SEQ ID NO: 9494941 - DNA, 22 bp, Homo sapiens
ggctgcctgaggctgaggcccg

SEQ ID NO: 9494942 - DNA, 22 bp, Homo sapiens
ggctgcctctggaagctggaga

SEQ ID NO: 9494943 - DNA, 22 bp, Homo sapiens
ggctgcctctgatgtgcagacg

SEQ ID NO: 9494944 - DNA, 22 bp, Homo sapiens
ggctgcctctgatgtgcagacg

SEQ ID NO: 9494945 - DNA, 22 bp, Homo sapiens
ggctgcctctgatgtgcagacg

SEQ ID NO: 9494946 - DNA, 22 bp, Homo sapiens
ggctgcctctatttaggatcaa

SEQ ID NO: 9494947 - DNA, 22 bp, Homo sapiens
ggctgcctgaactttggggaaa

SEQ ID NO: 9494948 - DNA, 22 bp, Homo sapiens
ggctgcctctggaagctggaga

SEQ ID NO: 9494949 - DNA, 22 bp, Homo sapiens
ggctgcctctttcttagtgtct

SEQ ID NO: 9494950 - DNA, 22 bp, Homo sapiens
ggctgcctgaggcagtgagaga

SEQ ID NO: 9494951 - DNA, 22 bp, Homo sapiens
ggctggagtgggctccagagtt

SEQ ID NO: 9494952 - DNA, 19 bp, Homo sapiens
ggctggagtggccatctgt

SEQ ID NO: 9494953 - DNA, 19 bp, Homo sapiens
ggctggagtggccatctgt

SEQ ID NO: 9494954 - DNA, 22 bp, Homo sapiens
ggctggagtgggctccagagtt

SEQ ID NO: 9494955 - DNA, 22 bp, Homo sapiens
ggctggagtgggctccagagtt

SEQ ID NO: 9494956 - DNA, 22 bp, Homo sapiens
ggctggagtgggctccagagtt

SEQ ID NO: 9494957 - DNA, 17 bp, Homo sapiens
ggctggaggggacccgg

SEQ ID NO: 9494958 - DNA, 17 bp, Homo sapiens
ggctggaggggacccgg

SEQ ID NO: 9494959 - DNA, 19 bp, Homo sapiens
ggctggagtggccatctgt

SEQ ID NO: 9494960 - DNA, 22 bp, Homo sapiens
ggctggaggtagaagaacactt

SEQ ID NO: 9494961 - DNA, 22 bp, Homo sapiens
ggctggcagtgtgagagaggga

SEQ ID NO: 9494962 - DNA, 22 bp, Homo sapiens
ggctggcagtgtgagagaggga

SEQ ID NO: 9494963 - DNA, 22 bp, Homo sapiens
ggctggcaggcacagtatgcaa

SEQ ID NO: 9494964 - DNA, 22 bp, Homo sapiens
ggctggcagaagtgtgctggct

SEQ ID NO: 9494965 - DNA, 22 bp, Homo sapiens
ggctgcagttgtgtgaaggccg

SEQ ID NO: 9494966 - DNA, 22 bp, Homo sapiens
ggctgcagttgtgtgaaggccg

SEQ ID NO: 9494967 - DNA, 22 bp, Homo sapiens
ggctgccaggagaagctcagtg

SEQ ID NO: 9494968 - DNA, 22 bp, Homo sapiens
ggctgccagcactggtgtagag

SEQ ID NO: 9494969 - DNA, 22 bp, Homo sapiens
ggctgccacgtcgagggtccaa

SEQ ID NO: 9494970 - DNA, 22 bp, Homo sapiens
ggctgcctcagatttgctgact

SEQ ID NO: 9494971 - DNA, 22 bp, Homo sapiens
ggctgcctcagatttgctgact

SEQ ID NO: 9494972 - DNA, 22 bp, Homo sapiens
ggctgcctcagatttgctgact

SEQ ID NO: 9494973 - DNA, 22 bp, Homo sapiens
ggctgcctcccaggagaatctg

SEQ ID NO: 9494974 - DNA, 22 bp, Homo sapiens
ggctgcctcctcgagacaggat

SEQ ID NO: 9494975 - DNA, 22 bp, Homo sapiens
ggctgcctcctcgagacaggat

SEQ ID NO: 9494976 - DNA, 22 bp, Homo sapiens
ggctgcctccactgcttgtccc

SEQ ID NO: 9494977 - DNA, 22 bp, Homo sapiens
ggctgcctccactgcttgtccc

SEQ ID NO: 9494978 - DNA, 22 bp, Homo sapiens
ggctgcctccactgcttgtccc

SEQ ID NO: 9494979 - DNA, 22 bp, Homo sapiens
ggctgcctcccaggagaatctg

SEQ ID NO: 9494980 - DNA, 22 bp, Homo sapiens
ggctgcctcctcgagacaggat

SEQ ID NO: 9494981 - DNA, 22 bp, Homo sapiens
ggctgcctcctcgagacaggat

SEQ ID NO: 9494982 - DNA, 22 bp, Homo sapiens
ggctgcctcctgctgggctgga

SEQ ID NO: 9494983 - DNA, 22 bp, Homo sapiens
ggctgcctcctgctgggctgga

SEQ ID NO: 9494984 - DNA, 19 bp, Homo sapiens
ggctgcctcctgggagatt

SEQ ID NO: 9494985 - DNA, 19 bp, Homo sapiens
ggctgcctcctgggagatt

SEQ ID NO: 9494986 - DNA, 19 bp, Homo sapiens
ggctgcctcctgggagatt

SEQ ID NO: 9494987 - DNA, 20 bp, Homo sapiens
ggctgcctccttcctttcct

SEQ ID NO: 9494988 - DNA, 20 bp, Homo sapiens
ggctgcctccttcctttcct

SEQ ID NO: 9494989 - DNA, 22 bp, Homo sapiens
ggctgcctctatttaggatcaa

SEQ ID NO: 9494990 - DNA, 22 bp, Homo sapiens
ggctgcctctatttaggatcaa

SEQ ID NO: 9494991 - DNA, 20 bp, Homo sapiens
ggctgcctccttcctttcct

SEQ ID NO: 9494992 - DNA, 22 bp, Homo sapiens
ggctgcaggcttccctccagca

SEQ ID NO: 9494993 - DNA, 22 bp, Homo sapiens
ggctgcaggcttccctccagca

SEQ ID NO: 9494994 - DNA, 22 bp, Homo sapiens
ggctgcaggcttccctccagca

SEQ ID NO: 9494995 - DNA, 21 bp, Homo sapiens
ggctgcagggagccctggggt

SEQ ID NO: 9494996 - DNA, 21 bp, Homo sapiens
ggctgcagggagccctggggt

SEQ ID NO: 9494997 - DNA, 22 bp, Homo sapiens
ggctgcaggcagggtatccact

SEQ ID NO: 9494998 - DNA, 22 bp, Homo sapiens
ggctgcaggcagggtatccact

SEQ ID NO: 9494999 - DNA, 22 bp, Homo sapiens
ggctgcaggcagggtatccact

SEQ ID NO: 9495000 - DNA, 22 bp, Homo sapiens
ggctgcaggcagggtatccact

SEQ ID NO: 9495001 - DNA, 20 bp, Homo sapiens
ggctgcagtgcacctcatct

SEQ ID NO: 9495002 - DNA, 20 bp, Homo sapiens
ggctgcagtgcacctcatct

SEQ ID NO: 9495003 - DNA, 17 bp, Homo sapiens
ggctgcagtccaggagg

SEQ ID NO: 9495004 - DNA, 17 bp, Homo sapiens
ggctgcagtccaggagg

SEQ ID NO: 9495005 - DNA, 17 bp, Homo sapiens
ggctgcagtccaggagg

SEQ ID NO: 9495006 - DNA, 17 bp, Homo sapiens
ggctgcagtccaggagg

SEQ ID NO: 9495007 - DNA, 17 bp, Homo sapiens
ggctgcagtccaggagg

SEQ ID NO: 9495008 - DNA, 22 bp, Homo sapiens
ggctgcagggcagctggtgtgg

SEQ ID NO: 9495009 - DNA, 22 bp, Homo sapiens
ggctgcaggttggttggcagct

SEQ ID NO: 9495010 - DNA, 22 bp, Homo sapiens
ggctgcaggttggttggcagct

SEQ ID NO: 9495011 - DNA, 22 bp, Homo sapiens
ggctgcaggttggttggcagct

SEQ ID NO: 9495012 - DNA, 22 bp, Homo sapiens
ggctgcaggttggttggcagct

SEQ ID NO: 9495013 - DNA, 22 bp, Homo sapiens
gggagctgaatggcaatggaga

SEQ ID NO: 9495014 - DNA, 22 bp, Homo sapiens
gggagctgaatggcaatggaga

SEQ ID NO: 9495015 - DNA, 22 bp, Homo sapiens
gggagctgaatggcaatggaga

SEQ ID NO: 9495016 - DNA, 22 bp, Homo sapiens
gggaggttgaggctgcagtgag

SEQ ID NO: 9495017 - DNA, 22 bp, Homo sapiens
gggagtcagagaggtaatggga

SEQ ID NO: 9495018 - DNA, 22 bp, Homo sapiens
gggaggttgaggctgcagtgag

SEQ ID NO: 9495019 - DNA, 22 bp, Homo sapiens
gggaggttgaggctgcagtgag

SEQ ID NO: 9495020 - DNA, 22 bp, Homo sapiens
gggagtggagagcaatggatga

SEQ ID NO: 9495021 - DNA, 22 bp, Homo sapiens
gggagtggagagcaatggatga

SEQ ID NO: 9495022 - DNA, 22 bp, Homo sapiens
gggagtggagagcaatggatga

SEQ ID NO: 9495023 - DNA, 22 bp, Homo sapiens
gggagtcagtgaaggagtcaga

SEQ ID NO: 9495024 - DNA, 22 bp, Homo sapiens
gggagtcaggctccctcagaga

SEQ ID NO: 9495025 - DNA, 22 bp, Homo sapiens
gggagtcaggctccctcagaga

SEQ ID NO: 9495026 - DNA, 22 bp, Homo sapiens
gggagcgggactgcgcaggctt

SEQ ID NO: 9495027 - DNA, 22 bp, Homo sapiens
gggagcgggactgcgcaggctt

SEQ ID NO: 9495028 - DNA, 22 bp, Homo sapiens
gggagctctccctgaggcctgg

SEQ ID NO: 9495029 - DNA, 22 bp, Homo sapiens
gggagctccactgcctctcatt

SEQ ID NO: 9495030 - DNA, 22 bp, Homo sapiens
gggagctgaactgctgaagttg

SEQ ID NO: 9495031 - DNA, 22 bp, Homo sapiens
gggagctgaactgctgaagttg

SEQ ID NO: 9495032 - DNA, 22 bp, Homo sapiens
gggagctgaactgctgaagttg

SEQ ID NO: 9495033 - DNA, 22 bp, Homo sapiens
gggagctgaagtaggggtaaat

SEQ ID NO: 9495034 - DNA, 22 bp, Homo sapiens
gggagctgaagtaggggtaaat

SEQ ID NO: 9495035 - DNA, 22 bp, Homo sapiens
gggagctgaaggagccggcggg

SEQ ID NO: 9495036 - DNA, 22 bp, Homo sapiens
gggagctgaaggagccggcggg

SEQ ID NO: 9495037 - DNA, 22 bp, Homo sapiens
gggataggagattgggagtgtt

SEQ ID NO: 9495038 - DNA, 22 bp, Homo sapiens
gggataggtttggaagaggtgg

SEQ ID NO: 9495039 - DNA, 22 bp, Homo sapiens
gggataggtttggaagaggtgg

SEQ ID NO: 9495040 - DNA, 22 bp, Homo sapiens
gggagtgtgcagaagctggggg

SEQ ID NO: 9495041 - DNA, 19 bp, Homo sapiens
gggatcagcccagggctct

SEQ ID NO: 9495042 - DNA, 20 bp, Homo sapiens
gggatcaggaaaggaggcta

SEQ ID NO: 9495043 - DNA, 19 bp, Homo sapiens
gggatcagcccagggctct

SEQ ID NO: 9495044 - DNA, 22 bp, Homo sapiens
gggagtgggtttggcctaggcc

SEQ ID NO: 9495045 - DNA, 22 bp, Homo sapiens
gggagtgggtttggcctaggcc

SEQ ID NO: 9495046 - DNA, 20 bp, Homo sapiens
gggagtggtggtagcctgtg

SEQ ID NO: 9495047 - DNA, 20 bp, Homo sapiens
gggagtggtggtagcctgtg

SEQ ID NO: 9495048 - DNA, 20 bp, Homo sapiens
gggagtggtggtagcctgtg

SEQ ID NO: 9495049 - DNA, 22 bp, Homo sapiens
gggagtggattatgtggaccca

SEQ ID NO: 9495050 - DNA, 22 bp, Homo sapiens
gggagtggattatgtggaccca

SEQ ID NO: 9495051 - DNA, 22 bp, Homo sapiens
gggagtgggtttggcctaggcc

SEQ ID NO: 9495052 - DNA, 21 bp, Homo sapiens
gggcagaggggcctcctgggt

SEQ ID NO: 9495053 - DNA, 21 bp, Homo sapiens
gggcagaggggcctcctgggt

SEQ ID NO: 9495054 - DNA, 21 bp, Homo sapiens
gggcagaggggcctcctgggt

SEQ ID NO: 9495055 - DNA, 21 bp, Homo sapiens
gggcagaggggcctcctgggt

SEQ ID NO: 9495056 - DNA, 17 bp, Homo sapiens
gggcagggactcctggg

SEQ ID NO: 9495057 - DNA, 17 bp, Homo sapiens
gggcagggactcctggg

SEQ ID NO: 9495058 - DNA, 21 bp, Homo sapiens
gggcaggtctctgatgtcaac

SEQ ID NO: 9495059 - DNA, 22 bp, Homo sapiens
gggcaggtctgggtcagcctga

SEQ ID NO: 9495060 - DNA, 22 bp, Homo sapiens
gggcaggtctgggtcagcctga

SEQ ID NO: 9495061 - DNA, 17 bp, Homo sapiens
gggcagggactcctggg

SEQ ID NO: 9495062 - DNA, 17 bp, Homo sapiens
gggcagggactcctggg

SEQ ID NO: 9495063 - DNA, 21 bp, Homo sapiens
gggcaggtctctgatgtcaac

SEQ ID NO: 9495064 - DNA, 21 bp, Homo sapiens
gggcaggtctctgatgtcaac

SEQ ID NO: 9495065 - DNA, 21 bp, Homo sapiens
gggcaggtctctgatgtcaac

SEQ ID NO: 9495066 - DNA, 22 bp, Homo sapiens
gggcaggtgacctcttgtcctg

SEQ ID NO: 9495067 - DNA, 22 bp, Homo sapiens
gggcaggtgcccagggccagag

SEQ ID NO: 9495068 - DNA, 22 bp, Homo sapiens
gggcaggtgcccagggccagag

SEQ ID NO: 9495069 - DNA, 22 bp, Homo sapiens
gggcagagagctggaactcctt

SEQ ID NO: 9495070 - DNA, 22 bp, Homo sapiens
gggcagagactcagaaacagaa

SEQ ID NO: 9495071 - DNA, 22 bp, Homo sapiens
gggcagagactcagaaacagaa

SEQ ID NO: 9495072 - DNA, 22 bp, Homo sapiens
gggcagagactcagaaacagaa

SEQ ID NO: 9495073 - DNA, 22 bp, Homo sapiens
gggcagagactcagaaacagaa

SEQ ID NO: 9495074 - DNA, 22 bp, Homo sapiens
gggcagagactcagaaacagaa

SEQ ID NO: 9495075 - DNA, 22 bp, Homo sapiens
gggcagagactcagaaacagaa

SEQ ID NO: 9495076 - DNA, 22 bp, Homo sapiens
gggcactgtacactgtgcatgg

SEQ ID NO: 9495077 - DNA, 22 bp, Homo sapiens
gggatccatccgtgcagcagag

SEQ ID NO: 9495078 - DNA, 20 bp, Homo sapiens
gggatcaggaaaggaggcta

SEQ ID NO: 9495079 - DNA, 20 bp, Homo sapiens
gggcagagccagccagtccc

SEQ ID NO: 9495080 - DNA, 20 bp, Homo sapiens
gggcagagccagccagtccc

SEQ ID NO: 9495081 - DNA, 20 bp, Homo sapiens
gggcagagccagccagtccc

SEQ ID NO: 9495082 - DNA, 22 bp, Homo sapiens
gggcagaggctctggcccatcc

SEQ ID NO: 9495083 - DNA, 22 bp, Homo sapiens
gggcagagagctggaactcctt

SEQ ID NO: 9495084 - DNA, 20 bp, Homo sapiens
gggcagagccagccagtccc

SEQ ID NO: 9495085 - DNA, 20 bp, Homo sapiens
gggcagagccagccagtccc

SEQ ID NO: 9495086 - DNA, 20 bp, Homo sapiens
gggcagagccagccagtccc

SEQ ID NO: 9495087 - DNA, 22 bp, Homo sapiens
gggctctggacccaggcaagag

SEQ ID NO: 9495088 - DNA, 22 bp, Homo sapiens
gggctctggacccaggcaagag

SEQ ID NO: 9495089 - DNA, 22 bp, Homo sapiens
gggctctggaaggtgcaccatg

SEQ ID NO: 9495090 - DNA, 22 bp, Homo sapiens
gggctctggaaggtgcaccatg

SEQ ID NO: 9495091 - DNA, 22 bp, Homo sapiens
gggctctggaaatgggagctcc

SEQ ID NO: 9495092 - DNA, 22 bp, Homo sapiens
gggctctggaaatgggagctcc

SEQ ID NO: 9495093 - DNA, 22 bp, Homo sapiens
gggctctggaaatgggagctcc

SEQ ID NO: 9495094 - DNA, 22 bp, Homo sapiens
gggctctggaaatgggagctcc

SEQ ID NO: 9495095 - DNA, 22 bp, Homo sapiens
gggctctggatggagcctgcag

SEQ ID NO: 9495096 - DNA, 22 bp, Homo sapiens
gggctctggatggagcctgcag

SEQ ID NO: 9495097 - DNA, 22 bp, Homo sapiens
gggctctggagttctagaaaga

SEQ ID NO: 9495098 - DNA, 22 bp, Homo sapiens
gggctctggagttctagaaaga

SEQ ID NO: 9495099 - DNA, 22 bp, Homo sapiens
gggctctggacccaggcaagag

SEQ ID NO: 9495100 - DNA, 18 bp, Homo sapiens
gggctctggcatctgggt

SEQ ID NO: 9495101 - DNA, 22 bp, Homo sapiens
gggctctggatggagcctgcag

SEQ ID NO: 9495102 - DNA, 22 bp, Homo sapiens
gggctctggatggagcctgcag

SEQ ID NO: 9495103 - DNA, 22 bp, Homo sapiens
gggctctggatggagcctgcag

SEQ ID NO: 9495104 - DNA, 22 bp, Homo sapiens
gggctctgagctctgggaatta

SEQ ID NO: 9495105 - DNA, 22 bp, Homo sapiens
gggctctgactgaatattgaat

SEQ ID NO: 9495106 - DNA, 22 bp, Homo sapiens
gggctctgaatgagttaccaag

SEQ ID NO: 9495107 - DNA, 22 bp, Homo sapiens
gggctctgaatcccaggtctgc

SEQ ID NO: 9495108 - DNA, 22 bp, Homo sapiens
gggctctgaatcccaggtctgc

SEQ ID NO: 9495109 - DNA, 22 bp, Homo sapiens
gggctctgaatcccaggtctgc

SEQ ID NO: 9495110 - DNA, 22 bp, Homo sapiens
gggctccaactacatcagcctt

SEQ ID NO: 9495111 - DNA, 22 bp, Homo sapiens
gggctccaactacatcagcctt

SEQ ID NO: 9495112 - DNA, 22 bp, Homo sapiens
gggctccaactacatcagcctt

SEQ ID NO: 9495113 - DNA, 22 bp, Homo sapiens
gggctccaacggtgagcatgga

SEQ ID NO: 9495114 - DNA, 22 bp, Homo sapiens
gggctccaacggtgagcatgga

SEQ ID NO: 9495115 - DNA, 22 bp, Homo sapiens
gggctccaaaatctatgtcttc

SEQ ID NO: 9495116 - DNA, 22 bp, Homo sapiens
gggctccaaaatcctgtagcct

SEQ ID NO: 9495117 - DNA, 22 bp, Homo sapiens
gggctccaaaatctatgtcttc

SEQ ID NO: 9495118 - DNA, 22 bp, Homo sapiens
gggctcattcatctgggcttgg

SEQ ID NO: 9495119 - DNA, 22 bp, Homo sapiens
gggctcagttctgcttcatgct

SEQ ID NO: 9495120 - DNA, 22 bp, Homo sapiens
gggctcagttctgcttcatgct

SEQ ID NO: 9495121 - DNA, 21 bp, Homo sapiens
gggctcagtggaaaagagtgt

SEQ ID NO: 9495122 - DNA, 21 bp, Homo sapiens
gggctcagtggaaaagagtgt

SEQ ID NO: 9495123 - DNA, 21 bp, Homo sapiens
gggctcagtggaaaagagtgt

SEQ ID NO: 9495124 - DNA, 22 bp, Homo sapiens
gggctcagctccttccttccta

SEQ ID NO: 9495125 - DNA, 22 bp, Homo sapiens
gggctcagctgggcgtgctggt

SEQ ID NO: 9495126 - DNA, 22 bp, Homo sapiens
gggctcagctccttccttccta

SEQ ID NO: 9495127 - DNA, 22 bp, Homo sapiens
gggctcagctccttccttccta

SEQ ID NO: 9495128 - DNA, 22 bp, Homo sapiens
gggctcagagcatttgggttgg

SEQ ID NO: 9495129 - DNA, 22 bp, Homo sapiens
gggctcagagcatttgggttgg

SEQ ID NO: 9495130 - DNA, 22 bp, Homo sapiens
gggctcagacatccctcctgga

SEQ ID NO: 9495131 - DNA, 23 bp, Homo sapiens
gggctcagatttcattctgtgcc

SEQ ID NO: 9495132 - DNA, 22 bp, Homo sapiens
gggctcagaggagtggcctggg

SEQ ID NO: 9495133 - DNA, 22 bp, Homo sapiens
gggctcagcctcctcacttcga

SEQ ID NO: 9495134 - DNA, 22 bp, Homo sapiens
gggctcagcctcctcacttcga

SEQ ID NO: 9495135 - DNA, 22 bp, Homo sapiens
gggcccagtaccctctgccaag

SEQ ID NO: 9495136 - DNA, 22 bp, Homo sapiens
gggcccagtaccctctgccaag

SEQ ID NO: 9495137 - DNA, 22 bp, Homo sapiens
gggcccaggcctccttccttcc

SEQ ID NO: 9495138 - DNA, 22 bp, Homo sapiens
gggcaggtgtttccaaggtgag

SEQ ID NO: 9495139 - DNA, 22 bp, Homo sapiens
gggccccaagaacctcctcctg

SEQ ID NO: 9495140 - DNA, 22 bp, Homo sapiens
gggccccaaaatgccaggctct

SEQ ID NO: 9495141 - DNA, 22 bp, Homo sapiens
gggccccaaaatgccaggctct

SEQ ID NO: 9495142 - DNA, 22 bp, Homo sapiens
gggccccactggggctgcctgc

SEQ ID NO: 9495143 - DNA, 22 bp, Homo sapiens
gggccccactggggctgcctgc

SEQ ID NO: 9495144 - DNA, 22 bp, Homo sapiens
gggccccagtcctcccacgtgg

SEQ ID NO: 9495145 - DNA, 22 bp, Homo sapiens
gggccccagtcctcccacgtgg

SEQ ID NO: 9495146 - DNA, 22 bp, Homo sapiens
gggccccagtcctcccacgtgg

SEQ ID NO: 9495147 - DNA, 22 bp, Homo sapiens
gggcaggtggagggcccagcca

SEQ ID NO: 9495148 - DNA, 22 bp, Homo sapiens
gggcaggtggcaaagccagagg

SEQ ID NO: 9495149 - DNA, 22 bp, Homo sapiens
gggcaggtggcaaagccagagg

SEQ ID NO: 9495150 - DNA, 22 bp, Homo sapiens
gggcaggtggcagggtctctgg

SEQ ID NO: 9495151 - DNA, 22 bp, Homo sapiens
gggcaggtggcctcttgtacta

SEQ ID NO: 9495152 - DNA, 22 bp, Homo sapiens
gggcaggtgtgcagagctgttg

SEQ ID NO: 9495153 - DNA, 22 bp, Homo sapiens
gggcaggtgtgcagagctgttg

SEQ ID NO: 9495154 - DNA, 22 bp, Homo sapiens
gggcaggtgtgcagagctgttg

SEQ ID NO: 9495155 - DNA, 22 bp, Homo sapiens
gggcaggtgttgtcaatctaat

SEQ ID NO: 9495156 - DNA, 22 bp, Homo sapiens
gggcaggtgtttccaaggtgag

SEQ ID NO: 9495157 - DNA, 22 bp, Homo sapiens
gggcaggtgtttccaaggtgag

SEQ ID NO: 9495158 - DNA, 22 bp, Homo sapiens
gggccctgcctaaggaacacac

SEQ ID NO: 9495159 - DNA, 22 bp, Homo sapiens
gggccctgcctaaggaacacac

SEQ ID NO: 9495160 - DNA, 22 bp, Homo sapiens
gggccctgcgactcgcggcgga

SEQ ID NO: 9495161 - DNA, 22 bp, Homo sapiens
gggccctgggattcagagcaag

SEQ ID NO: 9495162 - DNA, 22 bp, Homo sapiens
gggccctggggatgtggacgcg

SEQ ID NO: 9495163 - DNA, 22 bp, Homo sapiens
gggccctggggatgtggacgcg

SEQ ID NO: 9495164 - DNA, 22 bp, Homo sapiens
gggccctcagtcccaggccttc

SEQ ID NO: 9495165 - DNA, 22 bp, Homo sapiens
gggccctctgcagctgcccagg

SEQ ID NO: 9495166 - DNA, 22 bp, Homo sapiens
gggccctgatctgtgagcgcag

SEQ ID NO: 9495167 - DNA, 22 bp, Homo sapiens
gggccctgccccgtggctctga

SEQ ID NO: 9495168 - DNA, 22 bp, Homo sapiens
gggccctgtgatttcttgagga

SEQ ID NO: 9495169 - DNA, 22 bp, Homo sapiens
gggccctggggcctgatttgca

SEQ ID NO: 9495170 - DNA, 22 bp, Homo sapiens
gggccctggggcctgatttgca

SEQ ID NO: 9495171 - DNA, 22 bp, Homo sapiens
gggccggagctgggtcccgcgc

SEQ ID NO: 9495172 - DNA, 22 bp, Homo sapiens
gggccggagctgggtcccgcgc

SEQ ID NO: 9495173 - DNA, 22 bp, Homo sapiens
gggccggagctgggtcccgcgc

SEQ ID NO: 9495174 - DNA, 22 bp, Homo sapiens
gggtgcagctttgaaagcatgt

SEQ ID NO: 9495175 - DNA, 22 bp, Homo sapiens
gggtgcagcagagctcctctgt

SEQ ID NO: 9495176 - DNA, 22 bp, Homo sapiens
gggtgcagctttgaaagcatgt

SEQ ID NO: 9495177 - DNA, 22 bp, Homo sapiens
gggtgcaggcagcccaggcagg

SEQ ID NO: 9495178 - DNA, 18 bp, Homo sapiens
gggtgcaggcactgactg

SEQ ID NO: 9495179 - DNA, 18 bp, Homo sapiens
gggtgcaggcactgactg

SEQ ID NO: 9495180 - DNA, 22 bp, Homo sapiens
gggtgctgggaggctgacatct

SEQ ID NO: 9495181 - DNA, 22 bp, Homo sapiens
gggtgctgggaggctgacatct

SEQ ID NO: 9495182 - DNA, 22 bp, Homo sapiens
gggtgcaggcagcccaggcagg

SEQ ID NO: 9495183 - DNA, 22 bp, Homo sapiens
gggtgcaggcagcccaggcagg

SEQ ID NO: 9495184 - DNA, 22 bp, Homo sapiens
gggtgcaggcagcccaggcagg

SEQ ID NO: 9495185 - DNA, 21 bp, Homo sapiens
gggtgctgtggtcatgcagga

SEQ ID NO: 9495186 - DNA, 21 bp, Homo sapiens
gggtgctgtggtcatgcagga

SEQ ID NO: 9495187 - DNA, 21 bp, Homo sapiens
gggtgctgtggtcatgcagga

SEQ ID NO: 9495188 - DNA, 22 bp, Homo sapiens
gggtgaggccttgctgccatca

SEQ ID NO: 9495189 - DNA, 22 bp, Homo sapiens
gggtgagggatgagccttcttc

SEQ ID NO: 9495190 - DNA, 22 bp, Homo sapiens
gggtgcagcagagctcctctgt

SEQ ID NO: 9495191 - DNA, 22 bp, Homo sapiens
gggtgatttgcaaaataagtgt

SEQ ID NO: 9495192 - DNA, 22 bp, Homo sapiens
gggtgaggagctgccagtcatg

SEQ ID NO: 9495193 - DNA, 22 bp, Homo sapiens
gggtgaggagctgccagtcatg

SEQ ID NO: 9495194 - DNA, 20 bp, Homo sapiens
gggtgaggatggagaatttg

SEQ ID NO: 9495195 - DNA, 20 bp, Homo sapiens
gggtgaggatggagaatttg

SEQ ID NO: 9495196 - DNA, 22 bp, Homo sapiens
gggtgaggccttgctgccatca

SEQ ID NO: 9495197 - DNA, 22 bp, Homo sapiens
gggtgaggcccatttgaggcca

SEQ ID NO: 9495198 - DNA, 22 bp, Homo sapiens
gggtggtggccagcagtgggca

SEQ ID NO: 9495199 - DNA, 22 bp, Homo sapiens
gggtggtgagatgtagctgatg

SEQ ID NO: 9495200 - DNA, 22 bp, Homo sapiens
gggtggtctggcaggctggaaa

SEQ ID NO: 9495201 - DNA, 21 bp, Homo sapiens
gggtggtctagctcaggaact

SEQ ID NO: 9495202 - DNA, 22 bp, Homo sapiens
gggtggtgggcacagaatctgg

SEQ ID NO: 9495203 - DNA, 22 bp, Homo sapiens
gggtggtgtattagagctgcag

SEQ ID NO: 9495204 - DNA, 22 bp, Homo sapiens
gggtggtgtattagagctgcag

SEQ ID NO: 9495205 - DNA, 22 bp, Homo sapiens
gggtggtggcggaggctccagg

SEQ ID NO: 9495206 - DNA, 22 bp, Homo sapiens
gggtggtggccagcagtgggca

SEQ ID NO: 9495207 - DNA, 22 bp, Homo sapiens
gggtggtggccagcagtgggca

SEQ ID NO: 9495208 - DNA, 22 bp, Homo sapiens
gggtggagaggctaagtccagt

SEQ ID NO: 9495209 - DNA, 22 bp, Homo sapiens
gggtggagaggctaagtccagt

SEQ ID NO: 9495210 - DNA, 22 bp, Homo sapiens
gggtggagccagttgactctgt

SEQ ID NO: 9495211 - DNA, 22 bp, Homo sapiens
gggtggagagaaagaaacgtga

SEQ ID NO: 9495212 - DNA, 22 bp, Homo sapiens
gggtggagagaaagaaacgtga

SEQ ID NO: 9495213 - DNA, 22 bp, Homo sapiens
gggtggagagaaagaaacgtga

SEQ ID NO: 9495214 - DNA, 22 bp, Homo sapiens
gggtgggtggtccgcagacata

SEQ ID NO: 9495215 - DNA, 22 bp, Homo sapiens
gggtgggtggtccgcagacata

SEQ ID NO: 9495216 - DNA, 22 bp, Homo sapiens
gggtgggtggcagcaccgaggc

SEQ ID NO: 9495217 - DNA, 21 bp, Homo sapiens
gggtggggttccagccttttc

SEQ ID NO: 9495218 - DNA, 21 bp, Homo sapiens
gggtgggtggaattaggagtg

SEQ ID NO: 9495219 - DNA, 21 bp, Homo sapiens
gggtggggttccagccttttc

SEQ ID NO: 9495220 - DNA, 21 bp, Homo sapiens
gggtggggttccagccttttc

SEQ ID NO: 9495221 - DNA, 21 bp, Homo sapiens
gggtggggttccagccttttc

SEQ ID NO: 9495222 - DNA, 22 bp, Homo sapiens
ggggtggatttcaggcggtgtc

SEQ ID NO: 9495223 - DNA, 22 bp, Homo sapiens
ggggtggatcaggcaggcccag

SEQ ID NO: 9495224 - DNA, 22 bp, Homo sapiens
ggggtggagatggtggcccttt

SEQ ID NO: 9495225 - DNA, 22 bp, Homo sapiens
ggggtggagatggtggcccttt

SEQ ID NO: 9495226 - DNA, 22 bp, Homo sapiens
ggggtgctgaagatgtcatggt

SEQ ID NO: 9495227 - DNA, 19 bp, Homo sapiens
ggggtgctagggagggatc

SEQ ID NO: 9495228 - DNA, 19 bp, Homo sapiens
ggggtgctagggagggatc

SEQ ID NO: 9495229 - DNA, 22 bp, Homo sapiens
ggggtgctagagtggggccact

SEQ ID NO: 9495230 - DNA, 18 bp, Homo sapiens
ggggtgcccagactgtct

SEQ ID NO: 9495231 - DNA, 19 bp, Homo sapiens
ggggtggctggggctccag

SEQ ID NO: 9495232 - DNA, 22 bp, Homo sapiens
ggggtgggagtgccatccttga

SEQ ID NO: 9495233 - DNA, 22 bp, Homo sapiens
ggggtgggagtgccatccttga

SEQ ID NO: 9495234 - DNA, 22 bp, Homo sapiens
ggggtgggagtgccatccttga

SEQ ID NO: 9495235 - DNA, 22 bp, Homo sapiens
ggggtgggagtgccatccttga

SEQ ID NO: 9495236 - DNA, 22 bp, Homo sapiens
ggggtgggagtgccatccttga

SEQ ID NO: 9495237 - DNA, 22 bp, Homo sapiens
ggggtgggagtgccatccttga

SEQ ID NO: 9495238 - DNA, 22 bp, Homo sapiens
ggggtgggagtgccatccttga

SEQ ID NO: 9495239 - DNA, 22 bp, Homo sapiens
ggggtgggcgtgcagggacacc

SEQ ID NO: 9495240 - DNA, 22 bp, Homo sapiens
ggggtggcctgtaggcagcatg

SEQ ID NO: 9495241 - DNA, 22 bp, Homo sapiens
ggggtggcctgtaggcagcatg

SEQ ID NO: 9495242 - DNA, 22 bp, Homo sapiens
ggggtggctggcacctcctggt

SEQ ID NO: 9495243 - DNA, 22 bp, Homo sapiens
ggggtggctggcacctcctggt

SEQ ID NO: 9495244 - DNA, 19 bp, Homo sapiens
ggggtggctggggctccag

SEQ ID NO: 9495245 - DNA, 19 bp, Homo sapiens
ggggtggctggggctccag

SEQ ID NO: 9495246 - DNA, 22 bp, Homo sapiens
ggggcccagggcagcagtgcag

SEQ ID NO: 9495247 - DNA, 22 bp, Homo sapiens
ggggtgagttagcgtcggcttg

SEQ ID NO: 9495248 - DNA, 22 bp, Homo sapiens
ggggtgagttagcgtcggcttg

SEQ ID NO: 9495249 - DNA, 22 bp, Homo sapiens
ggggtgagtgctcagccccgga

SEQ ID NO: 9495250 - DNA, 22 bp, Homo sapiens
ggggtagggcgattgctgcttt

SEQ ID NO: 9495251 - DNA, 22 bp, Homo sapiens
ggggtaggcaggtgatctgatc

SEQ ID NO: 9495252 - DNA, 22 bp, Homo sapiens
ggggccaggtccagcttccaaa

SEQ ID NO: 9495253 - DNA, 22 bp, Homo sapiens
ggggccagtaggagtgatgtac

SEQ ID NO: 9495254 - DNA, 22 bp, Homo sapiens
ggggccagtaggagtgatgtac

SEQ ID NO: 9495255 - DNA, 22 bp, Homo sapiens
ggggccagtaggagtgatgtac

SEQ ID NO: 9495256 - DNA, 22 bp, Homo sapiens
ggggccagtaggagtgatgtac

SEQ ID NO: 9495257 - DNA, 22 bp, Homo sapiens
ggggccagcttcgcgtgctctt

SEQ ID NO: 9495258 - DNA, 22 bp, Homo sapiens
ggggccagcaatgttgaggaat

SEQ ID NO: 9495259 - DNA, 22 bp, Homo sapiens
ggggccagatatcactaaggtt

SEQ ID NO: 9495260 - DNA, 22 bp, Homo sapiens
ggggccagatatcactaaggtt

SEQ ID NO: 9495261 - DNA, 22 bp, Homo sapiens
ggggccagcaatgttgaggaat

SEQ ID NO: 9495262 - DNA, 22 bp, Homo sapiens
ggggccaagggaatgtattgtg

SEQ ID NO: 9495263 - DNA, 22 bp, Homo sapiens
ggggccagagaggacccaggtg

SEQ ID NO: 9495264 - DNA, 22 bp, Homo sapiens
ggggccagagaggacccaggtg

SEQ ID NO: 9495265 - DNA, 22 bp, Homo sapiens
ggggcagtttctcgtttgccat

SEQ ID NO: 9495266 - DNA, 20 bp, Homo sapiens
ggggcaggtttttatggcta

SEQ ID NO: 9495267 - DNA, 20 bp, Homo sapiens
ggggcaggtttttatggcta

SEQ ID NO: 9495268 - DNA, 20 bp, Homo sapiens
ggggcaggtttttatggcta

SEQ ID NO: 9495269 - DNA, 22 bp, Homo sapiens
ggggcagggaggttatcgccga

SEQ ID NO: 9495270 - DNA, 22 bp, Homo sapiens
ggggcagggaggttatcgccga

SEQ ID NO: 9495271 - DNA, 22 bp, Homo sapiens
ggggcaggaggtgttctctttt

SEQ ID NO: 9495272 - DNA, 22 bp, Homo sapiens
ggggagttaaaatgtgctgcaa

SEQ ID NO: 9495273 - DNA, 19 bp, Homo sapiens
ggggaggtattgttttcat

SEQ ID NO: 9495274 - DNA, 22 bp, Homo sapiens
ggggagtgacgcagggccatag

SEQ ID NO: 9495275 - DNA, 22 bp, Homo sapiens
ggggagtgacgcagggccatag

SEQ ID NO: 9495276 - DNA, 22 bp, Homo sapiens
ggggagtgttttcatgggcttg

SEQ ID NO: 9495277 - DNA, 22 bp, Homo sapiens
ggggagtgttttcatgggcttg

SEQ ID NO: 9495278 - DNA, 22 bp, Homo sapiens
ggggagtggttgcctgtgatcc

SEQ ID NO: 9495279 - DNA, 22 bp, Homo sapiens
gggcttctgtacctacctggaa

SEQ ID NO: 9495280 - DNA, 19 bp, Homo sapiens
ggggagaactagagacagc

SEQ ID NO: 9495281 - DNA, 22 bp, Homo sapiens
ggggagaataaatcagatttta

SEQ ID NO: 9495282 - DNA, 22 bp, Homo sapiens
ggggaggaagctggaacacggg

SEQ ID NO: 9495283 - DNA, 22 bp, Homo sapiens
ggggaggaagctggaacacggg

SEQ ID NO: 9495284 - DNA, 22 bp, Homo sapiens
ggggaggacctttccaaggctt

SEQ ID NO: 9495285 - DNA, 22 bp, Homo sapiens
ggggaggaagctggaacacggg

SEQ ID NO: 9495286 - DNA, 22 bp, Homo sapiens
ggggaggaagctggaacacggg

SEQ ID NO: 9495287 - DNA, 22 bp, Homo sapiens
ggggaggaagctggaacacggg

SEQ ID NO: 9495288 - DNA, 22 bp, Homo sapiens
ggggaggctgatgtgggcaaag

SEQ ID NO: 9495289 - DNA, 22 bp, Homo sapiens
ggggaggctgatgtgggcaaag

SEQ ID NO: 9495290 - DNA, 22 bp, Homo sapiens
ggggaggctgatgtgggcaaag

SEQ ID NO: 9495291 - DNA, 22 bp, Homo sapiens
ggggaggcaagatgaagtgagg

SEQ ID NO: 9495292 - DNA, 22 bp, Homo sapiens
ggggaggcaagatgaagtgagg

SEQ ID NO: 9495293 - DNA, 22 bp, Homo sapiens
ggggaggacctttccaaggctt

SEQ ID NO: 9495294 - DNA, 22 bp, Homo sapiens
ggggaggacctttccaaggctt

SEQ ID NO: 9495295 - DNA, 22 bp, Homo sapiens
ggggaggagccatgtaactagt

SEQ ID NO: 9495296 - DNA, 22 bp, Homo sapiens
ggggaggagtgtacaggtttat

SEQ ID NO: 9495297 - DNA, 22 bp, Homo sapiens
ggggaggcaagatgaagtgagg

SEQ ID NO: 9495298 - DNA, 20 bp, Homo sapiens
gggctctggccaatgctttg

SEQ ID NO: 9495299 - DNA, 18 bp, Homo sapiens
gggctctggcatctgggt

SEQ ID NO: 9495300 - DNA, 18 bp, Homo sapiens
gggctctggcatctgggt

SEQ ID NO: 9495301 - DNA, 18 bp, Homo sapiens
gggctctggcatctgggt

SEQ ID NO: 9495302 - DNA, 18 bp, Homo sapiens
gggctctggcatctgggt

SEQ ID NO: 9495303 - DNA, 22 bp, Homo sapiens
gggctctgggatgctcttagag

SEQ ID NO: 9495304 - DNA, 19 bp, Homo sapiens
gggctctggcctcagtggg

SEQ ID NO: 9495305 - DNA, 19 bp, Homo sapiens
gggctctggcctcagtggg

SEQ ID NO: 9495306 - DNA, 19 bp, Homo sapiens
gggctctggcctcagtggg

SEQ ID NO: 9495307 - DNA, 19 bp, Homo sapiens
gggctctggcctcagtggg

SEQ ID NO: 9495308 - DNA, 22 bp, Homo sapiens
gggctctgggatgctcttagag

SEQ ID NO: 9495309 - DNA, 22 bp, Homo sapiens
gggctctgggattcagagcaag

SEQ ID NO: 9495310 - DNA, 22 bp, Homo sapiens
gggctctgggattcagagcaag

SEQ ID NO: 9495311 - DNA, 22 bp, Homo sapiens
gggctctgggattcagagcaag

SEQ ID NO: 9495312 - DNA, 22 bp, Homo sapiens
gggctctggggaggacccttca

SEQ ID NO: 9495313 - DNA, 22 bp, Homo sapiens
gggctctggggaggacccttca

SEQ ID NO: 9495314 - DNA, 22 bp, Homo sapiens
gggctctggggaggacccttca

SEQ ID NO: 9495315 - DNA, 22 bp, Homo sapiens
gggctctggggtcagacagcct

SEQ ID NO: 9495316 - DNA, 22 bp, Homo sapiens
gggctctggggtcagacagcct

SEQ ID NO: 9495317 - DNA, 22 bp, Homo sapiens
gggctctggggtgccctggcat

SEQ ID NO: 9495318 - DNA, 22 bp, Homo sapiens
gggctctggggtgccctggcat

SEQ ID NO: 9495319 - DNA, 22 bp, Homo sapiens
gggctctggggtgccctggcat

SEQ ID NO: 9495320 - DNA, 16 bp, Homo sapiens
gggctgggggattctg

SEQ ID NO: 9495321 - DNA, 16 bp, Homo sapiens
gggctgggggattctg

SEQ ID NO: 9495322 - DNA, 16 bp, Homo sapiens
gggctgggggattctg

SEQ ID NO: 9495323 - DNA, 16 bp, Homo sapiens
gggctgggggattctg

SEQ ID NO: 9495324 - DNA, 16 bp, Homo sapiens
gggctgggggattctg

SEQ ID NO: 9495325 - DNA, 22 bp, Homo sapiens
gggctggtgaggctgccctgca

SEQ ID NO: 9495326 - DNA, 22 bp, Homo sapiens
gggctggtgaggctgccctgca

SEQ ID NO: 9495327 - DNA, 22 bp, Homo sapiens
gggcttctagaccagcagtgag

SEQ ID NO: 9495328 - DNA, 22 bp, Homo sapiens
gggcttctacttgcaaaggata

SEQ ID NO: 9495329 - DNA, 22 bp, Homo sapiens
gggcttctagaatttctgatat

SEQ ID NO: 9495330 - DNA, 22 bp, Homo sapiens
gggcttctattcaagtctgttt

SEQ ID NO: 9495331 - DNA, 23 bp, Homo sapiens
gggcttcattttaattcagctgc

SEQ ID NO: 9495332 - DNA, 22 bp, Homo sapiens
gggcttctaagtgaaagtgtaa

SEQ ID NO: 9495333 - DNA, 22 bp, Homo sapiens
gggcttctacttgcaaaggata

SEQ ID NO: 9495334 - DNA, 22 bp, Homo sapiens
gggcttctaagtgaaagtgtaa

SEQ ID NO: 9495335 - DNA, 22 bp, Homo sapiens
gggcttcagggtacttcctcct

SEQ ID NO: 9495336 - DNA, 22 bp, Homo sapiens
gggcttcagatccagggacctc

SEQ ID NO: 9495337 - DNA, 22 bp, Homo sapiens
gggcttcaggagggtcagccca

SEQ ID NO: 9495338 - DNA, 22 bp, Homo sapiens
gggcttcaaaattggcactctt

SEQ ID NO: 9495339 - DNA, 20 bp, Homo sapiens
gggctgttgctcttggtttg

SEQ ID NO: 9495340 - DNA, 22 bp, Homo sapiens
gggcttcaaaattggcactctt

SEQ ID NO: 9495341 - DNA, 22 bp, Homo sapiens
gggcttatggagggctttgtac

SEQ ID NO: 9495342 - DNA, 22 bp, Homo sapiens
gggcttctctttagtgagctga

SEQ ID NO: 9495343 - DNA, 22 bp, Homo sapiens
gggcttctgctcttttggtgct

SEQ ID NO: 9495344 - DNA, 22 bp, Homo sapiens
gggcttctctttagtgagctga

SEQ ID NO: 9495345 - DNA, 22 bp, Homo sapiens
gggcttctgggcaccactccct

SEQ ID NO: 9495346 - DNA, 19 bp, Homo sapiens
gggcttctgggatcaagag

SEQ ID NO: 9495347 - DNA, 22 bp, Homo sapiens
gggcttctggctactgtatgag

SEQ ID NO: 9495348 - DNA, 22 bp, Homo sapiens
gggcttctctgatcaatatttc

SEQ ID NO: 9495349 - DNA, 22 bp, Homo sapiens
gggcttctctcaggggcatgag

SEQ ID NO: 9495350 - DNA, 22 bp, Homo sapiens
gggcttctctgggagtcctggt

SEQ ID NO: 9495351 - DNA, 22 bp, Homo sapiens
gggcttctctgggagtcctggt

SEQ ID NO: 9495352 - DNA, 22 bp, Homo sapiens
gggcttctattctggcacaaga

SEQ ID NO: 9495353 - DNA, 22 bp, Homo sapiens
gggcttctattctggcacaaga

SEQ ID NO: 9495354 - DNA, 22 bp, Homo sapiens
gggcttctccctaaggactctg

SEQ ID NO: 9495355 - DNA, 22 bp, Homo sapiens
gggcttctctcagaaactatca

SEQ ID NO: 9495356 - DNA, 22 bp, Homo sapiens
ggttcactccgatctctgcctc

SEQ ID NO: 9495357 - DNA, 22 bp, Homo sapiens
ggttcactctcaagtctgccta

SEQ ID NO: 9495358 - DNA, 22 bp, Homo sapiens
ggttcagggatgtgggtgatgc

SEQ ID NO: 9495359 - DNA, 22 bp, Homo sapiens
ggttcagggctaccagtgggtg

SEQ ID NO: 9495360 - DNA, 22 bp, Homo sapiens
ggttccacctggcgaggggtat

SEQ ID NO: 9495361 - DNA, 22 bp, Homo sapiens
ggttggaggtgggaatagctag

SEQ ID NO: 9495362 - DNA, 19 bp, Homo sapiens
ggttggagaagagcggccc

SEQ ID NO: 9495363 - DNA, 22 bp, Homo sapiens
ggttcattctgaagtcttcagc

SEQ ID NO: 9495364 - DNA, 22 bp, Homo sapiens
ggttggggcgagctggaggccc

SEQ ID NO: 9495365 - DNA, 22 bp, Homo sapiens
ggttggggcgagctggaggccc

SEQ ID NO: 9495366 - DNA, 22 bp, Homo sapiens
ggttggggcgagctggaggccc

SEQ ID NO: 9495367 - DNA, 22 bp, Homo sapiens
gtaatttttagttcattctatc

SEQ ID NO: 9495368 - DNA, 22 bp, Homo sapiens
gtaattttggagtataacctgg

SEQ ID NO: 9495369 - DNA, 22 bp, Homo sapiens
gtaattgtcttgaattcacaac

SEQ ID NO: 9495370 - DNA, 22 bp, Homo sapiens
gtaattgtgggcttagtagagt

SEQ ID NO: 9495371 - DNA, 22 bp, Homo sapiens
gtaatttaattctctgacttga

SEQ ID NO: 9495372 - DNA, 22 bp, Homo sapiens
ggttgtagttggaggttgtata

SEQ ID NO: 9495373 - DNA, 22 bp, Homo sapiens
ggtttaaaagccatgcatgggg

SEQ ID NO: 9495374 - DNA, 22 bp, Homo sapiens
ggtttaaaagccatgcatgggg

SEQ ID NO: 9495375 - DNA, 22 bp, Homo sapiens
ggtttaaaagccatgcatgggg

SEQ ID NO: 9495376 - DNA, 21 bp, Homo sapiens
ggttggtgtgtccagtggcca

SEQ ID NO: 9495377 - DNA, 22 bp, Homo sapiens
gtaattacatgagtactgtaag

SEQ ID NO: 9495378 - DNA, 22 bp, Homo sapiens
ggttagagggcatgcgatcttt

SEQ ID NO: 9495379 - DNA, 22 bp, Homo sapiens
ggttactcaagcctgccttctc

SEQ ID NO: 9495380 - DNA, 22 bp, Homo sapiens
ggttacatggaagaaatataat

SEQ ID NO: 9495381 - DNA, 22 bp, Homo sapiens
ggttcacatattgagagtattc

SEQ ID NO: 9495382 - DNA, 22 bp, Homo sapiens
ggttcacactttcatgatttca

SEQ ID NO: 9495383 - DNA, 17 bp, Homo sapiens
ggtgtttaagtgccagc

SEQ ID NO: 9495384 - DNA, 22 bp, Homo sapiens
ggtgtttagacagggcccctct

SEQ ID NO: 9495385 - DNA, 23 bp, Homo sapiens
ggtgtttaattacagactgagag

SEQ ID NO: 9495386 - DNA, 22 bp, Homo sapiens
ggtgtttagggaggggttataa

SEQ ID NO: 9495387 - DNA, 19 bp, Homo sapiens
ggtgtttcttcattttcca

SEQ ID NO: 9495388 - DNA, 22 bp, Homo sapiens
ggttaaaaataatttacttggc

SEQ ID NO: 9495389 - DNA, 22 bp, Homo sapiens
ggttaaaatctaaaatgtgact

SEQ ID NO: 9495390 - DNA, 21 bp, Homo sapiens
ggttaaaagacacatctgttt

SEQ ID NO: 9495391 - DNA, 22 bp, Homo sapiens
ggttaaaactgatattatgggt

SEQ ID NO: 9495392 - DNA, 19 bp, Homo sapiens
ggttaatgttaggatactt

SEQ ID NO: 9495393 - DNA, 22 bp, Homo sapiens
ggttaaggctttacagtcaaac

SEQ ID NO: 9495394 - DNA, 22 bp, Homo sapiens
ggtggtggagccagctgggagt

SEQ ID NO: 9495395 - DNA, 22 bp, Homo sapiens
ggtggtggagccagctgggagt

SEQ ID NO: 9495396 - DNA, 22 bp, Homo sapiens
ggtggtggagccagctgggagt

SEQ ID NO: 9495397 - DNA, 22 bp, Homo sapiens
ggtggtggagccagctgggagt

SEQ ID NO: 9495398 - DNA, 22 bp, Homo sapiens
ggtggtgaagacaagtggaagt

SEQ ID NO: 9495399 - DNA, 22 bp, Homo sapiens
ggtgggtttggaagagcaggct

SEQ ID NO: 9495400 - DNA, 23 bp, Homo sapiens
ggtggtgctcatatctcaggcct

SEQ ID NO: 9495401 - DNA, 23 bp, Homo sapiens
ggtggtgctcatatctcaggcct

SEQ ID NO: 9495402 - DNA, 22 bp, Homo sapiens
ggtggtgactgtcctagggatg

SEQ ID NO: 9495403 - DNA, 22 bp, Homo sapiens
ggtgggcaggtcactctgcctc

SEQ ID NO: 9495404 - DNA, 22 bp, Homo sapiens
ggtggggagtcaggcattcttg

SEQ ID NO: 9495405 - DNA, 22 bp, Homo sapiens
ggtggggattcctgatcactgt

SEQ ID NO: 9495406 - DNA, 22 bp, Homo sapiens
ggtggggattcctgatcactgt

SEQ ID NO: 9495407 - DNA, 22 bp, Homo sapiens
ggtggggccagggctccaacct

SEQ ID NO: 9495408 - DNA, 22 bp, Homo sapiens
ggtggggccctggcactggtat

SEQ ID NO: 9495409 - DNA, 22 bp, Homo sapiens
ggtggggcccaggcatctgatg

SEQ ID NO: 9495410 - DNA, 22 bp, Homo sapiens
ggtggggcccaggcatctgatg

SEQ ID NO: 9495411 - DNA, 22 bp, Homo sapiens
ggtgggtgagccctgggagctg

SEQ ID NO: 9495412 - DNA, 22 bp, Homo sapiens
ggtgggtgagccctgggagctg

SEQ ID NO: 9495413 - DNA, 22 bp, Homo sapiens
ggtgggtgagccctgggagctg

SEQ ID NO: 9495414 - DNA, 22 bp, Homo sapiens
ggtgggtgcagggggcttctta

SEQ ID NO: 9495415 - DNA, 22 bp, Homo sapiens
ggtgggtggaaacagcatgtac

SEQ ID NO: 9495416 - DNA, 22 bp, Homo sapiens
ggtgggtggaaacagcatgtac

SEQ ID NO: 9495417 - DNA, 19 bp, Homo sapiens
ggtgggtgacctccccacc

SEQ ID NO: 9495418 - DNA, 22 bp, Homo sapiens
ggtggggcctgctccagcggcc

SEQ ID NO: 9495419 - DNA, 22 bp, Homo sapiens
ggtggggcctgctccagcggcc

SEQ ID NO: 9495420 - DNA, 22 bp, Homo sapiens
ggtggggcctgctccagcggcc

SEQ ID NO: 9495421 - DNA, 22 bp, Homo sapiens
ggtggcacactggggagctcgg

SEQ ID NO: 9495422 - DNA, 22 bp, Homo sapiens
ggtggagtaattcgcagaggtt

SEQ ID NO: 9495423 - DNA, 22 bp, Homo sapiens
ggtggagctgtggacaggaagg

SEQ ID NO: 9495424 - DNA, 22 bp, Homo sapiens
ggtggacagtgttagctctggg

SEQ ID NO: 9495425 - DNA, 22 bp, Homo sapiens
ggtggagagctggatgagaggt

SEQ ID NO: 9495426 - DNA, 22 bp, Homo sapiens
ggtggagcgcagggtgctggcg

SEQ ID NO: 9495427 - DNA, 22 bp, Homo sapiens
ggtggagctggaccaggagagg

SEQ ID NO: 9495428 - DNA, 22 bp, Homo sapiens
ggtggagctatacgggatggct

SEQ ID NO: 9495429 - DNA, 22 bp, Homo sapiens
ggtggagctatacgggatggct

SEQ ID NO: 9495430 - DNA, 19 bp, Homo sapiens
ggtggcagaacgtgggtcc

SEQ ID NO: 9495431 - DNA, 22 bp, Homo sapiens
ggtggcagaataattgaaggtc

SEQ ID NO: 9495432 - DNA, 22 bp, Homo sapiens
ggtggcagagacataggacata

SEQ ID NO: 9495433 - DNA, 19 bp, Homo sapiens
ggtggcagaacgtgggtcc

SEQ ID NO: 9495434 - DNA, 22 bp, Homo sapiens
ggtggcagaataattgaaggtc

SEQ ID NO: 9495435 - DNA, 22 bp, Homo sapiens
ggtggcagagaggaggtagttt

SEQ ID NO: 9495436 - DNA, 22 bp, Homo sapiens
ggtgggcaggcgaggcccaggt

SEQ ID NO: 9495437 - DNA, 22 bp, Homo sapiens
ggtgggcaggtcactctgcctc

SEQ ID NO: 9495438 - DNA, 22 bp, Homo sapiens
ggtggcagagacataggacata

SEQ ID NO: 9495439 - DNA, 22 bp, Homo sapiens
ggtggcagagacataggacata

SEQ ID NO: 9495440 - DNA, 22 bp, Homo sapiens
ggtggcagagacataggacata

SEQ ID NO: 9495441 - DNA, 19 bp, Homo sapiens
ggtgagccctcgcctgcct

SEQ ID NO: 9495442 - DNA, 22 bp, Homo sapiens
ggtgagcagctgtctgtatgga

SEQ ID NO: 9495443 - DNA, 22 bp, Homo sapiens
ggtgagcactgccctgggtctc

SEQ ID NO: 9495444 - DNA, 22 bp, Homo sapiens
ggtgagcactgccctgggtctc

SEQ ID NO: 9495445 - DNA, 22 bp, Homo sapiens
ggtgagcactgccctgggtctc

SEQ ID NO: 9495446 - DNA, 22 bp, Homo sapiens
ggtgagcactgccctgggtctc

SEQ ID NO: 9495447 - DNA, 22 bp, Homo sapiens
ggtgagcttgctgctagaggct

SEQ ID NO: 9495448 - DNA, 22 bp, Homo sapiens
ggtgaggaaagatggtgacagt

SEQ ID NO: 9495449 - DNA, 22 bp, Homo sapiens
ggtgagctggtctggggctgct

SEQ ID NO: 9495450 - DNA, 22 bp, Homo sapiens
ggtgagcttgctgctagaggct

SEQ ID NO: 9495451 - DNA, 22 bp, Homo sapiens
ggtgagctggtctggggctgct

SEQ ID NO: 9495452 - DNA, 22 bp, Homo sapiens
ggtgagcgtggaaggagtggga

SEQ ID NO: 9495453 - DNA, 22 bp, Homo sapiens
ggtgaggaattggggactgacc

SEQ ID NO: 9495454 - DNA, 22 bp, Homo sapiens
ggtgaggaaagatggtgacagt

SEQ ID NO: 9495455 - DNA, 22 bp, Homo sapiens
ggtgaggaattggggactgacc

SEQ ID NO: 9495456 - DNA, 22 bp, Homo sapiens
ggtgaggaaagatggtgacagt

SEQ ID NO: 9495457 - DNA, 22 bp, Homo sapiens
ggtgaggaaagatggtgacagt

SEQ ID NO: 9495458 - DNA, 22 bp, Homo sapiens
ggtgaggaattggggactgacc

SEQ ID NO: 9495459 - DNA, 22 bp, Homo sapiens
ggtgaggcaggtggctgctgag

SEQ ID NO: 9495460 - DNA, 22 bp, Homo sapiens
ggtgaggaattggggactgacc

SEQ ID NO: 9495461 - DNA, 22 bp, Homo sapiens
ggtgaggaattggggactgacc

SEQ ID NO: 9495462 - DNA, 22 bp, Homo sapiens
ggtgaggaattggggactgacc

SEQ ID NO: 9495463 - DNA, 22 bp, Homo sapiens
ggtgaggaattggggactgacc

SEQ ID NO: 9495464 - DNA, 22 bp, Homo sapiens
ggtccctgctgaagccttggtg

SEQ ID NO: 9495465 - DNA, 22 bp, Homo sapiens
ggtccctgctgaagccttggtg

SEQ ID NO: 9495466 - DNA, 22 bp, Homo sapiens
ggtccctggaaggcactagtga

SEQ ID NO: 9495467 - DNA, 22 bp, Homo sapiens
ggtgacagccgcttggcgctag

SEQ ID NO: 9495468 - DNA, 21 bp, Homo sapiens
ggtgacacgtggccccgctct

SEQ ID NO: 9495469 - DNA, 21 bp, Homo sapiens
ggtgacacgtggccccgctct

SEQ ID NO: 9495470 - DNA, 21 bp, Homo sapiens
ggtgacacgtggccccgctct

SEQ ID NO: 9495471 - DNA, 21 bp, Homo sapiens
ggtgaatttctaggaagtggc

SEQ ID NO: 9495472 - DNA, 22 bp, Homo sapiens
ggtccctggaaggccaagcttg

SEQ ID NO: 9495473 - DNA, 22 bp, Homo sapiens
ggtgacagcgggtcaagaggag

SEQ ID NO: 9495474 - DNA, 22 bp, Homo sapiens
ggtgacagcgggtcaagaggag

SEQ ID NO: 9495475 - DNA, 22 bp, Homo sapiens
ggtgagaggcagtgctgtggaa

SEQ ID NO: 9495476 - DNA, 22 bp, Homo sapiens
ggtgagaggcagtgctgtggaa

SEQ ID NO: 9495477 - DNA, 22 bp, Homo sapiens
ggtgacagcgggtcaagaggag

SEQ ID NO: 9495478 - DNA, 22 bp, Homo sapiens
ggtgagaggcagtgctgtggaa

SEQ ID NO: 9495479 - DNA, 22 bp, Homo sapiens
ggtgagcaaagcttcatctgta

SEQ ID NO: 9495480 - DNA, 22 bp, Homo sapiens
ggtgagaggcctgagagctgga

SEQ ID NO: 9495481 - DNA, 22 bp, Homo sapiens
ggtgagaggcctgagagctgga

SEQ ID NO: 9495482 - DNA, 22 bp, Homo sapiens
ggtgaggctaagtgacacaggg

SEQ ID NO: 9495483 - DNA, 22 bp, Homo sapiens
ggtgaggctaagtgacacaggg

SEQ ID NO: 9495484 - DNA, 22 bp, Homo sapiens
ggtgaggcaggtggctgctgag

SEQ ID NO: 9495485 - DNA, 22 bp, Homo sapiens
ggtgaggcctgtacaaagctgc

SEQ ID NO: 9495486 - DNA, 18 bp, Homo sapiens
ggtgagggagctggaagc

SEQ ID NO: 9495487 - DNA, 22 bp, Homo sapiens
ggtgagggacatcactcagcca

SEQ ID NO: 9495488 - DNA, 18 bp, Homo sapiens
ggtgagggagctggaagc

SEQ ID NO: 9495489 - DNA, 18 bp, Homo sapiens
ggtgagggagctggaagc

SEQ ID NO: 9495490 - DNA, 18 bp, Homo sapiens
ggtgagggagctggaagc

SEQ ID NO: 9495491 - DNA, 18 bp, Homo sapiens
ggtgagggagctggaagc

SEQ ID NO: 9495492 - DNA, 22 bp, Homo sapiens
ggtggaaggcagcagtctcagg

SEQ ID NO: 9495493 - DNA, 22 bp, Homo sapiens
ggtggaaggcctggaaggaggc

SEQ ID NO: 9495494 - DNA, 22 bp, Homo sapiens
ggtggaaggcctggaaggaggc

SEQ ID NO: 9495495 - DNA, 22 bp, Homo sapiens
ggtggaagccttcagaacagca

SEQ ID NO: 9495496 - DNA, 22 bp, Homo sapiens
ggtggacaaatgaatgactgaa

SEQ ID NO: 9495497 - DNA, 22 bp, Homo sapiens
ggtggacagtgttagctctggg

SEQ ID NO: 9495498 - DNA, 22 bp, Homo sapiens
ggtggacagtgttagctctggg

SEQ ID NO: 9495499 - DNA, 22 bp, Homo sapiens
ggtgctctttctcagacaagat

SEQ ID NO: 9495500 - DNA, 22 bp, Homo sapiens
ggtgctctttctcagacaagat

SEQ ID NO: 9495501 - DNA, 22 bp, Homo sapiens
ggtgagggagtggaacgaggtg

SEQ ID NO: 9495502 - DNA, 22 bp, Homo sapiens
ggtgagggagtggaacgaggtg

SEQ ID NO: 9495503 - DNA, 21 bp, Homo sapiens
ggtgctcctccatgctgctct

SEQ ID NO: 9495504 - DNA, 22 bp, Homo sapiens
gggtgtagaaagaaccctctgg

SEQ ID NO: 9495505 - DNA, 22 bp, Homo sapiens
gggtgtccagggcgtgtctgga

SEQ ID NO: 9495506 - DNA, 22 bp, Homo sapiens
gggttgaggcggatgtcggcgg

SEQ ID NO: 9495507 - DNA, 22 bp, Homo sapiens
gggttgaggcggatgtcggcgg

SEQ ID NO: 9495508 - DNA, 22 bp, Homo sapiens
gggttgaggcggatgtcggcgg

SEQ ID NO: 9495509 - DNA, 22 bp, Homo sapiens
gggtgtccttctgtggactctg

SEQ ID NO: 9495510 - DNA, 22 bp, Homo sapiens
gggtgtccttctgtggactctg

SEQ ID NO: 9495511 - DNA, 22 bp, Homo sapiens
gggttggattacttagggagaa

SEQ ID NO: 9495512 - DNA, 22 bp, Homo sapiens
gggttggggcccagcagtctgc

SEQ ID NO: 9495513 - DNA, 22 bp, Homo sapiens
ggtaaaaatcacaaatacttta

SEQ ID NO: 9495514 - DNA, 22 bp, Homo sapiens
ggtaaaaatcacaaatacttta

SEQ ID NO: 9495515 - DNA, 22 bp, Homo sapiens
ggtaaaaatcacaaatacttta

SEQ ID NO: 9495516 - DNA, 22 bp, Homo sapiens
ggtaaaaatcacaaatacttta

SEQ ID NO: 9495517 - DNA, 22 bp, Homo sapiens
ggtaaaaatcacaaatacttta

SEQ ID NO: 9495518 - DNA, 22 bp, Homo sapiens
gggttttcttcaaaagtctaga

SEQ ID NO: 9495519 - DNA, 22 bp, Homo sapiens
ggtcccagctggtcactgtcag

SEQ ID NO: 9495520 - DNA, 22 bp, Homo sapiens
ggtcccagctggtcactgtcag

SEQ ID NO: 9495521 - DNA, 22 bp, Homo sapiens
ggtcccagctggtcactgtcag

SEQ ID NO: 9495522 - DNA, 22 bp, Homo sapiens
ggtcccaggattggttgcgcag

SEQ ID NO: 9495523 - DNA, 22 bp, Homo sapiens
ggtcccaggaagtgcggcggcg

SEQ ID NO: 9495524 - DNA, 22 bp, Homo sapiens
ggtccctgcccaaagcccttgg

SEQ ID NO: 9495525 - DNA, 22 bp, Homo sapiens
ggtccctgcccacctgggagct

SEQ ID NO: 9495526 - DNA, 23 bp, Homo sapiens
ggtccctgacagcgggcaagttg

SEQ ID NO: 9495527 - DNA, 23 bp, Homo sapiens
ggtccctgacagcgggcaagttg

SEQ ID NO: 9495528 - DNA, 23 bp, Homo sapiens
ggtccctgacagcgggcaagttg

SEQ ID NO: 9495529 - DNA, 22 bp, Homo sapiens
ggtccctgccctacattttctt

SEQ ID NO: 9495530 - DNA, 22 bp, Homo sapiens
ggtccctgcctgaggctggcct

SEQ ID NO: 9495531 - DNA, 22 bp, Homo sapiens
ggtccctgcctgaggctggcct

SEQ ID NO: 9495532 - DNA, 22 bp, Homo sapiens
ggtccctgcctgaggctggcct

SEQ ID NO: 9495533 - DNA, 22 bp, Homo sapiens
ggtccctgaagatgcctgagga

SEQ ID NO: 9495534 - DNA, 22 bp, Homo sapiens
ggtccctgaagatgcctgagga

SEQ ID NO: 9495535 - DNA, 22 bp, Homo sapiens
ggtccctgaagatgcctgagga

SEQ ID NO: 9495536 - DNA, 22 bp, Homo sapiens
ggtccctgaagaggcctggggt

SEQ ID NO: 9495537 - DNA, 22 bp, Homo sapiens
ggtccctgaagaggcctggggt

SEQ ID NO: 9495538 - DNA, 22 bp, Homo sapiens
ggtccctgaagaggcctggggt

SEQ ID NO: 9495539 - DNA, 22 bp, Homo sapiens
ggtccccgtggaggctggagcg

SEQ ID NO: 9495540 - DNA, 22 bp, Homo sapiens
ggtccccgtggaggctggagcg

SEQ ID NO: 9495541 - DNA, 22 bp, Homo sapiens
ggtcccagttgcccaggtcagg

SEQ ID NO: 9495542 - DNA, 22 bp, Homo sapiens
ggtcccagttgcccaggtcagg

SEQ ID NO: 9495543 - DNA, 23 bp, Homo sapiens
ggtcccagtggagaggcctcacc

SEQ ID NO: 9495544 - DNA, 22 bp, Homo sapiens
ggtcccatgaaagagggaggcc

SEQ ID NO: 9495545 - DNA, 22 bp, Homo sapiens
ggtccccagcagtggctgcttc

SEQ ID NO: 9495546 - DNA, 22 bp, Homo sapiens
ggtccccccatggtgagcactg

SEQ ID NO: 9495547 - DNA, 22 bp, Homo sapiens
ggtcccagtccctttccaccgt

SEQ ID NO: 9495548 - DNA, 22 bp, Homo sapiens
ggtcccagtcctctccctgcta

SEQ ID NO: 9495549 - DNA, 22 bp, Homo sapiens
ggtcccagtcctctccctgcta

SEQ ID NO: 9495550 - DNA, 23 bp, Homo sapiens
ggtcccagtggagaggcctcacc

SEQ ID NO: 9495551 - DNA, 23 bp, Homo sapiens
ggtcccagtggagaggcctcacc

SEQ ID NO: 9495552 - DNA, 22 bp, Homo sapiens
ggtcccaggctgcgggctggtg

SEQ ID NO: 9495553 - DNA, 22 bp, Homo sapiens
ggtcccaggttgacagggagac

SEQ ID NO: 9495554 - DNA, 22 bp, Homo sapiens
gtcctctgggcagctgccccac

SEQ ID NO: 9495555 - DNA, 22 bp, Homo sapiens
gtcctctggcctttcccaggac

SEQ ID NO: 9495556 - DNA, 22 bp, Homo sapiens
gtccaggctgacccctagagga

SEQ ID NO: 9495557 - DNA, 22 bp, Homo sapiens
gtccaggctgacccctagagga

SEQ ID NO: 9495558 - DNA, 22 bp, Homo sapiens
gtccaggctgacccctagagga

SEQ ID NO: 9495559 - DNA, 22 bp, Homo sapiens
gtcctctgcttcatgccctgat

SEQ ID NO: 9495560 - DNA, 22 bp, Homo sapiens
gtccaggccatggtggacacag

SEQ ID NO: 9495561 - DNA, 22 bp, Homo sapiens
gtccaggctcaaaaggttgtta

SEQ ID NO: 9495562 - DNA, 22 bp, Homo sapiens
gtccaggctaagtcccttctgc

SEQ ID NO: 9495563 - DNA, 22 bp, Homo sapiens
gtccaggcacctcccttgtgct

SEQ ID NO: 9495564 - DNA, 20 bp, Homo sapiens
gtccaggacccagcaggagg

SEQ ID NO: 9495565 - DNA, 20 bp, Homo sapiens
gtccaggacccagcaggagg

SEQ ID NO: 9495566 - DNA, 22 bp, Homo sapiens
gtccaggaatcaaaagatggaa

SEQ ID NO: 9495567 - DNA, 22 bp, Homo sapiens
gtcctggagtggcatggcatgg

SEQ ID NO: 9495568 - DNA, 22 bp, Homo sapiens
gtcctggaatcctagaacagtg

SEQ ID NO: 9495569 - DNA, 22 bp, Homo sapiens
gtcctgctctggcccaggtttg

SEQ ID NO: 9495570 - DNA, 22 bp, Homo sapiens
gtcctgctggcttcaggagatt

SEQ ID NO: 9495571 - DNA, 22 bp, Homo sapiens
gtcctgcacatggagggcaatg

SEQ ID NO: 9495572 - DNA, 22 bp, Homo sapiens
gtcctctggtgaaagcattccc

SEQ ID NO: 9495573 - DNA, 22 bp, Homo sapiens
gtcctctgtagggctgggccac

SEQ ID NO: 9495574 - DNA, 22 bp, Homo sapiens
gtcgtggagctcacagtgtgcc

SEQ ID NO: 9495575 - DNA, 22 bp, Homo sapiens
gtctaaacacaatgcaagaagt

SEQ ID NO: 9495576 - DNA, 22 bp, Homo sapiens
gtcctggctggttctgtggggc

SEQ ID NO: 9495577 - DNA, 22 bp, Homo sapiens
gtcctggctagtcgtccgcgac

SEQ ID NO: 9495578 - DNA, 22 bp, Homo sapiens
gtcctggattgaacataggcag

SEQ ID NO: 9495579 - DNA, 22 bp, Homo sapiens
gtcctggattgaacataggcag

SEQ ID NO: 9495580 - DNA, 22 bp, Homo sapiens
gtccagcctgaagagtgggggc

SEQ ID NO: 9495581 - DNA, 22 bp, Homo sapiens
gtccagcccttgcagcttcttt

SEQ ID NO: 9495582 - DNA, 22 bp, Homo sapiens
gtccagcctgaagagtgggggc

SEQ ID NO: 9495583 - DNA, 22 bp, Homo sapiens
gtccagctccagggaggcaggc

SEQ ID NO: 9495584 - DNA, 22 bp, Homo sapiens
gtccagctctcagatggctgca

SEQ ID NO: 9495585 - DNA, 22 bp, Homo sapiens
gtccagctgggccagggcactc

SEQ ID NO: 9495586 - DNA, 22 bp, Homo sapiens
gtccagctgatcttgacccagc

SEQ ID NO: 9495587 - DNA, 22 bp, Homo sapiens
gtccagcccgggctccgccagc

SEQ ID NO: 9495588 - DNA, 22 bp, Homo sapiens
gtccagcccgggctccgccagc

SEQ ID NO: 9495589 - DNA, 22 bp, Homo sapiens
gtccagcccttgcagcttcttt

SEQ ID NO: 9495590 - DNA, 22 bp, Homo sapiens
gtccagccctctgcctccaggt

SEQ ID NO: 9495591 - DNA, 22 bp, Homo sapiens
gtccagccctctgcctccaggt

SEQ ID NO: 9495592 - DNA, 22 bp, Homo sapiens
gtccagccctctgcctccaggt

SEQ ID NO: 9495593 - DNA, 22 bp, Homo sapiens
gtccagcccctgactcccaggc

SEQ ID NO: 9495594 - DNA, 22 bp, Homo sapiens
gtccagcccctgactcccaggc

SEQ ID NO: 9495595 - DNA, 22 bp, Homo sapiens
gtccagccaggctgcagcaccc

SEQ ID NO: 9495596 - DNA, 22 bp, Homo sapiens
gtccagccaggcctgtctctgg

SEQ ID NO: 9495597 - DNA, 22 bp, Homo sapiens
gtccagccagctggtccttgcc

SEQ ID NO: 9495598 - DNA, 22 bp, Homo sapiens
gtcagagctgtgcaaggctgag

SEQ ID NO: 9495599 - DNA, 22 bp, Homo sapiens
gtcagaggaatggatgagtgat

SEQ ID NO: 9495600 - DNA, 22 bp, Homo sapiens
gtcagaggaggctgagtaggaa

SEQ ID NO: 9495601 - DNA, 20 bp, Homo sapiens
gtcagaggaccctagagcga

SEQ ID NO: 9495602 - DNA, 22 bp, Homo sapiens
gtcagagcccccagcggcgcgg

SEQ ID NO: 9495603 - DNA, 22 bp, Homo sapiens
gtcagagacaaacttcctctct

SEQ ID NO: 9495604 - DNA, 22 bp, Homo sapiens
gtcagagaactggattttccaa

SEQ ID NO: 9495605 - DNA, 20 bp, Homo sapiens
gtcagaggaccctagagcga

SEQ ID NO: 9495606 - DNA, 22 bp, Homo sapiens
gtccagagaagggaggggactc

SEQ ID NO: 9495607 - DNA, 21 bp, Homo sapiens
gtccagagagccggctcctga

SEQ ID NO: 9495608 - DNA, 22 bp, Homo sapiens
gtcactttcacactttattgct

SEQ ID NO: 9495609 - DNA, 22 bp, Homo sapiens
gtcactttattaattttggtga

SEQ ID NO: 9495610 - DNA, 22 bp, Homo sapiens
gtcactttacactcctactaaa

SEQ ID NO: 9495611 - DNA, 22 bp, Homo sapiens
gtcactttctgtgagatgtagt

SEQ ID NO: 9495612 - DNA, 22 bp, Homo sapiens
gtcactttcacactttattgct

SEQ ID NO: 9495613 - DNA, 22 bp, Homo sapiens
gtcactttgaagctgtttttag

SEQ ID NO: 9495614 - DNA, 22 bp, Homo sapiens
gtcactttctgtgagatgtagt

SEQ ID NO: 9495615 - DNA, 22 bp, Homo sapiens
gtcactttgaagctgtttttag

SEQ ID NO: 9495616 - DNA, 22 bp, Homo sapiens
gtcactttattaattttggtga

SEQ ID NO: 9495617 - DNA, 22 bp, Homo sapiens
gtcactttcacactttattgct

SEQ ID NO: 9495618 - DNA, 22 bp, Homo sapiens
gtcactttacactcctactaaa

SEQ ID NO: 9495619 - DNA, 22 bp, Homo sapiens
gtcactttattaattttggtga

SEQ ID NO: 9495620 - DNA, 22 bp, Homo sapiens
gtcactttaaagggttaacagg

SEQ ID NO: 9495621 - DNA, 22 bp, Homo sapiens
gtcactttacactcctactaaa

SEQ ID NO: 9495622 - DNA, 22 bp, Homo sapiens
gtcactttaaagggttaacagg

SEQ ID NO: 9495623 - DNA, 22 bp, Homo sapiens
gtcacttttaagggccttttct

SEQ ID NO: 9495624 - DNA, 22 bp, Homo sapiens
gtcacttttaagggccttttct

SEQ ID NO: 9495625 - DNA, 17 bp, Homo sapiens
gtcactttgtttaaagg

SEQ ID NO: 9495626 - DNA, 22 bp, Homo sapiens
gtcactttggcctctacagcca

SEQ ID NO: 9495627 - DNA, 17 bp, Homo sapiens
gtcactttgtttaaagg

SEQ ID NO: 9495628 - DNA, 17 bp, Homo sapiens
gtcactttgtttaaagg

SEQ ID NO: 9495629 - DNA, 22 bp, Homo sapiens
gtcactttggcctctacagcca

SEQ ID NO: 9495630 - DNA, 22 bp, Homo sapiens
gtcactttgaagctgtttttag

SEQ ID NO: 9495631 - DNA, 22 bp, Homo sapiens
gtcagaaaaagcaaggctgggc

SEQ ID NO: 9495632 - DNA, 22 bp, Homo sapiens
gtcagaaaccagtcaaacaaga

SEQ ID NO: 9495633 - DNA, 22 bp, Homo sapiens
gtcagaaaccagtcaaacaaga

SEQ ID NO: 9495634 - DNA, 22 bp, Homo sapiens
gtcagacacatttctttcagtg

SEQ ID NO: 9495635 - DNA, 22 bp, Homo sapiens
gtcactgtatccaggttccagc

SEQ ID NO: 9495636 - DNA, 22 bp, Homo sapiens
gtcactgcctcttaactttttc

SEQ ID NO: 9495637 - DNA, 22 bp, Homo sapiens
gtcacctcgctgtcttcctgag

SEQ ID NO: 9495638 - DNA, 22 bp, Homo sapiens
gtcaccctgctgtttgtccatt

SEQ ID NO: 9495639 - DNA, 22 bp, Homo sapiens
gtcactcaggctggagttcagt

SEQ ID NO: 9495640 - DNA, 22 bp, Homo sapiens
gtcaccttgaacaggctactca

SEQ ID NO: 9495641 - DNA, 19 bp, Homo sapiens
gtacaagaatgactgagca

SEQ ID NO: 9495642 - DNA, 22 bp, Homo sapiens
gtacaacatgattttactctct

SEQ ID NO: 9495643 - DNA, 22 bp, Homo sapiens
gtacaagaggagaaaatggagt

SEQ ID NO: 9495644 - DNA, 22 bp, Homo sapiens
gtacaataactagtcttatagt

SEQ ID NO: 9495645 - DNA, 22 bp, Homo sapiens
gtacaagtgtatttggcttgat

SEQ ID NO: 9495646 - DNA, 22 bp, Homo sapiens
gtacaacaggattgatgtacca

SEQ ID NO: 9495647 - DNA, 22 bp, Homo sapiens
gtacaacaggattgatgtacca

SEQ ID NO: 9495648 - DNA, 22 bp, Homo sapiens
gtacaaattgatacaggttttc

SEQ ID NO: 9495649 - DNA, 22 bp, Homo sapiens
gtacaaattttgacatctagga

SEQ ID NO: 9495650 - DNA, 22 bp, Homo sapiens
gtacaaattgatacagatttga

SEQ ID NO: 9495651 - DNA, 22 bp, Homo sapiens
gtacaaattgatacagatttga

SEQ ID NO: 9495652 - DNA, 22 bp, Homo sapiens
gtacaaattgatacagatttga

SEQ ID NO: 9495653 - DNA, 22 bp, Homo sapiens
gtacaaattgatacaggttttc

SEQ ID NO: 9495654 - DNA, 22 bp, Homo sapiens
gtacaaaagttattgcggtttt

SEQ ID NO: 9495655 - DNA, 22 bp, Homo sapiens
gtacaaaagttattgcggtttt

SEQ ID NO: 9495656 - DNA, 22 bp, Homo sapiens
gtacaaaagttattgcggtttt

SEQ ID NO: 9495657 - DNA, 22 bp, Homo sapiens
gtacaaaagttattgcggtttt

SEQ ID NO: 9495658 - DNA, 22 bp, Homo sapiens
gtacaaaagttattgcggtttt

SEQ ID NO: 9495659 - DNA, 22 bp, Homo sapiens
gtacaaaggcagaattgggtag

SEQ ID NO: 9495660 - DNA, 22 bp, Homo sapiens
gtacaaaggcagaattgggtag

SEQ ID NO: 9495661 - DNA, 22 bp, Homo sapiens
gtacaaatgagagttctgtttt

SEQ ID NO: 9495662 - DNA, 22 bp, Homo sapiens
gtacaaatgcaggtttgttaca

SEQ ID NO: 9495663 - DNA, 22 bp, Homo sapiens
gtacaaatgagagttctgtttt

SEQ ID NO: 9495664 - DNA, 22 bp, Homo sapiens
gtacaaatgcaggtttgttaca

SEQ ID NO: 9495665 - DNA, 22 bp, Homo sapiens
gtacaaattaggaagctttgtg

SEQ ID NO: 9495666 - DNA, 22 bp, Homo sapiens
gtacaaatgtacacttgtataa

SEQ ID NO: 9495667 - DNA, 22 bp, Homo sapiens
gtacaaatgtacacttgtataa

SEQ ID NO: 9495668 - DNA, 22 bp, Homo sapiens
gtacaaatgcaggtttgttaca

SEQ ID NO: 9495669 - DNA, 22 bp, Homo sapiens
gtacaaatgtacacttgtataa

SEQ ID NO: 9495670 - DNA, 22 bp, Homo sapiens
gtagtaaagcaggttttgctgt

SEQ ID NO: 9495671 - DNA, 22 bp, Homo sapiens
gtaggtcagacataagaggaca

SEQ ID NO: 9495672 - DNA, 22 bp, Homo sapiens
gtaggtcagacataagaggaca

SEQ ID NO: 9495673 - DNA, 22 bp, Homo sapiens
gtaggtcagacataagaggaca

SEQ ID NO: 9495674 - DNA, 22 bp, Homo sapiens
gtagtctgaacagtaattttgt

SEQ ID NO: 9495675 - DNA, 22 bp, Homo sapiens
gtagtctgaacagtaattttgt

SEQ ID NO: 9495676 - DNA, 22 bp, Homo sapiens
gtagtggagtctcctgtcctgg

SEQ ID NO: 9495677 - DNA, 22 bp, Homo sapiens
gtagtgctttcatctggagtgt

SEQ ID NO: 9495678 - DNA, 22 bp, Homo sapiens
gtagtcttggattttaaaaagt

SEQ ID NO: 9495679 - DNA, 22 bp, Homo sapiens
gtagtgcgcatggcctgtttgt

SEQ ID NO: 9495680 - DNA, 22 bp, Homo sapiens
gtaggggccagaaagacttaga

SEQ ID NO: 9495681 - DNA, 22 bp, Homo sapiens
gtagggctcagtaaatactttg

SEQ ID NO: 9495682 - DNA, 22 bp, Homo sapiens
gtacaataactagtcttatagt

SEQ ID NO: 9495683 - DNA, 22 bp, Homo sapiens
gtaggcaaattatggaacattg

SEQ ID NO: 9495684 - DNA, 22 bp, Homo sapiens
gtaggaattttgtgagctttcc

SEQ ID NO: 9495685 - DNA, 22 bp, Homo sapiens
gtcaaacatagggactttgtgg

SEQ ID NO: 9495686 - DNA, 22 bp, Homo sapiens
gtcaaagatcctatgagttaaa

SEQ ID NO: 9495687 - DNA, 22 bp, Homo sapiens
gtcaaatatatgcaaaactatt

SEQ ID NO: 9495688 - DNA, 22 bp, Homo sapiens
gtcacccactccctgctgctgt

SEQ ID NO: 9495689 - DNA, 22 bp, Homo sapiens
gtcacccactccctgctgctgt

SEQ ID NO: 9495690 - DNA, 22 bp, Homo sapiens
gtcaacaaagaaaattgttaat

SEQ ID NO: 9495691 - DNA, 22 bp, Homo sapiens
gtatttttagtagagtcggggt

SEQ ID NO: 9495692 - DNA, 22 bp, Homo sapiens
gtatttttcagttaggagctta

SEQ ID NO: 9495693 - DNA, 22 bp, Homo sapiens
gtatttttaggtaaggaaagta

SEQ ID NO: 9495694 - DNA, 22 bp, Homo sapiens
gtatttttcattccaagtgaga

SEQ ID NO: 9495695 - DNA, 22 bp, Homo sapiens
gtcaaaaagtagtcatttctgt

SEQ ID NO: 9495696 - DNA, 22 bp, Homo sapiens
gtcaaaaagtagtcatttctgt

SEQ ID NO: 9495697 - DNA, 22 bp, Homo sapiens
gtcaaaaagtagtcatttctgt

SEQ ID NO: 9495698 - DNA, 22 bp, Homo sapiens
gtatttttaggtaaggaaagta

SEQ ID NO: 9495699 - DNA, 22 bp, Homo sapiens
gtattttcatgatttcagacca

SEQ ID NO: 9495700 - DNA, 22 bp, Homo sapiens
gtattttatggcctggggccta

SEQ ID NO: 9495701 - DNA, 22 bp, Homo sapiens
gtattttcaagagcagtagtat

SEQ ID NO: 9495702 - DNA, 22 bp, Homo sapiens
gtatacatagatgatgaacaag

SEQ ID NO: 9495703 - DNA, 22 bp, Homo sapiens
gtatacatagatgatgaacaag

SEQ ID NO: 9495704 - DNA, 22 bp, Homo sapiens
gtatttcctatagtgagggcct

SEQ ID NO: 9495705 - DNA, 22 bp, Homo sapiens
gtattttatggcatgcagtggc

SEQ ID NO: 9495706 - DNA, 22 bp, Homo sapiens
gtattttatggcatgcagtggc

SEQ ID NO: 9495707 - DNA, 22 bp, Homo sapiens
gtatacaatacacaatgctctg

SEQ ID NO: 9495708 - DNA, 22 bp, Homo sapiens
gtatacaatacacaatgctctg

SEQ ID NO: 9495709 - DNA, 22 bp, Homo sapiens
gtatacagatacttagacgtgc

SEQ ID NO: 9495710 - DNA, 22 bp, Homo sapiens
gtatacagatacttagacgtgc

SEQ ID NO: 9495711 - DNA, 22 bp, Homo sapiens
gtatacactgtctcctctaggt

SEQ ID NO: 9495712 - DNA, 22 bp, Homo sapiens
gtataaagtataagcttgtttt

SEQ ID NO: 9495713 - DNA, 22 bp, Homo sapiens
gtataaagtataagcttgtttt

SEQ ID NO: 9495714 - DNA, 22 bp, Homo sapiens
gtataaaggcacaggttttctg

SEQ ID NO: 9495715 - DNA, 22 bp, Homo sapiens
gtataagcccattctcagagac

SEQ ID NO: 9495716 - DNA, 22 bp, Homo sapiens
gtagtgtgtaggcactgtgctc

SEQ ID NO: 9495717 - DNA, 22 bp, Homo sapiens
gtagtgctttcatctggagtgt

SEQ ID NO: 9495718 - DNA, 22 bp, Homo sapiens
gtagttctgcagtgtcacctga

SEQ ID NO: 9495719 - DNA, 22 bp, Homo sapiens
gtagttctgcagtgtcacctga

SEQ ID NO: 9495720 - DNA, 22 bp, Homo sapiens
gtagttctgcagtgtcacctga

SEQ ID NO: 9495721 - DNA, 22 bp, Homo sapiens
gtagttctttctcaatgttcaa

SEQ ID NO: 9495722 - DNA, 22 bp, Homo sapiens
gtagttttctgaaaattacttt

SEQ ID NO: 9495723 - DNA, 22 bp, Homo sapiens
gtagttttctgaaaattacttt

SEQ ID NO: 9495724 - DNA, 22 bp, Homo sapiens
gtgaggcagcaggagcctctgt

SEQ ID NO: 9495725 - DNA, 22 bp, Homo sapiens
gtgcagcaaactagtgcgaggg

SEQ ID NO: 9495726 - DNA, 22 bp, Homo sapiens
gtgcagcaaagtttgagatata

SEQ ID NO: 9495727 - DNA, 22 bp, Homo sapiens
gtgcagcaaagtttgagatata

SEQ ID NO: 9495728 - DNA, 22 bp, Homo sapiens
gtgaggcaagggcatactaggc

SEQ ID NO: 9495729 - DNA, 22 bp, Homo sapiens
gtgaggattgctctggagaatt

SEQ ID NO: 9495730 - DNA, 22 bp, Homo sapiens
gtgaggagtctgaagcacataa

SEQ ID NO: 9495731 - DNA, 22 bp, Homo sapiens
gtgaggatcaaatgaaatagca

SEQ ID NO: 9495732 - DNA, 22 bp, Homo sapiens
gtgcaggagtaggagagggctt

SEQ ID NO: 9495733 - DNA, 22 bp, Homo sapiens
gtgcaggagtaggagagggctt

SEQ ID NO: 9495734 - DNA, 22 bp, Homo sapiens
gtgcaggatgttgggaatcagg

SEQ ID NO: 9495735 - DNA, 22 bp, Homo sapiens
gtgcaggatgttgggaatcagg

SEQ ID NO: 9495736 - DNA, 22 bp, Homo sapiens
gtgcaggaggtaacatagcaaa

SEQ ID NO: 9495737 - DNA, 20 bp, Homo sapiens
gtgcagcacttgggggtagg

SEQ ID NO: 9495738 - DNA, 22 bp, Homo sapiens
gtgcaggaggtaacatagcaaa

SEQ ID NO: 9495739 - DNA, 22 bp, Homo sapiens
gtgcagggagcccagaaggtcc

SEQ ID NO: 9495740 - DNA, 22 bp, Homo sapiens
gtgcagggagcccagaaggtcc

SEQ ID NO: 9495741 - DNA, 22 bp, Homo sapiens
gtgcaggcattgggctagccat

SEQ ID NO: 9495742 - DNA, 22 bp, Homo sapiens
gtgcaggcattgggctagccat

SEQ ID NO: 9495743 - DNA, 22 bp, Homo sapiens
gtgcaggatttatagcccagct

SEQ ID NO: 9495744 - DNA, 22 bp, Homo sapiens
gtgccagaaggttcccgctgca

SEQ ID NO: 9495745 - DNA, 22 bp, Homo sapiens
gtgccagcagttatggtgattt

SEQ ID NO: 9495746 - DNA, 22 bp, Homo sapiens
gtgccagccgcaccccaggaga

SEQ ID NO: 9495747 - DNA, 22 bp, Homo sapiens
gtgccagagtttgaggacaatt

SEQ ID NO: 9495748 - DNA, 22 bp, Homo sapiens
gtgcaggggatcaggttgcagc

SEQ ID NO: 9495749 - DNA, 22 bp, Homo sapiens
gtgcaggggcctccccttgctg

SEQ ID NO: 9495750 - DNA, 22 bp, Homo sapiens
gtgcagggcagccgaatgggct

SEQ ID NO: 9495751 - DNA, 22 bp, Homo sapiens
gtgcagggcagccgaatgggct

SEQ ID NO: 9495752 - DNA, 17 bp, Homo sapiens
gtgcagggatgaaggat

SEQ ID NO: 9495753 - DNA, 17 bp, Homo sapiens
gtgcagggatgaaggat

SEQ ID NO: 9495754 - DNA, 17 bp, Homo sapiens
gtgcagggatgaaggat

SEQ ID NO: 9495755 - DNA, 22 bp, Homo sapiens
gtgcagggcagccgaatgggct

SEQ ID NO: 9495756 - DNA, 22 bp, Homo sapiens
gtgcagggcagccgaatgggct

SEQ ID NO: 9495757 - DNA, 22 bp, Homo sapiens
gtgcagggcagccgaatgggct

SEQ ID NO: 9495758 - DNA, 20 bp, Homo sapiens
gtgctggagttaggaaaggt

SEQ ID NO: 9495759 - DNA, 22 bp, Homo sapiens
gtgctgcttgggggcagagcag

SEQ ID NO: 9495760 - DNA, 22 bp, Homo sapiens
gtgctggaactgtgctaagaga

SEQ ID NO: 9495761 - DNA, 22 bp, Homo sapiens
gtgctggccctgtcctcgagct

SEQ ID NO: 9495762 - DNA, 22 bp, Homo sapiens
gtgctggccctgtcctcgagct

SEQ ID NO: 9495763 - DNA, 22 bp, Homo sapiens
gtgctggccctgtcctcgagct

SEQ ID NO: 9495764 - DNA, 22 bp, Homo sapiens
gtgctggccctgtcctcgagct

SEQ ID NO: 9495765 - DNA, 22 bp, Homo sapiens
gtgctggcacccctctccagtt

SEQ ID NO: 9495766 - DNA, 22 bp, Homo sapiens
gtgctgctgccagcaggatcct

SEQ ID NO: 9495767 - DNA, 22 bp, Homo sapiens
gtgctgctcacatctggaggta

SEQ ID NO: 9495768 - DNA, 22 bp, Homo sapiens
gtgctgctcaagggacaggaca

SEQ ID NO: 9495769 - DNA, 22 bp, Homo sapiens
gtgctgctcaagggacaggaca

SEQ ID NO: 9495770 - DNA, 22 bp, Homo sapiens
gtgctgcctgccagcttctggg

SEQ ID NO: 9495771 - DNA, 22 bp, Homo sapiens
gtgctgcctccatatccgtcag

SEQ ID NO: 9495772 - DNA, 22 bp, Homo sapiens
gtgctgccggcatagcagtgaa

SEQ ID NO: 9495773 - DNA, 22 bp, Homo sapiens
gtgctgccggcatagcagtgaa

SEQ ID NO: 9495774 - DNA, 22 bp, Homo sapiens
gtgctgccagacagtgagaggg

SEQ ID NO: 9495775 - DNA, 22 bp, Homo sapiens
gtgctgcatgacttgctcctga

SEQ ID NO: 9495776 - DNA, 23 bp, Homo sapiens
gtgctgcaaaatcggccactgca

SEQ ID NO: 9495777 - DNA, 20 bp, Homo sapiens
gtgctgagtgtctaactcct

SEQ ID NO: 9495778 - DNA, 22 bp, Homo sapiens
gtgctgacaggagcctggcggt

SEQ ID NO: 9495779 - DNA, 22 bp, Homo sapiens
gtgctgaattggagatgctcct

SEQ ID NO: 9495780 - DNA, 22 bp, Homo sapiens
gtgcccaggcccaaggcaccac

SEQ ID NO: 9495781 - DNA, 22 bp, Homo sapiens
gtgcccaggcccaaggcaccac

SEQ ID NO: 9495782 - DNA, 22 bp, Homo sapiens
gtgcccagctccacctcacaga

SEQ ID NO: 9495783 - DNA, 22 bp, Homo sapiens
gtgcccagctccacctcacaga

SEQ ID NO: 9495784 - DNA, 22 bp, Homo sapiens
gtgcccagcagcagcgtccccg

SEQ ID NO: 9495785 - DNA, 22 bp, Homo sapiens
gtgcccagcagcagcgtccccg

SEQ ID NO: 9495786 - DNA, 22 bp, Homo sapiens
gtgcccagctccacctcacaga

SEQ ID NO: 9495787 - DNA, 22 bp, Homo sapiens
gtgcccagctccacctcacaga

SEQ ID NO: 9495788 - DNA, 22 bp, Homo sapiens
gtgcccacgaggccaggctggt

SEQ ID NO: 9495789 - DNA, 22 bp, Homo sapiens
gtgcccaccggtgccctgagct

SEQ ID NO: 9495790 - DNA, 22 bp, Homo sapiens
gtgcccaccacgggctgtggcg

SEQ ID NO: 9495791 - DNA, 22 bp, Homo sapiens
gtgcccacacatgttcttacat

SEQ ID NO: 9495792 - DNA, 22 bp, Homo sapiens
gtgccaggtgctaagctgtgct

SEQ ID NO: 9495793 - DNA, 22 bp, Homo sapiens
gtgccatcgggctcctcctgct

SEQ ID NO: 9495794 - DNA, 22 bp, Homo sapiens
gtgccagggggcactgaacaga

SEQ ID NO: 9495795 - DNA, 22 bp, Homo sapiens
gtgccagggagtggaggagctt

SEQ ID NO: 9495796 - DNA, 22 bp, Homo sapiens
gtgccagggagtggaggagctt

SEQ ID NO: 9495797 - DNA, 22 bp, Homo sapiens
gtgccaggcccagggagcgggg

SEQ ID NO: 9495798 - DNA, 22 bp, Homo sapiens
gtgccaggcccagggagcgggg

SEQ ID NO: 9495799 - DNA, 20 bp, Homo sapiens
gtgccaggcaagacaggtgg

SEQ ID NO: 9495800 - DNA, 22 bp, Homo sapiens
gtgccagcctggtgcgcctggg

SEQ ID NO: 9495801 - DNA, 22 bp, Homo sapiens
gtgccagctctccccacatctg

SEQ ID NO: 9495802 - DNA, 22 bp, Homo sapiens
gtgccagctctccccacatctg

SEQ ID NO: 9495803 - DNA, 22 bp, Homo sapiens
gtgccagctgtccatgttcctc

SEQ ID NO: 9495804 - DNA, 22 bp, Homo sapiens
gtgccagctgtccatgttcctc

SEQ ID NO: 9495805 - DNA, 22 bp, Homo sapiens
gtgccagccgcaccccaggaga

SEQ ID NO: 9495806 - DNA, 22 bp, Homo sapiens
gtgccagcctggtgcgcctggg

SEQ ID NO: 9495807 - DNA, 22 bp, Homo sapiens
gtgccagcctggtgcgcctggg

SEQ ID NO: 9495808 - DNA, 18 bp, Homo sapiens
gtgccaggaggcgcagcc

SEQ ID NO: 9495809 - DNA, 18 bp, Homo sapiens
gtgccaggaggcgcagcc

SEQ ID NO: 9495810 - DNA, 22 bp, Homo sapiens
gtgagccaataccatgctgttc

SEQ ID NO: 9495811 - DNA, 22 bp, Homo sapiens
gtgagccagttcgactgtttct

SEQ ID NO: 9495812 - DNA, 22 bp, Homo sapiens
gtgagcagtggccagggtccta

SEQ ID NO: 9495813 - DNA, 22 bp, Homo sapiens
gtgagcagggcaggactgggga

SEQ ID NO: 9495814 - DNA, 22 bp, Homo sapiens
gtgagcagttgtataaagactt

SEQ ID NO: 9495815 - DNA, 22 bp, Homo sapiens
gtgagcagttgtgagccccaaa

SEQ ID NO: 9495816 - DNA, 22 bp, Homo sapiens
gtgagcagtttgttccagaatc

SEQ ID NO: 9495817 - DNA, 22 bp, Homo sapiens
gtgagctggaatagtggagaaa

SEQ ID NO: 9495818 - DNA, 22 bp, Homo sapiens
gtgagctgttggagtggcagag

SEQ ID NO: 9495819 - DNA, 22 bp, Homo sapiens
gtgagctgggtgaatggtaggg

SEQ ID NO: 9495820 - DNA, 22 bp, Homo sapiens
gtgagccattctactcctaacc

SEQ ID NO: 9495821 - DNA, 22 bp, Homo sapiens
gtgagccgagtatagttcatag

SEQ ID NO: 9495822 - DNA, 22 bp, Homo sapiens
gtgagctggaatagtggagaaa

SEQ ID NO: 9495823 - DNA, 22 bp, Homo sapiens
gtgagcgtggtcttctgtgggt

SEQ ID NO: 9495824 - DNA, 17 bp, Homo sapiens
gtgagctgagtcaggac

SEQ ID NO: 9495825 - DNA, 22 bp, Homo sapiens
gtgaggagctgacactggggtg

SEQ ID NO: 9495826 - DNA, 22 bp, Homo sapiens
gtgaggagctctttgactcacg

SEQ ID NO: 9495827 - DNA, 22 bp, Homo sapiens
gtgaggagggctggtcccaggc

SEQ ID NO: 9495828 - DNA, 22 bp, Homo sapiens
gtgaggagggctggtcccaggc

SEQ ID NO: 9495829 - DNA, 22 bp, Homo sapiens
gtgagctttgtggtaatgaagt

SEQ ID NO: 9495830 - DNA, 22 bp, Homo sapiens
gtgagctgttttggacccatct

SEQ ID NO: 9495831 - DNA, 22 bp, Homo sapiens
gtgaggaatcggttcacggtga

SEQ ID NO: 9495832 - DNA, 22 bp, Homo sapiens
gtgaggactggtaaggactgca

SEQ ID NO: 9495833 - DNA, 22 bp, Homo sapiens
gtgaaaaatcatcatgacttga

SEQ ID NO: 9495834 - DNA, 22 bp, Homo sapiens
gtgaaaaatcatcatgacttga

SEQ ID NO: 9495835 - DNA, 22 bp, Homo sapiens
gtgaaaaatcatcatgacttga

SEQ ID NO: 9495836 - DNA, 22 bp, Homo sapiens
gtgaaaaatgatttgttaactg

SEQ ID NO: 9495837 - DNA, 22 bp, Homo sapiens
gtgaaaaatgatttgttaactg

SEQ ID NO: 9495838 - DNA, 22 bp, Homo sapiens
gtgaaaaatgatttgttaactg

SEQ ID NO: 9495839 - DNA, 22 bp, Homo sapiens
gtcttttttacaccttacatca

SEQ ID NO: 9495840 - DNA, 22 bp, Homo sapiens
gtcttttttacaccttacatca

SEQ ID NO: 9495841 - DNA, 22 bp, Homo sapiens
gtcttttttacaccttacatca

SEQ ID NO: 9495842 - DNA, 22 bp, Homo sapiens
gtctttttgtctggcagaggtc

SEQ ID NO: 9495843 - DNA, 22 bp, Homo sapiens
gtctttttctacgatagcgcct

SEQ ID NO: 9495844 - DNA, 22 bp, Homo sapiens
gtctttttattatagagtggag

SEQ ID NO: 9495845 - DNA, 22 bp, Homo sapiens
gtctttcatggatattcagttt

SEQ ID NO: 9495846 - DNA, 21 bp, Homo sapiens
gtctttttaattgcgatttcc

SEQ ID NO: 9495847 - DNA, 22 bp, Homo sapiens
gtctttctatgcatagagcaga

SEQ ID NO: 9495848 - DNA, 22 bp, Homo sapiens
gtctttctatgcatagagcaga

SEQ ID NO: 9495849 - DNA, 22 bp, Homo sapiens
gtcttgtcagtgttggcagctt

SEQ ID NO: 9495850 - DNA, 22 bp, Homo sapiens
gtcttgggacccgcactgtggg

SEQ ID NO: 9495851 - DNA, 22 bp, Homo sapiens
gtcttgggacccgcactgtggg

SEQ ID NO: 9495852 - DNA, 22 bp, Homo sapiens
gtctttaagggactgaatttgg

SEQ ID NO: 9495853 - DNA, 22 bp, Homo sapiens
gtctttaagggactgaatttgg

SEQ ID NO: 9495854 - DNA, 22 bp, Homo sapiens
gtctttagttgaaacatgtggt

SEQ ID NO: 9495855 - DNA, 22 bp, Homo sapiens
gtctttagagctcctggcatct

SEQ ID NO: 9495856 - DNA, 20 bp, Homo sapiens
gtctttatgttttatgacct

SEQ ID NO: 9495857 - DNA, 20 bp, Homo sapiens
gtctttatgttttatgacct

SEQ ID NO: 9495858 - DNA, 22 bp, Homo sapiens
gtcttgcacatcttcactgtta

SEQ ID NO: 9495859 - DNA, 22 bp, Homo sapiens
gtcttgcagctcgctttgacta

SEQ ID NO: 9495860 - DNA, 21 bp, Homo sapiens
gtcttggcaccaggagagaga

SEQ ID NO: 9495861 - DNA, 22 bp, Homo sapiens
gtctccagttacagcagccagg

SEQ ID NO: 9495862 - DNA, 22 bp, Homo sapiens
gtctccatggaaagtagccagt

SEQ ID NO: 9495863 - DNA, 22 bp, Homo sapiens
gtctcccaatccgggacagcct

SEQ ID NO: 9495864 - DNA, 22 bp, Homo sapiens
gtctcccaaactctgatggtcc

SEQ ID NO: 9495865 - DNA, 22 bp, Homo sapiens
gtctccagggctgctggcgcct

SEQ ID NO: 9495866 - DNA, 22 bp, Homo sapiens
gtctccagggacacactagccg

SEQ ID NO: 9495867 - DNA, 22 bp, Homo sapiens
gtctccagtgttcaggtgactg

SEQ ID NO: 9495868 - DNA, 22 bp, Homo sapiens
gtctccagtgttcaggtgactg

SEQ ID NO: 9495869 - DNA, 22 bp, Homo sapiens
gtctccagttacagcagccagg

SEQ ID NO: 9495870 - DNA, 22 bp, Homo sapiens
gtctccagggctgctggcgcct

SEQ ID NO: 9495871 - DNA, 22 bp, Homo sapiens
gtctccagtgttcaggtgactg

SEQ ID NO: 9495872 - DNA, 22 bp, Homo sapiens
gtctatgatattttgttatagc

SEQ ID NO: 9495873 - DNA, 22 bp, Homo sapiens
gtctatgatattttgttatagc

SEQ ID NO: 9495874 - DNA, 22 bp, Homo sapiens
gtctaggccatcacaggcgcca

SEQ ID NO: 9495875 - DNA, 22 bp, Homo sapiens
gtctagaaatcatgtactgtga

SEQ ID NO: 9495876 - DNA, 22 bp, Homo sapiens
gtctagaaataggtttcagaaa

SEQ ID NO: 9495877 - DNA, 22 bp, Homo sapiens
gtctagaattgcttggcagatg

SEQ ID NO: 9495878 - DNA, 22 bp, Homo sapiens
gtctagaattgcttggcagatg

SEQ ID NO: 9495879 - DNA, 19 bp, Homo sapiens
gtctagaacattgtaggtg

SEQ ID NO: 9495880 - DNA, 20 bp, Homo sapiens
gtctacacgggcagtgtaga

SEQ ID NO: 9495881 - DNA, 20 bp, Homo sapiens
gtctacacgggcagtgtaga

SEQ ID NO: 9495882 - DNA, 22 bp, Homo sapiens
gtctacactgaatttccacaga

SEQ ID NO: 9495883 - DNA, 22 bp, Homo sapiens
gtctacactgaatttccacaga

SEQ ID NO: 9495884 - DNA, 22 bp, Homo sapiens
gtctacactgaatttccacaga

SEQ ID NO: 9495885 - DNA, 22 bp, Homo sapiens
tttttagagtgttaccagtata

SEQ ID NO: 9495886 - DNA, 22 bp, Homo sapiens
tttttagagtgttaccagtata

SEQ ID NO: 9495887 - DNA, 22 bp, Homo sapiens
tttttacagtcatggtcactca

SEQ ID NO: 9495888 - DNA, 22 bp, Homo sapiens
tttttacagtcatggtcactca

SEQ ID NO: 9495889 - DNA, 22 bp, Homo sapiens
tttttagattactcagccacca

SEQ ID NO: 9495890 - DNA, 22 bp, Homo sapiens
tttttagtagaggtgggtttca

SEQ ID NO: 9495891 - DNA, 23 bp, Homo sapiens
tttttagttacacctctgccacc

SEQ ID NO: 9495892 - DNA, 22 bp, Homo sapiens
tttttagtagaggtgggtttca

SEQ ID NO: 9495893 - DNA, 22 bp, Homo sapiens
tttttagtagaggtgggtttca

SEQ ID NO: 9495894 - DNA, 22 bp, Homo sapiens
tttttataccacctctcactta

SEQ ID NO: 9495895 - DNA, 23 bp, Homo sapiens
tttttagttacacctctgccacc

SEQ ID NO: 9495896 - DNA, 23 bp, Homo sapiens
tttttagttacacctctgccacc

SEQ ID NO: 9495897 - DNA, 23 bp, Homo sapiens
tttttagttacacctctgccacc

SEQ ID NO: 9495898 - DNA, 22 bp, Homo sapiens
ttttcttatgtgcagctatatg

SEQ ID NO: 9495899 - DNA, 22 bp, Homo sapiens
ttttcttatgtgcagctatatg

SEQ ID NO: 9495900 - DNA, 22 bp, Homo sapiens
ttttcttcctggattttggcat

SEQ ID NO: 9495901 - DNA, 22 bp, Homo sapiens
ttttgttggcttaagaaataca

SEQ ID NO: 9495902 - DNA, 22 bp, Homo sapiens
ttttcttcctggattttggcat

SEQ ID NO: 9495903 - DNA, 22 bp, Homo sapiens
ttttcttcctggattttggcat

SEQ ID NO: 9495904 - DNA, 22 bp, Homo sapiens
ttttgtttaaaatcctggatgg

SEQ ID NO: 9495905 - DNA, 22 bp, Homo sapiens
ttttgtttaaaatcctggatgg

SEQ ID NO: 9495906 - DNA, 22 bp, Homo sapiens
ttttgtttaaaatcctggatgg

SEQ ID NO: 9495907 - DNA, 22 bp, Homo sapiens
ttttgtttaaaatcctggatgg

SEQ ID NO: 9495908 - DNA, 22 bp, Homo sapiens
ttttgtttgtgtccactgcagt

SEQ ID NO: 9495909 - DNA, 22 bp, Homo sapiens
tttttacacttagcattgagcg

SEQ ID NO: 9495910 - DNA, 22 bp, Homo sapiens
tttttacacttagcattgagcg

SEQ ID NO: 9495911 - DNA, 19 bp, Homo sapiens
tttttacaagtaggtgtga

SEQ ID NO: 9495912 - DNA, 22 bp, Homo sapiens
ttttgtttgtgtccactgcagt

SEQ ID NO: 9495913 - DNA, 22 bp, Homo sapiens
tttttcatattcccctctctgg

SEQ ID NO: 9495914 - DNA, 22 bp, Homo sapiens
tttttcatattcccctctctgg

SEQ ID NO: 9495915 - DNA, 22 bp, Homo sapiens
tttttcatattcccctctctgg

SEQ ID NO: 9495916 - DNA, 22 bp, Homo sapiens
tttttcatctgattgataactc

SEQ ID NO: 9495917 - DNA, 22 bp, Homo sapiens
tttttcatctgattgataactc

SEQ ID NO: 9495918 - DNA, 22 bp, Homo sapiens
tttttatctacagattctcagc

SEQ ID NO: 9495919 - DNA, 22 bp, Homo sapiens
tttttatcttgtatgtgtctct

SEQ ID NO: 9495920 - DNA, 22 bp, Homo sapiens
tttttcaagacaacctgcatgt

SEQ ID NO: 9495921 - DNA, 22 bp, Homo sapiens
tttttatgcctacgctgaaaag

SEQ ID NO: 9495922 - DNA, 22 bp, Homo sapiens
tttttatgcctacgctgaaaag

SEQ ID NO: 9495923 - DNA, 22 bp, Homo sapiens
tttttatcttgtatgtgtctct

SEQ ID NO: 9495924 - DNA, 22 bp, Homo sapiens
tttttataccacctctcactta

SEQ ID NO: 9495925 - DNA, 22 bp, Homo sapiens
tttttatactttgctcaagatt

SEQ ID NO: 9495926 - DNA, 22 bp, Homo sapiens
tttgacaacagcaaatgtcaca

SEQ ID NO: 9495927 - DNA, 22 bp, Homo sapiens
tttgacaaccaggcaggtaaga

SEQ ID NO: 9495928 - DNA, 22 bp, Homo sapiens
tttgacaacgttgttgtgagga

SEQ ID NO: 9495929 - DNA, 22 bp, Homo sapiens
tttgacaactgtgcagtttgta

SEQ ID NO: 9495930 - DNA, 22 bp, Homo sapiens
tttgacaataattgcatttata

SEQ ID NO: 9495931 - DNA, 22 bp, Homo sapiens
tttgacaattaggtagaaaaag

SEQ ID NO: 9495932 - DNA, 22 bp, Homo sapiens
tttgacaattaggtagaaaaag

SEQ ID NO: 9495933 - DNA, 22 bp, Homo sapiens
tttgacaattaggtagaaaaag

SEQ ID NO: 9495934 - DNA, 22 bp, Homo sapiens
tttgacaattaggtagaaaaag

SEQ ID NO: 9495935 - DNA, 22 bp, Homo sapiens
tttgacaagagcaaatgttctt

SEQ ID NO: 9495936 - DNA, 22 bp, Homo sapiens
tttgacaagagggcatcttcag

SEQ ID NO: 9495937 - DNA, 22 bp, Homo sapiens
tttgacaagagggcatcttcag

SEQ ID NO: 9495938 - DNA, 19 bp, Homo sapiens
tttgacagagtttgagcat

SEQ ID NO: 9495939 - DNA, 22 bp, Homo sapiens
tttgacactgggagtgtgggtg

SEQ ID NO: 9495940 - DNA, 22 bp, Homo sapiens
tttgaatgattatctttcggca

SEQ ID NO: 9495941 - DNA, 22 bp, Homo sapiens
tttgaatgagggaaccacagtt

SEQ ID NO: 9495942 - DNA, 22 bp, Homo sapiens
tttgaatgcaggacatacagaa

SEQ ID NO: 9495943 - DNA, 22 bp, Homo sapiens
tttgaatggactgagaatcttg

SEQ ID NO: 9495944 - DNA, 22 bp, Homo sapiens
tttgaatgttggattgacttag

SEQ ID NO: 9495945 - DNA, 22 bp, Homo sapiens
tttgaatgttttaggtacttaa

SEQ ID NO: 9495946 - DNA, 22 bp, Homo sapiens
tttgaatgtaaatgctgcagct

SEQ ID NO: 9495947 - DNA, 20 bp, Homo sapiens
tttgaatgtaaagcatgtca

SEQ ID NO: 9495948 - DNA, 22 bp, Homo sapiens
tttgacaaatatttattggcac

SEQ ID NO: 9495949 - DNA, 22 bp, Homo sapiens
tttgacaaatccttcagcaatg

SEQ ID NO: 9495950 - DNA, 22 bp, Homo sapiens
tttgacaaaggaaaaatgcaca

SEQ ID NO: 9495951 - DNA, 22 bp, Homo sapiens
tttgacaaaggaaaaatgcaca

SEQ ID NO: 9495952 - DNA, 22 bp, Homo sapiens
tttgaagagccacagtgaaatt

SEQ ID NO: 9495953 - DNA, 22 bp, Homo sapiens
tttgaagagccacagtgaaatt

SEQ ID NO: 9495954 - DNA, 22 bp, Homo sapiens
tttgaatagcataggattacat

SEQ ID NO: 9495955 - DNA, 22 bp, Homo sapiens
tttgaagataaatatggagaaa

SEQ ID NO: 9495956 - DNA, 22 bp, Homo sapiens
tttgaagataaatatggagaaa

SEQ ID NO: 9495957 - DNA, 22 bp, Homo sapiens
tttgaagattatgccagagtga

SEQ ID NO: 9495958 - DNA, 22 bp, Homo sapiens
tttgaagcaccaaaggagaaaa

SEQ ID NO: 9495959 - DNA, 22 bp, Homo sapiens
tttgaatatacttcaaacaaag

SEQ ID NO: 9495960 - DNA, 22 bp, Homo sapiens
tttgaatgacatgattcaggca

SEQ ID NO: 9495961 - DNA, 22 bp, Homo sapiens
tttgaatctgatatggcagcat

SEQ ID NO: 9495962 - DNA, 19 bp, Homo sapiens
tttgaaaggattgttattt

SEQ ID NO: 9495963 - DNA, 22 bp, Homo sapiens
tttgaaagggttatgagactga

SEQ ID NO: 9495964 - DNA, 21 bp, Homo sapiens
tttgaaagccctatgttttca

SEQ ID NO: 9495965 - DNA, 22 bp, Homo sapiens
tttgaaagcaggtgtgggaggg

SEQ ID NO: 9495966 - DNA, 22 bp, Homo sapiens
tttgaaagcaccatttgagtag

SEQ ID NO: 9495967 - DNA, 22 bp, Homo sapiens
tttgaaagcctggcttttctct

SEQ ID NO: 9495968 - DNA, 21 bp, Homo sapiens
tttgaaagctacatctatagc

SEQ ID NO: 9495969 - DNA, 22 bp, Homo sapiens
tttcttttccaatatccctact

SEQ ID NO: 9495970 - DNA, 22 bp, Homo sapiens
tttcttttccaatatccctact

SEQ ID NO: 9495971 - DNA, 22 bp, Homo sapiens
tttcttttccaatatccctact

SEQ ID NO: 9495972 - DNA, 19 bp, Homo sapiens
tttcttttcccctcagcac

SEQ ID NO: 9495973 - DNA, 22 bp, Homo sapiens
tttcttttgaatagtgtgtggt

SEQ ID NO: 9495974 - DNA, 22 bp, Homo sapiens
tttcttttgaatagtgtgtggt

SEQ ID NO: 9495975 - DNA, 19 bp, Homo sapiens
tttcttttcccctcagcac

SEQ ID NO: 9495976 - DNA, 19 bp, Homo sapiens
tttcttttcccctcagcac

SEQ ID NO: 9495977 - DNA, 22 bp, Homo sapiens
tttcttttgccctgtgggttag

SEQ ID NO: 9495978 - DNA, 22 bp, Homo sapiens
tttcttttgctgagaggggcac

SEQ ID NO: 9495979 - DNA, 22 bp, Homo sapiens
tttcttttgccctgtgggttag

SEQ ID NO: 9495980 - DNA, 22 bp, Homo sapiens
tttcttttgaatagtgtgtggt

SEQ ID NO: 9495981 - DNA, 22 bp, Homo sapiens
tttctttgtagtagcataatca

SEQ ID NO: 9495982 - DNA, 22 bp, Homo sapiens
tttctttgtagtagcataatca

SEQ ID NO: 9495983 - DNA, 22 bp, Homo sapiens
tttctttgttgttatcacatca

SEQ ID NO: 9495984 - DNA, 22 bp, Homo sapiens
tttctttgttgttatcacatca

SEQ ID NO: 9495985 - DNA, 22 bp, Homo sapiens
tttcttttacagtgtggctatt

SEQ ID NO: 9495986 - DNA, 22 bp, Homo sapiens
tttcttttacagtgtggctatt

SEQ ID NO: 9495987 - DNA, 18 bp, Homo sapiens
tttctttctgcctggggc

SEQ ID NO: 9495988 - DNA, 22 bp, Homo sapiens
tttcctctgatgctgacttgga

SEQ ID NO: 9495989 - DNA, 22 bp, Homo sapiens
tttctttgagtctcagtttgct

SEQ ID NO: 9495990 - DNA, 22 bp, Homo sapiens
tttctttgagtctcagtttgct

SEQ ID NO: 9495991 - DNA, 22 bp, Homo sapiens
tttctttgagtctcagtttgct

SEQ ID NO: 9495992 - DNA, 22 bp, Homo sapiens
tttcctcagaagtgtctactat

SEQ ID NO: 9495993 - DNA, 22 bp, Homo sapiens
tttcctctccggggcctccagg

SEQ ID NO: 9495994 - DNA, 22 bp, Homo sapiens
tttcctctccggggcctccagg

SEQ ID NO: 9495995 - DNA, 22 bp, Homo sapiens
tttcctctgactgctcccctgc

SEQ ID NO: 9495996 - DNA, 22 bp, Homo sapiens
tttcccttctttcctgagtaat

SEQ ID NO: 9495997 - DNA, 22 bp, Homo sapiens
tttcccttctttcctgagtaat

SEQ ID NO: 9495998 - DNA, 22 bp, Homo sapiens
tttccctctgtgccagcttctc

SEQ ID NO: 9495999 - DNA, 22 bp, Homo sapiens
tttccctctgtgccagcttctc

SEQ ID NO: 9496000 - DNA, 22 bp, Homo sapiens
tttccctctgtgccagcttctc

SEQ ID NO: 9496001 - DNA, 17 bp, Homo sapiens
tttccctccttccactc

SEQ ID NO: 9496002 - DNA, 17 bp, Homo sapiens
tttccctccttccactc

SEQ ID NO: 9496003 - DNA, 17 bp, Homo sapiens
tttccctccttccactc

SEQ ID NO: 9496004 - DNA, 22 bp, Homo sapiens
tttccctttagcctgagaatcc

SEQ ID NO: 9496005 - DNA, 22 bp, Homo sapiens
tttcccttgttccttcctctga

SEQ ID NO: 9496006 - DNA, 19 bp, Homo sapiens
tttcctaaaaagctgtgct

SEQ ID NO: 9496007 - DNA, 19 bp, Homo sapiens
tttcctaaaaagctgtgct

SEQ ID NO: 9496008 - DNA, 22 bp, Homo sapiens
tttccctttgcactctacaatt

SEQ ID NO: 9496009 - DNA, 22 bp, Homo sapiens
tttggaaagtgtgatttcaagg

SEQ ID NO: 9496010 - DNA, 22 bp, Homo sapiens
tttggaaagtgtgatttcaagg

SEQ ID NO: 9496011 - DNA, 22 bp, Homo sapiens
tttggaaatacgcgtaggcaga

SEQ ID NO: 9496012 - DNA, 22 bp, Homo sapiens
tttgctttgtttaaaagtggta

SEQ ID NO: 9496013 - DNA, 22 bp, Homo sapiens
tttgctttgggaggttgtctgg

SEQ ID NO: 9496014 - DNA, 22 bp, Homo sapiens
tttgctttgtttaaaagtggta

SEQ ID NO: 9496015 - DNA, 22 bp, Homo sapiens
tttgcttttgtgctctagtggt

SEQ ID NO: 9496016 - DNA, 22 bp, Homo sapiens
tttggaaaaagacagcttatga

SEQ ID NO: 9496017 - DNA, 22 bp, Homo sapiens
tttgcttttgtgctctagtggt

SEQ ID NO: 9496018 - DNA, 22 bp, Homo sapiens
tttggaaactgcctcagctctt

SEQ ID NO: 9496019 - DNA, 22 bp, Homo sapiens
tttggttaaacgagagaacata

SEQ ID NO: 9496020 - DNA, 22 bp, Homo sapiens
tttggttaatttaggcttgcat

SEQ ID NO: 9496021 - DNA, 22 bp, Homo sapiens
tttggttaatttaggcttgcat

SEQ ID NO: 9496022 - DNA, 22 bp, Homo sapiens
tttggtttagggtcatttaaca

SEQ ID NO: 9496023 - DNA, 22 bp, Homo sapiens
tttggtgagctgcgagtgagga

SEQ ID NO: 9496024 - DNA, 21 bp, Homo sapiens
tttggtgctggaaatgccatt

SEQ ID NO: 9496025 - DNA, 22 bp, Homo sapiens
tttgtaaaagcccaagctgtag

SEQ ID NO: 9496026 - DNA, 22 bp, Homo sapiens
tttgtaaaagcccaagctgtag

SEQ ID NO: 9496027 - DNA, 22 bp, Homo sapiens
tttgtaaaagcccaagctgtag

SEQ ID NO: 9496028 - DNA, 22 bp, Homo sapiens
tttggtttttaatacaaagtac

SEQ ID NO: 9496029 - DNA, 22 bp, Homo sapiens
tttggtttgaatgagcataaga

SEQ ID NO: 9496030 - DNA, 22 bp, Homo sapiens
tttggtttgcctgagtaccctc

SEQ ID NO: 9496031 - DNA, 22 bp, Homo sapiens
tttggtttgaatgagcataaga

SEQ ID NO: 9496032 - DNA, 22 bp, Homo sapiens
tttggtttattaaattgtaggc

SEQ ID NO: 9496033 - DNA, 22 bp, Homo sapiens
tttggtcagggtaggacagttg

SEQ ID NO: 9496034 - DNA, 22 bp, Homo sapiens
tttggtattgcacactgtcttc

SEQ ID NO: 9496035 - DNA, 22 bp, Homo sapiens
tttggtcaaatattatcctgag

SEQ ID NO: 9496036 - DNA, 22 bp, Homo sapiens
tttggtattgcacactgtcttc

SEQ ID NO: 9496037 - DNA, 22 bp, Homo sapiens
tttggtattgcacactgtcttc

SEQ ID NO: 9496038 - DNA, 22 bp, Homo sapiens
tttgataattaaaaattgtagt

SEQ ID NO: 9496039 - DNA, 22 bp, Homo sapiens
tttgataattaaaaattgtagt

SEQ ID NO: 9496040 - DNA, 22 bp, Homo sapiens
tttgataattaaaaattgtagt

SEQ ID NO: 9496041 - DNA, 22 bp, Homo sapiens
tttgatactgagaaaaacaaat

SEQ ID NO: 9496042 - DNA, 22 bp, Homo sapiens
tttgatatcctatacaagtaaa

SEQ ID NO: 9496043 - DNA, 19 bp, Homo sapiens
tttgatatctgaattatgc

SEQ ID NO: 9496044 - DNA, 22 bp, Homo sapiens
tttgatatcttggtatacagat

SEQ ID NO: 9496045 - DNA, 22 bp, Homo sapiens
tttgatccgttgctggtgagga

SEQ ID NO: 9496046 - DNA, 22 bp, Homo sapiens
tttgatctatgcgtggtttccc

SEQ ID NO: 9496047 - DNA, 22 bp, Homo sapiens
tttgatgaaagctactatttac

SEQ ID NO: 9496048 - DNA, 22 bp, Homo sapiens
tttgacagatctcagagcattt

SEQ ID NO: 9496049 - DNA, 22 bp, Homo sapiens
tttgaggaagatcggagggaaa

SEQ ID NO: 9496050 - DNA, 18 bp, Homo sapiens
tttgaggaaatgtcctga

SEQ ID NO: 9496051 - DNA, 22 bp, Homo sapiens
tttgagcttgtagcattgctat

SEQ ID NO: 9496052 - DNA, 22 bp, Homo sapiens
tttgaggacattttagaaagtt

SEQ ID NO: 9496053 - DNA, 22 bp, Homo sapiens
tttgagtaggcttatattttgg

SEQ ID NO: 9496054 - DNA, 22 bp, Homo sapiens
tttgataacagtgaatatcatg

SEQ ID NO: 9496055 - DNA, 22 bp, Homo sapiens
tttgataacagtgaatatcatg

SEQ ID NO: 9496056 - DNA, 22 bp, Homo sapiens
tttgataagagctgctgaaact

SEQ ID NO: 9496057 - DNA, 22 bp, Homo sapiens
tttgataacagtgaatatcatg

SEQ ID NO: 9496058 - DNA, 22 bp, Homo sapiens
tttgataacagtgaatatcatg

SEQ ID NO: 9496059 - DNA, 22 bp, Homo sapiens
tttgataagagctgctgaaact

SEQ ID NO: 9496060 - DNA, 22 bp, Homo sapiens
tttgataatacacaagagaaag

SEQ ID NO: 9496061 - DNA, 22 bp, Homo sapiens
tttgataagagctgctgaaact

SEQ ID NO: 9496062 - DNA, 22 bp, Homo sapiens
tttgataacagtgaatatcatg

SEQ ID NO: 9496063 - DNA, 22 bp, Homo sapiens
tttgataacagtgaatatcatg

SEQ ID NO: 9496064 - DNA, 22 bp, Homo sapiens
tttgatttactggatattctca

SEQ ID NO: 9496065 - DNA, 22 bp, Homo sapiens
tttgatttactataagcagcac

SEQ ID NO: 9496066 - DNA, 22 bp, Homo sapiens
tttgatttactataagcagcac

SEQ ID NO: 9496067 - DNA, 22 bp, Homo sapiens
tttgattgcaatagttttatga

SEQ ID NO: 9496068 - DNA, 22 bp, Homo sapiens
tttgattcaatgtttatataaa

SEQ ID NO: 9496069 - DNA, 22 bp, Homo sapiens
tttgattctggcctctgagaag

SEQ ID NO: 9496070 - DNA, 22 bp, Homo sapiens
tttgattctaagttctgtcaac

SEQ ID NO: 9496071 - DNA, 19 bp, Homo sapiens
tttgatgagaatttaagca

SEQ ID NO: 9496072 - DNA, 22 bp, Homo sapiens
tttgatgaacctatataatttg

SEQ ID NO: 9496073 - DNA, 22 bp, Homo sapiens
tttgatgatgatgataaagttt

SEQ ID NO: 9496074 - DNA, 22 bp, Homo sapiens
tttgatgagtttaataacagcc

SEQ ID NO: 9496075 - DNA, 22 bp, Homo sapiens
tttgatgatgatgataaagttt

SEQ ID NO: 9496076 - DNA, 22 bp, Homo sapiens
tttgatgagtttaataacagcc

SEQ ID NO: 9496077 - DNA, 22 bp, Homo sapiens
tttgctttgactgtcagcaagt

SEQ ID NO: 9496078 - DNA, 22 bp, Homo sapiens
tttgctttgactgtcagcaagt

SEQ ID NO: 9496079 - DNA, 22 bp, Homo sapiens
tttgctttgactgtcagcaagt

SEQ ID NO: 9496080 - DNA, 22 bp, Homo sapiens
tttgctttgactgtcagcaagt

SEQ ID NO: 9496081 - DNA, 22 bp, Homo sapiens
tttgctttcttgattcagatta

SEQ ID NO: 9496082 - DNA, 22 bp, Homo sapiens
tttgctttcttgattcagatta

SEQ ID NO: 9496083 - DNA, 22 bp, Homo sapiens
tttgatttactggatattctca

SEQ ID NO: 9496084 - DNA, 22 bp, Homo sapiens
tttgatttactggatattctca

SEQ ID NO: 9496085 - DNA, 22 bp, Homo sapiens
tttgctttctgttgaacagagt

SEQ ID NO: 9496086 - DNA, 18 bp, Homo sapiens
tttgctttccttcttcag

SEQ ID NO: 9496087 - DNA, 18 bp, Homo sapiens
tttgctttccttcttcag

SEQ ID NO: 9496088 - DNA, 22 bp, Homo sapiens
ttttaaaggctgtatgaccaag

SEQ ID NO: 9496089 - DNA, 22 bp, Homo sapiens
ttttaaatctccagttgacccc

SEQ ID NO: 9496090 - DNA, 22 bp, Homo sapiens
ttttaaatctccagttgacccc

SEQ ID NO: 9496091 - DNA, 22 bp, Homo sapiens
ttttaaatctccagttgacccc

SEQ ID NO: 9496092 - DNA, 22 bp, Homo sapiens
ttttaaatctccagttgacccc

SEQ ID NO: 9496093 - DNA, 22 bp, Homo sapiens
ttttaaatctccagttgacccc

SEQ ID NO: 9496094 - DNA, 22 bp, Homo sapiens
ttttaacactcagcactatctc

SEQ ID NO: 9496095 - DNA, 22 bp, Homo sapiens
ttttaacactcagcactatctc

SEQ ID NO: 9496096 - DNA, 22 bp, Homo sapiens
ttttaacactcagcactatctc

SEQ ID NO: 9496097 - DNA, 21 bp, Homo sapiens
ttttaacaaggatttccctag

SEQ ID NO: 9496098 - DNA, 21 bp, Homo sapiens
ttttaacaaggatttccctag

SEQ ID NO: 9496099 - DNA, 22 bp, Homo sapiens
ttttaacactcagcactatctc

SEQ ID NO: 9496100 - DNA, 21 bp, Homo sapiens
ttttaacaaggatttccctag

SEQ ID NO: 9496101 - DNA, 22 bp, Homo sapiens
tttgttcaatatgtgtttgtcc

SEQ ID NO: 9496102 - DNA, 22 bp, Homo sapiens
tttgttcaaggaatagtaaatg

SEQ ID NO: 9496103 - DNA, 22 bp, Homo sapiens
tttgttcacagggttgttgtag

SEQ ID NO: 9496104 - DNA, 22 bp, Homo sapiens
tttgttcaatccagacaatagc

SEQ ID NO: 9496105 - DNA, 22 bp, Homo sapiens
ttttaaactgcagaatttagaa

SEQ ID NO: 9496106 - DNA, 22 bp, Homo sapiens
ttttaaactgcagaatttagaa

SEQ ID NO: 9496107 - DNA, 22 bp, Homo sapiens
ttttaaaggatactcttgtcta

SEQ ID NO: 9496108 - DNA, 22 bp, Homo sapiens
ttttaaaggatactcttgtcta

SEQ ID NO: 9496109 - DNA, 22 bp, Homo sapiens
ttttaaaggcagattatggctt

SEQ ID NO: 9496110 - DNA, 22 bp, Homo sapiens
ttttaaaggcagattatggctt

SEQ ID NO: 9496111 - DNA, 22 bp, Homo sapiens
ttttaaagagatgctgtgcata

SEQ ID NO: 9496112 - DNA, 22 bp, Homo sapiens
ttttaaagagatgctgtgcata

SEQ ID NO: 9496113 - DNA, 22 bp, Homo sapiens
ttttaaagagatgctgtgcata

SEQ ID NO: 9496114 - DNA, 22 bp, Homo sapiens
ttttaaaggatactcttgtcta

SEQ ID NO: 9496115 - DNA, 22 bp, Homo sapiens
ttttaaaggatactcttgtcta

SEQ ID NO: 9496116 - DNA, 22 bp, Homo sapiens
ttttaaaggatactcttgtcta

SEQ ID NO: 9496117 - DNA, 22 bp, Homo sapiens
ttttatgtgctggactggcagt

SEQ ID NO: 9496118 - DNA, 22 bp, Homo sapiens
ttttatgtcataaggacactca

SEQ ID NO: 9496119 - DNA, 22 bp, Homo sapiens
ttttatgtaataaactgtacac

SEQ ID NO: 9496120 - DNA, 22 bp, Homo sapiens
ttttaattgcaattatggtccc

SEQ ID NO: 9496121 - DNA, 18 bp, Homo sapiens
ttttaatttcaggggtgg

SEQ ID NO: 9496122 - DNA, 22 bp, Homo sapiens
ttttatgagaatgcgccacttg

SEQ ID NO: 9496123 - DNA, 22 bp, Homo sapiens
ttttatgcaagttatgattaaa

SEQ ID NO: 9496124 - DNA, 21 bp, Homo sapiens
ttttatgcataggaaatatat

SEQ ID NO: 9496125 - DNA, 21 bp, Homo sapiens
ttttatgcataggaaatatat

SEQ ID NO: 9496126 - DNA, 22 bp, Homo sapiens
ttttatgattgagctggctaca

SEQ ID NO: 9496127 - DNA, 22 bp, Homo sapiens
ttttatgagtgtccctctgtgg

SEQ ID NO: 9496128 - DNA, 23 bp, Homo sapiens
ttttaatttggacataagaagat

SEQ ID NO: 9496129 - DNA, 22 bp, Homo sapiens
ttttaattcaaagtgaatagtg

SEQ ID NO: 9496130 - DNA, 22 bp, Homo sapiens
ttttaattgcaattatggtccc

SEQ ID NO: 9496131 - DNA, 22 bp, Homo sapiens
ttttaatgtgctctgcaatgat

SEQ ID NO: 9496132 - DNA, 22 bp, Homo sapiens
ttttaatgtgctctgcaatgat

SEQ ID NO: 9496133 - DNA, 22 bp, Homo sapiens
ttttaatgtgctctgcaatgat

SEQ ID NO: 9496134 - DNA, 22 bp, Homo sapiens
ttttaattcaaagtgaatagtg

SEQ ID NO: 9496135 - DNA, 22 bp, Homo sapiens
ttttaattcaaagtgaatagtg

SEQ ID NO: 9496136 - DNA, 22 bp, Homo sapiens
ttttaattcaaagtgaatagtg

SEQ ID NO: 9496137 - DNA, 22 bp, Homo sapiens
ttttaatcctcttggtatctta

SEQ ID NO: 9496138 - DNA, 22 bp, Homo sapiens
ttttaatccatctggtaaacct

SEQ ID NO: 9496139 - DNA, 22 bp, Homo sapiens
ttttaatcctcttggtatctta

SEQ ID NO: 9496140 - DNA, 22 bp, Homo sapiens
ttttaatccatctggtaaacct

SEQ ID NO: 9496141 - DNA, 22 bp, Homo sapiens
ttttaatcctcttggtatctta

SEQ ID NO: 9496142 - DNA, 22 bp, Homo sapiens
ttttaagaaatgtatgactgtc

SEQ ID NO: 9496143 - DNA, 22 bp, Homo sapiens
ttttaagaaatgtatgactgtc

SEQ ID NO: 9496144 - DNA, 22 bp, Homo sapiens
ttttaagaaatgtatgactgtc

SEQ ID NO: 9496145 - DNA, 22 bp, Homo sapiens
ttttaatcatgcttctatgtcc

SEQ ID NO: 9496146 - DNA, 22 bp, Homo sapiens
ttttaatcatgcttctatgtcc

SEQ ID NO: 9496147 - DNA, 22 bp, Homo sapiens
ttttaatactgctattgtagga

SEQ ID NO: 9496148 - DNA, 22 bp, Homo sapiens
tttgttaaggagtattgcttct

SEQ ID NO: 9496149 - DNA, 22 bp, Homo sapiens
tttgttaaggagtattgcttct

SEQ ID NO: 9496150 - DNA, 22 bp, Homo sapiens
tttgttaaggagtattgcttct

SEQ ID NO: 9496151 - DNA, 22 bp, Homo sapiens
tttgttaagatgctgttctgct

SEQ ID NO: 9496152 - DNA, 22 bp, Homo sapiens
tttgttaagatgctgttctgct

SEQ ID NO: 9496153 - DNA, 22 bp, Homo sapiens
tttgttacattaaaaagtaggt

SEQ ID NO: 9496154 - DNA, 22 bp, Homo sapiens
tttgttaattcttatgttagag

SEQ ID NO: 9496155 - DNA, 22 bp, Homo sapiens
tttgttaattcttatgttagag

SEQ ID NO: 9496156 - DNA, 22 bp, Homo sapiens
tttgttcaaaaattataagata

SEQ ID NO: 9496157 - DNA, 22 bp, Homo sapiens
tttgttataacaataaaaagtc

SEQ ID NO: 9496158 - DNA, 22 bp, Homo sapiens
tttgttcaaggaatagtaaatg

SEQ ID NO: 9496159 - DNA, 22 bp, Homo sapiens
tttgttcaacaggtgaaataga

SEQ ID NO: 9496160 - DNA, 22 bp, Homo sapiens
tttgttcaacaggtgaaataga

SEQ ID NO: 9496161 - DNA, 22 bp, Homo sapiens
tttgtgttaaatgttaaattca

SEQ ID NO: 9496162 - DNA, 22 bp, Homo sapiens
tttgtgtttaatacaaggacct

SEQ ID NO: 9496163 - DNA, 22 bp, Homo sapiens
tttgtgttgttttaagccacta

SEQ ID NO: 9496164 - DNA, 22 bp, Homo sapiens
tttgtgtttgtacaatgcacta

SEQ ID NO: 9496165 - DNA, 22 bp, Homo sapiens
tttgtgtttgtacaatgcacta

SEQ ID NO: 9496166 - DNA, 22 bp, Homo sapiens
tttgttaaaatgcagattctgt

SEQ ID NO: 9496167 - DNA, 22 bp, Homo sapiens
tttgttaaaatgcagattctgt

SEQ ID NO: 9496168 - DNA, 22 bp, Homo sapiens
tttgttaaaatgcagattctgt

SEQ ID NO: 9496169 - DNA, 22 bp, Homo sapiens
tttgtgttttcactagcagtgt

SEQ ID NO: 9496170 - DNA, 22 bp, Homo sapiens
tttgtgttttagctggtgaggc

SEQ ID NO: 9496171 - DNA, 22 bp, Homo sapiens
tttgtgttttagctggtgaggc

SEQ ID NO: 9496172 - DNA, 22 bp, Homo sapiens
tttgtaaaggcctgaatttcag

SEQ ID NO: 9496173 - DNA, 22 bp, Homo sapiens
tttgtaaaggcctgaatttcag

SEQ ID NO: 9496174 - DNA, 22 bp, Homo sapiens
tttgtaaagtctgttctgagtt

SEQ ID NO: 9496175 - DNA, 22 bp, Homo sapiens
tttgtaaagtctgttctgagtt

SEQ ID NO: 9496176 - DNA, 22 bp, Homo sapiens
tttgtaaatagcagtactcatg

SEQ ID NO: 9496177 - DNA, 22 bp, Homo sapiens
tttgtaaatagcagtactcatg

SEQ ID NO: 9496178 - DNA, 22 bp, Homo sapiens
tttgtaaatagcagtactcatg

SEQ ID NO: 9496179 - DNA, 22 bp, Homo sapiens
tttgtaaatagcagtactcatg

SEQ ID NO: 9496180 - DNA, 22 bp, Homo sapiens
tttgtaaatagcagtactcatg

SEQ ID NO: 9496181 - DNA, 22 bp, Homo sapiens
tttgtaacatcccaacaaattt

SEQ ID NO: 9496182 - DNA, 22 bp, Homo sapiens
tttgtaaaaggaggaagcatgg

SEQ ID NO: 9496183 - DNA, 22 bp, Homo sapiens
tttgtaaaaggaggaagcatgg

SEQ ID NO: 9496184 - DNA, 22 bp, Homo sapiens
tttgtaaaaggaggaagcatgg

SEQ ID NO: 9496185 - DNA, 22 bp, Homo sapiens
tttgtaaaaggaggaagcatgg

SEQ ID NO: 9496186 - DNA, 22 bp, Homo sapiens
tttgtaaaattagggaattcaa

SEQ ID NO: 9496187 - DNA, 22 bp, Homo sapiens
tttgtaaaattagggaattcaa

SEQ ID NO: 9496188 - DNA, 22 bp, Homo sapiens
tttgtgtgtatatccttccaga

SEQ ID NO: 9496189 - DNA, 22 bp, Homo sapiens
tttgtgtgtatatgtatataga

SEQ ID NO: 9496190 - DNA, 22 bp, Homo sapiens
tttgtgtgtatatgtatataga

SEQ ID NO: 9496191 - DNA, 21 bp, Homo sapiens
tttgtgtgtcacgtgcacagg

SEQ ID NO: 9496192 - DNA, 22 bp, Homo sapiens
tttgtgtgtgctcacatagatg

SEQ ID NO: 9496193 - DNA, 22 bp, Homo sapiens
tttgtgtgtgtataggaaagga

SEQ ID NO: 9496194 - DNA, 22 bp, Homo sapiens
tttgtgtggtggatactgggta

SEQ ID NO: 9496195 - DNA, 22 bp, Homo sapiens
tttgtgtgggggaaacaaggta

SEQ ID NO: 9496196 - DNA, 22 bp, Homo sapiens
tttgtgtggtggatactgggta

SEQ ID NO: 9496197 - DNA, 22 bp, Homo sapiens
tttgtgtggcgttggccggcgg

SEQ ID NO: 9496198 - DNA, 22 bp, Homo sapiens
tttgtgtgcttggtattgaaga

SEQ ID NO: 9496199 - DNA, 22 bp, Homo sapiens
tttgtgtgcttggtattgaaga

SEQ ID NO: 9496200 - DNA, 22 bp, Homo sapiens
tttgtgtggatggaaggcagta

SEQ ID NO: 9496201 - DNA, 22 bp, Homo sapiens
tttgtgtggcgttggccggcgg

SEQ ID NO: 9496202 - DNA, 22 bp, Homo sapiens
tttgtgtggatggaaggcagta

SEQ ID NO: 9496203 - DNA, 22 bp, Homo sapiens
tttgtaagcaaaaagtccattc

SEQ ID NO: 9496204 - DNA, 22 bp, Homo sapiens
tttgtaactttagaattgatcc

SEQ ID NO: 9496205 - DNA, 22 bp, Homo sapiens
tttgtgtgaaaatatttaagtt

SEQ ID NO: 9496206 - DNA, 22 bp, Homo sapiens
tttgtgtgcaacgcatggagtc

SEQ ID NO: 9496207 - DNA, 22 bp, Homo sapiens
tttgtgtgcgtctggcctgggg

SEQ ID NO: 9496208 - DNA, 22 bp, Homo sapiens
ttttattggagtgataccaagc

SEQ ID NO: 9496209 - DNA, 22 bp, Homo sapiens
ttttattggagtgataccaagc

SEQ ID NO: 9496210 - DNA, 22 bp, Homo sapiens
ttttattggagtgataccaagc

SEQ ID NO: 9496211 - DNA, 22 bp, Homo sapiens
ttttattggagtgataccaagc

SEQ ID NO: 9496212 - DNA, 22 bp, Homo sapiens
ttttattggagtgataccaagc

SEQ ID NO: 9496213 - DNA, 22 bp, Homo sapiens
ttttattggagtgataccaagc

SEQ ID NO: 9496214 - DNA, 22 bp, Homo sapiens
ttttattgcaataaagtgtgta

SEQ ID NO: 9496215 - DNA, 22 bp, Homo sapiens
ttttattgcaataaagtgtgta

SEQ ID NO: 9496216 - DNA, 22 bp, Homo sapiens
ttttattgcaataaagtgtgta

SEQ ID NO: 9496217 - DNA, 22 bp, Homo sapiens
ttttattgcaataaagtgtgta

SEQ ID NO: 9496218 - DNA, 22 bp, Homo sapiens
ttttattgcaataaagtgtgta

SEQ ID NO: 9496219 - DNA, 22 bp, Homo sapiens
ttttattgcaataaagtgtgta

SEQ ID NO: 9496220 - DNA, 21 bp, Homo sapiens
ttttattgatgaatggccact

SEQ ID NO: 9496221 - DNA, 22 bp, Homo sapiens
ttttatgttcctctttatgcga

SEQ ID NO: 9496222 - DNA, 22 bp, Homo sapiens
ttttatgttcctgaagctatct

SEQ ID NO: 9496223 - DNA, 22 bp, Homo sapiens
ttttatgttcctctttatgcga

SEQ ID NO: 9496224 - DNA, 22 bp, Homo sapiens
ttttatgtgtgaaatgctgtct

SEQ ID NO: 9496225 - DNA, 22 bp, Homo sapiens
ttttatgtgtgaaatgctgtct

SEQ ID NO: 9496226 - DNA, 22 bp, Homo sapiens
ttttatgtgtgaaatgctgtct

SEQ ID NO: 9496227 - DNA, 22 bp, Homo sapiens
ttttattagtggctagatgggg

SEQ ID NO: 9496228 - DNA, 22 bp, Homo sapiens
ttttattagtggctagatgggg

SEQ ID NO: 9496229 - DNA, 22 bp, Homo sapiens
ttttattagtggctagatgggg

SEQ ID NO: 9496230 - DNA, 22 bp, Homo sapiens
ttttattagtggctagatgggg

SEQ ID NO: 9496231 - DNA, 22 bp, Homo sapiens
ttttatgttcctgaagctatct

SEQ ID NO: 9496232 - DNA, 22 bp, Homo sapiens
ttttatgttcctgaagctatct

SEQ ID NO: 9496233 - DNA, 22 bp, Homo sapiens
ttttcattgtaaatcaggaaac

SEQ ID NO: 9496234 - DNA, 22 bp, Homo sapiens
ttttcattgtaaatcaggaaac

SEQ ID NO: 9496235 - DNA, 22 bp, Homo sapiens
ttttcattagaatgactgagaa

SEQ ID NO: 9496236 - DNA, 22 bp, Homo sapiens
ttttcattgagcacctgagtaa

SEQ ID NO: 9496237 - DNA, 22 bp, Homo sapiens
ttttcatgttccttgttaagtg

SEQ ID NO: 9496238 - DNA, 22 bp, Homo sapiens
ttttcattgttcctcgagcatt

SEQ ID NO: 9496239 - DNA, 22 bp, Homo sapiens
ttttcattgttactatgagcta

SEQ ID NO: 9496240 - DNA, 22 bp, Homo sapiens
ttttcattgttactatgagcta

SEQ ID NO: 9496241 - DNA, 22 bp, Homo sapiens
ttttcattgttactatgagcta

SEQ ID NO: 9496242 - DNA, 22 bp, Homo sapiens
ttttcattgttcctcgagcatt

SEQ ID NO: 9496243 - DNA, 22 bp, Homo sapiens
ttttcattgttactatgagcta

SEQ ID NO: 9496244 - DNA, 22 bp, Homo sapiens
ttttcattgtaaatcaggaaac

SEQ ID NO: 9496245 - DNA, 22 bp, Homo sapiens
ttttcattgtaaatcaggaaac

SEQ ID NO: 9496246 - DNA, 22 bp, Homo sapiens
ttttcatctctgctttgtacct

SEQ ID NO: 9496247 - DNA, 22 bp, Homo sapiens
ttttcatgtcatgtccttgagg

SEQ ID NO: 9496248 - DNA, 22 bp, Homo sapiens
ttttcatgtgatgtgacatttc

SEQ ID NO: 9496249 - DNA, 22 bp, Homo sapiens
ttttcacacaaggtgataagtt

SEQ ID NO: 9496250 - DNA, 22 bp, Homo sapiens
ttttcacattgtcccagcacta

SEQ ID NO: 9496251 - DNA, 22 bp, Homo sapiens
ttttattggagtgataccaagc

SEQ ID NO: 9496252 - DNA, 22 bp, Homo sapiens
ttttattggagtgataccaagc

SEQ ID NO: 9496253 - DNA, 22 bp, Homo sapiens
ttttcacacaaggtgataagtt

SEQ ID NO: 9496254 - DNA, 22 bp, Homo sapiens
ttttctattaactcattttgca

SEQ ID NO: 9496255 - DNA, 22 bp, Homo sapiens
ttttctattcattgtctatggt

SEQ ID NO: 9496256 - DNA, 22 bp, Homo sapiens
ttttctattcattgtctatggt

SEQ ID NO: 9496257 - DNA, 22 bp, Homo sapiens
ttttccacagcaccataagatt

SEQ ID NO: 9496258 - DNA, 19 bp, Homo sapiens
ttttccacagaaatatgtt

SEQ ID NO: 9496259 - DNA, 22 bp, Homo sapiens
ttttcatttttgtagatgcaag

SEQ ID NO: 9496260 - DNA, 22 bp, Homo sapiens
ttttcatttacattagggaaga

SEQ ID NO: 9496261 - DNA, 22 bp, Homo sapiens
ttttcatttttgtagatgcaag

SEQ ID NO: 9496262 - DNA, 22 bp, Homo sapiens
ttttcatttttgtagatgcaag

SEQ ID NO: 9496263 - DNA, 22 bp, Homo sapiens
ttttcatttttgtagatgcaag

SEQ ID NO: 9496264 - DNA, 22 bp, Homo sapiens
ttttctcttgttaatgtactga

SEQ ID NO: 9496265 - DNA, 22 bp, Homo sapiens
ttttctcttccctctggacctg

SEQ ID NO: 9496266 - DNA, 22 bp, Homo sapiens
ttttctattcattgtctatggt

SEQ ID NO: 9496267 - DNA, 22 bp, Homo sapiens
ttttctcttgttaatgtactga

SEQ ID NO: 9496268 - DNA, 22 bp, Homo sapiens
ttttctcttgttaatgtactga

SEQ ID NO: 9496269 - DNA, 22 bp, Homo sapiens
ttttctcttgttaatgtactga

SEQ ID NO: 9496270 - DNA, 22 bp, Homo sapiens
ttttctcttgttaatgtactga

SEQ ID NO: 9496271 - DNA, 22 bp, Homo sapiens
ttttctgaagtttaagacattt

SEQ ID NO: 9496272 - DNA, 22 bp, Homo sapiens
ttttctgaagtttaagacattt

SEQ ID NO: 9496273 - DNA, 22 bp, Homo sapiens
ttttcttactgtctgtgatcct

SEQ ID NO: 9496274 - DNA, 22 bp, Homo sapiens
ttttctgtttgcttcaagacat

SEQ ID NO: 9496275 - DNA, 22 bp, Homo sapiens
ttttcttactgtctgtgatcct

SEQ ID NO: 9496276 - DNA, 22 bp, Homo sapiens
ttttcttaggtgctccaagtag

SEQ ID NO: 9496277 - DNA, 22 bp, Homo sapiens
ttttcttatagagcttaaagtt

SEQ ID NO: 9496278 - DNA, 22 bp, Homo sapiens
ttttcttatagagcttaaagtt

SEQ ID NO: 9496279 - DNA, 22 bp, Homo sapiens
ttttcttactgtctgtgatcct

SEQ ID NO: 9496280 - DNA, 22 bp, Homo sapiens
ttttcttaggtgctccaagtag

SEQ ID NO: 9496281 - DNA, 22 bp, Homo sapiens
ttttcttatagagcttaaagtt

SEQ ID NO: 9496282 - DNA, 22 bp, Homo sapiens
ttttcttatagagcttaaagtt

SEQ ID NO: 9496283 - DNA, 22 bp, Homo sapiens
ttttcttatggtgaagcacaaa

SEQ ID NO: 9496284 - DNA, 22 bp, Homo sapiens
ttttcttatgtgcagctatatg

SEQ ID NO: 9496285 - DNA, 22 bp, Homo sapiens
ttttcttatggtgaagcacaaa

SEQ ID NO: 9496286 - DNA, 22 bp, Homo sapiens
ttttcttatggtgaagcacaaa

SEQ ID NO: 9496287 - DNA, 22 bp, Homo sapiens
ttttcttatgtgcagctatatg

SEQ ID NO: 9496288 - DNA, 22 bp, Homo sapiens
ttttcttatggtgaagcacaaa

SEQ ID NO: 9496289 - DNA, 20 bp, Homo sapiens
ttttctgtgccaagaaaact

SEQ ID NO: 9496290 - DNA, 22 bp, Homo sapiens
ttttctgttacaaagtacagcg

SEQ ID NO: 9496291 - DNA, 22 bp, Homo sapiens
ttttctggtcacatgttattaa

SEQ ID NO: 9496292 - DNA, 22 bp, Homo sapiens
ttttctggtcacatgttattaa

SEQ ID NO: 9496293 - DNA, 22 bp, Homo sapiens
ttttctgtaagaggactttaat

SEQ ID NO: 9496294 - DNA, 21 bp, Homo sapiens
ttttctggagtatgtctcctc

SEQ ID NO: 9496295 - DNA, 22 bp, Homo sapiens
ttcagttttattgtactgctat

SEQ ID NO: 9496296 - DNA, 22 bp, Homo sapiens
ttcagttttattgtactgctat

SEQ ID NO: 9496297 - DNA, 22 bp, Homo sapiens
ttcagttttattgtactgctat

SEQ ID NO: 9496298 - DNA, 22 bp, Homo sapiens
ttcagttttattgtactgctat

SEQ ID NO: 9496299 - DNA, 22 bp, Homo sapiens
ttcagttttctttagaatgtag

SEQ ID NO: 9496300 - DNA, 22 bp, Homo sapiens
ttcagttttccctcctgcaggt

SEQ ID NO: 9496301 - DNA, 22 bp, Homo sapiens
ttcagtttatacctgttgatta

SEQ ID NO: 9496302 - DNA, 22 bp, Homo sapiens
ttcagtttatacctgttgatta

SEQ ID NO: 9496303 - DNA, 22 bp, Homo sapiens
ttcagtttcaaatcctggatgc

SEQ ID NO: 9496304 - DNA, 22 bp, Homo sapiens
ttcagtttgctacaagcaacat

SEQ ID NO: 9496305 - DNA, 22 bp, Homo sapiens
ttcagtttgtttgactgttaga

SEQ ID NO: 9496306 - DNA, 23 bp, Homo sapiens
ttcataactcaaggtgatataat

SEQ ID NO: 9496307 - DNA, 23 bp, Homo sapiens
ttcataactcaaggtgatataat

SEQ ID NO: 9496308 - DNA, 21 bp, Homo sapiens
ttcataaaccattctcatgca

SEQ ID NO: 9496309 - DNA, 22 bp, Homo sapiens
ttcataaacaactgatggtaat

SEQ ID NO: 9496310 - DNA, 22 bp, Homo sapiens
ttcataaacaactgatggtaat

SEQ ID NO: 9496311 - DNA, 22 bp, Homo sapiens
ttcagttttctttagaatgtag

SEQ ID NO: 9496312 - DNA, 22 bp, Homo sapiens
ttcagttttgcttttaatcatg

SEQ ID NO: 9496313 - DNA, 22 bp, Homo sapiens
ttcagtgtgcttcaggacgtta

SEQ ID NO: 9496314 - DNA, 22 bp, Homo sapiens
ttcagtgtggaatgtgaactgc

SEQ ID NO: 9496315 - DNA, 22 bp, Homo sapiens
ttcagtgtggtgcacagttttg

SEQ ID NO: 9496316 - DNA, 22 bp, Homo sapiens
ttcagtgtggcccatgaagagg

SEQ ID NO: 9496317 - DNA, 22 bp, Homo sapiens
ttcagtgtggcccatgaagagg

SEQ ID NO: 9496318 - DNA, 22 bp, Homo sapiens
ttcagtgttaaattcaaagagt

SEQ ID NO: 9496319 - DNA, 22 bp, Homo sapiens
ttcagtgtgtgatacctgctgt

SEQ ID NO: 9496320 - DNA, 22 bp, Homo sapiens
ttcagtgtggtgcacagttttg

SEQ ID NO: 9496321 - DNA, 22 bp, Homo sapiens
ttcagtgtgtcagtttcagcag

SEQ ID NO: 9496322 - DNA, 22 bp, Homo sapiens
ttcagtgttaatcttgggagaa

SEQ ID NO: 9496323 - DNA, 22 bp, Homo sapiens
ttcagtgttaaattcaaagagt

SEQ ID NO: 9496324 - DNA, 22 bp, Homo sapiens
ttcagtgttaatcttgggagaa

SEQ ID NO: 9496325 - DNA, 22 bp, Homo sapiens
ttcagtgttactcaaggggcag

SEQ ID NO: 9496326 - DNA, 22 bp, Homo sapiens
ttcagtgttcttttctgttagc

SEQ ID NO: 9496327 - DNA, 22 bp, Homo sapiens
ttcagtgttcttttctgttagc

SEQ ID NO: 9496328 - DNA, 22 bp, Homo sapiens
ttcagtgttcttttctgttagc

SEQ ID NO: 9496329 - DNA, 22 bp, Homo sapiens
ttcagttccttgtgcgaattcc

SEQ ID NO: 9496330 - DNA, 22 bp, Homo sapiens
ttcagttctacaagagctttgt

SEQ ID NO: 9496331 - DNA, 22 bp, Homo sapiens
ttcagtgtttgtagagataact

SEQ ID NO: 9496332 - DNA, 22 bp, Homo sapiens
ttcagtgtttgtagagataact

SEQ ID NO: 9496333 - DNA, 22 bp, Homo sapiens
ttcagtgtttgtagagataact

SEQ ID NO: 9496334 - DNA, 22 bp, Homo sapiens
ttcattgtctctgtttgccttc

SEQ ID NO: 9496335 - DNA, 22 bp, Homo sapiens
ttcattgtactttaagagatgc

SEQ ID NO: 9496336 - DNA, 22 bp, Homo sapiens
ttcatttaatcagaatctctaa

SEQ ID NO: 9496337 - DNA, 22 bp, Homo sapiens
ttcatttaatcagaatctctaa

SEQ ID NO: 9496338 - DNA, 22 bp, Homo sapiens
ttcatttaatcagaatctctaa

SEQ ID NO: 9496339 - DNA, 22 bp, Homo sapiens
ttcattgtgaacacattctgcc

SEQ ID NO: 9496340 - DNA, 22 bp, Homo sapiens
ttcattgtgattcttggctagc

SEQ ID NO: 9496341 - DNA, 22 bp, Homo sapiens
ttcataatcaccaaaaactgga

SEQ ID NO: 9496342 - DNA, 22 bp, Homo sapiens
ttcataatcaccaaaaactgga

SEQ ID NO: 9496343 - DNA, 22 bp, Homo sapiens
ttcattgcagttcttcaggtta

SEQ ID NO: 9496344 - DNA, 22 bp, Homo sapiens
ttcattgatttccttggaataa

SEQ ID NO: 9496345 - DNA, 22 bp, Homo sapiens
ttcattgcattccagcctgggt

SEQ ID NO: 9496346 - DNA, 22 bp, Homo sapiens
ttcatttattcagcaggtattt

SEQ ID NO: 9496347 - DNA, 23 bp, Homo sapiens
ttcatttaggagttcataagagc

SEQ ID NO: 9496348 - DNA, 23 bp, Homo sapiens
ttcatttaggagttcataagagc

SEQ ID NO: 9496349 - DNA, 23 bp, Homo sapiens
ttcatttaggagttcataagagc

SEQ ID NO: 9496350 - DNA, 22 bp, Homo sapiens
ttcatttgccatcagtgtaatg

SEQ ID NO: 9496351 - DNA, 22 bp, Homo sapiens
ttcatttgatggtgggagagaa

SEQ ID NO: 9496352 - DNA, 22 bp, Homo sapiens
ttcatttgagtttatagttgct

SEQ ID NO: 9496353 - DNA, 23 bp, Homo sapiens
ttcatttaggagttcataagagc

SEQ ID NO: 9496354 - DNA, 22 bp, Homo sapiens
ttcatttaatttgtgtattaac

SEQ ID NO: 9496355 - DNA, 22 bp, Homo sapiens
ttcatttaatttgtgtattaac

SEQ ID NO: 9496356 - DNA, 22 bp, Homo sapiens
ttcatttaatttgtgtattaac

SEQ ID NO: 9496357 - DNA, 22 bp, Homo sapiens
ttcatttaatttgtgtattaac

SEQ ID NO: 9496358 - DNA, 22 bp, Homo sapiens
ttcatttaatttgtgtattaac

SEQ ID NO: 9496359 - DNA, 22 bp, Homo sapiens
ttcatttaatttgtgtattaac

SEQ ID NO: 9496360 - DNA, 22 bp, Homo sapiens
ttcatttaatcagaatctctaa

SEQ ID NO: 9496361 - DNA, 22 bp, Homo sapiens
ttccaggaacactctgtgtccc

SEQ ID NO: 9496362 - DNA, 22 bp, Homo sapiens
ttccaggaacaaactcacctta

SEQ ID NO: 9496363 - DNA, 22 bp, Homo sapiens
ttcattttctttcacgctgctg

SEQ ID NO: 9496364 - DNA, 22 bp, Homo sapiens
ttcattttctttcacgctgctg

SEQ ID NO: 9496365 - DNA, 20 bp, Homo sapiens
ttcatttgttgagcaccttc

SEQ ID NO: 9496366 - DNA, 22 bp, Homo sapiens
ttcattttataaaccctgctga

SEQ ID NO: 9496367 - DNA, 22 bp, Homo sapiens
ttcatttgttgacagagacatg

SEQ ID NO: 9496368 - DNA, 22 bp, Homo sapiens
ttcatttgtggttatttacaat

SEQ ID NO: 9496369 - DNA, 22 bp, Homo sapiens
ttcatttgtaactctgttaggg

SEQ ID NO: 9496370 - DNA, 19 bp, Homo sapiens
ttcatttgtatctgctcac

SEQ ID NO: 9496371 - DNA, 19 bp, Homo sapiens
ttcatttgtatctgctcac

SEQ ID NO: 9496372 - DNA, 22 bp, Homo sapiens
ttcatttgggatgagtcagaag

SEQ ID NO: 9496373 - DNA, 20 bp, Homo sapiens
ttcatttgggaaaatctgcg

SEQ ID NO: 9496374 - DNA, 22 bp, Homo sapiens
ttcatttgtctgctatagatcc

SEQ ID NO: 9496375 - DNA, 22 bp, Homo sapiens
ttcatttgtggttatttacaat

SEQ ID NO: 9496376 - DNA, 22 bp, Homo sapiens
ttcatttgtggtgaatgaagtg

SEQ ID NO: 9496377 - DNA, 22 bp, Homo sapiens
ttcatttgtccaaatactatgt

SEQ ID NO: 9496378 - DNA, 22 bp, Homo sapiens
ttcatttgtctgctatagatcc

SEQ ID NO: 9496379 - DNA, 22 bp, Homo sapiens
ttcatttgtctgctatagatcc

SEQ ID NO: 9496380 - DNA, 22 bp, Homo sapiens
ttccaggtgttgctgtcttcct

SEQ ID NO: 9496381 - DNA, 18 bp, Homo sapiens
ttccagtagctgtatcac

SEQ ID NO: 9496382 - DNA, 22 bp, Homo sapiens
ttccagtctggcctgtgcttag

SEQ ID NO: 9496383 - DNA, 22 bp, Homo sapiens
ttccagtctagtacctggatgc

SEQ ID NO: 9496384 - DNA, 22 bp, Homo sapiens
ttccagtctagtacctggatgc

SEQ ID NO: 9496385 - DNA, 22 bp, Homo sapiens
ttccagttaaggaagctattct

SEQ ID NO: 9496386 - DNA, 22 bp, Homo sapiens
ttccagttcactccatttctgg

SEQ ID NO: 9496387 - DNA, 22 bp, Homo sapiens
ttccagttcagatgcaacaggg

SEQ ID NO: 9496388 - DNA, 22 bp, Homo sapiens
ttccagttcccatgaggattaa

SEQ ID NO: 9496389 - DNA, 22 bp, Homo sapiens
ttccagtgaccatagagtatgg

SEQ ID NO: 9496390 - DNA, 23 bp, Homo sapiens
ttccagtgagactgagaggtctt

SEQ ID NO: 9496391 - DNA, 22 bp, Homo sapiens
ttccagttaaggaagctattct

SEQ ID NO: 9496392 - DNA, 22 bp, Homo sapiens
ttccaggcattacagggtttgc

SEQ ID NO: 9496393 - DNA, 22 bp, Homo sapiens
ttccaggcattaaagtttctcc

SEQ ID NO: 9496394 - DNA, 22 bp, Homo sapiens
ttccaggcatgtcagacatagg

SEQ ID NO: 9496395 - DNA, 22 bp, Homo sapiens
ttccaggctgatgggccacagg

SEQ ID NO: 9496396 - DNA, 22 bp, Homo sapiens
ttccaggctcccttggaggtgt

SEQ ID NO: 9496397 - DNA, 22 bp, Homo sapiens
ttccagggaagagcaaggcagt

SEQ ID NO: 9496398 - DNA, 22 bp, Homo sapiens
ttccagggaagagcaaggcagt

SEQ ID NO: 9496399 - DNA, 22 bp, Homo sapiens
ttccagggcagcaagtgaatgg

SEQ ID NO: 9496400 - DNA, 19 bp, Homo sapiens
ttccaggtgctgtggggag

SEQ ID NO: 9496401 - DNA, 19 bp, Homo sapiens
ttccaggtgctgtggggag

SEQ ID NO: 9496402 - DNA, 22 bp, Homo sapiens
ttccaggtcgccataggtttga

SEQ ID NO: 9496403 - DNA, 22 bp, Homo sapiens
ttccaggggcagcagtgatggt

SEQ ID NO: 9496404 - DNA, 22 bp, Homo sapiens
ttccaggggcagcagtgatggt

SEQ ID NO: 9496405 - DNA, 22 bp, Homo sapiens
ttccagggttaatttatatggt

SEQ ID NO: 9496406 - DNA, 22 bp, Homo sapiens
ttccagggctaggtaatgggta

SEQ ID NO: 9496407 - DNA, 22 bp, Homo sapiens
ttcagagagtttgtgagtcctt

SEQ ID NO: 9496408 - DNA, 20 bp, Homo sapiens
ttcagagatagggtctttaa

SEQ ID NO: 9496409 - DNA, 20 bp, Homo sapiens
ttcagagatagggtctttaa

SEQ ID NO: 9496410 - DNA, 22 bp, Homo sapiens
ttcagagacatgttctagatca

SEQ ID NO: 9496411 - DNA, 22 bp, Homo sapiens
ttcagagacatgttctagatca

SEQ ID NO: 9496412 - DNA, 22 bp, Homo sapiens
ttcacagggcagcagctgagcc

SEQ ID NO: 9496413 - DNA, 22 bp, Homo sapiens
ttcacaggatatatgtgcaggg

SEQ ID NO: 9496414 - DNA, 22 bp, Homo sapiens
ttcacaggatatatgtgcaggg

SEQ ID NO: 9496415 - DNA, 22 bp, Homo sapiens
ttcagagaaactgaggtttaga

SEQ ID NO: 9496416 - DNA, 22 bp, Homo sapiens
ttcagactagacacatttcaag

SEQ ID NO: 9496417 - DNA, 18 bp, Homo sapiens
ttcagcagcagacacact

SEQ ID NO: 9496418 - DNA, 22 bp, Homo sapiens
ttcagtgtgaagcttctgaaag

SEQ ID NO: 9496419 - DNA, 22 bp, Homo sapiens
ttcagtgtgaagcttctgaaag

SEQ ID NO: 9496420 - DNA, 22 bp, Homo sapiens
ttcagtgtgaagcttctgaaag

SEQ ID NO: 9496421 - DNA, 22 bp, Homo sapiens
ttcagtgtgcctaagtcagttg

SEQ ID NO: 9496422 - DNA, 22 bp, Homo sapiens
ttcagtgtgcctaagtcagttg

SEQ ID NO: 9496423 - DNA, 22 bp, Homo sapiens
ttcagtgtgcttcaggacgtta

SEQ ID NO: 9496424 - DNA, 19 bp, Homo sapiens
ttcagtgtgctggctcctg

SEQ ID NO: 9496425 - DNA, 22 bp, Homo sapiens
ttcagtgtcacaagagcaagcc

SEQ ID NO: 9496426 - DNA, 22 bp, Homo sapiens
ttcagtgtccctagtagaagtt

SEQ ID NO: 9496427 - DNA, 22 bp, Homo sapiens
ttcagtgtccctagtagaagtt

SEQ ID NO: 9496428 - DNA, 22 bp, Homo sapiens
ttcagtgtcacaagagcaagcc

SEQ ID NO: 9496429 - DNA, 22 bp, Homo sapiens
ttcagcacagttcaagatggta

SEQ ID NO: 9496430 - DNA, 22 bp, Homo sapiens
ttcagcaattttttaagctaat

SEQ ID NO: 9496431 - DNA, 22 bp, Homo sapiens
ttcagcactgttatggatttgc

SEQ ID NO: 9496432 - DNA, 22 bp, Homo sapiens
ttcagcactgactgagtggtta

SEQ ID NO: 9496433 - DNA, 21 bp, Homo sapiens
ttcagcaagcactctggacac

SEQ ID NO: 9496434 - DNA, 22 bp, Homo sapiens
ttcagcaatgggatggtgcagg

SEQ ID NO: 9496435 - DNA, 22 bp, Homo sapiens
ttcagcaagaccaccatgtacc

SEQ ID NO: 9496436 - DNA, 22 bp, Homo sapiens
ttcagcaagaccaccatgtacc

SEQ ID NO: 9496437 - DNA, 22 bp, Homo sapiens
ttcagcaaatggactgttcagg

SEQ ID NO: 9496438 - DNA, 22 bp, Homo sapiens
ttcacaataggagcatgcaaat

SEQ ID NO: 9496439 - DNA, 22 bp, Homo sapiens
ttcacaatctggcttagcattg

SEQ ID NO: 9496440 - DNA, 22 bp, Homo sapiens
ttcacaataggagcatgcaaat

SEQ ID NO: 9496441 - DNA, 22 bp, Homo sapiens
ttcacagactttccatagattg

SEQ ID NO: 9496442 - DNA, 22 bp, Homo sapiens
ttcacaattaactttatactta

SEQ ID NO: 9496443 - DNA, 22 bp, Homo sapiens
ttcacagactttccatagattg

SEQ ID NO: 9496444 - DNA, 22 bp, Homo sapiens
ttcacaatggcaaaccattaaa

SEQ ID NO: 9496445 - DNA, 22 bp, Homo sapiens
ttcacaatggcaaaccattaaa

SEQ ID NO: 9496446 - DNA, 23 bp, Homo sapiens
ttcaaagatcttctgaaatctgt

SEQ ID NO: 9496447 - DNA, 23 bp, Homo sapiens
ttcaaagatcttctgaaatctgt

SEQ ID NO: 9496448 - DNA, 22 bp, Homo sapiens
ttcaaagatggagggatagatt

SEQ ID NO: 9496449 - DNA, 22 bp, Homo sapiens
ttcaaagataattaccaaacat

SEQ ID NO: 9496450 - DNA, 22 bp, Homo sapiens
ttcaaagataattaccaaacat

SEQ ID NO: 9496451 - DNA, 22 bp, Homo sapiens
ttcaaagattagcatacgcaat

SEQ ID NO: 9496452 - DNA, 22 bp, Homo sapiens
ttcaaagattagcatacgcaat

SEQ ID NO: 9496453 - DNA, 22 bp, Homo sapiens
ttcaaagattttcccaaagctc

SEQ ID NO: 9496454 - DNA, 22 bp, Homo sapiens
ttcaaagcaagacacaattcct

SEQ ID NO: 9496455 - DNA, 22 bp, Homo sapiens
ttcaaagcagagggtcaataca

SEQ ID NO: 9496456 - DNA, 22 bp, Homo sapiens
ttcaaagcagagggtcaataca

SEQ ID NO: 9496457 - DNA, 22 bp, Homo sapiens
ttcaaagctgcagactcctggg

SEQ ID NO: 9496458 - DNA, 22 bp, Homo sapiens
ttcaaagcaatagaaagagtga

SEQ ID NO: 9496459 - DNA, 22 bp, Homo sapiens
ttcaaagaattttgagacctga

SEQ ID NO: 9496460 - DNA, 20 bp, Homo sapiens
ttcaaagaccctcaggtcca

SEQ ID NO: 9496461 - DNA, 22 bp, Homo sapiens
ttcaaagaccttacttggcaaa

SEQ ID NO: 9496462 - DNA, 22 bp, Homo sapiens
ttcaaagaccttacttggcaaa

SEQ ID NO: 9496463 - DNA, 21 bp, Homo sapiens
ttcaaagacttgatgctgacc

SEQ ID NO: 9496464 - DNA, 21 bp, Homo sapiens
ttcaaagacttgatgctgacc

SEQ ID NO: 9496465 - DNA, 22 bp, Homo sapiens
ttcaaagataatgtagcatttt

SEQ ID NO: 9496466 - DNA, 22 bp, Homo sapiens
ttcaaagagttgggtgtctggg

SEQ ID NO: 9496467 - DNA, 22 bp, Homo sapiens
ttcaaagagaaattgtattttc

SEQ ID NO: 9496468 - DNA, 22 bp, Homo sapiens
ttcaaagagaaattgtattttc

SEQ ID NO: 9496469 - DNA, 21 bp, Homo sapiens
ttcaaagagtgggcattgtca

SEQ ID NO: 9496470 - DNA, 21 bp, Homo sapiens
ttcaaagagtgggcattgtca

SEQ ID NO: 9496471 - DNA, 22 bp, Homo sapiens
ttcaaagataatgtagcatttt

SEQ ID NO: 9496472 - DNA, 22 bp, Homo sapiens
ttcaaagataattaccaaacat

SEQ ID NO: 9496473 - DNA, 22 bp, Homo sapiens
ttcaaagataatgtagcatttt

SEQ ID NO: 9496474 - DNA, 21 bp, Homo sapiens
ttcacagatgggaaaactgag

SEQ ID NO: 9496475 - DNA, 22 bp, Homo sapiens
ttcacagatgcctgatgtgtgg

SEQ ID NO: 9496476 - DNA, 21 bp, Homo sapiens
ttcacagatgggaaaactgag

SEQ ID NO: 9496477 - DNA, 22 bp, Homo sapiens
ttcacagatgagaaaattgagg

SEQ ID NO: 9496478 - DNA, 22 bp, Homo sapiens
ttcacagataacacaggcaaat

SEQ ID NO: 9496479 - DNA, 22 bp, Homo sapiens
ttcacagagttatttttatgct

SEQ ID NO: 9496480 - DNA, 18 bp, Homo sapiens
ttcacagatccacaggaa

SEQ ID NO: 9496481 - DNA, 22 bp, Homo sapiens
ttcacagatgagaaaattgagg

SEQ ID NO: 9496482 - DNA, 22 bp, Homo sapiens
ttcacagatgagaaaattgagg

SEQ ID NO: 9496483 - DNA, 22 bp, Homo sapiens
ttcacagatgagaaaattgagg

SEQ ID NO: 9496484 - DNA, 22 bp, Homo sapiens
ttcacagagttatttttatgct

SEQ ID NO: 9496485 - DNA, 20 bp, Homo sapiens
ttcacagaggactcaggtca

SEQ ID NO: 9496486 - DNA, 22 bp, Homo sapiens
ttcacagagcgggatgctggga

SEQ ID NO: 9496487 - DNA, 22 bp, Homo sapiens
ttcacagagcttgttcatggcc

SEQ ID NO: 9496488 - DNA, 20 bp, Homo sapiens
ttcacagaggactcaggtca

SEQ ID NO: 9496489 - DNA, 22 bp, Homo sapiens
ttcacagagagaactcaaacca

SEQ ID NO: 9496490 - DNA, 22 bp, Homo sapiens
ttcacagagagtatgcagagaa

SEQ ID NO: 9496491 - DNA, 22 bp, Homo sapiens
ttcacagagagtatgcagagaa

SEQ ID NO: 9496492 - DNA, 22 bp, Homo sapiens
ttcacagagcactgccaagtac

SEQ ID NO: 9496493 - DNA, 22 bp, Homo sapiens
ttcacagattgactggattcct

SEQ ID NO: 9496494 - DNA, 22 bp, Homo sapiens
ttcacagatttccctgcacatg

SEQ ID NO: 9496495 - DNA, 22 bp, Homo sapiens
ttcacagcctctgccccaggca

SEQ ID NO: 9496496 - DNA, 23 bp, Homo sapiens
ttcacagattaaatatttcttct

SEQ ID NO: 9496497 - DNA, 22 bp, Homo sapiens
ttcacagatgtattggaactcc

SEQ ID NO: 9496498 - DNA, 22 bp, Homo sapiens
ttcacagatgtattggaactcc

SEQ ID NO: 9496499 - DNA, 22 bp, Homo sapiens
ttcacagatgtattggaactcc

SEQ ID NO: 9496500 - DNA, 21 bp, Homo sapiens
ttcacagatgggaaaactgag

SEQ ID NO: 9496501 - DNA, 22 bp, Homo sapiens
ttcacagatgtattggaactcc

SEQ ID NO: 9496502 - DNA, 22 bp, Homo sapiens
ttattaagtgcctacaataaag

SEQ ID NO: 9496503 - DNA, 22 bp, Homo sapiens
ttattaaaatgcggatttggct

SEQ ID NO: 9496504 - DNA, 22 bp, Homo sapiens
ttattaagtgcgtactgtatgc

SEQ ID NO: 9496505 - DNA, 22 bp, Homo sapiens
ttattaagtgcgtactgtatgc

SEQ ID NO: 9496506 - DNA, 22 bp, Homo sapiens
ttattaataaagtggcatagcc

SEQ ID NO: 9496507 - DNA, 22 bp, Homo sapiens
ttattaataaagtggcatagcc

SEQ ID NO: 9496508 - DNA, 22 bp, Homo sapiens
ttattaataaagtggcatagcc

SEQ ID NO: 9496509 - DNA, 22 bp, Homo sapiens
ttattaatacatgcacctgcat

SEQ ID NO: 9496510 - DNA, 22 bp, Homo sapiens
ttattaatacatgcacctgcat

SEQ ID NO: 9496511 - DNA, 22 bp, Homo sapiens
ttattaataaagtggcatagcc

SEQ ID NO: 9496512 - DNA, 22 bp, Homo sapiens
ttattaatcttatctttggaaa

SEQ ID NO: 9496513 - DNA, 22 bp, Homo sapiens
ttattaatcttatctttggaaa

SEQ ID NO: 9496514 - DNA, 22 bp, Homo sapiens
ttattaatgagtacaagttatt

SEQ ID NO: 9496515 - DNA, 22 bp, Homo sapiens
ttattaatgagtacaagttatt

SEQ ID NO: 9496516 - DNA, 22 bp, Homo sapiens
ttattaatgagtacaagttatt

SEQ ID NO: 9496517 - DNA, 22 bp, Homo sapiens
ttattaatgagtacaagttatt

SEQ ID NO: 9496518 - DNA, 22 bp, Homo sapiens
ttattacaatgcagaaaataga

SEQ ID NO: 9496519 - DNA, 22 bp, Homo sapiens
ttattaatgagtacaagttatt

SEQ ID NO: 9496520 - DNA, 22 bp, Homo sapiens
ttattaaaatgcggatttggct

SEQ ID NO: 9496521 - DNA, 22 bp, Homo sapiens
ttattaaaatgcggatttggct

SEQ ID NO: 9496522 - DNA, 22 bp, Homo sapiens
ttatatgagtatcatatcactt

SEQ ID NO: 9496523 - DNA, 22 bp, Homo sapiens
ttatatatcttgatttgttcca

SEQ ID NO: 9496524 - DNA, 22 bp, Homo sapiens
ttatatatcttgatttgttcca

SEQ ID NO: 9496525 - DNA, 22 bp, Homo sapiens
ttatatatatgtagaggtcacg

SEQ ID NO: 9496526 - DNA, 22 bp, Homo sapiens
ttattacaatgcagaaaataga

SEQ ID NO: 9496527 - DNA, 22 bp, Homo sapiens
ttattacactgaaagaattgcg

SEQ ID NO: 9496528 - DNA, 22 bp, Homo sapiens
ttattactgtattaatccagag

SEQ ID NO: 9496529 - DNA, 22 bp, Homo sapiens
ttattataatgagggataaaaa

SEQ ID NO: 9496530 - DNA, 22 bp, Homo sapiens
ttattcttttctccagaatccc

SEQ ID NO: 9496531 - DNA, 22 bp, Homo sapiens
ttattctttaaacatatatgtt

SEQ ID NO: 9496532 - DNA, 22 bp, Homo sapiens
ttattctttaaacatatatgtt

SEQ ID NO: 9496533 - DNA, 22 bp, Homo sapiens
ttattatgtggatgaaagatgt

SEQ ID NO: 9496534 - DNA, 22 bp, Homo sapiens
ttattatgtggatgaaagatgt

SEQ ID NO: 9496535 - DNA, 22 bp, Homo sapiens
ttattatgtggatgaaagatgt

SEQ ID NO: 9496536 - DNA, 22 bp, Homo sapiens
ttattatgtgctagagaatgta

SEQ ID NO: 9496537 - DNA, 22 bp, Homo sapiens
ttattatgccattacctccctg

SEQ ID NO: 9496538 - DNA, 22 bp, Homo sapiens
ttattatggcagttttctaggt

SEQ ID NO: 9496539 - DNA, 22 bp, Homo sapiens
ttattatggtatttctttgcag

SEQ ID NO: 9496540 - DNA, 22 bp, Homo sapiens
ttattatggtatttctttgcag

SEQ ID NO: 9496541 - DNA, 22 bp, Homo sapiens
ttattatggtatttctttgcag

SEQ ID NO: 9496542 - DNA, 22 bp, Homo sapiens
ttattataatgagggataaaaa

SEQ ID NO: 9496543 - DNA, 22 bp, Homo sapiens
ttattatagattatgcaagatt

SEQ ID NO: 9496544 - DNA, 22 bp, Homo sapiens
ttattatagattatgcaagatt

SEQ ID NO: 9496545 - DNA, 22 bp, Homo sapiens
ttattatagattatgcaagatt

SEQ ID NO: 9496546 - DNA, 22 bp, Homo sapiens
ttattgacttgtttgtcctggt

SEQ ID NO: 9496547 - DNA, 22 bp, Homo sapiens
ttattgagagctgttttatggc

SEQ ID NO: 9496548 - DNA, 22 bp, Homo sapiens
ttattgagaccgtaagtcaggt

SEQ ID NO: 9496549 - DNA, 21 bp, Homo sapiens
ttattgagacatttgtggaaa

SEQ ID NO: 9496550 - DNA, 22 bp, Homo sapiens
ttattcttttctccagaatccc

SEQ ID NO: 9496551 - DNA, 22 bp, Homo sapiens
ttattcttttctccagaatccc

SEQ ID NO: 9496552 - DNA, 22 bp, Homo sapiens
ttattgaaatggaagctataac

SEQ ID NO: 9496553 - DNA, 22 bp, Homo sapiens
ttattgaaggaactgaaataaa

SEQ ID NO: 9496554 - DNA, 22 bp, Homo sapiens
ttattgactcccagcttttcca

SEQ ID NO: 9496555 - DNA, 18 bp, Homo sapiens
ttattggtgctgctgttc

SEQ ID NO: 9496556 - DNA, 22 bp, Homo sapiens
ttattgtagcactttggcagtg

SEQ ID NO: 9496557 - DNA, 22 bp, Homo sapiens
ttattgtaggcctattgtagaa

SEQ ID NO: 9496558 - DNA, 17 bp, Homo sapiens
ttattgtcaaggttcca

SEQ ID NO: 9496559 - DNA, 22 bp, Homo sapiens
ttattgtcctacttattgtctt

SEQ ID NO: 9496560 - DNA, 22 bp, Homo sapiens
ttattgtcttaaatttggtctt

SEQ ID NO: 9496561 - DNA, 22 bp, Homo sapiens
ttattgtaggcctattgtagaa

SEQ ID NO: 9496562 - DNA, 22 bp, Homo sapiens
ttattgagcacatagtatgtgg

SEQ ID NO: 9496563 - DNA, 22 bp, Homo sapiens
ttattgagcacatagtatgtgg

SEQ ID NO: 9496564 - DNA, 21 bp, Homo sapiens
ttattgagacatttgtggaaa

SEQ ID NO: 9496565 - DNA, 22 bp, Homo sapiens
ttattgagcaactctggggctc

SEQ ID NO: 9496566 - DNA, 22 bp, Homo sapiens
ttattgagcacctactatgtgt

SEQ ID NO: 9496567 - DNA, 22 bp, Homo sapiens
ttattgctgctaacattttatg

SEQ ID NO: 9496568 - DNA, 22 bp, Homo sapiens
ttattgagcacctactatgtgt

SEQ ID NO: 9496569 - DNA, 22 bp, Homo sapiens
ttattgagcacctactatgtgt

SEQ ID NO: 9496570 - DNA, 22 bp, Homo sapiens
ttattggaaaagggctgtaatt

SEQ ID NO: 9496571 - DNA, 22 bp, Homo sapiens
ttattggaaaagggctgtaatt

SEQ ID NO: 9496572 - DNA, 22 bp, Homo sapiens
ttattggattcttgccccaggt

SEQ ID NO: 9496573 - DNA, 22 bp, Homo sapiens
ttcaaacagttgcacaacttat

SEQ ID NO: 9496574 - DNA, 22 bp, Homo sapiens
ttcaaacagttgcacaacttat

SEQ ID NO: 9496575 - DNA, 22 bp, Homo sapiens
ttcaaacagtgtagaatatatg

SEQ ID NO: 9496576 - DNA, 22 bp, Homo sapiens
ttcaaacctatctaagaaatag

SEQ ID NO: 9496577 - DNA, 22 bp, Homo sapiens
ttcaaaccttcacttgcagagt

SEQ ID NO: 9496578 - DNA, 22 bp, Homo sapiens
ttcaaacattcaaataaaccgg

SEQ ID NO: 9496579 - DNA, 22 bp, Homo sapiens
ttcaaaccatggcacaggaagg

SEQ ID NO: 9496580 - DNA, 22 bp, Homo sapiens
ttcaaacattcaaataaaccgg

SEQ ID NO: 9496581 - DNA, 22 bp, Homo sapiens
ttcaaacattcaaataaaccgg

SEQ ID NO: 9496582 - DNA, 22 bp, Homo sapiens
ttcaaactcttgctctgctagt

SEQ ID NO: 9496583 - DNA, 22 bp, Homo sapiens
ttcaaactagttaaaagtcaga

SEQ ID NO: 9496584 - DNA, 22 bp, Homo sapiens
ttcaaactatgacttcagctac

SEQ ID NO: 9496585 - DNA, 22 bp, Homo sapiens
ttcaaactatgacttcagctac

SEQ ID NO: 9496586 - DNA, 22 bp, Homo sapiens
ttcaaactatgacttcagctac

SEQ ID NO: 9496587 - DNA, 22 bp, Homo sapiens
ttcaaacactgttggcactggg

SEQ ID NO: 9496588 - DNA, 22 bp, Homo sapiens
ttcaaacagatgactctgctct

SEQ ID NO: 9496589 - DNA, 22 bp, Homo sapiens
ttcaaacagatgactctgctct

SEQ ID NO: 9496590 - DNA, 22 bp, Homo sapiens
ttcaaacacagacagcagcatg

SEQ ID NO: 9496591 - DNA, 22 bp, Homo sapiens
ttcaaacactggcttagccaat

SEQ ID NO: 9496592 - DNA, 22 bp, Homo sapiens
ttattgtgtacttcctctgtgc

SEQ ID NO: 9496593 - DNA, 18 bp, Homo sapiens
ttattgtggtcacagcac

SEQ ID NO: 9496594 - DNA, 22 bp, Homo sapiens
ttattgtcttaaatttggtctt

SEQ ID NO: 9496595 - DNA, 22 bp, Homo sapiens
ttattgtggactactgttctgg

SEQ ID NO: 9496596 - DNA, 22 bp, Homo sapiens
ttattgtggactactgttctgg

SEQ ID NO: 9496597 - DNA, 22 bp, Homo sapiens
ttagccttagaagcttagcaaa

SEQ ID NO: 9496598 - DNA, 22 bp, Homo sapiens
ttagctcagaaaatttaaactt

SEQ ID NO: 9496599 - DNA, 22 bp, Homo sapiens
ttagctcagaaaatttaaactt

SEQ ID NO: 9496600 - DNA, 22 bp, Homo sapiens
ttagctgtggaagcttcagcca

SEQ ID NO: 9496601 - DNA, 22 bp, Homo sapiens
ttagctgtggaagcttcagcca

SEQ ID NO: 9496602 - DNA, 22 bp, Homo sapiens
ttagctgctgattaaatatgtt

SEQ ID NO: 9496603 - DNA, 22 bp, Homo sapiens
ttagctgactgtgtgatttggc

SEQ ID NO: 9496604 - DNA, 22 bp, Homo sapiens
ttagctgaaaaaattcatgcaa

SEQ ID NO: 9496605 - DNA, 22 bp, Homo sapiens
ttagctgagattaagtgaactt

SEQ ID NO: 9496606 - DNA, 22 bp, Homo sapiens
ttagctttcagcctttctcacc

SEQ ID NO: 9496607 - DNA, 22 bp, Homo sapiens
ttagctttagagccattactgg

SEQ ID NO: 9496608 - DNA, 22 bp, Homo sapiens
ttagctttcagcctttctcacc

SEQ ID NO: 9496609 - DNA, 22 bp, Homo sapiens
ttagcttcctacaactgctgca

SEQ ID NO: 9496610 - DNA, 22 bp, Homo sapiens
ttagccagtgaaatggagaaat

SEQ ID NO: 9496611 - DNA, 22 bp, Homo sapiens
ttagccataattgtttttccca

SEQ ID NO: 9496612 - DNA, 22 bp, Homo sapiens
ttagccatgttgaagatttaga

SEQ ID NO: 9496613 - DNA, 21 bp, Homo sapiens
tcctgctgctcctgtcgtgtt

SEQ ID NO: 9496614 - DNA, 22 bp, Homo sapiens
tcctgctggaaacttcctcttg

SEQ ID NO: 9496615 - DNA, 22 bp, Homo sapiens
tcctgctgctcttgggaaacct

SEQ ID NO: 9496616 - DNA, 22 bp, Homo sapiens
tcctgctggaagtagggaatga

SEQ ID NO: 9496617 - DNA, 22 bp, Homo sapiens
tcctgctggaagtagggaatga

SEQ ID NO: 9496618 - DNA, 22 bp, Homo sapiens
tcctgctggactctgagtacaa

SEQ ID NO: 9496619 - DNA, 22 bp, Homo sapiens
ttagccaggggagcagcttgtc

SEQ ID NO: 9496620 - DNA, 22 bp, Homo sapiens
tcctgctggaatggaaaatgaa

SEQ ID NO: 9496621 - DNA, 19 bp, Homo sapiens
tcctgcctggggccgcctg

SEQ ID NO: 9496622 - DNA, 19 bp, Homo sapiens
tcctgcctggggccgcctg

SEQ ID NO: 9496623 - DNA, 18 bp, Homo sapiens
tcctgcctgtgccccagg

SEQ ID NO: 9496624 - DNA, 18 bp, Homo sapiens
tcctgcctgtgccccagg

SEQ ID NO: 9496625 - DNA, 22 bp, Homo sapiens
tcctgcctgtttacctgtactt

SEQ ID NO: 9496626 - DNA, 18 bp, Homo sapiens
tcctgcctgcgggctccc

SEQ ID NO: 9496627 - DNA, 18 bp, Homo sapiens
tcctgcctgcgggctccc

SEQ ID NO: 9496628 - DNA, 19 bp, Homo sapiens
tcctgcctggggccgcctg

SEQ ID NO: 9496629 - DNA, 22 bp, Homo sapiens
tcctgcctgcaatcccagcact

SEQ ID NO: 9496630 - DNA, 18 bp, Homo sapiens
tcctgcctgcgggctccc

SEQ ID NO: 9496631 - DNA, 23 bp, Homo sapiens
tcctgctgaaagctccagctggc

SEQ ID NO: 9496632 - DNA, 20 bp, Homo sapiens
tcctgctgaccttcacaagc

SEQ ID NO: 9496633 - DNA, 20 bp, Homo sapiens
tcctgctgaccttcacaagc

SEQ ID NO: 9496634 - DNA, 21 bp, Homo sapiens
tcctgctgagaaacagatggt

SEQ ID NO: 9496635 - DNA, 22 bp, Homo sapiens
tcctgctgaccagtaaatgaat

SEQ ID NO: 9496636 - DNA, 22 bp, Homo sapiens
tcctgctgacaaggaaagcatg

SEQ ID NO: 9496637 - DNA, 22 bp, Homo sapiens
tcctgctgacaaggaaagcatg

SEQ ID NO: 9496638 - DNA, 22 bp, Homo sapiens
tcctgctgccatttcaagtgct

SEQ ID NO: 9496639 - DNA, 22 bp, Homo sapiens
tcctgctgctacctggcccacg

SEQ ID NO: 9496640 - DNA, 22 bp, Homo sapiens
tcctgctgctcacctttttgtc

SEQ ID NO: 9496641 - DNA, 22 bp, Homo sapiens
tcctgctgctcacctttttgtc

SEQ ID NO: 9496642 - DNA, 20 bp, Homo sapiens
tcctgctgccacctcttctt

SEQ ID NO: 9496643 - DNA, 22 bp, Homo sapiens
tcctgctgagcgtctgtcattt

SEQ ID NO: 9496644 - DNA, 22 bp, Homo sapiens
tcctgctgagcatgttctgccc

SEQ ID NO: 9496645 - DNA, 22 bp, Homo sapiens
tcctgctgagcatgttctgccc

SEQ ID NO: 9496646 - DNA, 22 bp, Homo sapiens
ttagctttcatgaacctggtcg

SEQ ID NO: 9496647 - DNA, 22 bp, Homo sapiens
ttagctttcatgaacctggtcg

SEQ ID NO: 9496648 - DNA, 22 bp, Homo sapiens
ttagctttctttggcagacgtg

SEQ ID NO: 9496649 - DNA, 22 bp, Homo sapiens
ttagctttggattgcatttagt

SEQ ID NO: 9496650 - DNA, 22 bp, Homo sapiens
ttagctttggattgcatttagt

SEQ ID NO: 9496651 - DNA, 22 bp, Homo sapiens
ttagcttttaagtgtgctacat

SEQ ID NO: 9496652 - DNA, 22 bp, Homo sapiens
ttagcttttaagtgtgctacat

SEQ ID NO: 9496653 - DNA, 22 bp, Homo sapiens
ttagcttttcacttgcattatc

SEQ ID NO: 9496654 - DNA, 22 bp, Homo sapiens
ttagcttttctctatgttggct

SEQ ID NO: 9496655 - DNA, 22 bp, Homo sapiens
ttagcttttcacttgcattatc

SEQ ID NO: 9496656 - DNA, 22 bp, Homo sapiens
ttagcttttgagaatgatttct

SEQ ID NO: 9496657 - DNA, 22 bp, Homo sapiens
ttaggaaaagaagacatttcta

SEQ ID NO: 9496658 - DNA, 22 bp, Homo sapiens
ttaggaaaagaagacatttcta

SEQ ID NO: 9496659 - DNA, 19 bp, Homo sapiens
ttaggaaaccactttcctt

SEQ ID NO: 9496660 - DNA, 19 bp, Homo sapiens
ttaggaaaccactttcctt

SEQ ID NO: 9496661 - DNA, 22 bp, Homo sapiens
ttatacagtttatacttagaat

SEQ ID NO: 9496662 - DNA, 22 bp, Homo sapiens
ttatacatgtgttttgagatga

SEQ ID NO: 9496663 - DNA, 21 bp, Homo sapiens
ttatacatatgttctctgcct

SEQ ID NO: 9496664 - DNA, 22 bp, Homo sapiens
ttatacatgtgttttgagatga

SEQ ID NO: 9496665 - DNA, 22 bp, Homo sapiens
ttatacatgtgttttgagatga

SEQ ID NO: 9496666 - DNA, 22 bp, Homo sapiens
ttatacatgtgttttgagatga

SEQ ID NO: 9496667 - DNA, 22 bp, Homo sapiens
ttatacatgtttataaggttga

SEQ ID NO: 9496668 - DNA, 22 bp, Homo sapiens
ttaggaaaggaacattgaaacg

SEQ ID NO: 9496669 - DNA, 22 bp, Homo sapiens
ttaggaaagtctcttggctggg

SEQ ID NO: 9496670 - DNA, 22 bp, Homo sapiens
ttaggaaacgctgctattgact

SEQ ID NO: 9496671 - DNA, 22 bp, Homo sapiens
ttaggaaaggaacattgaaacg

SEQ ID NO: 9496672 - DNA, 22 bp, Homo sapiens
ttatataactcaggtgggctca

SEQ ID NO: 9496673 - DNA, 22 bp, Homo sapiens
ttatataaagataacttttctt

SEQ ID NO: 9496674 - DNA, 22 bp, Homo sapiens
ttatataaagataacttttctt

SEQ ID NO: 9496675 - DNA, 22 bp, Homo sapiens
ttatataaagataacttttctt

SEQ ID NO: 9496676 - DNA, 22 bp, Homo sapiens
ttatagttagtaggtcattaaa

SEQ ID NO: 9496677 - DNA, 22 bp, Homo sapiens
ttatagtattaggtactcaaca

SEQ ID NO: 9496678 - DNA, 22 bp, Homo sapiens
ttatagtattaggtactcaaca

SEQ ID NO: 9496679 - DNA, 22 bp, Homo sapiens
ttatagtatgtgcatatgtgtg

SEQ ID NO: 9496680 - DNA, 22 bp, Homo sapiens
ttatagcagcatgatttatagt

SEQ ID NO: 9496681 - DNA, 22 bp, Homo sapiens
ttatagaatggtggattttctg

SEQ ID NO: 9496682 - DNA, 22 bp, Homo sapiens
ttatagaatggtggattttctg

SEQ ID NO: 9496683 - DNA, 22 bp, Homo sapiens
ttatagatctaaatgtgaaggg

SEQ ID NO: 9496684 - DNA, 22 bp, Homo sapiens
ttatagatgccttgagtaaatg

SEQ ID NO: 9496685 - DNA, 22 bp, Homo sapiens
ttatagatgccttgagtaaatg

SEQ ID NO: 9496686 - DNA, 22 bp, Homo sapiens
ttatagcagcatgatttacaat

SEQ ID NO: 9496687 - DNA, 22 bp, Homo sapiens
ttatagcagcatgatttataat

SEQ ID NO: 9496688 - DNA, 22 bp, Homo sapiens
ttatactttatactacatcatt

SEQ ID NO: 9496689 - DNA, 22 bp, Homo sapiens
ttatactaaaacgcattgaatt

SEQ ID NO: 9496690 - DNA, 22 bp, Homo sapiens
ttatactttatactacatcatt

SEQ ID NO: 9496691 - DNA, 22 bp, Homo sapiens
ttatagaacggttctgtgcaaa

SEQ ID NO: 9496692 - DNA, 22 bp, Homo sapiens
ttatagaacagcctcctctaga

SEQ ID NO: 9496693 - DNA, 22 bp, Homo sapiens
ttatagaacggttctgtgcaaa

SEQ ID NO: 9496694 - DNA, 22 bp, Homo sapiens
ttatagaaggagcattcactta

SEQ ID NO: 9496695 - DNA, 22 bp, Homo sapiens
ttctggagatagtcaggcatta

SEQ ID NO: 9496696 - DNA, 22 bp, Homo sapiens
ttctggagatagtcaggcatta

SEQ ID NO: 9496697 - DNA, 22 bp, Homo sapiens
ttctggagaggaacagaaaggt

SEQ ID NO: 9496698 - DNA, 22 bp, Homo sapiens
ttctggagaggaacagaaaggt

SEQ ID NO: 9496699 - DNA, 22 bp, Homo sapiens
ttctggagaggaacagaaaggt

SEQ ID NO: 9496700 - DNA, 22 bp, Homo sapiens
ttctggagaggaacagaaaggt

SEQ ID NO: 9496701 - DNA, 22 bp, Homo sapiens
ttctggagattgagaaggcatt

SEQ ID NO: 9496702 - DNA, 22 bp, Homo sapiens
ttctggagatgacttttagaaa

SEQ ID NO: 9496703 - DNA, 22 bp, Homo sapiens
ttctggagatctgcctatggga

SEQ ID NO: 9496704 - DNA, 22 bp, Homo sapiens
ttctggagattgagaaggcatt

SEQ ID NO: 9496705 - DNA, 22 bp, Homo sapiens
ttctggagattgagaaggcatt

SEQ ID NO: 9496706 - DNA, 22 bp, Homo sapiens
ttctggagctaaagtccactct

SEQ ID NO: 9496707 - DNA, 22 bp, Homo sapiens
ttctggagctctcgaccccact

SEQ ID NO: 9496708 - DNA, 22 bp, Homo sapiens
ttctggttttactgaggaaatc

SEQ ID NO: 9496709 - DNA, 22 bp, Homo sapiens
ttctggtttaagaaagtgctgg

SEQ ID NO: 9496710 - DNA, 22 bp, Homo sapiens
ttctgtaaacatcaagtgcctg

SEQ ID NO: 9496711 - DNA, 22 bp, Homo sapiens
ttctgtaagctaccaagtttgt

SEQ ID NO: 9496712 - DNA, 19 bp, Homo sapiens
ttctgtaaggacattaatc

SEQ ID NO: 9496713 - DNA, 22 bp, Homo sapiens
ttctgtaagctaccaagtttgt

SEQ ID NO: 9496714 - DNA, 22 bp, Homo sapiens
ttctggagctaaagtccactct

SEQ ID NO: 9496715 - DNA, 22 bp, Homo sapiens
ttctggagctaaagtccactct

SEQ ID NO: 9496716 - DNA, 22 bp, Homo sapiens
ttctggagccgggcctgggcag

SEQ ID NO: 9496717 - DNA, 22 bp, Homo sapiens
ttctggagccgggcctgggcag

SEQ ID NO: 9496718 - DNA, 22 bp, Homo sapiens
ttctggagccccaagatctgta

SEQ ID NO: 9496719 - DNA, 22 bp, Homo sapiens
ttctggagccccaagatctgta

SEQ ID NO: 9496720 - DNA, 22 bp, Homo sapiens
ttctggagacccagcaacaggg

SEQ ID NO: 9496721 - DNA, 22 bp, Homo sapiens
ttctggagacccagcaacaggg

SEQ ID NO: 9496722 - DNA, 22 bp, Homo sapiens
ttctggagagaagaccagtgtg

SEQ ID NO: 9496723 - DNA, 22 bp, Homo sapiens
ttctggagagaaaccttacaaa

SEQ ID NO: 9496724 - DNA, 22 bp, Homo sapiens
ttctggagacccagcaacaggg

SEQ ID NO: 9496725 - DNA, 22 bp, Homo sapiens
ttctggagaataatcagcattg

SEQ ID NO: 9496726 - DNA, 22 bp, Homo sapiens
ttctggagaataatcagcattg

SEQ ID NO: 9496727 - DNA, 22 bp, Homo sapiens
ttctggagaatcaccaccaggc

SEQ ID NO: 9496728 - DNA, 23 bp, Homo sapiens
ttctggagaaaggaccatagctt

SEQ ID NO: 9496729 - DNA, 23 bp, Homo sapiens
ttctggagaaaggaccatagctt

SEQ ID NO: 9496730 - DNA, 22 bp, Homo sapiens
ttctggacttgccttgctgatg

SEQ ID NO: 9496731 - DNA, 22 bp, Homo sapiens
ttctggagaaaattctgtcatt

SEQ ID NO: 9496732 - DNA, 22 bp, Homo sapiens
ttctggagaaaattctgtcatt

SEQ ID NO: 9496733 - DNA, 19 bp, Homo sapiens
ttctggacagcagaaacca

SEQ ID NO: 9496734 - DNA, 19 bp, Homo sapiens
ttctggacagcagaaacca

SEQ ID NO: 9496735 - DNA, 22 bp, Homo sapiens
ttctggaattcttgcagccact

SEQ ID NO: 9496736 - DNA, 22 bp, Homo sapiens
ttctggaattcttgcagccact

SEQ ID NO: 9496737 - DNA, 22 bp, Homo sapiens
ttctggaattcttgcagccact

SEQ ID NO: 9496738 - DNA, 22 bp, Homo sapiens
ttctggaatcctcaaaacatga

SEQ ID NO: 9496739 - DNA, 22 bp, Homo sapiens
ttctggaatatttgacacaatt

SEQ ID NO: 9496740 - DNA, 22 bp, Homo sapiens
ttctggaagtgttagaatctgg

SEQ ID NO: 9496741 - DNA, 22 bp, Homo sapiens
ttctggaagtgttagaatctgg

SEQ ID NO: 9496742 - DNA, 22 bp, Homo sapiens
ttctggaagtggaatttttgta

SEQ ID NO: 9496743 - DNA, 22 bp, Homo sapiens
ttctggaagttggaaatagcag

SEQ ID NO: 9496744 - DNA, 22 bp, Homo sapiens
ttctggaagttggaaatagcag

SEQ ID NO: 9496745 - DNA, 22 bp, Homo sapiens
ttctggaagtgttagaatctgg

SEQ ID NO: 9496746 - DNA, 22 bp, Homo sapiens
ttctggaatactaagttccttt

SEQ ID NO: 9496747 - DNA, 22 bp, Homo sapiens
ttctggaatactaagttccttt

SEQ ID NO: 9496748 - DNA, 22 bp, Homo sapiens
ttctggaatactaagttccttt

SEQ ID NO: 9496749 - DNA, 22 bp, Homo sapiens
ttctggaatatttgacacaatt

SEQ ID NO: 9496750 - DNA, 22 bp, Homo sapiens
ttctggaatatttgacacaatt

SEQ ID NO: 9496751 - DNA, 22 bp, Homo sapiens
ttctggaaatgggtatagagca

SEQ ID NO: 9496752 - DNA, 22 bp, Homo sapiens
ttctggaaatgggtatagagca

SEQ ID NO: 9496753 - DNA, 22 bp, Homo sapiens
ttctggaaatgcacaactaatt

SEQ ID NO: 9496754 - DNA, 22 bp, Homo sapiens
ttctggaaatgttgctgaggcc

SEQ ID NO: 9496755 - DNA, 22 bp, Homo sapiens
ttctggaaatgttgctgaggcc

SEQ ID NO: 9496756 - DNA, 22 bp, Homo sapiens
ttctggaacatagcaagaagtt

SEQ ID NO: 9496757 - DNA, 22 bp, Homo sapiens
ttctggaaatgaatgctaggaa

SEQ ID NO: 9496758 - DNA, 22 bp, Homo sapiens
ttctggaaatgcacaactaatt

SEQ ID NO: 9496759 - DNA, 21 bp, Homo sapiens
ttctctggtcaagcacacata

SEQ ID NO: 9496760 - DNA, 21 bp, Homo sapiens
ttctctggtcaagcacacata

SEQ ID NO: 9496761 - DNA, 22 bp, Homo sapiens
ttctctgggaacataaatgaag

SEQ ID NO: 9496762 - DNA, 22 bp, Homo sapiens
ttctctgggacaggaacagttt

SEQ ID NO: 9496763 - DNA, 22 bp, Homo sapiens
ttctctggacagtgaagagagg

SEQ ID NO: 9496764 - DNA, 22 bp, Homo sapiens
ttctctggacagtgaagagagg

SEQ ID NO: 9496765 - DNA, 22 bp, Homo sapiens
ttctctggacagtgaagagagg

SEQ ID NO: 9496766 - DNA, 22 bp, Homo sapiens
ttctctgggatctggcaaaagg

SEQ ID NO: 9496767 - DNA, 22 bp, Homo sapiens
ttctctgggacaggaacagttt

SEQ ID NO: 9496768 - DNA, 22 bp, Homo sapiens
ttctctgggatctggcaaaagg

SEQ ID NO: 9496769 - DNA, 22 bp, Homo sapiens
ttctctgggcttttcggatccg

SEQ ID NO: 9496770 - DNA, 22 bp, Homo sapiens
ttctctggggactgtctctatt

SEQ ID NO: 9496771 - DNA, 22 bp, Homo sapiens
ttctctgggcttttcggatccg

SEQ ID NO: 9496772 - DNA, 16 bp, Homo sapiens
ttctctggggttgtgc

SEQ ID NO: 9496773 - DNA, 22 bp, Homo sapiens
ttctctggtaaacacatgcgta

SEQ ID NO: 9496774 - DNA, 22 bp, Homo sapiens
ttctctgggttaggggaactat

SEQ ID NO: 9496775 - DNA, 22 bp, Homo sapiens
ttctctgggttaggggaactat

SEQ ID NO: 9496776 - DNA, 22 bp, Homo sapiens
ttctctgggttaggggaactat

SEQ ID NO: 9496777 - DNA, 22 bp, Homo sapiens
ttctctggggactgtctctatt

SEQ ID NO: 9496778 - DNA, 22 bp, Homo sapiens
ttctctggggacttggttggag

SEQ ID NO: 9496779 - DNA, 22 bp, Homo sapiens
ttctctggggttcagtatctct

SEQ ID NO: 9496780 - DNA, 22 bp, Homo sapiens
ttctctggggttcagtatctct

SEQ ID NO: 9496781 - DNA, 22 bp, Homo sapiens
ttctctggggttcagtatctct

SEQ ID NO: 9496782 - DNA, 22 bp, Homo sapiens
ttctgtgcgtaggcgatgcagt

SEQ ID NO: 9496783 - DNA, 22 bp, Homo sapiens
ttctgtgattagttgtctggct

SEQ ID NO: 9496784 - DNA, 22 bp, Homo sapiens
ttctgtgaatggccatgacaag

SEQ ID NO: 9496785 - DNA, 22 bp, Homo sapiens
ttctgtgaaactaaagagagga

SEQ ID NO: 9496786 - DNA, 22 bp, Homo sapiens
ttctgtggtctcccatgtctgt

SEQ ID NO: 9496787 - DNA, 22 bp, Homo sapiens
ttctgtgtgccagagttgtgct

SEQ ID NO: 9496788 - DNA, 22 bp, Homo sapiens
ttctgtggttgaaaggagagat

SEQ ID NO: 9496789 - DNA, 22 bp, Homo sapiens
ttctgtgtcttcttgttctgtg

SEQ ID NO: 9496790 - DNA, 22 bp, Homo sapiens
ttctgtcttcccactgaggagc

SEQ ID NO: 9496791 - DNA, 22 bp, Homo sapiens
ttctgtctgtaaacttctcaat

SEQ ID NO: 9496792 - DNA, 22 bp, Homo sapiens
ttctgtctggaaaaggacatag

SEQ ID NO: 9496793 - DNA, 22 bp, Homo sapiens
ttctgtcttcccactgaggagc

SEQ ID NO: 9496794 - DNA, 22 bp, Homo sapiens
ttctgtcttcccactgaggagc

SEQ ID NO: 9496795 - DNA, 22 bp, Homo sapiens
ttctgtcttcccactgaggagc

SEQ ID NO: 9496796 - DNA, 22 bp, Homo sapiens
ttctgtctgtaaacttctcaat

SEQ ID NO: 9496797 - DNA, 22 bp, Homo sapiens
ttctgtctctgtgtttacatta

SEQ ID NO: 9496798 - DNA, 22 bp, Homo sapiens
ttctgtctggaaaaggacatag

SEQ ID NO: 9496799 - DNA, 22 bp, Homo sapiens
ttctgtctggaaaaggacatag

SEQ ID NO: 9496800 - DNA, 22 bp, Homo sapiens
ttctgtctctgtgtttacatta

SEQ ID NO: 9496801 - DNA, 22 bp, Homo sapiens
ttctgtctgatggtgccagaac

SEQ ID NO: 9496802 - DNA, 22 bp, Homo sapiens
ttctgtgtgcttactggtgttc

SEQ ID NO: 9496803 - DNA, 22 bp, Homo sapiens
ttctgtgtgggtagctcctgtt

SEQ ID NO: 9496804 - DNA, 19 bp, Homo sapiens
ttctgtgttaattccttta

SEQ ID NO: 9496805 - DNA, 19 bp, Homo sapiens
ttctgtgttaattccttta

SEQ ID NO: 9496806 - DNA, 22 bp, Homo sapiens
ttctgtgtgtctcagcaagctg

SEQ ID NO: 9496807 - DNA, 22 bp, Homo sapiens
ttcttacattactttacatgtg

SEQ ID NO: 9496808 - DNA, 22 bp, Homo sapiens
ttcttacattactttacatgtg

SEQ ID NO: 9496809 - DNA, 22 bp, Homo sapiens
ttcttactagtatgtttcagca

SEQ ID NO: 9496810 - DNA, 22 bp, Homo sapiens
ttcttacattagtctgtgcttt

SEQ ID NO: 9496811 - DNA, 22 bp, Homo sapiens
ttcttacattagtctgtgcttt

SEQ ID NO: 9496812 - DNA, 22 bp, Homo sapiens
ttcttacattagtctgtgcttt

SEQ ID NO: 9496813 - DNA, 22 bp, Homo sapiens
ttctgtgttctgtgcaatgagc

SEQ ID NO: 9496814 - DNA, 22 bp, Homo sapiens
ttctgtgttgtgacattctaga

SEQ ID NO: 9496815 - DNA, 22 bp, Homo sapiens
ttctgttacaagtgaaaaaatg

SEQ ID NO: 9496816 - DNA, 22 bp, Homo sapiens
ttcttaggagcattagtaattt

SEQ ID NO: 9496817 - DNA, 19 bp, Homo sapiens
ttcttagtctcatgcatga

SEQ ID NO: 9496818 - DNA, 20 bp, Homo sapiens
ttcttagtagagcatgtatt

SEQ ID NO: 9496819 - DNA, 22 bp, Homo sapiens
ttcttagtggtagtcatctttg

SEQ ID NO: 9496820 - DNA, 22 bp, Homo sapiens
ttcttactatgatttgagcctc

SEQ ID NO: 9496821 - DNA, 22 bp, Homo sapiens
ttcttataagttaatatttcca

SEQ ID NO: 9496822 - DNA, 22 bp, Homo sapiens
ttcttataagttaatatttcca

SEQ ID NO: 9496823 - DNA, 22 bp, Homo sapiens
ttcttagttcaactaaaattta

SEQ ID NO: 9496824 - DNA, 22 bp, Homo sapiens
ttcttagttcaactaaaattta

SEQ ID NO: 9496825 - DNA, 22 bp, Homo sapiens
ttcttatagaagcaaccattgt

SEQ ID NO: 9496826 - DNA, 22 bp, Homo sapiens
ttcttatgttcacataattcca

SEQ ID NO: 9496827 - DNA, 22 bp, Homo sapiens
ttcttatgttcacataattcca

SEQ ID NO: 9496828 - DNA, 22 bp, Homo sapiens
ttgaacattaacttcagtctat

SEQ ID NO: 9496829 - DNA, 22 bp, Homo sapiens
ttgaacattaacttcagtctat

SEQ ID NO: 9496830 - DNA, 22 bp, Homo sapiens
ttgaacattaacttcagtctat

SEQ ID NO: 9496831 - DNA, 22 bp, Homo sapiens
ttgaacaatttggtatacaaac

SEQ ID NO: 9496832 - DNA, 22 bp, Homo sapiens
ttgaacaatttggtatacaaac

SEQ ID NO: 9496833 - DNA, 22 bp, Homo sapiens
ttgaaattttaggccttgcaat

SEQ ID NO: 9496834 - DNA, 19 bp, Homo sapiens
ttgaaattgtttgatatgg

SEQ ID NO: 9496835 - DNA, 22 bp, Homo sapiens
ttgaaatggcagcagctgacct

SEQ ID NO: 9496836 - DNA, 22 bp, Homo sapiens
ttgaagaaagtcatatataatg

SEQ ID NO: 9496837 - DNA, 22 bp, Homo sapiens
ttgaagaaagtcatatataatg

SEQ ID NO: 9496838 - DNA, 22 bp, Homo sapiens
ttgaagaaagtcatatataatg

SEQ ID NO: 9496839 - DNA, 22 bp, Homo sapiens
ttgaagaaagtcatatataatg

SEQ ID NO: 9496840 - DNA, 22 bp, Homo sapiens
ttgaattatttgtttgcaagct

SEQ ID NO: 9496841 - DNA, 22 bp, Homo sapiens
ttgaatttagattgtatgttga

SEQ ID NO: 9496842 - DNA, 22 bp, Homo sapiens
ttgaatttagattgtatgttga

SEQ ID NO: 9496843 - DNA, 22 bp, Homo sapiens
ttgaatttagattgtatgttga

SEQ ID NO: 9496844 - DNA, 23 bp, Homo sapiens
ttgaatttctcttgcaatattta

SEQ ID NO: 9496845 - DNA, 23 bp, Homo sapiens
ttgaatttctcttgcaatattta

SEQ ID NO: 9496846 - DNA, 22 bp, Homo sapiens
ttgaacattttctatgttatag

SEQ ID NO: 9496847 - DNA, 17 bp, Homo sapiens
ttgaacctagacacctt

SEQ ID NO: 9496848 - DNA, 22 bp, Homo sapiens
ttgaacattggcaatttcatat

SEQ ID NO: 9496849 - DNA, 22 bp, Homo sapiens
ttgaactctggacccatgccag

SEQ ID NO: 9496850 - DNA, 22 bp, Homo sapiens
ttgaaatcttccacagcccaag

SEQ ID NO: 9496851 - DNA, 22 bp, Homo sapiens
ttctttttaaagtgtgtatgca

SEQ ID NO: 9496852 - DNA, 22 bp, Homo sapiens
ttctttttaaagtgtgtatgca

SEQ ID NO: 9496853 - DNA, 22 bp, Homo sapiens
ttctttttaaagtgtgtatgca

SEQ ID NO: 9496854 - DNA, 22 bp, Homo sapiens
ttcttttggactcaaagagaac

SEQ ID NO: 9496855 - DNA, 22 bp, Homo sapiens
ttcttttggactcaaagagaac

SEQ ID NO: 9496856 - DNA, 22 bp, Homo sapiens
ttcttttcttggcaggagtaga

SEQ ID NO: 9496857 - DNA, 22 bp, Homo sapiens
ttcttttctttaggcattgtgt

SEQ ID NO: 9496858 - DNA, 22 bp, Homo sapiens
ttcttattgggagaccttttct

SEQ ID NO: 9496859 - DNA, 22 bp, Homo sapiens
ttcttattcttgaaatgtggga

SEQ ID NO: 9496860 - DNA, 23 bp, Homo sapiens
ttcttatttactttggaatctcc

SEQ ID NO: 9496861 - DNA, 22 bp, Homo sapiens
ttcttattatgtgctctgtgaa

SEQ ID NO: 9496862 - DNA, 22 bp, Homo sapiens
ttcttattatgtgctctgtgaa

SEQ ID NO: 9496863 - DNA, 22 bp, Homo sapiens
ttcttattatgtgctctgtgaa

SEQ ID NO: 9496864 - DNA, 22 bp, Homo sapiens
ttcttattcttgaaatgtggga

SEQ ID NO: 9496865 - DNA, 22 bp, Homo sapiens
ttcttattgggagaccttttct

SEQ ID NO: 9496866 - DNA, 22 bp, Homo sapiens
ttcttcaaaatccagcatgatt

SEQ ID NO: 9496867 - DNA, 22 bp, Homo sapiens
ttcttattttcctgaggaagaa

SEQ ID NO: 9496868 - DNA, 21 bp, Homo sapiens
ttcttcaaagaagaaggcaca

SEQ ID NO: 9496869 - DNA, 22 bp, Homo sapiens
ttcttcaaacaaaagtggcatg

SEQ ID NO: 9496870 - DNA, 22 bp, Homo sapiens
ttcttcaaaatccagcatgatt

SEQ ID NO: 9496871 - DNA, 22 bp, Homo sapiens
ttcttcaaagatgtctgttgga

SEQ ID NO: 9496872 - DNA, 22 bp, Homo sapiens
ttcttcaaagtaatagagacta

SEQ ID NO: 9496873 - DNA, 22 bp, Homo sapiens
ttcttcagactactgatgattg

SEQ ID NO: 9496874 - DNA, 22 bp, Homo sapiens
ttcttcaattttccatatactg

SEQ ID NO: 9496875 - DNA, 22 bp, Homo sapiens
ttcttcaagggtaaaggcaacg

SEQ ID NO: 9496876 - DNA, 22 bp, Homo sapiens
ttcttcaatgtgccctgttttc

SEQ ID NO: 9496877 - DNA, 22 bp, Homo sapiens
ttcttcaaccatctacataaac

SEQ ID NO: 9496878 - DNA, 22 bp, Homo sapiens
ttcttcaaccatctacataaac

SEQ ID NO: 9496879 - DNA, 22 bp, Homo sapiens
ttcttcaacaaggacactgtta

SEQ ID NO: 9496880 - DNA, 22 bp, Homo sapiens
ttcttcaaagtaatagagacta

SEQ ID NO: 9496881 - DNA, 22 bp, Homo sapiens
ttcttttaaaagagagcagaaa

SEQ ID NO: 9496882 - DNA, 22 bp, Homo sapiens
ttctttgttgtactttcctaca

SEQ ID NO: 9496883 - DNA, 22 bp, Homo sapiens
ttctttgtagcaaaacgtgtat

SEQ ID NO: 9496884 - DNA, 22 bp, Homo sapiens
ttctttggtgttacccagctca

SEQ ID NO: 9496885 - DNA, 19 bp, Homo sapiens
ttctttggtggtggtgacc

SEQ ID NO: 9496886 - DNA, 22 bp, Homo sapiens
ttctttgtaacctttgggaact

SEQ ID NO: 9496887 - DNA, 22 bp, Homo sapiens
ttcttttctgcagctggtattt

SEQ ID NO: 9496888 - DNA, 22 bp, Homo sapiens
ttcttttctgcagctggtattt

SEQ ID NO: 9496889 - DNA, 22 bp, Homo sapiens
ttcttttaatgttctgaagttt

SEQ ID NO: 9496890 - DNA, 22 bp, Homo sapiens
ttcctgcaaagccagatgtcga

SEQ ID NO: 9496891 - DNA, 22 bp, Homo sapiens
ttcctgatgcacacagtcattt

SEQ ID NO: 9496892 - DNA, 23 bp, Homo sapiens
ttcctgagtgctggagagagtgc

SEQ ID NO: 9496893 - DNA, 22 bp, Homo sapiens
ttcctgagtcgccgagtctatg

SEQ ID NO: 9496894 - DNA, 22 bp, Homo sapiens
ttcctgagtcgccgagtctatg

SEQ ID NO: 9496895 - DNA, 22 bp, Homo sapiens
ttcctgatcccccaggacaaag

SEQ ID NO: 9496896 - DNA, 22 bp, Homo sapiens
ttcctgagcttttaacctagtc

SEQ ID NO: 9496897 - DNA, 22 bp, Homo sapiens
ttcctgaggaggaccaggacca

SEQ ID NO: 9496898 - DNA, 22 bp, Homo sapiens
ttcctgagcttttaacctagtc

SEQ ID NO: 9496899 - DNA, 22 bp, Homo sapiens
ttcctgaggaggaccaggacca

SEQ ID NO: 9496900 - DNA, 22 bp, Homo sapiens
ttcctgagcaccagacactgca

SEQ ID NO: 9496901 - DNA, 22 bp, Homo sapiens
ttcctgagcaccagacactgca

SEQ ID NO: 9496902 - DNA, 22 bp, Homo sapiens
ttcctgagggacttttgagatt

SEQ ID NO: 9496903 - DNA, 22 bp, Homo sapiens
ttcctgaggaggaccaggacca

SEQ ID NO: 9496904 - DNA, 22 bp, Homo sapiens
ttcctgagggccccagaggagg

SEQ ID NO: 9496905 - DNA, 22 bp, Homo sapiens
ttcctgaggtgattctaatgtg

SEQ ID NO: 9496906 - DNA, 22 bp, Homo sapiens
ttcctgagtcccgggtaaagat

SEQ ID NO: 9496907 - DNA, 22 bp, Homo sapiens
ttccagttggcactgcaattta

SEQ ID NO: 9496908 - DNA, 22 bp, Homo sapiens
ttccagttggcactgcaattta

SEQ ID NO: 9496909 - DNA, 22 bp, Homo sapiens
ttccagttcttctgtaagcact

SEQ ID NO: 9496910 - DNA, 22 bp, Homo sapiens
ttccagttctggctttgccact

SEQ ID NO: 9496911 - DNA, 22 bp, Homo sapiens
ttccagttctggctttgccact

SEQ ID NO: 9496912 - DNA, 19 bp, Homo sapiens
ttccagttctaatctcttc

SEQ ID NO: 9496913 - DNA, 17 bp, Homo sapiens
ttccagtttagtattgt

SEQ ID NO: 9496914 - DNA, 17 bp, Homo sapiens
ttccagtttagtattgt

SEQ ID NO: 9496915 - DNA, 17 bp, Homo sapiens
ttccagtttagtattgt

SEQ ID NO: 9496916 - DNA, 22 bp, Homo sapiens
ttccagttgtcataaagctagg

SEQ ID NO: 9496917 - DNA, 22 bp, Homo sapiens
ttcctgaatcccaaggagagct

SEQ ID NO: 9496918 - DNA, 22 bp, Homo sapiens
ttcctgagaccctcacagtgat

SEQ ID NO: 9496919 - DNA, 22 bp, Homo sapiens
ttcctgagaacatggcagctta

SEQ ID NO: 9496920 - DNA, 22 bp, Homo sapiens
ttcctgagaccctcacagtgat

SEQ ID NO: 9496921 - DNA, 22 bp, Homo sapiens
ttcctgagaacatggcagctta

SEQ ID NO: 9496922 - DNA, 22 bp, Homo sapiens
ttcctgagaaatttgtacctgg

SEQ ID NO: 9496923 - DNA, 22 bp, Homo sapiens
ttcctggcatagagagggcaca

SEQ ID NO: 9496924 - DNA, 22 bp, Homo sapiens
ttcctggccccacccctggaga

SEQ ID NO: 9496925 - DNA, 22 bp, Homo sapiens
ttcctggccaagcagagtggaa

SEQ ID NO: 9496926 - DNA, 22 bp, Homo sapiens
ttcctggcctctctctgagcag

SEQ ID NO: 9496927 - DNA, 22 bp, Homo sapiens
ttcctggcctctctctgagcag

SEQ ID NO: 9496928 - DNA, 22 bp, Homo sapiens
ttcctggggcgactgtatctga

SEQ ID NO: 9496929 - DNA, 21 bp, Homo sapiens
ttcctggggacttccgtggga

SEQ ID NO: 9496930 - DNA, 17 bp, Homo sapiens
ttcctggaagtcattcc

SEQ ID NO: 9496931 - DNA, 22 bp, Homo sapiens
ttcctggaaattatgctcacct

SEQ ID NO: 9496932 - DNA, 17 bp, Homo sapiens
ttcctggaagtcattcc

SEQ ID NO: 9496933 - DNA, 21 bp, Homo sapiens
ttcctggaggcagaaacgtga

SEQ ID NO: 9496934 - DNA, 22 bp, Homo sapiens
ttcctggagagttttcccaaag

SEQ ID NO: 9496935 - DNA, 22 bp, Homo sapiens
ttcctggcacatagttagtgct

SEQ ID NO: 9496936 - DNA, 22 bp, Homo sapiens
ttcctggcaccaccacttctag

SEQ ID NO: 9496937 - DNA, 22 bp, Homo sapiens
ttcctggcaaagtgagcatcac

SEQ ID NO: 9496938 - DNA, 22 bp, Homo sapiens
ttcctggcaaagtgagcatcac

SEQ ID NO: 9496939 - DNA, 22 bp, Homo sapiens
ttcctgcgcccttctcgcccgc

SEQ ID NO: 9496940 - DNA, 22 bp, Homo sapiens
ttcctgcctacatgccttatgc

SEQ ID NO: 9496941 - DNA, 22 bp, Homo sapiens
ttcctgcctacatgccttatgc

SEQ ID NO: 9496942 - DNA, 22 bp, Homo sapiens
ttccttcttccagaggctgccc

SEQ ID NO: 9496943 - DNA, 22 bp, Homo sapiens
ttccttcttccaaacccatcat

SEQ ID NO: 9496944 - DNA, 22 bp, Homo sapiens
ttccttcttccaaacccatcat

SEQ ID NO: 9496945 - DNA, 22 bp, Homo sapiens
ttccttcttccaaacccatcat

SEQ ID NO: 9496946 - DNA, 22 bp, Homo sapiens
ttccttcttcctttagtaacca

SEQ ID NO: 9496947 - DNA, 22 bp, Homo sapiens
ttccttcttgtaatgatctgcc

SEQ ID NO: 9496948 - DNA, 22 bp, Homo sapiens
ttccttcttcattgtgttacag

SEQ ID NO: 9496949 - DNA, 22 bp, Homo sapiens
ttccttcttcattgtgttacag

SEQ ID NO: 9496950 - DNA, 22 bp, Homo sapiens
ttccttctggaggctccagggg

SEQ ID NO: 9496951 - DNA, 18 bp, Homo sapiens
ttccttctgatgtatatg

SEQ ID NO: 9496952 - DNA, 18 bp, Homo sapiens
ttccttctgatgtatatg

SEQ ID NO: 9496953 - DNA, 22 bp, Homo sapiens
ttccttctggagcccggggagc

SEQ ID NO: 9496954 - DNA, 22 bp, Homo sapiens
ttccttctggaagcttcagggg

SEQ ID NO: 9496955 - DNA, 22 bp, Homo sapiens
ttccttgccctctgggatcttg

SEQ ID NO: 9496956 - DNA, 22 bp, Homo sapiens
ttccttgattagtacatgaagg

SEQ ID NO: 9496957 - DNA, 22 bp, Homo sapiens
ttccttggagcgctaaagctct

SEQ ID NO: 9496958 - DNA, 22 bp, Homo sapiens
ttccttggaagggtaattgcaa

SEQ ID NO: 9496959 - DNA, 22 bp, Homo sapiens
ttccttggagtcaaacagggag

SEQ ID NO: 9496960 - DNA, 22 bp, Homo sapiens
ttccttggccacactggtgctt

SEQ ID NO: 9496961 - DNA, 22 bp, Homo sapiens
ttccttggccccatgcccaggg

SEQ ID NO: 9496962 - DNA, 22 bp, Homo sapiens
ttccttctttgtggtagaaagt

SEQ ID NO: 9496963 - DNA, 22 bp, Homo sapiens
ttccttcttttacaccataaat

SEQ ID NO: 9496964 - DNA, 22 bp, Homo sapiens
ttccttgaatgagtcatggaaa

SEQ ID NO: 9496965 - DNA, 22 bp, Homo sapiens
ttccttgaatgagtcatggaaa

SEQ ID NO: 9496966 - DNA, 22 bp, Homo sapiens
ttccttgaatgagtcatggaaa

SEQ ID NO: 9496967 - DNA, 22 bp, Homo sapiens
ttccttgagaaaggcacaagtt

SEQ ID NO: 9496968 - DNA, 22 bp, Homo sapiens
ttcctggtgagatttcgttctg

SEQ ID NO: 9496969 - DNA, 22 bp, Homo sapiens
ttcctggtgacctcactggtag

SEQ ID NO: 9496970 - DNA, 22 bp, Homo sapiens
ttcctggtgacctcactggtag

SEQ ID NO: 9496971 - DNA, 22 bp, Homo sapiens
ttcctggtgacctcactggtag

SEQ ID NO: 9496972 - DNA, 22 bp, Homo sapiens
ttcctggtgagatttcgttctg

SEQ ID NO: 9496973 - DNA, 22 bp, Homo sapiens
ttcctggttggattctgattaa

SEQ ID NO: 9496974 - DNA, 22 bp, Homo sapiens
ttcctggtttatacctgtatca

SEQ ID NO: 9496975 - DNA, 22 bp, Homo sapiens
ttcctggtcccgttcttcactg

SEQ ID NO: 9496976 - DNA, 22 bp, Homo sapiens
ttcctggtcccgttcttcactg

SEQ ID NO: 9496977 - DNA, 22 bp, Homo sapiens
ttcctggtcctattatatacac

SEQ ID NO: 9496978 - DNA, 22 bp, Homo sapiens
ttcctggtctgtgccattcaga

SEQ ID NO: 9496979 - DNA, 22 bp, Homo sapiens
ttcctggtctgtgccattcaga

SEQ ID NO: 9496980 - DNA, 22 bp, Homo sapiens
ttcctggtagtaagacatctgg

SEQ ID NO: 9496981 - DNA, 22 bp, Homo sapiens
ttcctggtcactgctgttccct

SEQ ID NO: 9496982 - DNA, 22 bp, Homo sapiens
ttcctggtagtaagacatctgg

SEQ ID NO: 9496983 - DNA, 22 bp, Homo sapiens
ttcctggtaacaatctcaaagt

SEQ ID NO: 9496984 - DNA, 22 bp, Homo sapiens
ttcctggtaaattatgtccagg

SEQ ID NO: 9496985 - DNA, 22 bp, Homo sapiens
ttcctggtaaattatgtccagg

SEQ ID NO: 9496986 - DNA, 22 bp, Homo sapiens
ttcctgggttccctctcattct

SEQ ID NO: 9496987 - DNA, 22 bp, Homo sapiens
ttcctgggttccctctcattct

SEQ ID NO: 9496988 - DNA, 22 bp, Homo sapiens
ttcctgggttgtgcattgtaca

SEQ ID NO: 9496989 - DNA, 22 bp, Homo sapiens
ttcctgggttgtgcattgtaca

SEQ ID NO: 9496990 - DNA, 22 bp, Homo sapiens
ttcctgggtttacgtattgggt

SEQ ID NO: 9496991 - DNA, 19 bp, Homo sapiens
ttcctggggttccattgtg

SEQ ID NO: 9496992 - DNA, 22 bp, Homo sapiens
ttcctggggtgaagatattttt

SEQ ID NO: 9496993 - DNA, 19 bp, Homo sapiens
ttcctggggttccattgtg

SEQ ID NO: 9496994 - DNA, 22 bp, Homo sapiens
ttcctgggtggtcctggtagag

SEQ ID NO: 9496995 - DNA, 22 bp, Homo sapiens
ttcctgggtggtcctggtagag

SEQ ID NO: 9496996 - DNA, 22 bp, Homo sapiens
ttcctggggctccagctaccag

SEQ ID NO: 9496997 - DNA, 22 bp, Homo sapiens
ttcctggggcttagcaatggag

SEQ ID NO: 9496998 - DNA, 22 bp, Homo sapiens
ttcctgggggcagcagtcttga

SEQ ID NO: 9496999 - DNA, 22 bp, Homo sapiens
ttcctggggcttagcaatggag

SEQ ID NO: 9497000 - DNA, 22 bp, Homo sapiens
ttcctggggcttagcaatggag

SEQ ID NO: 9497001 - DNA, 22 bp, Homo sapiens
ttcctggggggatagatttcac

SEQ ID NO: 9497002 - DNA, 22 bp, Homo sapiens
ttcctggggggatagatttcac

SEQ ID NO: 9497003 - DNA, 22 bp, Homo sapiens
ttcctgggggcagcagtcttga

SEQ ID NO: 9497004 - DNA, 22 bp, Homo sapiens
ttcctggggtgaagatattttt

SEQ ID NO: 9497005 - DNA, 22 bp, Homo sapiens
ttcctggggtactggagaaaat

SEQ ID NO: 9497006 - DNA, 22 bp, Homo sapiens
ttcctggggtactggagaaaat

SEQ ID NO: 9497007 - DNA, 22 bp, Homo sapiens
ttctcagatccatcagaagtcc

SEQ ID NO: 9497008 - DNA, 22 bp, Homo sapiens
ttccttgttctacatccctgcc

SEQ ID NO: 9497009 - DNA, 22 bp, Homo sapiens
ttccttgttaatagtgtctgga

SEQ ID NO: 9497010 - DNA, 22 bp, Homo sapiens
ttccttgtgtaaactctccatc

SEQ ID NO: 9497011 - DNA, 22 bp, Homo sapiens
ttccttgttcctaggagatcaa

SEQ ID NO: 9497012 - DNA, 22 bp, Homo sapiens
ttccttgtggaaactatggacg

SEQ ID NO: 9497013 - DNA, 22 bp, Homo sapiens
ttccttggtacagagtagcttt

SEQ ID NO: 9497014 - DNA, 22 bp, Homo sapiens
ttccttggtagggacaactctg

SEQ ID NO: 9497015 - DNA, 22 bp, Homo sapiens
ttccttggtgtaactgctccta

SEQ ID NO: 9497016 - DNA, 22 bp, Homo sapiens
ttccttgggtgcctacttagag

SEQ ID NO: 9497017 - DNA, 22 bp, Homo sapiens
ttctcaggaactcagtgtcagc

SEQ ID NO: 9497018 - DNA, 22 bp, Homo sapiens
ttctcaggaactcagtgtcagc

SEQ ID NO: 9497019 - DNA, 22 bp, Homo sapiens
ttctcaggaactcagtgtcagc

SEQ ID NO: 9497020 - DNA, 22 bp, Homo sapiens
ttctcaggcccctgcctggact

SEQ ID NO: 9497021 - DNA, 22 bp, Homo sapiens
ttctcaggcacttcttccccgc

SEQ ID NO: 9497022 - DNA, 22 bp, Homo sapiens
ttctcaggcacttcttccccgc

SEQ ID NO: 9497023 - DNA, 23 bp, Homo sapiens
ttctcaggagcccccaggtcagg

SEQ ID NO: 9497024 - DNA, 23 bp, Homo sapiens
ttctcaggagcccccaggtcagg

SEQ ID NO: 9497025 - DNA, 22 bp, Homo sapiens
ttctcaggctctgagaccctat

SEQ ID NO: 9497026 - DNA, 22 bp, Homo sapiens
ttctcaggcctttgggatggga

SEQ ID NO: 9497027 - DNA, 22 bp, Homo sapiens
ttctcaggctgtggagccgtct

SEQ ID NO: 9497028 - DNA, 22 bp, Homo sapiens
ttctcaggctgtggagccgtct

SEQ ID NO: 9497029 - DNA, 22 bp, Homo sapiens
ttctcaggcccctgcctggact

SEQ ID NO: 9497030 - DNA, 22 bp, Homo sapiens
ttctcaggcctttgggatggga

SEQ ID NO: 9497031 - DNA, 22 bp, Homo sapiens
ttctcagggtctggatggcctg

SEQ ID NO: 9497032 - DNA, 22 bp, Homo sapiens
ttctcagggtctggatggcctg

SEQ ID NO: 9497033 - DNA, 22 bp, Homo sapiens
ttctcagggtctggatggcctg

SEQ ID NO: 9497034 - DNA, 22 bp, Homo sapiens
ttctcagggtctggatggcctg

SEQ ID NO: 9497035 - DNA, 22 bp, Homo sapiens
ttctcagggtagaggtgacact

SEQ ID NO: 9497036 - DNA, 22 bp, Homo sapiens
ttctcagggccctgtgttagct

SEQ ID NO: 9497037 - DNA, 22 bp, Homo sapiens
ttctcagggccctgtgttagct

SEQ ID NO: 9497038 - DNA, 22 bp, Homo sapiens
ttctcagggcatctcatgaccc

SEQ ID NO: 9497039 - DNA, 22 bp, Homo sapiens
ttctcaggtcaccagggtgcca

SEQ ID NO: 9497040 - DNA, 22 bp, Homo sapiens
ttctcaggtcaccagggtgcca

SEQ ID NO: 9497041 - DNA, 22 bp, Homo sapiens
ttctccaacacaagcatgatgt

SEQ ID NO: 9497042 - DNA, 22 bp, Homo sapiens
ttctccaagatgaagctgtgta

SEQ ID NO: 9497043 - DNA, 22 bp, Homo sapiens
ttctccaacacaagcatgatgt

SEQ ID NO: 9497044 - DNA, 22 bp, Homo sapiens
ttctccaactcttttaagtaat

SEQ ID NO: 9497045 - DNA, 22 bp, Homo sapiens
ttctccaactcttttaagtaat

SEQ ID NO: 9497046 - DNA, 22 bp, Homo sapiens
ttctcaggtagtgctgatgctg

SEQ ID NO: 9497047 - DNA, 22 bp, Homo sapiens
ttctcagggtttgtgcaggctt

SEQ ID NO: 9497048 - DNA, 22 bp, Homo sapiens
ttctcaggtagtgctgatgctg

SEQ ID NO: 9497049 - DNA, 22 bp, Homo sapiens
ttctcagggtttgtgcaggctt

SEQ ID NO: 9497050 - DNA, 22 bp, Homo sapiens
ttctcagggttggcctcaaatc

SEQ ID NO: 9497051 - DNA, 22 bp, Homo sapiens
ttctcagggtcttgtgcaaggg

SEQ ID NO: 9497052 - DNA, 22 bp, Homo sapiens
ttctcagggtcttgtgcaaggg

SEQ ID NO: 9497053 - DNA, 22 bp, Homo sapiens
ttctccacatggtgtgctgtga

SEQ ID NO: 9497054 - DNA, 22 bp, Homo sapiens
ttctccagacaacagagggtga

SEQ ID NO: 9497055 - DNA, 22 bp, Homo sapiens
ttctccaaggatacagtcctgt

SEQ ID NO: 9497056 - DNA, 22 bp, Homo sapiens
ttctccaagggatttctgcctt

SEQ ID NO: 9497057 - DNA, 22 bp, Homo sapiens
ttctccaaggttcatatttatc

SEQ ID NO: 9497058 - DNA, 22 bp, Homo sapiens
ttctccaatagctgctcatggc

SEQ ID NO: 9497059 - DNA, 22 bp, Homo sapiens
ttctcctgagttcccaggtcta

SEQ ID NO: 9497060 - DNA, 22 bp, Homo sapiens
ttctctaagagatgcagaagtt

SEQ ID NO: 9497061 - DNA, 23 bp, Homo sapiens
ttctcctgaggaagcagggactg

SEQ ID NO: 9497062 - DNA, 22 bp, Homo sapiens
ttctcctgagttcccaggtcta

SEQ ID NO: 9497063 - DNA, 22 bp, Homo sapiens
ttctccagaccttgtgactatg

SEQ ID NO: 9497064 - DNA, 22 bp, Homo sapiens
ttctccagagggctctgcagga

SEQ ID NO: 9497065 - DNA, 22 bp, Homo sapiens
ttctccagaccctcctgcagac

SEQ ID NO: 9497066 - DNA, 22 bp, Homo sapiens
ttctccagaccctcctgcagac

SEQ ID NO: 9497067 - DNA, 22 bp, Homo sapiens
ttctccagaccactgcctctgt

SEQ ID NO: 9497068 - DNA, 22 bp, Homo sapiens
ttctccagaccactgcctctgt

SEQ ID NO: 9497069 - DNA, 22 bp, Homo sapiens
ttctccagaccactgcctctgt

SEQ ID NO: 9497070 - DNA, 22 bp, Homo sapiens
ttctccagaccactgcctctgt

SEQ ID NO: 9497071 - DNA, 22 bp, Homo sapiens
ttctccagaccactgcctctgt

SEQ ID NO: 9497072 - DNA, 22 bp, Homo sapiens
ttctctatgtgtgttgtagttt

SEQ ID NO: 9497073 - DNA, 22 bp, Homo sapiens
ttctctcagttaaactttgtga

SEQ ID NO: 9497074 - DNA, 20 bp, Homo sapiens
ttctctagccttcccctggg

SEQ ID NO: 9497075 - DNA, 22 bp, Homo sapiens
ttctctaggactttggagtcct

SEQ ID NO: 9497076 - DNA, 22 bp, Homo sapiens
ttctctaatggtgatgattaga

SEQ ID NO: 9497077 - DNA, 22 bp, Homo sapiens
ttctctaatggtgatgattaga

SEQ ID NO: 9497078 - DNA, 22 bp, Homo sapiens
ttctctaatacattttgacaaa

SEQ ID NO: 9497079 - DNA, 22 bp, Homo sapiens
ttctctaatacattttgacaaa

SEQ ID NO: 9497080 - DNA, 22 bp, Homo sapiens
ttctctacttcacaagggatgg

SEQ ID NO: 9497081 - DNA, 22 bp, Homo sapiens
ttctctaatggtgatgattaga

SEQ ID NO: 9497082 - DNA, 22 bp, Homo sapiens
ttctctaatacattttgacaaa

SEQ ID NO: 9497083 - DNA, 22 bp, Homo sapiens
ttctctaagagttatatgaatt

SEQ ID NO: 9497084 - DNA, 22 bp, Homo sapiens
ttctctaagccttagtttcttc

SEQ ID NO: 9497085 - DNA, 22 bp, Homo sapiens
ttctctaagccttagtttcttc

SEQ ID NO: 9497086 - DNA, 22 bp, Homo sapiens
ttctctaagccttagtttcttc

SEQ ID NO: 9497087 - DNA, 22 bp, Homo sapiens
ttctctcctcctagaggctttt

SEQ ID NO: 9497088 - DNA, 22 bp, Homo sapiens
ttctctcctcctagaggctttt

SEQ ID NO: 9497089 - DNA, 22 bp, Homo sapiens
ttctctctgagagcatctggaa

SEQ ID NO: 9497090 - DNA, 22 bp, Homo sapiens
ttctctctgagagcatctggaa

SEQ ID NO: 9497091 - DNA, 22 bp, Homo sapiens
ttctctcagttaaactttgtga

SEQ ID NO: 9497092 - DNA, 22 bp, Homo sapiens
ttctctccagactgcagtgggt

SEQ ID NO: 9497093 - DNA, 22 bp, Homo sapiens
ttctctcccatgaagcttctat

SEQ ID NO: 9497094 - DNA, 22 bp, Homo sapiens
ttctctctggacctgggatgcg

SEQ ID NO: 9497095 - DNA, 22 bp, Homo sapiens
ttctctctgtggtcccattttg

SEQ ID NO: 9497096 - DNA, 22 bp, Homo sapiens
ttctctctgttatggattttac

SEQ ID NO: 9497097 - DNA, 22 bp, Homo sapiens
ttctctcttactgccatgctgt

SEQ ID NO: 9497098 - DNA, 22 bp, Homo sapiens
ttctctcttactgccatgctgt

SEQ ID NO: 9497099 - DNA, 22 bp, Homo sapiens
ttctctcttactgccatgctgt

SEQ ID NO: 9497100 - DNA, 22 bp, Homo sapiens
ttctctgaaggccatgctcact

SEQ ID NO: 9497101 - DNA, 22 bp, Homo sapiens
ttctctgaaggttgtggaacta

SEQ ID NO: 9497102 - DNA, 22 bp, Homo sapiens
ttctctgaaggccatgctcact

SEQ ID NO: 9497103 - DNA, 22 bp, Homo sapiens
ttctctcttttgggtaggaggt

SEQ ID NO: 9497104 - DNA, 22 bp, Homo sapiens
ttctctcttttgggtaggaggt

SEQ ID NO: 9497105 - DNA, 22 bp, Homo sapiens
ttctctcttccagttcccactt

SEQ ID NO: 9497106 - DNA, 22 bp, Homo sapiens
ttctctcttccagttcccactt

SEQ ID NO: 9497107 - DNA, 22 bp, Homo sapiens
ttctctcttactgccatgctgt

SEQ ID NO: 9497108 - DNA, 22 bp, Homo sapiens
ttctctcttccagttcccactt

SEQ ID NO: 9497109 - DNA, 22 bp, Homo sapiens
ttctctggaaggctctacggga

SEQ ID NO: 9497110 - DNA, 22 bp, Homo sapiens
ttctctggaaggctctacggga

SEQ ID NO: 9497111 - DNA, 22 bp, Homo sapiens
ttctctgctctcacatacagaa

SEQ ID NO: 9497112 - DNA, 22 bp, Homo sapiens
ttctctggaactgaaacaagat

SEQ ID NO: 9497113 - DNA, 22 bp, Homo sapiens
ttctctgctacatactagggct

SEQ ID NO: 9497114 - DNA, 22 bp, Homo sapiens
ttctctgcattgtaaagagcca

SEQ ID NO: 9497115 - DNA, 22 bp, Homo sapiens
ttctctgcctcacaggtctaag

SEQ ID NO: 9497116 - DNA, 22 bp, Homo sapiens
ttgctgtgtctgatggctgaga

SEQ ID NO: 9497117 - DNA, 22 bp, Homo sapiens
ttgctgtgtaactcctggcctg

SEQ ID NO: 9497118 - DNA, 22 bp, Homo sapiens
ttgcttaattctgaaaatatag

SEQ ID NO: 9497119 - DNA, 21 bp, Homo sapiens
ttgcttatggcactgctttgc

SEQ ID NO: 9497120 - DNA, 22 bp, Homo sapiens
ttgcttatttgattaaatgtct

SEQ ID NO: 9497121 - DNA, 22 bp, Homo sapiens
ttgcttatagagagtttcatac

SEQ ID NO: 9497122 - DNA, 21 bp, Homo sapiens
ttgcttatggcactgctttgc

SEQ ID NO: 9497123 - DNA, 22 bp, Homo sapiens
ttgctgttttacatctggtggg

SEQ ID NO: 9497124 - DNA, 21 bp, Homo sapiens
ttgctgttttcccaatgcagt

SEQ ID NO: 9497125 - DNA, 22 bp, Homo sapiens
ttgctgaagtatgaaaaagaca

SEQ ID NO: 9497126 - DNA, 22 bp, Homo sapiens
ttgctcttgaaaattgatgctg

SEQ ID NO: 9497127 - DNA, 22 bp, Homo sapiens
ttgctctgtcagggcctcagtc

SEQ ID NO: 9497128 - DNA, 22 bp, Homo sapiens
ttgctctgtcagggcctcagtc

SEQ ID NO: 9497129 - DNA, 22 bp, Homo sapiens
ttgctctgtcagggcctcagtc

SEQ ID NO: 9497130 - DNA, 22 bp, Homo sapiens
ttgctctgtaataatctggggt

SEQ ID NO: 9497131 - DNA, 22 bp, Homo sapiens
ttgctctgtccagccagcaggt

SEQ ID NO: 9497132 - DNA, 22 bp, Homo sapiens
ttgctctgtccagccagcaggt

SEQ ID NO: 9497133 - DNA, 22 bp, Homo sapiens
ttgctctgcagtccagacagta

SEQ ID NO: 9497134 - DNA, 22 bp, Homo sapiens
ttgctctgcagtccagacagta

SEQ ID NO: 9497135 - DNA, 22 bp, Homo sapiens
ttgctctgtaataatctggggt

SEQ ID NO: 9497136 - DNA, 22 bp, Homo sapiens
ttgctctgactggagtgcagtg

SEQ ID NO: 9497137 - DNA, 22 bp, Homo sapiens
ttgctctgactggagtgcagtg

SEQ ID NO: 9497138 - DNA, 22 bp, Homo sapiens
ttgctctatgtttgtaaacaga

SEQ ID NO: 9497139 - DNA, 19 bp, Homo sapiens
ttgctcccaccccagtttt

SEQ ID NO: 9497140 - DNA, 19 bp, Homo sapiens
ttgctcccaccccagtttt

SEQ ID NO: 9497141 - DNA, 22 bp, Homo sapiens
ttgctctgaaccacaccatcac

SEQ ID NO: 9497142 - DNA, 22 bp, Homo sapiens
ttgctctccagaggctcacagc

SEQ ID NO: 9497143 - DNA, 22 bp, Homo sapiens
ttgctcatttgcctttaggttt

SEQ ID NO: 9497144 - DNA, 22 bp, Homo sapiens
ttgctccaggctgcagactctg

SEQ ID NO: 9497145 - DNA, 22 bp, Homo sapiens
ttgctcatatttgcatgtgttt

SEQ ID NO: 9497146 - DNA, 22 bp, Homo sapiens
ttgcatttactgcaccgtgagt

SEQ ID NO: 9497147 - DNA, 22 bp, Homo sapiens
ttgcatttcaattgctcaggaa

SEQ ID NO: 9497148 - DNA, 22 bp, Homo sapiens
ttggaattgtgaactaagtgat

SEQ ID NO: 9497149 - DNA, 22 bp, Homo sapiens
ttggaatttagggaatattcat

SEQ ID NO: 9497150 - DNA, 22 bp, Homo sapiens
ttggaatttagtaaaataatgc

SEQ ID NO: 9497151 - DNA, 22 bp, Homo sapiens
ttggaacacaatgtttctttca

SEQ ID NO: 9497152 - DNA, 22 bp, Homo sapiens
ttggaattcctgttgtttcgtc

SEQ ID NO: 9497153 - DNA, 22 bp, Homo sapiens
ttggaacacagcagctgatttt

SEQ ID NO: 9497154 - DNA, 22 bp, Homo sapiens
ttggaattgaggatttacatag

SEQ ID NO: 9497155 - DNA, 21 bp, Homo sapiens
ttggaatttgggagctatgtg

SEQ ID NO: 9497156 - DNA, 22 bp, Homo sapiens
ttggaacaatcacatccttgct

SEQ ID NO: 9497157 - DNA, 22 bp, Homo sapiens
ttggaacaatcacatccttgct

SEQ ID NO: 9497158 - DNA, 22 bp, Homo sapiens
ttggaaattgcaagtgatttgc

SEQ ID NO: 9497159 - DNA, 22 bp, Homo sapiens
ttggaaatgtagaaaagcagat

SEQ ID NO: 9497160 - DNA, 22 bp, Homo sapiens
ttggaaatgtagaaaagcagat

SEQ ID NO: 9497161 - DNA, 22 bp, Homo sapiens
ttggaaattgcaagtgatttgc

SEQ ID NO: 9497162 - DNA, 23 bp, Homo sapiens
ttggaaatggggagaacagattc

SEQ ID NO: 9497163 - DNA, 23 bp, Homo sapiens
ttggaaatggggagaacagattc

SEQ ID NO: 9497164 - DNA, 22 bp, Homo sapiens
ttggaaatggctgtagttatga

SEQ ID NO: 9497165 - DNA, 22 bp, Homo sapiens
ttggaaatgcatttgttattat

SEQ ID NO: 9497166 - DNA, 22 bp, Homo sapiens
ttggaaatgcatttgttattat

SEQ ID NO: 9497167 - DNA, 22 bp, Homo sapiens
ttggaaatggctgtagttatga

SEQ ID NO: 9497168 - DNA, 22 bp, Homo sapiens
ttggaaatggctgtagttatga

SEQ ID NO: 9497169 - DNA, 22 bp, Homo sapiens
ttggaaagtttttactgaagac

SEQ ID NO: 9497170 - DNA, 22 bp, Homo sapiens
ttggaaagggatatctgtactt

SEQ ID NO: 9497171 - DNA, 22 bp, Homo sapiens
ttggaaatacagcagttacttt

SEQ ID NO: 9497172 - DNA, 22 bp, Homo sapiens
ttggaaatacagcagttacttt

SEQ ID NO: 9497173 - DNA, 22 bp, Homo sapiens
ttggaaatacagcagttacttt

SEQ ID NO: 9497174 - DNA, 22 bp, Homo sapiens
ttggaaatgatttctattatta

SEQ ID NO: 9497175 - DNA, 22 bp, Homo sapiens
ttggaaatgcaaatatattgaa

SEQ ID NO: 9497176 - DNA, 22 bp, Homo sapiens
ttggaaatgcaaatatattgaa

SEQ ID NO: 9497177 - DNA, 22 bp, Homo sapiens
ttggaaatgatttctattatta

SEQ ID NO: 9497178 - DNA, 22 bp, Homo sapiens
ttggaaacgtcaccttttcctt

SEQ ID NO: 9497179 - DNA, 22 bp, Homo sapiens
ttgctttcccaaggcagaacat

SEQ ID NO: 9497180 - DNA, 23 bp, Homo sapiens
ttgctttcatcatgagatgctcc

SEQ ID NO: 9497181 - DNA, 23 bp, Homo sapiens
ttgctttcatcatgagatgctcc

SEQ ID NO: 9497182 - DNA, 22 bp, Homo sapiens
ttgctttattgggtttactgcc

SEQ ID NO: 9497183 - DNA, 22 bp, Homo sapiens
ttgcttatttgattaaatgtct

SEQ ID NO: 9497184 - DNA, 22 bp, Homo sapiens
ttgcttatttgattaaatgtct

SEQ ID NO: 9497185 - DNA, 22 bp, Homo sapiens
ttgcttcagagggagacacttt

SEQ ID NO: 9497186 - DNA, 22 bp, Homo sapiens
ttgcttcagagaggaggaggtg

SEQ ID NO: 9497187 - DNA, 22 bp, Homo sapiens
ttgcttcactgagttatgcctg

SEQ ID NO: 9497188 - DNA, 22 bp, Homo sapiens
ttgcttcagagacagggctcac

SEQ ID NO: 9497189 - DNA, 22 bp, Homo sapiens
ttggaaactttcaagcataatg

SEQ ID NO: 9497190 - DNA, 22 bp, Homo sapiens
ttggaaagaagggctgagcaag

SEQ ID NO: 9497191 - DNA, 22 bp, Homo sapiens
ttggaaagattattattatgaa

SEQ ID NO: 9497192 - DNA, 22 bp, Homo sapiens
ttggaaagcaacttttgagagt

SEQ ID NO: 9497193 - DNA, 22 bp, Homo sapiens
ttgcagggtcccagaggcctgg

SEQ ID NO: 9497194 - DNA, 22 bp, Homo sapiens
ttgcaggggagaggaacaaaca

SEQ ID NO: 9497195 - DNA, 22 bp, Homo sapiens
ttgcaggggaaggagcagagct

SEQ ID NO: 9497196 - DNA, 22 bp, Homo sapiens
ttgcagggttgaccaataggct

SEQ ID NO: 9497197 - DNA, 22 bp, Homo sapiens
ttgcagttgcatatgcccctac

SEQ ID NO: 9497198 - DNA, 22 bp, Homo sapiens
ttgcagttaaaaatcattagtt

SEQ ID NO: 9497199 - DNA, 22 bp, Homo sapiens
ttgcagttaaaaatcattagtt

SEQ ID NO: 9497200 - DNA, 22 bp, Homo sapiens
ttgcagcttcttgcatcagaaa

SEQ ID NO: 9497201 - DNA, 22 bp, Homo sapiens
ttgcagcttctaccactgtttc

SEQ ID NO: 9497202 - DNA, 22 bp, Homo sapiens
ttgcagggaaatagaaataaac

SEQ ID NO: 9497203 - DNA, 23 bp, Homo sapiens
ttgcagggatggagttcaaaatg

SEQ ID NO: 9497204 - DNA, 22 bp, Homo sapiens
ttgcagggataaaacaagtgaa

SEQ ID NO: 9497205 - DNA, 22 bp, Homo sapiens
ttgcagggataaaacaagtgaa

SEQ ID NO: 9497206 - DNA, 22 bp, Homo sapiens
ttgcagggaaatcagtgaggat

SEQ ID NO: 9497207 - DNA, 22 bp, Homo sapiens
ttgcagggacctgcagaaagct

SEQ ID NO: 9497208 - DNA, 22 bp, Homo sapiens
ttgcagctgcagtaaatgttca

SEQ ID NO: 9497209 - DNA, 22 bp, Homo sapiens
ttgcagctgtgagctttacacg

SEQ ID NO: 9497210 - DNA, 22 bp, Homo sapiens
ttgcagcttcaagcaggttgac

SEQ ID NO: 9497211 - DNA, 22 bp, Homo sapiens
ttgcagctgttgcaaagtctct

SEQ ID NO: 9497212 - DNA, 22 bp, Homo sapiens
ttgcagcttagtgatgttatct

SEQ ID NO: 9497213 - DNA, 22 bp, Homo sapiens
ttgcagattaaaacactgagct

SEQ ID NO: 9497214 - DNA, 22 bp, Homo sapiens
ttgcagattaaaacactgagct

SEQ ID NO: 9497215 - DNA, 19 bp, Homo sapiens
ttgcagcaaagttaggacc

SEQ ID NO: 9497216 - DNA, 22 bp, Homo sapiens
ttgcagatttcttcttacctgt

SEQ ID NO: 9497217 - DNA, 22 bp, Homo sapiens
ttgcagctgaggaaattgaagc

SEQ ID NO: 9497218 - DNA, 22 bp, Homo sapiens
ttgcagatatatggagtgcatt

SEQ ID NO: 9497219 - DNA, 22 bp, Homo sapiens
ttgcagaggcaaaaatgaactc

SEQ ID NO: 9497220 - DNA, 22 bp, Homo sapiens
ttgcagagcagtaggaatatag

SEQ ID NO: 9497221 - DNA, 22 bp, Homo sapiens
ttgcagagaggttaggaactca

SEQ ID NO: 9497222 - DNA, 22 bp, Homo sapiens
ttgcagaatacttattctgtat

SEQ ID NO: 9497223 - DNA, 22 bp, Homo sapiens
ttgcagacttacttcgagaaat

SEQ ID NO: 9497224 - DNA, 22 bp, Homo sapiens
ttgcagaagggcacagtgatca

SEQ ID NO: 9497225 - DNA, 21 bp, Homo sapiens
ttgcacagaaaaccatagaga

SEQ ID NO: 9497226 - DNA, 22 bp, Homo sapiens
ttgacacagttttctcattaag

SEQ ID NO: 9497227 - DNA, 22 bp, Homo sapiens
ttgacacagtcaacttgatttt

SEQ ID NO: 9497228 - DNA, 22 bp, Homo sapiens
ttgacacattagagcttgtaaa

SEQ ID NO: 9497229 - DNA, 22 bp, Homo sapiens
ttgacagaatgttacatataga

SEQ ID NO: 9497230 - DNA, 22 bp, Homo sapiens
ttgacactaagatttccaaaca

SEQ ID NO: 9497231 - DNA, 22 bp, Homo sapiens
ttgacagaaatgtatttgcatg

SEQ ID NO: 9497232 - DNA, 22 bp, Homo sapiens
ttgacagagctaggtcaactct

SEQ ID NO: 9497233 - DNA, 22 bp, Homo sapiens
ttgacagctacctacatggtgg

SEQ ID NO: 9497234 - DNA, 22 bp, Homo sapiens
ttgacagcaaagattgtgccta

SEQ ID NO: 9497235 - DNA, 22 bp, Homo sapiens
ttgacagagaaaagtgtgactt

SEQ ID NO: 9497236 - DNA, 22 bp, Homo sapiens
ttgcaattgctatggagagcgt

SEQ ID NO: 9497237 - DNA, 22 bp, Homo sapiens
ttgcaattaacatatgtcaact

SEQ ID NO: 9497238 - DNA, 22 bp, Homo sapiens
ttgacagctattttgctttgat

SEQ ID NO: 9497239 - DNA, 22 bp, Homo sapiens
ttgacaaagatatattcatgct

SEQ ID NO: 9497240 - DNA, 22 bp, Homo sapiens
ttgacaaagatatattcatgct

SEQ ID NO: 9497241 - DNA, 22 bp, Homo sapiens
ttgacaaagatatattcatgct

SEQ ID NO: 9497242 - DNA, 22 bp, Homo sapiens
ttgacaaagatatattcatgct

SEQ ID NO: 9497243 - DNA, 22 bp, Homo sapiens
ttgacaaaggaattgaatctct

SEQ ID NO: 9497244 - DNA, 22 bp, Homo sapiens
ttgacaaaggaattgaatctct

SEQ ID NO: 9497245 - DNA, 22 bp, Homo sapiens
ttgacaaaggaattgaatctct

SEQ ID NO: 9497246 - DNA, 22 bp, Homo sapiens
ttgacaaaggaattgaatctct

SEQ ID NO: 9497247 - DNA, 22 bp, Homo sapiens
ttgacaaaggaattgaatctct

SEQ ID NO: 9497248 - DNA, 22 bp, Homo sapiens
ttgacaaaggctgagaggaaaa

SEQ ID NO: 9497249 - DNA, 22 bp, Homo sapiens
ttgacaaagtttagtaataatc

SEQ ID NO: 9497250 - DNA, 22 bp, Homo sapiens
ttgacaaaggaccttgctattt

SEQ ID NO: 9497251 - DNA, 22 bp, Homo sapiens
ttgacaaaaataacacagcata

SEQ ID NO: 9497252 - DNA, 22 bp, Homo sapiens
ttgacaaaaataacacagcata

SEQ ID NO: 9497253 - DNA, 22 bp, Homo sapiens
ttgacaaaaacctcatttcacc

SEQ ID NO: 9497254 - DNA, 22 bp, Homo sapiens
ttgacaaaaacctcatttcacc

SEQ ID NO: 9497255 - DNA, 22 bp, Homo sapiens
ttgacaaaaacctcatttcacc

SEQ ID NO: 9497256 - DNA, 22 bp, Homo sapiens
ttgacaaaacaacacagatttc

SEQ ID NO: 9497257 - DNA, 22 bp, Homo sapiens
ttgacaaaacaacacagatttc

SEQ ID NO: 9497258 - DNA, 22 bp, Homo sapiens
ttgacaaaacaacacagatttc

SEQ ID NO: 9497259 - DNA, 22 bp, Homo sapiens
ttgacaaagatatattcatgct

SEQ ID NO: 9497260 - DNA, 22 bp, Homo sapiens
ttgacaaaacaacacagatttc

SEQ ID NO: 9497261 - DNA, 22 bp, Homo sapiens
ttgacaaaacaacacagatttc

SEQ ID NO: 9497262 - DNA, 22 bp, Homo sapiens
ttgacacaatgtatattttcaa

SEQ ID NO: 9497263 - DNA, 22 bp, Homo sapiens
ttgacacaaacagtgatgtagt

SEQ ID NO: 9497264 - DNA, 22 bp, Homo sapiens
ttgacacaaacagtgatgtagt

SEQ ID NO: 9497265 - DNA, 22 bp, Homo sapiens
ttgacacagatcaatattcaac

SEQ ID NO: 9497266 - DNA, 22 bp, Homo sapiens
ttgacaatgtcctttgaatttc

SEQ ID NO: 9497267 - DNA, 22 bp, Homo sapiens
ttgacaatgtcctttgaatttc

SEQ ID NO: 9497268 - DNA, 22 bp, Homo sapiens
ttgacaatgcactgtgctaagt

SEQ ID NO: 9497269 - DNA, 22 bp, Homo sapiens
ttgacaatgtcctttgaatttc

SEQ ID NO: 9497270 - DNA, 22 bp, Homo sapiens
ttgacaattgggagatataaag

SEQ ID NO: 9497271 - DNA, 22 bp, Homo sapiens
ttgacaatccctgttagaagtg

SEQ ID NO: 9497272 - DNA, 22 bp, Homo sapiens
ttgacaagcgaagtaccataat

SEQ ID NO: 9497273 - DNA, 22 bp, Homo sapiens
ttgacaaatacccattagacca

SEQ ID NO: 9497274 - DNA, 22 bp, Homo sapiens
ttgacaaatacccattagacca

SEQ ID NO: 9497275 - DNA, 22 bp, Homo sapiens
ttgacaaagtttagtaataatc

SEQ ID NO: 9497276 - DNA, 22 bp, Homo sapiens
ttgacaaagtttagtaataatc

SEQ ID NO: 9497277 - DNA, 22 bp, Homo sapiens
ttgacaaagtttagtaataatc

SEQ ID NO: 9497278 - DNA, 22 bp, Homo sapiens
ttgtgtctgggggagtgacatc

SEQ ID NO: 9497279 - DNA, 22 bp, Homo sapiens
ttgtgtctggatttcagctttc

SEQ ID NO: 9497280 - DNA, 22 bp, Homo sapiens
ttgtgtctgggggagtgacatc

SEQ ID NO: 9497281 - DNA, 22 bp, Homo sapiens
ttgtgtcttaaagattaaatgg

SEQ ID NO: 9497282 - DNA, 22 bp, Homo sapiens
ttgtgtctatggtttgagcatc

SEQ ID NO: 9497283 - DNA, 22 bp, Homo sapiens
ttgtgtctggaatgcgtggagc

SEQ ID NO: 9497284 - DNA, 22 bp, Homo sapiens
ttgtgtctaaataaggagacct

SEQ ID NO: 9497285 - DNA, 22 bp, Homo sapiens
ttgtgtctaaataaggagacct

SEQ ID NO: 9497286 - DNA, 23 bp, Homo sapiens
ttgtgtctacttcctatctaggg

SEQ ID NO: 9497287 - DNA, 22 bp, Homo sapiens
ttgtgtctaaataaggagacct

SEQ ID NO: 9497288 - DNA, 22 bp, Homo sapiens
ttgtggcatgtgagaactagaa

SEQ ID NO: 9497289 - DNA, 22 bp, Homo sapiens
ttgtggcatgtgagaactagaa

SEQ ID NO: 9497290 - DNA, 22 bp, Homo sapiens
ttgtccatctgtatttcccatg

SEQ ID NO: 9497291 - DNA, 22 bp, Homo sapiens
ttgtcattggggttatttgtta

SEQ ID NO: 9497292 - DNA, 22 bp, Homo sapiens
ttgtccaaggtcccacagttag

SEQ ID NO: 9497293 - DNA, 22 bp, Homo sapiens
ttgtcaggaactatgattatgc

SEQ ID NO: 9497294 - DNA, 22 bp, Homo sapiens
ttgtcatatttataaaatgtaa

SEQ ID NO: 9497295 - DNA, 22 bp, Homo sapiens
ttgtcaagtaaggctgacattt

SEQ ID NO: 9497296 - DNA, 22 bp, Homo sapiens
ttgtcaaggcttttaatattct

SEQ ID NO: 9497297 - DNA, 22 bp, Homo sapiens
ttgtcaagaaaaatggatgaag

SEQ ID NO: 9497298 - DNA, 22 bp, Homo sapiens
ttgtcaagattgagagatgact

SEQ ID NO: 9497299 - DNA, 19 bp, Homo sapiens
ttgtcacaattcatcaggt

SEQ ID NO: 9497300 - DNA, 20 bp, Homo sapiens
ttgtcacagctttccatcag

SEQ ID NO: 9497301 - DNA, 22 bp, Homo sapiens
ttgtacaagttttgagcttaag

SEQ ID NO: 9497302 - DNA, 22 bp, Homo sapiens
ttgtacaatggatgccagatga

SEQ ID NO: 9497303 - DNA, 22 bp, Homo sapiens
ttgtacaatggatgccagatga

SEQ ID NO: 9497304 - DNA, 22 bp, Homo sapiens
ttgtacacaattcttaacatac

SEQ ID NO: 9497305 - DNA, 22 bp, Homo sapiens
ttgtaagtcacaccagggcagg

SEQ ID NO: 9497306 - DNA, 22 bp, Homo sapiens
ttgtaagtcacaccagggcagg

SEQ ID NO: 9497307 - DNA, 22 bp, Homo sapiens
ttgtaaggaatgcagaatctca

SEQ ID NO: 9497308 - DNA, 22 bp, Homo sapiens
ttgtacaagttttgagcttaag

SEQ ID NO: 9497309 - DNA, 22 bp, Homo sapiens
ttgtacaagtattatgtgaaca

SEQ ID NO: 9497310 - DNA, 22 bp, Homo sapiens
ttgtattttttcctggcggtgg

SEQ ID NO: 9497311 - DNA, 23 bp, Homo sapiens
ttgtatttttagtagagacaggg

SEQ ID NO: 9497312 - DNA, 22 bp, Homo sapiens
ttgtatttcgatgcacgtgtag

SEQ ID NO: 9497313 - DNA, 22 bp, Homo sapiens
ttgtatttcgatgcacgtgtag

SEQ ID NO: 9497314 - DNA, 22 bp, Homo sapiens
ttgtatttctccactttctgtt

SEQ ID NO: 9497315 - DNA, 22 bp, Homo sapiens
ttgtatttcctataacctttct

SEQ ID NO: 9497316 - DNA, 22 bp, Homo sapiens
ttgtacagggaagtaatacaag

SEQ ID NO: 9497317 - DNA, 22 bp, Homo sapiens
ttgtacagggaagtaatacaag

SEQ ID NO: 9497318 - DNA, 22 bp, Homo sapiens
ttgtactatcaccatgtcatgt

SEQ ID NO: 9497319 - DNA, 22 bp, Homo sapiens
ttgtactatcaccatgtcatgt

SEQ ID NO: 9497320 - DNA, 22 bp, Homo sapiens
ttgtactagaaaggatgtcaaa

SEQ ID NO: 9497321 - DNA, 22 bp, Homo sapiens
ttgtactagaaaattattcttt

SEQ ID NO: 9497322 - DNA, 23 bp, Homo sapiens
ttgtaaaacagtgtgacggttcc

SEQ ID NO: 9497323 - DNA, 22 bp, Homo sapiens
ttgtaaacatctgttgcttaga

SEQ ID NO: 9497324 - DNA, 22 bp, Homo sapiens
ttgtaaacatagagatttaggt

SEQ ID NO: 9497325 - DNA, 22 bp, Homo sapiens
ttgtaaactgttaaaagccaga

SEQ ID NO: 9497326 - DNA, 22 bp, Homo sapiens
ttgtaaactgttaaaagccaga

SEQ ID NO: 9497327 - DNA, 22 bp, Homo sapiens
ttgtaaactgctgcaggagtgc

SEQ ID NO: 9497328 - DNA, 22 bp, Homo sapiens
ttgtaaacttgtttgaaggtat

SEQ ID NO: 9497329 - DNA, 22 bp, Homo sapiens
ttgtaaacttgtttgaaggtat

SEQ ID NO: 9497330 - DNA, 22 bp, Homo sapiens
ttgtaaactggatagacctatt

SEQ ID NO: 9497331 - DNA, 22 bp, Homo sapiens
ttgggcctgatcggaataagga

SEQ ID NO: 9497332 - DNA, 22 bp, Homo sapiens
ttgtaaagatgcttcccattct

SEQ ID NO: 9497333 - DNA, 22 bp, Homo sapiens
ttgtaaagtacttagcacagca

SEQ ID NO: 9497334 - DNA, 22 bp, Homo sapiens
ttgtaaatgaccttttctaatt

SEQ ID NO: 9497335 - DNA, 22 bp, Homo sapiens
ttgtaaatagtagtaagatgcc

SEQ ID NO: 9497336 - DNA, 22 bp, Homo sapiens
ttgtaaatagtagtaagatgcc

SEQ ID NO: 9497337 - DNA, 22 bp, Homo sapiens
ttgtaacaggtactaaataact

SEQ ID NO: 9497338 - DNA, 22 bp, Homo sapiens
ttgtaacaggtactaaataact

SEQ ID NO: 9497339 - DNA, 22 bp, Homo sapiens
ttgtaacaggtactaaataact

SEQ ID NO: 9497340 - DNA, 22 bp, Homo sapiens
ttgtaacaggtactaaataact

SEQ ID NO: 9497341 - DNA, 22 bp, Homo sapiens
ttgtaacatcaccatcaaaatc

SEQ ID NO: 9497342 - DNA, 22 bp, Homo sapiens
ttgtaacatcaccatcaaaatc

SEQ ID NO: 9497343 - DNA, 22 bp, Homo sapiens
ttgtaacatcaccatcaaaatc

SEQ ID NO: 9497344 - DNA, 22 bp, Homo sapiens
ttgtaacagctgcttaatagag

SEQ ID NO: 9497345 - DNA, 22 bp, Homo sapiens
ttgtaacacttttctattaata

SEQ ID NO: 9497346 - DNA, 22 bp, Homo sapiens
ttgtaacagctgtttatatagt

SEQ ID NO: 9497347 - DNA, 22 bp, Homo sapiens
ttgtaacagctgcttaatagag

SEQ ID NO: 9497348 - DNA, 21 bp, Homo sapiens
ttgtaaatggctttttccttc

SEQ ID NO: 9497349 - DNA, 22 bp, Homo sapiens
ttgtaacaaagacactccaaaa

SEQ ID NO: 9497350 - DNA, 22 bp, Homo sapiens
ttgtaacaatctgtcataaatg

SEQ ID NO: 9497351 - DNA, 22 bp, Homo sapiens
ttgtaacaatctgtcataaatg

SEQ ID NO: 9497352 - DNA, 22 bp, Homo sapiens
ttgtaacaatctgtcataaatg

SEQ ID NO: 9497353 - DNA, 22 bp, Homo sapiens
ttgggcagtgattagttcatga

SEQ ID NO: 9497354 - DNA, 22 bp, Homo sapiens
ttgggccaaagatgtccttgtt

SEQ ID NO: 9497355 - DNA, 22 bp, Homo sapiens
ttgggcaggtgaagagagggct

SEQ ID NO: 9497356 - DNA, 22 bp, Homo sapiens
ttgggcagtagcctcttggtgt

SEQ ID NO: 9497357 - DNA, 22 bp, Homo sapiens
ttgggcagggaaaggacaggca

SEQ ID NO: 9497358 - DNA, 22 bp, Homo sapiens
ttgggcagggaaaggacaggca

SEQ ID NO: 9497359 - DNA, 22 bp, Homo sapiens
ttgggagcttggacttagtgtg

SEQ ID NO: 9497360 - DNA, 22 bp, Homo sapiens
ttgggagatggggagataatat

SEQ ID NO: 9497361 - DNA, 22 bp, Homo sapiens
ttgggagatggggagataatat

SEQ ID NO: 9497362 - DNA, 22 bp, Homo sapiens
ttgggagatattgttctttaca

SEQ ID NO: 9497363 - DNA, 22 bp, Homo sapiens
ttgggagctggaagcaaggcct

SEQ ID NO: 9497364 - DNA, 22 bp, Homo sapiens
ttgggacagctgtggtagtgag

SEQ ID NO: 9497365 - DNA, 22 bp, Homo sapiens
ttgggacatctggcatacagtt

SEQ ID NO: 9497366 - DNA, 22 bp, Homo sapiens
ttgggacatctggcatacagtt

SEQ ID NO: 9497367 - DNA, 22 bp, Homo sapiens
ttgggacatctggcatacagtt

SEQ ID NO: 9497368 - DNA, 22 bp, Homo sapiens
ttgggacattatcagtctgcag

SEQ ID NO: 9497369 - DNA, 22 bp, Homo sapiens
ttgggacattatcagtctgcag

SEQ ID NO: 9497370 - DNA, 22 bp, Homo sapiens
ttgggacatgtaagctggaagt

SEQ ID NO: 9497371 - DNA, 22 bp, Homo sapiens
ttgggacatgtaagctggaagt

SEQ ID NO: 9497372 - DNA, 17 bp, Homo sapiens
ttgggagagaaaggtat

SEQ ID NO: 9497373 - DNA, 17 bp, Homo sapiens
ttgggagagaaaggtat

SEQ ID NO: 9497374 - DNA, 22 bp, Homo sapiens
ttgggaaggcgtggaagcagaa

SEQ ID NO: 9497375 - DNA, 22 bp, Homo sapiens
ttgggaaggcgtggaagcagaa

SEQ ID NO: 9497376 - DNA, 22 bp, Homo sapiens
ttggcccacagtaccatgctgt

SEQ ID NO: 9497377 - DNA, 22 bp, Homo sapiens
ttgggacagaaaaggagaagat

SEQ ID NO: 9497378 - DNA, 22 bp, Homo sapiens
ttgggacaaagactccttgaat

SEQ ID NO: 9497379 - DNA, 22 bp, Homo sapiens
ttgggacaagagatagctctga

SEQ ID NO: 9497380 - DNA, 20 bp, Homo sapiens
ttgggacacttgctttgcta

SEQ ID NO: 9497381 - DNA, 22 bp, Homo sapiens
ttgggacaaagactccttgaat

SEQ ID NO: 9497382 - DNA, 22 bp, Homo sapiens
ttgggacagcactgctacccct

SEQ ID NO: 9497383 - DNA, 22 bp, Homo sapiens
ttgggacagctgtggtagtgag

SEQ ID NO: 9497384 - DNA, 22 bp, Homo sapiens
ttgggacagcaacggttctgtt

SEQ ID NO: 9497385 - DNA, 22 bp, Homo sapiens
ttgggacagcaacggttctgtt

SEQ ID NO: 9497386 - DNA, 22 bp, Homo sapiens
ttgggacagcaaccatctgcta

SEQ ID NO: 9497387 - DNA, 22 bp, Homo sapiens
ttgggacagaaaaggagaagat

SEQ ID NO: 9497388 - DNA, 22 bp, Homo sapiens
ttgggacagaaaaggagaagat

SEQ ID NO: 9497389 - DNA, 22 bp, Homo sapiens
ttgggacagagctggggctgga

SEQ ID NO: 9497390 - DNA, 22 bp, Homo sapiens
ttgggacagcaaccatctgcta

SEQ ID NO: 9497391 - DNA, 22 bp, Homo sapiens
ttggccagcagctctggcttag

SEQ ID NO: 9497392 - DNA, 22 bp, Homo sapiens
ttggccagcgacgaccttctta

SEQ ID NO: 9497393 - DNA, 22 bp, Homo sapiens
ttggcatccactttgcaagttt

SEQ ID NO: 9497394 - DNA, 22 bp, Homo sapiens
ttggccagcgacgaccttctta

SEQ ID NO: 9497395 - DNA, 22 bp, Homo sapiens
ttggccagcgacgaccttctta

SEQ ID NO: 9497396 - DNA, 22 bp, Homo sapiens
ttggccaggtccatttctccat

SEQ ID NO: 9497397 - DNA, 22 bp, Homo sapiens
ttggccaggcatgaataaaaga

SEQ ID NO: 9497398 - DNA, 22 bp, Homo sapiens
ttggccagctctggaaagtggt

SEQ ID NO: 9497399 - DNA, 22 bp, Homo sapiens
ttggccagctctggaaagtggt

SEQ ID NO: 9497400 - DNA, 22 bp, Homo sapiens
ttggcataccttagtggtggag

SEQ ID NO: 9497401 - DNA, 22 bp, Homo sapiens
ttggcataccttagtggtggag

SEQ ID NO: 9497402 - DNA, 22 bp, Homo sapiens
ttggcatcagtgtaggacctgt

SEQ ID NO: 9497403 - DNA, 22 bp, Homo sapiens
ttggcatccactttgcaagttt

SEQ ID NO: 9497404 - DNA, 22 bp, Homo sapiens
ttggccagtgaaccaggcctgg

SEQ ID NO: 9497405 - DNA, 22 bp, Homo sapiens
ttggccagtgcttgtgattttc

SEQ ID NO: 9497406 - DNA, 22 bp, Homo sapiens
ttggccagtgaaccaggcctgg

SEQ ID NO: 9497407 - DNA, 22 bp, Homo sapiens
ttggccaggtgtaggtcacacc

SEQ ID NO: 9497408 - DNA, 22 bp, Homo sapiens
ttggccaggtgtaggtcacacc

SEQ ID NO: 9497409 - DNA, 22 bp, Homo sapiens
ttggccaggtgtccagcccagg

SEQ ID NO: 9497410 - DNA, 22 bp, Homo sapiens
ttggccaggtgtccagcccagg

SEQ ID NO: 9497411 - DNA, 22 bp, Homo sapiens
ttggccagtggaaagaggagga

SEQ ID NO: 9497412 - DNA, 22 bp, Homo sapiens
ttggccagtggaaagaggagga

SEQ ID NO: 9497413 - DNA, 22 bp, Homo sapiens
ttggccagtggaaagaggagga

SEQ ID NO: 9497414 - DNA, 22 bp, Homo sapiens
ttggccaggtccatttctccat

SEQ ID NO: 9497415 - DNA, 22 bp, Homo sapiens
ttggccatctaagcccagccac

SEQ ID NO: 9497416 - DNA, 22 bp, Homo sapiens
ttggccagtgaaccaggcctgg

SEQ ID NO: 9497417 - DNA, 22 bp, Homo sapiens
ttggcagcagggagttggccgc

SEQ ID NO: 9497418 - DNA, 20 bp, Homo sapiens
ttggcagcagttccaagtga

SEQ ID NO: 9497419 - DNA, 22 bp, Homo sapiens
ttggcagcatacagttggattg

SEQ ID NO: 9497420 - DNA, 22 bp, Homo sapiens
ttggcagcatccaagtctcggg

SEQ ID NO: 9497421 - DNA, 22 bp, Homo sapiens
ttggcagcattccagccaagca

SEQ ID NO: 9497422 - DNA, 22 bp, Homo sapiens
ttggaggaggcattggaggatt

SEQ ID NO: 9497423 - DNA, 22 bp, Homo sapiens
ttggaggaaattgcttttgtgg

SEQ ID NO: 9497424 - DNA, 22 bp, Homo sapiens
ttggcagctcttgatggcaccc

SEQ ID NO: 9497425 - DNA, 22 bp, Homo sapiens
ttggcagctgcacagactccat

SEQ ID NO: 9497426 - DNA, 19 bp, Homo sapiens
ttggcagctgagatcctgc

SEQ ID NO: 9497427 - DNA, 22 bp, Homo sapiens
ttggcagctgttggaccttgac

SEQ ID NO: 9497428 - DNA, 20 bp, Homo sapiens
ttggcagcttcagggtacta

SEQ ID NO: 9497429 - DNA, 22 bp, Homo sapiens
ttggcagccaggacccgcctgg

SEQ ID NO: 9497430 - DNA, 22 bp, Homo sapiens
ttggcagcccagcttactagca

SEQ ID NO: 9497431 - DNA, 22 bp, Homo sapiens
ttggcagccctgacccaatggg

SEQ ID NO: 9497432 - DNA, 22 bp, Homo sapiens
ttggcagcggggaccctggctg

SEQ ID NO: 9497433 - DNA, 22 bp, Homo sapiens
ttggcagctacttccccagtgc

SEQ ID NO: 9497434 - DNA, 23 bp, Homo sapiens
ttggcagcgggtcaggctgtggg

SEQ ID NO: 9497435 - DNA, 20 bp, Homo sapiens
ttggcagttaagaatcttac

SEQ ID NO: 9497436 - DNA, 22 bp, Homo sapiens
ttggcagtgtcactagggagcc

SEQ ID NO: 9497437 - DNA, 21 bp, Homo sapiens
ttggcagtcagaaatgtgagg

SEQ ID NO: 9497438 - DNA, 22 bp, Homo sapiens
ttggcagtcagtcttggtgctt

SEQ ID NO: 9497439 - DNA, 22 bp, Homo sapiens
ttggcagtctcagtcagatggc

SEQ ID NO: 9497440 - DNA, 22 bp, Homo sapiens
ttggcagggcatcagacacgtg

SEQ ID NO: 9497441 - DNA, 22 bp, Homo sapiens
ttggcagtaaaagaaaatgctt

SEQ ID NO: 9497442 - DNA, 22 bp, Homo sapiens
ttggcagtagtggtagtacatt

SEQ ID NO: 9497443 - DNA, 22 bp, Homo sapiens
ttggagagaggctgctcaggct

SEQ ID NO: 9497444 - DNA, 22 bp, Homo sapiens
ttggagaatgttttcctgcagt

SEQ ID NO: 9497445 - DNA, 22 bp, Homo sapiens
ttggagaatgttttcctgcagt

SEQ ID NO: 9497446 - DNA, 22 bp, Homo sapiens
ttggagaactggcatttttaat

SEQ ID NO: 9497447 - DNA, 21 bp, Homo sapiens
ttggagaagtgctatcagtat

SEQ ID NO: 9497448 - DNA, 18 bp, Homo sapiens
ttggacctgtgtcagggc

SEQ ID NO: 9497449 - DNA, 18 bp, Homo sapiens
ttggacctgtgtcagggc

SEQ ID NO: 9497450 - DNA, 22 bp, Homo sapiens
ttggacctcagttattctatca

SEQ ID NO: 9497451 - DNA, 23 bp, Homo sapiens
ttggaccactactgttttctctt

SEQ ID NO: 9497452 - DNA, 17 bp, Homo sapiens
ttggaccagattctaaa

SEQ ID NO: 9497453 - DNA, 22 bp, Homo sapiens
ttggaccagtggattatggtgg

SEQ ID NO: 9497454 - DNA, 22 bp, Homo sapiens
ttggacagtactttaaagcaga

SEQ ID NO: 9497455 - DNA, 22 bp, Homo sapiens
ttggagagtgatattcagatgc

SEQ ID NO: 9497456 - DNA, 22 bp, Homo sapiens
ttggagagggcttggatcacac

SEQ ID NO: 9497457 - DNA, 22 bp, Homo sapiens
ttggagccatgcccagctctct

SEQ ID NO: 9497458 - DNA, 22 bp, Homo sapiens
ttggagccctgaggatctggat

SEQ ID NO: 9497459 - DNA, 22 bp, Homo sapiens
ttggagatatcacaccttcaca

SEQ ID NO: 9497460 - DNA, 22 bp, Homo sapiens
ttggagatatcacaccttcaca

SEQ ID NO: 9497461 - DNA, 22 bp, Homo sapiens
ttggagatgtaaaattcagaga

SEQ ID NO: 9497462 - DNA, 22 bp, Homo sapiens
ttggagagttaattgacagtta

SEQ ID NO: 9497463 - DNA, 22 bp, Homo sapiens
ttggagatatcacaccttcaca

SEQ ID NO: 9497464 - DNA, 22 bp, Homo sapiens
tttacagtcaccaaactttgct

SEQ ID NO: 9497465 - DNA, 22 bp, Homo sapiens
tttacagtaaggtggatggtac

SEQ ID NO: 9497466 - DNA, 22 bp, Homo sapiens
tttacagtctctatagtcaaaa

SEQ ID NO: 9497467 - DNA, 22 bp, Homo sapiens
tttacagtctgtctagcaatgt

SEQ ID NO: 9497468 - DNA, 22 bp, Homo sapiens
tttacagtctgtctagcaatgt

SEQ ID NO: 9497469 - DNA, 22 bp, Homo sapiens
tttacagtctatgttgaattaa

SEQ ID NO: 9497470 - DNA, 22 bp, Homo sapiens
tttacagtctatgttgaattaa

SEQ ID NO: 9497471 - DNA, 22 bp, Homo sapiens
tttaatgtattctttggaacca

SEQ ID NO: 9497472 - DNA, 22 bp, Homo sapiens
tttaatgtgacatcttttagag

SEQ ID NO: 9497473 - DNA, 22 bp, Homo sapiens
tttaatgtagcgtgaaatgatt

SEQ ID NO: 9497474 - DNA, 22 bp, Homo sapiens
tttaatgggatccatctggtta

SEQ ID NO: 9497475 - DNA, 22 bp, Homo sapiens
tttaatgatagtcttacgaaaa

SEQ ID NO: 9497476 - DNA, 23 bp, Homo sapiens
tttaatgaccaatagaaggaaca

SEQ ID NO: 9497477 - DNA, 22 bp, Homo sapiens
tttaagggatattttgatagct

SEQ ID NO: 9497478 - DNA, 22 bp, Homo sapiens
tttaagggattgtgattttcac

SEQ ID NO: 9497479 - DNA, 22 bp, Homo sapiens
tttaagggtggaggaacaaatg

SEQ ID NO: 9497480 - DNA, 22 bp, Homo sapiens
tttaatgaataattcaaatctg

SEQ ID NO: 9497481 - DNA, 23 bp, Homo sapiens
tttaatgaccaatagaaggaaca

SEQ ID NO: 9497482 - DNA, 22 bp, Homo sapiens
tttaagtgaaatgtaatacagt

SEQ ID NO: 9497483 - DNA, 22 bp, Homo sapiens
tttaagtgatgaaatgcagata

SEQ ID NO: 9497484 - DNA, 22 bp, Homo sapiens
tttaatctattccctaaacacc

SEQ ID NO: 9497485 - DNA, 19 bp, Homo sapiens
tttaagcaatagtatcttg

SEQ ID NO: 9497486 - DNA, 22 bp, Homo sapiens
tttaagcacagggataaagtta

SEQ ID NO: 9497487 - DNA, 22 bp, Homo sapiens
tttaagcaagttgacatagcat

SEQ ID NO: 9497488 - DNA, 22 bp, Homo sapiens
tttaagatttcttctcctgaga

SEQ ID NO: 9497489 - DNA, 22 bp, Homo sapiens
tttaagattcagtaaggcaaac

SEQ ID NO: 9497490 - DNA, 22 bp, Homo sapiens
tttaagatggtattttataaag

SEQ ID NO: 9497491 - DNA, 22 bp, Homo sapiens
tttaagcagagaaatgatgtat

SEQ ID NO: 9497492 - DNA, 22 bp, Homo sapiens
tttaagcacagggataaagtta

SEQ ID NO: 9497493 - DNA, 22 bp, Homo sapiens
tttaaatgtttaaaactcgtga

SEQ ID NO: 9497494 - DNA, 22 bp, Homo sapiens
tttaaatgttcatgatactgaa

SEQ ID NO: 9497495 - DNA, 22 bp, Homo sapiens
tttaaatgtttaaaactcgtga

SEQ ID NO: 9497496 - DNA, 22 bp, Homo sapiens
tttaaatgtttaaaactcgtga

SEQ ID NO: 9497497 - DNA, 22 bp, Homo sapiens
tttaagatggtattttataaag

SEQ ID NO: 9497498 - DNA, 22 bp, Homo sapiens
tttaagatggtattttataaag

SEQ ID NO: 9497499 - DNA, 22 bp, Homo sapiens
tttaagatggtattttataaag

SEQ ID NO: 9497500 - DNA, 22 bp, Homo sapiens
tttaaatgtttatagagagtac

SEQ ID NO: 9497501 - DNA, 22 bp, Homo sapiens
tttaaatgtttatagagagtac

SEQ ID NO: 9497502 - DNA, 22 bp, Homo sapiens
tttaaatgttcatgatactgaa

SEQ ID NO: 9497503 - DNA, 22 bp, Homo sapiens
tttaaatgtgttcttagtagct

SEQ ID NO: 9497504 - DNA, 22 bp, Homo sapiens
tttaaatgtgttcttagtagct

SEQ ID NO: 9497505 - DNA, 22 bp, Homo sapiens
tttaaatgtgttcttagtagct

SEQ ID NO: 9497506 - DNA, 22 bp, Homo sapiens
tttaaatggcattttcccagat

SEQ ID NO: 9497507 - DNA, 22 bp, Homo sapiens
tttaaatggcattttcccagat

SEQ ID NO: 9497508 - DNA, 22 bp, Homo sapiens
tttaaatgctttaagcaagggt

SEQ ID NO: 9497509 - DNA, 22 bp, Homo sapiens
tttaaatgcagacgttgattca

SEQ ID NO: 9497510 - DNA, 22 bp, Homo sapiens
tttaaatgcagacgttgattca

SEQ ID NO: 9497511 - DNA, 22 bp, Homo sapiens
tttaaatgcagacgttgattca

SEQ ID NO: 9497512 - DNA, 22 bp, Homo sapiens
tttaaataggactcctgggggt

SEQ ID NO: 9497513 - DNA, 22 bp, Homo sapiens
tttaaataggactcctgggggt

SEQ ID NO: 9497514 - DNA, 22 bp, Homo sapiens
tttaaataggactcctgggggt

SEQ ID NO: 9497515 - DNA, 22 bp, Homo sapiens
tttaaatgcagacgttgattca

SEQ ID NO: 9497516 - DNA, 22 bp, Homo sapiens
tttaaataggactcctgggggt

SEQ ID NO: 9497517 - DNA, 22 bp, Homo sapiens
tttaaagtgctgctcctatcct

SEQ ID NO: 9497518 - DNA, 22 bp, Homo sapiens
tttaaagtggtccatttcagaa

SEQ ID NO: 9497519 - DNA, 22 bp, Homo sapiens
tttaaagtttttgcacattctg

SEQ ID NO: 9497520 - DNA, 22 bp, Homo sapiens
tttaaataggactcctgggggt

SEQ ID NO: 9497521 - DNA, 22 bp, Homo sapiens
tttaaagagaatgtgaaggagt

SEQ ID NO: 9497522 - DNA, 22 bp, Homo sapiens
tttaaagagaatgtgaaggagt

SEQ ID NO: 9497523 - DNA, 19 bp, Homo sapiens
tttaaagtgactggtattt

SEQ ID NO: 9497524 - DNA, 21 bp, Homo sapiens
tttaaagaataggaagggagg

SEQ ID NO: 9497525 - DNA, 22 bp, Homo sapiens
tttaaagaaattcctcatcttt

SEQ ID NO: 9497526 - DNA, 22 bp, Homo sapiens
tttaaagaaattcctcatcttt

SEQ ID NO: 9497527 - DNA, 22 bp, Homo sapiens
tttaaactaacagtacacgttg

SEQ ID NO: 9497528 - DNA, 22 bp, Homo sapiens
tttaaactgttgattttatgaa

SEQ ID NO: 9497529 - DNA, 17 bp, Homo sapiens
tttaaactactacaagg

SEQ ID NO: 9497530 - DNA, 17 bp, Homo sapiens
tttaaactactacaagg

SEQ ID NO: 9497531 - DNA, 17 bp, Homo sapiens
ttgtgtgtagttctgat

SEQ ID NO: 9497532 - DNA, 22 bp, Homo sapiens
tttaaacatcttgttgccttaa

SEQ ID NO: 9497533 - DNA, 22 bp, Homo sapiens
tttaaacatcttgttgccttaa

SEQ ID NO: 9497534 - DNA, 22 bp, Homo sapiens
tttaaacatcttgttgccttaa

SEQ ID NO: 9497535 - DNA, 22 bp, Homo sapiens
tttaaacatcttgttgccttaa

SEQ ID NO: 9497536 - DNA, 22 bp, Homo sapiens
ttgtgtgtagactcagccattg

SEQ ID NO: 9497537 - DNA, 22 bp, Homo sapiens
ttgtgtgtagactcagccattg

SEQ ID NO: 9497538 - DNA, 17 bp, Homo sapiens
ttgtgtgtagttctgat

SEQ ID NO: 9497539 - DNA, 17 bp, Homo sapiens
ttgtgtgtagttctgat

SEQ ID NO: 9497540 - DNA, 22 bp, Homo sapiens
ttgtgtgtagactcagccattg

SEQ ID NO: 9497541 - DNA, 17 bp, Homo sapiens
ttgtgtgtagttctgat

SEQ ID NO: 9497542 - DNA, 17 bp, Homo sapiens
ttgtgtgtagttctgat

SEQ ID NO: 9497543 - DNA, 22 bp, Homo sapiens
ttgtgtgtagactcagccattg

SEQ ID NO: 9497544 - DNA, 22 bp, Homo sapiens
ttgtgtgtagactcagccattg

SEQ ID NO: 9497545 - DNA, 22 bp, Homo sapiens
ttgtgtgtactggttatgggca

SEQ ID NO: 9497546 - DNA, 22 bp, Homo sapiens
ttgtgtgtactggttatgggca

SEQ ID NO: 9497547 - DNA, 22 bp, Homo sapiens
ttgtgtgtactggttatgggca

SEQ ID NO: 9497548 - DNA, 22 bp, Homo sapiens
ttgtgtgtactggttatgggca

SEQ ID NO: 9497549 - DNA, 22 bp, Homo sapiens
ttgtgtgcataaattctgatgt

SEQ ID NO: 9497550 - DNA, 22 bp, Homo sapiens
ttgtgtgctgagggcctgctgt

SEQ ID NO: 9497551 - DNA, 22 bp, Homo sapiens
ttgtgtgataagtctcttgtgc

SEQ ID NO: 9497552 - DNA, 22 bp, Homo sapiens
ttgtgtgtactggttatgggca

SEQ ID NO: 9497553 - DNA, 20 bp, Homo sapiens
tttacattttgaaacagtga

SEQ ID NO: 9497554 - DNA, 20 bp, Homo sapiens
tttacattttgaaacagtga

SEQ ID NO: 9497555 - DNA, 20 bp, Homo sapiens
tttacattttgaaacagtga

SEQ ID NO: 9497556 - DNA, 20 bp, Homo sapiens
tttacattttgaaacagtga

SEQ ID NO: 9497557 - DNA, 20 bp, Homo sapiens
tttacattttgaaacagtga

SEQ ID NO: 9497558 - DNA, 22 bp, Homo sapiens
tttacagtctgtctagcaatgt

SEQ ID NO: 9497559 - DNA, 22 bp, Homo sapiens
tttacagtgagagcttagtgag

SEQ ID NO: 9497560 - DNA, 22 bp, Homo sapiens
tttacagtgagagcttagtgag

SEQ ID NO: 9497561 - DNA, 22 bp, Homo sapiens
tttagaagggctggtcagaaat

SEQ ID NO: 9497562 - DNA, 22 bp, Homo sapiens
tttagaagttcacacatttaaa

SEQ ID NO: 9497563 - DNA, 19 bp, Homo sapiens
tttagaagttgaaactctg

SEQ ID NO: 9497564 - DNA, 17 bp, Homo sapiens
tttagaatacaatgttt

SEQ ID NO: 9497565 - DNA, 22 bp, Homo sapiens
tttagaaggactacagtgtgat

SEQ ID NO: 9497566 - DNA, 20 bp, Homo sapiens
tttaccaactcaccagtatc

SEQ ID NO: 9497567 - DNA, 22 bp, Homo sapiens
tttaccaagctttaattacata

SEQ ID NO: 9497568 - DNA, 22 bp, Homo sapiens
tttaccaaggcatagtaatctc

SEQ ID NO: 9497569 - DNA, 22 bp, Homo sapiens
tttaccaagctttaattacata

SEQ ID NO: 9497570 - DNA, 22 bp, Homo sapiens
tttagattgtgacctcccccca

SEQ ID NO: 9497571 - DNA, 22 bp, Homo sapiens
tttagcaaaacattatgtctgt

SEQ ID NO: 9497572 - DNA, 22 bp, Homo sapiens
tttagcaaaacattatgtctgt

SEQ ID NO: 9497573 - DNA, 22 bp, Homo sapiens
tttagcaaattactcacagggt

SEQ ID NO: 9497574 - DNA, 22 bp, Homo sapiens
tttagcaaggtaggtccatgga

SEQ ID NO: 9497575 - DNA, 22 bp, Homo sapiens
tttagcaaggagaaataatcct

SEQ ID NO: 9497576 - DNA, 22 bp, Homo sapiens
tttagcaaggagaaataatcct

SEQ ID NO: 9497577 - DNA, 22 bp, Homo sapiens
tttagaggttagaggctgatag

SEQ ID NO: 9497578 - DNA, 22 bp, Homo sapiens
tttagaggttggggactttgca

SEQ ID NO: 9497579 - DNA, 22 bp, Homo sapiens
tttagaggggaaagtggctggt

SEQ ID NO: 9497580 - DNA, 22 bp, Homo sapiens
tttagaggaattgggagaacgt

SEQ ID NO: 9497581 - DNA, 17 bp, Homo sapiens
tttagaatacaatgttt

SEQ ID NO: 9497582 - DNA, 22 bp, Homo sapiens
tttagagaggctctgtaaaatg

SEQ ID NO: 9497583 - DNA, 22 bp, Homo sapiens
tttagagagaattttcaaagtg

SEQ ID NO: 9497584 - DNA, 22 bp, Homo sapiens
tttatatttcccaggattggcc

SEQ ID NO: 9497585 - DNA, 22 bp, Homo sapiens
tttatattgtaaaaatggttct

SEQ ID NO: 9497586 - DNA, 22 bp, Homo sapiens
tttatattgtaaaaatggttct

SEQ ID NO: 9497587 - DNA, 22 bp, Homo sapiens
tttatattgtaaaaatggttct

SEQ ID NO: 9497588 - DNA, 22 bp, Homo sapiens
tttatattgggagtcgttttga

SEQ ID NO: 9497589 - DNA, 22 bp, Homo sapiens
tttatattgtaaaaatggttct

SEQ ID NO: 9497590 - DNA, 22 bp, Homo sapiens
tttatattgtaaaaatggttct

SEQ ID NO: 9497591 - DNA, 22 bp, Homo sapiens
tttatattgggagtcgttttga

SEQ ID NO: 9497592 - DNA, 22 bp, Homo sapiens
tttatattgggagtcgttttga

SEQ ID NO: 9497593 - DNA, 22 bp, Homo sapiens
tttatatatggctggtctggat

SEQ ID NO: 9497594 - DNA, 22 bp, Homo sapiens
tttatatagagatttgtgcatg

SEQ ID NO: 9497595 - DNA, 22 bp, Homo sapiens
tttatatagagatttgtgcatg

SEQ ID NO: 9497596 - DNA, 22 bp, Homo sapiens
tttatatatggctggtctggat

SEQ ID NO: 9497597 - DNA, 22 bp, Homo sapiens
tttagcagaatttctctagaag

SEQ ID NO: 9497598 - DNA, 22 bp, Homo sapiens
tttagcagagcatatgatatcc

SEQ ID NO: 9497599 - DNA, 22 bp, Homo sapiens
tttagcagaatttctctagaag

SEQ ID NO: 9497600 - DNA, 22 bp, Homo sapiens
tttagcaataaagggatattaa

SEQ ID NO: 9497601 - DNA, 22 bp, Homo sapiens
tttagcaattagaatccagcat

SEQ ID NO: 9497602 - DNA, 22 bp, Homo sapiens
tttagcagagcatatgatatcc

SEQ ID NO: 9497603 - DNA, 22 bp, Homo sapiens
tttagcagcaaataagtagtgc

SEQ ID NO: 9497604 - DNA, 22 bp, Homo sapiens
tttagcatccaaggttatgact

SEQ ID NO: 9497605 - DNA, 22 bp, Homo sapiens
tttagcatatcctataaaacta

SEQ ID NO: 9497606 - DNA, 22 bp, Homo sapiens
tttatcagaggctatgtttcat

SEQ ID NO: 9497607 - DNA, 20 bp, Homo sapiens
tttatcaggcacttactatt

SEQ ID NO: 9497608 - DNA, 22 bp, Homo sapiens
tttatcaaacaaattatccagc

SEQ ID NO: 9497609 - DNA, 22 bp, Homo sapiens
tttatcaaacaaattatccagc

SEQ ID NO: 9497610 - DNA, 22 bp, Homo sapiens
tttatcaaacaaattatccagc

SEQ ID NO: 9497611 - DNA, 21 bp, Homo sapiens
tttatcatcacgagcttgagc

SEQ ID NO: 9497612 - DNA, 22 bp, Homo sapiens
tttatcatcttgtttttaaagc

SEQ ID NO: 9497613 - DNA, 22 bp, Homo sapiens
tttatccactcatccatgcctc

SEQ ID NO: 9497614 - DNA, 22 bp, Homo sapiens
tttatccaagcacaatttctaa

SEQ ID NO: 9497615 - DNA, 22 bp, Homo sapiens
tttatccaagggttttaactgt

SEQ ID NO: 9497616 - DNA, 22 bp, Homo sapiens
tttatccacagtatccaaaatc

SEQ ID NO: 9497617 - DNA, 22 bp, Homo sapiens
tttatccatcatctgctgaagg

SEQ ID NO: 9497618 - DNA, 22 bp, Homo sapiens
tttatccatcatctgctgaagg

SEQ ID NO: 9497619 - DNA, 22 bp, Homo sapiens
tttatccatcatctgctgaagg

SEQ ID NO: 9497620 - DNA, 22 bp, Homo sapiens
tttatccagcagctattcaaaa

SEQ ID NO: 9497621 - DNA, 22 bp, Homo sapiens
tttatccatatcattaaaatct

SEQ ID NO: 9497622 - DNA, 22 bp, Homo sapiens
tttatccagtgttggaattttt

SEQ ID NO: 9497623 - DNA, 22 bp, Homo sapiens
tttatctgagctgatagatagt

SEQ ID NO: 9497624 - DNA, 22 bp, Homo sapiens
tttattattctgttctctctac

SEQ ID NO: 9497625 - DNA, 22 bp, Homo sapiens
tttatctgaatatgctccccac

SEQ ID NO: 9497626 - DNA, 22 bp, Homo sapiens
tttatctgagctgatagatagt

SEQ ID NO: 9497627 - DNA, 22 bp, Homo sapiens
tttatctgagctgatagatagt

SEQ ID NO: 9497628 - DNA, 22 bp, Homo sapiens
tttattgacccaaagcgagagt

SEQ ID NO: 9497629 - DNA, 22 bp, Homo sapiens
tttattgacttcagtgagtctt

SEQ ID NO: 9497630 - DNA, 20 bp, Homo sapiens
tttattgagcacgtactgtg

SEQ ID NO: 9497631 - DNA, 22 bp, Homo sapiens
tttattgagtatctactatgtg

SEQ ID NO: 9497632 - DNA, 22 bp, Homo sapiens
tttcaaagggaagttatgaagt

SEQ ID NO: 9497633 - DNA, 22 bp, Homo sapiens
tttattgcatacacaaatgtca

SEQ ID NO: 9497634 - DNA, 22 bp, Homo sapiens
tttcaaagggaagttatgaagt

SEQ ID NO: 9497635 - DNA, 23 bp, Homo sapiens
tttcaacaatgcttagagaaaac

SEQ ID NO: 9497636 - DNA, 22 bp, Homo sapiens
tttcaacagaatatgatcagag

SEQ ID NO: 9497637 - DNA, 22 bp, Homo sapiens
tttcaacagaatatgatcagag

SEQ ID NO: 9497638 - DNA, 22 bp, Homo sapiens
tttcaacagatctgtcttcagg

SEQ ID NO: 9497639 - DNA, 22 bp, Homo sapiens
tttcaacagaatatgatcagag

SEQ ID NO: 9497640 - DNA, 22 bp, Homo sapiens
tttcaaaggtggaagagtgaat

SEQ ID NO: 9497641 - DNA, 22 bp, Homo sapiens
tttcaaaggttttgtcatgtct

SEQ ID NO: 9497642 - DNA, 22 bp, Homo sapiens
tttcaaaggttttgtcatgtct

SEQ ID NO: 9497643 - DNA, 22 bp, Homo sapiens
tttcaaaggttttgtcatgtct

SEQ ID NO: 9497644 - DNA, 22 bp, Homo sapiens
tttcaaagtaaggattttcatc

SEQ ID NO: 9497645 - DNA, 23 bp, Homo sapiens
tttcaacaatgcttagagaaaac

SEQ ID NO: 9497646 - DNA, 22 bp, Homo sapiens
tttattctagctcagaatagtt

SEQ ID NO: 9497647 - DNA, 22 bp, Homo sapiens
tttattctagctcagaatagtt

SEQ ID NO: 9497648 - DNA, 20 bp, Homo sapiens
tttattcacagagaagagtt

SEQ ID NO: 9497649 - DNA, 21 bp, Homo sapiens
tttattctcagatacagggag

SEQ ID NO: 9497650 - DNA, 22 bp, Homo sapiens
tttattctataggcattaagca

SEQ ID NO: 9497651 - DNA, 22 bp, Homo sapiens
tttattctataggcattaagca

SEQ ID NO: 9497652 - DNA, 22 bp, Homo sapiens
tttattctagctcagaatagtt

SEQ ID NO: 9497653 - DNA, 22 bp, Homo sapiens
tttattctagctcagaatagtt

SEQ ID NO: 9497654 - DNA, 22 bp, Homo sapiens
tttattctagctcagaatagtt

SEQ ID NO: 9497655 - DNA, 22 bp, Homo sapiens
tttattctagctcagaatagtt

SEQ ID NO: 9497656 - DNA, 22 bp, Homo sapiens
tttattctataggcattaagca

SEQ ID NO: 9497657 - DNA, 22 bp, Homo sapiens
tttattgaattgtaaccctatt

SEQ ID NO: 9497658 - DNA, 22 bp, Homo sapiens
tttattcttgagagtgagaaga

SEQ ID NO: 9497659 - DNA, 22 bp, Homo sapiens
tttattcttgagagtgagaaga

SEQ ID NO: 9497660 - DNA, 22 bp, Homo sapiens
tttattcttgagagtgagaaga

SEQ ID NO: 9497661 - DNA, 22 bp, Homo sapiens
tttattcttgagagtgagaaga

SEQ ID NO: 9497662 - DNA, 22 bp, Homo sapiens
tttattctgtgctacatgaaga

SEQ ID NO: 9497663 - DNA, 22 bp, Homo sapiens
tttattctgtgctacatgaaga

SEQ ID NO: 9497664 - DNA, 22 bp, Homo sapiens
tttattctgtgctacatgaaga

SEQ ID NO: 9497665 - DNA, 22 bp, Homo sapiens
tttattctgtgctacatgaaga

SEQ ID NO: 9497666 - DNA, 23 bp, Homo sapiens
tttattctcagatacataggtct

SEQ ID NO: 9497667 - DNA, 23 bp, Homo sapiens
tttattctcagatacataggtct

SEQ ID NO: 9497668 - DNA, 22 bp, Homo sapiens
tttattctctagttggtcagat

SEQ ID NO: 9497669 - DNA, 22 bp, Homo sapiens
tttattctgtgctacatgaaga

SEQ ID NO: 9497670 - DNA, 22 bp, Homo sapiens
tttcaacagctctcaaatgatc

SEQ ID NO: 9497671 - DNA, 22 bp, Homo sapiens
tttcaacagctctcaaatgatc

SEQ ID NO: 9497672 - DNA, 22 bp, Homo sapiens
tttcaacagctctcaaatgatc

SEQ ID NO: 9497673 - DNA, 22 bp, Homo sapiens
tttcaacagctctcaaatgatc

SEQ ID NO: 9497674 - DNA, 22 bp, Homo sapiens
tttcaacataatgcctgctagg

SEQ ID NO: 9497675 - DNA, 22 bp, Homo sapiens
tttcaacagggcacaggtgcca

SEQ ID NO: 9497676 - DNA, 23 bp, Homo sapiens
tttcaacaggcagagaagactta

SEQ ID NO: 9497677 - DNA, 22 bp, Homo sapiens
tttcaacaggatgataataggc

SEQ ID NO: 9497678 - DNA, 22 bp, Homo sapiens
tttcaacaggatgataataggc

SEQ ID NO: 9497679 - DNA, 22 bp, Homo sapiens
tttcaacaggatgataataggc

SEQ ID NO: 9497680 - DNA, 22 bp, Homo sapiens
tttcaacatataccataatgcc

SEQ ID NO: 9497681 - DNA, 22 bp, Homo sapiens
tttcaacatacctcagtgtatg

SEQ ID NO: 9497682 - DNA, 22 bp, Homo sapiens
tttcaacatcacctagcagttc

SEQ ID NO: 9497683 - DNA, 22 bp, Homo sapiens
tttcaacatcacctagcagttc

SEQ ID NO: 9497684 - DNA, 22 bp, Homo sapiens
tttcaacatcacctagcagttc

SEQ ID NO: 9497685 - DNA, 17 bp, Homo sapiens
tttcaacatcactcagc

SEQ ID NO: 9497686 - DNA, 22 bp, Homo sapiens
tttcaacttgaagaattgatac

SEQ ID NO: 9497687 - DNA, 22 bp, Homo sapiens
tttcaagaacagcagcattcca

SEQ ID NO: 9497688 - DNA, 22 bp, Homo sapiens
tttcaagaagcaaattaaagtc

SEQ ID NO: 9497689 - DNA, 22 bp, Homo sapiens
tttcaagactcattgagtattg

SEQ ID NO: 9497690 - DNA, 22 bp, Homo sapiens
tttcaagagaaaactaacctat

SEQ ID NO: 9497691 - DNA, 22 bp, Homo sapiens
tttcaagactcattgagtattg

SEQ ID NO: 9497692 - DNA, 22 bp, Homo sapiens
tttcaagagcaggaaaaaggtc

SEQ ID NO: 9497693 - DNA, 22 bp, Homo sapiens
tttcaagagggaactgaacaca

SEQ ID NO: 9497694 - DNA, 22 bp, Homo sapiens
tttcacactgcagcatcagaga

SEQ ID NO: 9497695 - DNA, 22 bp, Homo sapiens
tttcacactgcagcatcagaga

SEQ ID NO: 9497696 - DNA, 22 bp, Homo sapiens
tttcacactgcagcatcagaga

SEQ ID NO: 9497697 - DNA, 22 bp, Homo sapiens
tttcacacccactaggactgtt

SEQ ID NO: 9497698 - DNA, 22 bp, Homo sapiens
tttcacactagtcagaatacca

SEQ ID NO: 9497699 - DNA, 22 bp, Homo sapiens
tttcacaattttaaggagcaaa

SEQ ID NO: 9497700 - DNA, 22 bp, Homo sapiens
tttcacaatgcaatcctacttc

SEQ ID NO: 9497701 - DNA, 22 bp, Homo sapiens
tttcacaattttaaggagcaaa

SEQ ID NO: 9497702 - DNA, 22 bp, Homo sapiens
tttcacacaacgtgaatatact

SEQ ID NO: 9497703 - DNA, 23 bp, Homo sapiens
tttcacaatgagcattacagaat

SEQ ID NO: 9497704 - DNA, 23 bp, Homo sapiens
tttcacaatgagcattacagaat

SEQ ID NO: 9497705 - DNA, 23 bp, Homo sapiens
tttcacaatgagcattacagaat

SEQ ID NO: 9497706 - DNA, 23 bp, Homo sapiens
tttcacaatgagcattacagaat

SEQ ID NO: 9497707 - DNA, 22 bp, Homo sapiens
tttcaagcaggatcaaagcaaa

SEQ ID NO: 9497708 - DNA, 20 bp, Homo sapiens
tttcacaatgaacatgtctc

SEQ ID NO: 9497709 - DNA, 20 bp, Homo sapiens
tttcacaatgaacatgtctc

SEQ ID NO: 9497710 - DNA, 20 bp, Homo sapiens
tttcacaatgaacatgtctc

SEQ ID NO: 9497711 - DNA, 20 bp, Homo sapiens
tttcacaatgaacatgtctc

SEQ ID NO: 9497712 - DNA, 23 bp, Homo sapiens
tttcacaatgagcattacagaat

SEQ ID NO: 9497713 - DNA, 22 bp, Homo sapiens
tttcacagaaaggataacatta

SEQ ID NO: 9497714 - DNA, 22 bp, Homo sapiens
tttcacagaactcactaaggag

SEQ ID NO: 9497715 - DNA, 22 bp, Homo sapiens
tttcacagaactcactaaggag

SEQ ID NO: 9497716 - DNA, 23 bp, Homo sapiens
tttcacagaaggattgtagggcc

SEQ ID NO: 9497717 - DNA, 22 bp, Homo sapiens
tttcacactgcagcatcagaga

SEQ ID NO: 9497718 - DNA, 22 bp, Homo sapiens
tttcccatccatagccctgcaa

SEQ ID NO: 9497719 - DNA, 22 bp, Homo sapiens
tttcccatccatagccctgcaa

SEQ ID NO: 9497720 - DNA, 22 bp, Homo sapiens
tttcccatggcagaagccctgt

SEQ ID NO: 9497721 - DNA, 22 bp, Homo sapiens
tttcccatcttagcagattaaa

SEQ ID NO: 9497722 - DNA, 22 bp, Homo sapiens
tttccccaggtagatagataat

SEQ ID NO: 9497723 - DNA, 22 bp, Homo sapiens
tttcccattctaattactcatt

SEQ ID NO: 9497724 - DNA, 22 bp, Homo sapiens
tttcccatggcagaagccctgt

SEQ ID NO: 9497725 - DNA, 22 bp, Homo sapiens
tttcccagttccctgctctata

SEQ ID NO: 9497726 - DNA, 21 bp, Homo sapiens
tttcccagcagagatagctgg

SEQ ID NO: 9497727 - DNA, 22 bp, Homo sapiens
tttcattgatgggtgatagaaa

SEQ ID NO: 9497728 - DNA, 22 bp, Homo sapiens
tttcattgcagagtctgtgtgc

SEQ ID NO: 9497729 - DNA, 22 bp, Homo sapiens
tttcattgatgggtgatagaaa

SEQ ID NO: 9497730 - DNA, 22 bp, Homo sapiens
tttcattgagactatagacatc

SEQ ID NO: 9497731 - DNA, 21 bp, Homo sapiens
tttcattgaatgagataaggt

SEQ ID NO: 9497732 - DNA, 22 bp, Homo sapiens
tttcattgagaatataagattt

SEQ ID NO: 9497733 - DNA, 22 bp, Homo sapiens
tttcattgagaatataagattt

SEQ ID NO: 9497734 - DNA, 22 bp, Homo sapiens
tttcattcattatacagtagag

SEQ ID NO: 9497735 - DNA, 22 bp, Homo sapiens
tttcattcattatacagtagag

SEQ ID NO: 9497736 - DNA, 22 bp, Homo sapiens
tttcattcattatacagtagag

SEQ ID NO: 9497737 - DNA, 22 bp, Homo sapiens
tttcattgaactaaagaatctg

SEQ ID NO: 9497738 - DNA, 22 bp, Homo sapiens
tttcattatacagcttcataaa

SEQ ID NO: 9497739 - DNA, 22 bp, Homo sapiens
tttcattattcatgctagttat

SEQ ID NO: 9497740 - DNA, 22 bp, Homo sapiens
tttcattatgttcctggaagag

SEQ ID NO: 9497741 - DNA, 22 bp, Homo sapiens
tttcatgtctgaattctttagt

SEQ ID NO: 9497742 - DNA, 22 bp, Homo sapiens
tttcatgtacttttttgataga

SEQ ID NO: 9497743 - DNA, 22 bp, Homo sapiens
tttcatgtgttgaatgtgtaca

SEQ ID NO: 9497744 - DNA, 22 bp, Homo sapiens
tttcatgtgttgaatgtgtaca

SEQ ID NO: 9497745 - DNA, 22 bp, Homo sapiens
tttcattatacagcttcataaa

SEQ ID NO: 9497746 - DNA, 22 bp, Homo sapiens
tttcatgtggcgatgtctctgg

SEQ ID NO: 9497747 - DNA, 22 bp, Homo sapiens
tttcatggctaggactagagtg

SEQ ID NO: 9497748 - DNA, 22 bp, Homo sapiens
tttcatgatccatttacaaaat

SEQ ID NO: 9497749 - DNA, 22 bp, Homo sapiens
tttcatgattaacttagtgaat

SEQ ID NO: 9497750 - DNA, 22 bp, Homo sapiens
tttcatgattaacttagtgaat

SEQ ID NO: 9497751 - DNA, 22 bp, Homo sapiens
tttcatcttccttggcataggt

SEQ ID NO: 9497752 - DNA, 22 bp, Homo sapiens
tttcatgagattcctccacatc

SEQ ID NO: 9497753 - DNA, 22 bp, Homo sapiens
tttcatcttgattctatatggc

SEQ ID NO: 9497754 - DNA, 22 bp, Homo sapiens
tttcatcttgattctatatggc

SEQ ID NO: 9497755 - DNA, 22 bp, Homo sapiens
tttcatcttgattctatatggc

SEQ ID NO: 9497756 - DNA, 22 bp, Homo sapiens
tttcatcttgattctatatggc

SEQ ID NO: 9497757 - DNA, 22 bp, Homo sapiens
tttcatgaggggcaaaatctca

SEQ ID NO: 9497758 - DNA, 22 bp, Homo sapiens
tttcatgaggctgcataaggag

SEQ ID NO: 9497759 - DNA, 22 bp, Homo sapiens
tttcatgaggctgcataaggag

SEQ ID NO: 9497760 - DNA, 22 bp, Homo sapiens
tttcagaaagctgaacatatga

SEQ ID NO: 9497761 - DNA, 22 bp, Homo sapiens
tttcagaaagctgaacatatga

SEQ ID NO: 9497762 - DNA, 22 bp, Homo sapiens
tttcagaaagctgaacatatga

SEQ ID NO: 9497763 - DNA, 22 bp, Homo sapiens
tttcagaaagctgaacatatga

SEQ ID NO: 9497764 - DNA, 22 bp, Homo sapiens
tttcagaaagctgaacatatga

SEQ ID NO: 9497765 - DNA, 22 bp, Homo sapiens
tttcagaaagctgaacatatga

SEQ ID NO: 9497766 - DNA, 22 bp, Homo sapiens
tttcagaaatggcactgaaatc

SEQ ID NO: 9497767 - DNA, 22 bp, Homo sapiens
tttcagaaatggcactgaaatc

SEQ ID NO: 9497768 - DNA, 22 bp, Homo sapiens
tttcagaatatcgattcagtga

SEQ ID NO: 9497769 - DNA, 22 bp, Homo sapiens
tttcagaaatggcactgaaatc

SEQ ID NO: 9497770 - DNA, 22 bp, Homo sapiens
tttcagaaagcatcatcaaagt

SEQ ID NO: 9497771 - DNA, 22 bp, Homo sapiens
tttcagaaagcatcatcaaagt

SEQ ID NO: 9497772 - DNA, 22 bp, Homo sapiens
tttcagaaagcatcatcaaagt

SEQ ID NO: 9497773 - DNA, 22 bp, Homo sapiens
tttcagaaagcatcatcaaagt

SEQ ID NO: 9497774 - DNA, 22 bp, Homo sapiens
tttcagaaacgattatgaacac

SEQ ID NO: 9497775 - DNA, 22 bp, Homo sapiens
tttcagaaacgattatgaacac

SEQ ID NO: 9497776 - DNA, 22 bp, Homo sapiens
tttcagaaacgattatgaacac

SEQ ID NO: 9497777 - DNA, 22 bp, Homo sapiens
tttcagaaaacttatcatcagt

SEQ ID NO: 9497778 - DNA, 22 bp, Homo sapiens
tttcagaaaacttatcatcagt

SEQ ID NO: 9497779 - DNA, 22 bp, Homo sapiens
tttcagagatgtctagcctatt

SEQ ID NO: 9497780 - DNA, 22 bp, Homo sapiens
tttcagagcctttatctctcta

SEQ ID NO: 9497781 - DNA, 22 bp, Homo sapiens
tttcagacaggacttcatatgt

SEQ ID NO: 9497782 - DNA, 22 bp, Homo sapiens
tttcactgggcttgcagaaatc

SEQ ID NO: 9497783 - DNA, 22 bp, Homo sapiens
tttcactgttaggagtatgcta

SEQ ID NO: 9497784 - DNA, 20 bp, Homo sapiens
tttcactggcttgataaggt

SEQ ID NO: 9497785 - DNA, 22 bp, Homo sapiens
tttcactagaacgttcttgttt

SEQ ID NO: 9497786 - DNA, 22 bp, Homo sapiens
tttcacattttatacttaagcc

SEQ ID NO: 9497787 - DNA, 22 bp, Homo sapiens
tttcacattttatacttaagcc

SEQ ID NO: 9497788 - DNA, 22 bp, Homo sapiens
tttcacatttgttttaagaagt

SEQ ID NO: 9497789 - DNA, 22 bp, Homo sapiens
tttcacatttgttttaagaagt

SEQ ID NO: 9497790 - DNA, 22 bp, Homo sapiens
tttcacatttgttttaagaagt

SEQ ID NO: 9497791 - DNA, 22 bp, Homo sapiens
tttcacatttgttttaagaagt

SEQ ID NO: 9497792 - DNA, 22 bp, Homo sapiens
tttcacagctgggtggcagagt

SEQ ID NO: 9497793 - DNA, 22 bp, Homo sapiens
tttcacagctgggtggcagagt

SEQ ID NO: 9497794 - DNA, 22 bp, Homo sapiens
tttcacagatgttttggagtct

SEQ ID NO: 9497795 - DNA, 20 bp, Homo sapiens
aatgaatgaacgaatggatg

SEQ ID NO: 9497796 - DNA, 22 bp, Homo sapiens
aatgaatgaaccacatataaca

SEQ ID NO: 9497797 - DNA, 22 bp, Homo sapiens
aatgaataccgtttcactcagt

SEQ ID NO: 9497798 - DNA, 22 bp, Homo sapiens
aatgaatgaaccacatataaca

SEQ ID NO: 9497799 - DNA, 22 bp, Homo sapiens
agaagccactggaggttgagat

SEQ ID NO: 9497800 - DNA, 22 bp, Homo sapiens
agaagccactgctcccagtgag

SEQ ID NO: 9497801 - DNA, 18 bp, Homo sapiens
agaagccacgaggagtcc

SEQ ID NO: 9497802 - DNA, 18 bp, Homo sapiens
agaagccacgaggagtcc

SEQ ID NO: 9497803 - DNA, 22 bp, Homo sapiens
agaagccagaatattcatggat

SEQ ID NO: 9497804 - DNA, 22 bp, Homo sapiens
agaagccactggaggttgagat

SEQ ID NO: 9497805 - DNA, 22 bp, Homo sapiens
agaagccagaggcagtgggtac

SEQ ID NO: 9497806 - DNA, 22 bp, Homo sapiens
agaagccagaatattcatggat

SEQ ID NO: 9497807 - DNA, 22 bp, Homo sapiens
agaagccactggaggttgagat

SEQ ID NO: 9497808 - DNA, 22 bp, Homo sapiens
aatgaagtgtttagaagtttta

SEQ ID NO: 9497809 - DNA, 22 bp, Homo sapiens
aatgaagtgttatttagtttca

SEQ ID NO: 9497810 - DNA, 22 bp, Homo sapiens
aatgaagtgttatttagtttca

SEQ ID NO: 9497811 - DNA, 21 bp, Homo sapiens
aatgaagtggctattttgagg

SEQ ID NO: 9497812 - DNA, 22 bp, Homo sapiens
aatgaagttctattcattttct

SEQ ID NO: 9497813 - DNA, 22 bp, Homo sapiens
aatgaataccgtttcactcagt

SEQ ID NO: 9497814 - DNA, 22 bp, Homo sapiens
aatgaataccgtttcactcagt

SEQ ID NO: 9497815 - DNA, 22 bp, Homo sapiens
aatgaagttctattcattttct

SEQ ID NO: 9497816 - DNA, 20 bp, Homo sapiens
aatgaagttattaatgatgt

SEQ ID NO: 9497817 - DNA, 22 bp, Homo sapiens
aatgaagccaggtagaagagaa

SEQ ID NO: 9497818 - DNA, 22 bp, Homo sapiens
aatgaagccagctgggatgcga

SEQ ID NO: 9497819 - DNA, 22 bp, Homo sapiens
aatgaagccaggtagaagagaa

SEQ ID NO: 9497820 - DNA, 22 bp, Homo sapiens
aatgaagccactgaagacaatc

SEQ ID NO: 9497821 - DNA, 22 bp, Homo sapiens
aatgaagccactgaagacaatc

SEQ ID NO: 9497822 - DNA, 22 bp, Homo sapiens
aatgaagcagttttcatcaagt

SEQ ID NO: 9497823 - DNA, 22 bp, Homo sapiens
aatgaagcagtccatctgctct

SEQ ID NO: 9497824 - DNA, 22 bp, Homo sapiens
aatgaagcagtccatctgctct

SEQ ID NO: 9497825 - DNA, 22 bp, Homo sapiens
aatgaagcaagctgctgtgttt

SEQ ID NO: 9497826 - DNA, 22 bp, Homo sapiens
aatgaagataaaatgggatgga

SEQ ID NO: 9497827 - DNA, 22 bp, Homo sapiens
aatgaagaaatggacatcttta

SEQ ID NO: 9497828 - DNA, 22 bp, Homo sapiens
aatgaagacacatctttctcat

SEQ ID NO: 9497829 - DNA, 22 bp, Homo sapiens
agaactgcaattacttctgcac

SEQ ID NO: 9497830 - DNA, 22 bp, Homo sapiens
agaactgctagctctccttctg

SEQ ID NO: 9497831 - DNA, 22 bp, Homo sapiens
agaacaattgccccaaagcttg

SEQ ID NO: 9497832 - DNA, 22 bp, Homo sapiens
agaacacacgtcagagtttcct

SEQ ID NO: 9497833 - DNA, 22 bp, Homo sapiens
agaacaattgccccaaagcttg

SEQ ID NO: 9497834 - DNA, 22 bp, Homo sapiens
agaacggcttggttggcattgt

SEQ ID NO: 9497835 - DNA, 21 bp, Homo sapiens
agaactaagactcagcagtac

SEQ ID NO: 9497836 - DNA, 21 bp, Homo sapiens
agaactaagactcagcagtac

SEQ ID NO: 9497837 - DNA, 22 bp, Homo sapiens
agaagaaactgtcggggatatt

SEQ ID NO: 9497838 - DNA, 22 bp, Homo sapiens
agaagaaactgtcggggatatt

SEQ ID NO: 9497839 - DNA, 22 bp, Homo sapiens
agaacttaggaacaacagctta

SEQ ID NO: 9497840 - DNA, 22 bp, Homo sapiens
agaacttaattgtcacttttct

SEQ ID NO: 9497841 - DNA, 22 bp, Homo sapiens
agaagaaagattgaaggttcct

SEQ ID NO: 9497842 - DNA, 22 bp, Homo sapiens
agaagaaactgtcggggatatt

SEQ ID NO: 9497843 - DNA, 22 bp, Homo sapiens
agaagaaagattgaaggttcct

SEQ ID NO: 9497844 - DNA, 22 bp, Homo sapiens
agaagaaagattgaaggttcct

SEQ ID NO: 9497845 - DNA, 22 bp, Homo sapiens
agaagaaagattgaaggttcct

SEQ ID NO: 9497846 - DNA, 22 bp, Homo sapiens
aatgaactggagaacaatgacc

SEQ ID NO: 9497847 - DNA, 22 bp, Homo sapiens
aatgaactggagaacaatgacc

SEQ ID NO: 9497848 - DNA, 22 bp, Homo sapiens
aatgaactgtgttaactgaata

SEQ ID NO: 9497849 - DNA, 22 bp, Homo sapiens
aatgaagaaatggacatcttta

SEQ ID NO: 9497850 - DNA, 22 bp, Homo sapiens
aatgaagaaatggacatcttta

SEQ ID NO: 9497851 - DNA, 22 bp, Homo sapiens
aatgcattttattatatgtgac

SEQ ID NO: 9497852 - DNA, 22 bp, Homo sapiens
aatgcattttattatatgtgac

SEQ ID NO: 9497853 - DNA, 22 bp, Homo sapiens
aatgccaatattcatttgtgtt

SEQ ID NO: 9497854 - DNA, 22 bp, Homo sapiens
aatgccaatgggcagaactaga

SEQ ID NO: 9497855 - DNA, 22 bp, Homo sapiens
aatgccatccctctgtcaccaa

SEQ ID NO: 9497856 - DNA, 22 bp, Homo sapiens
aatgccatcagagaaaactctt

SEQ ID NO: 9497857 - DNA, 22 bp, Homo sapiens
aatgccttcaagtatctgagga

SEQ ID NO: 9497858 - DNA, 22 bp, Homo sapiens
aatgccttataggctgaaaatt

SEQ ID NO: 9497859 - DNA, 22 bp, Homo sapiens
aatgccatctggtgatgtatta

SEQ ID NO: 9497860 - DNA, 19 bp, Homo sapiens
aatgcctcaaattgggaga

SEQ ID NO: 9497861 - DNA, 22 bp, Homo sapiens
aatgcattgattgctggaaata

SEQ ID NO: 9497862 - DNA, 21 bp, Homo sapiens
aatgcattaacataaagctga

SEQ ID NO: 9497863 - DNA, 22 bp, Homo sapiens
aatgcattagctacatatgtct

SEQ ID NO: 9497864 - DNA, 22 bp, Homo sapiens
aatgcattagctacatatgtct

SEQ ID NO: 9497865 - DNA, 22 bp, Homo sapiens
aatgcattaaagttagagactt

SEQ ID NO: 9497866 - DNA, 22 bp, Homo sapiens
aatgcatatgtaggcaagcagt

SEQ ID NO: 9497867 - DNA, 22 bp, Homo sapiens
aatgcataatggtttgtgacaa

SEQ ID NO: 9497868 - DNA, 22 bp, Homo sapiens
aatgcacaaaggtgtctattgc

SEQ ID NO: 9497869 - DNA, 22 bp, Homo sapiens
aatgcataccatgtcatctttg

SEQ ID NO: 9497870 - DNA, 22 bp, Homo sapiens
aatgcatacgtgtttgtggcaa

SEQ ID NO: 9497871 - DNA, 22 bp, Homo sapiens
agaagccagattgtagtgggac

SEQ ID NO: 9497872 - DNA, 22 bp, Homo sapiens
agaagccagattgtagtgggac

SEQ ID NO: 9497873 - DNA, 22 bp, Homo sapiens
agaagccagattgtagtgggac

SEQ ID NO: 9497874 - DNA, 22 bp, Homo sapiens
agaagccagaggcagtgggtac

SEQ ID NO: 9497875 - DNA, 22 bp, Homo sapiens
agaagccagaggcagtgggtac

SEQ ID NO: 9497876 - DNA, 22 bp, Homo sapiens
agaagccagtcgctctcccgca

SEQ ID NO: 9497877 - DNA, 22 bp, Homo sapiens
agaagccagtcgctctcccgca

SEQ ID NO: 9497878 - DNA, 22 bp, Homo sapiens
agaagccagccttgcctccttt

SEQ ID NO: 9497879 - DNA, 22 bp, Homo sapiens
agaagccagcttcagctgcccg

SEQ ID NO: 9497880 - DNA, 22 bp, Homo sapiens
agaagctgtggtatgaaatgtg

SEQ ID NO: 9497881 - DNA, 22 bp, Homo sapiens
agaagcttcaagatatttggta

SEQ ID NO: 9497882 - DNA, 22 bp, Homo sapiens
agaagcttccacggatgtgtct

SEQ ID NO: 9497883 - DNA, 22 bp, Homo sapiens
agaagcttcctacattgttctt

SEQ ID NO: 9497884 - DNA, 22 bp, Homo sapiens
agaaggaaaacctgtcttatgt

SEQ ID NO: 9497885 - DNA, 22 bp, Homo sapiens
agaaggaaaacctgtcttatgt

SEQ ID NO: 9497886 - DNA, 18 bp, Homo sapiens
aatgcaatgtatttgcag

SEQ ID NO: 9497887 - DNA, 22 bp, Homo sapiens
aatgcacaaaaattgtatgtaa

SEQ ID NO: 9497888 - DNA, 22 bp, Homo sapiens
agaaggaaggctgagtgctgat

SEQ ID NO: 9497889 - DNA, 22 bp, Homo sapiens
agaaggaaggctgagtgctgat

SEQ ID NO: 9497890 - DNA, 22 bp, Homo sapiens
agaaggaaggataactgcatta

SEQ ID NO: 9497891 - DNA, 22 bp, Homo sapiens
agaaggaaggaagcattctgtt

SEQ ID NO: 9497892 - DNA, 22 bp, Homo sapiens
agaaggaaggaagcattctgtt

SEQ ID NO: 9497893 - DNA, 22 bp, Homo sapiens
agaaggaagccaggagggtgca

SEQ ID NO: 9497894 - DNA, 22 bp, Homo sapiens
agaaggaaacagctgtgctttg

SEQ ID NO: 9497895 - DNA, 22 bp, Homo sapiens
agaaggaaacagctgtgctttg

SEQ ID NO: 9497896 - DNA, 22 bp, Homo sapiens
aatcacaattacttttgcacca

SEQ ID NO: 9497897 - DNA, 22 bp, Homo sapiens
aatcacaaatgcaagttgtcac

SEQ ID NO: 9497898 - DNA, 22 bp, Homo sapiens
aatcacaaatgcaagttgtcac

SEQ ID NO: 9497899 - DNA, 22 bp, Homo sapiens
aatcacagagtccagcagatga

SEQ ID NO: 9497900 - DNA, 22 bp, Homo sapiens
aatcacagccacaacctggggg

SEQ ID NO: 9497901 - DNA, 22 bp, Homo sapiens
aatcacacaaaggcaacttttg

SEQ ID NO: 9497902 - DNA, 22 bp, Homo sapiens
aatcacaattacttttgcacca

SEQ ID NO: 9497903 - DNA, 22 bp, Homo sapiens
aatcacaattacttttgcacca

SEQ ID NO: 9497904 - DNA, 22 bp, Homo sapiens
aatcacatagccatctctttga

SEQ ID NO: 9497905 - DNA, 22 bp, Homo sapiens
aatcacagttagtaagggagaa

SEQ ID NO: 9497906 - DNA, 22 bp, Homo sapiens
aatcacaggcatagattgctcc

SEQ ID NO: 9497907 - DNA, 20 bp, Homo sapiens
aatcacagttaactctttct

SEQ ID NO: 9497908 - DNA, 20 bp, Homo sapiens
aatcacagttaactctttct

SEQ ID NO: 9497909 - DNA, 22 bp, Homo sapiens
aatcacagtgggtactagattg

SEQ ID NO: 9497910 - DNA, 22 bp, Homo sapiens
agaaaggagaccagctctgccc

SEQ ID NO: 9497911 - DNA, 22 bp, Homo sapiens
agaaaggagaccagctctgccc

SEQ ID NO: 9497912 - DNA, 22 bp, Homo sapiens
agaaaggagcaccgtgggggat

SEQ ID NO: 9497913 - DNA, 22 bp, Homo sapiens
agaaaggaggaagaatgacctc

SEQ ID NO: 9497914 - DNA, 22 bp, Homo sapiens
agaaaggaggaagaatgacctc

SEQ ID NO: 9497915 - DNA, 22 bp, Homo sapiens
agaaaggcaatattaactacac

SEQ ID NO: 9497916 - DNA, 22 bp, Homo sapiens
agaaaggcaatattaactacac

SEQ ID NO: 9497917 - DNA, 22 bp, Homo sapiens
agaaaggcaatattaactacac

SEQ ID NO: 9497918 - DNA, 22 bp, Homo sapiens
agaaagcttatgaatgggcaag

SEQ ID NO: 9497919 - DNA, 22 bp, Homo sapiens
agaaagcttatgaatgggcaag

SEQ ID NO: 9497920 - DNA, 22 bp, Homo sapiens
agaaactgaattatttctgagg

SEQ ID NO: 9497921 - DNA, 22 bp, Homo sapiens
agaaactgaattatttctgagg

SEQ ID NO: 9497922 - DNA, 22 bp, Homo sapiens
aatctagagtgctaggtctgtg

SEQ ID NO: 9497923 - DNA, 22 bp, Homo sapiens
aatctagagtgctaggtctgtg

SEQ ID NO: 9497924 - DNA, 22 bp, Homo sapiens
aatctagtttcagactttgagt

SEQ ID NO: 9497925 - DNA, 23 bp, Homo sapiens
aatctatacttaggctggtaata

SEQ ID NO: 9497926 - DNA, 22 bp, Homo sapiens
aatctacatagagatcaaatga

SEQ ID NO: 9497927 - DNA, 22 bp, Homo sapiens
aatctacatagagatcaaatga

SEQ ID NO: 9497928 - DNA, 22 bp, Homo sapiens
aatctaagccaccagtagtttc

SEQ ID NO: 9497929 - DNA, 22 bp, Homo sapiens
aatctaagccaccagtagtttc

SEQ ID NO: 9497930 - DNA, 22 bp, Homo sapiens
aatctaagccaccagtagtttc

SEQ ID NO: 9497931 - DNA, 22 bp, Homo sapiens
aatctaaggacttagcattgct

SEQ ID NO: 9497932 - DNA, 22 bp, Homo sapiens
aatctacatttcagttttgccc

SEQ ID NO: 9497933 - DNA, 22 bp, Homo sapiens
aatctacatagagatcaaatga

SEQ ID NO: 9497934 - DNA, 22 bp, Homo sapiens
aatctacatgcaatatttttag

SEQ ID NO: 9497935 - DNA, 22 bp, Homo sapiens
agaaagggatgaggtagctgct

SEQ ID NO: 9497936 - DNA, 22 bp, Homo sapiens
agaaagggagcgtggatcaatt

SEQ ID NO: 9497937 - DNA, 22 bp, Homo sapiens
agaaagggagcgtggatcaatt

SEQ ID NO: 9497938 - DNA, 22 bp, Homo sapiens
agaaagggaactggcaaagcca

SEQ ID NO: 9497939 - DNA, 22 bp, Homo sapiens
agaaagggaactggcaaagcca

SEQ ID NO: 9497940 - DNA, 22 bp, Homo sapiens
agaaagggaactggcaaagcca

SEQ ID NO: 9497941 - DNA, 22 bp, Homo sapiens
agaaaggcagggatgaggattg

SEQ ID NO: 9497942 - DNA, 17 bp, Homo sapiens
agaaaggcagttcctct

SEQ ID NO: 9497943 - DNA, 22 bp, Homo sapiens
aatcgcttggtaattttaaaag

SEQ ID NO: 9497944 - DNA, 22 bp, Homo sapiens
aatcgcttggtaattttaaaag

SEQ ID NO: 9497945 - DNA, 22 bp, Homo sapiens
agaaagggatgaggtagctgct

SEQ ID NO: 9497946 - DNA, 22 bp, Homo sapiens
agaaagggatgaggtagctgct

SEQ ID NO: 9497947 - DNA, 22 bp, Homo sapiens
aatcctggcatgtgccttggga

SEQ ID NO: 9497948 - DNA, 22 bp, Homo sapiens
acttttatgataatcaatgttc

SEQ ID NO: 9497949 - DNA, 22 bp, Homo sapiens
acttttatgataatcaatgttc

SEQ ID NO: 9497950 - DNA, 22 bp, Homo sapiens
acttttatgataatcaatgttc

SEQ ID NO: 9497951 - DNA, 22 bp, Homo sapiens
acttttatcaaggaagtgatct

SEQ ID NO: 9497952 - DNA, 22 bp, Homo sapiens
acttttatgataatcaatgttc

SEQ ID NO: 9497953 - DNA, 22 bp, Homo sapiens
acttttatcaaggaagtgatct

SEQ ID NO: 9497954 - DNA, 22 bp, Homo sapiens
acttttatcaaggaagtgatct

SEQ ID NO: 9497955 - DNA, 22 bp, Homo sapiens
acttttatcaaggaagtgatct

SEQ ID NO: 9497956 - DNA, 22 bp, Homo sapiens
acttttatcaaggaagtgatct

SEQ ID NO: 9497957 - DNA, 22 bp, Homo sapiens
acttttaaggggccttgattta

SEQ ID NO: 9497958 - DNA, 22 bp, Homo sapiens
acttttaaggggccttgattta

SEQ ID NO: 9497959 - DNA, 22 bp, Homo sapiens
acttttcaaatgggaaactcag

SEQ ID NO: 9497960 - DNA, 22 bp, Homo sapiens
acttttatgataatcaatgttc

SEQ ID NO: 9497961 - DNA, 21 bp, Homo sapiens
aatcaagagtactggtgtggc

SEQ ID NO: 9497962 - DNA, 22 bp, Homo sapiens
aatcaagagttgtgtaatattt

SEQ ID NO: 9497963 - DNA, 22 bp, Homo sapiens
aatcaagtattttccagtggca

SEQ ID NO: 9497964 - DNA, 22 bp, Homo sapiens
aatcaatgttagtcatgaattt

SEQ ID NO: 9497965 - DNA, 22 bp, Homo sapiens
aatcaatgttagtcatgaattt

SEQ ID NO: 9497966 - DNA, 22 bp, Homo sapiens
acttttaaatgagtttcagttg

SEQ ID NO: 9497967 - DNA, 22 bp, Homo sapiens
acttttaaatgagtttcagttg

SEQ ID NO: 9497968 - DNA, 22 bp, Homo sapiens
actttgatcctttgaatatttg

SEQ ID NO: 9497969 - DNA, 22 bp, Homo sapiens
actttgatagtttaatctagga

SEQ ID NO: 9497970 - DNA, 22 bp, Homo sapiens
actttgttcctttcacaaagaa

SEQ ID NO: 9497971 - DNA, 22 bp, Homo sapiens
actttgttgatgaaatagtttt

SEQ ID NO: 9497972 - DNA, 22 bp, Homo sapiens
actttgttgaagaatatgttag

SEQ ID NO: 9497973 - DNA, 22 bp, Homo sapiens
aatagcatgttaataaccagag

SEQ ID NO: 9497974 - DNA, 22 bp, Homo sapiens
aatagcatttttaagggaatca

SEQ ID NO: 9497975 - DNA, 22 bp, Homo sapiens
aatagccactttagagcaggtg

SEQ ID NO: 9497976 - DNA, 22 bp, Homo sapiens
aatagccaaagtgcatttatga

SEQ ID NO: 9497977 - DNA, 22 bp, Homo sapiens
aatagcatgttcatgataaaat

SEQ ID NO: 9497978 - DNA, 22 bp, Homo sapiens
aatagcatgttcatgataaaat

SEQ ID NO: 9497979 - DNA, 22 bp, Homo sapiens
aatagcatgttcatgataaaat

SEQ ID NO: 9497980 - DNA, 22 bp, Homo sapiens
aatagcatgttcatgataaaat

SEQ ID NO: 9497981 - DNA, 22 bp, Homo sapiens
aatagcttatgggatagatgtt

SEQ ID NO: 9497982 - DNA, 22 bp, Homo sapiens
aatagcttagtcctgattctgt

SEQ ID NO: 9497983 - DNA, 22 bp, Homo sapiens
aatagcttagtcctgattctgt

SEQ ID NO: 9497984 - DNA, 22 bp, Homo sapiens
aatagcttagtcctgattctgt

SEQ ID NO: 9497985 - DNA, 22 bp, Homo sapiens
aatagctgggaggcacattcat

SEQ ID NO: 9497986 - DNA, 22 bp, Homo sapiens
aatagtaaaagatacagctaat

SEQ ID NO: 9497987 - DNA, 22 bp, Homo sapiens
aataggcagttggatatgcaag

SEQ ID NO: 9497988 - DNA, 22 bp, Homo sapiens
aataggctcaaatgttcttctc

SEQ ID NO: 9497989 - DNA, 22 bp, Homo sapiens
aataggaagcaccaaattctcc

SEQ ID NO: 9497990 - DNA, 22 bp, Homo sapiens
aataggcagcttagcaggggct

SEQ ID NO: 9497991 - DNA, 22 bp, Homo sapiens
aataggaagtcacatcaaggga

SEQ ID NO: 9497992 - DNA, 22 bp, Homo sapiens
aataggaaaatatttaacaaga

SEQ ID NO: 9497993 - DNA, 22 bp, Homo sapiens
aatagcttggacccattgcttt

SEQ ID NO: 9497994 - DNA, 22 bp, Homo sapiens
aatagctttggtcaccatctgg

SEQ ID NO: 9497995 - DNA, 22 bp, Homo sapiens
aatagctttctcatgacttcac

SEQ ID NO: 9497996 - DNA, 22 bp, Homo sapiens
aatagcttggacccattgcttt

SEQ ID NO: 9497997 - DNA, 22 bp, Homo sapiens
aatagcttgcctaatcctcatg

SEQ ID NO: 9497998 - DNA, 22 bp, Homo sapiens
aatagcttattgacagtgaatt

SEQ ID NO: 9497999 - DNA, 22 bp, Homo sapiens
aataatacttcgtaaagttgtt

SEQ ID NO: 9498000 - DNA, 22 bp, Homo sapiens
aataatactgcatgtaaggtgc

SEQ ID NO: 9498001 - DNA, 22 bp, Homo sapiens
aataatacatgagattaatgtt

SEQ ID NO: 9498002 - DNA, 22 bp, Homo sapiens
aataatacatgagattaatgtt

SEQ ID NO: 9498003 - DNA, 22 bp, Homo sapiens
aataataagatactaagggagt

SEQ ID NO: 9498004 - DNA, 22 bp, Homo sapiens
aataataagatactaagggagt

SEQ ID NO: 9498005 - DNA, 22 bp, Homo sapiens
aataataagatactaagggagt

SEQ ID NO: 9498006 - DNA, 22 bp, Homo sapiens
aataatacatgagattaatgtt

SEQ ID NO: 9498007 - DNA, 22 bp, Homo sapiens
aataatacatgagattaatgtt

SEQ ID NO: 9498008 - DNA, 22 bp, Homo sapiens
aataatagcagagtttacaatc

SEQ ID NO: 9498009 - DNA, 22 bp, Homo sapiens
aataatacttcgtaaagttgtt

SEQ ID NO: 9498010 - DNA, 22 bp, Homo sapiens
aataatacttcgtaaagttgtt

SEQ ID NO: 9498011 - DNA, 19 bp, Homo sapiens
actgggcttgtcctcgtgg

SEQ ID NO: 9498012 - DNA, 22 bp, Homo sapiens
actggggaatggaactgggaat

SEQ ID NO: 9498013 - DNA, 22 bp, Homo sapiens
actggggagagtcatgccagca

SEQ ID NO: 9498014 - DNA, 22 bp, Homo sapiens
actgggcaccatcatgagatag

SEQ ID NO: 9498015 - DNA, 22 bp, Homo sapiens
aataagttgcctgttgaatcat

SEQ ID NO: 9498016 - DNA, 22 bp, Homo sapiens
aataagccagcccatgtgaccc

SEQ ID NO: 9498017 - DNA, 22 bp, Homo sapiens
aataagctgctaggaacttagt

SEQ ID NO: 9498018 - DNA, 19 bp, Homo sapiens
aataagcttgggtaaaact

SEQ ID NO: 9498019 - DNA, 19 bp, Homo sapiens
aataagcttgggtaaaact

SEQ ID NO: 9498020 - DNA, 22 bp, Homo sapiens
aataagctggagctatattgag

SEQ ID NO: 9498021 - DNA, 22 bp, Homo sapiens
actgggagttctccatgtccct

SEQ ID NO: 9498022 - DNA, 22 bp, Homo sapiens
actgggagtcatgaggaaggag

SEQ ID NO: 9498023 - DNA, 22 bp, Homo sapiens
actgggagggtcttgaagaggg

SEQ ID NO: 9498024 - DNA, 22 bp, Homo sapiens
actgggagggtcttgaagaggg

SEQ ID NO: 9498025 - DNA, 22 bp, Homo sapiens
actgggaggcatctggagctga

SEQ ID NO: 9498026 - DNA, 22 bp, Homo sapiens
aataaaatggtcagttttctca

SEQ ID NO: 9498027 - DNA, 20 bp, Homo sapiens
aagttttctccaaatacagt

SEQ ID NO: 9498028 - DNA, 22 bp, Homo sapiens
aagttttgaaatactgaagtgt

SEQ ID NO: 9498029 - DNA, 22 bp, Homo sapiens
aagtttttggtagagaaaagta

SEQ ID NO: 9498030 - DNA, 22 bp, Homo sapiens
aagtttttggtagagaaaagta

SEQ ID NO: 9498031 - DNA, 22 bp, Homo sapiens
aataaaatgaactggtagagtt

SEQ ID NO: 9498032 - DNA, 22 bp, Homo sapiens
aataaaatgaactggtagagtt

SEQ ID NO: 9498033 - DNA, 22 bp, Homo sapiens
aataaaatgaactggtagagtt

SEQ ID NO: 9498034 - DNA, 22 bp, Homo sapiens
aataaaatgaactggtagagtt

SEQ ID NO: 9498035 - DNA, 21 bp, Homo sapiens
aataaaacagttggtgtcaat

SEQ ID NO: 9498036 - DNA, 20 bp, Homo sapiens
aataaaagaagccttcaccc

SEQ ID NO: 9498037 - DNA, 20 bp, Homo sapiens
aataaaagaagccttcaccc

SEQ ID NO: 9498038 - DNA, 22 bp, Homo sapiens
aatagcaattacatttgcacca

SEQ ID NO: 9498039 - DNA, 22 bp, Homo sapiens
aatagcaaatgctcatttgaaa

SEQ ID NO: 9498040 - DNA, 22 bp, Homo sapiens
aatagcaattacccttcaactc

SEQ ID NO: 9498041 - DNA, 22 bp, Homo sapiens
aatagcaaagttatcaaattaa

SEQ ID NO: 9498042 - DNA, 22 bp, Homo sapiens
aatagcatcttctgagacaaag

SEQ ID NO: 9498043 - DNA, 22 bp, Homo sapiens
aatagcatagagttaaaatgca

SEQ ID NO: 9498044 - DNA, 22 bp, Homo sapiens
aatagcatcctaaaacatactt

SEQ ID NO: 9498045 - DNA, 22 bp, Homo sapiens
aatagcagaagactagtagaca

SEQ ID NO: 9498046 - DNA, 22 bp, Homo sapiens
aatagcagttaaaaatcagccc

SEQ ID NO: 9498047 - DNA, 22 bp, Homo sapiens
aatagcataagatgtcaaatag

SEQ ID NO: 9498048 - DNA, 22 bp, Homo sapiens
aatagcataagatgtcaaatag

SEQ ID NO: 9498049 - DNA, 22 bp, Homo sapiens
aatagcatagagttaaaatgca

SEQ ID NO: 9498050 - DNA, 22 bp, Homo sapiens
aatagcataagatgtcaaatag

SEQ ID NO: 9498051 - DNA, 22 bp, Homo sapiens
actgtcgattatgatgagtcag

SEQ ID NO: 9498052 - DNA, 22 bp, Homo sapiens
actgtcctggagctcacactct

SEQ ID NO: 9498053 - DNA, 22 bp, Homo sapiens
actgtctcctcatcatgcctgg

SEQ ID NO: 9498054 - DNA, 22 bp, Homo sapiens
actgtcctcgaagtacctgtgc

SEQ ID NO: 9498055 - DNA, 22 bp, Homo sapiens
actgtcctcagatattcttctg

SEQ ID NO: 9498056 - DNA, 22 bp, Homo sapiens
aatagaatgtaatctaatacat

SEQ ID NO: 9498057 - DNA, 22 bp, Homo sapiens
aatagaatgtaatctaatacat

SEQ ID NO: 9498058 - DNA, 23 bp, Homo sapiens
actgtctgatatgttttccatca

SEQ ID NO: 9498059 - DNA, 22 bp, Homo sapiens
aatagaacaataattgtaaact

SEQ ID NO: 9498060 - DNA, 22 bp, Homo sapiens
actgtctctctagcagttcagg

SEQ ID NO: 9498061 - DNA, 22 bp, Homo sapiens
actgtctgagctgattgagcta

SEQ ID NO: 9498062 - DNA, 18 bp, Homo sapiens
actgtctctgagagtggt

SEQ ID NO: 9498063 - DNA, 18 bp, Homo sapiens
actgtctctgagagtggt

SEQ ID NO: 9498064 - DNA, 22 bp, Homo sapiens
actgtacaaatattgcaaaata

SEQ ID NO: 9498065 - DNA, 22 bp, Homo sapiens
actgtacaactgctgagcagaa

SEQ ID NO: 9498066 - DNA, 22 bp, Homo sapiens
actgtaatattttaagatgtct

SEQ ID NO: 9498067 - DNA, 22 bp, Homo sapiens
actgtaatattttaagatgtct

SEQ ID NO: 9498068 - DNA, 22 bp, Homo sapiens
actgtaattggattgtctgact

SEQ ID NO: 9498069 - DNA, 22 bp, Homo sapiens
actgtaatgttttaaagcagag

SEQ ID NO: 9498070 - DNA, 22 bp, Homo sapiens
actgtaattatctgaacgtgca

SEQ ID NO: 9498071 - DNA, 22 bp, Homo sapiens
actgtaatggtggatccatgtc

SEQ ID NO: 9498072 - DNA, 22 bp, Homo sapiens
actgtaatattttaagatgtct

SEQ ID NO: 9498073 - DNA, 22 bp, Homo sapiens
actgtaatggtggatccatgtc

SEQ ID NO: 9498074 - DNA, 22 bp, Homo sapiens
actgtcctagaacctgcagctc

SEQ ID NO: 9498075 - DNA, 22 bp, Homo sapiens
actgtcccatttatgtagacat

SEQ ID NO: 9498076 - DNA, 21 bp, Homo sapiens
actgtcatttgcttagggagg

SEQ ID NO: 9498077 - DNA, 22 bp, Homo sapiens
actgtcattaatgaatgtaata

SEQ ID NO: 9498078 - DNA, 22 bp, Homo sapiens
actgtcatgcattatggcatgt

SEQ ID NO: 9498079 - DNA, 22 bp, Homo sapiens
actgtacatgcatcttgtctat

SEQ ID NO: 9498080 - DNA, 22 bp, Homo sapiens
actgtacacgtgtcatttacag

SEQ ID NO: 9498081 - DNA, 22 bp, Homo sapiens
actgtacacgtgtcatttacag

SEQ ID NO: 9498082 - DNA, 22 bp, Homo sapiens
actgtacatatggattctaaga

SEQ ID NO: 9498083 - DNA, 22 bp, Homo sapiens
actgtacacgtgtcatttacag

SEQ ID NO: 9498084 - DNA, 22 bp, Homo sapiens
actgtacacattcgtcaagact

SEQ ID NO: 9498085 - DNA, 22 bp, Homo sapiens
actgtacacattcgtcaagact

SEQ ID NO: 9498086 - DNA, 22 bp, Homo sapiens
actcttcttgctgctcattaat

SEQ ID NO: 9498087 - DNA, 22 bp, Homo sapiens
actctggcttgaggaccaggtc

SEQ ID NO: 9498088 - DNA, 22 bp, Homo sapiens
actctgggaatcctcaccttcc

SEQ ID NO: 9498089 - DNA, 22 bp, Homo sapiens
actctgggaatcctcaccttcc

SEQ ID NO: 9498090 - DNA, 22 bp, Homo sapiens
actctggctgccttgtgagcat

SEQ ID NO: 9498091 - DNA, 22 bp, Homo sapiens
aagtgtttggggatcattttaa

SEQ ID NO: 9498092 - DNA, 22 bp, Homo sapiens
actcttgaactgattaagaatg

SEQ ID NO: 9498093 - DNA, 22 bp, Homo sapiens
actcttgtttgtagagcccacc

SEQ ID NO: 9498094 - DNA, 20 bp, Homo sapiens
actctttagaagggaaaaca

SEQ ID NO: 9498095 - DNA, 22 bp, Homo sapiens
aagtgtttaggtttgcagtcga

SEQ ID NO: 9498096 - DNA, 22 bp, Homo sapiens
aagtgtttacttaaagtcatgg

SEQ ID NO: 9498097 - DNA, 22 bp, Homo sapiens
aagtgtttacttaaagtcatgg

SEQ ID NO: 9498098 - DNA, 22 bp, Homo sapiens
aagtgtttatggttattgttaa

SEQ ID NO: 9498099 - DNA, 22 bp, Homo sapiens
aagtgtttattgattggtctag

SEQ ID NO: 9498100 - DNA, 22 bp, Homo sapiens
aagtgtttaaattatttgcagg

SEQ ID NO: 9498101 - DNA, 22 bp, Homo sapiens
acctgcctatggagccacatgg

SEQ ID NO: 9498102 - DNA, 22 bp, Homo sapiens
acctgcctcagtgcagctggat

SEQ ID NO: 9498103 - DNA, 22 bp, Homo sapiens
acctgcctctaagcagcaggtg

SEQ ID NO: 9498104 - DNA, 22 bp, Homo sapiens
aagtgtctgacacaaaatatgt

SEQ ID NO: 9498105 - DNA, 22 bp, Homo sapiens
aagtgtctgatggagcgaaatg

SEQ ID NO: 9498106 - DNA, 22 bp, Homo sapiens
aagtgtctgacacaaaatatgt

SEQ ID NO: 9498107 - DNA, 22 bp, Homo sapiens
aagtgtctgcaaaatgacagag

SEQ ID NO: 9498108 - DNA, 22 bp, Homo sapiens
aagtgtctgctggctctaccct

SEQ ID NO: 9498109 - DNA, 22 bp, Homo sapiens
aagtgtctgctggctctaccct

SEQ ID NO: 9498110 - DNA, 22 bp, Homo sapiens
aagtgtcttaactccttttggg

SEQ ID NO: 9498111 - DNA, 22 bp, Homo sapiens
aagtgtcttaactccttttggg

SEQ ID NO: 9498112 - DNA, 22 bp, Homo sapiens
aagtgtcttaactccttttggg

SEQ ID NO: 9498113 - DNA, 22 bp, Homo sapiens
aagtgtcttctgatggggtgtg

SEQ ID NO: 9498114 - DNA, 22 bp, Homo sapiens
aagtgtggggtctcagagctga

SEQ ID NO: 9498115 - DNA, 22 bp, Homo sapiens
aagtgtgatttgtagaatgcct

SEQ ID NO: 9498116 - DNA, 22 bp, Homo sapiens
aagtgtgggaagtaggtggcga

SEQ ID NO: 9498117 - DNA, 22 bp, Homo sapiens
aagtgtgaattttagagtcagg

SEQ ID NO: 9498118 - DNA, 22 bp, Homo sapiens
aagtgtgagacacacaaaatta

SEQ ID NO: 9498119 - DNA, 22 bp, Homo sapiens
aagtgtcttttagccactttta

SEQ ID NO: 9498120 - DNA, 22 bp, Homo sapiens
aagtgtcttttagccactttta

SEQ ID NO: 9498121 - DNA, 22 bp, Homo sapiens
aagtgtctttatatttgagaaa

SEQ ID NO: 9498122 - DNA, 22 bp, Homo sapiens
aagtgtgtgggcaggcagtggt

SEQ ID NO: 9498123 - DNA, 22 bp, Homo sapiens
aagtgtgtgggcaggcagtggt

SEQ ID NO: 9498124 - DNA, 22 bp, Homo sapiens
aagtgtgtgagcctgtcaggct

SEQ ID NO: 9498125 - DNA, 19 bp, Homo sapiens
aagtgtgttgagccaggat

SEQ ID NO: 9498126 - DNA, 19 bp, Homo sapiens
aagtgtgttgagccaggat

SEQ ID NO: 9498127 - DNA, 22 bp, Homo sapiens
aagtgtgttttcagtgtactta

SEQ ID NO: 9498128 - DNA, 22 bp, Homo sapiens
aagtgtgttgactgaattgggg

SEQ ID NO: 9498129 - DNA, 22 bp, Homo sapiens
aagtgtgtcttgggaagggagg

SEQ ID NO: 9498130 - DNA, 22 bp, Homo sapiens
aagtgtgtcttgggaagggagg

SEQ ID NO: 9498131 - DNA, 22 bp, Homo sapiens
aagtgtgtctggcggcccagtg

SEQ ID NO: 9498132 - DNA, 22 bp, Homo sapiens
aagtgtgtatttttcttcagtg

SEQ ID NO: 9498133 - DNA, 22 bp, Homo sapiens
aagtgtgtattgtttatgctgc

SEQ ID NO: 9498134 - DNA, 22 bp, Homo sapiens
actgaaaaagacatcttggtaa

SEQ ID NO: 9498135 - DNA, 22 bp, Homo sapiens
actctttattgtttgtggctag

SEQ ID NO: 9498136 - DNA, 18 bp, Homo sapiens
actctttctgcccacagg

SEQ ID NO: 9498137 - DNA, 18 bp, Homo sapiens
actctttctgcccacagg

SEQ ID NO: 9498138 - DNA, 18 bp, Homo sapiens
actctttctgcccacagg

SEQ ID NO: 9498139 - DNA, 18 bp, Homo sapiens
actctttctgcccacagg

SEQ ID NO: 9498140 - DNA, 22 bp, Homo sapiens
actcttttataaagcatcttga

SEQ ID NO: 9498141 - DNA, 18 bp, Homo sapiens
actctttctgcccacagg

SEQ ID NO: 9498142 - DNA, 22 bp, Homo sapiens
actctttgtctgttgccgctta

SEQ ID NO: 9498143 - DNA, 22 bp, Homo sapiens
aagttcaatcagatgaaaaagc

SEQ ID NO: 9498144 - DNA, 22 bp, Homo sapiens
aagttcacagaagattccaatt

SEQ ID NO: 9498145 - DNA, 22 bp, Homo sapiens
aagttcatcaaagagtaaatat

SEQ ID NO: 9498146 - DNA, 18 bp, Homo sapiens
aagttccacaagagatct

SEQ ID NO: 9498147 - DNA, 22 bp, Homo sapiens
aagttcctaaagtcaggggtca

SEQ ID NO: 9498148 - DNA, 22 bp, Homo sapiens
aagttcctcttctctgcaggga

SEQ ID NO: 9498149 - DNA, 22 bp, Homo sapiens
aagttcctcttctctgcaggga

SEQ ID NO: 9498150 - DNA, 22 bp, Homo sapiens
actgcagggcatcctggccaag

SEQ ID NO: 9498151 - DNA, 22 bp, Homo sapiens
actgcaggccttggtgccagca

SEQ ID NO: 9498152 - DNA, 22 bp, Homo sapiens
actgcatgctttacatgacatg

SEQ ID NO: 9498153 - DNA, 21 bp, Homo sapiens
actgcatctgaagtcccagga

SEQ ID NO: 9498154 - DNA, 22 bp, Homo sapiens
actgcatctgaactgtgaatgg

SEQ ID NO: 9498155 - DNA, 22 bp, Homo sapiens
actgcatctgaaacatgggtca

SEQ ID NO: 9498156 - DNA, 20 bp, Homo sapiens
aagttttctccaaatacagt

SEQ ID NO: 9498157 - DNA, 22 bp, Homo sapiens
aagttttattggctatagcact

SEQ ID NO: 9498158 - DNA, 20 bp, Homo sapiens
aagttttctccaaatacagt

SEQ ID NO: 9498159 - DNA, 22 bp, Homo sapiens
aagttttcctgtgtccaagatg

SEQ ID NO: 9498160 - DNA, 22 bp, Homo sapiens
aagttctaacaggaggtctctt

SEQ ID NO: 9498161 - DNA, 22 bp, Homo sapiens
actgcactccagcctgggtgac

SEQ ID NO: 9498162 - DNA, 22 bp, Homo sapiens
aagttccttagccttagggctt

SEQ ID NO: 9498163 - DNA, 22 bp, Homo sapiens
aagttcctgttactccccagaa

SEQ ID NO: 9498164 - DNA, 22 bp, Homo sapiens
aagttcctgggccaagtccagg

SEQ ID NO: 9498165 - DNA, 22 bp, Homo sapiens
actgcactccagcctgggtgac

SEQ ID NO: 9498166 - DNA, 22 bp, Homo sapiens
actgcactccagcctgggtgac

SEQ ID NO: 9498167 - DNA, 22 bp, Homo sapiens
actgcaggagacacagctgctg

SEQ ID NO: 9498168 - DNA, 22 bp, Homo sapiens
actgcaggatgtgctcctattg

SEQ ID NO: 9498169 - DNA, 22 bp, Homo sapiens
acctctggacactgcatccttc

SEQ ID NO: 9498170 - DNA, 22 bp, Homo sapiens
acctctggcaccccctggcttg

SEQ ID NO: 9498171 - DNA, 22 bp, Homo sapiens
acctctggcaccccctggcttg

SEQ ID NO: 9498172 - DNA, 22 bp, Homo sapiens
acctctggacactgcatccttc

SEQ ID NO: 9498173 - DNA, 22 bp, Homo sapiens
acctctggacactgcatccttc

SEQ ID NO: 9498174 - DNA, 22 bp, Homo sapiens
acctctgaggtgaggaggagct

SEQ ID NO: 9498175 - DNA, 22 bp, Homo sapiens
acctctgaggtgaggaggagct

SEQ ID NO: 9498176 - DNA, 22 bp, Homo sapiens
acctctgagccatggaaggtga

SEQ ID NO: 9498177 - DNA, 19 bp, Homo sapiens
acctctgagaatgccagtc

SEQ ID NO: 9498178 - DNA, 22 bp, Homo sapiens
acctctgagatgagtcagggga

SEQ ID NO: 9498179 - DNA, 22 bp, Homo sapiens
acctctgacctctgagagagaa

SEQ ID NO: 9498180 - DNA, 22 bp, Homo sapiens
acctctgacctctgagagagaa

SEQ ID NO: 9498181 - DNA, 20 bp, Homo sapiens
acctctgacccagagcaggc

SEQ ID NO: 9498182 - DNA, 20 bp, Homo sapiens
acctctgacccagagcaggc

SEQ ID NO: 9498183 - DNA, 22 bp, Homo sapiens
acctctcttgtagctgctggtg

SEQ ID NO: 9498184 - DNA, 22 bp, Homo sapiens
acctctgaaacttaatctattg

SEQ ID NO: 9498185 - DNA, 22 bp, Homo sapiens
acctctgaacatttttaagact

SEQ ID NO: 9498186 - DNA, 22 bp, Homo sapiens
acctctgaaggtttacatttcc

SEQ ID NO: 9498187 - DNA, 22 bp, Homo sapiens
acctctgaagggccaagcaatg

SEQ ID NO: 9498188 - DNA, 22 bp, Homo sapiens
acctctctgggcctgcttcctg

SEQ ID NO: 9498189 - DNA, 22 bp, Homo sapiens
acctctcaggtcttcctcatat

SEQ ID NO: 9498190 - DNA, 20 bp, Homo sapiens
acctcctggaagcaggtgcc

SEQ ID NO: 9498191 - DNA, 21 bp, Homo sapiens
acctcctggcatcctgttccc

SEQ ID NO: 9498192 - DNA, 17 bp, Homo sapiens
acctattgatctgtcac

SEQ ID NO: 9498193 - DNA, 22 bp, Homo sapiens
aaggtgtcaccagattggcagg

SEQ ID NO: 9498194 - DNA, 20 bp, Homo sapiens
acctagtacaatctgtttct

SEQ ID NO: 9498195 - DNA, 22 bp, Homo sapiens
acctcctggctgctcatggaac

SEQ ID NO: 9498196 - DNA, 22 bp, Homo sapiens
acctcctggctgctcatggaac

SEQ ID NO: 9498197 - DNA, 20 bp, Homo sapiens
acctcctggcgggcatcctc

SEQ ID NO: 9498198 - DNA, 20 bp, Homo sapiens
acctcctggcgggcatcctc

SEQ ID NO: 9498199 - DNA, 22 bp, Homo sapiens
acctcctggcctcaagcaatcc

SEQ ID NO: 9498200 - DNA, 21 bp, Homo sapiens
acctcctggcatcctgttccc

SEQ ID NO: 9498201 - DNA, 22 bp, Homo sapiens
acctcctggcttatcatggaca

SEQ ID NO: 9498202 - DNA, 22 bp, Homo sapiens
acctcctggtgcccaagtgttt

SEQ ID NO: 9498203 - DNA, 22 bp, Homo sapiens
acctcctggcttatcatggaca

SEQ ID NO: 9498204 - DNA, 22 bp, Homo sapiens
acctctcaggtcttcctcatat

SEQ ID NO: 9498205 - DNA, 22 bp, Homo sapiens
acctctaaaaaattagaagcct

SEQ ID NO: 9498206 - DNA, 22 bp, Homo sapiens
acccaggggcagccttgctgtg

SEQ ID NO: 9498207 - DNA, 22 bp, Homo sapiens
acccaggggcagccttgctgtg

SEQ ID NO: 9498208 - DNA, 22 bp, Homo sapiens
acccaggggcgaagctggccac

SEQ ID NO: 9498209 - DNA, 19 bp, Homo sapiens
acccaggggtttatgtgtg

SEQ ID NO: 9498210 - DNA, 22 bp, Homo sapiens
acccagggtagaacctcagagc

SEQ ID NO: 9498211 - DNA, 22 bp, Homo sapiens
acccagggtagaacctcagagc

SEQ ID NO: 9498212 - DNA, 22 bp, Homo sapiens
aaggtggtgagtacagttaggt

SEQ ID NO: 9498213 - DNA, 22 bp, Homo sapiens
acccagggccacagcccgcagt

SEQ ID NO: 9498214 - DNA, 22 bp, Homo sapiens
acccagggctcaagcgtaggca

SEQ ID NO: 9498215 - DNA, 22 bp, Homo sapiens
acccagggcagccagcggggag

SEQ ID NO: 9498216 - DNA, 22 bp, Homo sapiens
acccagggcagccagcggggag

SEQ ID NO: 9498217 - DNA, 22 bp, Homo sapiens
acccagggagtgctcctgttct

SEQ ID NO: 9498218 - DNA, 22 bp, Homo sapiens
acccagggcttaaggcggtgca

SEQ ID NO: 9498219 - DNA, 22 bp, Homo sapiens
acccagggcttaaggcggtgca

SEQ ID NO: 9498220 - DNA, 21 bp, Homo sapiens
acccaggggaagcagaaactg

SEQ ID NO: 9498221 - DNA, 22 bp, Homo sapiens
acccagggctcaagcgtaggca

SEQ ID NO: 9498222 - DNA, 22 bp, Homo sapiens
acccagggcttaaggcggtgca

SEQ ID NO: 9498223 - DNA, 22 bp, Homo sapiens
acccagggctcaagcgtaggca

SEQ ID NO: 9498224 - DNA, 22 bp, Homo sapiens
acccagggctcaagcgtaggca

SEQ ID NO: 9498225 - DNA, 22 bp, Homo sapiens
acctgcctagttggttctgccc

SEQ ID NO: 9498226 - DNA, 22 bp, Homo sapiens
acctgcctatcagctgcctgct

SEQ ID NO: 9498227 - DNA, 22 bp, Homo sapiens
acctgcctatcagctgcctgct

SEQ ID NO: 9498228 - DNA, 22 bp, Homo sapiens
acctgcctagttggttctgccc

SEQ ID NO: 9498229 - DNA, 22 bp, Homo sapiens
acctgcctatcagctgcctgct

SEQ ID NO: 9498230 - DNA, 22 bp, Homo sapiens
acctgcctatcagctgcctgct

SEQ ID NO: 9498231 - DNA, 22 bp, Homo sapiens
acctgcctatggagccacatgg

SEQ ID NO: 9498232 - DNA, 22 bp, Homo sapiens
acctgcctatggagccacatgg

SEQ ID NO: 9498233 - DNA, 18 bp, Homo sapiens
aagtccttcctttgcttt

SEQ ID NO: 9498234 - DNA, 22 bp, Homo sapiens
aagtccttctttatatgagagt

SEQ ID NO: 9498235 - DNA, 22 bp, Homo sapiens
acctgcctagttggttctgccc

SEQ ID NO: 9498236 - DNA, 22 bp, Homo sapiens
acctgcccttaacactgtgtgc

SEQ ID NO: 9498237 - DNA, 22 bp, Homo sapiens
aagtcctgaaacttctttctga

SEQ ID NO: 9498238 - DNA, 22 bp, Homo sapiens
aagtcctcaattttctctgcta

SEQ ID NO: 9498239 - DNA, 22 bp, Homo sapiens
aagtccctggttcctagcaaaa

SEQ ID NO: 9498240 - DNA, 22 bp, Homo sapiens
aagtccctggttcctagcaaaa

SEQ ID NO: 9498241 - DNA, 22 bp, Homo sapiens
aagtccctgtggggtggaggct

SEQ ID NO: 9498242 - DNA, 22 bp, Homo sapiens
aagtccctttaatcagtgcctt

SEQ ID NO: 9498243 - DNA, 22 bp, Homo sapiens
aagtccctttaatcagtgcctt

SEQ ID NO: 9498244 - DNA, 20 bp, Homo sapiens
aagtccctaagtctctggcc

SEQ ID NO: 9498245 - DNA, 20 bp, Homo sapiens
aagtccctaagtctctggcc

SEQ ID NO: 9498246 - DNA, 22 bp, Homo sapiens
aagtccctggtgctggctgcgc

SEQ ID NO: 9498247 - DNA, 22 bp, Homo sapiens
aagtcccaaagtcactctgctt

SEQ ID NO: 9498248 - DNA, 22 bp, Homo sapiens
aagtcccaatccctggcctgct

SEQ ID NO: 9498249 - DNA, 22 bp, Homo sapiens
aagtcccatctgcctccatgta

SEQ ID NO: 9498250 - DNA, 22 bp, Homo sapiens
acctctggccaagactcgtgtt

SEQ ID NO: 9498251 - DNA, 19 bp, Homo sapiens
aagtagtcatcccattctt

SEQ ID NO: 9498252 - DNA, 22 bp, Homo sapiens
aagtagttagtccgcctgctct

SEQ ID NO: 9498253 - DNA, 22 bp, Homo sapiens
aagtatactgaaggtatccagg

SEQ ID NO: 9498254 - DNA, 22 bp, Homo sapiens
aagtatacttaaaagagttgat

SEQ ID NO: 9498255 - DNA, 22 bp, Homo sapiens
aagtatacttaggcataatggt

SEQ ID NO: 9498256 - DNA, 22 bp, Homo sapiens
aagtatatactaaatgttaatc

SEQ ID NO: 9498257 - DNA, 22 bp, Homo sapiens
aagtatatttagctgagcttgt

SEQ ID NO: 9498258 - DNA, 22 bp, Homo sapiens
aagtatattttttgaagcatat

SEQ ID NO: 9498259 - DNA, 22 bp, Homo sapiens
aagtatatactaaatgttaatc

SEQ ID NO: 9498260 - DNA, 22 bp, Homo sapiens
aagtatatactaaatgttaatc

SEQ ID NO: 9498261 - DNA, 22 bp, Homo sapiens
aagtatctcaaaaacagtaatc

SEQ ID NO: 9498262 - DNA, 22 bp, Homo sapiens
aagtcagtgctagctaatggct

SEQ ID NO: 9498263 - DNA, 22 bp, Homo sapiens
aagtcagtgaaaaggcatcatc

SEQ ID NO: 9498264 - DNA, 22 bp, Homo sapiens
aagtcatcactcctctgaactt

SEQ ID NO: 9498265 - DNA, 22 bp, Homo sapiens
aagtccagtgatactggcagga

SEQ ID NO: 9498266 - DNA, 22 bp, Homo sapiens
aagtccagtttcatttgaggtc

SEQ ID NO: 9498267 - DNA, 22 bp, Homo sapiens
aagtccagtgctttagattcca

SEQ ID NO: 9498268 - DNA, 22 bp, Homo sapiens
aagtccagtgatactggcagga

SEQ ID NO: 9498269 - DNA, 22 bp, Homo sapiens
aagtccatagtttgcattacag

SEQ ID NO: 9498270 - DNA, 22 bp, Homo sapiens
aagtccatgatcaagatgtggc

SEQ ID NO: 9498271 - DNA, 22 bp, Homo sapiens
aagggcacagggaaagagtgca

SEQ ID NO: 9498272 - DNA, 22 bp, Homo sapiens
aagggcaagatcctaagcatcc

SEQ ID NO: 9498273 - DNA, 22 bp, Homo sapiens
aagggattgatcttgacacagt

SEQ ID NO: 9498274 - DNA, 22 bp, Homo sapiens
aagggatgcaggaaagaaggtt

SEQ ID NO: 9498275 - DNA, 22 bp, Homo sapiens
aagggcagaatagagaagatgg

SEQ ID NO: 9498276 - DNA, 22 bp, Homo sapiens
aagggcagaaagggacgctttg

SEQ ID NO: 9498277 - DNA, 22 bp, Homo sapiens
aagggcagaaagggacgctttg

SEQ ID NO: 9498278 - DNA, 22 bp, Homo sapiens
aagggcagaaagggacgctttg

SEQ ID NO: 9498279 - DNA, 22 bp, Homo sapiens
aagggcagaatagagaagatgg

SEQ ID NO: 9498280 - DNA, 22 bp, Homo sapiens
aagggcagaatagagaagatgg

SEQ ID NO: 9498281 - DNA, 22 bp, Homo sapiens
acatgcatgtctatgggcaggt

SEQ ID NO: 9498282 - DNA, 22 bp, Homo sapiens
aagggagacagttgtgtgagga

SEQ ID NO: 9498283 - DNA, 20 bp, Homo sapiens
aagggagaataatgattgta

SEQ ID NO: 9498284 - DNA, 22 bp, Homo sapiens
aagggaggtaaagctatttaaa

SEQ ID NO: 9498285 - DNA, 22 bp, Homo sapiens
aagggaggggatgtaagcctgg

SEQ ID NO: 9498286 - DNA, 22 bp, Homo sapiens
aagggaggtaaagctatttaaa

SEQ ID NO: 9498287 - DNA, 22 bp, Homo sapiens
aagggaggtaaagctatttaaa

SEQ ID NO: 9498288 - DNA, 22 bp, Homo sapiens
acatttcagaatcacacagctt

SEQ ID NO: 9498289 - DNA, 22 bp, Homo sapiens
aagggcagagggaatcccacat

SEQ ID NO: 9498290 - DNA, 22 bp, Homo sapiens
acatttcagatgtaatgtgatg

SEQ ID NO: 9498291 - DNA, 22 bp, Homo sapiens
acatttcagatgtaatgtgatg

SEQ ID NO: 9498292 - DNA, 22 bp, Homo sapiens
acatttcagattcatgaagtga

SEQ ID NO: 9498293 - DNA, 22 bp, Homo sapiens
acatttcagattcatgaagtga

SEQ ID NO: 9498294 - DNA, 20 bp, Homo sapiens
aagggcagagggaacagact

SEQ ID NO: 9498295 - DNA, 20 bp, Homo sapiens
aagggcagagggaacagact

SEQ ID NO: 9498296 - DNA, 22 bp, Homo sapiens
aagggcagaatagagaagatgg

SEQ ID NO: 9498297 - DNA, 20 bp, Homo sapiens
aagggcagagggaacagact

SEQ ID NO: 9498298 - DNA, 22 bp, Homo sapiens
aagggcagaatagagaagatgg

SEQ ID NO: 9498299 - DNA, 20 bp, Homo sapiens
aagggcagagggaacagact

SEQ ID NO: 9498300 - DNA, 22 bp, Homo sapiens
acatttcagcgtgcatgacatg

SEQ ID NO: 9498301 - DNA, 22 bp, Homo sapiens
acatttcagtaagtgttaattt

SEQ ID NO: 9498302 - DNA, 22 bp, Homo sapiens
acatttcagcgtgcatgacatg

SEQ ID NO: 9498303 - DNA, 22 bp, Homo sapiens
acatttcagattcatgaagtga

SEQ ID NO: 9498304 - DNA, 22 bp, Homo sapiens
acatttcagattcatgaagtga

SEQ ID NO: 9498305 - DNA, 22 bp, Homo sapiens
acatttcagtgagctattgaag

SEQ ID NO: 9498306 - DNA, 22 bp, Homo sapiens
acatttcagtgagctattgaag

SEQ ID NO: 9498307 - DNA, 22 bp, Homo sapiens
acatttcagtgagctattgaag

SEQ ID NO: 9498308 - DNA, 22 bp, Homo sapiens
aagggctgcaatccaaaacact

SEQ ID NO: 9498309 - DNA, 22 bp, Homo sapiens
aagggctggagaggaaaggttg

SEQ ID NO: 9498310 - DNA, 22 bp, Homo sapiens
aagggctggatctctctgagca

SEQ ID NO: 9498311 - DNA, 22 bp, Homo sapiens
aagggctggccacattctgggt

SEQ ID NO: 9498312 - DNA, 22 bp, Homo sapiens
aagggctggccctgggaagagt

SEQ ID NO: 9498313 - DNA, 22 bp, Homo sapiens
aagggctggccctgggaagagt

SEQ ID NO: 9498314 - DNA, 22 bp, Homo sapiens
aagggctgggtctggttaaccc

SEQ ID NO: 9498315 - DNA, 19 bp, Homo sapiens
aagggctgggcacctcact

SEQ ID NO: 9498316 - DNA, 22 bp, Homo sapiens
aagggttgaagataaataaggt

SEQ ID NO: 9498317 - DNA, 22 bp, Homo sapiens
aagggtggtgtaggagatcaaa

SEQ ID NO: 9498318 - DNA, 22 bp, Homo sapiens
aagggttgcaaggtcagaggaa

SEQ ID NO: 9498319 - DNA, 22 bp, Homo sapiens
aagggtttgtctccctcaaggc

SEQ ID NO: 9498320 - DNA, 22 bp, Homo sapiens
aagggtggtgtaggagatcaaa

SEQ ID NO: 9498321 - DNA, 22 bp, Homo sapiens
aagggtttgtctccctcaaggc

SEQ ID NO: 9498322 - DNA, 22 bp, Homo sapiens
aaggtaatatttttctctctaa

SEQ ID NO: 9498323 - DNA, 22 bp, Homo sapiens
aaggtaatcagcctttccacaa

SEQ ID NO: 9498324 - DNA, 22 bp, Homo sapiens
aaggtaatgaaacagcagctaa

SEQ ID NO: 9498325 - DNA, 22 bp, Homo sapiens
aaggtacagaaattaacaagga

SEQ ID NO: 9498326 - DNA, 22 bp, Homo sapiens
aaggtacaaagtattatttaaa

SEQ ID NO: 9498327 - DNA, 22 bp, Homo sapiens
aaggtacaaagttatacagcgt

SEQ ID NO: 9498328 - DNA, 22 bp, Homo sapiens
aaggtacagggtattagattat

SEQ ID NO: 9498329 - DNA, 22 bp, Homo sapiens
aagggtgcgacctaggagtgag

SEQ ID NO: 9498330 - DNA, 22 bp, Homo sapiens
aagggtgaagggtggtggccta

SEQ ID NO: 9498331 - DNA, 23 bp, Homo sapiens
aagggtccatagctatcattaca

SEQ ID NO: 9498332 - DNA, 22 bp, Homo sapiens
aagggtccaaggctttgcgttt

SEQ ID NO: 9498333 - DNA, 22 bp, Homo sapiens
aagggtccagcacctcggctcc

SEQ ID NO: 9498334 - DNA, 22 bp, Homo sapiens
aaggggtgggcattagagcagt

SEQ ID NO: 9498335 - DNA, 22 bp, Homo sapiens
aaggggtgggcattagagcagt

SEQ ID NO: 9498336 - DNA, 22 bp, Homo sapiens
aagggtgggcaccgccaggtca

SEQ ID NO: 9498337 - DNA, 22 bp, Homo sapiens
aagggtggatttctgagctcta

SEQ ID NO: 9498338 - DNA, 22 bp, Homo sapiens
aagggtgggcaccgccaggtca

SEQ ID NO: 9498339 - DNA, 22 bp, Homo sapiens
aagggtgggccctggcagccat

SEQ ID NO: 9498340 - DNA, 22 bp, Homo sapiens
aagggggcggcagccagtggaa

SEQ ID NO: 9498341 - DNA, 22 bp, Homo sapiens
aaggggtgagcagaggcttcgc

SEQ ID NO: 9498342 - DNA, 22 bp, Homo sapiens
aagggggcggcagccagtggaa

SEQ ID NO: 9498343 - DNA, 22 bp, Homo sapiens
aaggggtgcaagttaatcagca

SEQ ID NO: 9498344 - DNA, 22 bp, Homo sapiens
aaggggtgctgttggaaaccca

SEQ ID NO: 9498345 - DNA, 22 bp, Homo sapiens
aaggggtgctgttggaaaccca

SEQ ID NO: 9498346 - DNA, 19 bp, Homo sapiens
aaggggtgagggaagcaga

SEQ ID NO: 9498347 - DNA, 19 bp, Homo sapiens
aaggggtgagggaagcaga

SEQ ID NO: 9498348 - DNA, 22 bp, Homo sapiens
aaggggaagagaccgcagagtc

SEQ ID NO: 9498349 - DNA, 22 bp, Homo sapiens
aagggggccacacctggtgtga

SEQ ID NO: 9498350 - DNA, 22 bp, Homo sapiens
aagggggcacagtcactgtaat

SEQ ID NO: 9498351 - DNA, 22 bp, Homo sapiens
aagggggcccagcactaagttg

SEQ ID NO: 9498352 - DNA, 22 bp, Homo sapiens
aagggggcgaagacgtgattga

SEQ ID NO: 9498353 - DNA, 22 bp, Homo sapiens
aagggggccacacctggtgtga

SEQ ID NO: 9498354 - DNA, 22 bp, Homo sapiens
accagcacctgataggcagtaa

SEQ ID NO: 9498355 - DNA, 22 bp, Homo sapiens
aaggggaaaaagtgttaggagt

SEQ ID NO: 9498356 - DNA, 20 bp, Homo sapiens
accagaggaaagagcagtga

SEQ ID NO: 9498357 - DNA, 20 bp, Homo sapiens
accagaggaaagagcagtga

SEQ ID NO: 9498358 - DNA, 22 bp, Homo sapiens
accagaggaagggaatctcaag

SEQ ID NO: 9498359 - DNA, 22 bp, Homo sapiens
accagagggagacttcctcttc

SEQ ID NO: 9498360 - DNA, 22 bp, Homo sapiens
accagagtaatgtgtggaaatt

SEQ ID NO: 9498361 - DNA, 22 bp, Homo sapiens
accagaggaggaattaccttcc

SEQ ID NO: 9498362 - DNA, 21 bp, Homo sapiens
acatgcatagagagatttctg

SEQ ID NO: 9498363 - DNA, 22 bp, Homo sapiens
acatgcatatacttaaatatgt

SEQ ID NO: 9498364 - DNA, 22 bp, Homo sapiens
acatgacagtgcttagcaaact

SEQ ID NO: 9498365 - DNA, 22 bp, Homo sapiens
acatgcatactgctgccaacgc

SEQ ID NO: 9498366 - DNA, 22 bp, Homo sapiens
acatgcatacacgtacatacct

SEQ ID NO: 9498367 - DNA, 22 bp, Homo sapiens
acatgacagtgactttataaga

SEQ ID NO: 9498368 - DNA, 22 bp, Homo sapiens
acatgacagtgcttagcaaact

SEQ ID NO: 9498369 - DNA, 22 bp, Homo sapiens
acatgaatgcagccataacact

SEQ ID NO: 9498370 - DNA, 22 bp, Homo sapiens
acatgaatgcagccataacact

SEQ ID NO: 9498371 - DNA, 22 bp, Homo sapiens
acatgacaaaatgcacaggatt

SEQ ID NO: 9498372 - DNA, 22 bp, Homo sapiens
acatgaatgaagactttacaat

SEQ ID NO: 9498373 - DNA, 22 bp, Homo sapiens
acatgaagcaagaaagatgcta

SEQ ID NO: 9498374 - DNA, 22 bp, Homo sapiens
acatgaatatatgaagttcaac

SEQ ID NO: 9498375 - DNA, 22 bp, Homo sapiens
acatgaagtggtcagatcaaac

SEQ ID NO: 9498376 - DNA, 22 bp, Homo sapiens
acatgaaatgcagcctgtaacc

SEQ ID NO: 9498377 - DNA, 22 bp, Homo sapiens
acatctcagaactgagtaaccg

SEQ ID NO: 9498378 - DNA, 22 bp, Homo sapiens
acatctcagaactgagtaaccg

SEQ ID NO: 9498379 - DNA, 22 bp, Homo sapiens
acatctcacttctttgaaggct

SEQ ID NO: 9498380 - DNA, 22 bp, Homo sapiens
acatgaaatgcagcctgtaacc

SEQ ID NO: 9498381 - DNA, 22 bp, Homo sapiens
acatgaaattctagctgaaccc

SEQ ID NO: 9498382 - DNA, 22 bp, Homo sapiens
acatcctcccgatctactggct

SEQ ID NO: 9498383 - DNA, 22 bp, Homo sapiens
acatcctgaagtcagtcatttg

SEQ ID NO: 9498384 - DNA, 20 bp, Homo sapiens
acatcctggtgactagaact

SEQ ID NO: 9498385 - DNA, 22 bp, Homo sapiens
acatcctcccgatctactggct

SEQ ID NO: 9498386 - DNA, 22 bp, Homo sapiens
acatcctcccgatctactggct

SEQ ID NO: 9498387 - DNA, 22 bp, Homo sapiens
acatcctcggggaaaggcactg

SEQ ID NO: 9498388 - DNA, 22 bp, Homo sapiens
acatctatttttttctgtccat

SEQ ID NO: 9498389 - DNA, 22 bp, Homo sapiens
acatctcaaattccaggctcca

SEQ ID NO: 9498390 - DNA, 22 bp, Homo sapiens
acatctcaaattccaggctcca

SEQ ID NO: 9498391 - DNA, 22 bp, Homo sapiens
acatctcacttctttgaaggct

SEQ ID NO: 9498392 - DNA, 22 bp, Homo sapiens
acatctaagccaattttgattt

SEQ ID NO: 9498393 - DNA, 22 bp, Homo sapiens
acatctaagccaattttgattt

SEQ ID NO: 9498394 - DNA, 22 bp, Homo sapiens
aaggccagcagtttgagaccag

SEQ ID NO: 9498395 - DNA, 22 bp, Homo sapiens
aaggccagattctctctagggg

SEQ ID NO: 9498396 - DNA, 22 bp, Homo sapiens
aaggccagattctctctagggg

SEQ ID NO: 9498397 - DNA, 22 bp, Homo sapiens
aaggccagattctctctagggg

SEQ ID NO: 9498398 - DNA, 22 bp, Homo sapiens
aaggccagattctctctagggg

SEQ ID NO: 9498399 - DNA, 22 bp, Homo sapiens
aaggccagattctctctagggg

SEQ ID NO: 9498400 - DNA, 22 bp, Homo sapiens
aaggccagattctctctagggg

SEQ ID NO: 9498401 - DNA, 22 bp, Homo sapiens
aaggccagagtactagaggctg

SEQ ID NO: 9498402 - DNA, 22 bp, Homo sapiens
aaggccagagttgaactgctcc

SEQ ID NO: 9498403 - DNA, 22 bp, Homo sapiens
aaggccagattcactttacaat

SEQ ID NO: 9498404 - DNA, 22 bp, Homo sapiens
aaggccagattcactttacaat

SEQ ID NO: 9498405 - DNA, 22 bp, Homo sapiens
aaggccagccttggaaccctga

SEQ ID NO: 9498406 - DNA, 22 bp, Homo sapiens
aaggccagcctgagagctaaca

SEQ ID NO: 9498407 - DNA, 22 bp, Homo sapiens
acatccattttgttcaaaagca

SEQ ID NO: 9498408 - DNA, 22 bp, Homo sapiens
aaggccagcagtttgagaccag

SEQ ID NO: 9498409 - DNA, 22 bp, Homo sapiens
aaggccagccctaatgatgctc

SEQ ID NO: 9498410 - DNA, 22 bp, Homo sapiens
aaggccagccctaatgatgctc

SEQ ID NO: 9498411 - DNA, 22 bp, Homo sapiens
aaggccagagcgtgtcctgcct

SEQ ID NO: 9498412 - DNA, 22 bp, Homo sapiens
aaggccagagcgtgtcctgcct

SEQ ID NO: 9498413 - DNA, 22 bp, Homo sapiens
aaggccagagcagactggagtt

SEQ ID NO: 9498414 - DNA, 22 bp, Homo sapiens
aaggccagagtactagaggctg

SEQ ID NO: 9498415 - DNA, 22 bp, Homo sapiens
aaggccagagtactagaggctg

SEQ ID NO: 9498416 - DNA, 22 bp, Homo sapiens
aaggccagagtactagaggctg

SEQ ID NO: 9498417 - DNA, 22 bp, Homo sapiens
aaggccagagcgtgtcctgcct

SEQ ID NO: 9498418 - DNA, 23 bp, Homo sapiens
aaggccagagagaggctagtgtc

SEQ ID NO: 9498419 - DNA, 22 bp, Homo sapiens
aaggcattgagcagttacagta

SEQ ID NO: 9498420 - DNA, 22 bp, Homo sapiens
aaggcaccataggcaaatccag

SEQ ID NO: 9498421 - DNA, 22 bp, Homo sapiens
aaggcacattcctgaaaacaat

SEQ ID NO: 9498422 - DNA, 22 bp, Homo sapiens
aaggcacatattttagagtcac

SEQ ID NO: 9498423 - DNA, 22 bp, Homo sapiens
aaggcacaacacaagagggtga

SEQ ID NO: 9498424 - DNA, 22 bp, Homo sapiens
aaggcacacagttagatagagc

SEQ ID NO: 9498425 - DNA, 22 bp, Homo sapiens
aaggcacagaggcagggcactt

SEQ ID NO: 9498426 - DNA, 22 bp, Homo sapiens
aaggcaattggcttgtataaga

SEQ ID NO: 9498427 - DNA, 22 bp, Homo sapiens
aaggcaattggcttgtataaga

SEQ ID NO: 9498428 - DNA, 22 bp, Homo sapiens
aaggcaattggcttgtataaga

SEQ ID NO: 9498429 - DNA, 22 bp, Homo sapiens
aaggcaatttggaagaggcaga

SEQ ID NO: 9498430 - DNA, 22 bp, Homo sapiens
aaggcacagccacttgatcatc

SEQ ID NO: 9498431 - DNA, 18 bp, Homo sapiens
aaggcacaggagaacatt

SEQ ID NO: 9498432 - DNA, 22 bp, Homo sapiens
aaggcacatattttagagtcac

SEQ ID NO: 9498433 - DNA, 22 bp, Homo sapiens
aaggcaaggttcaccgtgctat

SEQ ID NO: 9498434 - DNA, 22 bp, Homo sapiens
aaggcaagttttagttttctgg

SEQ ID NO: 9498435 - DNA, 22 bp, Homo sapiens
aaggcaaatgtgttcttttagt

SEQ ID NO: 9498436 - DNA, 22 bp, Homo sapiens
aaggcaaatgtgttcttttagt

SEQ ID NO: 9498437 - DNA, 22 bp, Homo sapiens
aaggcaaatgtgttcttttagt

SEQ ID NO: 9498438 - DNA, 22 bp, Homo sapiens
aaggcaatgactgatttagaat

SEQ ID NO: 9498439 - DNA, 22 bp, Homo sapiens
aaggcaatagtattaaactgga

SEQ ID NO: 9498440 - DNA, 22 bp, Homo sapiens
aaggcaatagtattaaactgga

SEQ ID NO: 9498441 - DNA, 22 bp, Homo sapiens
aaggcaatgtaaattacagctt

SEQ ID NO: 9498442 - DNA, 22 bp, Homo sapiens
aaggcaatgtaaattacagctt

SEQ ID NO: 9498443 - DNA, 22 bp, Homo sapiens
aaggcaatgttagcaacataat

SEQ ID NO: 9498444 - DNA, 22 bp, Homo sapiens
aaggcaattgagaagaaacaga

SEQ ID NO: 9498445 - DNA, 22 bp, Homo sapiens
aaggcaattgagaagaaacaga

SEQ ID NO: 9498446 - DNA, 22 bp, Homo sapiens
aaggcaatggcaagagaaagca

SEQ ID NO: 9498447 - DNA, 22 bp, Homo sapiens
aaggcaatggcaagagaaagca

SEQ ID NO: 9498448 - DNA, 22 bp, Homo sapiens
aaggcaatggtttctgtgcctt

SEQ ID NO: 9498449 - DNA, 22 bp, Homo sapiens
aaggcaatgagggagatagagt

SEQ ID NO: 9498450 - DNA, 22 bp, Homo sapiens
aaggcaatgactgatttagaat

SEQ ID NO: 9498451 - DNA, 22 bp, Homo sapiens
aaggcaatgactgatttagaat

SEQ ID NO: 9498452 - DNA, 22 bp, Homo sapiens
aaggcaatgagggagatagagt

SEQ ID NO: 9498453 - DNA, 21 bp, Homo sapiens
aagcttggctgatgttattgg

SEQ ID NO: 9498454 - DNA, 22 bp, Homo sapiens
aagcttggaagtcttcctttca

SEQ ID NO: 9498455 - DNA, 22 bp, Homo sapiens
aagcttgggaaccacggtaatc

SEQ ID NO: 9498456 - DNA, 22 bp, Homo sapiens
aagcttgtagagtttgacttcc

SEQ ID NO: 9498457 - DNA, 22 bp, Homo sapiens
aaggaagaagggaagttactta

SEQ ID NO: 9498458 - DNA, 22 bp, Homo sapiens
aaggaagaagggaagttactta

SEQ ID NO: 9498459 - DNA, 23 bp, Homo sapiens
aagcttctatctctgcagaagga

SEQ ID NO: 9498460 - DNA, 22 bp, Homo sapiens
aagcttcttagaatgcatgtgc

SEQ ID NO: 9498461 - DNA, 20 bp, Homo sapiens
aagcttccttgggcgcccgg

SEQ ID NO: 9498462 - DNA, 23 bp, Homo sapiens
aagcttccttgactggcccctag

SEQ ID NO: 9498463 - DNA, 22 bp, Homo sapiens
aagctgttgttcatcctgaatt

SEQ ID NO: 9498464 - DNA, 22 bp, Homo sapiens
aagctgttgccctgctctttct

SEQ ID NO: 9498465 - DNA, 22 bp, Homo sapiens
aagctgtttgcagtggatggag

SEQ ID NO: 9498466 - DNA, 22 bp, Homo sapiens
aagctgttctgaatcagtaagt

SEQ ID NO: 9498467 - DNA, 22 bp, Homo sapiens
aagctgttctgaatcagtaagt

SEQ ID NO: 9498468 - DNA, 22 bp, Homo sapiens
aagctgttctccagtgactcag

SEQ ID NO: 9498469 - DNA, 22 bp, Homo sapiens
aagctgttatcttctggcggac

SEQ ID NO: 9498470 - DNA, 22 bp, Homo sapiens
aagcttcaatgagataattgtt

SEQ ID NO: 9498471 - DNA, 20 bp, Homo sapiens
aagcttcacttcatttgatc

SEQ ID NO: 9498472 - DNA, 22 bp, Homo sapiens
acagctggagtgaggatggagt

SEQ ID NO: 9498473 - DNA, 22 bp, Homo sapiens
aagctggatgccttcctcccaa

SEQ ID NO: 9498474 - DNA, 22 bp, Homo sapiens
aagctggatgtaggatccccct

SEQ ID NO: 9498475 - DNA, 22 bp, Homo sapiens
aagctgtgaaatctctagtgca

SEQ ID NO: 9498476 - DNA, 22 bp, Homo sapiens
aagctgtgaaatctctagtgca

SEQ ID NO: 9498477 - DNA, 22 bp, Homo sapiens
aagctggaggctgagatcacca

SEQ ID NO: 9498478 - DNA, 22 bp, Homo sapiens
acagctggaggggctgcagagg

SEQ ID NO: 9498479 - DNA, 22 bp, Homo sapiens
acagctggagccctatggctgg

SEQ ID NO: 9498480 - DNA, 22 bp, Homo sapiens
acagctggagccctatggctgg

SEQ ID NO: 9498481 - DNA, 22 bp, Homo sapiens
aagctgtggcttggaggaaaca

SEQ ID NO: 9498482 - DNA, 22 bp, Homo sapiens
aagctgtggcttggaggaaaca

SEQ ID NO: 9498483 - DNA, 22 bp, Homo sapiens
aagctgtgcctttgcctagaat

SEQ ID NO: 9498484 - DNA, 22 bp, Homo sapiens
aagctgtgcctttgcctagaat

SEQ ID NO: 9498485 - DNA, 22 bp, Homo sapiens
aagctgtgcaggaactgcttgc

SEQ ID NO: 9498486 - DNA, 22 bp, Homo sapiens
aagctgtgcaggaactgcttgc

SEQ ID NO: 9498487 - DNA, 22 bp, Homo sapiens
aagctgtgaagagcaagtgagg

SEQ ID NO: 9498488 - DNA, 22 bp, Homo sapiens
aagctgtgagctggatgctcca

SEQ ID NO: 9498489 - DNA, 22 bp, Homo sapiens
aagctgtgagctggatgctcca

SEQ ID NO: 9498490 - DNA, 22 bp, Homo sapiens
aagctgtgagctggatgctcca

SEQ ID NO: 9498491 - DNA, 22 bp, Homo sapiens
aagctgtgaaatctctagtgca

SEQ ID NO: 9498492 - DNA, 22 bp, Homo sapiens
aagctgtgaaatctctagtgca

SEQ ID NO: 9498493 - DNA, 22 bp, Homo sapiens
aagctgtgtattacagaatatt

SEQ ID NO: 9498494 - DNA, 22 bp, Homo sapiens
aagctgtgtgactatttctgag

SEQ ID NO: 9498495 - DNA, 22 bp, Homo sapiens
aagctgtgtcctagaggtgtaa

SEQ ID NO: 9498496 - DNA, 22 bp, Homo sapiens
aagctgtgtaagttgcttggtt

SEQ ID NO: 9498497 - DNA, 22 bp, Homo sapiens
aagctgtgtaagttgcttggtt

SEQ ID NO: 9498498 - DNA, 22 bp, Homo sapiens
aagctgtggtaaagggtagagg

SEQ ID NO: 9498499 - DNA, 22 bp, Homo sapiens
aagctgtgtgactatttctgag

SEQ ID NO: 9498500 - DNA, 22 bp, Homo sapiens
aagctgtgtgcagatgatctca

SEQ ID NO: 9498501 - DNA, 22 bp, Homo sapiens
aagctgtgtgcagatgatctca

SEQ ID NO: 9498502 - DNA, 22 bp, Homo sapiens
aagctgtgtgcagatgatctca

SEQ ID NO: 9498503 - DNA, 21 bp, Homo sapiens
aagctgtgttccactgatagc

SEQ ID NO: 9498504 - DNA, 22 bp, Homo sapiens
aaggacaagtagtatttgcatc

SEQ ID NO: 9498505 - DNA, 19 bp, Homo sapiens
aaggacacaacagagatag

SEQ ID NO: 9498506 - DNA, 18 bp, Homo sapiens
aaggacacagtccctgct

SEQ ID NO: 9498507 - DNA, 22 bp, Homo sapiens
aaggacacctgcagagggacca

SEQ ID NO: 9498508 - DNA, 22 bp, Homo sapiens
aaggacacctgcagagggacca

SEQ ID NO: 9498509 - DNA, 22 bp, Homo sapiens
aaggacagaaacagattgctgg

SEQ ID NO: 9498510 - DNA, 22 bp, Homo sapiens
aaggacagaaacagattgctgg

SEQ ID NO: 9498511 - DNA, 22 bp, Homo sapiens
aaggacaggcacagtggtggag

SEQ ID NO: 9498512 - DNA, 22 bp, Homo sapiens
aaggaggccctctccttctgga

SEQ ID NO: 9498513 - DNA, 22 bp, Homo sapiens
aaggaggcagaactcacatgga

SEQ ID NO: 9498514 - DNA, 22 bp, Homo sapiens
aaggacaggcacagtggtggag

SEQ ID NO: 9498515 - DNA, 22 bp, Homo sapiens
aaggacaggcacagtggtggag

SEQ ID NO: 9498516 - DNA, 22 bp, Homo sapiens
aaggacaggcacagtggtggag

SEQ ID NO: 9498517 - DNA, 22 bp, Homo sapiens
aaggacaggagaaaacgggatc

SEQ ID NO: 9498518 - DNA, 22 bp, Homo sapiens
aaggacaggagaaaacgggatc

SEQ ID NO: 9498519 - DNA, 22 bp, Homo sapiens
aaggacaggagaaaacgggatc

SEQ ID NO: 9498520 - DNA, 22 bp, Homo sapiens
aaggacagagagccattccaga

SEQ ID NO: 9498521 - DNA, 22 bp, Homo sapiens
aaggacagagagccattccaga

SEQ ID NO: 9498522 - DNA, 22 bp, Homo sapiens
aaggacagagagccattccaga

SEQ ID NO: 9498523 - DNA, 22 bp, Homo sapiens
aaggacagaaacagattgctgg

SEQ ID NO: 9498524 - DNA, 22 bp, Homo sapiens
aaggatgattggtaatgacact

SEQ ID NO: 9498525 - DNA, 22 bp, Homo sapiens
aaggatcatgtatatgtttaag

SEQ ID NO: 9498526 - DNA, 22 bp, Homo sapiens
aaggatcatagtaaacattgat

SEQ ID NO: 9498527 - DNA, 22 bp, Homo sapiens
aaggatcatgtatatgtttaag

SEQ ID NO: 9498528 - DNA, 22 bp, Homo sapiens
aaggaggccctctccttctgga

SEQ ID NO: 9498529 - DNA, 22 bp, Homo sapiens
aaggcaaatgtgttcttttagt

SEQ ID NO: 9498530 - DNA, 22 bp, Homo sapiens
aaggcaaaagaggtgtcatcac

SEQ ID NO: 9498531 - DNA, 22 bp, Homo sapiens
aaggcaaaagaggtgtcatcac

SEQ ID NO: 9498532 - DNA, 22 bp, Homo sapiens
aaggatttttggaatgagatgg

SEQ ID NO: 9498533 - DNA, 20 bp, Homo sapiens
aaggattgttggaagcatcc

SEQ ID NO: 9498534 - DNA, 20 bp, Homo sapiens
aaggattgttggaagcatcc

SEQ ID NO: 9498535 - DNA, 22 bp, Homo sapiens
aaggatttgtccaaagtcacac

SEQ ID NO: 9498536 - DNA, 22 bp, Homo sapiens
aaggattggtctggaagcatga

SEQ ID NO: 9498537 - DNA, 22 bp, Homo sapiens
aaggattggtctggaagcatga

SEQ ID NO: 9498538 - DNA, 22 bp, Homo sapiens
aaggattgtctggctatttatg

SEQ ID NO: 9498539 - DNA, 22 bp, Homo sapiens
aaggaaggaattgatcatgcgc

SEQ ID NO: 9498540 - DNA, 22 bp, Homo sapiens
aaggaagggaaatagtgatgtc

SEQ ID NO: 9498541 - DNA, 22 bp, Homo sapiens
aaggaagggaaatagtgatgtc

SEQ ID NO: 9498542 - DNA, 22 bp, Homo sapiens
aaggaagggaaatagtgatgtc

SEQ ID NO: 9498543 - DNA, 22 bp, Homo sapiens
aaggaagaatcatcacgttggg

SEQ ID NO: 9498544 - DNA, 22 bp, Homo sapiens
aaggaagatgctggcctgggga

SEQ ID NO: 9498545 - DNA, 22 bp, Homo sapiens
aaggaagatgctggcctgggga

SEQ ID NO: 9498546 - DNA, 22 bp, Homo sapiens
aaggaagatgctggcctgggga

SEQ ID NO: 9498547 - DNA, 22 bp, Homo sapiens
aaggaagcagcaatgcatgatt

SEQ ID NO: 9498548 - DNA, 22 bp, Homo sapiens
aaggaagcagcaatgcatgatt

SEQ ID NO: 9498549 - DNA, 22 bp, Homo sapiens
aaggaaggtactcagtgattct

SEQ ID NO: 9498550 - DNA, 22 bp, Homo sapiens
aaggaaggttcatagtcaaaga

SEQ ID NO: 9498551 - DNA, 21 bp, Homo sapiens
aaggaagtgactttagtggtt

SEQ ID NO: 9498552 - DNA, 20 bp, Homo sapiens
aaggaatatttgtatctggg

SEQ ID NO: 9498553 - DNA, 19 bp, Homo sapiens
aaggaatggctttaagtag

SEQ ID NO: 9498554 - DNA, 19 bp, Homo sapiens
aaggaatggctttaagtag

SEQ ID NO: 9498555 - DNA, 22 bp, Homo sapiens
aaggaatgctctaggagggcag

SEQ ID NO: 9498556 - DNA, 22 bp, Homo sapiens
aaggacaaagcagagctggatg

SEQ ID NO: 9498557 - DNA, 22 bp, Homo sapiens
aaggaatttgaggctgcagtga

SEQ ID NO: 9498558 - DNA, 22 bp, Homo sapiens
aaggaattccctttctgacaga

SEQ ID NO: 9498559 - DNA, 17 bp, Homo sapiens
aaggaatgtcagaagtt

SEQ ID NO: 9498560 - DNA, 22 bp, Homo sapiens
aatttctgtatgaatagagaaa

SEQ ID NO: 9498561 - DNA, 22 bp, Homo sapiens
aatttcttcagctctaaaatgg

SEQ ID NO: 9498562 - DNA, 22 bp, Homo sapiens
aatttcttcagctctaaaatgg

SEQ ID NO: 9498563 - DNA, 22 bp, Homo sapiens
aatttcttgggagctcagagaa

SEQ ID NO: 9498564 - DNA, 22 bp, Homo sapiens
aatttcttcagctctaaaatgg

SEQ ID NO: 9498565 - DNA, 22 bp, Homo sapiens
aatttcttcagctctaaaatgg

SEQ ID NO: 9498566 - DNA, 22 bp, Homo sapiens
aatttcttcagctctaaaatgg

SEQ ID NO: 9498567 - DNA, 22 bp, Homo sapiens
aatttctccaagaatgcttaga

SEQ ID NO: 9498568 - DNA, 22 bp, Homo sapiens
aatttctcatggattcagttat

SEQ ID NO: 9498569 - DNA, 22 bp, Homo sapiens
aatttctaattgaatctctctt

SEQ ID NO: 9498570 - DNA, 22 bp, Homo sapiens
aatttctaattgaatctctctt

SEQ ID NO: 9498571 - DNA, 22 bp, Homo sapiens
aatttctcggttttgatattgt

SEQ ID NO: 9498572 - DNA, 18 bp, Homo sapiens
aatttctttgacaactta

SEQ ID NO: 9498573 - DNA, 18 bp, Homo sapiens
aatttctttgacaactta

SEQ ID NO: 9498574 - DNA, 22 bp, Homo sapiens
aatttcttgggagctcagagaa

SEQ ID NO: 9498575 - DNA, 18 bp, Homo sapiens
aatttctttgacaactta

SEQ ID NO: 9498576 - DNA, 18 bp, Homo sapiens
aatttctttgacaactta

SEQ ID NO: 9498577 - DNA, 18 bp, Homo sapiens
aatttctttgacaactta

SEQ ID NO: 9498578 - DNA, 22 bp, Homo sapiens
aatttgattcagcaaatgttca

SEQ ID NO: 9498579 - DNA, 22 bp, Homo sapiens
aatttgattccctgcacctgtt

SEQ ID NO: 9498580 - DNA, 22 bp, Homo sapiens
aatttggagagagattaatgtt

SEQ ID NO: 9498581 - DNA, 22 bp, Homo sapiens
aatttggagagaaacaagtagg

SEQ ID NO: 9498582 - DNA, 22 bp, Homo sapiens
aatttggagagaaacaagtagg

SEQ ID NO: 9498583 - DNA, 22 bp, Homo sapiens
agagtgtggaaatgttcagagt

SEQ ID NO: 9498584 - DNA, 22 bp, Homo sapiens
agagtgtggaaatgttcagagt

SEQ ID NO: 9498585 - DNA, 22 bp, Homo sapiens
agagtgtgaagaaagtgcaatg

SEQ ID NO: 9498586 - DNA, 22 bp, Homo sapiens
agagtgtcagccccagagtatg

SEQ ID NO: 9498587 - DNA, 22 bp, Homo sapiens
agagtgtctggtagctgctctg

SEQ ID NO: 9498588 - DNA, 22 bp, Homo sapiens
agagtgttatttgctctgtatt

SEQ ID NO: 9498589 - DNA, 22 bp, Homo sapiens
agagtgtgttccccaagaaaga

SEQ ID NO: 9498590 - DNA, 22 bp, Homo sapiens
agagtgtgttccccaagaaaga

SEQ ID NO: 9498591 - DNA, 18 bp, Homo sapiens
agagtgttctcagtgaaa

SEQ ID NO: 9498592 - DNA, 22 bp, Homo sapiens
agagtgtggaacttgaggagct

SEQ ID NO: 9498593 - DNA, 22 bp, Homo sapiens
agagtgtggttcttgcccgcat

SEQ ID NO: 9498594 - DNA, 22 bp, Homo sapiens
agagtgtgtctatggaaggggt

SEQ ID NO: 9498595 - DNA, 22 bp, Homo sapiens
agagtgtgtgctgagaaacgag

SEQ ID NO: 9498596 - DNA, 22 bp, Homo sapiens
agagtgtgtggggctgaggtca

SEQ ID NO: 9498597 - DNA, 22 bp, Homo sapiens
agagttaaatgaaatggtatgt

SEQ ID NO: 9498598 - DNA, 22 bp, Homo sapiens
agagttaagaggaatgtgaatt

SEQ ID NO: 9498599 - DNA, 21 bp, Homo sapiens
agagttactgtcatcctaggt

SEQ ID NO: 9498600 - DNA, 22 bp, Homo sapiens
agagttcacactcagtgcaccc

SEQ ID NO: 9498601 - DNA, 22 bp, Homo sapiens
agagttatggacttaatgcagg

SEQ ID NO: 9498602 - DNA, 22 bp, Homo sapiens
agagttatattggttgagaatt

SEQ ID NO: 9498603 - DNA, 22 bp, Homo sapiens
aatttgtacaaaatgtttataa

SEQ ID NO: 9498604 - DNA, 22 bp, Homo sapiens
aatttgtataaaatggtgtttt

SEQ ID NO: 9498605 - DNA, 22 bp, Homo sapiens
aatttgtataaaatggtgtttt

SEQ ID NO: 9498606 - DNA, 22 bp, Homo sapiens
agagtgaagttcatcgtgcagc

SEQ ID NO: 9498607 - DNA, 22 bp, Homo sapiens
agagtgaagtttttgaaagtga

SEQ ID NO: 9498608 - DNA, 22 bp, Homo sapiens
agagtgaagttcatcgtgcagc

SEQ ID NO: 9498609 - DNA, 22 bp, Homo sapiens
aatttgggcgaggagggaggca

SEQ ID NO: 9498610 - DNA, 22 bp, Homo sapiens
aatttgtacaaaatgtttataa

SEQ ID NO: 9498611 - DNA, 22 bp, Homo sapiens
aatttgtacaaaatgtttataa

SEQ ID NO: 9498612 - DNA, 22 bp, Homo sapiens
aatttgtacaaaatgtttataa

SEQ ID NO: 9498613 - DNA, 22 bp, Homo sapiens
agagtgggttataggcagactt

SEQ ID NO: 9498614 - DNA, 22 bp, Homo sapiens
agagtgggttataggcagactt

SEQ ID NO: 9498615 - DNA, 22 bp, Homo sapiens
agagtggtggccgtggtgtcac

SEQ ID NO: 9498616 - DNA, 22 bp, Homo sapiens
agagtgacagccactgcagtaa

SEQ ID NO: 9498617 - DNA, 20 bp, Homo sapiens
agagtgggtgtcacaggctg

SEQ ID NO: 9498618 - DNA, 20 bp, Homo sapiens
agagtgggtgtcacaggctg

SEQ ID NO: 9498619 - DNA, 20 bp, Homo sapiens
agagtgggtgtcacaggctg

SEQ ID NO: 9498620 - DNA, 20 bp, Homo sapiens
agagtgggtgtcacaggctg

SEQ ID NO: 9498621 - DNA, 23 bp, Homo sapiens
acaacaggaaatcagacctgaac

SEQ ID NO: 9498622 - DNA, 22 bp, Homo sapiens
acaacagagctggactgagagg

SEQ ID NO: 9498623 - DNA, 22 bp, Homo sapiens
agatgctggatggaaaatgatc

SEQ ID NO: 9498624 - DNA, 22 bp, Homo sapiens
agatgctgattgaatagatttc

SEQ ID NO: 9498625 - DNA, 22 bp, Homo sapiens
acaacagtaggaaaacatgtct

SEQ ID NO: 9498626 - DNA, 22 bp, Homo sapiens
acaacagtagcctttacaaggc

SEQ ID NO: 9498627 - DNA, 22 bp, Homo sapiens
acaacagtaggaaaacatgtct

SEQ ID NO: 9498628 - DNA, 22 bp, Homo sapiens
acaacagtagcctttacaaggc

SEQ ID NO: 9498629 - DNA, 22 bp, Homo sapiens
agatgctgctccacaggccagg

SEQ ID NO: 9498630 - DNA, 22 bp, Homo sapiens
agatgctgctccacaggccagg

SEQ ID NO: 9498631 - DNA, 22 bp, Homo sapiens
agatgctgccaggcccctcagt

SEQ ID NO: 9498632 - DNA, 22 bp, Homo sapiens
agatgctgaagctgaggcaaca

SEQ ID NO: 9498633 - DNA, 22 bp, Homo sapiens
agatgctgaattattgtgcttt

SEQ ID NO: 9498634 - DNA, 22 bp, Homo sapiens
agatgctgaattattgtgcttt

SEQ ID NO: 9498635 - DNA, 22 bp, Homo sapiens
agatgctgaattattgtgcttt

SEQ ID NO: 9498636 - DNA, 21 bp, Homo sapiens
agatgctgatgctgcaggtcc

SEQ ID NO: 9498637 - DNA, 22 bp, Homo sapiens
agatgccaggttgggaagtgat

SEQ ID NO: 9498638 - DNA, 22 bp, Homo sapiens
agatgccagcttacactgggaa

SEQ ID NO: 9498639 - DNA, 21 bp, Homo sapiens
agatgcagtttgcaggtgggt

SEQ ID NO: 9498640 - DNA, 22 bp, Homo sapiens
agatgcagtggttaacaataca

SEQ ID NO: 9498641 - DNA, 22 bp, Homo sapiens
agatgcagtggttaacaataca

SEQ ID NO: 9498642 - DNA, 22 bp, Homo sapiens
agatgcagatttggattcagga

SEQ ID NO: 9498643 - DNA, 22 bp, Homo sapiens
agatgcagatttggattcagga

SEQ ID NO: 9498644 - DNA, 21 bp, Homo sapiens
agatgcagtgacccactgggg

SEQ ID NO: 9498645 - DNA, 22 bp, Homo sapiens
agatgcagacttggttcaggca

SEQ ID NO: 9498646 - DNA, 22 bp, Homo sapiens
agatgcagacttggttcaggca

SEQ ID NO: 9498647 - DNA, 22 bp, Homo sapiens
agatgcagacttggttcaggca

SEQ ID NO: 9498648 - DNA, 22 bp, Homo sapiens
agatgcagagtttgctgtggac

SEQ ID NO: 9498649 - DNA, 22 bp, Homo sapiens
acaaagtcacaataattaacct

SEQ ID NO: 9498650 - DNA, 22 bp, Homo sapiens
agagttccacgtacagcttttg

SEQ ID NO: 9498651 - DNA, 20 bp, Homo sapiens
acaaagtattgaggacaagt

SEQ ID NO: 9498652 - DNA, 22 bp, Homo sapiens
agagttcagttgtagccatatt

SEQ ID NO: 9498653 - DNA, 22 bp, Homo sapiens
agagttcacactcagtgcaccc

SEQ ID NO: 9498654 - DNA, 22 bp, Homo sapiens
agagttcacactcagtgcaccc

SEQ ID NO: 9498655 - DNA, 19 bp, Homo sapiens
acaaagtgcgtgctctttt

SEQ ID NO: 9498656 - DNA, 22 bp, Homo sapiens
acaaagtgctgacattacaggc

SEQ ID NO: 9498657 - DNA, 22 bp, Homo sapiens
acaaagtctctaataatcttct

SEQ ID NO: 9498658 - DNA, 22 bp, Homo sapiens
acaaagtctctaataatcttct

SEQ ID NO: 9498659 - DNA, 22 bp, Homo sapiens
acaaagtgtgcggagcccaggg

SEQ ID NO: 9498660 - DNA, 22 bp, Homo sapiens
acaaagtgttttctgaaggcct

SEQ ID NO: 9498661 - DNA, 22 bp, Homo sapiens
acaaatagagattcaaataaag

SEQ ID NO: 9498662 - DNA, 22 bp, Homo sapiens
acaaataggtagatttgcaaca

SEQ ID NO: 9498663 - DNA, 22 bp, Homo sapiens
acaaataggtagatttgcaaca

SEQ ID NO: 9498664 - DNA, 22 bp, Homo sapiens
acaaatagaaaatctggattgg

SEQ ID NO: 9498665 - DNA, 22 bp, Homo sapiens
agatctttagtgaagctaaatc

SEQ ID NO: 9498666 - DNA, 22 bp, Homo sapiens
agatctttagtgaagctaaatc

SEQ ID NO: 9498667 - DNA, 22 bp, Homo sapiens
agcacagggcccagcctaggcc

SEQ ID NO: 9498668 - DNA, 22 bp, Homo sapiens
agcacagggcccagcctaggcc

SEQ ID NO: 9498669 - DNA, 22 bp, Homo sapiens
agcacagggcccagcctaggcc

SEQ ID NO: 9498670 - DNA, 22 bp, Homo sapiens
agcacagggcccagcctaggcc

SEQ ID NO: 9498671 - DNA, 22 bp, Homo sapiens
agcacagggacaatgccaggtg

SEQ ID NO: 9498672 - DNA, 22 bp, Homo sapiens
agcacaggctttggtgtgaggg

SEQ ID NO: 9498673 - DNA, 22 bp, Homo sapiens
agcacaggctttggtgtgaggg

SEQ ID NO: 9498674 - DNA, 22 bp, Homo sapiens
agcacaggacgtagagcttgga

SEQ ID NO: 9498675 - DNA, 22 bp, Homo sapiens
agcacaggacgtagagcttgga

SEQ ID NO: 9498676 - DNA, 22 bp, Homo sapiens
agcacaggacgtagagcttgga

SEQ ID NO: 9498677 - DNA, 22 bp, Homo sapiens
agcacaggaccaaggaagctgt

SEQ ID NO: 9498678 - DNA, 22 bp, Homo sapiens
acacaaattgtaggataattgc

SEQ ID NO: 9498679 - DNA, 22 bp, Homo sapiens
acacaaaatcaaagtcctaggc

SEQ ID NO: 9498680 - DNA, 22 bp, Homo sapiens
agcacagggcccagcctaggcc

SEQ ID NO: 9498681 - DNA, 22 bp, Homo sapiens
agcacaggtaatacagagtaac

SEQ ID NO: 9498682 - DNA, 22 bp, Homo sapiens
agcacaggtaatacagagtaac

SEQ ID NO: 9498683 - DNA, 21 bp, Homo sapiens
acacaacaggcagtcattttc

SEQ ID NO: 9498684 - DNA, 22 bp, Homo sapiens
acacaaattgtaggataattgc

SEQ ID NO: 9498685 - DNA, 22 bp, Homo sapiens
acacaacagaagagcaattgca

SEQ ID NO: 9498686 - DNA, 22 bp, Homo sapiens
acacaaattgtaggataattgc

SEQ ID NO: 9498687 - DNA, 21 bp, Homo sapiens
acacaacaggcagtcattttc

SEQ ID NO: 9498688 - DNA, 22 bp, Homo sapiens
acacaacagaagagcaattgca

SEQ ID NO: 9498689 - DNA, 22 bp, Homo sapiens
acacaacagaagagcaattgca

SEQ ID NO: 9498690 - DNA, 22 bp, Homo sapiens
agcacagaaagtattgactgaa

SEQ ID NO: 9498691 - DNA, 22 bp, Homo sapiens
agcacagaaagtattgactgaa

SEQ ID NO: 9498692 - DNA, 22 bp, Homo sapiens
agcacagaaagcacatttgaaa

SEQ ID NO: 9498693 - DNA, 22 bp, Homo sapiens
agcacagaaagtattgactgaa

SEQ ID NO: 9498694 - DNA, 22 bp, Homo sapiens
agcacacatcacttctgctcat

SEQ ID NO: 9498695 - DNA, 21 bp, Homo sapiens
agcacagctttaagccatgtg

SEQ ID NO: 9498696 - DNA, 21 bp, Homo sapiens
agcacagctttaagccatgtg

SEQ ID NO: 9498697 - DNA, 22 bp, Homo sapiens
agcacagaatggcttggaagcc

SEQ ID NO: 9498698 - DNA, 22 bp, Homo sapiens
agcacagaatggcttggaagcc

SEQ ID NO: 9498699 - DNA, 22 bp, Homo sapiens
agcacagaatgaggtggaagtg

SEQ ID NO: 9498700 - DNA, 22 bp, Homo sapiens
agcacagaatgaggtggaagtg

SEQ ID NO: 9498701 - DNA, 22 bp, Homo sapiens
agcacaagtttctggcagacag

SEQ ID NO: 9498702 - DNA, 22 bp, Homo sapiens
agcaaggcagtcagctggctgg

SEQ ID NO: 9498703 - DNA, 22 bp, Homo sapiens
agcaaggccgagaggatgctat

SEQ ID NO: 9498704 - DNA, 22 bp, Homo sapiens
agcacaaaagcagccacagatg

SEQ ID NO: 9498705 - DNA, 22 bp, Homo sapiens
agcacacaggccacctccactt

SEQ ID NO: 9498706 - DNA, 22 bp, Homo sapiens
agcacacagtattagccattgt

SEQ ID NO: 9498707 - DNA, 22 bp, Homo sapiens
agcacaatgtgaaaagagctct

SEQ ID NO: 9498708 - DNA, 22 bp, Homo sapiens
agcacaatgtgaaaagagctct

SEQ ID NO: 9498709 - DNA, 22 bp, Homo sapiens
agcacacaggacttgattcatg

SEQ ID NO: 9498710 - DNA, 22 bp, Homo sapiens
agcacacaggacttgattcatg

SEQ ID NO: 9498711 - DNA, 22 bp, Homo sapiens
agcaaagtcagtggaaccatcc

SEQ ID NO: 9498712 - DNA, 22 bp, Homo sapiens
agcaaagtatgtgctgggagct

SEQ ID NO: 9498713 - DNA, 22 bp, Homo sapiens
agcaaagtccagtctgtgtaca

SEQ ID NO: 9498714 - DNA, 22 bp, Homo sapiens
agcaaagtggctttccaaacca

SEQ ID NO: 9498715 - DNA, 22 bp, Homo sapiens
agcaaagtggctttccaaacca

SEQ ID NO: 9498716 - DNA, 22 bp, Homo sapiens
agcaaagtggctttccaaacca

SEQ ID NO: 9498717 - DNA, 22 bp, Homo sapiens
agcaaagttaaggtttctcttt

SEQ ID NO: 9498718 - DNA, 22 bp, Homo sapiens
agcaaagtagctgctgttctta

SEQ ID NO: 9498719 - DNA, 21 bp, Homo sapiens
agcaaaggcaggagaggtttc

SEQ ID NO: 9498720 - DNA, 22 bp, Homo sapiens
agcaaagctgctcccttttgtc

SEQ ID NO: 9498721 - DNA, 22 bp, Homo sapiens
agcaaagctgattaagagcaca

SEQ ID NO: 9498722 - DNA, 22 bp, Homo sapiens
agcaaagctgattaagagcaca

SEQ ID NO: 9498723 - DNA, 22 bp, Homo sapiens
agcaaagcttccataaagcagc

SEQ ID NO: 9498724 - DNA, 22 bp, Homo sapiens
agcaaataaagacaattatgtc

SEQ ID NO: 9498725 - DNA, 22 bp, Homo sapiens
agcaaataaagacaattatgtc

SEQ ID NO: 9498726 - DNA, 22 bp, Homo sapiens
agcaaatacatttttagcataa

SEQ ID NO: 9498727 - DNA, 22 bp, Homo sapiens
agcaaatacatttttagcataa

SEQ ID NO: 9498728 - DNA, 19 bp, Homo sapiens
agcaaatacatcaaaattg

SEQ ID NO: 9498729 - DNA, 22 bp, Homo sapiens
acaacagtttaggtatttgtag

SEQ ID NO: 9498730 - DNA, 22 bp, Homo sapiens
acaacattatacatagaaagct

SEQ ID NO: 9498731 - DNA, 22 bp, Homo sapiens
acaacattatacatagaaagct

SEQ ID NO: 9498732 - DNA, 22 bp, Homo sapiens
acaacagtccagtatagactgt

SEQ ID NO: 9498733 - DNA, 22 bp, Homo sapiens
acaacagtaggaaaacatgtct

SEQ ID NO: 9498734 - DNA, 22 bp, Homo sapiens
acaacagtccagtatagactgt

SEQ ID NO: 9498735 - DNA, 22 bp, Homo sapiens
acaacagtccagtatagactgt

SEQ ID NO: 9498736 - DNA, 22 bp, Homo sapiens
acaacagtttaggtatttgtag

SEQ ID NO: 9498737 - DNA, 22 bp, Homo sapiens
acaacattcttaaatacactga

SEQ ID NO: 9498738 - DNA, 22 bp, Homo sapiens
acaacattcttaaatacactga

SEQ ID NO: 9498739 - DNA, 22 bp, Homo sapiens
acaacattcttaaatacactga

SEQ ID NO: 9498740 - DNA, 22 bp, Homo sapiens
acaacattcttaaatacactga

SEQ ID NO: 9498741 - DNA, 22 bp, Homo sapiens
acaacattcttaaatacactga

SEQ ID NO: 9498742 - DNA, 22 bp, Homo sapiens
agcaaaagatagattaacaaga

SEQ ID NO: 9498743 - DNA, 22 bp, Homo sapiens
agcaaaagatagattaacaaga

SEQ ID NO: 9498744 - DNA, 18 bp, Homo sapiens
agattttgagaaatacaa

SEQ ID NO: 9498745 - DNA, 22 bp, Homo sapiens
acaataatgtattgccaaaagt

SEQ ID NO: 9498746 - DNA, 22 bp, Homo sapiens
acaataatgtattgccaaaagt

SEQ ID NO: 9498747 - DNA, 22 bp, Homo sapiens
acaataagtattgggcttttga

SEQ ID NO: 9498748 - DNA, 22 bp, Homo sapiens
acaatagaaggaaactgacata

SEQ ID NO: 9498749 - DNA, 22 bp, Homo sapiens
acaatagaaggaaactgacata

SEQ ID NO: 9498750 - DNA, 22 bp, Homo sapiens
acaatagaaggaaactgacata

SEQ ID NO: 9498751 - DNA, 22 bp, Homo sapiens
acaatagaaataattaagcaca

SEQ ID NO: 9498752 - DNA, 22 bp, Homo sapiens
acaatagaaataattaagcaca

SEQ ID NO: 9498753 - DNA, 19 bp, Homo sapiens
acaatagaaaagtcttttg

SEQ ID NO: 9498754 - DNA, 22 bp, Homo sapiens
acaatagaaataattaagcaca

SEQ ID NO: 9498755 - DNA, 19 bp, Homo sapiens
acaataactcattgattgc

SEQ ID NO: 9498756 - DNA, 22 bp, Homo sapiens
acaataacttctgtttccttgc

SEQ ID NO: 9498757 - DNA, 22 bp, Homo sapiens
acaagtttcattgtttagaacc

SEQ ID NO: 9498758 - DNA, 22 bp, Homo sapiens
agcaaatattttgttgaagtgc

SEQ ID NO: 9498759 - DNA, 18 bp, Homo sapiens
agcaaatattaagtgcat

SEQ ID NO: 9498760 - DNA, 22 bp, Homo sapiens
agcaaatacttgaataaaaaga

SEQ ID NO: 9498761 - DNA, 22 bp, Homo sapiens
agcaaatacttgaataaaaaga

SEQ ID NO: 9498762 - DNA, 22 bp, Homo sapiens
agcaaatacatttttagcataa

SEQ ID NO: 9498763 - DNA, 19 bp, Homo sapiens
agcaaatataatagtgttc

SEQ ID NO: 9498764 - DNA, 22 bp, Homo sapiens
agcaaatacttgaataaaaaga

SEQ ID NO: 9498765 - DNA, 22 bp, Homo sapiens
agagctggaagctgctcttaga

SEQ ID NO: 9498766 - DNA, 22 bp, Homo sapiens
agagctggaagctgctcttaga

SEQ ID NO: 9498767 - DNA, 22 bp, Homo sapiens
agagctggaatcagacctcagg

SEQ ID NO: 9498768 - DNA, 22 bp, Homo sapiens
aattcatactctatattgcttt

SEQ ID NO: 9498769 - DNA, 22 bp, Homo sapiens
aattcatactctatattgcttt

SEQ ID NO: 9498770 - DNA, 22 bp, Homo sapiens
aattcatagcaacaaagaccca

SEQ ID NO: 9498771 - DNA, 22 bp, Homo sapiens
aattcatagcaacaaagaccca

SEQ ID NO: 9498772 - DNA, 22 bp, Homo sapiens
aattcatatggatatgctagta

SEQ ID NO: 9498773 - DNA, 22 bp, Homo sapiens
aattcatatggatatgctagta

SEQ ID NO: 9498774 - DNA, 22 bp, Homo sapiens
aattcatagcaacaaagaccca

SEQ ID NO: 9498775 - DNA, 22 bp, Homo sapiens
aattcatatggatatgctagta

SEQ ID NO: 9498776 - DNA, 22 bp, Homo sapiens
aattcattgccagaatctatga

SEQ ID NO: 9498777 - DNA, 22 bp, Homo sapiens
aattcattaagaaagagctaaa

SEQ ID NO: 9498778 - DNA, 22 bp, Homo sapiens
aattcatccatgaacaattcca

SEQ ID NO: 9498779 - DNA, 22 bp, Homo sapiens
aattcatgagtagaatctatat

SEQ ID NO: 9498780 - DNA, 22 bp, Homo sapiens
aattcatccatgaacaattcca

SEQ ID NO: 9498781 - DNA, 22 bp, Homo sapiens
aattcattgccagaatctatga

SEQ ID NO: 9498782 - DNA, 22 bp, Homo sapiens
aattccaaatcaactagtctag

SEQ ID NO: 9498783 - DNA, 22 bp, Homo sapiens
agagctgaatttgggtggtgga

SEQ ID NO: 9498784 - DNA, 22 bp, Homo sapiens
agagctgagcaccaagcatggt

SEQ ID NO: 9498785 - DNA, 22 bp, Homo sapiens
agagctgaggatccagctgagc

SEQ ID NO: 9498786 - DNA, 22 bp, Homo sapiens
agagctgcaatttcatgtggtg

SEQ ID NO: 9498787 - DNA, 22 bp, Homo sapiens
agagcctggctcccagctaccg

SEQ ID NO: 9498788 - DNA, 22 bp, Homo sapiens
agagctgaattcaagtgctggc

SEQ ID NO: 9498789 - DNA, 22 bp, Homo sapiens
aattacagtcggagcagcactg

SEQ ID NO: 9498790 - DNA, 22 bp, Homo sapiens
aattaattttgttcattcagtc

SEQ ID NO: 9498791 - DNA, 22 bp, Homo sapiens
aattacaaatgtagactctcat

SEQ ID NO: 9498792 - DNA, 22 bp, Homo sapiens
aattacaaatgtagactctcat

SEQ ID NO: 9498793 - DNA, 23 bp, Homo sapiens
aattacaaccaagaactggaagg

SEQ ID NO: 9498794 - DNA, 21 bp, Homo sapiens
aattacagatggaattacaga

SEQ ID NO: 9498795 - DNA, 23 bp, Homo sapiens
aattacaaccaagaactggaagg

SEQ ID NO: 9498796 - DNA, 23 bp, Homo sapiens
aattacaaccaagaactggaagg

SEQ ID NO: 9498797 - DNA, 22 bp, Homo sapiens
aattaatggaaagtaaggaagg

SEQ ID NO: 9498798 - DNA, 22 bp, Homo sapiens
aattaatatttgtggaattaat

SEQ ID NO: 9498799 - DNA, 22 bp, Homo sapiens
aattaatatttgtggaattaat

SEQ ID NO: 9498800 - DNA, 22 bp, Homo sapiens
aattaagtcacacacctaaacc

SEQ ID NO: 9498801 - DNA, 22 bp, Homo sapiens
aattaagagagagttgaagcaa

SEQ ID NO: 9498802 - DNA, 22 bp, Homo sapiens
aattaagaaaatgttttatgat

SEQ ID NO: 9498803 - DNA, 22 bp, Homo sapiens
aattaagaaaatgttttatgat

SEQ ID NO: 9498804 - DNA, 22 bp, Homo sapiens
aattaacagagggcttattact

SEQ ID NO: 9498805 - DNA, 22 bp, Homo sapiens
aattaacagagggcttattact

SEQ ID NO: 9498806 - DNA, 22 bp, Homo sapiens
aattaacagagggcttattact

SEQ ID NO: 9498807 - DNA, 22 bp, Homo sapiens
aattaactaaaattcactttat

SEQ ID NO: 9498808 - DNA, 22 bp, Homo sapiens
agagcacaaattagttggtctt

SEQ ID NO: 9498809 - DNA, 22 bp, Homo sapiens
agaggcaaaaatctatggcaac

SEQ ID NO: 9498810 - DNA, 22 bp, Homo sapiens
agaggattgatcaaacactgca

SEQ ID NO: 9498811 - DNA, 22 bp, Homo sapiens
agaggatgttctaggcactcat

SEQ ID NO: 9498812 - DNA, 22 bp, Homo sapiens
agaggagtgggaagcagtgcaa

SEQ ID NO: 9498813 - DNA, 22 bp, Homo sapiens
agaggatcatctagtttgactc

SEQ ID NO: 9498814 - DNA, 22 bp, Homo sapiens
agaggatgattttaaggacact

SEQ ID NO: 9498815 - DNA, 22 bp, Homo sapiens
agaggatgattttaaggacact

SEQ ID NO: 9498816 - DNA, 22 bp, Homo sapiens
agaggatgattttaaggacact

SEQ ID NO: 9498817 - DNA, 22 bp, Homo sapiens
agaggatgattttaaggacact

SEQ ID NO: 9498818 - DNA, 22 bp, Homo sapiens
agaggaggtggtgatgctttaa

SEQ ID NO: 9498819 - DNA, 22 bp, Homo sapiens
agaggaatctgtctagacacaa

SEQ ID NO: 9498820 - DNA, 22 bp, Homo sapiens
agaggaataaatttctgtagtg

SEQ ID NO: 9498821 - DNA, 21 bp, Homo sapiens
agaggaagtgattggtctggc

SEQ ID NO: 9498822 - DNA, 21 bp, Homo sapiens
agaggaagtgattggtctggc

SEQ ID NO: 9498823 - DNA, 22 bp, Homo sapiens
agaggaagtaatcaggacctgc

SEQ ID NO: 9498824 - DNA, 22 bp, Homo sapiens
agaggaagtaatcaggacctgc

SEQ ID NO: 9498825 - DNA, 22 bp, Homo sapiens
agaggaagtaatcaggacctgc

SEQ ID NO: 9498826 - DNA, 22 bp, Homo sapiens
agaggaagtaatcaggacctgc

SEQ ID NO: 9498827 - DNA, 22 bp, Homo sapiens
agaggaagtaatcaggacctgc

SEQ ID NO: 9498828 - DNA, 22 bp, Homo sapiens
agaggaaggatgcatatccaaa

SEQ ID NO: 9498829 - DNA, 22 bp, Homo sapiens
agagctgggtggtggtgactca

SEQ ID NO: 9498830 - DNA, 22 bp, Homo sapiens
agagctgggtggtggtgactca

SEQ ID NO: 9498831 - DNA, 22 bp, Homo sapiens
aattccaagtagcatcccatca

SEQ ID NO: 9498832 - DNA, 22 bp, Homo sapiens
aattccaagagcttcctaagtg

SEQ ID NO: 9498833 - DNA, 22 bp, Homo sapiens
aattccaagagcttcctaagtg

SEQ ID NO: 9498834 - DNA, 22 bp, Homo sapiens
aattccaacagacaaagttaga

SEQ ID NO: 9498835 - DNA, 22 bp, Homo sapiens
aattccacagctgcacagaggt

SEQ ID NO: 9498836 - DNA, 22 bp, Homo sapiens
aattccacagatgtctatctgt

SEQ ID NO: 9498837 - DNA, 20 bp, Homo sapiens
aattccagcatgatatttat

SEQ ID NO: 9498838 - DNA, 20 bp, Homo sapiens
aatgtatattttatgccagg

SEQ ID NO: 9498839 - DNA, 22 bp, Homo sapiens
aatgtataatatttaatgcttt

SEQ ID NO: 9498840 - DNA, 22 bp, Homo sapiens
aatgtataatatttaatgcttt

SEQ ID NO: 9498841 - DNA, 20 bp, Homo sapiens
aatgtatattttatgccagg

SEQ ID NO: 9498842 - DNA, 22 bp, Homo sapiens
aatgtatgagcgtgaaagcact

SEQ ID NO: 9498843 - DNA, 22 bp, Homo sapiens
aatgtatgagcgtgaaagcact

SEQ ID NO: 9498844 - DNA, 22 bp, Homo sapiens
aatgtatgtgtatatcaaatca

SEQ ID NO: 9498845 - DNA, 22 bp, Homo sapiens
aatgtatgtgtatatcaaatca

SEQ ID NO: 9498846 - DNA, 22 bp, Homo sapiens
aatgtatgggtgagaaagttga

SEQ ID NO: 9498847 - DNA, 22 bp, Homo sapiens
aatgtatgggtgagaaagttga

SEQ ID NO: 9498848 - DNA, 23 bp, Homo sapiens
aatgtatgttagtatcttagaga

SEQ ID NO: 9498849 - DNA, 22 bp, Homo sapiens
agacatggagaaggagccagtg

SEQ ID NO: 9498850 - DNA, 22 bp, Homo sapiens
agacattatgctgagtgaaaga

SEQ ID NO: 9498851 - DNA, 22 bp, Homo sapiens
aatgtataaccataggaaattt

SEQ ID NO: 9498852 - DNA, 22 bp, Homo sapiens
aatgtataatatttaatgcttt

SEQ ID NO: 9498853 - DNA, 22 bp, Homo sapiens
aatgtataatatttaatgcttt

SEQ ID NO: 9498854 - DNA, 22 bp, Homo sapiens
aatgtataatatttaatgcttt

SEQ ID NO: 9498855 - DNA, 22 bp, Homo sapiens
agacatttatgtttctctagga

SEQ ID NO: 9498856 - DNA, 22 bp, Homo sapiens
agacatttatgtttctctagga

SEQ ID NO: 9498857 - DNA, 22 bp, Homo sapiens
agacatttattcacacatttat

SEQ ID NO: 9498858 - DNA, 23 bp, Homo sapiens
agacatcaggatggtggctggga

SEQ ID NO: 9498859 - DNA, 19 bp, Homo sapiens
aatgctgcttctttttgca

SEQ ID NO: 9498860 - DNA, 22 bp, Homo sapiens
aatgctgctctcataattatag

SEQ ID NO: 9498861 - DNA, 22 bp, Homo sapiens
agacatgacagatagttgctag

SEQ ID NO: 9498862 - DNA, 22 bp, Homo sapiens
agacatgaaaattccaaacatc

SEQ ID NO: 9498863 - DNA, 22 bp, Homo sapiens
aatgctctctgccatagctaac

SEQ ID NO: 9498864 - DNA, 17 bp, Homo sapiens
aatgctccaacctgaag

SEQ ID NO: 9498865 - DNA, 22 bp, Homo sapiens
aatgctcaaaatgtttcatcta

SEQ ID NO: 9498866 - DNA, 22 bp, Homo sapiens
aatgctatcggctctaagcatg

SEQ ID NO: 9498867 - DNA, 22 bp, Homo sapiens
aatgctaacattggtttatatc

SEQ ID NO: 9498868 - DNA, 22 bp, Homo sapiens
aatgctctttgaatttgtcaga

SEQ ID NO: 9498869 - DNA, 22 bp, Homo sapiens
aatgccttgcctgctacaactt

SEQ ID NO: 9498870 - DNA, 22 bp, Homo sapiens
aatgccttggagagcctagagg

SEQ ID NO: 9498871 - DNA, 22 bp, Homo sapiens
aatgccttgcctgctacaactt

SEQ ID NO: 9498872 - DNA, 22 bp, Homo sapiens
aatgccttgcctgctacaactt

SEQ ID NO: 9498873 - DNA, 22 bp, Homo sapiens
aatgccttggagagcctagagg

SEQ ID NO: 9498874 - DNA, 22 bp, Homo sapiens
aatgccttggagagcctagagg

SEQ ID NO: 9498875 - DNA, 22 bp, Homo sapiens
aatgccttggagagcctagagg

SEQ ID NO: 9498876 - DNA, 22 bp, Homo sapiens
aatgctaaaatggcactaaagt

SEQ ID NO: 9498877 - DNA, 22 bp, Homo sapiens
aatgctaaaatggcactaaagt

SEQ ID NO: 9498878 - DNA, 22 bp, Homo sapiens
aatgctaaaacacagatttttg

SEQ ID NO: 9498879 - DNA, 22 bp, Homo sapiens
aatgccttggagagcctagagg

SEQ ID NO: 9498880 - DNA, 22 bp, Homo sapiens
aatgctaaaacacagatttttg

SEQ ID NO: 9498881 - DNA, 22 bp, Homo sapiens
aatgtattatacataatttgtg

SEQ ID NO: 9498882 - DNA, 22 bp, Homo sapiens
agagaaggcatagaacttgagt

SEQ ID NO: 9498883 - DNA, 22 bp, Homo sapiens
agagaaggcatagaacttgagt

SEQ ID NO: 9498884 - DNA, 22 bp, Homo sapiens
agagaaggcatagaacttgagt

SEQ ID NO: 9498885 - DNA, 19 bp, Homo sapiens
agagaaggatcctatggtt

SEQ ID NO: 9498886 - DNA, 19 bp, Homo sapiens
agagaaggatcctatggtt

SEQ ID NO: 9498887 - DNA, 22 bp, Homo sapiens
agagaaatttccctgccttctg

SEQ ID NO: 9498888 - DNA, 19 bp, Homo sapiens
agagaaggatcctatggtt

SEQ ID NO: 9498889 - DNA, 21 bp, Homo sapiens
agagaagggattccaggccct

SEQ ID NO: 9498890 - DNA, 21 bp, Homo sapiens
agagaagggattccaggccct

SEQ ID NO: 9498891 - DNA, 21 bp, Homo sapiens
agagaagggattccaggccct

SEQ ID NO: 9498892 - DNA, 21 bp, Homo sapiens
agagaagggattccaggccct

SEQ ID NO: 9498893 - DNA, 21 bp, Homo sapiens
agagaagggactcttccagtc

SEQ ID NO: 9498894 - DNA, 22 bp, Homo sapiens
agagaagggcctgtatgtaatc

SEQ ID NO: 9498895 - DNA, 22 bp, Homo sapiens
agagaagggcctgtatgtaatc

SEQ ID NO: 9498896 - DNA, 21 bp, Homo sapiens
agagaagggactcttccagtc

SEQ ID NO: 9498897 - DNA, 21 bp, Homo sapiens
agagaagggactcttccagtc

SEQ ID NO: 9498898 - DNA, 22 bp, Homo sapiens
agagaaggcatagaacttgagt

SEQ ID NO: 9498899 - DNA, 22 bp, Homo sapiens
agagaagggaagggattcaccc

SEQ ID NO: 9498900 - DNA, 22 bp, Homo sapiens
agagaagggaagggattcaccc

SEQ ID NO: 9498901 - DNA, 21 bp, Homo sapiens
agagaagggactcttccagtc

SEQ ID NO: 9498902 - DNA, 22 bp, Homo sapiens
aatgtgtactttttcatgctca

SEQ ID NO: 9498903 - DNA, 22 bp, Homo sapiens
agagaaggggtaaagagtcctg

SEQ ID NO: 9498904 - DNA, 22 bp, Homo sapiens
agagaaggggtaaagagtcctg

SEQ ID NO: 9498905 - DNA, 22 bp, Homo sapiens
aatgtgtacatgacagatagaa

SEQ ID NO: 9498906 - DNA, 22 bp, Homo sapiens
aatgtgtagcatttaatgcagt

SEQ ID NO: 9498907 - DNA, 22 bp, Homo sapiens
aatgtgtagcatttaatgcagt

SEQ ID NO: 9498908 - DNA, 22 bp, Homo sapiens
agagaagggcctgtatgtaatc

SEQ ID NO: 9498909 - DNA, 22 bp, Homo sapiens
agagaagggcctgtatgtaatc

SEQ ID NO: 9498910 - DNA, 22 bp, Homo sapiens
agagaagggcctgtatgtaatc

SEQ ID NO: 9498911 - DNA, 22 bp, Homo sapiens
agagaagggggaaagatctcac

SEQ ID NO: 9498912 - DNA, 22 bp, Homo sapiens
agagaagggggaaagatctcac

SEQ ID NO: 9498913 - DNA, 22 bp, Homo sapiens
agagaagggggaaagatctcac

SEQ ID NO: 9498914 - DNA, 22 bp, Homo sapiens
agagaagggggaaagatctcac

SEQ ID NO: 9498915 - DNA, 22 bp, Homo sapiens
agagaaggggtaaagagtcctg

SEQ ID NO: 9498916 - DNA, 22 bp, Homo sapiens
agagaagggggaaagatctcac

SEQ ID NO: 9498917 - DNA, 22 bp, Homo sapiens
agagaaggggtaaagagtcctg

SEQ ID NO: 9498918 - DNA, 22 bp, Homo sapiens
agagaaggggtaaagagtcctg

SEQ ID NO: 9498919 - DNA, 22 bp, Homo sapiens
agagaaggggtaaagagtcctg

SEQ ID NO: 9498920 - DNA, 22 bp, Homo sapiens
agagaaggggtaaagagtcctg

SEQ ID NO: 9498921 - DNA, 22 bp, Homo sapiens
agagcaatttcttctccaagtt

SEQ ID NO: 9498922 - DNA, 22 bp, Homo sapiens
agagcaatttcttctccaagtt

SEQ ID NO: 9498923 - DNA, 22 bp, Homo sapiens
agagcaagtgacagaaacaggg

SEQ ID NO: 9498924 - DNA, 21 bp, Homo sapiens
agagcaagttaaggcattaat

SEQ ID NO: 9498925 - DNA, 22 bp, Homo sapiens
agagcaatggcatccagctgat

SEQ ID NO: 9498926 - DNA, 23 bp, Homo sapiens
agagcaaggaaatgaggtgtgat

SEQ ID NO: 9498927 - DNA, 23 bp, Homo sapiens
agagcaaggaaatgaggtgtgat

SEQ ID NO: 9498928 - DNA, 23 bp, Homo sapiens
agagcaaggaaatgaggtgtgat

SEQ ID NO: 9498929 - DNA, 22 bp, Homo sapiens
agagcaagtgacagaaacaggg

SEQ ID NO: 9498930 - DNA, 22 bp, Homo sapiens
agagcaagtgacagaaacaggg

SEQ ID NO: 9498931 - DNA, 22 bp, Homo sapiens
agagcaagtgacagaaacaggg

SEQ ID NO: 9498932 - DNA, 22 bp, Homo sapiens
agagcaaagggacatggaagag

SEQ ID NO: 9498933 - DNA, 22 bp, Homo sapiens
agagcaaagggacatggaagag

SEQ ID NO: 9498934 - DNA, 22 bp, Homo sapiens
agagatttgtcaatgatttcca

SEQ ID NO: 9498935 - DNA, 22 bp, Homo sapiens
agagatttctactgcactcttt

SEQ ID NO: 9498936 - DNA, 22 bp, Homo sapiens
agagcaaatagagaagccagct

SEQ ID NO: 9498937 - DNA, 22 bp, Homo sapiens
agagcaaatagagaagccagct

SEQ ID NO: 9498938 - DNA, 22 bp, Homo sapiens
agagcaaatagagaagccagct

SEQ ID NO: 9498939 - DNA, 23 bp, Homo sapiens
agagcaaggaaatgaggtgtgat

SEQ ID NO: 9498940 - DNA, 22 bp, Homo sapiens
aatgtgtatactggcaattaag

SEQ ID NO: 9498941 - DNA, 22 bp, Homo sapiens
aatgtgtataagggagagctaa

SEQ ID NO: 9498942 - DNA, 22 bp, Homo sapiens
aatgtgtcagcttgtcgatctt

SEQ ID NO: 9498943 - DNA, 22 bp, Homo sapiens
aatgtgtcatttcccacaggtg

SEQ ID NO: 9498944 - DNA, 22 bp, Homo sapiens
aatgtgtcccttatttcacagg

SEQ ID NO: 9498945 - DNA, 22 bp, Homo sapiens
aatgtgtgttcggggcccagag

SEQ ID NO: 9498946 - DNA, 22 bp, Homo sapiens
aatgtgtgtatttctaggcgag

SEQ ID NO: 9498947 - DNA, 21 bp, Homo sapiens
aatgtgtgctatttatctttt

SEQ ID NO: 9498948 - DNA, 22 bp, Homo sapiens
aatgtgtgaacttcagagcatc

SEQ ID NO: 9498949 - DNA, 22 bp, Homo sapiens
agagatgaaaagtggagactgg

SEQ ID NO: 9498950 - DNA, 22 bp, Homo sapiens
agagatgaaaagggtactgagg

SEQ ID NO: 9498951 - DNA, 22 bp, Homo sapiens
agagatgaaaagggtactgagg

SEQ ID NO: 9498952 - DNA, 22 bp, Homo sapiens
aatgtgtgcctgttaaggggca

SEQ ID NO: 9498953 - DNA, 22 bp, Homo sapiens
agagatgaaaagggtactgagg

SEQ ID NO: 9498954 - DNA, 22 bp, Homo sapiens
agcggtggtgtcggcagcggct

SEQ ID NO: 9498955 - DNA, 22 bp, Homo sapiens
agcggctgtcggccagccggag

SEQ ID NO: 9498956 - DNA, 22 bp, Homo sapiens
agcgggcaccctttgagggttt

SEQ ID NO: 9498957 - DNA, 22 bp, Homo sapiens
acagaggtcatggagagttctc

SEQ ID NO: 9498958 - DNA, 22 bp, Homo sapiens
agccttagatttgggcaagaac

SEQ ID NO: 9498959 - DNA, 22 bp, Homo sapiens
agccttcaacctagctagagca

SEQ ID NO: 9498960 - DNA, 22 bp, Homo sapiens
agctaaatgttgcttaaaattt

SEQ ID NO: 9498961 - DNA, 22 bp, Homo sapiens
agctaaatgtgaaatgtcaacc

SEQ ID NO: 9498962 - DNA, 22 bp, Homo sapiens
agctaaatgtgaaatgtcaacc

SEQ ID NO: 9498963 - DNA, 22 bp, Homo sapiens
agctaaatcctacttttgtatt

SEQ ID NO: 9498964 - DNA, 22 bp, Homo sapiens
agctaaatcctacttttgtatt

SEQ ID NO: 9498965 - DNA, 22 bp, Homo sapiens
agctaaatcacttattctttca

SEQ ID NO: 9498966 - DNA, 22 bp, Homo sapiens
agctaaactaggtaaacagcag

SEQ ID NO: 9498967 - DNA, 22 bp, Homo sapiens
acagataattagcataaatgct

SEQ ID NO: 9498968 - DNA, 22 bp, Homo sapiens
acagataattagcataaatgct

SEQ ID NO: 9498969 - DNA, 22 bp, Homo sapiens
acagataattagcataaatgct

SEQ ID NO: 9498970 - DNA, 22 bp, Homo sapiens
acagataattagcataaatgct

SEQ ID NO: 9498971 - DNA, 22 bp, Homo sapiens
acagataatacattgtgctaca

SEQ ID NO: 9498972 - DNA, 22 bp, Homo sapiens
agcgtgtgtgcgggtcttcttt

SEQ ID NO: 9498973 - DNA, 22 bp, Homo sapiens
agcgtgtggagaactaagcaga

SEQ ID NO: 9498974 - DNA, 22 bp, Homo sapiens
agcgtgtgtgcgggtcttcttt

SEQ ID NO: 9498975 - DNA, 22 bp, Homo sapiens
agcgtgggtccaaggctctggt

SEQ ID NO: 9498976 - DNA, 22 bp, Homo sapiens
agcgtgtgcctcggggtacacg

SEQ ID NO: 9498977 - DNA, 22 bp, Homo sapiens
agcgtggactgctgggcaaggt

SEQ ID NO: 9498978 - DNA, 22 bp, Homo sapiens
agcgtgaattagttggtacaca

SEQ ID NO: 9498979 - DNA, 21 bp, Homo sapiens
agcgtcaatatcgtcaacagg

SEQ ID NO: 9498980 - DNA, 22 bp, Homo sapiens
agcgtgaattagttggtacaca

SEQ ID NO: 9498981 - DNA, 23 bp, Homo sapiens
acagaggcttaaatgagtggcag

SEQ ID NO: 9498982 - DNA, 23 bp, Homo sapiens
acagaggcttaaatgagtggcag

SEQ ID NO: 9498983 - DNA, 23 bp, Homo sapiens
acagaggcttaaatgagtggcag

SEQ ID NO: 9498984 - DNA, 22 bp, Homo sapiens
acagaggctgatcttcaagccc

SEQ ID NO: 9498985 - DNA, 22 bp, Homo sapiens
acagaggcctcgtaggtacaac

SEQ ID NO: 9498986 - DNA, 22 bp, Homo sapiens
acagaggctgcgcttgggaacg

SEQ ID NO: 9498987 - DNA, 22 bp, Homo sapiens
acagaggccccgtgggagagcc

SEQ ID NO: 9498988 - DNA, 22 bp, Homo sapiens
acagaggccccgtgggagagcc

SEQ ID NO: 9498989 - DNA, 22 bp, Homo sapiens
acagaggcctcgtaggtacaac

SEQ ID NO: 9498990 - DNA, 22 bp, Homo sapiens
acagaggcctcgtaggtacaac

SEQ ID NO: 9498991 - DNA, 22 bp, Homo sapiens
acagaggcctcgtaggtacaac

SEQ ID NO: 9498992 - DNA, 22 bp, Homo sapiens
acagaggcctcggcctgcccag

SEQ ID NO: 9498993 - DNA, 22 bp, Homo sapiens
acagaggcctcggcctgcccag

SEQ ID NO: 9498994 - DNA, 22 bp, Homo sapiens
acagagggtctgggcacaggac

SEQ ID NO: 9498995 - DNA, 22 bp, Homo sapiens
acagagggtctgggcacaggac

SEQ ID NO: 9498996 - DNA, 22 bp, Homo sapiens
acagaggggtcacagcctgaag

SEQ ID NO: 9498997 - DNA, 22 bp, Homo sapiens
acagagggggccttggagtgca

SEQ ID NO: 9498998 - DNA, 19 bp, Homo sapiens
acagagggcaactgagaaa

SEQ ID NO: 9498999 - DNA, 22 bp, Homo sapiens
acagagggtgtggaggaagacg

SEQ ID NO: 9499000 - DNA, 22 bp, Homo sapiens
acagagggtgtggaggaagacg

SEQ ID NO: 9499001 - DNA, 22 bp, Homo sapiens
acagagggtgtggaggaagacg

SEQ ID NO: 9499002 - DNA, 22 bp, Homo sapiens
acagaggtcacctttgtatctt

SEQ ID NO: 9499003 - DNA, 22 bp, Homo sapiens
acagaggtaggacatgagatat

SEQ ID NO: 9499004 - DNA, 22 bp, Homo sapiens
acagaagctcaagagagcagtg

SEQ ID NO: 9499005 - DNA, 22 bp, Homo sapiens
acagaaggcggggacaaggcgg

SEQ ID NO: 9499006 - DNA, 22 bp, Homo sapiens
acagaagtccccatgaagaagc

SEQ ID NO: 9499007 - DNA, 22 bp, Homo sapiens
acagaagtccccatgaagaagc

SEQ ID NO: 9499008 - DNA, 23 bp, Homo sapiens
acagaagccaggagccgctgggc

SEQ ID NO: 9499009 - DNA, 22 bp, Homo sapiens
acagaacttccagggaacatac

SEQ ID NO: 9499010 - DNA, 22 bp, Homo sapiens
acagaagtgtgtgtgtaggaat

SEQ ID NO: 9499011 - DNA, 22 bp, Homo sapiens
acagaagtgtgtgtgtaggaat

SEQ ID NO: 9499012 - DNA, 22 bp, Homo sapiens
acagaagtgtctttttcattca

SEQ ID NO: 9499013 - DNA, 22 bp, Homo sapiens
acagaagtgtctttttcattca

SEQ ID NO: 9499014 - DNA, 22 bp, Homo sapiens
acagaagtgttgaagttttcat

SEQ ID NO: 9499015 - DNA, 22 bp, Homo sapiens
acagaagtgacaatttcttggg

SEQ ID NO: 9499016 - DNA, 22 bp, Homo sapiens
acagaataactcttgcttgagt

SEQ ID NO: 9499017 - DNA, 22 bp, Homo sapiens
acagaagtttcaagtaagaagt

SEQ ID NO: 9499018 - DNA, 22 bp, Homo sapiens
acagaagttggaattagatact

SEQ ID NO: 9499019 - DNA, 23 bp, Homo sapiens
acagaataccattgactaggtgt

SEQ ID NO: 9499020 - DNA, 23 bp, Homo sapiens
acagaataccattgactaggtgt

SEQ ID NO: 9499021 - DNA, 22 bp, Homo sapiens
acagaatactcataagaagggg

SEQ ID NO: 9499022 - DNA, 22 bp, Homo sapiens
acagaatactacagactggtta

SEQ ID NO: 9499023 - DNA, 22 bp, Homo sapiens
acagaatactcataagaagggg

SEQ ID NO: 9499024 - DNA, 22 bp, Homo sapiens
acagaatagtagcttaaagtca

SEQ ID NO: 9499025 - DNA, 22 bp, Homo sapiens
acagaataggtacagtcagtca

SEQ ID NO: 9499026 - DNA, 22 bp, Homo sapiens
acagaatagtagcttaaagtca

SEQ ID NO: 9499027 - DNA, 22 bp, Homo sapiens
acagaatagtagcttaaagtca

SEQ ID NO: 9499028 - DNA, 22 bp, Homo sapiens
acagaatagtagcttaaagtca

SEQ ID NO: 9499029 - DNA, 22 bp, Homo sapiens
acagaatattggttactgttgc

SEQ ID NO: 9499030 - DNA, 22 bp, Homo sapiens
acagaatattggttactgttgc

SEQ ID NO: 9499031 - DNA, 22 bp, Homo sapiens
acagaatattggttactgttgc

SEQ ID NO: 9499032 - DNA, 22 bp, Homo sapiens
acagaatgcgtagtgcatgttg

SEQ ID NO: 9499033 - DNA, 22 bp, Homo sapiens
acagaggccatgagctgccacc

SEQ ID NO: 9499034 - DNA, 21 bp, Homo sapiens
acagaggcatacagcttaagg

SEQ ID NO: 9499035 - DNA, 22 bp, Homo sapiens
acagaggcagtgtgagatactg

SEQ ID NO: 9499036 - DNA, 22 bp, Homo sapiens
acagaggcagtgtgagatactg

SEQ ID NO: 9499037 - DNA, 17 bp, Homo sapiens
acagaggcaggagtgga

SEQ ID NO: 9499038 - DNA, 22 bp, Homo sapiens
acagaattaacatttgatgaat

SEQ ID NO: 9499039 - DNA, 17 bp, Homo sapiens
acagaggcaggagtgga

SEQ ID NO: 9499040 - DNA, 17 bp, Homo sapiens
acagaggcaggagtgga

SEQ ID NO: 9499041 - DNA, 22 bp, Homo sapiens
acagaattaacatttgatgaat

SEQ ID NO: 9499042 - DNA, 22 bp, Homo sapiens
acagaattaaagtgtttgtgga

SEQ ID NO: 9499043 - DNA, 22 bp, Homo sapiens
acagaattaaagtgtttgtgga

SEQ ID NO: 9499044 - DNA, 22 bp, Homo sapiens
acagaatgggatttgaatattt

SEQ ID NO: 9499045 - DNA, 22 bp, Homo sapiens
acagaatgggatttgaatattt

SEQ ID NO: 9499046 - DNA, 22 bp, Homo sapiens
acagaatgcgtagtgcatgttg

SEQ ID NO: 9499047 - DNA, 22 bp, Homo sapiens
acagaatgggatttgaatattt

SEQ ID NO: 9499048 - DNA, 22 bp, Homo sapiens
acagcagaccactactagtagg

SEQ ID NO: 9499049 - DNA, 22 bp, Homo sapiens
acagcagaccccagtgccatgg

SEQ ID NO: 9499050 - DNA, 22 bp, Homo sapiens
acagcagagtgtgagatagcca

SEQ ID NO: 9499051 - DNA, 22 bp, Homo sapiens
acagcagagtgtgagatagcca

SEQ ID NO: 9499052 - DNA, 22 bp, Homo sapiens
acagcagagtggagatgagcac

SEQ ID NO: 9499053 - DNA, 20 bp, Homo sapiens
acagcagataccacaactat

SEQ ID NO: 9499054 - DNA, 22 bp, Homo sapiens
acagcagatctggctacaggtt

SEQ ID NO: 9499055 - DNA, 22 bp, Homo sapiens
acagcagagtgtgagatagcca

SEQ ID NO: 9499056 - DNA, 22 bp, Homo sapiens
acagcagagtgtgagatagcca

SEQ ID NO: 9499057 - DNA, 22 bp, Homo sapiens
acagatagatgataatggcttt

SEQ ID NO: 9499058 - DNA, 22 bp, Homo sapiens
acagatactcagctctatgctt

SEQ ID NO: 9499059 - DNA, 22 bp, Homo sapiens
acagataatttaattaatgcat

SEQ ID NO: 9499060 - DNA, 22 bp, Homo sapiens
acagatacaaatatacaaatac

SEQ ID NO: 9499061 - DNA, 22 bp, Homo sapiens
acagatatatgattgtgtaaat

SEQ ID NO: 9499062 - DNA, 22 bp, Homo sapiens
acagatatttaagagcttttgt

SEQ ID NO: 9499063 - DNA, 22 bp, Homo sapiens
acagatataaactatagtagtg

SEQ ID NO: 9499064 - DNA, 22 bp, Homo sapiens
acagatataaactatagtagtg

SEQ ID NO: 9499065 - DNA, 22 bp, Homo sapiens
acagcagatctgtggagcttat

SEQ ID NO: 9499066 - DNA, 22 bp, Homo sapiens
acagcagatgacaactatttat

SEQ ID NO: 9499067 - DNA, 22 bp, Homo sapiens
acagcagattacattctgctat

SEQ ID NO: 9499068 - DNA, 22 bp, Homo sapiens
acagcagatttccctgggctcc

SEQ ID NO: 9499069 - DNA, 21 bp, Homo sapiens
acagcagcaatctgtctttcc

SEQ ID NO: 9499070 - DNA, 21 bp, Homo sapiens
acagcagcaatctgtctttcc

SEQ ID NO: 9499071 - DNA, 22 bp, Homo sapiens
acagcagcaatagcagtgacat

SEQ ID NO: 9499072 - DNA, 22 bp, Homo sapiens
acagcagcaatagcagtgacat

SEQ ID NO: 9499073 - DNA, 22 bp, Homo sapiens
acagcagcatcctatttcactc

SEQ ID NO: 9499074 - DNA, 22 bp, Homo sapiens
acagcagcataaactgactaag

SEQ ID NO: 9499075 - DNA, 22 bp, Homo sapiens
acagcagcataaactgactaag

SEQ ID NO: 9499076 - DNA, 22 bp, Homo sapiens
acagcagcagaccagcatatgt

SEQ ID NO: 9499077 - DNA, 22 bp, Homo sapiens
acagcagcactattgacatttt

SEQ ID NO: 9499078 - DNA, 22 bp, Homo sapiens
acagcagcactattgacatttt

SEQ ID NO: 9499079 - DNA, 20 bp, Homo sapiens
acagcagccttgctagaaac

SEQ ID NO: 9499080 - DNA, 22 bp, Homo sapiens
acagcagcctgcagccctgtgt

SEQ ID NO: 9499081 - DNA, 22 bp, Homo sapiens
acagcagcctgcagccctgtgt

SEQ ID NO: 9499082 - DNA, 22 bp, Homo sapiens
acagcagcctgcagccctgtgt

SEQ ID NO: 9499083 - DNA, 22 bp, Homo sapiens
acagcagccagccactgtgagc

SEQ ID NO: 9499084 - DNA, 22 bp, Homo sapiens
acagcagccagccactgtgagc

SEQ ID NO: 9499085 - DNA, 22 bp, Homo sapiens
agctgatgccatgtggaacagt

SEQ ID NO: 9499086 - DNA, 22 bp, Homo sapiens
acagcaggcatgaatgacactg

SEQ ID NO: 9499087 - DNA, 22 bp, Homo sapiens
agctgaggttgaagagtgaacg

SEQ ID NO: 9499088 - DNA, 22 bp, Homo sapiens
agctgagttaattcatcactta

SEQ ID NO: 9499089 - DNA, 21 bp, Homo sapiens
agctgaggtaaggcaagagag

SEQ ID NO: 9499090 - DNA, 23 bp, Homo sapiens
agctgaggtgcagatccaaagaa

SEQ ID NO: 9499091 - DNA, 23 bp, Homo sapiens
agctgaggtgcagatccaaagaa

SEQ ID NO: 9499092 - DNA, 22 bp, Homo sapiens
agctgaggttagtataaatgtg

SEQ ID NO: 9499093 - DNA, 22 bp, Homo sapiens
agctgagggcaggatggggtga

SEQ ID NO: 9499094 - DNA, 22 bp, Homo sapiens
agctgagggcaggatggggtga

SEQ ID NO: 9499095 - DNA, 21 bp, Homo sapiens
agctgaggtaaggcaagagag

SEQ ID NO: 9499096 - DNA, 22 bp, Homo sapiens
acagcagcgtgaagtgtgttat

SEQ ID NO: 9499097 - DNA, 22 bp, Homo sapiens
agctgagattatgctcttctca

SEQ ID NO: 9499098 - DNA, 22 bp, Homo sapiens
agctgagaggtggcaagctgta

SEQ ID NO: 9499099 - DNA, 22 bp, Homo sapiens
acagcagccttgttggtttcga

SEQ ID NO: 9499100 - DNA, 22 bp, Homo sapiens
acagcagcgtcaacttaaaatt

SEQ ID NO: 9499101 - DNA, 22 bp, Homo sapiens
acagcagtggattagaggatgg

SEQ ID NO: 9499102 - DNA, 22 bp, Homo sapiens
acagcaggttttaactttgaag

SEQ ID NO: 9499103 - DNA, 22 bp, Homo sapiens
acagcaggttttaactttgaag

SEQ ID NO: 9499104 - DNA, 22 bp, Homo sapiens
acagcaggttttaactttgaag

SEQ ID NO: 9499105 - DNA, 21 bp, Homo sapiens
acagcagggctggcatgacag

SEQ ID NO: 9499106 - DNA, 22 bp, Homo sapiens
acagcaggttattgttatggca

SEQ ID NO: 9499107 - DNA, 22 bp, Homo sapiens
acagcaggttacagtggcacag

SEQ ID NO: 9499108 - DNA, 18 bp, Homo sapiens
acagcaggtttcattctt

SEQ ID NO: 9499109 - DNA, 18 bp, Homo sapiens
acagcaggtttcattctt

SEQ ID NO: 9499110 - DNA, 17 bp, Homo sapiens
acagcaggcccggaggg

SEQ ID NO: 9499111 - DNA, 17 bp, Homo sapiens
acagcaggcccggaggg

SEQ ID NO: 9499112 - DNA, 22 bp, Homo sapiens
acagcaggcccatactggaagg

SEQ ID NO: 9499113 - DNA, 17 bp, Homo sapiens
acagcaggcccggaggg

SEQ ID NO: 9499114 - DNA, 22 bp, Homo sapiens
acagcaggcccatactggaagg

SEQ ID NO: 9499115 - DNA, 17 bp, Homo sapiens
acagcagggaagtgttg

SEQ ID NO: 9499116 - DNA, 19 bp, Homo sapiens
acagcagggatttttggag

SEQ ID NO: 9499117 - DNA, 22 bp, Homo sapiens
acagcagggaatatgggaattg

SEQ ID NO: 9499118 - DNA, 22 bp, Homo sapiens
agccagaggtcatgagcacagg

SEQ ID NO: 9499119 - DNA, 22 bp, Homo sapiens
agccagctgctcgggggaaaca

SEQ ID NO: 9499120 - DNA, 22 bp, Homo sapiens
agccagctgcctttcacatctg

SEQ ID NO: 9499121 - DNA, 22 bp, Homo sapiens
agccagctggagaccactgttt

SEQ ID NO: 9499122 - DNA, 22 bp, Homo sapiens
agccagctggtgggtcagctgg

SEQ ID NO: 9499123 - DNA, 22 bp, Homo sapiens
agccagctggagaccactgttt

SEQ ID NO: 9499124 - DNA, 22 bp, Homo sapiens
agccagaggccagcctgcctca

SEQ ID NO: 9499125 - DNA, 22 bp, Homo sapiens
agccagaggccagcctgcctca

SEQ ID NO: 9499126 - DNA, 22 bp, Homo sapiens
agccagaggtcatgagcacagg

SEQ ID NO: 9499127 - DNA, 22 bp, Homo sapiens
agccagaggtcatgagcacagg

SEQ ID NO: 9499128 - DNA, 22 bp, Homo sapiens
agccagagggatctttctaaga

SEQ ID NO: 9499129 - DNA, 22 bp, Homo sapiens
agccagaggtcatgagcacagg

SEQ ID NO: 9499130 - DNA, 22 bp, Homo sapiens
agccagaggtcatgagcacagg

SEQ ID NO: 9499131 - DNA, 22 bp, Homo sapiens
agccaggaaccagctacagtct

SEQ ID NO: 9499132 - DNA, 22 bp, Homo sapiens
agccagctttcacaaatgaaga

SEQ ID NO: 9499133 - DNA, 22 bp, Homo sapiens
agccagctgttctggggcagca

SEQ ID NO: 9499134 - DNA, 22 bp, Homo sapiens
agccaggaagaaggtcacacca

SEQ ID NO: 9499135 - DNA, 22 bp, Homo sapiens
agccaggaagagaggcctcacc

SEQ ID NO: 9499136 - DNA, 22 bp, Homo sapiens
agccagctgtgggctcaggcgg

SEQ ID NO: 9499137 - DNA, 22 bp, Homo sapiens
agccagctgtgggctcaggcgg

SEQ ID NO: 9499138 - DNA, 22 bp, Homo sapiens
agccagctgtgtggtcaggcaa

SEQ ID NO: 9499139 - DNA, 22 bp, Homo sapiens
agccagctgtgtggtcaggcaa

SEQ ID NO: 9499140 - DNA, 22 bp, Homo sapiens
agccagctggtgggtcagctgg

SEQ ID NO: 9499141 - DNA, 22 bp, Homo sapiens
agccagctgtactgcctgctca

SEQ ID NO: 9499142 - DNA, 22 bp, Homo sapiens
agccagctgtggctatggctcc

SEQ ID NO: 9499143 - DNA, 22 bp, Homo sapiens
agccagctgtcctccctttcct

SEQ ID NO: 9499144 - DNA, 22 bp, Homo sapiens
agccagagattgagatgcaggc

SEQ ID NO: 9499145 - DNA, 22 bp, Homo sapiens
agccagagctgatgtcattctc

SEQ ID NO: 9499146 - DNA, 22 bp, Homo sapiens
agccagagattgagatgcaggc

SEQ ID NO: 9499147 - DNA, 22 bp, Homo sapiens
agccagagattgagatgcaggc

SEQ ID NO: 9499148 - DNA, 22 bp, Homo sapiens
agccagagattgagatgcaggc

SEQ ID NO: 9499149 - DNA, 22 bp, Homo sapiens
agccagaggaagcctggccctc

SEQ ID NO: 9499150 - DNA, 22 bp, Homo sapiens
agccagaggaacttgatgactg

SEQ ID NO: 9499151 - DNA, 22 bp, Homo sapiens
agccagagattgagatgcaggc

SEQ ID NO: 9499152 - DNA, 22 bp, Homo sapiens
agccagagatccatccctagga

SEQ ID NO: 9499153 - DNA, 22 bp, Homo sapiens
agccacagtctgatgcctgaga

SEQ ID NO: 9499154 - DNA, 23 bp, Homo sapiens
acacttcacccattgtgatagga

SEQ ID NO: 9499155 - DNA, 22 bp, Homo sapiens
acacttcaaatggttggaaaat

SEQ ID NO: 9499156 - DNA, 22 bp, Homo sapiens
agccacagtctgatgcctgaga

SEQ ID NO: 9499157 - DNA, 22 bp, Homo sapiens
acactgttcctgaaattgttat

SEQ ID NO: 9499158 - DNA, 20 bp, Homo sapiens
acactgttcttcacacattt

SEQ ID NO: 9499159 - DNA, 22 bp, Homo sapiens
acactgttctttgcactgagaa

SEQ ID NO: 9499160 - DNA, 22 bp, Homo sapiens
acactgttgctggcacagacag

SEQ ID NO: 9499161 - DNA, 22 bp, Homo sapiens
acactgttccacactaagaagg

SEQ ID NO: 9499162 - DNA, 22 bp, Homo sapiens
acacttacggttccttcatcca

SEQ ID NO: 9499163 - DNA, 22 bp, Homo sapiens
acacttaatcttactgaggatc

SEQ ID NO: 9499164 - DNA, 22 bp, Homo sapiens
acacttcaaagggtgacttgat

SEQ ID NO: 9499165 - DNA, 22 bp, Homo sapiens
acacttatttttgtccacttcc

SEQ ID NO: 9499166 - DNA, 22 bp, Homo sapiens
acacttaagcatgaagtataaa

SEQ ID NO: 9499167 - DNA, 22 bp, Homo sapiens
acacttaagcatgaagtataaa

SEQ ID NO: 9499168 - DNA, 22 bp, Homo sapiens
acacttaacttctgagaataaa

SEQ ID NO: 9499169 - DNA, 22 bp, Homo sapiens
acactgttctttgcactgagaa

SEQ ID NO: 9499170 - DNA, 22 bp, Homo sapiens
acactgttgctggcacagacag

SEQ ID NO: 9499171 - DNA, 22 bp, Homo sapiens
acactgttgctggcacagacag

SEQ ID NO: 9499172 - DNA, 22 bp, Homo sapiens
acacccagctgggccacctcca

SEQ ID NO: 9499173 - DNA, 22 bp, Homo sapiens
acacccagctgggccacctcca

SEQ ID NO: 9499174 - DNA, 22 bp, Homo sapiens
acacccagcttttgaatgccct

SEQ ID NO: 9499175 - DNA, 22 bp, Homo sapiens
acacccagcttttgaatgccct

SEQ ID NO: 9499176 - DNA, 22 bp, Homo sapiens
acacccaggaataaggactggg

SEQ ID NO: 9499177 - DNA, 22 bp, Homo sapiens
acacccagcttttgaatgccct

SEQ ID NO: 9499178 - DNA, 22 bp, Homo sapiens
agcatttacctcaatgcatctg

SEQ ID NO: 9499179 - DNA, 22 bp, Homo sapiens
agccaaggacacggagcctcct

SEQ ID NO: 9499180 - DNA, 22 bp, Homo sapiens
agccaaggcagctagagctctg

SEQ ID NO: 9499181 - DNA, 22 bp, Homo sapiens
agccaaggagtgcaggtggctt

SEQ ID NO: 9499182 - DNA, 22 bp, Homo sapiens
agccaaggagtgcaggtggctt

SEQ ID NO: 9499183 - DNA, 22 bp, Homo sapiens
agccaaggagtgcaggtggctt

SEQ ID NO: 9499184 - DNA, 22 bp, Homo sapiens
agccaaggagtgcaggtggctt

SEQ ID NO: 9499185 - DNA, 22 bp, Homo sapiens
agccaaggagtgcaggtggctt

SEQ ID NO: 9499186 - DNA, 22 bp, Homo sapiens
agccaaggagtgcaggtggctt

SEQ ID NO: 9499187 - DNA, 22 bp, Homo sapiens
agccaaggagtgcaggtggctt

SEQ ID NO: 9499188 - DNA, 18 bp, Homo sapiens
agccaaggaggaggagga

SEQ ID NO: 9499189 - DNA, 18 bp, Homo sapiens
agccaaggaggaggagga

SEQ ID NO: 9499190 - DNA, 18 bp, Homo sapiens
agccaaggaggaggagga

SEQ ID NO: 9499191 - DNA, 22 bp, Homo sapiens
agccaaggacacggagcctcct

SEQ ID NO: 9499192 - DNA, 22 bp, Homo sapiens
agccaaggactcagtggtaggc

SEQ ID NO: 9499193 - DNA, 22 bp, Homo sapiens
agccaaggactcagtggtaggc

SEQ ID NO: 9499194 - DNA, 18 bp, Homo sapiens
agccaaggaggaggagga

SEQ ID NO: 9499195 - DNA, 18 bp, Homo sapiens
agccaaggaggaggagga

SEQ ID NO: 9499196 - DNA, 22 bp, Homo sapiens
agccaaggtatcatgagaggca

SEQ ID NO: 9499197 - DNA, 22 bp, Homo sapiens
agccaaggtcgccccagggcaa

SEQ ID NO: 9499198 - DNA, 22 bp, Homo sapiens
agccaaggtcgccccagggcaa

SEQ ID NO: 9499199 - DNA, 22 bp, Homo sapiens
agccaaggtcgccccagggcaa

SEQ ID NO: 9499200 - DNA, 22 bp, Homo sapiens
agccaaggtcgccccagggcaa

SEQ ID NO: 9499201 - DNA, 22 bp, Homo sapiens
agccaagggtcagctgcacaga

SEQ ID NO: 9499202 - DNA, 22 bp, Homo sapiens
agccaaggtatcatgagaggca

SEQ ID NO: 9499203 - DNA, 22 bp, Homo sapiens
agccaaggtatcatgagaggca

SEQ ID NO: 9499204 - DNA, 22 bp, Homo sapiens
agccaaggtatcatgagaggca

SEQ ID NO: 9499205 - DNA, 22 bp, Homo sapiens
agccaaggtatcatgagaggca

SEQ ID NO: 9499206 - DNA, 22 bp, Homo sapiens
agccaaggtatcatgagaggca

SEQ ID NO: 9499207 - DNA, 22 bp, Homo sapiens
agccaaggtatcatgagaggca

SEQ ID NO: 9499208 - DNA, 22 bp, Homo sapiens
agccaaggcagctagagctctg

SEQ ID NO: 9499209 - DNA, 22 bp, Homo sapiens
agccaaggcagctagagctctg

SEQ ID NO: 9499210 - DNA, 22 bp, Homo sapiens
agccaaggcagctagagctctg

SEQ ID NO: 9499211 - DNA, 22 bp, Homo sapiens
agccaaggcagctagagctctg

SEQ ID NO: 9499212 - DNA, 22 bp, Homo sapiens
agccaagggtcagctgcacaga

SEQ ID NO: 9499213 - DNA, 22 bp, Homo sapiens
agcaggtgtatataaggctgag

SEQ ID NO: 9499214 - DNA, 22 bp, Homo sapiens
agcaggtgtatataaggctgag

SEQ ID NO: 9499215 - DNA, 22 bp, Homo sapiens
agcaggtgtagggctctttgta

SEQ ID NO: 9499216 - DNA, 21 bp, Homo sapiens
agcaggtgtaaaggaggaaat

SEQ ID NO: 9499217 - DNA, 21 bp, Homo sapiens
agcaggtgtaaaggaggaaat

SEQ ID NO: 9499218 - DNA, 21 bp, Homo sapiens
agcaggtgtaaaggaggaaat

SEQ ID NO: 9499219 - DNA, 22 bp, Homo sapiens
agcaggtggtaggcagtcagca

SEQ ID NO: 9499220 - DNA, 22 bp, Homo sapiens
agcaggtggtaggcagtcagca

SEQ ID NO: 9499221 - DNA, 22 bp, Homo sapiens
agcaggtggtaggcagtcagca

SEQ ID NO: 9499222 - DNA, 22 bp, Homo sapiens
agcaggtggtctgttgctgctg

SEQ ID NO: 9499223 - DNA, 22 bp, Homo sapiens
agcaggtggtaggcagtcagca

SEQ ID NO: 9499224 - DNA, 22 bp, Homo sapiens
agcaggtggtaggcagtcagca

SEQ ID NO: 9499225 - DNA, 22 bp, Homo sapiens
agcaggtgagcacagccaggct

SEQ ID NO: 9499226 - DNA, 22 bp, Homo sapiens
agcaggtgagcacagccaggct

SEQ ID NO: 9499227 - DNA, 22 bp, Homo sapiens
acacccagagcgccagtgccga

SEQ ID NO: 9499228 - DNA, 22 bp, Homo sapiens
acacccagagcgccagtgccga

SEQ ID NO: 9499229 - DNA, 22 bp, Homo sapiens
acacccagattatgcacacaaa

SEQ ID NO: 9499230 - DNA, 22 bp, Homo sapiens
acacccagattatgcacacaaa

SEQ ID NO: 9499231 - DNA, 22 bp, Homo sapiens
acacccagagcgccagtgccga

SEQ ID NO: 9499232 - DNA, 21 bp, Homo sapiens
acacccacttatgcccgcttg

SEQ ID NO: 9499233 - DNA, 22 bp, Homo sapiens
acaccatggttcccaaactgtg

SEQ ID NO: 9499234 - DNA, 22 bp, Homo sapiens
agcaggtgtatcggtcacctac

SEQ ID NO: 9499235 - DNA, 22 bp, Homo sapiens
agcaggtgtatcggtcacctac

SEQ ID NO: 9499236 - DNA, 22 bp, Homo sapiens
acaccaggtcccgtctgtacct

SEQ ID NO: 9499237 - DNA, 22 bp, Homo sapiens
acaccagtcatttattcagtca

SEQ ID NO: 9499238 - DNA, 22 bp, Homo sapiens
acaccatactcatgttggttcc

SEQ ID NO: 9499239 - DNA, 22 bp, Homo sapiens
acaccatactcatgttggttcc

SEQ ID NO: 9499240 - DNA, 22 bp, Homo sapiens
acacagtatgcatctagaaatt

SEQ ID NO: 9499241 - DNA, 22 bp, Homo sapiens
acacagtattacaataggtgct

SEQ ID NO: 9499242 - DNA, 22 bp, Homo sapiens
acacagtatcaaatttcatctt

SEQ ID NO: 9499243 - DNA, 22 bp, Homo sapiens
acacagtatgaaaagtctagtt

SEQ ID NO: 9499244 - DNA, 18 bp, Homo sapiens
acacacacacctgtgtat

SEQ ID NO: 9499245 - DNA, 18 bp, Homo sapiens
acacacacacctgtgtat

SEQ ID NO: 9499246 - DNA, 18 bp, Homo sapiens
acacacacacctgtgtat

SEQ ID NO: 9499247 - DNA, 19 bp, Homo sapiens
acacagggctagagttaca

SEQ ID NO: 9499248 - DNA, 22 bp, Homo sapiens
acacacacaagcaggttgtgga

SEQ ID NO: 9499249 - DNA, 22 bp, Homo sapiens
acacacacaagcaggttgtgga

SEQ ID NO: 9499250 - DNA, 22 bp, Homo sapiens
acacacacaagcaggttgtgga

SEQ ID NO: 9499251 - DNA, 18 bp, Homo sapiens
acacacacacctgtgtat

SEQ ID NO: 9499252 - DNA, 22 bp, Homo sapiens
acacacacaagcaggttgtgga

SEQ ID NO: 9499253 - DNA, 22 bp, Homo sapiens
acacagtggtgagtctggacct

SEQ ID NO: 9499254 - DNA, 18 bp, Homo sapiens
acacagtggatgcctggt

SEQ ID NO: 9499255 - DNA, 22 bp, Homo sapiens
acacagtgccaaattgcagtta

SEQ ID NO: 9499256 - DNA, 20 bp, Homo sapiens
acacagtgacaggaaagaga

SEQ ID NO: 9499257 - DNA, 20 bp, Homo sapiens
acacagtgacaggaaagaga

SEQ ID NO: 9499258 - DNA, 22 bp, Homo sapiens
acacagtattgtgactataact

SEQ ID NO: 9499259 - DNA, 22 bp, Homo sapiens
acacagtattgtgactataact

SEQ ID NO: 9499260 - DNA, 22 bp, Homo sapiens
acacagtgtgtgcagtcggacg

SEQ ID NO: 9499261 - DNA, 22 bp, Homo sapiens
acacagtgtcttaggtagtgtc

SEQ ID NO: 9499262 - DNA, 22 bp, Homo sapiens
acacagtgtcagggcaggggcc

SEQ ID NO: 9499263 - DNA, 22 bp, Homo sapiens
acacagtggtgtttacaaaatt

SEQ ID NO: 9499264 - DNA, 22 bp, Homo sapiens
acacagtggtgtttacaaaatt

SEQ ID NO: 9499265 - DNA, 23 bp, Homo sapiens
acacaatagagtactattcagcc

SEQ ID NO: 9499266 - DNA, 19 bp, Homo sapiens
acacaatgacacatatata

SEQ ID NO: 9499267 - DNA, 23 bp, Homo sapiens
acacaatagagtactattcagcc

SEQ ID NO: 9499268 - DNA, 23 bp, Homo sapiens
acacaatagagtactattcagcc

SEQ ID NO: 9499269 - DNA, 22 bp, Homo sapiens
acacaatacagggctcaaaata

SEQ ID NO: 9499270 - DNA, 22 bp, Homo sapiens
acacaagtgaatattttaagga

SEQ ID NO: 9499271 - DNA, 22 bp, Homo sapiens
acacaagtccctccatactctc

SEQ ID NO: 9499272 - DNA, 23 bp, Homo sapiens
acacaagggtaactgccagccat

SEQ ID NO: 9499273 - DNA, 22 bp, Homo sapiens
acacaatacagggctcaaaata

SEQ ID NO: 9499274 - DNA, 22 bp, Homo sapiens
acacaataaatttatcctttga

SEQ ID NO: 9499275 - DNA, 22 bp, Homo sapiens
acacaagaataatgatgaaggt

SEQ ID NO: 9499276 - DNA, 22 bp, Homo sapiens
acacaagggcctatagtgtatt

SEQ ID NO: 9499277 - DNA, 22 bp, Homo sapiens
acacaagattgtgtattgaatt

SEQ ID NO: 9499278 - DNA, 19 bp, Homo sapiens
acacaatgacacatatata

SEQ ID NO: 9499279 - DNA, 22 bp, Homo sapiens
acacaatgcatatttttccaga

SEQ ID NO: 9499280 - DNA, 19 bp, Homo sapiens
acacaatgacacatatata

SEQ ID NO: 9499281 - DNA, 22 bp, Homo sapiens
acacaatgtcatcataatgtca

SEQ ID NO: 9499282 - DNA, 22 bp, Homo sapiens
acacaatgtcatcataatgtca

SEQ ID NO: 9499283 - DNA, 22 bp, Homo sapiens
acacacaactcattgtgtaata

SEQ ID NO: 9499284 - DNA, 22 bp, Homo sapiens
acacaatttcctgtccatatgt

SEQ ID NO: 9499285 - DNA, 22 bp, Homo sapiens
acacaatttcctgtccatatgt

SEQ ID NO: 9499286 - DNA, 22 bp, Homo sapiens
acacatatgtggcaactgtaga

SEQ ID NO: 9499287 - DNA, 22 bp, Homo sapiens
acacatctatctctacacaagg

SEQ ID NO: 9499288 - DNA, 22 bp, Homo sapiens
agcaggtgagcacagccaggct

SEQ ID NO: 9499289 - DNA, 22 bp, Homo sapiens
acacatctcaggggacactctc

SEQ ID NO: 9499290 - DNA, 22 bp, Homo sapiens
acacatctatctctacacaagg

SEQ ID NO: 9499291 - DNA, 22 bp, Homo sapiens
acacatcatgccaagtttcacc

SEQ ID NO: 9499292 - DNA, 22 bp, Homo sapiens
acacatatgtcattgaaaaatc

SEQ ID NO: 9499293 - DNA, 22 bp, Homo sapiens
agcagggactgagccagtggga

SEQ ID NO: 9499294 - DNA, 22 bp, Homo sapiens
agcagggactgagccagtggga

SEQ ID NO: 9499295 - DNA, 22 bp, Homo sapiens
agcagggactgagccagtggga

SEQ ID NO: 9499296 - DNA, 22 bp, Homo sapiens
agcagggactacgtgaaagtga

SEQ ID NO: 9499297 - DNA, 22 bp, Homo sapiens
agcagggaagcctccagaacct

SEQ ID NO: 9499298 - DNA, 22 bp, Homo sapiens
agcagggaatagcggaaagaat

SEQ ID NO: 9499299 - DNA, 22 bp, Homo sapiens
agcagggaatagcggaaagaat

SEQ ID NO: 9499300 - DNA, 22 bp, Homo sapiens
agcagggacatggcatctctcc

SEQ ID NO: 9499301 - DNA, 19 bp, Homo sapiens
agcagggacatggaacttt

SEQ ID NO: 9499302 - DNA, 19 bp, Homo sapiens
agcaggccacagggccagc

SEQ ID NO: 9499303 - DNA, 19 bp, Homo sapiens
agcaggccacagggccagc

SEQ ID NO: 9499304 - DNA, 22 bp, Homo sapiens
agcaggcttgttatgtctgaga

SEQ ID NO: 9499305 - DNA, 22 bp, Homo sapiens
agcaggcttggtccccagcctc

SEQ ID NO: 9499306 - DNA, 22 bp, Homo sapiens
agcaggctttccacagaaggag

SEQ ID NO: 9499307 - DNA, 22 bp, Homo sapiens
agcaggctttcaagagtcttct

SEQ ID NO: 9499308 - DNA, 21 bp, Homo sapiens
agcaggctttggagtggggct

SEQ ID NO: 9499309 - DNA, 21 bp, Homo sapiens
agcaggctttggagtggggct

SEQ ID NO: 9499310 - DNA, 22 bp, Homo sapiens
agcaggctttccacagaaggag

SEQ ID NO: 9499311 - DNA, 22 bp, Homo sapiens
acacagtttatggtattctgtt

SEQ ID NO: 9499312 - DNA, 22 bp, Homo sapiens
acacagttggtggctcagtctg

SEQ ID NO: 9499313 - DNA, 22 bp, Homo sapiens
acacagttctttcactgttggt

SEQ ID NO: 9499314 - DNA, 22 bp, Homo sapiens
aaatacatacactgtacgtggc

SEQ ID NO: 9499315 - DNA, 22 bp, Homo sapiens
aaatacatacactgtacgtggc

SEQ ID NO: 9499316 - DNA, 22 bp, Homo sapiens
aaatacataaaggttgtaccag

SEQ ID NO: 9499317 - DNA, 22 bp, Homo sapiens
aaatacataaaggttgtaccag

SEQ ID NO: 9499318 - DNA, 22 bp, Homo sapiens
aagagagaactcccttcgccag

SEQ ID NO: 9499319 - DNA, 22 bp, Homo sapiens
aaatacagtggcagcagataat

SEQ ID NO: 9499320 - DNA, 22 bp, Homo sapiens
aaatacagtggcagcagataat

SEQ ID NO: 9499321 - DNA, 22 bp, Homo sapiens
aaatacataaaggttgtaccag

SEQ ID NO: 9499322 - DNA, 22 bp, Homo sapiens
aagaagttaaataaatggacca

SEQ ID NO: 9499323 - DNA, 22 bp, Homo sapiens
aagaaggtgtggaaagatgctc

SEQ ID NO: 9499324 - DNA, 22 bp, Homo sapiens
aagaagtctggagcaatgcaat

SEQ ID NO: 9499325 - DNA, 22 bp, Homo sapiens
aagaaggtgtggaaagatgctc

SEQ ID NO: 9499326 - DNA, 22 bp, Homo sapiens
aagaagtggtccttttctttct

SEQ ID NO: 9499327 - DNA, 22 bp, Homo sapiens
aagaagtggtccttttctttct

SEQ ID NO: 9499328 - DNA, 22 bp, Homo sapiens
aagaagtggttggaagaagcat

SEQ ID NO: 9499329 - DNA, 22 bp, Homo sapiens
aagaaggcggaccagaagggag

SEQ ID NO: 9499330 - DNA, 22 bp, Homo sapiens
aagaaggcggaccagaagggag

SEQ ID NO: 9499331 - DNA, 22 bp, Homo sapiens
aagaagctgatgcagagggttc

SEQ ID NO: 9499332 - DNA, 22 bp, Homo sapiens
aagaagctgtagggattaactc

SEQ ID NO: 9499333 - DNA, 22 bp, Homo sapiens
aagaagcatgagaagattttat

SEQ ID NO: 9499334 - DNA, 22 bp, Homo sapiens
aagaagcaggtcacagacaggg

SEQ ID NO: 9499335 - DNA, 22 bp, Homo sapiens
aagaagcatggctgtagattcc

SEQ ID NO: 9499336 - DNA, 22 bp, Homo sapiens
aagaagcaggtcacagacaggg

SEQ ID NO: 9499337 - DNA, 22 bp, Homo sapiens
aagaagcatggctgtagattcc

SEQ ID NO: 9499338 - DNA, 22 bp, Homo sapiens
aagaagcagctgccaggccagt

SEQ ID NO: 9499339 - DNA, 22 bp, Homo sapiens
aaagttgttcagtaagaaactc

SEQ ID NO: 9499340 - DNA, 22 bp, Homo sapiens
aaagttgtaatggaagaaatgc

SEQ ID NO: 9499341 - DNA, 22 bp, Homo sapiens
aaagttgatttggagggatatt

SEQ ID NO: 9499342 - DNA, 22 bp, Homo sapiens
aaagttgactactaaggaatgt

SEQ ID NO: 9499343 - DNA, 22 bp, Homo sapiens
aaagttgagttttatgtgttac

SEQ ID NO: 9499344 - DNA, 22 bp, Homo sapiens
aaagttgagtgctgatctgatt

SEQ ID NO: 9499345 - DNA, 19 bp, Homo sapiens
aaagttgagaaacaatgga

SEQ ID NO: 9499346 - DNA, 22 bp, Homo sapiens
aagagtttctttattaaccttt

SEQ ID NO: 9499347 - DNA, 22 bp, Homo sapiens
aagagtttctttattaaccttt

SEQ ID NO: 9499348 - DNA, 22 bp, Homo sapiens
aagagtttctgggtcaaggatt

SEQ ID NO: 9499349 - DNA, 22 bp, Homo sapiens
aagagtttcttactggcatcta

SEQ ID NO: 9499350 - DNA, 19 bp, Homo sapiens
aaatatcagagagatgata

SEQ ID NO: 9499351 - DNA, 22 bp, Homo sapiens
aagagtttccatgctctgtgct

SEQ ID NO: 9499352 - DNA, 22 bp, Homo sapiens
aagagtttctgattcagtaggt

SEQ ID NO: 9499353 - DNA, 19 bp, Homo sapiens
aaatatcagagagatgata

SEQ ID NO: 9499354 - DNA, 22 bp, Homo sapiens
aaatatagtgacacttatagtc

SEQ ID NO: 9499355 - DNA, 22 bp, Homo sapiens
aaatatagtgacacttatagtc

SEQ ID NO: 9499356 - DNA, 22 bp, Homo sapiens
aaatatagtaaatgcatagttc

SEQ ID NO: 9499357 - DNA, 22 bp, Homo sapiens
aaatatagtaaatgcatagttc

SEQ ID NO: 9499358 - DNA, 22 bp, Homo sapiens
aaatatagtgacacttatagtc

SEQ ID NO: 9499359 - DNA, 22 bp, Homo sapiens
aaatatgactagaatgccaggt

SEQ ID NO: 9499360 - DNA, 22 bp, Homo sapiens
aaatatgagatgttctctttcg

SEQ ID NO: 9499361 - DNA, 22 bp, Homo sapiens
aaatattattgcttaaggggag

SEQ ID NO: 9499362 - DNA, 22 bp, Homo sapiens
aagagttttctctgatggcatt

SEQ ID NO: 9499363 - DNA, 22 bp, Homo sapiens
aagagttttctataatcttggc

SEQ ID NO: 9499364 - DNA, 22 bp, Homo sapiens
aagagtttttggagtgtgagtt

SEQ ID NO: 9499365 - DNA, 22 bp, Homo sapiens
aagagtttgggcaagtcataaa

SEQ ID NO: 9499366 - DNA, 22 bp, Homo sapiens
aagagtttgtcagatctgcacg

SEQ ID NO: 9499367 - DNA, 22 bp, Homo sapiens
aagagtttctttattaaccttt

SEQ ID NO: 9499368 - DNA, 22 bp, Homo sapiens
aagagtttgacctgtgccatcc

SEQ ID NO: 9499369 - DNA, 22 bp, Homo sapiens
aagagttttagacaaactgatt

SEQ ID NO: 9499370 - DNA, 22 bp, Homo sapiens
aagagttttctataatcttggc

SEQ ID NO: 9499371 - DNA, 22 bp, Homo sapiens
aagagtttgtcagatctgcacg

SEQ ID NO: 9499372 - DNA, 22 bp, Homo sapiens
aagagagacaataggtagcatt

SEQ ID NO: 9499373 - DNA, 22 bp, Homo sapiens
aagagagaagtctctctggttc

SEQ ID NO: 9499374 - DNA, 22 bp, Homo sapiens
aagagagaagtctctctggttc

SEQ ID NO: 9499375 - DNA, 22 bp, Homo sapiens
aagagagaccatgggggacagg

SEQ ID NO: 9499376 - DNA, 22 bp, Homo sapiens
aagagagagttcctaggcaaaa

SEQ ID NO: 9499377 - DNA, 22 bp, Homo sapiens
aaataggggaccaggaaaggag

SEQ ID NO: 9499378 - DNA, 22 bp, Homo sapiens
aagagagagcattcttctgtta

SEQ ID NO: 9499379 - DNA, 22 bp, Homo sapiens
aagagagagcattcttctgtta

SEQ ID NO: 9499380 - DNA, 22 bp, Homo sapiens
aaatatactagatgatgaccca

SEQ ID NO: 9499381 - DNA, 22 bp, Homo sapiens
aaatatactagatgatgaccca

SEQ ID NO: 9499382 - DNA, 22 bp, Homo sapiens
aaatatactagatgatgaccca

SEQ ID NO: 9499383 - DNA, 22 bp, Homo sapiens
aaatatacggtccctaacagtc

SEQ ID NO: 9499384 - DNA, 22 bp, Homo sapiens
aaatatagtaaatgcatagttc

SEQ ID NO: 9499385 - DNA, 22 bp, Homo sapiens
aaatatagtaaatgcatagttc

SEQ ID NO: 9499386 - DNA, 22 bp, Homo sapiens
aaatatagcaattatgcctact

SEQ ID NO: 9499387 - DNA, 22 bp, Homo sapiens
aaatagtcctgggaatagtact

SEQ ID NO: 9499388 - DNA, 22 bp, Homo sapiens
aaatagtaaagtggtagccatc

SEQ ID NO: 9499389 - DNA, 22 bp, Homo sapiens
aaatataccagttgcctgcatc

SEQ ID NO: 9499390 - DNA, 22 bp, Homo sapiens
aaatataccagttgcctgcatc

SEQ ID NO: 9499391 - DNA, 22 bp, Homo sapiens
aaatatacggtccctaacagtc

SEQ ID NO: 9499392 - DNA, 22 bp, Homo sapiens
aaatatacggtccctaacagtc

SEQ ID NO: 9499393 - DNA, 22 bp, Homo sapiens
aaatgcttgctcttgattattt

SEQ ID NO: 9499394 - DNA, 22 bp, Homo sapiens
aaatgcttcacctcattaaact

SEQ ID NO: 9499395 - DNA, 22 bp, Homo sapiens
aaatgcttcacctcattaaact

SEQ ID NO: 9499396 - DNA, 22 bp, Homo sapiens
aaatgcttgcaacatcccaggt

SEQ ID NO: 9499397 - DNA, 22 bp, Homo sapiens
aaatgctttggtgctggtacag

SEQ ID NO: 9499398 - DNA, 22 bp, Homo sapiens
aaatgcttgtatatttcttggt

SEQ ID NO: 9499399 - DNA, 22 bp, Homo sapiens
aaatgcttgtatatttcttggt

SEQ ID NO: 9499400 - DNA, 22 bp, Homo sapiens
aaatgcttgtaaattttccatg

SEQ ID NO: 9499401 - DNA, 22 bp, Homo sapiens
aaatggaactgggctactaggt

SEQ ID NO: 9499402 - DNA, 21 bp, Homo sapiens
aaatgctttgtatatatctgt

SEQ ID NO: 9499403 - DNA, 21 bp, Homo sapiens
aaatgctttgtatatatctgt

SEQ ID NO: 9499404 - DNA, 21 bp, Homo sapiens
aaatgctttgtatatatctgt

SEQ ID NO: 9499405 - DNA, 20 bp, Homo sapiens
aaatgcttttgacacatatt

SEQ ID NO: 9499406 - DNA, 20 bp, Homo sapiens
aaatgcttttgacacatatt

SEQ ID NO: 9499407 - DNA, 22 bp, Homo sapiens
aaatgctgtgttttaacataga

SEQ ID NO: 9499408 - DNA, 22 bp, Homo sapiens
aaatgcttattagtgtcacaaa

SEQ ID NO: 9499409 - DNA, 22 bp, Homo sapiens
aaatgcttattagtgtcacaaa

SEQ ID NO: 9499410 - DNA, 22 bp, Homo sapiens
aaatgcttattagtgtcacaaa

SEQ ID NO: 9499411 - DNA, 22 bp, Homo sapiens
aaatgcttagaggtgttcaaat

SEQ ID NO: 9499412 - DNA, 22 bp, Homo sapiens
aaatgcttagaggtgttcaaat

SEQ ID NO: 9499413 - DNA, 22 bp, Homo sapiens
aaatgctgtaactgatattctg

SEQ ID NO: 9499414 - DNA, 22 bp, Homo sapiens
aaatgctgggaaccattggatc

SEQ ID NO: 9499415 - DNA, 22 bp, Homo sapiens
aaatgctgtagatcagtgagtt

SEQ ID NO: 9499416 - DNA, 22 bp, Homo sapiens
aaatgctgcagctagtgtgttt

SEQ ID NO: 9499417 - DNA, 22 bp, Homo sapiens
aaatgctgagtgtttagagatc

SEQ ID NO: 9499418 - DNA, 22 bp, Homo sapiens
aaatgcaattgtatgtactcca

SEQ ID NO: 9499419 - DNA, 22 bp, Homo sapiens
aaatgcacaaagattttgcact

SEQ ID NO: 9499420 - DNA, 22 bp, Homo sapiens
aaatgcaattgtatgtactcca

SEQ ID NO: 9499421 - DNA, 22 bp, Homo sapiens
aaatgcacaataaagtaaaggc

SEQ ID NO: 9499422 - DNA, 22 bp, Homo sapiens
aaatgcacaaagattttgcact

SEQ ID NO: 9499423 - DNA, 22 bp, Homo sapiens
aaatgcaaggccatgtgaagga

SEQ ID NO: 9499424 - DNA, 22 bp, Homo sapiens
aaatgcaattcaggaagacaag

SEQ ID NO: 9499425 - DNA, 22 bp, Homo sapiens
aaatgcaattcaggaagacaag

SEQ ID NO: 9499426 - DNA, 22 bp, Homo sapiens
aaatgcaattcaggaagacaag

SEQ ID NO: 9499427 - DNA, 22 bp, Homo sapiens
aaatgcatttttaattagaccc

SEQ ID NO: 9499428 - DNA, 22 bp, Homo sapiens
aaatgcacaggagaaccaattc

SEQ ID NO: 9499429 - DNA, 22 bp, Homo sapiens
aaatgccaaggagagactgtta

SEQ ID NO: 9499430 - DNA, 22 bp, Homo sapiens
aaatgcacaataaagtaaaggc

SEQ ID NO: 9499431 - DNA, 22 bp, Homo sapiens
aaatgcacaataaagtaaaggc

SEQ ID NO: 9499432 - DNA, 22 bp, Homo sapiens
aaatgcacaataaagtaaaggc

SEQ ID NO: 9499433 - DNA, 22 bp, Homo sapiens
aaatgatggaaatgaggctgaa

SEQ ID NO: 9499434 - DNA, 20 bp, Homo sapiens
aaatgatgggaataatctat

SEQ ID NO: 9499435 - DNA, 22 bp, Homo sapiens
aaatgatgtggagtgaaattgt

SEQ ID NO: 9499436 - DNA, 22 bp, Homo sapiens
aaatgatggtactcatgtttag

SEQ ID NO: 9499437 - DNA, 22 bp, Homo sapiens
aaatgcaaggccatgtgaagga

SEQ ID NO: 9499438 - DNA, 22 bp, Homo sapiens
aaatgcaaggccatgtgaagga

SEQ ID NO: 9499439 - DNA, 22 bp, Homo sapiens
aaatgcaaggcacattcctttt

SEQ ID NO: 9499440 - DNA, 22 bp, Homo sapiens
aaatgcaaggcacattcctttt

SEQ ID NO: 9499441 - DNA, 22 bp, Homo sapiens
aaatgcaaggattttgttaggc

SEQ ID NO: 9499442 - DNA, 22 bp, Homo sapiens
aaatgattgtcaaagttctgtt

SEQ ID NO: 9499443 - DNA, 22 bp, Homo sapiens
aaatgattgtcaaagttctgtt

SEQ ID NO: 9499444 - DNA, 17 bp, Homo sapiens
aaatcactgtcagttca

SEQ ID NO: 9499445 - DNA, 21 bp, Homo sapiens
aaatcactgtccaatcttggt

SEQ ID NO: 9499446 - DNA, 22 bp, Homo sapiens
aaatcactgattaaagttagaa

SEQ ID NO: 9499447 - DNA, 22 bp, Homo sapiens
aaatcagaaaatatggagagga

SEQ ID NO: 9499448 - DNA, 22 bp, Homo sapiens
aaatcagaaaatatggagagga

SEQ ID NO: 9499449 - DNA, 22 bp, Homo sapiens
aaatcagaaaatatggagagga

SEQ ID NO: 9499450 - DNA, 22 bp, Homo sapiens
aaatcaaggagggattatattt

SEQ ID NO: 9499451 - DNA, 22 bp, Homo sapiens
aaatcacagggtctctaagtat

SEQ ID NO: 9499452 - DNA, 22 bp, Homo sapiens
aaatcacagggtctctaagtat

SEQ ID NO: 9499453 - DNA, 22 bp, Homo sapiens
aaatcaaggagggattatattt

SEQ ID NO: 9499454 - DNA, 22 bp, Homo sapiens
aaatcaaggagggattatattt

SEQ ID NO: 9499455 - DNA, 22 bp, Homo sapiens
aaatcactaagttatagtgtgg

SEQ ID NO: 9499456 - DNA, 22 bp, Homo sapiens
aaatcacagggtctctaagtat

SEQ ID NO: 9499457 - DNA, 22 bp, Homo sapiens
aaatcactaagttatagtgtgg

SEQ ID NO: 9499458 - DNA, 23 bp, Homo sapiens
aaatattcttttttagtaagtgc

SEQ ID NO: 9499459 - DNA, 23 bp, Homo sapiens
aaatattcttttttagtaagtgc

SEQ ID NO: 9499460 - DNA, 23 bp, Homo sapiens
aaatattcttttttagtaagtgc

SEQ ID NO: 9499461 - DNA, 23 bp, Homo sapiens
aaatattcttttttagtaagtgc

SEQ ID NO: 9499462 - DNA, 23 bp, Homo sapiens
aaatattcttttttagtaagtgc

SEQ ID NO: 9499463 - DNA, 23 bp, Homo sapiens
aaatattcttttttagtaagtgc

SEQ ID NO: 9499464 - DNA, 22 bp, Homo sapiens
aaatattgttttggtaagcttc

SEQ ID NO: 9499465 - DNA, 22 bp, Homo sapiens
aaatattgttttggtaagcttc

SEQ ID NO: 9499466 - DNA, 22 bp, Homo sapiens
aaatattgttttggtaagcttc

SEQ ID NO: 9499467 - DNA, 22 bp, Homo sapiens
aaatattggtaggatgcttgtt

SEQ ID NO: 9499468 - DNA, 22 bp, Homo sapiens
aaatattggtaggatgcttgtt

SEQ ID NO: 9499469 - DNA, 22 bp, Homo sapiens
aaatcaaaagacatgtgtttta

SEQ ID NO: 9499470 - DNA, 22 bp, Homo sapiens
aaatcaaaagacatgtgtttta

SEQ ID NO: 9499471 - DNA, 22 bp, Homo sapiens
aaatcaaaagacatgtgtttta

SEQ ID NO: 9499472 - DNA, 22 bp, Homo sapiens
aaatcaaaagacatgtgtttta

SEQ ID NO: 9499473 - DNA, 22 bp, Homo sapiens
aaatatttgtctgaggcggttg

SEQ ID NO: 9499474 - DNA, 22 bp, Homo sapiens
aaatcaaaagacatgtgtttta

SEQ ID NO: 9499475 - DNA, 23 bp, Homo sapiens
aaatgacatatggtttctgaagg

SEQ ID NO: 9499476 - DNA, 22 bp, Homo sapiens
aaatgacattaggatcctgcat

SEQ ID NO: 9499477 - DNA, 23 bp, Homo sapiens
aaatgactaaatgttcttataga

SEQ ID NO: 9499478 - DNA, 23 bp, Homo sapiens
aaatgactaaatgttcttataga

SEQ ID NO: 9499479 - DNA, 22 bp, Homo sapiens
aaatgaggttaatacagtgctt

SEQ ID NO: 9499480 - DNA, 22 bp, Homo sapiens
aaatgaggccagatcatgcaga

SEQ ID NO: 9499481 - DNA, 22 bp, Homo sapiens
aaatgagtagcgatgcacatta

SEQ ID NO: 9499482 - DNA, 22 bp, Homo sapiens
aaatgagtttgcctctagatag

SEQ ID NO: 9499483 - DNA, 22 bp, Homo sapiens
aaatgagtttcctcaatgtcct

SEQ ID NO: 9499484 - DNA, 22 bp, Homo sapiens
aaatgatagtatggaactagga

SEQ ID NO: 9499485 - DNA, 22 bp, Homo sapiens
aaatgatagtatggaactagga

SEQ ID NO: 9499486 - DNA, 22 bp, Homo sapiens
aaatgatagtatggaactagga

SEQ ID NO: 9499487 - DNA, 22 bp, Homo sapiens
aaatgatcatgtaatttcagaa

SEQ ID NO: 9499488 - DNA, 22 bp, Homo sapiens
aaatgatgattaaaatgaggta

SEQ ID NO: 9499489 - DNA, 22 bp, Homo sapiens
aaatcagaggcaacaactactt

SEQ ID NO: 9499490 - DNA, 22 bp, Homo sapiens
aaatcagaggcaacaactactt

SEQ ID NO: 9499491 - DNA, 22 bp, Homo sapiens
aaatcagacttgaattttcatc

SEQ ID NO: 9499492 - DNA, 22 bp, Homo sapiens
aaatcagacttgaattttcatc

SEQ ID NO: 9499493 - DNA, 19 bp, Homo sapiens
aaatcagaatctgcatttt

SEQ ID NO: 9499494 - DNA, 22 bp, Homo sapiens
aaatcagacacagtgaaagtta

SEQ ID NO: 9499495 - DNA, 22 bp, Homo sapiens
aaatcagagtctgattttaagg

SEQ ID NO: 9499496 - DNA, 22 bp, Homo sapiens
aaatcagagtctgattttaagg

SEQ ID NO: 9499497 - DNA, 22 bp, Homo sapiens
aaatctttccctttactatcca

SEQ ID NO: 9499498 - DNA, 22 bp, Homo sapiens
aaatcagagtctgattttaagg

SEQ ID NO: 9499499 - DNA, 22 bp, Homo sapiens
aaatcagagtagaattgagcca

SEQ ID NO: 9499500 - DNA, 22 bp, Homo sapiens
aaatcagagtagaattgagcca

SEQ ID NO: 9499501 - DNA, 22 bp, Homo sapiens
aaatcagagtagaattgagcca

SEQ ID NO: 9499502 - DNA, 22 bp, Homo sapiens
aaatgaacagttgcattctctg

SEQ ID NO: 9499503 - DNA, 22 bp, Homo sapiens
aaatgaacatcaagaatagcct

SEQ ID NO: 9499504 - DNA, 19 bp, Homo sapiens
aaagttctgactgtagagc

SEQ ID NO: 9499505 - DNA, 22 bp, Homo sapiens
aaagttctctatggtgtaaaaa

SEQ ID NO: 9499506 - DNA, 19 bp, Homo sapiens
aaagttctgactgtagagc

SEQ ID NO: 9499507 - DNA, 19 bp, Homo sapiens
aaagttctgactgtagagc

SEQ ID NO: 9499508 - DNA, 22 bp, Homo sapiens
aaagttctgagactgatggcta

SEQ ID NO: 9499509 - DNA, 22 bp, Homo sapiens
aaagttacacatctagtaagtg

SEQ ID NO: 9499510 - DNA, 22 bp, Homo sapiens
aaagttctattggatagtgctg

SEQ ID NO: 9499511 - DNA, 22 bp, Homo sapiens
aaagttctgatgctgatcaaag

SEQ ID NO: 9499512 - DNA, 22 bp, Homo sapiens
aaagttctgatgctgatcaaag

SEQ ID NO: 9499513 - DNA, 22 bp, Homo sapiens
aaagttctgggggtgtttctgg

SEQ ID NO: 9499514 - DNA, 22 bp, Homo sapiens
aacttctttgagctccagtttt

SEQ ID NO: 9499515 - DNA, 22 bp, Homo sapiens
aacttgaaactgttccagaaaa

SEQ ID NO: 9499516 - DNA, 22 bp, Homo sapiens
aacttgaaaacctcatgaattg

SEQ ID NO: 9499517 - DNA, 22 bp, Homo sapiens
aacttgaaactgttccagaaaa

SEQ ID NO: 9499518 - DNA, 22 bp, Homo sapiens
aacttgaatgagaacttttgcc

SEQ ID NO: 9499519 - DNA, 22 bp, Homo sapiens
aaagttacacatctagtaagtg

SEQ ID NO: 9499520 - DNA, 22 bp, Homo sapiens
aacttgaagttgcagaaagtac

SEQ ID NO: 9499521 - DNA, 22 bp, Homo sapiens
aacttgaaccacagaagctgcc

SEQ ID NO: 9499522 - DNA, 22 bp, Homo sapiens
aacttctgcttttacaggcagt

SEQ ID NO: 9499523 - DNA, 22 bp, Homo sapiens
aacttctgggctgtccaaaact

SEQ ID NO: 9499524 - DNA, 22 bp, Homo sapiens
aacttctgcagaaaagtgcatg

SEQ ID NO: 9499525 - DNA, 22 bp, Homo sapiens
aacttctgacctcaagaactgt

SEQ ID NO: 9499526 - DNA, 22 bp, Homo sapiens
aaagtcctgtttgaaggacctg

SEQ ID NO: 9499527 - DNA, 22 bp, Homo sapiens
aaagtccttgcagtttcctctt

SEQ ID NO: 9499528 - DNA, 22 bp, Homo sapiens
aaagtcctttttgccatgcaag

SEQ ID NO: 9499529 - DNA, 22 bp, Homo sapiens
aaagtcctttttgccatgcaag

SEQ ID NO: 9499530 - DNA, 22 bp, Homo sapiens
aaagtccagggaaagagcgtct

SEQ ID NO: 9499531 - DNA, 22 bp, Homo sapiens
aaagtcacgctgatgggaaatg

SEQ ID NO: 9499532 - DNA, 22 bp, Homo sapiens
aaagtcacgctgatgggaaatg

SEQ ID NO: 9499533 - DNA, 22 bp, Homo sapiens
aaagtcacatataacaagggca

SEQ ID NO: 9499534 - DNA, 22 bp, Homo sapiens
aaagtcacgctgatgggaaatg

SEQ ID NO: 9499535 - DNA, 22 bp, Homo sapiens
aaagtcctagcgatccacagaa

SEQ ID NO: 9499536 - DNA, 22 bp, Homo sapiens
aaagtcctgactgcaggggatg

SEQ ID NO: 9499537 - DNA, 22 bp, Homo sapiens
aaagtccagagggcacactgaa

SEQ ID NO: 9499538 - DNA, 22 bp, Homo sapiens
aaagtcctagcgatccacagaa

SEQ ID NO: 9499539 - DNA, 22 bp, Homo sapiens
aaagtcctagcgatccacagaa

SEQ ID NO: 9499540 - DNA, 22 bp, Homo sapiens
aaagtcctagcgatccacagaa

SEQ ID NO: 9499541 - DNA, 22 bp, Homo sapiens
aaagtctgaaagataagagtga

SEQ ID NO: 9499542 - DNA, 22 bp, Homo sapiens
aaagtcttgttacgttccattg

SEQ ID NO: 9499543 - DNA, 20 bp, Homo sapiens
aaagtcttatggttaatttt

SEQ ID NO: 9499544 - DNA, 20 bp, Homo sapiens
aaagtcttatggttaatttt

SEQ ID NO: 9499545 - DNA, 22 bp, Homo sapiens
aacttccttctagttcatatgt

SEQ ID NO: 9499546 - DNA, 22 bp, Homo sapiens
aacttccttctagttcatatgt

SEQ ID NO: 9499547 - DNA, 22 bp, Homo sapiens
aacttccaacccagaagcctaa

SEQ ID NO: 9499548 - DNA, 22 bp, Homo sapiens
aacttccaccaaatagtatata

SEQ ID NO: 9499549 - DNA, 22 bp, Homo sapiens
aacttccagctttctgtctaat

SEQ ID NO: 9499550 - DNA, 22 bp, Homo sapiens
aaagtctttattttgtatcttt

SEQ ID NO: 9499551 - DNA, 22 bp, Homo sapiens
aaagtctttattttgtatcttt

SEQ ID NO: 9499552 - DNA, 22 bp, Homo sapiens
aaagtctttattttgtatcttt

SEQ ID NO: 9499553 - DNA, 22 bp, Homo sapiens
aaagtctttctcattggccatg

SEQ ID NO: 9499554 - DNA, 22 bp, Homo sapiens
aaagggaggggcgataagccgg

SEQ ID NO: 9499555 - DNA, 22 bp, Homo sapiens
aaagtcacatataacaagggca

SEQ ID NO: 9499556 - DNA, 22 bp, Homo sapiens
aaagtcacatataacaagggca

SEQ ID NO: 9499557 - DNA, 22 bp, Homo sapiens
aaagtcacatagcatcacttct

SEQ ID NO: 9499558 - DNA, 22 bp, Homo sapiens
aaagggagcatggctgcaggga

SEQ ID NO: 9499559 - DNA, 22 bp, Homo sapiens
aaagggaatgtgtaggacatgt

SEQ ID NO: 9499560 - DNA, 22 bp, Homo sapiens
aaagggagcatggctgcaggga

SEQ ID NO: 9499561 - DNA, 22 bp, Homo sapiens
aaagggaatgtgtaggacatgt

SEQ ID NO: 9499562 - DNA, 22 bp, Homo sapiens
aaaggcttcacttatttatttt

SEQ ID NO: 9499563 - DNA, 22 bp, Homo sapiens
aaaggctggggactgaggaagg

SEQ ID NO: 9499564 - DNA, 22 bp, Homo sapiens
aaaggctggattcagagaggtg

SEQ ID NO: 9499565 - DNA, 22 bp, Homo sapiens
aaaggctggattcagagaggtg

SEQ ID NO: 9499566 - DNA, 22 bp, Homo sapiens
aaaggctttaaaatgtacatat

SEQ ID NO: 9499567 - DNA, 22 bp, Homo sapiens
aaaggctttaaagaaccagaac

SEQ ID NO: 9499568 - DNA, 22 bp, Homo sapiens
aacatgatttagtataatgcag

SEQ ID NO: 9499569 - DNA, 22 bp, Homo sapiens
aacatgatttagtataatgcag

SEQ ID NO: 9499570 - DNA, 22 bp, Homo sapiens
aacatgattggaaaatgctgtc

SEQ ID NO: 9499571 - DNA, 22 bp, Homo sapiens
aacatgattggaaaatgctgtc

SEQ ID NO: 9499572 - DNA, 22 bp, Homo sapiens
aacatgatttagtataatgcag

SEQ ID NO: 9499573 - DNA, 22 bp, Homo sapiens
aaaggcatgcctccatttctat

SEQ ID NO: 9499574 - DNA, 22 bp, Homo sapiens
aaaggctatgagatagaagata

SEQ ID NO: 9499575 - DNA, 22 bp, Homo sapiens
aaaggcatgattaattctgtgt

SEQ ID NO: 9499576 - DNA, 22 bp, Homo sapiens
aacatgagtctgtgtgaaagtg

SEQ ID NO: 9499577 - DNA, 22 bp, Homo sapiens
aacatgagcattcttgtgcttg

SEQ ID NO: 9499578 - DNA, 22 bp, Homo sapiens
aacatgatgacaaaggtatatt

SEQ ID NO: 9499579 - DNA, 22 bp, Homo sapiens
aacatgatggggaagaacaaga

SEQ ID NO: 9499580 - DNA, 22 bp, Homo sapiens
aacatgatgtgaagcatgaact

SEQ ID NO: 9499581 - DNA, 22 bp, Homo sapiens
aaaggctgccaggtaaaatatt

SEQ ID NO: 9499582 - DNA, 22 bp, Homo sapiens
aaaggctctaacaaggagagag

SEQ ID NO: 9499583 - DNA, 22 bp, Homo sapiens
aaaggctctaacaaggagagag

SEQ ID NO: 9499584 - DNA, 22 bp, Homo sapiens
aaaggctctattgttttcatat

SEQ ID NO: 9499585 - DNA, 22 bp, Homo sapiens
aaaggctcagaatcggcagacc

SEQ ID NO: 9499586 - DNA, 22 bp, Homo sapiens
aaaggctcaacagctgtacttt

SEQ ID NO: 9499587 - DNA, 22 bp, Homo sapiens
aaaggctcacgcagttagtgat

SEQ ID NO: 9499588 - DNA, 22 bp, Homo sapiens
aaaggctatttttagatgtttg

SEQ ID NO: 9499589 - DNA, 22 bp, Homo sapiens
aaaggctatttttagatgtttg

SEQ ID NO: 9499590 - DNA, 22 bp, Homo sapiens
aaaggctattgctgataatgtt

SEQ ID NO: 9499591 - DNA, 22 bp, Homo sapiens
aaaggctatttcagggtcagta

SEQ ID NO: 9499592 - DNA, 22 bp, Homo sapiens
aaaggctatttttagatgtttg

SEQ ID NO: 9499593 - DNA, 22 bp, Homo sapiens
aaaggctatgagatagaagata

SEQ ID NO: 9499594 - DNA, 22 bp, Homo sapiens
aaaggctatgagatagaagata

SEQ ID NO: 9499595 - DNA, 22 bp, Homo sapiens
aaaggctatgagatagaagata

SEQ ID NO: 9499596 - DNA, 22 bp, Homo sapiens
aaaggctatgagatagaagata

SEQ ID NO: 9499597 - DNA, 22 bp, Homo sapiens
aaaggctattcagggacttgcc

SEQ ID NO: 9499598 - DNA, 22 bp, Homo sapiens
aaaggctatgatagtccagtgg

SEQ ID NO: 9499599 - DNA, 23 bp, Homo sapiens
aaaggctatcaaagttttgctga

SEQ ID NO: 9499600 - DNA, 22 bp, Homo sapiens
aaaggctattcagggacttgcc

SEQ ID NO: 9499601 - DNA, 22 bp, Homo sapiens
aaaggctattcagggacttgcc

SEQ ID NO: 9499602 - DNA, 22 bp, Homo sapiens
aaaggctattcagggacttgcc

SEQ ID NO: 9499603 - DNA, 22 bp, Homo sapiens
aaagcagcaagtatttgttact

SEQ ID NO: 9499604 - DNA, 22 bp, Homo sapiens
aaagcagcaacgtgcatataac

SEQ ID NO: 9499605 - DNA, 22 bp, Homo sapiens
aaagcagcaacagctgttagaa

SEQ ID NO: 9499606 - DNA, 22 bp, Homo sapiens
aaagcagcaacagctgttagaa

SEQ ID NO: 9499607 - DNA, 22 bp, Homo sapiens
aaattgtctctattttgattcg

SEQ ID NO: 9499608 - DNA, 22 bp, Homo sapiens
aaattgtctctattttgattcg

SEQ ID NO: 9499609 - DNA, 22 bp, Homo sapiens
aaattgtccttttaagaaacag

SEQ ID NO: 9499610 - DNA, 23 bp, Homo sapiens
aaattgtcgtaaggtggagatgt

SEQ ID NO: 9499611 - DNA, 22 bp, Homo sapiens
aaattgtccttttaagaaacag

SEQ ID NO: 9499612 - DNA, 22 bp, Homo sapiens
aaattgtcagaattcagaaagt

SEQ ID NO: 9499613 - DNA, 22 bp, Homo sapiens
aaattgtataatgttccagctg

SEQ ID NO: 9499614 - DNA, 22 bp, Homo sapiens
aaattgtaatgacttcacttga

SEQ ID NO: 9499615 - DNA, 22 bp, Homo sapiens
aaattgtaatgacttcacttga

SEQ ID NO: 9499616 - DNA, 22 bp, Homo sapiens
aaattgtaggatcacatgacct

SEQ ID NO: 9499617 - DNA, 22 bp, Homo sapiens
aaattgtaggatcacatgacct

SEQ ID NO: 9499618 - DNA, 22 bp, Homo sapiens
aaattggattttaaactgttgg

SEQ ID NO: 9499619 - DNA, 22 bp, Homo sapiens
aaagcaggttatgaccatggcc

SEQ ID NO: 9499620 - DNA, 22 bp, Homo sapiens
aaagcaggttatgaccatggcc

SEQ ID NO: 9499621 - DNA, 22 bp, Homo sapiens
aaagcagcacatggatatcagt

SEQ ID NO: 9499622 - DNA, 22 bp, Homo sapiens
aaagcagcaagtatttgttact

SEQ ID NO: 9499623 - DNA, 22 bp, Homo sapiens
aaagcagcacatggatatcagt

SEQ ID NO: 9499624 - DNA, 22 bp, Homo sapiens
aaagcagtatgaaaggcaataa

SEQ ID NO: 9499625 - DNA, 22 bp, Homo sapiens
aaattcagcatcctgcactgga

SEQ ID NO: 9499626 - DNA, 22 bp, Homo sapiens
aaattcagttcctcagccacat

SEQ ID NO: 9499627 - DNA, 22 bp, Homo sapiens
aaattcagatggctttcttttc

SEQ ID NO: 9499628 - DNA, 22 bp, Homo sapiens
aaagacatgacacattggagag

SEQ ID NO: 9499629 - DNA, 22 bp, Homo sapiens
aaattcatttttcttagtgtgc

SEQ ID NO: 9499630 - DNA, 22 bp, Homo sapiens
aaattcatttttcttagtgtgc

SEQ ID NO: 9499631 - DNA, 22 bp, Homo sapiens
aaattcatttttcttagtgtgc

SEQ ID NO: 9499632 - DNA, 22 bp, Homo sapiens
aaattccaccagaatcagtaat

SEQ ID NO: 9499633 - DNA, 22 bp, Homo sapiens
aaattcatatgttgaaatgcta

SEQ ID NO: 9499634 - DNA, 22 bp, Homo sapiens
aaattcatatgttgaaatgcta

SEQ ID NO: 9499635 - DNA, 22 bp, Homo sapiens
aaattcatatgttgaaatgcta

SEQ ID NO: 9499636 - DNA, 22 bp, Homo sapiens
aaattcatatgttgaaatgcta

SEQ ID NO: 9499637 - DNA, 22 bp, Homo sapiens
aaattcagttttaataatcact

SEQ ID NO: 9499638 - DNA, 22 bp, Homo sapiens
aaattcatatgttgaaatgcta

SEQ ID NO: 9499639 - DNA, 22 bp, Homo sapiens
aaattccagaaactcagtatat

SEQ ID NO: 9499640 - DNA, 22 bp, Homo sapiens
aaattccagaaactcagtatat

SEQ ID NO: 9499641 - DNA, 22 bp, Homo sapiens
aaattccagttcttttacctgc

SEQ ID NO: 9499642 - DNA, 22 bp, Homo sapiens
aaattccattatgataatttcg

SEQ ID NO: 9499643 - DNA, 22 bp, Homo sapiens
aaattccattatgataatttcg

SEQ ID NO: 9499644 - DNA, 22 bp, Homo sapiens
aaattccattaggaaacttcca

SEQ ID NO: 9499645 - DNA, 22 bp, Homo sapiens
aaattccattaggaaacttcca

SEQ ID NO: 9499646 - DNA, 22 bp, Homo sapiens
aaattgctgaccaagtatattc

SEQ ID NO: 9499647 - DNA, 22 bp, Homo sapiens
aaattgcttataaagatgaatg

SEQ ID NO: 9499648 - DNA, 22 bp, Homo sapiens
aaattgctctttaaaagtactg

SEQ ID NO: 9499649 - DNA, 22 bp, Homo sapiens
aaattgctatatgtgaatgtga

SEQ ID NO: 9499650 - DNA, 22 bp, Homo sapiens
aaattccattttgtgactattc

SEQ ID NO: 9499651 - DNA, 22 bp, Homo sapiens
aaagcatgctactttatatagg

SEQ ID NO: 9499652 - DNA, 22 bp, Homo sapiens
aaagcatgttgggtccctcttt

SEQ ID NO: 9499653 - DNA, 22 bp, Homo sapiens
aaagcatgactcaagaattact

SEQ ID NO: 9499654 - DNA, 22 bp, Homo sapiens
aaagcatcagatctgacacttc

SEQ ID NO: 9499655 - DNA, 22 bp, Homo sapiens
aaagcatagaattagagttagg

SEQ ID NO: 9499656 - DNA, 22 bp, Homo sapiens
aaagcatttcatgtctagaaag

SEQ ID NO: 9499657 - DNA, 22 bp, Homo sapiens
aaagcatttcatgtctagaaag

SEQ ID NO: 9499658 - DNA, 20 bp, Homo sapiens
aaagcatttacttgtgattg

SEQ ID NO: 9499659 - DNA, 22 bp, Homo sapiens
aaagcattattctgtggaaaaa

SEQ ID NO: 9499660 - DNA, 22 bp, Homo sapiens
aaagcattactagactggattt

SEQ ID NO: 9499661 - DNA, 22 bp, Homo sapiens
aaagcattgtttcaagattaac

SEQ ID NO: 9499662 - DNA, 23 bp, Homo sapiens
aaagccaagtcagtctactggaa

SEQ ID NO: 9499663 - DNA, 23 bp, Homo sapiens
aaagccaagtcagtctactggaa

SEQ ID NO: 9499664 - DNA, 22 bp, Homo sapiens
aaaggaagattgagcttttcca

SEQ ID NO: 9499665 - DNA, 22 bp, Homo sapiens
aaaggaagtgccactcttcttc

SEQ ID NO: 9499666 - DNA, 22 bp, Homo sapiens
aaaggaagtgccactcttcttc

SEQ ID NO: 9499667 - DNA, 22 bp, Homo sapiens
aaagccaaatgaaagatggttc

SEQ ID NO: 9499668 - DNA, 22 bp, Homo sapiens
aaagccaagctgggaaggcagg

SEQ ID NO: 9499669 - DNA, 22 bp, Homo sapiens
aaagccaaatgaaagatggttc

SEQ ID NO: 9499670 - DNA, 22 bp, Homo sapiens
aaagccaaatgaaagatggttc

SEQ ID NO: 9499671 - DNA, 22 bp, Homo sapiens
aacatgaagttttctatagtga

SEQ ID NO: 9499672 - DNA, 22 bp, Homo sapiens
aacatgaaacccaaacagaata

SEQ ID NO: 9499673 - DNA, 22 bp, Homo sapiens
aacatgaaacccaaacagaata

SEQ ID NO: 9499674 - DNA, 20 bp, Homo sapiens
aaaggcacagcaacagagct

SEQ ID NO: 9499675 - DNA, 20 bp, Homo sapiens
aaaggcacagcaacagagct

SEQ ID NO: 9499676 - DNA, 20 bp, Homo sapiens
aaaggcacagcaacagagct

SEQ ID NO: 9499677 - DNA, 23 bp, Homo sapiens
aaaggcacagcattgtctagcag

SEQ ID NO: 9499678 - DNA, 20 bp, Homo sapiens
aaaggcacagcaacagagct

SEQ ID NO: 9499679 - DNA, 22 bp, Homo sapiens
aaaggcactagaagttaccttt

SEQ ID NO: 9499680 - DNA, 22 bp, Homo sapiens
aaaggcactagaagttaccttt

SEQ ID NO: 9499681 - DNA, 23 bp, Homo sapiens
aaaggcacagcattgtctagcag

SEQ ID NO: 9499682 - DNA, 23 bp, Homo sapiens
aaaggcacagcattgtctagcag

SEQ ID NO: 9499683 - DNA, 22 bp, Homo sapiens
aaaggcactgatcttatccagt

SEQ ID NO: 9499684 - DNA, 22 bp, Homo sapiens
aaaggcactgatcttatccagt

SEQ ID NO: 9499685 - DNA, 22 bp, Homo sapiens
aaaggcactggatagctgggga

SEQ ID NO: 9499686 - DNA, 22 bp, Homo sapiens
aaaggcagagtgctcagctggc

SEQ ID NO: 9499687 - DNA, 22 bp, Homo sapiens
aaaggcactggatagctgggga

SEQ ID NO: 9499688 - DNA, 22 bp, Homo sapiens
aaaggcactggatagctgggga

SEQ ID NO: 9499689 - DNA, 22 bp, Homo sapiens
aaaggcactggatagctgggga

SEQ ID NO: 9499690 - DNA, 22 bp, Homo sapiens
aaaggattagagataccatgcc

SEQ ID NO: 9499691 - DNA, 22 bp, Homo sapiens
aaaggattagagataccatgcc

SEQ ID NO: 9499692 - DNA, 22 bp, Homo sapiens
aaaggcaaaattcttagcagga

SEQ ID NO: 9499693 - DNA, 22 bp, Homo sapiens
aaaggattctcttgatttcagt

SEQ ID NO: 9499694 - DNA, 22 bp, Homo sapiens
aaaggcaagcatttatatagga

SEQ ID NO: 9499695 - DNA, 22 bp, Homo sapiens
aaaggcacaaattcagcatttt

SEQ ID NO: 9499696 - DNA, 22 bp, Homo sapiens
aaaggcacaaattcagcatttt

SEQ ID NO: 9499697 - DNA, 22 bp, Homo sapiens
aaaggcacaaattcagcatttt

SEQ ID NO: 9499698 - DNA, 22 bp, Homo sapiens
aaaggcacagaagggaaaccaa

SEQ ID NO: 9499699 - DNA, 22 bp, Homo sapiens
aaaggcacagaagggaaaccaa

SEQ ID NO: 9499700 - DNA, 22 bp, Homo sapiens
aaaggcacacactccttgttat

SEQ ID NO: 9499701 - DNA, 22 bp, Homo sapiens
aaaggcacacactccttgttat

SEQ ID NO: 9499702 - DNA, 22 bp, Homo sapiens
aaaggcacagaagggaaaccaa

SEQ ID NO: 9499703 - DNA, 22 bp, Homo sapiens
aaaggcacacactccttgttat

SEQ ID NO: 9499704 - DNA, 22 bp, Homo sapiens
aaaggataaggttatcaatttt

SEQ ID NO: 9499705 - DNA, 22 bp, Homo sapiens
aaaggattaaataaatgtgctg

SEQ ID NO: 9499706 - DNA, 22 bp, Homo sapiens
aaaggataaggttatcaatttt

SEQ ID NO: 9499707 - DNA, 22 bp, Homo sapiens
aaaggaggccacatggctagga

SEQ ID NO: 9499708 - DNA, 22 bp, Homo sapiens
aaaagcagtttatagtcagttg

SEQ ID NO: 9499709 - DNA, 22 bp, Homo sapiens
aaaagcatctcaaaggagcttc

SEQ ID NO: 9499710 - DNA, 22 bp, Homo sapiens
aaaagcatctcaaaggagcttc

SEQ ID NO: 9499711 - DNA, 22 bp, Homo sapiens
aaaagcatctcaaaggagcttc

SEQ ID NO: 9499712 - DNA, 22 bp, Homo sapiens
aaaagcagttatctgggaggaa

SEQ ID NO: 9499713 - DNA, 22 bp, Homo sapiens
aaaagcagtaaatgtatgacct

SEQ ID NO: 9499714 - DNA, 20 bp, Homo sapiens
aaaagcagccagagatggta

SEQ ID NO: 9499715 - DNA, 20 bp, Homo sapiens
aaaagcagccagagatggta

SEQ ID NO: 9499716 - DNA, 22 bp, Homo sapiens
aaaagcaggtactcagcttggg

SEQ ID NO: 9499717 - DNA, 22 bp, Homo sapiens
aaaagcaggtactcagcttggg

SEQ ID NO: 9499718 - DNA, 22 bp, Homo sapiens
aaaagcaattgcgggttttgcc

SEQ ID NO: 9499719 - DNA, 22 bp, Homo sapiens
aaaagcaattgcagttcttgcc

SEQ ID NO: 9499720 - DNA, 22 bp, Homo sapiens
aaaagcaattgcagttcttgcc

SEQ ID NO: 9499721 - DNA, 22 bp, Homo sapiens
aaaagcaattgcgggttttgcc

SEQ ID NO: 9499722 - DNA, 22 bp, Homo sapiens
aaaagcaagttgcctaggttga

SEQ ID NO: 9499723 - DNA, 22 bp, Homo sapiens
aaaagcaagttgcctaggttga

SEQ ID NO: 9499724 - DNA, 22 bp, Homo sapiens
aaaagcaagttgcctaggttga

SEQ ID NO: 9499725 - DNA, 22 bp, Homo sapiens
aaaagcaattgcagttcttgcc

SEQ ID NO: 9499726 - DNA, 20 bp, Homo sapiens
aaaagcagccagagatggta

SEQ ID NO: 9499727 - DNA, 22 bp, Homo sapiens
aaaagcagatctccaaagtcta

SEQ ID NO: 9499728 - DNA, 22 bp, Homo sapiens
aaaagcagagactctggagcta

SEQ ID NO: 9499729 - DNA, 22 bp, Homo sapiens
aaaagcagagactctggagcta

SEQ ID NO: 9499730 - DNA, 22 bp, Homo sapiens
aaaagcagaccacgctttgtgg

SEQ ID NO: 9499731 - DNA, 22 bp, Homo sapiens
aaaagcactacaatttcgcttc

SEQ ID NO: 9499732 - DNA, 22 bp, Homo sapiens
aaaagcactacaatttcgcttc

SEQ ID NO: 9499733 - DNA, 22 bp, Homo sapiens
aaaacagttataaacagagtca

SEQ ID NO: 9499734 - DNA, 22 bp, Homo sapiens
aaaacaggtgtcagcaaactat

SEQ ID NO: 9499735 - DNA, 22 bp, Homo sapiens
aaaacaggagttttggtaggct

SEQ ID NO: 9499736 - DNA, 22 bp, Homo sapiens
aaaacagtttaggcatcacagt

SEQ ID NO: 9499737 - DNA, 22 bp, Homo sapiens
aaaacagtttaggcatcacagt

SEQ ID NO: 9499738 - DNA, 22 bp, Homo sapiens
aaaacagtttaggcatcacagt

SEQ ID NO: 9499739 - DNA, 22 bp, Homo sapiens
aaaagagcttggttgattttgc

SEQ ID NO: 9499740 - DNA, 22 bp, Homo sapiens
aaaagcaagttgcctaggttga

SEQ ID NO: 9499741 - DNA, 22 bp, Homo sapiens
aaaagagccacttatgacctca

SEQ ID NO: 9499742 - DNA, 22 bp, Homo sapiens
aaaacacactggaccaatttaa

SEQ ID NO: 9499743 - DNA, 22 bp, Homo sapiens
aaaacacaagaagcagggtaca

SEQ ID NO: 9499744 - DNA, 22 bp, Homo sapiens
aaaacacaagaagcagggtaca

SEQ ID NO: 9499745 - DNA, 22 bp, Homo sapiens
aaaacacactggaccaatttaa

SEQ ID NO: 9499746 - DNA, 22 bp, Homo sapiens
aaaacacactggaccaatttaa

SEQ ID NO: 9499747 - DNA, 22 bp, Homo sapiens
aaaacactgcctgcttgactga

SEQ ID NO: 9499748 - DNA, 22 bp, Homo sapiens
aaaacactgcctgcttgactga

SEQ ID NO: 9499749 - DNA, 22 bp, Homo sapiens
aaaacagacagccagtgtagag

SEQ ID NO: 9499750 - DNA, 22 bp, Homo sapiens
aaaacagacagccagtgtagag

SEQ ID NO: 9499751 - DNA, 22 bp, Homo sapiens
aaaacactgcctgcttgactga

SEQ ID NO: 9499752 - DNA, 22 bp, Homo sapiens
aaaacagacagccagtgtagag

SEQ ID NO: 9499753 - DNA, 22 bp, Homo sapiens
aaaacagacagccagtgtagag

SEQ ID NO: 9499754 - DNA, 23 bp, Homo sapiens
aaaacagcttcctccagtggctc

SEQ ID NO: 9499755 - DNA, 22 bp, Homo sapiens
aaaacagaggtgcctgggccca

SEQ ID NO: 9499756 - DNA, 22 bp, Homo sapiens
aaaagcaagaggctggattaaa

SEQ ID NO: 9499757 - DNA, 22 bp, Homo sapiens
aaaagcaagaggctggattaaa

SEQ ID NO: 9499758 - DNA, 22 bp, Homo sapiens
aaaagcaagaggctggattaaa

SEQ ID NO: 9499759 - DNA, 22 bp, Homo sapiens
aaaagattgttagggagaatgt

SEQ ID NO: 9499760 - DNA, 22 bp, Homo sapiens
aaaagagtgactgataagtata

SEQ ID NO: 9499761 - DNA, 20 bp, Homo sapiens
aaaagagtgcttcaactgct

SEQ ID NO: 9499762 - DNA, 22 bp, Homo sapiens
aaaagagtgtttcaactttggc

SEQ ID NO: 9499763 - DNA, 22 bp, Homo sapiens
aaaagagtgtttcaactttggc

SEQ ID NO: 9499764 - DNA, 22 bp, Homo sapiens
aaaagatgaaatggtgtcttgg

SEQ ID NO: 9499765 - DNA, 22 bp, Homo sapiens
aaaagcaagaggctggattaaa

SEQ ID NO: 9499766 - DNA, 22 bp, Homo sapiens
aaaagcaagaggctggattaaa

SEQ ID NO: 9499767 - DNA, 22 bp, Homo sapiens
aaaagcaaggcagtctgtctga

SEQ ID NO: 9499768 - DNA, 22 bp, Homo sapiens
aaaagcaagttgcctaggttga

SEQ ID NO: 9499769 - DNA, 22 bp, Homo sapiens
aaaagcaagttgcctaggttga

SEQ ID NO: 9499770 - DNA, 22 bp, Homo sapiens
aaaagcaagttgcctaggttga

SEQ ID NO: 9499771 - DNA, 22 bp, Homo sapiens
aaaagcaaggcagtctgtctga

SEQ ID NO: 9499772 - DNA, 22 bp, Homo sapiens
aaaagcaaggcagtctgtctga

SEQ ID NO: 9499773 - DNA, 22 bp, Homo sapiens
aaaagcaaggcagtctgtctga

SEQ ID NO: 9499774 - DNA, 22 bp, Homo sapiens
aaaagcaaggcagtctgtctga

SEQ ID NO: 9499775 - DNA, 22 bp, Homo sapiens
aaaaatttatggttcttctctg

SEQ ID NO: 9499776 - DNA, 22 bp, Homo sapiens
aaaacacaagaagcagggtaca

SEQ ID NO: 9499777 - DNA, 22 bp, Homo sapiens
aaaacacaagaagcagggtaca

SEQ ID NO: 9499778 - DNA, 22 bp, Homo sapiens
aaaaatgttatctactgtccga

SEQ ID NO: 9499779 - DNA, 22 bp, Homo sapiens
aaaaattgctgagaacggaatt

SEQ ID NO: 9499780 - DNA, 22 bp, Homo sapiens
aaaaatttatggttcttctctg

SEQ ID NO: 9499781 - DNA, 22 bp, Homo sapiens
aaaaatttatggttcttctctg

SEQ ID NO: 9499782 - DNA, 22 bp, Homo sapiens
aaaaatgttatctactgtccga

SEQ ID NO: 9499783 - DNA, 22 bp, Homo sapiens
aaaaatctatgactgcttctcc

SEQ ID NO: 9499784 - DNA, 22 bp, Homo sapiens
aaaaccagacactgtttctggg

SEQ ID NO: 9499785 - DNA, 22 bp, Homo sapiens
aaaaccaggcgtttcctattat

SEQ ID NO: 9499786 - DNA, 22 bp, Homo sapiens
aaaaccaggcgtttcctattat

SEQ ID NO: 9499787 - DNA, 22 bp, Homo sapiens
aaaaccaggcgtttcctattat

SEQ ID NO: 9499788 - DNA, 22 bp, Homo sapiens
aaaagagtcttaggcagtcata

SEQ ID NO: 9499789 - DNA, 22 bp, Homo sapiens
aaaaccagacactgtttctggg

SEQ ID NO: 9499790 - DNA, 22 bp, Homo sapiens
aaaaccagacactgtttctggg

SEQ ID NO: 9499791 - DNA, 22 bp, Homo sapiens
aaaaccacttccttgctattgg

SEQ ID NO: 9499792 - DNA, 22 bp, Homo sapiens
aaaaccacaattatttttgcac

SEQ ID NO: 9499793 - DNA, 22 bp, Homo sapiens
aaaacatgtccatacagaaact

SEQ ID NO: 9499794 - DNA, 22 bp, Homo sapiens
aaaacattctgtgaactctcaa

SEQ ID NO: 9499795 - DNA, 22 bp, Homo sapiens
aaaacattctgtgaactctcaa

SEQ ID NO: 9499796 - DNA, 22 bp, Homo sapiens
aaaacattctgtgaactctcaa

SEQ ID NO: 9499797 - DNA, 22 bp, Homo sapiens
aaaacattctgtgaactctcaa

SEQ ID NO: 9499798 - DNA, 22 bp, Homo sapiens
aaaacattctgtgaactctcaa

SEQ ID NO: 9499799 - DNA, 22 bp, Homo sapiens
aaaacatgtccatacagaaact

SEQ ID NO: 9499800 - DNA, 22 bp, Homo sapiens
aaaacatgtccatacagaaact

SEQ ID NO: 9499801 - DNA, 22 bp, Homo sapiens
aaaacattttactgccatctca

SEQ ID NO: 9499802 - DNA, 22 bp, Homo sapiens
aaaaccaagttttccttagtct

SEQ ID NO: 9499803 - DNA, 22 bp, Homo sapiens
aaaacattctgtgaactctcaa

SEQ ID NO: 9499804 - DNA, 22 bp, Homo sapiens
aaaacattgaattgcacactat

SEQ ID NO: 9499805 - DNA, 22 bp, Homo sapiens
aaaacattgaattgcacactat

SEQ ID NO: 9499806 - DNA, 22 bp, Homo sapiens
aaaacattgaattgcacactat

SEQ ID NO: 9499807 - DNA, 22 bp, Homo sapiens
aaaacattgaattgcacactat

SEQ ID NO: 9499808 - DNA, 22 bp, Homo sapiens
aaaataacttctactatttgca

SEQ ID NO: 9499809 - DNA, 22 bp, Homo sapiens
aaaataacttctactatttgca

SEQ ID NO: 9499810 - DNA, 22 bp, Homo sapiens
aaaataacttctactatttgca

SEQ ID NO: 9499811 - DNA, 22 bp, Homo sapiens
aaaataacttctactatttgca

SEQ ID NO: 9499812 - DNA, 22 bp, Homo sapiens
aaaataacttctactatttgca

SEQ ID NO: 9499813 - DNA, 22 bp, Homo sapiens
aaaataacttctactatttgca

SEQ ID NO: 9499814 - DNA, 18 bp, Homo sapiens
aaaataacaaagttggct

SEQ ID NO: 9499815 - DNA, 18 bp, Homo sapiens
aaaataacaaagttggct

SEQ ID NO: 9499816 - DNA, 22 bp, Homo sapiens
aaaagtttgtgcaaacactcag

SEQ ID NO: 9499817 - DNA, 22 bp, Homo sapiens
aaaagtttgtgcaaacactcag

SEQ ID NO: 9499818 - DNA, 22 bp, Homo sapiens
aaaagtttgtgcaaacactcag

SEQ ID NO: 9499819 - DNA, 22 bp, Homo sapiens
aaaagtttaagactcattctag

SEQ ID NO: 9499820 - DNA, 22 bp, Homo sapiens
aaaagtttgtgcaaacactcag

SEQ ID NO: 9499821 - DNA, 21 bp, Homo sapiens
aaaagtttgacaggaaaggga

SEQ ID NO: 9499822 - DNA, 22 bp, Homo sapiens
aaaatactactgtcttcttccc

SEQ ID NO: 9499823 - DNA, 22 bp, Homo sapiens
aaaatactgtggagtgttgaaa

SEQ ID NO: 9499824 - DNA, 22 bp, Homo sapiens
aaaatactactgtcttcttccc

SEQ ID NO: 9499825 - DNA, 22 bp, Homo sapiens
aaaatactactgtcttcttccc

SEQ ID NO: 9499826 - DNA, 22 bp, Homo sapiens
aaaatacacatactaggggaaa

SEQ ID NO: 9499827 - DNA, 22 bp, Homo sapiens
aaaatactactgtcttcttccc

SEQ ID NO: 9499828 - DNA, 22 bp, Homo sapiens
aaaatgagatacagtttgaaag

SEQ ID NO: 9499829 - DNA, 22 bp, Homo sapiens
aaaatctgcttccttttacaga

SEQ ID NO: 9499830 - DNA, 22 bp, Homo sapiens
aaaatctgcttccttttacaga

SEQ ID NO: 9499831 - DNA, 22 bp, Homo sapiens
aaaatctgcttccttttacaga

SEQ ID NO: 9499832 - DNA, 22 bp, Homo sapiens
aaaatctggcaacactaagttt

SEQ ID NO: 9499833 - DNA, 22 bp, Homo sapiens
aaaatctggcaacactaagttt

SEQ ID NO: 9499834 - DNA, 22 bp, Homo sapiens
aaaatgacattccagtgatatt

SEQ ID NO: 9499835 - DNA, 22 bp, Homo sapiens
aaaagtattttgagcactttat

SEQ ID NO: 9499836 - DNA, 22 bp, Homo sapiens
aaaagtattttgagcactttat

SEQ ID NO: 9499837 - DNA, 22 bp, Homo sapiens
aaaagtattttgagcactttat

SEQ ID NO: 9499838 - DNA, 22 bp, Homo sapiens
aaaagtatttatggctatgtaa

SEQ ID NO: 9499839 - DNA, 22 bp, Homo sapiens
aaaagtatttatggctatgtaa

SEQ ID NO: 9499840 - DNA, 22 bp, Homo sapiens
aaaagtattttgagcactttat

SEQ ID NO: 9499841 - DNA, 22 bp, Homo sapiens
aaaagtattttgagcactttat

SEQ ID NO: 9499842 - DNA, 22 bp, Homo sapiens
aaaagctagtcaatgatgtatt

SEQ ID NO: 9499843 - DNA, 22 bp, Homo sapiens
aaaagctagtcaatgatgtatt

SEQ ID NO: 9499844 - DNA, 22 bp, Homo sapiens
aaaagctttgttaataggtttg

SEQ ID NO: 9499845 - DNA, 22 bp, Homo sapiens
aaaagctttgttaataggtttg

SEQ ID NO: 9499846 - DNA, 21 bp, Homo sapiens
aaaaggaaggtctgtttgggg

SEQ ID NO: 9499847 - DNA, 21 bp, Homo sapiens
aaaaggaaggtctgtttgggg

SEQ ID NO: 9499848 - DNA, 19 bp, Homo sapiens
aaaaggaatattctttggg

SEQ ID NO: 9499849 - DNA, 22 bp, Homo sapiens
aaaagtttaagactcattctag

SEQ ID NO: 9499850 - DNA, 22 bp, Homo sapiens
aaaagttccctggttagaaaag

SEQ ID NO: 9499851 - DNA, 22 bp, Homo sapiens
aaaagttccctggttagaaaag

SEQ ID NO: 9499852 - DNA, 22 bp, Homo sapiens
aaaagtttaagactcattctag

SEQ ID NO: 9499853 - DNA, 22 bp, Homo sapiens
aaaagtttaagactcattctag

SEQ ID NO: 9499854 - DNA, 22 bp, Homo sapiens
aaaagtttaagactcattctag

SEQ ID NO: 9499855 - DNA, 21 bp, Homo sapiens
aaaagtttgacaggaaaggga

SEQ ID NO: 9499856 - DNA, 22 bp, Homo sapiens
aaaagtttaagactcattctag

SEQ ID NO: 9499857 - DNA, 22 bp, Homo sapiens
aaaagttacctctgtaatataa

SEQ ID NO: 9499858 - DNA, 22 bp, Homo sapiens
aaaatgcatgagaatgtgctcg

SEQ ID NO: 9499859 - DNA, 22 bp, Homo sapiens
aaaatgcatgagaatgtgctcg

SEQ ID NO: 9499860 - DNA, 18 bp, Homo sapiens
aaaatgcaggcgacatgg

SEQ ID NO: 9499861 - DNA, 18 bp, Homo sapiens
aaaatgcaggcgacatgg

SEQ ID NO: 9499862 - DNA, 18 bp, Homo sapiens
aaaatgcaggcgacatgg

SEQ ID NO: 9499863 - DNA, 18 bp, Homo sapiens
aaaatgcaggcgacatgg

SEQ ID NO: 9499864 - DNA, 18 bp, Homo sapiens
aaaatgcaggcgacatgg

SEQ ID NO: 9499865 - DNA, 22 bp, Homo sapiens
aaaatgtaaagcttgagtgtag

SEQ ID NO: 9499866 - DNA, 22 bp, Homo sapiens
aaaatgtaaagcttgagtgtag

SEQ ID NO: 9499867 - DNA, 22 bp, Homo sapiens
aaaatggtctcagctggcacca

SEQ ID NO: 9499868 - DNA, 22 bp, Homo sapiens
aaaatggtctcagctggcacca

SEQ ID NO: 9499869 - DNA, 22 bp, Homo sapiens
aaaatgtaaagcttgagtgtag

SEQ ID NO: 9499870 - DNA, 22 bp, Homo sapiens
aaaatgtaaagcttgagtgtag

SEQ ID NO: 9499871 - DNA, 22 bp, Homo sapiens
aaaatggctgtggtctggcaag

SEQ ID NO: 9499872 - DNA, 22 bp, Homo sapiens
aaaatgatgctgtaatttggca

SEQ ID NO: 9499873 - DNA, 22 bp, Homo sapiens
aaaatgatgctgtaatttggca

SEQ ID NO: 9499874 - DNA, 22 bp, Homo sapiens
aaaatgcaaacctacctacata

SEQ ID NO: 9499875 - DNA, 20 bp, Homo sapiens
aaaatgatgggcagggcagg

SEQ ID NO: 9499876 - DNA, 20 bp, Homo sapiens
aaaatgatgggcagggcagg

SEQ ID NO: 9499877 - DNA, 22 bp, Homo sapiens
aaaatgatatcctgacttttat

SEQ ID NO: 9499878 - DNA, 22 bp, Homo sapiens
aaaatgatatcctgacttttat

SEQ ID NO: 9499879 - DNA, 22 bp, Homo sapiens
aaaatgatatcctgacttttat

SEQ ID NO: 9499880 - DNA, 22 bp, Homo sapiens
aaaatgatatcctgacttttat

SEQ ID NO: 9499881 - DNA, 22 bp, Homo sapiens
aaaatgatatcctgacttttat

SEQ ID NO: 9499882 - DNA, 22 bp, Homo sapiens
aaagcagccacagagagagcgt

SEQ ID NO: 9499883 - DNA, 22 bp, Homo sapiens
aaagcagcagcacctgcatttc

SEQ ID NO: 9499884 - DNA, 22 bp, Homo sapiens
aaagcagcagaatctctcaggg

SEQ ID NO: 9499885 - DNA, 22 bp, Homo sapiens
aaagcagcagcacgtggaagag

SEQ ID NO: 9499886 - DNA, 22 bp, Homo sapiens
aaagcagcagaatctctcaggg

SEQ ID NO: 9499887 - DNA, 22 bp, Homo sapiens
aaagcagcagcacgtggaagag

SEQ ID NO: 9499888 - DNA, 22 bp, Homo sapiens
aaagcagcagcacctgcatttc

SEQ ID NO: 9499889 - DNA, 22 bp, Homo sapiens
aaagcaatggatgagaatctgt

SEQ ID NO: 9499890 - DNA, 22 bp, Homo sapiens
aaaatgtatgatggaggtgcta

SEQ ID NO: 9499891 - DNA, 22 bp, Homo sapiens
aaaatgtatgatggaggtgcta

SEQ ID NO: 9499892 - DNA, 21 bp, Homo sapiens
aaaatgtagacttttccctga

SEQ ID NO: 9499893 - DNA, 22 bp, Homo sapiens
aaaatgtatgatggaggtgcta

SEQ ID NO: 9499894 - DNA, 21 bp, Homo sapiens
aaaatgtagacttttccctga

SEQ ID NO: 9499895 - DNA, 22 bp, Homo sapiens
aaagcaatggatgagaatctgt

SEQ ID NO: 9499896 - DNA, 22 bp, Homo sapiens
aaagcaatggatgagaatctgt

SEQ ID NO: 9499897 - DNA, 21 bp, Homo sapiens
aaaatgtgagcgtgatgctta

SEQ ID NO: 9499898 - DNA, 22 bp, Homo sapiens
aaagcaatggatgagaatctgt

SEQ ID NO: 9499899 - DNA, 22 bp, Homo sapiens
aaagcagctgtttgactttcca

SEQ ID NO: 9499900 - DNA, 22 bp, Homo sapiens
aaagcagctgctctggccttga

SEQ ID NO: 9499901 - DNA, 22 bp, Homo sapiens
aaagcagctgctctggccttga

SEQ ID NO: 9499902 - DNA, 22 bp, Homo sapiens
aaagcagctgtttgactttcca

SEQ ID NO: 9499903 - DNA, 22 bp, Homo sapiens
aaagcaggcagcaggctggatt

SEQ ID NO: 9499904 - DNA, 22 bp, Homo sapiens
aaagcaggcagcaggctggatt

SEQ ID NO: 9499905 - DNA, 22 bp, Homo sapiens
aaagcagctgatagtctcatct

SEQ ID NO: 9499906 - DNA, 22 bp, Homo sapiens
aaagcagcggtgtctttactgc

SEQ ID NO: 9499907 - DNA, 22 bp, Homo sapiens
aaagcagctgatctcagagcct

SEQ ID NO: 9499908 - DNA, 22 bp, Homo sapiens
aaagcagctgatctcagagcct

SEQ ID NO: 9499909 - DNA, 22 bp, Homo sapiens
aaagcagggatgaggctagagg

SEQ ID NO: 9499910 - DNA, 22 bp, Homo sapiens
aaagcagggatgaggctagagg

SEQ ID NO: 9499911 - DNA, 22 bp, Homo sapiens
aaagcagggtccaaggagatgt

SEQ ID NO: 9499912 - DNA, 22 bp, Homo sapiens
aaagcagggtccaaggagatgt

SEQ ID NO: 9499913 - DNA, 22 bp, Homo sapiens
aaagcagggtccaaggagatgt

SEQ ID NO: 9499914 - DNA, 22 bp, Homo sapiens
aaagcagggtccaaggagatgt

SEQ ID NO: 9499915 - DNA, 21 bp, Homo sapiens
aaatgaatgtggtagtgcaag

SEQ ID NO: 9499916 - DNA, 21 bp, Homo sapiens
aaatgaatgtggtagtgcaag

SEQ ID NO: 9499917 - DNA, 21 bp, Homo sapiens
aaatgaatgtggtagtgcaag

SEQ ID NO: 9499918 - DNA, 22 bp, Homo sapiens
aaatccagtttgtcatttccca

SEQ ID NO: 9499919 - DNA, 22 bp, Homo sapiens
aaatgaactcaatgatctccca

SEQ ID NO: 9499920 - DNA, 22 bp, Homo sapiens
aaatgaacatcaagaatagcct

SEQ ID NO: 9499921 - DNA, 22 bp, Homo sapiens
aaatgaactcttcctgcatccc

SEQ ID NO: 9499922 - DNA, 22 bp, Homo sapiens
aaatgacaataaaagtccatgc

SEQ ID NO: 9499923 - DNA, 22 bp, Homo sapiens
aaatgacaataaaagtccatgc

SEQ ID NO: 9499924 - DNA, 22 bp, Homo sapiens
aaatgacaataaaagtccatgc

SEQ ID NO: 9499925 - DNA, 22 bp, Homo sapiens
aaatgacaataaaagtccatgc

SEQ ID NO: 9499926 - DNA, 22 bp, Homo sapiens
aaatgacactaggctttttgca

SEQ ID NO: 9499927 - DNA, 22 bp, Homo sapiens
aaatgacactaggctttttgca

SEQ ID NO: 9499928 - DNA, 22 bp, Homo sapiens
aaatgacactaggctttttgca

SEQ ID NO: 9499929 - DNA, 22 bp, Homo sapiens
aaatgacactcattcagtgtca

SEQ ID NO: 9499930 - DNA, 22 bp, Homo sapiens
aaatgacactaggctttttgca

SEQ ID NO: 9499931 - DNA, 22 bp, Homo sapiens
aaactgttgtggtttatcatta

SEQ ID NO: 9499932 - DNA, 22 bp, Homo sapiens
aaactgttatagcagaaaggac

SEQ ID NO: 9499933 - DNA, 23 bp, Homo sapiens
aaatgacatatggtttctgaagg

SEQ ID NO: 9499934 - DNA, 22 bp, Homo sapiens
aaatgacagagtaagctgttta

SEQ ID NO: 9499935 - DNA, 22 bp, Homo sapiens
aaatgacagagtaagctgttta

SEQ ID NO: 9499936 - DNA, 22 bp, Homo sapiens
aaatgacagttctctctgagta

SEQ ID NO: 9499937 - DNA, 22 bp, Homo sapiens
aaatgacagagctgggactagt

SEQ ID NO: 9499938 - DNA, 22 bp, Homo sapiens
aaatgacactcattcagtgtca

SEQ ID NO: 9499939 - DNA, 22 bp, Homo sapiens
aaatgacagagctgggactagt

SEQ ID NO: 9499940 - DNA, 22 bp, Homo sapiens
aaatacacgtacatgtgtaaaa

SEQ ID NO: 9499941 - DNA, 22 bp, Homo sapiens
aaataaaggtccactttagggc

SEQ ID NO: 9499942 - DNA, 22 bp, Homo sapiens
aaataacagtcagggacaacat

SEQ ID NO: 9499943 - DNA, 22 bp, Homo sapiens
aaataaaggaactgttttccca

SEQ ID NO: 9499944 - DNA, 22 bp, Homo sapiens
aaataaactgaagcacagagag

SEQ ID NO: 9499945 - DNA, 22 bp, Homo sapiens
aaatacagagttgcttaaaagc

SEQ ID NO: 9499946 - DNA, 22 bp, Homo sapiens
aaatacagagttgcttaaaagc

SEQ ID NO: 9499947 - DNA, 22 bp, Homo sapiens
aaatacagagttgcttaaaagc

SEQ ID NO: 9499948 - DNA, 22 bp, Homo sapiens
aaatccagtgggtcctcatgag

SEQ ID NO: 9499949 - DNA, 22 bp, Homo sapiens
aaatacagattccagggtctta

SEQ ID NO: 9499950 - DNA, 22 bp, Homo sapiens
aaatacagagttgcttaaaagc

SEQ ID NO: 9499951 - DNA, 21 bp, Homo sapiens
aaatacagatgcaaatctgtt

SEQ ID NO: 9499952 - DNA, 22 bp, Homo sapiens
aaacttcaagattcaagcctgg

SEQ ID NO: 9499953 - DNA, 22 bp, Homo sapiens
aaacttcaactggaatgggcta

SEQ ID NO: 9499954 - DNA, 22 bp, Homo sapiens
aaacttcaagattcaagcctgg

SEQ ID NO: 9499955 - DNA, 22 bp, Homo sapiens
aaacttcaagattcaagcctgg

SEQ ID NO: 9499956 - DNA, 22 bp, Homo sapiens
aaacttcaaggatttgcaaatc

SEQ ID NO: 9499957 - DNA, 22 bp, Homo sapiens
aaacttcaaggatttgcaaatc

SEQ ID NO: 9499958 - DNA, 22 bp, Homo sapiens
aaacttcaaggatttgcaaatc

SEQ ID NO: 9499959 - DNA, 22 bp, Homo sapiens
aaacttcaaggatttgcaaatc

SEQ ID NO: 9499960 - DNA, 22 bp, Homo sapiens
aaacttcagactccccacttct

SEQ ID NO: 9499961 - DNA, 22 bp, Homo sapiens
aaacttcagactccccacttct

SEQ ID NO: 9499962 - DNA, 17 bp, Homo sapiens
aaacttcacggtcagcc

SEQ ID NO: 9499963 - DNA, 22 bp, Homo sapiens
aaacttcagggaataaaagagt

SEQ ID NO: 9499964 - DNA, 22 bp, Homo sapiens
aaacttcagggaataaaagagt

SEQ ID NO: 9499965 - DNA, 23 bp, Homo sapiens
aaacttcagtagtgtcatcagcc

SEQ ID NO: 9499966 - DNA, 22 bp, Homo sapiens
aaacttcagggaataaaagagt

SEQ ID NO: 9499967 - DNA, 22 bp, Homo sapiens
aaacttcagtaggagccaacct

SEQ ID NO: 9499968 - DNA, 22 bp, Homo sapiens
aaacttcagtaggagccaacct

SEQ ID NO: 9499969 - DNA, 22 bp, Homo sapiens
aaacttcatggataatataaag

SEQ ID NO: 9499970 - DNA, 22 bp, Homo sapiens
aaacttcatggataatataaag

SEQ ID NO: 9499971 - DNA, 22 bp, Homo sapiens
aaacttcatggataatataaag

SEQ ID NO: 9499972 - DNA, 22 bp, Homo sapiens
aaacttcagtgaatgacttatg

SEQ ID NO: 9499973 - DNA, 22 bp, Homo sapiens
aaacttcagtgaatgacttatg

SEQ ID NO: 9499974 - DNA, 22 bp, Homo sapiens
aaacttcatggataatataaag

SEQ ID NO: 9499975 - DNA, 22 bp, Homo sapiens
aaacttcatggataatataaag

SEQ ID NO: 9499976 - DNA, 22 bp, Homo sapiens
aaatggtgtttctaatgctaga

SEQ ID NO: 9499977 - DNA, 22 bp, Homo sapiens
aaatgtctgagacttctgaact

SEQ ID NO: 9499978 - DNA, 22 bp, Homo sapiens
aaatgtctatctggcatattcc

SEQ ID NO: 9499979 - DNA, 22 bp, Homo sapiens
aaatgtctgagacttctgaact

SEQ ID NO: 9499980 - DNA, 22 bp, Homo sapiens
aaatgtctgtatgagaaagaga

SEQ ID NO: 9499981 - DNA, 22 bp, Homo sapiens
aaatgtctgtatgagaaagaga

SEQ ID NO: 9499982 - DNA, 22 bp, Homo sapiens
aaatgtctgttagtcatatcat

SEQ ID NO: 9499983 - DNA, 22 bp, Homo sapiens
aaatgtctgttagtcatatcat

SEQ ID NO: 9499984 - DNA, 23 bp, Homo sapiens
aaatgtcttctagctcttgagaa

SEQ ID NO: 9499985 - DNA, 23 bp, Homo sapiens
aaatgtcttctagctcttgagaa

SEQ ID NO: 9499986 - DNA, 22 bp, Homo sapiens
aaatgtctttatctcatgtaac

SEQ ID NO: 9499987 - DNA, 22 bp, Homo sapiens
aaatgtctttatctcatgtaac

SEQ ID NO: 9499988 - DNA, 22 bp, Homo sapiens
aaagacagatggcaaggatgat

SEQ ID NO: 9499989 - DNA, 22 bp, Homo sapiens
aaagacacatgtctcttagatt

SEQ ID NO: 9499990 - DNA, 22 bp, Homo sapiens
aaagacagatggcaaggatgat

SEQ ID NO: 9499991 - DNA, 22 bp, Homo sapiens
aaagacagtggattcaaaatcc

SEQ ID NO: 9499992 - DNA, 22 bp, Homo sapiens
aaagacatatttctaagtttat

SEQ ID NO: 9499993 - DNA, 22 bp, Homo sapiens
aaagacatcagaaccagctgag

SEQ ID NO: 9499994 - DNA, 22 bp, Homo sapiens
aaatgtctttcaatagagaaat

SEQ ID NO: 9499995 - DNA, 22 bp, Homo sapiens
aaatgtctttcaatagagaaat

SEQ ID NO: 9499996 - DNA, 22 bp, Homo sapiens
aaatgtgacagatgcagtacag

SEQ ID NO: 9499997 - DNA, 22 bp, Homo sapiens
aaagacacacagccagcaagtg

SEQ ID NO: 9499998 - DNA, 22 bp, Homo sapiens
aaatgtgacagatgcagtacag

SEQ ID NO: 9499999 - DNA, 23 bp, Homo sapiens
aaatgtgagggaaaatctttctg

SEQ ID NO: 9500000 - DNA, 22 bp, Homo sapiens
aaagtcatctaggagcagattt

SEQ ID NO: 9500001 - DNA, 22 bp, Homo sapiens
aaagtcatcatttcttttcaaa

SEQ ID NO: 9500002 - DNA, 22 bp, Homo sapiens
aaagtcatctaggagcagattt

SEQ ID NO: 9500003 - DNA, 22 bp, Homo sapiens
aaagtcatctaggagcagattt

SEQ ID NO: 9500004 - DNA, 22 bp, Homo sapiens
aaagtcatctaggagcagattt

SEQ ID NO: 9500005 - DNA, 22 bp, Homo sapiens
aaagtcattggaatattaatga

SEQ ID NO: 9500006 - DNA, 22 bp, Homo sapiens
aaagtcattggaatattaatga

SEQ ID NO: 9500007 - DNA, 22 bp, Homo sapiens
aaagtcattgtaatatatgcta

SEQ ID NO: 9500008 - DNA, 22 bp, Homo sapiens
aaagtcattgtaatatatgcta

SEQ ID NO: 9500009 - DNA, 22 bp, Homo sapiens
aaagttccttttatagacatga

SEQ ID NO: 9500010 - DNA, 22 bp, Homo sapiens
aaagtcatgtaatgatatgatt

SEQ ID NO: 9500011 - DNA, 22 bp, Homo sapiens
aaagtcattgctgttatcaatg

SEQ ID NO: 9500012 - DNA, 22 bp, Homo sapiens
aaagtcattgctgttatcaatg

SEQ ID NO: 9500013 - DNA, 22 bp, Homo sapiens
aaagtcattggaatattaatga

SEQ ID NO: 9500014 - DNA, 22 bp, Homo sapiens
aaagttctaaaactctttgtga

SEQ ID NO: 9500015 - DNA, 22 bp, Homo sapiens
aaagttctaaaactctttgtga

SEQ ID NO: 9500016 - DNA, 22 bp, Homo sapiens
aaagttctagagttgcaagaga

SEQ ID NO: 9500017 - DNA, 22 bp, Homo sapiens
aaagttttctgccttcattaga

SEQ ID NO: 9500018 - DNA, 19 bp, Homo sapiens
aaagttttattctcatttg

SEQ ID NO: 9500019 - DNA, 19 bp, Homo sapiens
aaagttttattctcatttg

SEQ ID NO: 9500020 - DNA, 22 bp, Homo sapiens
aaagttttctgccttcattaga

SEQ ID NO: 9500021 - DNA, 22 bp, Homo sapiens
aaagtttttaagcaagaccctt

SEQ ID NO: 9500022 - DNA, 22 bp, Homo sapiens
aaataaactgaagcacagagag

SEQ ID NO: 9500023 - DNA, 22 bp, Homo sapiens
aaataaactgaagcacagagag

SEQ ID NO: 9500024 - DNA, 22 bp, Homo sapiens
aaagtcaggctgtgtacctaac

SEQ ID NO: 9500025 - DNA, 22 bp, Homo sapiens
aaagtcacttccttctgtcagc

SEQ ID NO: 9500026 - DNA, 22 bp, Homo sapiens
aaagtcagttggccagatcact

SEQ ID NO: 9500027 - DNA, 22 bp, Homo sapiens
aaagtcacttacagctcttttg

SEQ ID NO: 9500028 - DNA, 22 bp, Homo sapiens
aaagtcacttacagctcttttg

SEQ ID NO: 9500029 - DNA, 22 bp, Homo sapiens
aaagtcacttccttctgtcagc

SEQ ID NO: 9500030 - DNA, 22 bp, Homo sapiens
aaagtcagttggccagatcact

SEQ ID NO: 9500031 - DNA, 22 bp, Homo sapiens
aaagtcagttggccagatcact

SEQ ID NO: 9500032 - DNA, 22 bp, Homo sapiens
aaagtcagttggccagatcact

SEQ ID NO: 9500033 - DNA, 22 bp, Homo sapiens
aaagtacatgcaattcttctga

SEQ ID NO: 9500034 - DNA, 22 bp, Homo sapiens
aaagtacatgagattcaagggg

SEQ ID NO: 9500035 - DNA, 22 bp, Homo sapiens
aaagtacatagcatattccaac

SEQ ID NO: 9500036 - DNA, 22 bp, Homo sapiens
aaagtacagatggtgaggttgg

SEQ ID NO: 9500037 - DNA, 22 bp, Homo sapiens
aaagtacagccacatccaagta

SEQ ID NO: 9500038 - DNA, 22 bp, Homo sapiens
aaagtacagatggtgaggttgg

SEQ ID NO: 9500039 - DNA, 22 bp, Homo sapiens
aaagtacagccacatccaagta

SEQ ID NO: 9500040 - DNA, 22 bp, Homo sapiens
aaagtacaaggaaaggatctga

SEQ ID NO: 9500041 - DNA, 22 bp, Homo sapiens
aaaggttagacagctctgcata

SEQ ID NO: 9500042 - DNA, 22 bp, Homo sapiens
aaaggttaatgttgtcatgtta

SEQ ID NO: 9500043 - DNA, 22 bp, Homo sapiens
aaaggttagacagctctgcata

SEQ ID NO: 9500044 - DNA, 22 bp, Homo sapiens
aaagtacaatattgagattgat

SEQ ID NO: 9500045 - DNA, 22 bp, Homo sapiens
aaagtacacacagagccaagaa

SEQ ID NO: 9500046 - DNA, 22 bp, Homo sapiens
aaagctagaaggaaattttatg

SEQ ID NO: 9500047 - DNA, 22 bp, Homo sapiens
aaagctagaaggaaattttatg

SEQ ID NO: 9500048 - DNA, 22 bp, Homo sapiens
aaaattttgccctatccttcat

SEQ ID NO: 9500049 - DNA, 22 bp, Homo sapiens
aaagccagggacagtgtgcatg

SEQ ID NO: 9500050 - DNA, 22 bp, Homo sapiens
aaagctagtaatattttaatcc

SEQ ID NO: 9500051 - DNA, 22 bp, Homo sapiens
aaagctagtaatattttaatcc

SEQ ID NO: 9500052 - DNA, 22 bp, Homo sapiens
aaagctatagggtcaagcattt

SEQ ID NO: 9500053 - DNA, 22 bp, Homo sapiens
aaagctatttattacagagaat

SEQ ID NO: 9500054 - DNA, 22 bp, Homo sapiens
aaagctattcaacacgaacatg

SEQ ID NO: 9500055 - DNA, 22 bp, Homo sapiens
aaaattgtgaaggtttctgaaa

SEQ ID NO: 9500056 - DNA, 22 bp, Homo sapiens
aaaattgtgaaggtttctgaaa

SEQ ID NO: 9500057 - DNA, 22 bp, Homo sapiens
aaaattgtcgaacagtagtaac

SEQ ID NO: 9500058 - DNA, 22 bp, Homo sapiens
aaaattgtcgaacagtagtaac

SEQ ID NO: 9500059 - DNA, 22 bp, Homo sapiens
aaaattgtcgaacagtagtaac

SEQ ID NO: 9500060 - DNA, 22 bp, Homo sapiens
aaaattttactggtgtttcctt

SEQ ID NO: 9500061 - DNA, 22 bp, Homo sapiens
aaaattttactggtgtttcctt

SEQ ID NO: 9500062 - DNA, 22 bp, Homo sapiens
aaaattttactggtgtttcctt

SEQ ID NO: 9500063 - DNA, 22 bp, Homo sapiens
aaaattttgccctatccttcat

SEQ ID NO: 9500064 - DNA, 22 bp, Homo sapiens
aaaattttcagcttgacttgat

SEQ ID NO: 9500065 - DNA, 22 bp, Homo sapiens
aaaattttcagcttgacttgat

SEQ ID NO: 9500066 - DNA, 22 bp, Homo sapiens
aaaggaggaatggagagatgct

SEQ ID NO: 9500067 - DNA, 22 bp, Homo sapiens
aaaggttaaggtgttcaagaaa

SEQ ID NO: 9500068 - DNA, 22 bp, Homo sapiens
aaaggagagtgagtcagatgcc

SEQ ID NO: 9500069 - DNA, 22 bp, Homo sapiens
aaaggagacttcagatctcctt

SEQ ID NO: 9500070 - DNA, 22 bp, Homo sapiens
aaaggagaaaacatacaggact

SEQ ID NO: 9500071 - DNA, 22 bp, Homo sapiens
aaaggagaaaacatacaggact

SEQ ID NO: 9500072 - DNA, 22 bp, Homo sapiens
aaaggactagtctttctaccat

SEQ ID NO: 9500073 - DNA, 22 bp, Homo sapiens
aaagctctgagaagcactgcaa

SEQ ID NO: 9500074 - DNA, 22 bp, Homo sapiens
aaagctctgagaagcactgcaa

SEQ ID NO: 9500075 - DNA, 22 bp, Homo sapiens
aaaggacatgtcaatatcaggc

SEQ ID NO: 9500076 - DNA, 22 bp, Homo sapiens
aaaggacatgtcaatatcaggc

SEQ ID NO: 9500077 - DNA, 22 bp, Homo sapiens
aaaggacatgtcaatatcaggc

SEQ ID NO: 9500078 - DNA, 22 bp, Homo sapiens
aaaggactaggtgttgccaaaa

SEQ ID NO: 9500079 - DNA, 22 bp, Homo sapiens
aaaggacacacaggaggtgtct

SEQ ID NO: 9500080 - DNA, 22 bp, Homo sapiens
aaaggaatgagcttctgttagg

SEQ ID NO: 9500081 - DNA, 22 bp, Homo sapiens
aaaggacatgtcaatatcaggc

SEQ ID NO: 9500082 - DNA, 22 bp, Homo sapiens
aaaggaatattcaaaacagtca

SEQ ID NO: 9500083 - DNA, 22 bp, Homo sapiens
aaagctcttaatgagattatcc

SEQ ID NO: 9500084 - DNA, 22 bp, Homo sapiens
aaagctcttaaattgacctgct

SEQ ID NO: 9500085 - DNA, 22 bp, Homo sapiens
aaggctgaccagtttacacttt

SEQ ID NO: 9500086 - DNA, 22 bp, Homo sapiens
aaggctgaccagtttacacttt

SEQ ID NO: 9500087 - DNA, 22 bp, Homo sapiens
aaggctgacgtttgtgtttatt

SEQ ID NO: 9500088 - DNA, 22 bp, Homo sapiens
aaggctgacgtttgtgtttatt

SEQ ID NO: 9500089 - DNA, 22 bp, Homo sapiens
aaggctgacgtttgtgtttatt

SEQ ID NO: 9500090 - DNA, 22 bp, Homo sapiens
aaggctgactcaacagggggcc

SEQ ID NO: 9500091 - DNA, 21 bp, Homo sapiens
aaggctgagacaactcaggag

SEQ ID NO: 9500092 - DNA, 22 bp, Homo sapiens
aaggctgactcaacagggggcc

SEQ ID NO: 9500093 - DNA, 22 bp, Homo sapiens
aaggctgagacagcacaggtcc

SEQ ID NO: 9500094 - DNA, 22 bp, Homo sapiens
aagggaggccagaggttttgca

SEQ ID NO: 9500095 - DNA, 22 bp, Homo sapiens
aagggaggggatgtaagcctgg

SEQ ID NO: 9500096 - DNA, 22 bp, Homo sapiens
aagggaggggatgtaagcctgg

SEQ ID NO: 9500097 - DNA, 22 bp, Homo sapiens
aagggcaggcacccaccctcac

SEQ ID NO: 9500098 - DNA, 22 bp, Homo sapiens
aagggcaggcacccaccctcac

SEQ ID NO: 9500099 - DNA, 22 bp, Homo sapiens
aagggcaggcacccaccctcac

SEQ ID NO: 9500100 - DNA, 22 bp, Homo sapiens
aagggcaggcacccaccctcac

SEQ ID NO: 9500101 - DNA, 22 bp, Homo sapiens
aagggcaggcagagatcatata

SEQ ID NO: 9500102 - DNA, 22 bp, Homo sapiens
aagggcaggcagagatcatata

SEQ ID NO: 9500103 - DNA, 22 bp, Homo sapiens
aagggcaggcagagatcatata

SEQ ID NO: 9500104 - DNA, 22 bp, Homo sapiens
aagggcaggcacccaccctcac

SEQ ID NO: 9500105 - DNA, 22 bp, Homo sapiens
aagggcaggcacccaccctcac

SEQ ID NO: 9500106 - DNA, 22 bp, Homo sapiens
aagggcaggcagagatcatata

SEQ ID NO: 9500107 - DNA, 22 bp, Homo sapiens
aagggcaggcagagatcatata

SEQ ID NO: 9500108 - DNA, 22 bp, Homo sapiens
aagggcaggaaaagatggatgt

SEQ ID NO: 9500109 - DNA, 22 bp, Homo sapiens
aagggcaggaaaagatggatgt

SEQ ID NO: 9500110 - DNA, 22 bp, Homo sapiens
aagggcaggaaaagatggatgt

SEQ ID NO: 9500111 - DNA, 22 bp, Homo sapiens
aagggcaggaaaagatggatgt

SEQ ID NO: 9500112 - DNA, 22 bp, Homo sapiens
aagggcaggagaagacggatat

SEQ ID NO: 9500113 - DNA, 22 bp, Homo sapiens
aagggcaggagaagacggatat

SEQ ID NO: 9500114 - DNA, 22 bp, Homo sapiens
aagggcaggagaagacggatat

SEQ ID NO: 9500115 - DNA, 22 bp, Homo sapiens
aagggcaggagaagacggatat

SEQ ID NO: 9500116 - DNA, 22 bp, Homo sapiens
aagggcaggagaagacggatat

SEQ ID NO: 9500117 - DNA, 22 bp, Homo sapiens
aagggcaggagaagacggatat

SEQ ID NO: 9500118 - DNA, 22 bp, Homo sapiens
aaggccaggtccctgcagtgca

SEQ ID NO: 9500119 - DNA, 22 bp, Homo sapiens
aaggccaggggctggcgcctcc

SEQ ID NO: 9500120 - DNA, 23 bp, Homo sapiens
aaggccagagagaggctagtgtc

SEQ ID NO: 9500121 - DNA, 22 bp, Homo sapiens
aaggcactgagccagccgtctc

SEQ ID NO: 9500122 - DNA, 22 bp, Homo sapiens
aaggcactgctttgctgcgccc

SEQ ID NO: 9500123 - DNA, 22 bp, Homo sapiens
aaggcactgctttgctgcgccc

SEQ ID NO: 9500124 - DNA, 22 bp, Homo sapiens
aaggcactgctttgctgcgccc

SEQ ID NO: 9500125 - DNA, 22 bp, Homo sapiens
aaggcccacagaactgtctcca

SEQ ID NO: 9500126 - DNA, 22 bp, Homo sapiens
aaggcccacagaactgtctcca

SEQ ID NO: 9500127 - DNA, 22 bp, Homo sapiens
aaggcccacagaactgtctcca

SEQ ID NO: 9500128 - DNA, 22 bp, Homo sapiens
aaggccattgtaatgtaaatat

SEQ ID NO: 9500129 - DNA, 22 bp, Homo sapiens
aaggccatacaatgaaaggggc

SEQ ID NO: 9500130 - DNA, 22 bp, Homo sapiens
aaggccaggtccctgcagtgca

SEQ ID NO: 9500131 - DNA, 22 bp, Homo sapiens
aaggccatctacttacggaatt

SEQ ID NO: 9500132 - DNA, 22 bp, Homo sapiens
aaggctgaattcaagggtaggc

SEQ ID NO: 9500133 - DNA, 22 bp, Homo sapiens
aaggctgaattcaagggtaggc

SEQ ID NO: 9500134 - DNA, 22 bp, Homo sapiens
aaggctgaaagaccttgaacct

SEQ ID NO: 9500135 - DNA, 22 bp, Homo sapiens
aaggcccttccaccagtcctcg

SEQ ID NO: 9500136 - DNA, 22 bp, Homo sapiens
aaggcccttccaccagtcctcg

SEQ ID NO: 9500137 - DNA, 22 bp, Homo sapiens
aaggccctggccccagcttctt

SEQ ID NO: 9500138 - DNA, 22 bp, Homo sapiens
aaggccctgtctccaaatacag

SEQ ID NO: 9500139 - DNA, 22 bp, Homo sapiens
aaggccctgtctccaaatacag

SEQ ID NO: 9500140 - DNA, 22 bp, Homo sapiens
aaggccctggcaggaagcagga

SEQ ID NO: 9500141 - DNA, 22 bp, Homo sapiens
aaggccctggcaggaagcagga

SEQ ID NO: 9500142 - DNA, 22 bp, Homo sapiens
aaggccctcatgcgtcagagcc

SEQ ID NO: 9500143 - DNA, 22 bp, Homo sapiens
aaggccctcatgcgtcagagcc

SEQ ID NO: 9500144 - DNA, 22 bp, Homo sapiens
aaggccctggatggttttgaga

SEQ ID NO: 9500145 - DNA, 22 bp, Homo sapiens
aaggcccaggctgccctgggca

SEQ ID NO: 9500146 - DNA, 22 bp, Homo sapiens
aaggcccagcgtgacctcagtg

SEQ ID NO: 9500147 - DNA, 22 bp, Homo sapiens
aaggcccagggattggaggtca

SEQ ID NO: 9500148 - DNA, 22 bp, Homo sapiens
aaggccctaatagagcacatat

SEQ ID NO: 9500149 - DNA, 22 bp, Homo sapiens
aaggccctaatagagcacatat

SEQ ID NO: 9500150 - DNA, 22 bp, Homo sapiens
aaggccctagaatctatattgc

SEQ ID NO: 9500151 - DNA, 22 bp, Homo sapiens
aaggccctcatgcgtcagagcc

SEQ ID NO: 9500152 - DNA, 22 bp, Homo sapiens
aaggcactgaaaaattgtgtgt

SEQ ID NO: 9500153 - DNA, 22 bp, Homo sapiens
aaggcactgaaaaattgtgtgt

SEQ ID NO: 9500154 - DNA, 22 bp, Homo sapiens
aaggcactgaaaaattgtgtgt

SEQ ID NO: 9500155 - DNA, 22 bp, Homo sapiens
aaggcactcattcaaggagata

SEQ ID NO: 9500156 - DNA, 22 bp, Homo sapiens
aaggcactcattcaaggagata

SEQ ID NO: 9500157 - DNA, 22 bp, Homo sapiens
aaggcactcattcaaggagata

SEQ ID NO: 9500158 - DNA, 22 bp, Homo sapiens
aaggcactgaaaaattgtgtgt

SEQ ID NO: 9500159 - DNA, 22 bp, Homo sapiens
aaggcactgactgtgcagggga

SEQ ID NO: 9500160 - DNA, 22 bp, Homo sapiens
aaggcactgactgtgcagggga

SEQ ID NO: 9500161 - DNA, 22 bp, Homo sapiens
aaggcactgagccagccgtctc

SEQ ID NO: 9500162 - DNA, 22 bp, Homo sapiens
aaggcactgaacttaaattctg

SEQ ID NO: 9500163 - DNA, 22 bp, Homo sapiens
aaggcactgaacttaaattctg

SEQ ID NO: 9500164 - DNA, 22 bp, Homo sapiens
aaggcactgaacttaaattctg

SEQ ID NO: 9500165 - DNA, 22 bp, Homo sapiens
aaggatatttggctacagaagc

SEQ ID NO: 9500166 - DNA, 22 bp, Homo sapiens
aaggcactagcaagctgcctgg

SEQ ID NO: 9500167 - DNA, 22 bp, Homo sapiens
aaggcactagcaagctgcctgg

SEQ ID NO: 9500168 - DNA, 22 bp, Homo sapiens
aaggcactagcaagctgcctgg

SEQ ID NO: 9500169 - DNA, 22 bp, Homo sapiens
aaggatcaagtggattttctta

SEQ ID NO: 9500170 - DNA, 22 bp, Homo sapiens
aaggcactagcaagctgcctgg

SEQ ID NO: 9500171 - DNA, 22 bp, Homo sapiens
aaggcactagcagaattagtga

SEQ ID NO: 9500172 - DNA, 22 bp, Homo sapiens
aaggcactagcagaattagtga

SEQ ID NO: 9500173 - DNA, 22 bp, Homo sapiens
aaggcactagcagaattagtga

SEQ ID NO: 9500174 - DNA, 20 bp, Homo sapiens
aaggcactatgtctgctagc

SEQ ID NO: 9500175 - DNA, 22 bp, Homo sapiens
aaggcactcagccttgggacag

SEQ ID NO: 9500176 - DNA, 22 bp, Homo sapiens
aaggcactcattcaaggagata

SEQ ID NO: 9500177 - DNA, 22 bp, Homo sapiens
aaggatacttttagagcctgag

SEQ ID NO: 9500178 - DNA, 22 bp, Homo sapiens
aaggatacttttagagcctgag

SEQ ID NO: 9500179 - DNA, 22 bp, Homo sapiens
aaggagggttcccaggtcctgg

SEQ ID NO: 9500180 - DNA, 22 bp, Homo sapiens
aaggagtctgggccattcagag

SEQ ID NO: 9500181 - DNA, 22 bp, Homo sapiens
aaatggatctgtggaatacatt

SEQ ID NO: 9500182 - DNA, 22 bp, Homo sapiens
aaatggatctttttataatgca

SEQ ID NO: 9500183 - DNA, 18 bp, Homo sapiens
aaatggatgacagtacca

SEQ ID NO: 9500184 - DNA, 21 bp, Homo sapiens
aaatggatagggcaatggaag

SEQ ID NO: 9500185 - DNA, 22 bp, Homo sapiens
aaatggaggcacgcagtggtta

SEQ ID NO: 9500186 - DNA, 22 bp, Homo sapiens
aaatggaggcacgcagtggtta

SEQ ID NO: 9500187 - DNA, 22 bp, Homo sapiens
aaatggaggcaaaattggtttc

SEQ ID NO: 9500188 - DNA, 22 bp, Homo sapiens
aaatggagatgataagagggtt

SEQ ID NO: 9500189 - DNA, 22 bp, Homo sapiens
aaatggaagaagtgcaatactg

SEQ ID NO: 9500190 - DNA, 22 bp, Homo sapiens
aaatggaagaagtgcaatactg

SEQ ID NO: 9500191 - DNA, 22 bp, Homo sapiens
aaatggaagaagtgcaatactg

SEQ ID NO: 9500192 - DNA, 22 bp, Homo sapiens
aaatggaagctatttatgattc

SEQ ID NO: 9500193 - DNA, 22 bp, Homo sapiens
aaatggaagaagtgcaatactg

SEQ ID NO: 9500194 - DNA, 22 bp, Homo sapiens
aaatggaagctatttatgattc

SEQ ID NO: 9500195 - DNA, 22 bp, Homo sapiens
aaatggaatgtgtttataattc

SEQ ID NO: 9500196 - DNA, 22 bp, Homo sapiens
aaatggaatgtgtttataattc

SEQ ID NO: 9500197 - DNA, 22 bp, Homo sapiens
aaatggaatgtgtttataattc

SEQ ID NO: 9500198 - DNA, 22 bp, Homo sapiens
aaatggaatgtgtttataattc

SEQ ID NO: 9500199 - DNA, 22 bp, Homo sapiens
aaggagggaaagcagtgcttct

SEQ ID NO: 9500200 - DNA, 22 bp, Homo sapiens
aaggagaagtctgttgagattg

SEQ ID NO: 9500201 - DNA, 22 bp, Homo sapiens
aaggagaagggtaatcaacaca

SEQ ID NO: 9500202 - DNA, 22 bp, Homo sapiens
aaggagaagggtaatcaacaca

SEQ ID NO: 9500203 - DNA, 16 bp, Homo sapiens
aaggagggaagagaat

SEQ ID NO: 9500204 - DNA, 22 bp, Homo sapiens
aaggagggttcccaggtcctgg

SEQ ID NO: 9500205 - DNA, 22 bp, Homo sapiens
aaatggcaatcagcagaagcta

SEQ ID NO: 9500206 - DNA, 22 bp, Homo sapiens
aaatggcaacagaagggagttc

SEQ ID NO: 9500207 - DNA, 22 bp, Homo sapiens
aaatggatgttgagttaaatgt

SEQ ID NO: 9500208 - DNA, 22 bp, Homo sapiens
aaatggcaacagaagggagttc

SEQ ID NO: 9500209 - DNA, 22 bp, Homo sapiens
aaatggatgttgagttaaatgt

SEQ ID NO: 9500210 - DNA, 18 bp, Homo sapiens
aaatggcagaatggatag

SEQ ID NO: 9500211 - DNA, 22 bp, Homo sapiens
aaatggcactttgacagcctgc

SEQ ID NO: 9500212 - DNA, 22 bp, Homo sapiens
aaggagaagggtaatcaacaca

SEQ ID NO: 9500213 - DNA, 22 bp, Homo sapiens
aaatggcaatttagtttattta

SEQ ID NO: 9500214 - DNA, 22 bp, Homo sapiens
aaatggcaatttagtttattta

SEQ ID NO: 9500215 - DNA, 22 bp, Homo sapiens
aagtgcctgggcaacatagcaa

SEQ ID NO: 9500216 - DNA, 21 bp, Homo sapiens
aagtgccacccacagatgcat

SEQ ID NO: 9500217 - DNA, 22 bp, Homo sapiens
aagtgccagggacacttcttgt

SEQ ID NO: 9500218 - DNA, 22 bp, Homo sapiens
aagtgcattagatagaatgatg

SEQ ID NO: 9500219 - DNA, 21 bp, Homo sapiens
aagtgccacccacagatgcat

SEQ ID NO: 9500220 - DNA, 22 bp, Homo sapiens
aagtgccatcatagcatggctg

SEQ ID NO: 9500221 - DNA, 22 bp, Homo sapiens
aagtgccagtttctggcttcct

SEQ ID NO: 9500222 - DNA, 22 bp, Homo sapiens
aagtctttttgaatctataact

SEQ ID NO: 9500223 - DNA, 22 bp, Homo sapiens
aagtgcatatttttgttgtaga

SEQ ID NO: 9500224 - DNA, 22 bp, Homo sapiens
aagtgaaacatgtatctcttta

SEQ ID NO: 9500225 - DNA, 22 bp, Homo sapiens
aagtgcattagatagaatgatg

SEQ ID NO: 9500226 - DNA, 22 bp, Homo sapiens
aagtctggtgctgtcctcaccc

SEQ ID NO: 9500227 - DNA, 22 bp, Homo sapiens
aagtctgggcctccttcccaga

SEQ ID NO: 9500228 - DNA, 18 bp, Homo sapiens
aagtcttggaatttccac

SEQ ID NO: 9500229 - DNA, 22 bp, Homo sapiens
aagtcttttgctaagagtaatg

SEQ ID NO: 9500230 - DNA, 22 bp, Homo sapiens
aagtcttttgttcaggctggca

SEQ ID NO: 9500231 - DNA, 22 bp, Homo sapiens
aacagtgttttgctctttgccc

SEQ ID NO: 9500232 - DNA, 22 bp, Homo sapiens
aacagtggggaaaagagttggt

SEQ ID NO: 9500233 - DNA, 22 bp, Homo sapiens
aacagtggtctggggagtggag

SEQ ID NO: 9500234 - DNA, 22 bp, Homo sapiens
aacagtgcttcattcacacatt

SEQ ID NO: 9500235 - DNA, 22 bp, Homo sapiens
aacagtgctgttataaatgtac

SEQ ID NO: 9500236 - DNA, 22 bp, Homo sapiens
aacagtgctgattattttacct

SEQ ID NO: 9500237 - DNA, 22 bp, Homo sapiens
aagtgctgtttctgatgaatgc

SEQ ID NO: 9500238 - DNA, 22 bp, Homo sapiens
aagtgctgtacagtgtgtaaat

SEQ ID NO: 9500239 - DNA, 22 bp, Homo sapiens
aagtgctgggattataggcatg

SEQ ID NO: 9500240 - DNA, 22 bp, Homo sapiens
aagtgctgggattacaggtgtg

SEQ ID NO: 9500241 - DNA, 22 bp, Homo sapiens
aagtgctgggattacaggtgtc

SEQ ID NO: 9500242 - DNA, 22 bp, Homo sapiens
aagtgctgggattacaggggtg

SEQ ID NO: 9500243 - DNA, 22 bp, Homo sapiens
aacagtaaagacagaatttatc

SEQ ID NO: 9500244 - DNA, 22 bp, Homo sapiens
aacagtaaagacagaatttatc

SEQ ID NO: 9500245 - DNA, 22 bp, Homo sapiens
aacagtaacgagatgtcctaac

SEQ ID NO: 9500246 - DNA, 22 bp, Homo sapiens
aacagtaacgagatgtcctaac

SEQ ID NO: 9500247 - DNA, 22 bp, Homo sapiens
aacagtgctgattattttacct

SEQ ID NO: 9500248 - DNA, 22 bp, Homo sapiens
aacagtgctgcattcattgagc

SEQ ID NO: 9500249 - DNA, 22 bp, Homo sapiens
aacagtgatatcaagacagaca

SEQ ID NO: 9500250 - DNA, 22 bp, Homo sapiens
aaggtgtgaagagatgggaaga

SEQ ID NO: 9500251 - DNA, 22 bp, Homo sapiens
aaggtgttattggaggcatcag

SEQ ID NO: 9500252 - DNA, 22 bp, Homo sapiens
aaggtgtcgggttagctcagcc

SEQ ID NO: 9500253 - DNA, 22 bp, Homo sapiens
aaggtgtcggcagagccgcttc

SEQ ID NO: 9500254 - DNA, 22 bp, Homo sapiens
aagggctgctgtagaagcagag

SEQ ID NO: 9500255 - DNA, 21 bp, Homo sapiens
aaggtctgtaaagtgacagga

SEQ ID NO: 9500256 - DNA, 22 bp, Homo sapiens
aaggtctggatgatgggtgtgc

SEQ ID NO: 9500257 - DNA, 22 bp, Homo sapiens
aagggctgcaatccaaaacact

SEQ ID NO: 9500258 - DNA, 22 bp, Homo sapiens
aagggctgcatttgatgtgtca

SEQ ID NO: 9500259 - DNA, 22 bp, Homo sapiens
aagggcagggagtttgtgtcta

SEQ ID NO: 9500260 - DNA, 22 bp, Homo sapiens
aagggcagggagtttgtgtcta

SEQ ID NO: 9500261 - DNA, 22 bp, Homo sapiens
aagggcagggagtttgtgtcta

SEQ ID NO: 9500262 - DNA, 22 bp, Homo sapiens
aagggcaggtgggcatttctgg

SEQ ID NO: 9500263 - DNA, 22 bp, Homo sapiens
aagggcaggtgggcatttctgg

SEQ ID NO: 9500264 - DNA, 22 bp, Homo sapiens
aagggcagggagtttgtgtcta

SEQ ID NO: 9500265 - DNA, 22 bp, Homo sapiens
aagggcagggagtttgtgtcta

SEQ ID NO: 9500266 - DNA, 22 bp, Homo sapiens
aagggctgccagggggtgccag

SEQ ID NO: 9500267 - DNA, 22 bp, Homo sapiens
aagggctgctgtagaagcagag

SEQ ID NO: 9500268 - DNA, 22 bp, Homo sapiens
aagggctgctgtagaagcagag

SEQ ID NO: 9500269 - DNA, 22 bp, Homo sapiens
aagggctgctgtagaagcagag

SEQ ID NO: 9500270 - DNA, 22 bp, Homo sapiens
aagggctggaatatctcttaga

SEQ ID NO: 9500271 - DNA, 21 bp, Homo sapiens
aagtaatgtgtctcttctacc

SEQ ID NO: 9500272 - DNA, 20 bp, Homo sapiens
aagtaatatttgtgtaactg

SEQ ID NO: 9500273 - DNA, 22 bp, Homo sapiens
aagtacaaattttgaagagctt

SEQ ID NO: 9500274 - DNA, 22 bp, Homo sapiens
aagtacaacgcatacagagaaa

SEQ ID NO: 9500275 - DNA, 22 bp, Homo sapiens
aagtacaacgcatacagagaaa

SEQ ID NO: 9500276 - DNA, 22 bp, Homo sapiens
aagtccagtatgagaaacctgc

SEQ ID NO: 9500277 - DNA, 22 bp, Homo sapiens
aagtccagtatttctagatctt

SEQ ID NO: 9500278 - DNA, 22 bp, Homo sapiens
aagtccaggtcctcattccatc

SEQ ID NO: 9500279 - DNA, 22 bp, Homo sapiens
aagtccaggtcccgggctctgg

SEQ ID NO: 9500280 - DNA, 22 bp, Homo sapiens
aagtccagtgaaatagaatgca

SEQ ID NO: 9500281 - DNA, 22 bp, Homo sapiens
aagtctgagtgtcagtgcaagt

SEQ ID NO: 9500282 - DNA, 22 bp, Homo sapiens
aagtctgagtgtcagtgcaagt

SEQ ID NO: 9500283 - DNA, 22 bp, Homo sapiens
aagtaacatctgaacatgatgt

SEQ ID NO: 9500284 - DNA, 22 bp, Homo sapiens
aagtaacaggtgcttagtttat

SEQ ID NO: 9500285 - DNA, 23 bp, Homo sapiens
aaggtgttctgtatttaactcag

SEQ ID NO: 9500286 - DNA, 23 bp, Homo sapiens
aaggtgtttgatgggttgaggaa

SEQ ID NO: 9500287 - DNA, 23 bp, Homo sapiens
aagtaacagggataatagcagtt

SEQ ID NO: 9500288 - DNA, 22 bp, Homo sapiens
aagtaacatctgaacatgatgt

SEQ ID NO: 9500289 - DNA, 22 bp, Homo sapiens
aagtaacatctgaacatgatgt

SEQ ID NO: 9500290 - DNA, 22 bp, Homo sapiens
aagtaacatctgaacatgatgt

SEQ ID NO: 9500291 - DNA, 22 bp, Homo sapiens
aagtaactaaagatatccattt

SEQ ID NO: 9500292 - DNA, 22 bp, Homo sapiens
aagtaacatgggaacatctgaa

SEQ ID NO: 9500293 - DNA, 22 bp, Homo sapiens
aagtaacatgggaacatctgaa

SEQ ID NO: 9500294 - DNA, 22 bp, Homo sapiens
aagtaacttatttgcaaacagg

SEQ ID NO: 9500295 - DNA, 22 bp, Homo sapiens
aagtaacttatttgcaaacagg

SEQ ID NO: 9500296 - DNA, 22 bp, Homo sapiens
aagtaagtaagtctcttttctg

SEQ ID NO: 9500297 - DNA, 22 bp, Homo sapiens
aagtaagtttctctctccaaga

SEQ ID NO: 9500298 - DNA, 22 bp, Homo sapiens
aagtaagtgccttttattctta

SEQ ID NO: 9500299 - DNA, 22 bp, Homo sapiens
aagtaagtgccttttattctta

SEQ ID NO: 9500300 - DNA, 22 bp, Homo sapiens
aagtaagtcttacattcacatt

SEQ ID NO: 9500301 - DNA, 22 bp, Homo sapiens
aatgaaatgaagatatgatcag

SEQ ID NO: 9500302 - DNA, 18 bp, Homo sapiens
aatgaaatgtacaccttt

SEQ ID NO: 9500303 - DNA, 18 bp, Homo sapiens
aatgaaatgtacaccttt

SEQ ID NO: 9500304 - DNA, 18 bp, Homo sapiens
aatgaaatgtacaccttt

SEQ ID NO: 9500305 - DNA, 18 bp, Homo sapiens
aatgaaatgtacaccttt

SEQ ID NO: 9500306 - DNA, 22 bp, Homo sapiens
aatgaacaaaatatgctttgca

SEQ ID NO: 9500307 - DNA, 22 bp, Homo sapiens
aatgaaatgtagcttatccata

SEQ ID NO: 9500308 - DNA, 22 bp, Homo sapiens
aatgcacaaaggtgtctattgc

SEQ ID NO: 9500309 - DNA, 22 bp, Homo sapiens
aatgcagagtaaatatttaatt

SEQ ID NO: 9500310 - DNA, 22 bp, Homo sapiens
aatgcacatgtcttggcctcac

SEQ ID NO: 9500311 - DNA, 22 bp, Homo sapiens
aatgcaccttggcagggattca

SEQ ID NO: 9500312 - DNA, 22 bp, Homo sapiens
aatgcacctaccttgattctgc

SEQ ID NO: 9500313 - DNA, 22 bp, Homo sapiens
aatgcacagcgttccatgcttg

SEQ ID NO: 9500314 - DNA, 22 bp, Homo sapiens
aatgcacagcgttccatgcttg

SEQ ID NO: 9500315 - DNA, 18 bp, Homo sapiens
aatgcacacatttactcc

SEQ ID NO: 9500316 - DNA, 22 bp, Homo sapiens
aatgcacatgccacatgtggta

SEQ ID NO: 9500317 - DNA, 22 bp, Homo sapiens
aatgcacataaatatggtctta

SEQ ID NO: 9500318 - DNA, 22 bp, Homo sapiens
aatgaaatctgctgggtaaaga

SEQ ID NO: 9500319 - DNA, 22 bp, Homo sapiens
aatgaaatctgctgggtaaaga

SEQ ID NO: 9500320 - DNA, 22 bp, Homo sapiens
aatgaaactgtatatagactgt

SEQ ID NO: 9500321 - DNA, 22 bp, Homo sapiens
aatgaaactcgaaataatcaca

SEQ ID NO: 9500322 - DNA, 22 bp, Homo sapiens
aatgaaactgtatatagactgt

SEQ ID NO: 9500323 - DNA, 22 bp, Homo sapiens
aatctgtagggaacaactgtac

SEQ ID NO: 9500324 - DNA, 22 bp, Homo sapiens
aatgaaactgtatatagactgt

SEQ ID NO: 9500325 - DNA, 22 bp, Homo sapiens
aatctggctcagaagaagatga

SEQ ID NO: 9500326 - DNA, 22 bp, Homo sapiens
aatctggcatttgagagtagga

SEQ ID NO: 9500327 - DNA, 15 bp, Homo sapiens
aatctggcggcaagt

SEQ ID NO: 9500328 - DNA, 23 bp, Homo sapiens
aatctggctgatgttttttctct

SEQ ID NO: 9500329 - DNA, 22 bp, Homo sapiens
aatctggacacagttctcatgc

SEQ ID NO: 9500330 - DNA, 22 bp, Homo sapiens
aatctggacacagttctcatgc

SEQ ID NO: 9500331 - DNA, 22 bp, Homo sapiens
aatctggcatgtaagcttagag

SEQ ID NO: 9500332 - DNA, 22 bp, Homo sapiens
aatctctttggctcaaggatcc

SEQ ID NO: 9500333 - DNA, 22 bp, Homo sapiens
aatctgaaagtatggagcagta

SEQ ID NO: 9500334 - DNA, 22 bp, Homo sapiens
aatctgaatatttatgtgtatt

SEQ ID NO: 9500335 - DNA, 20 bp, Homo sapiens
aatctgaatcccagtcctag

SEQ ID NO: 9500336 - DNA, 22 bp, Homo sapiens
aatctgacagctaggcaggcac

SEQ ID NO: 9500337 - DNA, 22 bp, Homo sapiens
aatctgagggaacttgaactcc

SEQ ID NO: 9500338 - DNA, 22 bp, Homo sapiens
aatctgcacaattcagtttcag

SEQ ID NO: 9500339 - DNA, 22 bp, Homo sapiens
aatctgcacccactgaaaatgc

SEQ ID NO: 9500340 - DNA, 22 bp, Homo sapiens
aatctgcacaattcagtttcag

SEQ ID NO: 9500341 - DNA, 22 bp, Homo sapiens
aatctgcacccactgaaaatgc

SEQ ID NO: 9500342 - DNA, 22 bp, Homo sapiens
aatctgcataagcacagttgga

SEQ ID NO: 9500343 - DNA, 19 bp, Homo sapiens
aatctctgacatctggctc

SEQ ID NO: 9500344 - DNA, 22 bp, Homo sapiens
aatctcttgggaggaatgaatt

SEQ ID NO: 9500345 - DNA, 22 bp, Homo sapiens
aatctcttggttcagaagcctc

SEQ ID NO: 9500346 - DNA, 22 bp, Homo sapiens
aatctcatgagcttcttgtccc

SEQ ID NO: 9500347 - DNA, 22 bp, Homo sapiens
aatctcatgagcttcttgtccc

SEQ ID NO: 9500348 - DNA, 22 bp, Homo sapiens
aactttaaaaaatatgtctgtt

SEQ ID NO: 9500349 - DNA, 22 bp, Homo sapiens
aactttaaaaaatatgtctgtt

SEQ ID NO: 9500350 - DNA, 20 bp, Homo sapiens
aacttgttttgttttctaat

SEQ ID NO: 9500351 - DNA, 22 bp, Homo sapiens
aacttgtaggactgcactgtag

SEQ ID NO: 9500352 - DNA, 21 bp, Homo sapiens
aacttgtatttctccttattc

SEQ ID NO: 9500353 - DNA, 22 bp, Homo sapiens
aactttacactgctttacatga

SEQ ID NO: 9500354 - DNA, 22 bp, Homo sapiens
aactttaaggctataaattatg

SEQ ID NO: 9500355 - DNA, 22 bp, Homo sapiens
aactttaaagaggaggcttggg

SEQ ID NO: 9500356 - DNA, 22 bp, Homo sapiens
aactttaaggctataaattatg

SEQ ID NO: 9500357 - DNA, 22 bp, Homo sapiens
aactttaaggctataaattatg

SEQ ID NO: 9500358 - DNA, 22 bp, Homo sapiens
aatgtacaaaagtcagccaact

SEQ ID NO: 9500359 - DNA, 22 bp, Homo sapiens
aatgtacaaaagtcagccaact

SEQ ID NO: 9500360 - DNA, 22 bp, Homo sapiens
aatgtacaaaagtcagccaact

SEQ ID NO: 9500361 - DNA, 22 bp, Homo sapiens
aatgtacaaaagtcagccaact

SEQ ID NO: 9500362 - DNA, 22 bp, Homo sapiens
aatgtacaaaagtcagccaact

SEQ ID NO: 9500363 - DNA, 22 bp, Homo sapiens
aatgtaaagttgggcacaaatg

SEQ ID NO: 9500364 - DNA, 22 bp, Homo sapiens
aatgtaaagttgggcacaaatg

SEQ ID NO: 9500365 - DNA, 22 bp, Homo sapiens
aatgtaacagcaacaacaatgg

SEQ ID NO: 9500366 - DNA, 22 bp, Homo sapiens
aatgtacaaaccttctttgtag

SEQ ID NO: 9500367 - DNA, 22 bp, Homo sapiens
aatgtacaaaccttctttgtag

SEQ ID NO: 9500368 - DNA, 22 bp, Homo sapiens
aatgtacaaaccttctttgtag

SEQ ID NO: 9500369 - DNA, 22 bp, Homo sapiens
aatgtacaaaccttctttgtag

SEQ ID NO: 9500370 - DNA, 22 bp, Homo sapiens
aatgtaaacagcaagagaaggg

SEQ ID NO: 9500371 - DNA, 22 bp, Homo sapiens
aatgtaaacagcaagagaaggg

SEQ ID NO: 9500372 - DNA, 22 bp, Homo sapiens
aatgtaaacagcaagagaaggg

SEQ ID NO: 9500373 - DNA, 22 bp, Homo sapiens
aatgtaaacagcaagagaaggg

SEQ ID NO: 9500374 - DNA, 22 bp, Homo sapiens
aatgtaaagttgggcacaaatg

SEQ ID NO: 9500375 - DNA, 22 bp, Homo sapiens
aatgtaaagttgggcacaaatg

SEQ ID NO: 9500376 - DNA, 22 bp, Homo sapiens
aatgtaaagttgggcacaaatg

SEQ ID NO: 9500377 - DNA, 22 bp, Homo sapiens
aatgtaaagttgggcacaaatg

SEQ ID NO: 9500378 - DNA, 22 bp, Homo sapiens
aatgtaaagctcaggtcaggag

SEQ ID NO: 9500379 - DNA, 22 bp, Homo sapiens
aatgtaaagctcaggtcaggag

SEQ ID NO: 9500380 - DNA, 22 bp, Homo sapiens
aatgtaaagttgggcacaaatg

SEQ ID NO: 9500381 - DNA, 22 bp, Homo sapiens
aatgtaaagttgggcacaaatg

SEQ ID NO: 9500382 - DNA, 22 bp, Homo sapiens
aatgctgtcttagcatgaaagc

SEQ ID NO: 9500383 - DNA, 22 bp, Homo sapiens
aatgcataatggtttgtgacaa

SEQ ID NO: 9500384 - DNA, 22 bp, Homo sapiens
aatgctgtatatcttagctaat

SEQ ID NO: 9500385 - DNA, 22 bp, Homo sapiens
aatgcagtgagccattaaatgg

SEQ ID NO: 9500386 - DNA, 22 bp, Homo sapiens
aatgcagttgaatttgggtatg

SEQ ID NO: 9500387 - DNA, 22 bp, Homo sapiens
aatgcagtgagccattaaatgg

SEQ ID NO: 9500388 - DNA, 22 bp, Homo sapiens
aatgcagtttcatttgtagaat

SEQ ID NO: 9500389 - DNA, 22 bp, Homo sapiens
aatgcttatgggttccataata

SEQ ID NO: 9500390 - DNA, 22 bp, Homo sapiens
aatgcttatgggttccataata

SEQ ID NO: 9500391 - DNA, 22 bp, Homo sapiens
aatgcttatacctaatgatctt

SEQ ID NO: 9500392 - DNA, 19 bp, Homo sapiens
aatgcttaggacagtgcct

SEQ ID NO: 9500393 - DNA, 22 bp, Homo sapiens
aatgcttataacgttagaatgt

SEQ ID NO: 9500394 - DNA, 22 bp, Homo sapiens
aatgcttataacgttagaatgt

SEQ ID NO: 9500395 - DNA, 22 bp, Homo sapiens
aatgcttataacgttagaatgt

SEQ ID NO: 9500396 - DNA, 22 bp, Homo sapiens
aatgcttataacgttagaatgt

SEQ ID NO: 9500397 - DNA, 22 bp, Homo sapiens
aatgctgtcttttctacttcat

SEQ ID NO: 9500398 - DNA, 22 bp, Homo sapiens
aacttcatttataatgtcatta

SEQ ID NO: 9500399 - DNA, 22 bp, Homo sapiens
aacttcattcctttttatgact

SEQ ID NO: 9500400 - DNA, 22 bp, Homo sapiens
aatgctttcaaaaatgtgcagt

SEQ ID NO: 9500401 - DNA, 22 bp, Homo sapiens
aatgctttagcagtgattagtg

SEQ ID NO: 9500402 - DNA, 22 bp, Homo sapiens
aatgctttcaaaaatgtgcagt

SEQ ID NO: 9500403 - DNA, 22 bp, Homo sapiens
aacttggtaaattgtgtcagat

SEQ ID NO: 9500404 - DNA, 22 bp, Homo sapiens
aacttggcttgcatggctgaaa

SEQ ID NO: 9500405 - DNA, 22 bp, Homo sapiens
aacttggtaaattgtgtcagat

SEQ ID NO: 9500406 - DNA, 22 bp, Homo sapiens
aacttggtaccaccttctgaag

SEQ ID NO: 9500407 - DNA, 22 bp, Homo sapiens
aacttggtaccaccttctgaag

SEQ ID NO: 9500408 - DNA, 22 bp, Homo sapiens
aatgcttccaaaataccaagcc

SEQ ID NO: 9500409 - DNA, 22 bp, Homo sapiens
aatgcttcctcctcacctcagg

SEQ ID NO: 9500410 - DNA, 22 bp, Homo sapiens
aatgcttattattaatagaatg

SEQ ID NO: 9500411 - DNA, 22 bp, Homo sapiens
aatgcttcaacctcccacatgt

SEQ ID NO: 9500412 - DNA, 22 bp, Homo sapiens
aatgcttatgggttccataata

SEQ ID NO: 9500413 - DNA, 22 bp, Homo sapiens
aatgcttattattaatagaatg

SEQ ID NO: 9500414 - DNA, 22 bp, Homo sapiens
aatgctttaattgcatgtagtg

SEQ ID NO: 9500415 - DNA, 22 bp, Homo sapiens
aatgcttattattaatagaatg

SEQ ID NO: 9500416 - DNA, 22 bp, Homo sapiens
aatgctttaaatcctagtgtaa

SEQ ID NO: 9500417 - DNA, 22 bp, Homo sapiens
aatatctgtctctaatgcatat

SEQ ID NO: 9500418 - DNA, 22 bp, Homo sapiens
aatatctggagatgctttttgt

SEQ ID NO: 9500419 - DNA, 22 bp, Homo sapiens
aatatctgtctctaatgcatat

SEQ ID NO: 9500420 - DNA, 22 bp, Homo sapiens
aatatctgtctctaatgcatat

SEQ ID NO: 9500421 - DNA, 22 bp, Homo sapiens
aatatctgtggccatacaattt

SEQ ID NO: 9500422 - DNA, 22 bp, Homo sapiens
aatatctgttgttctaagccac

SEQ ID NO: 9500423 - DNA, 22 bp, Homo sapiens
aatatctgtggccatacaattt

SEQ ID NO: 9500424 - DNA, 22 bp, Homo sapiens
aatatctgtggccatacaattt

SEQ ID NO: 9500425 - DNA, 22 bp, Homo sapiens
aatatctgtggccatacaattt

SEQ ID NO: 9500426 - DNA, 22 bp, Homo sapiens
aatatttatatttctcttccct

SEQ ID NO: 9500427 - DNA, 22 bp, Homo sapiens
aatattgagaaccagcatgttt

SEQ ID NO: 9500428 - DNA, 22 bp, Homo sapiens
aatatttatgacaggaagtagc

SEQ ID NO: 9500429 - DNA, 22 bp, Homo sapiens
aatatttatgacaggaagtagc

SEQ ID NO: 9500430 - DNA, 22 bp, Homo sapiens
aatatttatatttctcttccct

SEQ ID NO: 9500431 - DNA, 22 bp, Homo sapiens
aatatttatgacaggaagtagc

SEQ ID NO: 9500432 - DNA, 22 bp, Homo sapiens
aatatttatgacaggaagtagc

SEQ ID NO: 9500433 - DNA, 22 bp, Homo sapiens
aatctcaagctgtaaatacctc

SEQ ID NO: 9500434 - DNA, 22 bp, Homo sapiens
aatctcacatagctaggagtag

SEQ ID NO: 9500435 - DNA, 22 bp, Homo sapiens
aatccagattccagaaaatcgc

SEQ ID NO: 9500436 - DNA, 22 bp, Homo sapiens
aatatttctgtagctatgttct

SEQ ID NO: 9500437 - DNA, 22 bp, Homo sapiens
aatatttctggtgcttctcact

SEQ ID NO: 9500438 - DNA, 22 bp, Homo sapiens
aatatttctggtgcttctcact

SEQ ID NO: 9500439 - DNA, 22 bp, Homo sapiens
aatatttctgtagctatgttct

SEQ ID NO: 9500440 - DNA, 22 bp, Homo sapiens
aatatttctgtagctatgttct

SEQ ID NO: 9500441 - DNA, 22 bp, Homo sapiens
aatatttctggtgcttctcact

SEQ ID NO: 9500442 - DNA, 22 bp, Homo sapiens
aatatttctgcagaatggtttt

SEQ ID NO: 9500443 - DNA, 22 bp, Homo sapiens
aatatttctgcagaatggtttt

SEQ ID NO: 9500444 - DNA, 22 bp, Homo sapiens
aatatttctgcagaatggtttt

SEQ ID NO: 9500445 - DNA, 22 bp, Homo sapiens
aatatttctccttcgttatagc

SEQ ID NO: 9500446 - DNA, 22 bp, Homo sapiens
aatatttctgcagaatggtttt

SEQ ID NO: 9500447 - DNA, 22 bp, Homo sapiens
aatatttctgcagaatggtttt

SEQ ID NO: 9500448 - DNA, 22 bp, Homo sapiens
aatatttctggtgcttctcact

SEQ ID NO: 9500449 - DNA, 22 bp, Homo sapiens
aatatttctccttcgttatagc

SEQ ID NO: 9500450 - DNA, 22 bp, Homo sapiens
aatatttcgttgcgtggctaga

SEQ ID NO: 9500451 - DNA, 22 bp, Homo sapiens
aatatttcgttgcgtggctaga

SEQ ID NO: 9500452 - DNA, 22 bp, Homo sapiens
aatatttccaaggcctgtcagg

SEQ ID NO: 9500453 - DNA, 22 bp, Homo sapiens
aatatttcaaaaggaaacacag

SEQ ID NO: 9500454 - DNA, 22 bp, Homo sapiens
aatacagtaggtaatagttcat

SEQ ID NO: 9500455 - DNA, 22 bp, Homo sapiens
aatacagtaggtaatagttcat

SEQ ID NO: 9500456 - DNA, 22 bp, Homo sapiens
aatacagtaattttgatgagtt

SEQ ID NO: 9500457 - DNA, 22 bp, Homo sapiens
aatacataataagttttgtctg

SEQ ID NO: 9500458 - DNA, 22 bp, Homo sapiens
aatacatatggaattccatgtt

SEQ ID NO: 9500459 - DNA, 22 bp, Homo sapiens
aatacataataagttttgtctg

SEQ ID NO: 9500460 - DNA, 19 bp, Homo sapiens
aatacagtgttatagaatt

SEQ ID NO: 9500461 - DNA, 20 bp, Homo sapiens
aatataattctctgaattta

SEQ ID NO: 9500462 - DNA, 22 bp, Homo sapiens
aatacatatggaattccatgtt

SEQ ID NO: 9500463 - DNA, 22 bp, Homo sapiens
aatataattttattcctagagt

SEQ ID NO: 9500464 - DNA, 22 bp, Homo sapiens
aatatccacttcaatacaggca

SEQ ID NO: 9500465 - DNA, 22 bp, Homo sapiens
aatatcagtatattgtatcagt

SEQ ID NO: 9500466 - DNA, 22 bp, Homo sapiens
aatatcatctctcttttctgca

SEQ ID NO: 9500467 - DNA, 21 bp, Homo sapiens
aatatccaaatgattagatct

SEQ ID NO: 9500468 - DNA, 22 bp, Homo sapiens
aatatccaggtagatgtcttct

SEQ ID NO: 9500469 - DNA, 22 bp, Homo sapiens
aatatccaggtagatgtcttct

SEQ ID NO: 9500470 - DNA, 22 bp, Homo sapiens
aatatccattgggagcaaatgg

SEQ ID NO: 9500471 - DNA, 22 bp, Homo sapiens
aatatcctgaccagtaaactaa

SEQ ID NO: 9500472 - DNA, 22 bp, Homo sapiens
aatatctagcctttagcagctt

SEQ ID NO: 9500473 - DNA, 22 bp, Homo sapiens
aatatctcaccatgacaaagca

SEQ ID NO: 9500474 - DNA, 22 bp, Homo sapiens
aatatctggagatgctttttgt

SEQ ID NO: 9500475 - DNA, 22 bp, Homo sapiens
aataatatttgaagcttcaaag

SEQ ID NO: 9500476 - DNA, 22 bp, Homo sapiens
aataatatttgaagcttcaaag

SEQ ID NO: 9500477 - DNA, 22 bp, Homo sapiens
aataatatttgaagcttcaaag

SEQ ID NO: 9500478 - DNA, 22 bp, Homo sapiens
aataatatttgaagcttcaaag

SEQ ID NO: 9500479 - DNA, 22 bp, Homo sapiens
aataatattcctctgtgtgcgt

SEQ ID NO: 9500480 - DNA, 22 bp, Homo sapiens
aataatctccctttttgtatgt

SEQ ID NO: 9500481 - DNA, 22 bp, Homo sapiens
aataatatttgaagcttcaaag

SEQ ID NO: 9500482 - DNA, 22 bp, Homo sapiens
aataatatttgaagcttcaaag

SEQ ID NO: 9500483 - DNA, 22 bp, Homo sapiens
aataatcttgactactgaatca

SEQ ID NO: 9500484 - DNA, 22 bp, Homo sapiens
aataatgaacatttaaaacctg

SEQ ID NO: 9500485 - DNA, 22 bp, Homo sapiens
aataatgagacagcttatttaa

SEQ ID NO: 9500486 - DNA, 19 bp, Homo sapiens
aataatgccagatgtctgt

SEQ ID NO: 9500487 - DNA, 22 bp, Homo sapiens
aataatgtacatacatatttcg

SEQ ID NO: 9500488 - DNA, 22 bp, Homo sapiens
aatacagatattcagtggtact

SEQ ID NO: 9500489 - DNA, 22 bp, Homo sapiens
aatacagcagatggagacaaat

SEQ ID NO: 9500490 - DNA, 23 bp, Homo sapiens
aataatgtcttgtgctctcactt

SEQ ID NO: 9500491 - DNA, 22 bp, Homo sapiens
aataatgtaggatgataaatga

SEQ ID NO: 9500492 - DNA, 22 bp, Homo sapiens
aataatgtctatggttccaaaa

SEQ ID NO: 9500493 - DNA, 22 bp, Homo sapiens
aataatgtaggatgataaatga

SEQ ID NO: 9500494 - DNA, 22 bp, Homo sapiens
aataatgtctttggcttgacca

SEQ ID NO: 9500495 - DNA, 22 bp, Homo sapiens
aataatgtctgctattttaaaa

SEQ ID NO: 9500496 - DNA, 22 bp, Homo sapiens
aagttacagttggaactgtgaa

SEQ ID NO: 9500497 - DNA, 22 bp, Homo sapiens
aagttacagttggaactgtgaa

SEQ ID NO: 9500498 - DNA, 22 bp, Homo sapiens
aagttacagttattatttaaaa

SEQ ID NO: 9500499 - DNA, 22 bp, Homo sapiens
aagttacagttattatttaaaa

SEQ ID NO: 9500500 - DNA, 22 bp, Homo sapiens
aataagaattgccagatttgaa

SEQ ID NO: 9500501 - DNA, 22 bp, Homo sapiens
aataagaattgccagatttgaa

SEQ ID NO: 9500502 - DNA, 22 bp, Homo sapiens
aagttacagttatgaaactcac

SEQ ID NO: 9500503 - DNA, 22 bp, Homo sapiens
aagttacagttattatttaaaa

SEQ ID NO: 9500504 - DNA, 22 bp, Homo sapiens
aagttacagttattatttaaaa

SEQ ID NO: 9500505 - DNA, 22 bp, Homo sapiens
aagttacaggagaaagagatca

SEQ ID NO: 9500506 - DNA, 22 bp, Homo sapiens
aagttacagtcagaggttaaca

SEQ ID NO: 9500507 - DNA, 22 bp, Homo sapiens
aagttacacattttcattgtaa

SEQ ID NO: 9500508 - DNA, 22 bp, Homo sapiens
aagttaagggaagattccaaac

SEQ ID NO: 9500509 - DNA, 22 bp, Homo sapiens
aagttacaagactaaatggaag

SEQ ID NO: 9500510 - DNA, 22 bp, Homo sapiens
aagttacaagactaaatggaag

SEQ ID NO: 9500511 - DNA, 22 bp, Homo sapiens
aacagtttatcaagtttttaca

SEQ ID NO: 9500512 - DNA, 21 bp, Homo sapiens
aacagttctctttgaaggtgt

SEQ ID NO: 9500513 - DNA, 22 bp, Homo sapiens
aagcagtgttcccagctggccc

SEQ ID NO: 9500514 - DNA, 22 bp, Homo sapiens
aagcagttactatttactatta

SEQ ID NO: 9500515 - DNA, 22 bp, Homo sapiens
aagcagtgatgcatacagctgt

SEQ ID NO: 9500516 - DNA, 22 bp, Homo sapiens
aagcagtcttggctgggttcag

SEQ ID NO: 9500517 - DNA, 22 bp, Homo sapiens
aagcataaaacgttacaacatg

SEQ ID NO: 9500518 - DNA, 22 bp, Homo sapiens
aagcataaaacgttacaacatg

SEQ ID NO: 9500519 - DNA, 22 bp, Homo sapiens
acagcaggaagctggagggaaa

SEQ ID NO: 9500520 - DNA, 22 bp, Homo sapiens
aagcagtttagataggcaaagg

SEQ ID NO: 9500521 - DNA, 22 bp, Homo sapiens
aagcagtttttcaactgtttag

SEQ ID NO: 9500522 - DNA, 22 bp, Homo sapiens
aagcataaaacgttacaacatg

SEQ ID NO: 9500523 - DNA, 22 bp, Homo sapiens
aagcataaaacgttacaacatg

SEQ ID NO: 9500524 - DNA, 19 bp, Homo sapiens
acagcaggtgtggggataa

SEQ ID NO: 9500525 - DNA, 22 bp, Homo sapiens
acagcaggtagctttgtgcctc

SEQ ID NO: 9500526 - DNA, 22 bp, Homo sapiens
acagcaggggtggaataaacgt

SEQ ID NO: 9500527 - DNA, 22 bp, Homo sapiens
acagcagggtcacattccctct

SEQ ID NO: 9500528 - DNA, 22 bp, Homo sapiens
acagcagggtcacattccctct

SEQ ID NO: 9500529 - DNA, 21 bp, Homo sapiens
acagcagggctggcatgacag

SEQ ID NO: 9500530 - DNA, 21 bp, Homo sapiens
acagcagggctggcatgacag

SEQ ID NO: 9500531 - DNA, 22 bp, Homo sapiens
acagcaggggtggaataaacgt

SEQ ID NO: 9500532 - DNA, 22 bp, Homo sapiens
acagcagggggagctgttggac

SEQ ID NO: 9500533 - DNA, 22 bp, Homo sapiens
acagcagggggagctgttggac

SEQ ID NO: 9500534 - DNA, 18 bp, Homo sapiens
aagcagggtccattgtgc

SEQ ID NO: 9500535 - DNA, 22 bp, Homo sapiens
aagcagggtgtcttgacccatg

SEQ ID NO: 9500536 - DNA, 22 bp, Homo sapiens
aagcaggtaaatatgtttccct

SEQ ID NO: 9500537 - DNA, 22 bp, Homo sapiens
aagcagtaatgaggtactattt

SEQ ID NO: 9500538 - DNA, 22 bp, Homo sapiens
aagcaggtgtgagccagtgggc

SEQ ID NO: 9500539 - DNA, 22 bp, Homo sapiens
aagcaggttacatacattatct

SEQ ID NO: 9500540 - DNA, 22 bp, Homo sapiens
aagcaggcgagggcctggagca

SEQ ID NO: 9500541 - DNA, 22 bp, Homo sapiens
aagcaggacgtatttctatcct

SEQ ID NO: 9500542 - DNA, 21 bp, Homo sapiens
aagcaggacatatgatgccct

SEQ ID NO: 9500543 - DNA, 21 bp, Homo sapiens
aagcaggacatatgatgccct

SEQ ID NO: 9500544 - DNA, 22 bp, Homo sapiens
aagcaggaaggagcccagggca

SEQ ID NO: 9500545 - DNA, 22 bp, Homo sapiens
aagcaggctcacgccaggcagt

SEQ ID NO: 9500546 - DNA, 22 bp, Homo sapiens
aagcaggcttggtgtggccgct

SEQ ID NO: 9500547 - DNA, 22 bp, Homo sapiens
aagcccagtttcacactgagac

SEQ ID NO: 9500548 - DNA, 22 bp, Homo sapiens
aagcccagtttcacactgagac

SEQ ID NO: 9500549 - DNA, 22 bp, Homo sapiens
aagcccagtttcacactgagac

SEQ ID NO: 9500550 - DNA, 19 bp, Homo sapiens
aagcccagtgtatgctctt

SEQ ID NO: 9500551 - DNA, 19 bp, Homo sapiens
aagcccagtgtatgctctt

SEQ ID NO: 9500552 - DNA, 19 bp, Homo sapiens
aagcccagtgtatgctctt

SEQ ID NO: 9500553 - DNA, 22 bp, Homo sapiens
aagcccagctctgcctgctctg

SEQ ID NO: 9500554 - DNA, 22 bp, Homo sapiens
aagcccagctctgcctgctctg

SEQ ID NO: 9500555 - DNA, 22 bp, Homo sapiens
aagcccagctctgcctgctctg

SEQ ID NO: 9500556 - DNA, 22 bp, Homo sapiens
aagcccagctctgcctgctctg

SEQ ID NO: 9500557 - DNA, 22 bp, Homo sapiens
aagcccagctctgcctgctctg

SEQ ID NO: 9500558 - DNA, 22 bp, Homo sapiens
aagcccagcatccctgcaccag

SEQ ID NO: 9500559 - DNA, 22 bp, Homo sapiens
aagcccagcatccctgcaccag

SEQ ID NO: 9500560 - DNA, 22 bp, Homo sapiens
aagcccaggtaagtggctcatg

SEQ ID NO: 9500561 - DNA, 22 bp, Homo sapiens
aagcccaggtaagtggctcatg

SEQ ID NO: 9500562 - DNA, 22 bp, Homo sapiens
aagccctcatccccatgggcgt

SEQ ID NO: 9500563 - DNA, 21 bp, Homo sapiens
aagcccgtagagccaggactc

SEQ ID NO: 9500564 - DNA, 22 bp, Homo sapiens
aagccctcagagcctctttgac

SEQ ID NO: 9500565 - DNA, 22 bp, Homo sapiens
aagcccctcgggtgcgcacgcg

SEQ ID NO: 9500566 - DNA, 22 bp, Homo sapiens
aagccctgacctgagagtccgt

SEQ ID NO: 9500567 - DNA, 22 bp, Homo sapiens
aagccctgacctgagagtccgt

SEQ ID NO: 9500568 - DNA, 22 bp, Homo sapiens
aagccctcattagccatagccc

SEQ ID NO: 9500569 - DNA, 22 bp, Homo sapiens
aagccctcattagccatagccc

SEQ ID NO: 9500570 - DNA, 22 bp, Homo sapiens
aagccctcattagccatagccc

SEQ ID NO: 9500571 - DNA, 23 bp, Homo sapiens
aagccctgaaggtttcaggccct

SEQ ID NO: 9500572 - DNA, 22 bp, Homo sapiens
aagccctccgtacgtgctagct

SEQ ID NO: 9500573 - DNA, 22 bp, Homo sapiens
acagctgctgcttctcactggg

SEQ ID NO: 9500574 - DNA, 22 bp, Homo sapiens
acagctgctctatatctcagcc

SEQ ID NO: 9500575 - DNA, 21 bp, Homo sapiens
acagctggaaattacttgccc

SEQ ID NO: 9500576 - DNA, 21 bp, Homo sapiens
acagctggaaattacttgccc

SEQ ID NO: 9500577 - DNA, 22 bp, Homo sapiens
acagctgctttctcttactatg

SEQ ID NO: 9500578 - DNA, 22 bp, Homo sapiens
acagctgctgtggaggttttca

SEQ ID NO: 9500579 - DNA, 22 bp, Homo sapiens
acagctgctgtttttgaaggac

SEQ ID NO: 9500580 - DNA, 22 bp, Homo sapiens
acagccagcttgatgggatccg

SEQ ID NO: 9500581 - DNA, 21 bp, Homo sapiens
acagccaggaacatgaggggc

SEQ ID NO: 9500582 - DNA, 21 bp, Homo sapiens
acagccaggaacatgaggggc

SEQ ID NO: 9500583 - DNA, 22 bp, Homo sapiens
acagccaggacttggccctctt

SEQ ID NO: 9500584 - DNA, 22 bp, Homo sapiens
acagccaggacttggccctctt

SEQ ID NO: 9500585 - DNA, 22 bp, Homo sapiens
acagccaggaattctggagaag

SEQ ID NO: 9500586 - DNA, 22 bp, Homo sapiens
acagccaggaattctggagaag

SEQ ID NO: 9500587 - DNA, 22 bp, Homo sapiens
acagcaggttacagtggcacag

SEQ ID NO: 9500588 - DNA, 22 bp, Homo sapiens
acagccagatctgagagatctt

SEQ ID NO: 9500589 - DNA, 22 bp, Homo sapiens
acagccagatctgagagatctt

SEQ ID NO: 9500590 - DNA, 22 bp, Homo sapiens
acagccagatctgagagatctt

SEQ ID NO: 9500591 - DNA, 22 bp, Homo sapiens
acagcaggttacagtggcacag

SEQ ID NO: 9500592 - DNA, 22 bp, Homo sapiens
acagcaggttacagtggcacag

SEQ ID NO: 9500593 - DNA, 22 bp, Homo sapiens
acagcaggttacagtggcacag

SEQ ID NO: 9500594 - DNA, 22 bp, Homo sapiens
acagcaggttacagtggcacag

SEQ ID NO: 9500595 - DNA, 22 bp, Homo sapiens
acagccaggaggaactcagtga

SEQ ID NO: 9500596 - DNA, 22 bp, Homo sapiens
acagccaggaggaactcagtga

SEQ ID NO: 9500597 - DNA, 22 bp, Homo sapiens
acagccaggaggaactcagtga

SEQ ID NO: 9500598 - DNA, 22 bp, Homo sapiens
acagccaggaggaactcagtga

SEQ ID NO: 9500599 - DNA, 22 bp, Homo sapiens
acagccaggagccatgggcagg

SEQ ID NO: 9500600 - DNA, 22 bp, Homo sapiens
acagccaggagccatgggcagg

SEQ ID NO: 9500601 - DNA, 22 bp, Homo sapiens
acagccaggagccatgggcagg

SEQ ID NO: 9500602 - DNA, 22 bp, Homo sapiens
acagccaggagccatgggcagg

SEQ ID NO: 9500603 - DNA, 23 bp, Homo sapiens
acagccaggatgggagcagaagc

SEQ ID NO: 9500604 - DNA, 22 bp, Homo sapiens
acagccaggcccagcacgcagg

SEQ ID NO: 9500605 - DNA, 23 bp, Homo sapiens
acagccaggatgggagcagaagc

SEQ ID NO: 9500606 - DNA, 22 bp, Homo sapiens
aagcccagatgtgagaactgag

SEQ ID NO: 9500607 - DNA, 22 bp, Homo sapiens
aagcccagcatccctgcaccag

SEQ ID NO: 9500608 - DNA, 22 bp, Homo sapiens
aagccaggttccatggaggagc

SEQ ID NO: 9500609 - DNA, 22 bp, Homo sapiens
acagccaggcccagcacgcagg

SEQ ID NO: 9500610 - DNA, 22 bp, Homo sapiens
acagccagggacatacaatggt

SEQ ID NO: 9500611 - DNA, 22 bp, Homo sapiens
aagccaggttccatggaggagc

SEQ ID NO: 9500612 - DNA, 23 bp, Homo sapiens
acagaaatcatttgtaaggtacc

SEQ ID NO: 9500613 - DNA, 18 bp, Homo sapiens
acagaaatagctgtgcct

SEQ ID NO: 9500614 - DNA, 18 bp, Homo sapiens
acagaaatagctgtgcct

SEQ ID NO: 9500615 - DNA, 23 bp, Homo sapiens
acagaaagttctgctggacagag

SEQ ID NO: 9500616 - DNA, 23 bp, Homo sapiens
acagaaagttctgctggacagag

SEQ ID NO: 9500617 - DNA, 22 bp, Homo sapiens
acagaaataactttttatgttt

SEQ ID NO: 9500618 - DNA, 22 bp, Homo sapiens
acagacattttaagacacttta

SEQ ID NO: 9500619 - DNA, 22 bp, Homo sapiens
acagacatttaataaatgctga

SEQ ID NO: 9500620 - DNA, 22 bp, Homo sapiens
acagacatttaataaatgctga

SEQ ID NO: 9500621 - DNA, 22 bp, Homo sapiens
acagagcaacttgagtatcctc

SEQ ID NO: 9500622 - DNA, 22 bp, Homo sapiens
acagagcaacttgagtatcctc

SEQ ID NO: 9500623 - DNA, 22 bp, Homo sapiens
acagagcaactttatttcatgg

SEQ ID NO: 9500624 - DNA, 22 bp, Homo sapiens
acagagcaataacagggagagg

SEQ ID NO: 9500625 - DNA, 22 bp, Homo sapiens
acagagatgcaagtgtgtattt

SEQ ID NO: 9500626 - DNA, 22 bp, Homo sapiens
acagagatgggaacattcaggt

SEQ ID NO: 9500627 - DNA, 23 bp, Homo sapiens
acagagatcttgacttgtatgga

SEQ ID NO: 9500628 - DNA, 22 bp, Homo sapiens
acagagatgaataatacaggtg

SEQ ID NO: 9500629 - DNA, 22 bp, Homo sapiens
acagactggagtgagagaaata

SEQ ID NO: 9500630 - DNA, 23 bp, Homo sapiens
acagactgtattcaaagtaggac

SEQ ID NO: 9500631 - DNA, 22 bp, Homo sapiens
acagactgattcattgctcagg

SEQ ID NO: 9500632 - DNA, 22 bp, Homo sapiens
acagactgattcattgctcagg

SEQ ID NO: 9500633 - DNA, 22 bp, Homo sapiens
acagaccaagtttccagcaggt

SEQ ID NO: 9500634 - DNA, 22 bp, Homo sapiens
acagacctatggcagctgccat

SEQ ID NO: 9500635 - DNA, 20 bp, Homo sapiens
acacatagataagaagctga

SEQ ID NO: 9500636 - DNA, 22 bp, Homo sapiens
acacatataccactgtaaatga

SEQ ID NO: 9500637 - DNA, 22 bp, Homo sapiens
acacatataccactgtaaatga

SEQ ID NO: 9500638 - DNA, 22 bp, Homo sapiens
acacatagaaaataaatagtta

SEQ ID NO: 9500639 - DNA, 22 bp, Homo sapiens
acacataagcctaatcatctcc

SEQ ID NO: 9500640 - DNA, 22 bp, Homo sapiens
acacataagcctaatcatctcc

SEQ ID NO: 9500641 - DNA, 20 bp, Homo sapiens
acacatatagcagcataaac

SEQ ID NO: 9500642 - DNA, 20 bp, Homo sapiens
acacatatagcagcataaac

SEQ ID NO: 9500643 - DNA, 20 bp, Homo sapiens
acacatatagcagcataaac

SEQ ID NO: 9500644 - DNA, 20 bp, Homo sapiens
acacatatagcagcataaac

SEQ ID NO: 9500645 - DNA, 20 bp, Homo sapiens
acacatatagcagcataaac

SEQ ID NO: 9500646 - DNA, 22 bp, Homo sapiens
acacatatatacatatttgtgc

SEQ ID NO: 9500647 - DNA, 22 bp, Homo sapiens
aagatacacggtcaactctcaa

SEQ ID NO: 9500648 - DNA, 22 bp, Homo sapiens
aagatacacgttgtattgaata

SEQ ID NO: 9500649 - DNA, 22 bp, Homo sapiens
aagatacacgttgtattgaata

SEQ ID NO: 9500650 - DNA, 22 bp, Homo sapiens
aagatacagacagagccaaaat

SEQ ID NO: 9500651 - DNA, 22 bp, Homo sapiens
aagatacagacagagccaaaat

SEQ ID NO: 9500652 - DNA, 22 bp, Homo sapiens
aagatacagtgaaagggcattg

SEQ ID NO: 9500653 - DNA, 22 bp, Homo sapiens
aagatacataaaggtagagtct

SEQ ID NO: 9500654 - DNA, 22 bp, Homo sapiens
acacataagcctaatcatctcc

SEQ ID NO: 9500655 - DNA, 22 bp, Homo sapiens
aagatacatcaaagcaaattgg

SEQ ID NO: 9500656 - DNA, 22 bp, Homo sapiens
aagatacatcaaagcaaattgg

SEQ ID NO: 9500657 - DNA, 20 bp, Homo sapiens
acagaaagctgccttgtccc

SEQ ID NO: 9500658 - DNA, 22 bp, Homo sapiens
acagaaagatgatttgaaatgg

SEQ ID NO: 9500659 - DNA, 23 bp, Homo sapiens
acagaaagttctgctggacagag

SEQ ID NO: 9500660 - DNA, 23 bp, Homo sapiens
acagaaagttctgctggacagag

SEQ ID NO: 9500661 - DNA, 22 bp, Homo sapiens
acactttaagcatttcacactg

SEQ ID NO: 9500662 - DNA, 22 bp, Homo sapiens
acagaaagatgatttgaaatgg

SEQ ID NO: 9500663 - DNA, 22 bp, Homo sapiens
acactttaagcatttcacactg

SEQ ID NO: 9500664 - DNA, 22 bp, Homo sapiens
acacttgttaagaagaggatat

SEQ ID NO: 9500665 - DNA, 22 bp, Homo sapiens
acacttggagcaacacttatgg

SEQ ID NO: 9500666 - DNA, 22 bp, Homo sapiens
acacttggctctgagtcactac

SEQ ID NO: 9500667 - DNA, 22 bp, Homo sapiens
acacttggagcaacacttatgg

SEQ ID NO: 9500668 - DNA, 22 bp, Homo sapiens
acacttgccatgctgcacactg

SEQ ID NO: 9500669 - DNA, 18 bp, Homo sapiens
acacttcctggtggtgtg

SEQ ID NO: 9500670 - DNA, 18 bp, Homo sapiens
acacttcctggtggtgtg

SEQ ID NO: 9500671 - DNA, 22 bp, Homo sapiens
acacttctattccctgcacaaa

SEQ ID NO: 9500672 - DNA, 22 bp, Homo sapiens
acacttctcatttgatactaac

SEQ ID NO: 9500673 - DNA, 22 bp, Homo sapiens
acacttctttgtcacctgcttc

SEQ ID NO: 9500674 - DNA, 22 bp, Homo sapiens
acactggttgttaatagtaaca

SEQ ID NO: 9500675 - DNA, 22 bp, Homo sapiens
acactggttgaattgtataact

SEQ ID NO: 9500676 - DNA, 22 bp, Homo sapiens
acactggttggttgaatttact

SEQ ID NO: 9500677 - DNA, 23 bp, Homo sapiens
acactggttttaaagcagttaat

SEQ ID NO: 9500678 - DNA, 19 bp, Homo sapiens
acactggttgttcaagggc

SEQ ID NO: 9500679 - DNA, 22 bp, Homo sapiens
acactggttgaattgtataact

SEQ ID NO: 9500680 - DNA, 22 bp, Homo sapiens
acactggttgttaatagtaaca

SEQ ID NO: 9500681 - DNA, 22 bp, Homo sapiens
acacttcaggactctggggcaa

SEQ ID NO: 9500682 - DNA, 22 bp, Homo sapiens
acacttcagctccacaaacatt

SEQ ID NO: 9500683 - DNA, 22 bp, Homo sapiens
acacttcagctccacaaacatt

SEQ ID NO: 9500684 - DNA, 22 bp, Homo sapiens
acacttcatagcaaggttggag

SEQ ID NO: 9500685 - DNA, 22 bp, Homo sapiens
acacttcaggactctggggcaa

SEQ ID NO: 9500686 - DNA, 21 bp, Homo sapiens
acacttcagtttttaaaggga

SEQ ID NO: 9500687 - DNA, 22 bp, Homo sapiens
acacttcatgcattcttcactc

SEQ ID NO: 9500688 - DNA, 22 bp, Homo sapiens
acacttcatgcattcttcactc

SEQ ID NO: 9500689 - DNA, 20 bp, Homo sapiens
acacttcatttgcagcagct

SEQ ID NO: 9500690 - DNA, 22 bp, Homo sapiens
acacttcatttacattataggc

SEQ ID NO: 9500691 - DNA, 22 bp, Homo sapiens
acaatgtaggagtatgacagta

SEQ ID NO: 9500692 - DNA, 22 bp, Homo sapiens
acaatgtaggatatgtacttgt

SEQ ID NO: 9500693 - DNA, 22 bp, Homo sapiens
acaatgtagttgtcatgagaca

SEQ ID NO: 9500694 - DNA, 22 bp, Homo sapiens
acaatgtaggctgaaaaagctt

SEQ ID NO: 9500695 - DNA, 22 bp, Homo sapiens
acaatgtaggctgaaaaagctt

SEQ ID NO: 9500696 - DNA, 22 bp, Homo sapiens
acaatgtcaaaataggaaacat

SEQ ID NO: 9500697 - DNA, 22 bp, Homo sapiens
acaatgtcacctctcatgtttt

SEQ ID NO: 9500698 - DNA, 21 bp, Homo sapiens
acaatgtcaaggtcagacatt

SEQ ID NO: 9500699 - DNA, 21 bp, Homo sapiens
acaatgtcaaggtcagacatt

SEQ ID NO: 9500700 - DNA, 22 bp, Homo sapiens
acaatgttctacatatacataa

SEQ ID NO: 9500701 - DNA, 22 bp, Homo sapiens
acaatgtgggcatgagaaacca

SEQ ID NO: 9500702 - DNA, 22 bp, Homo sapiens
acaatgtgataatttaaagata

SEQ ID NO: 9500703 - DNA, 22 bp, Homo sapiens
acaatgtgcttatgaaggcagt

SEQ ID NO: 9500704 - DNA, 22 bp, Homo sapiens
acaatgtctttgtctccttcag

SEQ ID NO: 9500705 - DNA, 23 bp, Homo sapiens
acaatgtctgttcataaaatacc

SEQ ID NO: 9500706 - DNA, 22 bp, Homo sapiens
acaatgtctgctatttggctct

SEQ ID NO: 9500707 - DNA, 22 bp, Homo sapiens
acaatgtctcatattcgtgttc

SEQ ID NO: 9500708 - DNA, 22 bp, Homo sapiens
acaatgtctcatattcgtgttc

SEQ ID NO: 9500709 - DNA, 22 bp, Homo sapiens
acaatgtcacctctcatgtttt

SEQ ID NO: 9500710 - DNA, 21 bp, Homo sapiens
acaatgtcaaggtcagacatt

SEQ ID NO: 9500711 - DNA, 22 bp, Homo sapiens
acaatgtcacctctcatgtttt

SEQ ID NO: 9500712 - DNA, 22 bp, Homo sapiens
acaatatgggatatacatttta

SEQ ID NO: 9500713 - DNA, 22 bp, Homo sapiens
acaatatgggatatacatttta

SEQ ID NO: 9500714 - DNA, 22 bp, Homo sapiens
acaatatttgggggcagtttgt

SEQ ID NO: 9500715 - DNA, 22 bp, Homo sapiens
acaatatttgggggcagtttgt

SEQ ID NO: 9500716 - DNA, 22 bp, Homo sapiens
acaatatttgggggcagtttgt

SEQ ID NO: 9500717 - DNA, 22 bp, Homo sapiens
acaatatttgggggcagtttgt

SEQ ID NO: 9500718 - DNA, 22 bp, Homo sapiens
acaatattgtacccagaagttt

SEQ ID NO: 9500719 - DNA, 20 bp, Homo sapiens
acaatatgtagatgaatagc

SEQ ID NO: 9500720 - DNA, 22 bp, Homo sapiens
acaatattgtacccagaagttt

SEQ ID NO: 9500721 - DNA, 22 bp, Homo sapiens
acaatattgtacccagaagttt

SEQ ID NO: 9500722 - DNA, 22 bp, Homo sapiens
acaacaaaatcactagtcttcc

SEQ ID NO: 9500723 - DNA, 22 bp, Homo sapiens
acaaatttggtgagagtaaata

SEQ ID NO: 9500724 - DNA, 22 bp, Homo sapiens
acaaattgttgcttcatgaatg

SEQ ID NO: 9500725 - DNA, 22 bp, Homo sapiens
acaaattgttgcttcatgaatg

SEQ ID NO: 9500726 - DNA, 22 bp, Homo sapiens
acaaattgttgcttcatgaatg

SEQ ID NO: 9500727 - DNA, 22 bp, Homo sapiens
acaaattgttgcttcatgaatg

SEQ ID NO: 9500728 - DNA, 21 bp, Homo sapiens
acaaattgtttatataggaag

SEQ ID NO: 9500729 - DNA, 22 bp, Homo sapiens
acaacaaaatcactagtcttcc

SEQ ID NO: 9500730 - DNA, 22 bp, Homo sapiens
acaaggcttatagttgcttttt

SEQ ID NO: 9500731 - DNA, 22 bp, Homo sapiens
acaatagacccatgacacatac

SEQ ID NO: 9500732 - DNA, 21 bp, Homo sapiens
acaatagacataagcagagca

SEQ ID NO: 9500733 - DNA, 22 bp, Homo sapiens
acaaggcttcacacagtatgaa

SEQ ID NO: 9500734 - DNA, 22 bp, Homo sapiens
acaatagacaaagtgaatggct

SEQ ID NO: 9500735 - DNA, 21 bp, Homo sapiens
acaatagacataagcagagca

SEQ ID NO: 9500736 - DNA, 22 bp, Homo sapiens
acaatagtgcctggcatagagt

SEQ ID NO: 9500737 - DNA, 22 bp, Homo sapiens
acaatagtatgagccttttaga

SEQ ID NO: 9500738 - DNA, 22 bp, Homo sapiens
acaatagtaaggtatattgtca

SEQ ID NO: 9500739 - DNA, 20 bp, Homo sapiens
acaatagatttgagcaaagt

SEQ ID NO: 9500740 - DNA, 20 bp, Homo sapiens
acaatagatttgagcaaagt

SEQ ID NO: 9500741 - DNA, 20 bp, Homo sapiens
acaatagatttgagcaaagt

SEQ ID NO: 9500742 - DNA, 22 bp, Homo sapiens
acaatagacccatgacacatac

SEQ ID NO: 9500743 - DNA, 22 bp, Homo sapiens
acaatagagttctcataggaca

SEQ ID NO: 9500744 - DNA, 22 bp, Homo sapiens
acaatagagttctcataggaca

SEQ ID NO: 9500745 - DNA, 22 bp, Homo sapiens
acaatagatactgggcacatat

SEQ ID NO: 9500746 - DNA, 22 bp, Homo sapiens
acacagctatggggtaggaaac

SEQ ID NO: 9500747 - DNA, 22 bp, Homo sapiens
acacagctcacaacgtgtgcat

SEQ ID NO: 9500748 - DNA, 22 bp, Homo sapiens
acacagctagtgagtggcagag

SEQ ID NO: 9500749 - DNA, 22 bp, Homo sapiens
acacagctatggggtaggaaac

SEQ ID NO: 9500750 - DNA, 22 bp, Homo sapiens
acacagctgtgcagttttttca

SEQ ID NO: 9500751 - DNA, 22 bp, Homo sapiens
acacagctgtgcagttttttca

SEQ ID NO: 9500752 - DNA, 22 bp, Homo sapiens
acacagcttcaaagtctaattc

SEQ ID NO: 9500753 - DNA, 21 bp, Homo sapiens
acacagctgccggagacggat

SEQ ID NO: 9500754 - DNA, 17 bp, Homo sapiens
acacagccaggttctcc

SEQ ID NO: 9500755 - DNA, 22 bp, Homo sapiens
acacagccgtgaatctgcttct

SEQ ID NO: 9500756 - DNA, 22 bp, Homo sapiens
acacagctagtgagtggcagag

SEQ ID NO: 9500757 - DNA, 17 bp, Homo sapiens
acacagccaggttctcc

SEQ ID NO: 9500758 - DNA, 22 bp, Homo sapiens
acacagcaaggtctgactttgg

SEQ ID NO: 9500759 - DNA, 22 bp, Homo sapiens
aagatacaaatgtcaatattgg

SEQ ID NO: 9500760 - DNA, 22 bp, Homo sapiens
aagatacaaatgtcaatattgg

SEQ ID NO: 9500761 - DNA, 22 bp, Homo sapiens
aagatacaaatgtcaatattgg

SEQ ID NO: 9500762 - DNA, 22 bp, Homo sapiens
aagataatgtgtctgtctttgc

SEQ ID NO: 9500763 - DNA, 22 bp, Homo sapiens
aagatacaaatgtcaatattgg

SEQ ID NO: 9500764 - DNA, 22 bp, Homo sapiens
aagatacaccaagagcctagta

SEQ ID NO: 9500765 - DNA, 22 bp, Homo sapiens
aagatacaaatgtcaatattgg

SEQ ID NO: 9500766 - DNA, 22 bp, Homo sapiens
aagataagagggaggtgcctca

SEQ ID NO: 9500767 - DNA, 22 bp, Homo sapiens
aagataacaggaggagtttgta

SEQ ID NO: 9500768 - DNA, 22 bp, Homo sapiens
aagagtttatgatataacatgt

SEQ ID NO: 9500769 - DNA, 22 bp, Homo sapiens
aagagtttccagttgtggctca

SEQ ID NO: 9500770 - DNA, 22 bp, Homo sapiens
aagagtttatgatataacatgt

SEQ ID NO: 9500771 - DNA, 22 bp, Homo sapiens
aagataatattcattaactaga

SEQ ID NO: 9500772 - DNA, 22 bp, Homo sapiens
aagataatgtgtctgtctttgc

SEQ ID NO: 9500773 - DNA, 22 bp, Homo sapiens
aagataatattcattaactaga

SEQ ID NO: 9500774 - DNA, 22 bp, Homo sapiens
aagataatattcattaactaga

SEQ ID NO: 9500775 - DNA, 22 bp, Homo sapiens
aagataatattcattaactaga

SEQ ID NO: 9500776 - DNA, 22 bp, Homo sapiens
aagataatattcattaactaga

SEQ ID NO: 9500777 - DNA, 22 bp, Homo sapiens
aagataagtaacgagcctcagt

SEQ ID NO: 9500778 - DNA, 22 bp, Homo sapiens
acacagcaacttgcagtatgga

SEQ ID NO: 9500779 - DNA, 22 bp, Homo sapiens
acacagcaacttgcagtatgga

SEQ ID NO: 9500780 - DNA, 22 bp, Homo sapiens
acacagagcaaatcatgacaga

SEQ ID NO: 9500781 - DNA, 22 bp, Homo sapiens
acacagagccaaaccatatcac

SEQ ID NO: 9500782 - DNA, 22 bp, Homo sapiens
acacagagccagggaatacagt

SEQ ID NO: 9500783 - DNA, 22 bp, Homo sapiens
acacagagccagggaatacagt

SEQ ID NO: 9500784 - DNA, 22 bp, Homo sapiens
acacagagctggaactgcttca

SEQ ID NO: 9500785 - DNA, 17 bp, Homo sapiens
acacagacaggcagaca

SEQ ID NO: 9500786 - DNA, 22 bp, Homo sapiens
acacagaagctttttctattcc

SEQ ID NO: 9500787 - DNA, 17 bp, Homo sapiens
acacagacaggcagaca

SEQ ID NO: 9500788 - DNA, 17 bp, Homo sapiens
acacagacaggcagaca

SEQ ID NO: 9500789 - DNA, 17 bp, Homo sapiens
acacagagattaacaca

SEQ ID NO: 9500790 - DNA, 17 bp, Homo sapiens
acacagagattaacaca

SEQ ID NO: 9500791 - DNA, 17 bp, Homo sapiens
acacagagattaacaca

SEQ ID NO: 9500792 - DNA, 22 bp, Homo sapiens
acaatgttctacatatacataa

SEQ ID NO: 9500793 - DNA, 22 bp, Homo sapiens
acacagaagatctcttaatgct

SEQ ID NO: 9500794 - DNA, 22 bp, Homo sapiens
acacagaagctttttctattcc

SEQ ID NO: 9500795 - DNA, 22 bp, Homo sapiens
aagaacaggttctagaaccatt

SEQ ID NO: 9500796 - DNA, 22 bp, Homo sapiens
aatgtacaataagacaaagagg

SEQ ID NO: 9500797 - DNA, 22 bp, Homo sapiens
aatgtacaataagacaaagagg

SEQ ID NO: 9500798 - DNA, 22 bp, Homo sapiens
aatgtacaagggttccagtttt

SEQ ID NO: 9500799 - DNA, 22 bp, Homo sapiens
aatgtacaagggttccagtttt

SEQ ID NO: 9500800 - DNA, 22 bp, Homo sapiens
aatgtacaagggttccagtttt

SEQ ID NO: 9500801 - DNA, 22 bp, Homo sapiens
aatgtacaagggttccagtttt

SEQ ID NO: 9500802 - DNA, 22 bp, Homo sapiens
aagaacattcgaactattttct

SEQ ID NO: 9500803 - DNA, 22 bp, Homo sapiens
aagaacattcgaactattttct

SEQ ID NO: 9500804 - DNA, 22 bp, Homo sapiens
aagaacaggttctagaaccatt

SEQ ID NO: 9500805 - DNA, 22 bp, Homo sapiens
aagaacatgttaaaagattcac

SEQ ID NO: 9500806 - DNA, 22 bp, Homo sapiens
aagaacatgttaaaagattcac

SEQ ID NO: 9500807 - DNA, 22 bp, Homo sapiens
aagaacatgttaaaagattcac

SEQ ID NO: 9500808 - DNA, 22 bp, Homo sapiens
aagaacattttgtagaatgaca

SEQ ID NO: 9500809 - DNA, 22 bp, Homo sapiens
aagaacattttgtagaatgaca

SEQ ID NO: 9500810 - DNA, 22 bp, Homo sapiens
aagaacattttgtagaatgaca

SEQ ID NO: 9500811 - DNA, 22 bp, Homo sapiens
aagaacattgatattgtctatg

SEQ ID NO: 9500812 - DNA, 22 bp, Homo sapiens
aagaacatttatgatggcattt

SEQ ID NO: 9500813 - DNA, 22 bp, Homo sapiens
aagaacattttgtagaatgaca

SEQ ID NO: 9500814 - DNA, 22 bp, Homo sapiens
aagaacattttgtagaatgaca

SEQ ID NO: 9500815 - DNA, 22 bp, Homo sapiens
aagaactatctctggctgtagg

SEQ ID NO: 9500816 - DNA, 19 bp, Homo sapiens
aagaactatgtgattacag

SEQ ID NO: 9500817 - DNA, 22 bp, Homo sapiens
aagaactagtcttacagcctca

SEQ ID NO: 9500818 - DNA, 22 bp, Homo sapiens
aagaagagaaatgtgctgctgg

SEQ ID NO: 9500819 - DNA, 22 bp, Homo sapiens
aagaagagaaatgtgctgctgg

SEQ ID NO: 9500820 - DNA, 22 bp, Homo sapiens
aagaagagaactggcatcctaa

SEQ ID NO: 9500821 - DNA, 22 bp, Homo sapiens
aagaagaagtgttatttttaga

SEQ ID NO: 9500822 - DNA, 23 bp, Homo sapiens
aagaactttggtcctgcagagtc

SEQ ID NO: 9500823 - DNA, 22 bp, Homo sapiens
aagaacttttggcaagtgttat

SEQ ID NO: 9500824 - DNA, 22 bp, Homo sapiens
aagaactgtttacaattttcac

SEQ ID NO: 9500825 - DNA, 22 bp, Homo sapiens
aagaactgtatcaagatgtagt

SEQ ID NO: 9500826 - DNA, 22 bp, Homo sapiens
aagaactttaaagcacttatga

SEQ ID NO: 9500827 - DNA, 22 bp, Homo sapiens
aagaacttgggctgagtgaaag

SEQ ID NO: 9500828 - DNA, 22 bp, Homo sapiens
aagaactttaaagcacttatga

SEQ ID NO: 9500829 - DNA, 22 bp, Homo sapiens
aagaactttgatttcattgcat

SEQ ID NO: 9500830 - DNA, 22 bp, Homo sapiens
acaaaaattagctgggcatggt

SEQ ID NO: 9500831 - DNA, 22 bp, Homo sapiens
acaaaacagtgttcctgcccct

SEQ ID NO: 9500832 - DNA, 22 bp, Homo sapiens
acaaaacagtgttcctgcccct

SEQ ID NO: 9500833 - DNA, 22 bp, Homo sapiens
acaaaaattagctgggcatggt

SEQ ID NO: 9500834 - DNA, 22 bp, Homo sapiens
acaaaaagggagatgaggtaga

SEQ ID NO: 9500835 - DNA, 22 bp, Homo sapiens
acaaaaagggagatgaggtaga

SEQ ID NO: 9500836 - DNA, 22 bp, Homo sapiens
aattttatctctaagcaggctt

SEQ ID NO: 9500837 - DNA, 22 bp, Homo sapiens
aagaagatggttaactttcagt

SEQ ID NO: 9500838 - DNA, 22 bp, Homo sapiens
aagaagagaactggcatcctaa

SEQ ID NO: 9500839 - DNA, 22 bp, Homo sapiens
aagaagatggttaactttcagt

SEQ ID NO: 9500840 - DNA, 21 bp, Homo sapiens
aagaagcaatttattggaagg

SEQ ID NO: 9500841 - DNA, 21 bp, Homo sapiens
aagaagcaatttattggaagg

SEQ ID NO: 9500842 - DNA, 19 bp, Homo sapiens
aagaagcaataagctgtga

SEQ ID NO: 9500843 - DNA, 21 bp, Homo sapiens
aagaagcaatttattggaagg

SEQ ID NO: 9500844 - DNA, 19 bp, Homo sapiens
aagaagcaataagctgtga

SEQ ID NO: 9500845 - DNA, 22 bp, Homo sapiens
aagaatcatctgaactttgagg

SEQ ID NO: 9500846 - DNA, 22 bp, Homo sapiens
aagaatcatctgaactttgagg

SEQ ID NO: 9500847 - DNA, 22 bp, Homo sapiens
aagaatcatcctgcaagagtct

SEQ ID NO: 9500848 - DNA, 17 bp, Homo sapiens
aagaatcattagagaag

SEQ ID NO: 9500849 - DNA, 23 bp, Homo sapiens
aagaatcagtaagtaaggagacc

SEQ ID NO: 9500850 - DNA, 23 bp, Homo sapiens
aagaatcagtaagtaaggagacc

SEQ ID NO: 9500851 - DNA, 22 bp, Homo sapiens
aagaatcatagagccactgata

SEQ ID NO: 9500852 - DNA, 22 bp, Homo sapiens
aagaatcatcctgcaagagtct

SEQ ID NO: 9500853 - DNA, 22 bp, Homo sapiens
aagaatcatagagccactgata

SEQ ID NO: 9500854 - DNA, 22 bp, Homo sapiens
aagaatcatcctgcaagagtct

SEQ ID NO: 9500855 - DNA, 22 bp, Homo sapiens
acaaaatagagttctcccctgg

SEQ ID NO: 9500856 - DNA, 22 bp, Homo sapiens
aagaatatagattttttgaagt

SEQ ID NO: 9500857 - DNA, 22 bp, Homo sapiens
aagaatatctgttttatttagg

SEQ ID NO: 9500858 - DNA, 22 bp, Homo sapiens
aagaatatctgttttatttagg

SEQ ID NO: 9500859 - DNA, 22 bp, Homo sapiens
aagaatatctgttttatttagg

SEQ ID NO: 9500860 - DNA, 22 bp, Homo sapiens
acaaaagtgtaggaattcctta

SEQ ID NO: 9500861 - DNA, 22 bp, Homo sapiens
acaaaagtgtaggaattcctta

SEQ ID NO: 9500862 - DNA, 22 bp, Homo sapiens
acaaaagtgtaggaattcctta

SEQ ID NO: 9500863 - DNA, 22 bp, Homo sapiens
acaaaagtgagtgtgtctcaga

SEQ ID NO: 9500864 - DNA, 22 bp, Homo sapiens
acaaaagtgagtgtgtctcaga

SEQ ID NO: 9500865 - DNA, 22 bp, Homo sapiens
acaaaagtgagtgtgtctcaga

SEQ ID NO: 9500866 - DNA, 22 bp, Homo sapiens
acaaaagcactgcagagtaagc

SEQ ID NO: 9500867 - DNA, 22 bp, Homo sapiens
acaaaagcactgcagagtaagc

SEQ ID NO: 9500868 - DNA, 22 bp, Homo sapiens
acaaaagtagttgcggtttttg

SEQ ID NO: 9500869 - DNA, 22 bp, Homo sapiens
acaaaagaataagatgagtcat

SEQ ID NO: 9500870 - DNA, 22 bp, Homo sapiens
acaaaagaataagatgagtcat

SEQ ID NO: 9500871 - DNA, 22 bp, Homo sapiens
acaaaagaataagatgagtcat

SEQ ID NO: 9500872 - DNA, 22 bp, Homo sapiens
acaaaagaataagatgagtcat

SEQ ID NO: 9500873 - DNA, 22 bp, Homo sapiens
acaaaagaataagatgagtcat

SEQ ID NO: 9500874 - DNA, 22 bp, Homo sapiens
acaaaagaataagatgagtcat

SEQ ID NO: 9500875 - DNA, 22 bp, Homo sapiens
acaaaaccagaaaatctctacc

SEQ ID NO: 9500876 - DNA, 22 bp, Homo sapiens
acaaaagaataagatgagtcat

SEQ ID NO: 9500877 - DNA, 21 bp, Homo sapiens
acaaaagaagctgccttttaa

SEQ ID NO: 9500878 - DNA, 21 bp, Homo sapiens
acaaaagaagctgccttttaa

SEQ ID NO: 9500879 - DNA, 21 bp, Homo sapiens
acaaaagaagctgccttttaa

SEQ ID NO: 9500880 - DNA, 21 bp, Homo sapiens
acaaaagaagctgccttttaa

SEQ ID NO: 9500881 - DNA, 22 bp, Homo sapiens
acaaatgaatcatacataatgt

SEQ ID NO: 9500882 - DNA, 22 bp, Homo sapiens
acaaatgaatcatacataatgt

SEQ ID NO: 9500883 - DNA, 22 bp, Homo sapiens
acaaatgaatcatacataatgt

SEQ ID NO: 9500884 - DNA, 22 bp, Homo sapiens
acaaatgaatcatacataatgt

SEQ ID NO: 9500885 - DNA, 22 bp, Homo sapiens
acaaatgaatcatacataatgt

SEQ ID NO: 9500886 - DNA, 19 bp, Homo sapiens
acaaattgtcctcatcaag

SEQ ID NO: 9500887 - DNA, 20 bp, Homo sapiens
acaaattggcagaatgacaa

SEQ ID NO: 9500888 - DNA, 22 bp, Homo sapiens
acaaatctgttttatagacttt

SEQ ID NO: 9500889 - DNA, 22 bp, Homo sapiens
acaaatctgttttatagacttt

SEQ ID NO: 9500890 - DNA, 22 bp, Homo sapiens
acaaatgaacatataagcttga

SEQ ID NO: 9500891 - DNA, 22 bp, Homo sapiens
acaaatctgttttatagacttt

SEQ ID NO: 9500892 - DNA, 22 bp, Homo sapiens
acaaatgaacctgaaatctcag

SEQ ID NO: 9500893 - DNA, 22 bp, Homo sapiens
acaaatgaacatataagcttga

SEQ ID NO: 9500894 - DNA, 22 bp, Homo sapiens
acaaatgaacatataagcttga

SEQ ID NO: 9500895 - DNA, 22 bp, Homo sapiens
aagaatctatggtacatccaag

SEQ ID NO: 9500896 - DNA, 22 bp, Homo sapiens
aagaatcattgtaaagttctgt

SEQ ID NO: 9500897 - DNA, 22 bp, Homo sapiens
aagaatctatggtacatccaag

SEQ ID NO: 9500898 - DNA, 22 bp, Homo sapiens
aagaatctatggtacatccaag

SEQ ID NO: 9500899 - DNA, 22 bp, Homo sapiens
aagaatctatggtacatccaag

SEQ ID NO: 9500900 - DNA, 23 bp, Homo sapiens
aagaatctcagaattagaaatac

SEQ ID NO: 9500901 - DNA, 22 bp, Homo sapiens
aagaatctctgatcaggcttta

SEQ ID NO: 9500902 - DNA, 22 bp, Homo sapiens
aagaatctccatctgattcact

SEQ ID NO: 9500903 - DNA, 22 bp, Homo sapiens
acaaatatttactgaatccact

SEQ ID NO: 9500904 - DNA, 22 bp, Homo sapiens
acaaatatttactgaatccact

SEQ ID NO: 9500905 - DNA, 22 bp, Homo sapiens
acaaatatttactgaatccact

SEQ ID NO: 9500906 - DNA, 22 bp, Homo sapiens
acaaatatttactgaatccact

SEQ ID NO: 9500907 - DNA, 22 bp, Homo sapiens
acaaagctagagaagagaattg

SEQ ID NO: 9500908 - DNA, 22 bp, Homo sapiens
acaaagctctggaaggctcgtc

SEQ ID NO: 9500909 - DNA, 22 bp, Homo sapiens
acaaatatttactgaatccact

SEQ ID NO: 9500910 - DNA, 22 bp, Homo sapiens
acaaatatttactgaatccact

SEQ ID NO: 9500911 - DNA, 22 bp, Homo sapiens
cagcccagagaaggggcccgtg

SEQ ID NO: 9500912 - DNA, 22 bp, Homo sapiens
cagcccagagaaggggcccgtg

SEQ ID NO: 9500913 - DNA, 22 bp, Homo sapiens
cagcccagagaaggggcccgtg

SEQ ID NO: 9500914 - DNA, 22 bp, Homo sapiens
cagcccagagaaggggcccgtg

SEQ ID NO: 9500915 - DNA, 22 bp, Homo sapiens
cagcccagagaaggggcccgtg

SEQ ID NO: 9500916 - DNA, 22 bp, Homo sapiens
cagcccagagaaggggcccgtg

SEQ ID NO: 9500917 - DNA, 21 bp, Homo sapiens
cagcccagagcagtggggcca

SEQ ID NO: 9500918 - DNA, 21 bp, Homo sapiens
cagcccagagcagtggggcca

SEQ ID NO: 9500919 - DNA, 19 bp, Homo sapiens
cagcccagggtgctaccaa

SEQ ID NO: 9500920 - DNA, 16 bp, Homo sapiens
cagcccaggggcgggc

SEQ ID NO: 9500921 - DNA, 16 bp, Homo sapiens
cagcccaggggcgggc

SEQ ID NO: 9500922 - DNA, 22 bp, Homo sapiens
cagcccacttcccagcacctac

SEQ ID NO: 9500923 - DNA, 22 bp, Homo sapiens
cagcccacttcccagcacctac

SEQ ID NO: 9500924 - DNA, 22 bp, Homo sapiens
cagcccacttcccagcacctac

SEQ ID NO: 9500925 - DNA, 22 bp, Homo sapiens
cagcccagaactcacgtctcca

SEQ ID NO: 9500926 - DNA, 22 bp, Homo sapiens
cagcccagacaccatcattcta

SEQ ID NO: 9500927 - DNA, 22 bp, Homo sapiens
cagcccagaactcacgtctcca

SEQ ID NO: 9500928 - DNA, 22 bp, Homo sapiens
cagcccagaactcacgtctcca

SEQ ID NO: 9500929 - DNA, 22 bp, Homo sapiens
cagcccagaactcacgtctcca

SEQ ID NO: 9500930 - DNA, 22 bp, Homo sapiens
cagccagctggcactgtgagta

SEQ ID NO: 9500931 - DNA, 22 bp, Homo sapiens
cagccagtggttgaagatgcag

SEQ ID NO: 9500932 - DNA, 22 bp, Homo sapiens
cagccagtggttgaagatgcag

SEQ ID NO: 9500933 - DNA, 22 bp, Homo sapiens
cagccagtgtgaccgaggagga

SEQ ID NO: 9500934 - DNA, 22 bp, Homo sapiens
cagccagtgtgaccgaggagga

SEQ ID NO: 9500935 - DNA, 22 bp, Homo sapiens
agcggaaggcctggctgatccg

SEQ ID NO: 9500936 - DNA, 22 bp, Homo sapiens
cagccagctggcactgtgagta

SEQ ID NO: 9500937 - DNA, 22 bp, Homo sapiens
agcgctgtgggcgtgcgaggag

SEQ ID NO: 9500938 - DNA, 22 bp, Homo sapiens
cagccatcagtaaagacagctt

SEQ ID NO: 9500939 - DNA, 22 bp, Homo sapiens
cagcccacctggcacgtgtgtt

SEQ ID NO: 9500940 - DNA, 22 bp, Homo sapiens
cagcccactgcctctgtggtag

SEQ ID NO: 9500941 - DNA, 22 bp, Homo sapiens
cagcccaggtctctcttccagt

SEQ ID NO: 9500942 - DNA, 19 bp, Homo sapiens
cagcccagggtgctaccaa

SEQ ID NO: 9500943 - DNA, 19 bp, Homo sapiens
cagcccagggtgctaccaa

SEQ ID NO: 9500944 - DNA, 19 bp, Homo sapiens
cagcccagggtgctaccaa

SEQ ID NO: 9500945 - DNA, 22 bp, Homo sapiens
cagcccaggtggcggaggttgc

SEQ ID NO: 9500946 - DNA, 22 bp, Homo sapiens
cagcccaggtctctcttccagt

SEQ ID NO: 9500947 - DNA, 22 bp, Homo sapiens
cagcccaggtctctcttccagt

SEQ ID NO: 9500948 - DNA, 22 bp, Homo sapiens
cagcccagtgcacgcccgtttc

SEQ ID NO: 9500949 - DNA, 22 bp, Homo sapiens
cagcccagtgcatttgtgtact

SEQ ID NO: 9500950 - DNA, 22 bp, Homo sapiens
cagcccagtaccaagcagttgg

SEQ ID NO: 9500951 - DNA, 22 bp, Homo sapiens
cagcccagtgcacgcccgtttc

SEQ ID NO: 9500952 - DNA, 22 bp, Homo sapiens
cagcccagtgcacgcccgtttc

SEQ ID NO: 9500953 - DNA, 22 bp, Homo sapiens
cagcctctaagcacagcctctc

SEQ ID NO: 9500954 - DNA, 22 bp, Homo sapiens
cagcctctctgtatctcaggat

SEQ ID NO: 9500955 - DNA, 22 bp, Homo sapiens
cagcctctctgtatctcaggat

SEQ ID NO: 9500956 - DNA, 22 bp, Homo sapiens
cagcctctaagcacagcctctc

SEQ ID NO: 9500957 - DNA, 22 bp, Homo sapiens
cagcctctaagcacagcctctc

SEQ ID NO: 9500958 - DNA, 22 bp, Homo sapiens
cagcctctaagcacagcctctc

SEQ ID NO: 9500959 - DNA, 22 bp, Homo sapiens
cagcctctaagcacagcctctc

SEQ ID NO: 9500960 - DNA, 22 bp, Homo sapiens
cagccccacacggtctagctct

SEQ ID NO: 9500961 - DNA, 22 bp, Homo sapiens
cagcccattcctgccatgccgc

SEQ ID NO: 9500962 - DNA, 22 bp, Homo sapiens
cagccctggtgaggttggctat

SEQ ID NO: 9500963 - DNA, 22 bp, Homo sapiens
cagccctggtgaggttggctat

SEQ ID NO: 9500964 - DNA, 22 bp, Homo sapiens
agcgagggaggtctgaggacag

SEQ ID NO: 9500965 - DNA, 22 bp, Homo sapiens
agcgacagaaaccaaggacaag

SEQ ID NO: 9500966 - DNA, 22 bp, Homo sapiens
cagcatggtgccagtgagtcca

SEQ ID NO: 9500967 - DNA, 22 bp, Homo sapiens
cagcatggtgccagtgagtcca

SEQ ID NO: 9500968 - DNA, 22 bp, Homo sapiens
cagcatggtggagctgctcttt

SEQ ID NO: 9500969 - DNA, 22 bp, Homo sapiens
cagcatggggcttggagtcagc

SEQ ID NO: 9500970 - DNA, 22 bp, Homo sapiens
cagcatggggcttggagtcagc

SEQ ID NO: 9500971 - DNA, 22 bp, Homo sapiens
cagcatggggcttggagtcagc

SEQ ID NO: 9500972 - DNA, 22 bp, Homo sapiens
cagcatgggttccgggggcctg

SEQ ID NO: 9500973 - DNA, 22 bp, Homo sapiens
cagcatggtgccagtgagtcca

SEQ ID NO: 9500974 - DNA, 21 bp, Homo sapiens
agcgcctgcaacaaggcagat

SEQ ID NO: 9500975 - DNA, 22 bp, Homo sapiens
agcgccctgtgaggttggcagg

SEQ ID NO: 9500976 - DNA, 22 bp, Homo sapiens
agcgccactgcactccagcctg

SEQ ID NO: 9500977 - DNA, 22 bp, Homo sapiens
agcgccactgcactccagcctg

SEQ ID NO: 9500978 - DNA, 22 bp, Homo sapiens
agcgctggctggcgctccttcc

SEQ ID NO: 9500979 - DNA, 22 bp, Homo sapiens
agcgccactgcactccagcctg

SEQ ID NO: 9500980 - DNA, 22 bp, Homo sapiens
agcgccactgcactccagcctg

SEQ ID NO: 9500981 - DNA, 22 bp, Homo sapiens
agcgccactgcactccagcctg

SEQ ID NO: 9500982 - DNA, 22 bp, Homo sapiens
agcgaggttttgcagatacagc

SEQ ID NO: 9500983 - DNA, 22 bp, Homo sapiens
cagcatggcttgagtgtttcct

SEQ ID NO: 9500984 - DNA, 22 bp, Homo sapiens
cagcatggagacaaagtgggca

SEQ ID NO: 9500985 - DNA, 22 bp, Homo sapiens
cagcatggacccatcgctgagt

SEQ ID NO: 9500986 - DNA, 22 bp, Homo sapiens
cagcagaaaatgtgggtgattt

SEQ ID NO: 9500987 - DNA, 22 bp, Homo sapiens
cagcagaaacccagcaaagcca

SEQ ID NO: 9500988 - DNA, 22 bp, Homo sapiens
cagcagaaaatacctgtaactc

SEQ ID NO: 9500989 - DNA, 22 bp, Homo sapiens
cagcagaaaatacctgtaactc

SEQ ID NO: 9500990 - DNA, 22 bp, Homo sapiens
cagcatggacaggggtggcgtt

SEQ ID NO: 9500991 - DNA, 22 bp, Homo sapiens
cagcatcaccaacttgagcaat

SEQ ID NO: 9500992 - DNA, 22 bp, Homo sapiens
cagcactgtgataactgagcca

SEQ ID NO: 9500993 - DNA, 22 bp, Homo sapiens
cagcactgttcccagaccactg

SEQ ID NO: 9500994 - DNA, 22 bp, Homo sapiens
cagcactgggaccactagaaca

SEQ ID NO: 9500995 - DNA, 22 bp, Homo sapiens
cagcactgcttcgcagccaggg

SEQ ID NO: 9500996 - DNA, 22 bp, Homo sapiens
cagcactgtgataactgagcca

SEQ ID NO: 9500997 - DNA, 22 bp, Homo sapiens
cagcactggggccactggagtt

SEQ ID NO: 9500998 - DNA, 22 bp, Homo sapiens
cagcactggggccactggagtt

SEQ ID NO: 9500999 - DNA, 22 bp, Homo sapiens
agctctggctaagctgataaat

SEQ ID NO: 9501000 - DNA, 22 bp, Homo sapiens
agctctggctaagctgataaat

SEQ ID NO: 9501001 - DNA, 23 bp, Homo sapiens
agctctggcgttggggaggtagt

SEQ ID NO: 9501002 - DNA, 23 bp, Homo sapiens
agctctggcgttggggaggtagt

SEQ ID NO: 9501003 - DNA, 18 bp, Homo sapiens
agctctggcatacttgaa

SEQ ID NO: 9501004 - DNA, 22 bp, Homo sapiens
agctctggcactggcgcgggat

SEQ ID NO: 9501005 - DNA, 22 bp, Homo sapiens
agctctgggagtagttccacct

SEQ ID NO: 9501006 - DNA, 22 bp, Homo sapiens
agctctgggagtagttccacct

SEQ ID NO: 9501007 - DNA, 22 bp, Homo sapiens
agctctgggagtagttccacct

SEQ ID NO: 9501008 - DNA, 20 bp, Homo sapiens
agctgaagatctggatgggg

SEQ ID NO: 9501009 - DNA, 21 bp, Homo sapiens
agctgagcccagaagactggt

SEQ ID NO: 9501010 - DNA, 22 bp, Homo sapiens
agctgaggaataataacaaggt

SEQ ID NO: 9501011 - DNA, 22 bp, Homo sapiens
agctgaggacgtgaagggcggc

SEQ ID NO: 9501012 - DNA, 22 bp, Homo sapiens
agctgaggaggaatgatgggta

SEQ ID NO: 9501013 - DNA, 22 bp, Homo sapiens
agctgaggaggaatgatgggta

SEQ ID NO: 9501014 - DNA, 22 bp, Homo sapiens
agctgaggaggaatgatgggta

SEQ ID NO: 9501015 - DNA, 22 bp, Homo sapiens
agctgaggaggaatgatgggta

SEQ ID NO: 9501016 - DNA, 22 bp, Homo sapiens
cagctgggtgatcttgggcagg

SEQ ID NO: 9501017 - DNA, 22 bp, Homo sapiens
cagctgggtggctcttctgctc

SEQ ID NO: 9501018 - DNA, 22 bp, Homo sapiens
cagctggcatacctgggcccgg

SEQ ID NO: 9501019 - DNA, 22 bp, Homo sapiens
cagctggcagccctggccctgc

SEQ ID NO: 9501020 - DNA, 22 bp, Homo sapiens
cagctggcagccctggccctgc

SEQ ID NO: 9501021 - DNA, 22 bp, Homo sapiens
cagctggcagccctggccctgc

SEQ ID NO: 9501022 - DNA, 22 bp, Homo sapiens
cagctggcagaacctgcatcca

SEQ ID NO: 9501023 - DNA, 22 bp, Homo sapiens
cagctggcagaacctgcatcca

SEQ ID NO: 9501024 - DNA, 22 bp, Homo sapiens
cagctggcaagtggagcagggt

SEQ ID NO: 9501025 - DNA, 22 bp, Homo sapiens
cagctggcaagtggagcagggt

SEQ ID NO: 9501026 - DNA, 22 bp, Homo sapiens
cagctggatgggagaccatgtt

SEQ ID NO: 9501027 - DNA, 22 bp, Homo sapiens
cagctggcaagtggagcagggt

SEQ ID NO: 9501028 - DNA, 22 bp, Homo sapiens
cagctggcaagtggagcagggt

SEQ ID NO: 9501029 - DNA, 22 bp, Homo sapiens
cagctggatctgcctcgagcca

SEQ ID NO: 9501030 - DNA, 22 bp, Homo sapiens
cagctggatccctgcagaactt

SEQ ID NO: 9501031 - DNA, 22 bp, Homo sapiens
cagctggaggagcagcttccag

SEQ ID NO: 9501032 - DNA, 22 bp, Homo sapiens
cagctggaggagcagcttccag

SEQ ID NO: 9501033 - DNA, 22 bp, Homo sapiens
cagctggacttttgatagaagt

SEQ ID NO: 9501034 - DNA, 22 bp, Homo sapiens
cagctggactgggatgtagcga

SEQ ID NO: 9501035 - DNA, 22 bp, Homo sapiens
cagctggactgggatgtagcga

SEQ ID NO: 9501036 - DNA, 20 bp, Homo sapiens
agctgaggcacctgaggtta

SEQ ID NO: 9501037 - DNA, 21 bp, Homo sapiens
agctctggagcagcaatcaag

SEQ ID NO: 9501038 - DNA, 22 bp, Homo sapiens
agctctggagccggaggatttc

SEQ ID NO: 9501039 - DNA, 21 bp, Homo sapiens
agctctggagcagcaatcaag

SEQ ID NO: 9501040 - DNA, 21 bp, Homo sapiens
agctctggagcagcaatcaag

SEQ ID NO: 9501041 - DNA, 22 bp, Homo sapiens
agctctggagccggaggatttc

SEQ ID NO: 9501042 - DNA, 22 bp, Homo sapiens
agctctggacctgacatctggt

SEQ ID NO: 9501043 - DNA, 22 bp, Homo sapiens
agctctggacctgacatctggt

SEQ ID NO: 9501044 - DNA, 22 bp, Homo sapiens
agctctggaataatgatgtgat

SEQ ID NO: 9501045 - DNA, 22 bp, Homo sapiens
agctctggaataatgatgtgat

SEQ ID NO: 9501046 - DNA, 22 bp, Homo sapiens
agctctggaagccctggtagtt

SEQ ID NO: 9501047 - DNA, 18 bp, Homo sapiens
cagctgccagctcatgga

SEQ ID NO: 9501048 - DNA, 18 bp, Homo sapiens
cagctgccagctcatgga

SEQ ID NO: 9501049 - DNA, 22 bp, Homo sapiens
cagctgagagtagaaatggagg

SEQ ID NO: 9501050 - DNA, 22 bp, Homo sapiens
cagctgcccaagccccagatgt

SEQ ID NO: 9501051 - DNA, 22 bp, Homo sapiens
cagctgccatgacatgtcctgc

SEQ ID NO: 9501052 - DNA, 22 bp, Homo sapiens
cagctgccagcttctctccatc

SEQ ID NO: 9501053 - DNA, 22 bp, Homo sapiens
cagcgagagacaaagagctgtg

SEQ ID NO: 9501054 - DNA, 22 bp, Homo sapiens
cagcctttgtgaacatcaggtg

SEQ ID NO: 9501055 - DNA, 22 bp, Homo sapiens
cagcggaggacagatgggagct

SEQ ID NO: 9501056 - DNA, 22 bp, Homo sapiens
cagcggaggacagatgggagct

SEQ ID NO: 9501057 - DNA, 22 bp, Homo sapiens
cagcggtggcaaggtgactgtg

SEQ ID NO: 9501058 - DNA, 22 bp, Homo sapiens
cagcgtctcgttgtgggcctcg

SEQ ID NO: 9501059 - DNA, 22 bp, Homo sapiens
cagctgagagtagaaatggagg

SEQ ID NO: 9501060 - DNA, 22 bp, Homo sapiens
cagcctctgtggctgccacacc

SEQ ID NO: 9501061 - DNA, 22 bp, Homo sapiens
cagcctcttgcactttgaaggc

SEQ ID NO: 9501062 - DNA, 22 bp, Homo sapiens
cagccttcgacagttggagtag

SEQ ID NO: 9501063 - DNA, 22 bp, Homo sapiens
cagccttgatggatgaggaagt

SEQ ID NO: 9501064 - DNA, 22 bp, Homo sapiens
cagcctctgacaccacagtcgt

SEQ ID NO: 9501065 - DNA, 22 bp, Homo sapiens
cagcctctgacaccacagtcgt

SEQ ID NO: 9501066 - DNA, 22 bp, Homo sapiens
cagcctctgacaccacagtcgt

SEQ ID NO: 9501067 - DNA, 18 bp, Homo sapiens
cagcctctgattggttgc

SEQ ID NO: 9501068 - DNA, 22 bp, Homo sapiens
cagcctctgtggctgccacacc

SEQ ID NO: 9501069 - DNA, 22 bp, Homo sapiens
cagcctctgagccttggcagat

SEQ ID NO: 9501070 - DNA, 22 bp, Homo sapiens
cagcctctgagccttggcagat

SEQ ID NO: 9501071 - DNA, 22 bp, Homo sapiens
agccaagagacagatgcccacc

SEQ ID NO: 9501072 - DNA, 22 bp, Homo sapiens
agccaagagacagatgcccacc

SEQ ID NO: 9501073 - DNA, 22 bp, Homo sapiens
agccaagagatgaggctgcagg

SEQ ID NO: 9501074 - DNA, 22 bp, Homo sapiens
agccaagagctcacctcgtgtg

SEQ ID NO: 9501075 - DNA, 22 bp, Homo sapiens
agccaagagatgaggctgcagg

SEQ ID NO: 9501076 - DNA, 20 bp, Homo sapiens
agccaagaacaggcagaacc

SEQ ID NO: 9501077 - DNA, 20 bp, Homo sapiens
agccaagaacaggcagaacc

SEQ ID NO: 9501078 - DNA, 22 bp, Homo sapiens
agccaagaatcatgagctaata

SEQ ID NO: 9501079 - DNA, 22 bp, Homo sapiens
agccaagcactcaactcctgga

SEQ ID NO: 9501080 - DNA, 22 bp, Homo sapiens
agccaagaggagcctaaagcga

SEQ ID NO: 9501081 - DNA, 22 bp, Homo sapiens
agccaagagctcacctcgtgtg

SEQ ID NO: 9501082 - DNA, 22 bp, Homo sapiens
agccaggccttttctcaaggtt

SEQ ID NO: 9501083 - DNA, 22 bp, Homo sapiens
agccaggccttttctcaaggtt

SEQ ID NO: 9501084 - DNA, 22 bp, Homo sapiens
agccagggacgctgcaggctac

SEQ ID NO: 9501085 - DNA, 22 bp, Homo sapiens
agccagggacgctgcaggctac

SEQ ID NO: 9501086 - DNA, 22 bp, Homo sapiens
agccagggacgctgcaggctac

SEQ ID NO: 9501087 - DNA, 22 bp, Homo sapiens
agccagggaaggataacaagaa

SEQ ID NO: 9501088 - DNA, 16 bp, Homo sapiens
agccaggctgcctcgg

SEQ ID NO: 9501089 - DNA, 16 bp, Homo sapiens
agccaggctgcctcgg

SEQ ID NO: 9501090 - DNA, 16 bp, Homo sapiens
agccaggctgcctcgg

SEQ ID NO: 9501091 - DNA, 22 bp, Homo sapiens
agccagggaagaggcctacctc

SEQ ID NO: 9501092 - DNA, 22 bp, Homo sapiens
agccaggctgcagttggctggc

SEQ ID NO: 9501093 - DNA, 22 bp, Homo sapiens
agccaggctgcagttggctggc

SEQ ID NO: 9501094 - DNA, 22 bp, Homo sapiens
agccaggctcaaggcctgctcc

SEQ ID NO: 9501095 - DNA, 22 bp, Homo sapiens
agccaggggagtcagctgctgg

SEQ ID NO: 9501096 - DNA, 22 bp, Homo sapiens
agccaggggagtcagctgctgg

SEQ ID NO: 9501097 - DNA, 22 bp, Homo sapiens
agccagggctgcgagcagacag

SEQ ID NO: 9501098 - DNA, 22 bp, Homo sapiens
agccagggctgcgagcagacag

SEQ ID NO: 9501099 - DNA, 22 bp, Homo sapiens
agccagggctgcgagcagacag

SEQ ID NO: 9501100 - DNA, 22 bp, Homo sapiens
agccagggctgcaggttccttg

SEQ ID NO: 9501101 - DNA, 22 bp, Homo sapiens
agccagggctgcgagcagacag

SEQ ID NO: 9501102 - DNA, 22 bp, Homo sapiens
cagagcaggggtttcccaggtt

SEQ ID NO: 9501103 - DNA, 22 bp, Homo sapiens
agccaggggagtcagctgctgg

SEQ ID NO: 9501104 - DNA, 22 bp, Homo sapiens
cagagcaggggtttcccaggtt

SEQ ID NO: 9501105 - DNA, 22 bp, Homo sapiens
agccagggatgcagcacagtga

SEQ ID NO: 9501106 - DNA, 22 bp, Homo sapiens
agccagggatgcagcacagtga

SEQ ID NO: 9501107 - DNA, 22 bp, Homo sapiens
agccagggacgctgcaggctac

SEQ ID NO: 9501108 - DNA, 22 bp, Homo sapiens
agccagggacgctgcaggctac

SEQ ID NO: 9501109 - DNA, 22 bp, Homo sapiens
agccagggacgctgcaggctac

SEQ ID NO: 9501110 - DNA, 22 bp, Homo sapiens
agccagggacgctgcaggctac

SEQ ID NO: 9501111 - DNA, 22 bp, Homo sapiens
agccagggacgctgcaggctac

SEQ ID NO: 9501112 - DNA, 22 bp, Homo sapiens
agccagggatggcagtgcccag

SEQ ID NO: 9501113 - DNA, 22 bp, Homo sapiens
agccagggatggcagtgcccag

SEQ ID NO: 9501114 - DNA, 23 bp, Homo sapiens
agccagggcactggtggagattg

SEQ ID NO: 9501115 - DNA, 22 bp, Homo sapiens
agccagggctctccttcgcgtg

SEQ ID NO: 9501116 - DNA, 22 bp, Homo sapiens
cagagccagggttgcacccctg

SEQ ID NO: 9501117 - DNA, 22 bp, Homo sapiens
cagagccagggctaggaactgg

SEQ ID NO: 9501118 - DNA, 22 bp, Homo sapiens
cagagccaggcctgccctcttt

SEQ ID NO: 9501119 - DNA, 22 bp, Homo sapiens
cagagccaggcctgccctcttt

SEQ ID NO: 9501120 - DNA, 22 bp, Homo sapiens
cagagcagtctggagatccagc

SEQ ID NO: 9501121 - DNA, 22 bp, Homo sapiens
cagagcagtctggagatccagc

SEQ ID NO: 9501122 - DNA, 22 bp, Homo sapiens
cagagcagtctggagatccagc

SEQ ID NO: 9501123 - DNA, 22 bp, Homo sapiens
cagagcagtctggagatccagc

SEQ ID NO: 9501124 - DNA, 22 bp, Homo sapiens
cagagccaggtcttgaactcag

SEQ ID NO: 9501125 - DNA, 22 bp, Homo sapiens
cagagccaggtctaggagtctc

SEQ ID NO: 9501126 - DNA, 22 bp, Homo sapiens
cagagccagtcagtcagaaact

SEQ ID NO: 9501127 - DNA, 22 bp, Homo sapiens
cagagccaggtctaggagtctc

SEQ ID NO: 9501128 - DNA, 22 bp, Homo sapiens
cagagccagggttgcacccctg

SEQ ID NO: 9501129 - DNA, 22 bp, Homo sapiens
cagagcaggtatctttggtgaa

SEQ ID NO: 9501130 - DNA, 22 bp, Homo sapiens
cagagcagtaaatctggggcac

SEQ ID NO: 9501131 - DNA, 22 bp, Homo sapiens
cagagcagtagaaaacagcctt

SEQ ID NO: 9501132 - DNA, 22 bp, Homo sapiens
cagagcagtagaaaacagcctt

SEQ ID NO: 9501133 - DNA, 22 bp, Homo sapiens
cagagcagtagaaaacagcctt

SEQ ID NO: 9501134 - DNA, 22 bp, Homo sapiens
cagagcagtccttgtcaatcag

SEQ ID NO: 9501135 - DNA, 22 bp, Homo sapiens
cagagcagtccttgtcaatcag

SEQ ID NO: 9501136 - DNA, 22 bp, Homo sapiens
cagagcagtccttgtcaatcag

SEQ ID NO: 9501137 - DNA, 22 bp, Homo sapiens
cagagcagtccttgtcaatcag

SEQ ID NO: 9501138 - DNA, 18 bp, Homo sapiens
cagagcagtatgaatgtt

SEQ ID NO: 9501139 - DNA, 18 bp, Homo sapiens
cagagcagtatgaatgtt

SEQ ID NO: 9501140 - DNA, 18 bp, Homo sapiens
cagagcagtatgaatgtt

SEQ ID NO: 9501141 - DNA, 22 bp, Homo sapiens
cagagcagtagaaaacagcctt

SEQ ID NO: 9501142 - DNA, 18 bp, Homo sapiens
cagagcagtatgaatgtt

SEQ ID NO: 9501143 - DNA, 22 bp, Homo sapiens
cagagccatcatgatatggagt

SEQ ID NO: 9501144 - DNA, 22 bp, Homo sapiens
cagagccatcatgatatggagt

SEQ ID NO: 9501145 - DNA, 22 bp, Homo sapiens
cagagccatccaggtgcctgtt

SEQ ID NO: 9501146 - DNA, 22 bp, Homo sapiens
cagagccaggtcttgaactcag

SEQ ID NO: 9501147 - DNA, 22 bp, Homo sapiens
cagagctgtcatttgccagtga

SEQ ID NO: 9501148 - DNA, 23 bp, Homo sapiens
cagagctggctcagagctgcctg

SEQ ID NO: 9501149 - DNA, 22 bp, Homo sapiens
cagagccatcccagcctgtggt

SEQ ID NO: 9501150 - DNA, 22 bp, Homo sapiens
cagagctgtcatttgccagtga

SEQ ID NO: 9501151 - DNA, 21 bp, Homo sapiens
cagagctgtccaaaccctgac

SEQ ID NO: 9501152 - DNA, 22 bp, Homo sapiens
cagagctgtccaaaccctgaca

SEQ ID NO: 9501153 - DNA, 22 bp, Homo sapiens
cagagctgtccaaaccctgaca

SEQ ID NO: 9501154 - DNA, 21 bp, Homo sapiens
cagagctgtccaaaccctgac

SEQ ID NO: 9501155 - DNA, 22 bp, Homo sapiens
cagagctgtgataaatagatat

SEQ ID NO: 9501156 - DNA, 20 bp, Homo sapiens
cagagctgttatggatgatg

SEQ ID NO: 9501157 - DNA, 20 bp, Homo sapiens
cagagctgttatggatgatg

SEQ ID NO: 9501158 - DNA, 22 bp, Homo sapiens
cagagtggcactctgctggatg

SEQ ID NO: 9501159 - DNA, 22 bp, Homo sapiens
cagagtggagtttttcagcggg

SEQ ID NO: 9501160 - DNA, 22 bp, Homo sapiens
cagagtggagatgtgtgtggaa

SEQ ID NO: 9501161 - DNA, 22 bp, Homo sapiens
cagagtggagatgtgtgtggaa

SEQ ID NO: 9501162 - DNA, 22 bp, Homo sapiens
cagagtggcagtcccaggccca

SEQ ID NO: 9501163 - DNA, 22 bp, Homo sapiens
cagagtggcatgaatgaagcct

SEQ ID NO: 9501164 - DNA, 22 bp, Homo sapiens
cagagtggcatgaatgaagcct

SEQ ID NO: 9501165 - DNA, 22 bp, Homo sapiens
cagagtggcactctgctggatg

SEQ ID NO: 9501166 - DNA, 22 bp, Homo sapiens
cagagtggcgaccccctcagct

SEQ ID NO: 9501167 - DNA, 18 bp, Homo sapiens
cagagtgggccaagagac

SEQ ID NO: 9501168 - DNA, 22 bp, Homo sapiens
agccctcctggggccacgctgg

SEQ ID NO: 9501169 - DNA, 18 bp, Homo sapiens
cagagtgggccaagagac

SEQ ID NO: 9501170 - DNA, 22 bp, Homo sapiens
agccctcctttgttcatgctgc

SEQ ID NO: 9501171 - DNA, 22 bp, Homo sapiens
agccctcctggggccacgctgg

SEQ ID NO: 9501172 - DNA, 22 bp, Homo sapiens
agccctcctttgttcatgctgc

SEQ ID NO: 9501173 - DNA, 22 bp, Homo sapiens
agccctcgtttctgcatcctgt

SEQ ID NO: 9501174 - DNA, 22 bp, Homo sapiens
agccctcgtttctgcatcctgt

SEQ ID NO: 9501175 - DNA, 22 bp, Homo sapiens
agccctctgagctagtcaccat

SEQ ID NO: 9501176 - DNA, 22 bp, Homo sapiens
agccctctgctgttctagtctc

SEQ ID NO: 9501177 - DNA, 22 bp, Homo sapiens
agccctctaagcaagagaggaa

SEQ ID NO: 9501178 - DNA, 22 bp, Homo sapiens
agccctgagccagcctggtcag

SEQ ID NO: 9501179 - DNA, 22 bp, Homo sapiens
agccctgggctgtagataagca

SEQ ID NO: 9501180 - DNA, 22 bp, Homo sapiens
agccctgggctgtagataagca

SEQ ID NO: 9501181 - DNA, 22 bp, Homo sapiens
agcccttagtacatttctcaag

SEQ ID NO: 9501182 - DNA, 22 bp, Homo sapiens
agccctgggctgtagataagca

SEQ ID NO: 9501183 - DNA, 22 bp, Homo sapiens
cagaggtgctggagtgagtcct

SEQ ID NO: 9501184 - DNA, 22 bp, Homo sapiens
cagaggagttcagtacacagcc

SEQ ID NO: 9501185 - DNA, 22 bp, Homo sapiens
cagaggagttcagtacacagcc

SEQ ID NO: 9501186 - DNA, 22 bp, Homo sapiens
cagagtgaaataggggatcaag

SEQ ID NO: 9501187 - DNA, 21 bp, Homo sapiens
cagaggtggcctgacctctga

SEQ ID NO: 9501188 - DNA, 21 bp, Homo sapiens
cagaggtggcctgacctctga

SEQ ID NO: 9501189 - DNA, 22 bp, Homo sapiens
cagaggagtgggccgttatggt

SEQ ID NO: 9501190 - DNA, 22 bp, Homo sapiens
cagagtgaaataggggatcaag

SEQ ID NO: 9501191 - DNA, 22 bp, Homo sapiens
cagagtgaacagtgggatgtgc

SEQ ID NO: 9501192 - DNA, 22 bp, Homo sapiens
cagagtgagggcctgcacctgc

SEQ ID NO: 9501193 - DNA, 22 bp, Homo sapiens
cagagtgataaatatagaaatt

SEQ ID NO: 9501194 - DNA, 22 bp, Homo sapiens
cagagtggagaaacgcttcgtc

SEQ ID NO: 9501195 - DNA, 22 bp, Homo sapiens
cagagtgattatggaggattgc

SEQ ID NO: 9501196 - DNA, 22 bp, Homo sapiens
cagagtgatttgatgagttgca

SEQ ID NO: 9501197 - DNA, 22 bp, Homo sapiens
cagagtgcatggtgctgttcat

SEQ ID NO: 9501198 - DNA, 22 bp, Homo sapiens
cagagtgatggcacctgctggg

SEQ ID NO: 9501199 - DNA, 22 bp, Homo sapiens
cagaggaggcggtatacactgc

SEQ ID NO: 9501200 - DNA, 22 bp, Homo sapiens
cagaggaggccaccgcataggc

SEQ ID NO: 9501201 - DNA, 22 bp, Homo sapiens
cagaggaggccaccgcataggc

SEQ ID NO: 9501202 - DNA, 22 bp, Homo sapiens
cagaggaggccaccgcataggc

SEQ ID NO: 9501203 - DNA, 17 bp, Homo sapiens
cagaggagctttggggg

SEQ ID NO: 9501204 - DNA, 17 bp, Homo sapiens
cagaggagctttggggg

SEQ ID NO: 9501205 - DNA, 18 bp, Homo sapiens
cagaggagagacattcag

SEQ ID NO: 9501206 - DNA, 17 bp, Homo sapiens
cagaggagctttggggg

SEQ ID NO: 9501207 - DNA, 18 bp, Homo sapiens
cagaggagagacattcag

SEQ ID NO: 9501208 - DNA, 18 bp, Homo sapiens
cagaggagagacattcag

SEQ ID NO: 9501209 - DNA, 22 bp, Homo sapiens
agcccttcaagagctctgtcct

SEQ ID NO: 9501210 - DNA, 22 bp, Homo sapiens
agcccttggtattttccgatcc

SEQ ID NO: 9501211 - DNA, 22 bp, Homo sapiens
agcctagggggtcctgggccac

SEQ ID NO: 9501212 - DNA, 22 bp, Homo sapiens
agcctagactaagacttgctct

SEQ ID NO: 9501213 - DNA, 22 bp, Homo sapiens
agcctagctgtgtgaggccatc

SEQ ID NO: 9501214 - DNA, 22 bp, Homo sapiens
agccggccatgtggtcttgtgc

SEQ ID NO: 9501215 - DNA, 22 bp, Homo sapiens
agcctagaagaagtggctactt

SEQ ID NO: 9501216 - DNA, 18 bp, Homo sapiens
cagatccaggcagctatt

SEQ ID NO: 9501217 - DNA, 22 bp, Homo sapiens
cagatccagccgctcctgggaa

SEQ ID NO: 9501218 - DNA, 22 bp, Homo sapiens
cagatcataacagatacataga

SEQ ID NO: 9501219 - DNA, 23 bp, Homo sapiens
cagatcatatatccagctgtaag

SEQ ID NO: 9501220 - DNA, 22 bp, Homo sapiens
cagatccacccttgtagtgaca

SEQ ID NO: 9501221 - DNA, 22 bp, Homo sapiens
agcctattccaggatgagctca

SEQ ID NO: 9501222 - DNA, 22 bp, Homo sapiens
agcctattccaggatgagctca

SEQ ID NO: 9501223 - DNA, 22 bp, Homo sapiens
cagatattaggagctcaataat

SEQ ID NO: 9501224 - DNA, 22 bp, Homo sapiens
cagatcaagctgtatggtcaga

SEQ ID NO: 9501225 - DNA, 22 bp, Homo sapiens
cagatatgtggattctattagc

SEQ ID NO: 9501226 - DNA, 22 bp, Homo sapiens
agcctaggtctgggtctagcag

SEQ ID NO: 9501227 - DNA, 22 bp, Homo sapiens
agcctaggtctgggtctagcag

SEQ ID NO: 9501228 - DNA, 22 bp, Homo sapiens
agcctagggttctgatgtcact

SEQ ID NO: 9501229 - DNA, 22 bp, Homo sapiens
agcctgagctgcctgccgcctc

SEQ ID NO: 9501230 - DNA, 22 bp, Homo sapiens
agcctgagtgcttaggactgtt

SEQ ID NO: 9501231 - DNA, 22 bp, Homo sapiens
agcctgcttcctcagggaacaa

SEQ ID NO: 9501232 - DNA, 22 bp, Homo sapiens
agcctgagtgcttaggactgtt

SEQ ID NO: 9501233 - DNA, 22 bp, Homo sapiens
agcctgcttgagagtcctggct

SEQ ID NO: 9501234 - DNA, 22 bp, Homo sapiens
cagatgaactgtgactgaaaat

SEQ ID NO: 9501235 - DNA, 22 bp, Homo sapiens
cagatctgtttgccagatcagc

SEQ ID NO: 9501236 - DNA, 21 bp, Homo sapiens
cagatctgtaggtactaccat

SEQ ID NO: 9501237 - DNA, 22 bp, Homo sapiens
cagatctgctcctctgtccatg

SEQ ID NO: 9501238 - DNA, 22 bp, Homo sapiens
cagatctgtagtaaaagatctc

SEQ ID NO: 9501239 - DNA, 22 bp, Homo sapiens
agcctggacagctacggagaac

SEQ ID NO: 9501240 - DNA, 22 bp, Homo sapiens
agcctggacagctacggagaac

SEQ ID NO: 9501241 - DNA, 22 bp, Homo sapiens
agcctggacagctacggagaac

SEQ ID NO: 9501242 - DNA, 22 bp, Homo sapiens
agcctggaggaggagttgagca

SEQ ID NO: 9501243 - DNA, 22 bp, Homo sapiens
agcctggaggccaggagacagt

SEQ ID NO: 9501244 - DNA, 22 bp, Homo sapiens
agcctggaggccaggagacagt

SEQ ID NO: 9501245 - DNA, 22 bp, Homo sapiens
cagcactgctgctgtacacaca

SEQ ID NO: 9501246 - DNA, 22 bp, Homo sapiens
caagggctgctatcagctactg

SEQ ID NO: 9501247 - DNA, 22 bp, Homo sapiens
caagtcacttatgtgcagatat

SEQ ID NO: 9501248 - DNA, 22 bp, Homo sapiens
caagtcattactgaaatgtcac

SEQ ID NO: 9501249 - DNA, 22 bp, Homo sapiens
caagtcatcatagaagttcccc

SEQ ID NO: 9501250 - DNA, 22 bp, Homo sapiens
caagtccatcagataagcaaga

SEQ ID NO: 9501251 - DNA, 22 bp, Homo sapiens
caagtccaggtgggcaaataaa

SEQ ID NO: 9501252 - DNA, 22 bp, Homo sapiens
caagtcattgtttagtcatgtt

SEQ ID NO: 9501253 - DNA, 22 bp, Homo sapiens
caagtccaacagtttttcagac

SEQ ID NO: 9501254 - DNA, 22 bp, Homo sapiens
caagtccaagatcaagaagcca

SEQ ID NO: 9501255 - DNA, 22 bp, Homo sapiens
caagggcagatagctggtccaa

SEQ ID NO: 9501256 - DNA, 22 bp, Homo sapiens
caagggaaggctaagggcaaca

SEQ ID NO: 9501257 - DNA, 22 bp, Homo sapiens
caagggaaggctaagggcaaca

SEQ ID NO: 9501258 - DNA, 22 bp, Homo sapiens
caagggaattgtgtgtgagagg

SEQ ID NO: 9501259 - DNA, 22 bp, Homo sapiens
caagggaattgtgtgtgagagg

SEQ ID NO: 9501260 - DNA, 22 bp, Homo sapiens
caatgtttttccttccttaata

SEQ ID NO: 9501261 - DNA, 22 bp, Homo sapiens
caatgattctgcaactgtgtgc

SEQ ID NO: 9501262 - DNA, 22 bp, Homo sapiens
caatgatgtttagataaaatcc

SEQ ID NO: 9501263 - DNA, 22 bp, Homo sapiens
caagtgaagatatacagaaaat

SEQ ID NO: 9501264 - DNA, 22 bp, Homo sapiens
caagtctgtctgctcctgtgtg

SEQ ID NO: 9501265 - DNA, 22 bp, Homo sapiens
caagtgaagatatacagaaaat

SEQ ID NO: 9501266 - DNA, 22 bp, Homo sapiens
caagtctagcttggtcacttgg

SEQ ID NO: 9501267 - DNA, 22 bp, Homo sapiens
caagtccttttcttggctcagg

SEQ ID NO: 9501268 - DNA, 22 bp, Homo sapiens
caagtccttttcttggctcagg

SEQ ID NO: 9501269 - DNA, 22 bp, Homo sapiens
caagtccttttcttggctcagg

SEQ ID NO: 9501270 - DNA, 22 bp, Homo sapiens
caagtccttttcttggctcagg

SEQ ID NO: 9501271 - DNA, 22 bp, Homo sapiens
caagtcctaaatgtatttgttg

SEQ ID NO: 9501272 - DNA, 22 bp, Homo sapiens
caagtctgacctctgggtgaag

SEQ ID NO: 9501273 - DNA, 22 bp, Homo sapiens
caagtccttagatggttctttg

SEQ ID NO: 9501274 - DNA, 22 bp, Homo sapiens
caagtcctcaaagggctctgct

SEQ ID NO: 9501275 - DNA, 22 bp, Homo sapiens
caagtcctcgcttctagctgtg

SEQ ID NO: 9501276 - DNA, 22 bp, Homo sapiens
caagtcctccatgtgactaggt

SEQ ID NO: 9501277 - DNA, 22 bp, Homo sapiens
caattattcagtgacttaagag

SEQ ID NO: 9501278 - DNA, 22 bp, Homo sapiens
caattattcagtgacttaagag

SEQ ID NO: 9501279 - DNA, 22 bp, Homo sapiens
caattatatttagaatgataca

SEQ ID NO: 9501280 - DNA, 22 bp, Homo sapiens
caattatatttagaatgataca

SEQ ID NO: 9501281 - DNA, 22 bp, Homo sapiens
caattatatttagaatgataca

SEQ ID NO: 9501282 - DNA, 22 bp, Homo sapiens
caattatatttagaatgataca

SEQ ID NO: 9501283 - DNA, 22 bp, Homo sapiens
caattatatttagaatgataca

SEQ ID NO: 9501284 - DNA, 22 bp, Homo sapiens
caattactggtccacagaaatt

SEQ ID NO: 9501285 - DNA, 22 bp, Homo sapiens
caattacatttattgagcattc

SEQ ID NO: 9501286 - DNA, 22 bp, Homo sapiens
caattacatttattgagcattc

SEQ ID NO: 9501287 - DNA, 22 bp, Homo sapiens
caattacatttattgagcattc

SEQ ID NO: 9501288 - DNA, 22 bp, Homo sapiens
caatgtttttccttccttaata

SEQ ID NO: 9501289 - DNA, 22 bp, Homo sapiens
caattaaagaagacctgcctca

SEQ ID NO: 9501290 - DNA, 22 bp, Homo sapiens
caattaaagaagacctgcctca

SEQ ID NO: 9501291 - DNA, 21 bp, Homo sapiens
caattacagatggctcagggg

SEQ ID NO: 9501292 - DNA, 22 bp, Homo sapiens
caaggaagttttaggagaggaa

SEQ ID NO: 9501293 - DNA, 21 bp, Homo sapiens
agcagacagatgcacgcacac

SEQ ID NO: 9501294 - DNA, 22 bp, Homo sapiens
caaggaagacccacgcagatat

SEQ ID NO: 9501295 - DNA, 22 bp, Homo sapiens
caaggaaggagagatgatgggt

SEQ ID NO: 9501296 - DNA, 22 bp, Homo sapiens
agcagacaggctgccacagtgc

SEQ ID NO: 9501297 - DNA, 21 bp, Homo sapiens
agcagacagcccaagaaaatc

SEQ ID NO: 9501298 - DNA, 21 bp, Homo sapiens
agcagacagcccaagaaaatc

SEQ ID NO: 9501299 - DNA, 22 bp, Homo sapiens
agcagacaggtaggaggataaa

SEQ ID NO: 9501300 - DNA, 22 bp, Homo sapiens
agcagacatatctcatgtcaca

SEQ ID NO: 9501301 - DNA, 22 bp, Homo sapiens
agcagagaagacacaggcttca

SEQ ID NO: 9501302 - DNA, 22 bp, Homo sapiens
agcagagaagacacaggcttca

SEQ ID NO: 9501303 - DNA, 22 bp, Homo sapiens
agcagagacatgaaatatgctt

SEQ ID NO: 9501304 - DNA, 22 bp, Homo sapiens
agcagagacatgaaatatgctt

SEQ ID NO: 9501305 - DNA, 22 bp, Homo sapiens
agcagacatggcttggatgtgg

SEQ ID NO: 9501306 - DNA, 22 bp, Homo sapiens
agcagagaagacacaggcttca

SEQ ID NO: 9501307 - DNA, 22 bp, Homo sapiens
caagggaaggctaagggcaaca

SEQ ID NO: 9501308 - DNA, 22 bp, Homo sapiens
caagggaaggctaagggcaaca

SEQ ID NO: 9501309 - DNA, 22 bp, Homo sapiens
caagggaagaggacagggacct

SEQ ID NO: 9501310 - DNA, 22 bp, Homo sapiens
caaggcatttcgcttagagaga

SEQ ID NO: 9501311 - DNA, 22 bp, Homo sapiens
agcagagaccatatagcccaga

SEQ ID NO: 9501312 - DNA, 22 bp, Homo sapiens
agcagagaccatatagcccaga

SEQ ID NO: 9501313 - DNA, 22 bp, Homo sapiens
caaggcattaccatggctagag

SEQ ID NO: 9501314 - DNA, 22 bp, Homo sapiens
caaggcattgtgtaagcacttg

SEQ ID NO: 9501315 - DNA, 21 bp, Homo sapiens
agcaatttcatttggtttaac

SEQ ID NO: 9501316 - DNA, 22 bp, Homo sapiens
agcaattattgtataagaacaa

SEQ ID NO: 9501317 - DNA, 22 bp, Homo sapiens
agcaattatggagttgttgacg

SEQ ID NO: 9501318 - DNA, 22 bp, Homo sapiens
agcaatttctcgcaccagacgc

SEQ ID NO: 9501319 - DNA, 22 bp, Homo sapiens
agcaattttcccttagtctttg

SEQ ID NO: 9501320 - DNA, 22 bp, Homo sapiens
caagcagaggtttatgtattag

SEQ ID NO: 9501321 - DNA, 22 bp, Homo sapiens
caagctggctgggagaggcacg

SEQ ID NO: 9501322 - DNA, 22 bp, Homo sapiens
caaggaaacatgaaatgcattg

SEQ ID NO: 9501323 - DNA, 22 bp, Homo sapiens
caaggaaacatgaaatgcattg

SEQ ID NO: 9501324 - DNA, 22 bp, Homo sapiens
caaggaaacatgaaatgcattg

SEQ ID NO: 9501325 - DNA, 22 bp, Homo sapiens
caaggaaacatgaaatgcattg

SEQ ID NO: 9501326 - DNA, 22 bp, Homo sapiens
caaggaaaagaagtatttcaga

SEQ ID NO: 9501327 - DNA, 22 bp, Homo sapiens
caaggaaaacagatgatcaaca

SEQ ID NO: 9501328 - DNA, 22 bp, Homo sapiens
caaggaaaacagatgatcaaca

SEQ ID NO: 9501329 - DNA, 22 bp, Homo sapiens
caaggaaaacagatgatcaaca

SEQ ID NO: 9501330 - DNA, 22 bp, Homo sapiens
caaggaaaagaagtatttcaga

SEQ ID NO: 9501331 - DNA, 22 bp, Homo sapiens
caagcttgtttctcctgggggt

SEQ ID NO: 9501332 - DNA, 22 bp, Homo sapiens
caagcttgtttctcctgggggt

SEQ ID NO: 9501333 - DNA, 22 bp, Homo sapiens
caagctggtatcagctagagcg

SEQ ID NO: 9501334 - DNA, 22 bp, Homo sapiens
caaggaaaaagcgagctcgggg

SEQ ID NO: 9501335 - DNA, 22 bp, Homo sapiens
caaggaaaaagcgagctcgggg

SEQ ID NO: 9501336 - DNA, 22 bp, Homo sapiens
caaggaaaaagcgagctcgggg

SEQ ID NO: 9501337 - DNA, 22 bp, Homo sapiens
caatttcttgttaattctcagg

SEQ ID NO: 9501338 - DNA, 22 bp, Homo sapiens
caatttcttgttaattctcagg

SEQ ID NO: 9501339 - DNA, 18 bp, Homo sapiens
caattttacccagtccct

SEQ ID NO: 9501340 - DNA, 22 bp, Homo sapiens
caattcaacttgcctttgtagc

SEQ ID NO: 9501341 - DNA, 22 bp, Homo sapiens
caattcaaatgcatagttcaca

SEQ ID NO: 9501342 - DNA, 22 bp, Homo sapiens
caattattcagtgacttaagag

SEQ ID NO: 9501343 - DNA, 22 bp, Homo sapiens
caatttctggaactaattctga

SEQ ID NO: 9501344 - DNA, 22 bp, Homo sapiens
caatttctggaactaattctga

SEQ ID NO: 9501345 - DNA, 22 bp, Homo sapiens
caattcaatggcaaagtattgt

SEQ ID NO: 9501346 - DNA, 22 bp, Homo sapiens
caattcaatggcaaagtattgt

SEQ ID NO: 9501347 - DNA, 22 bp, Homo sapiens
caattcaagttgagtacagctt

SEQ ID NO: 9501348 - DNA, 22 bp, Homo sapiens
caattcaatggcaaagtattgt

SEQ ID NO: 9501349 - DNA, 22 bp, Homo sapiens
caatttttgtacttatagtact

SEQ ID NO: 9501350 - DNA, 22 bp, Homo sapiens
caatttttaaactatgaagttg

SEQ ID NO: 9501351 - DNA, 22 bp, Homo sapiens
caattttattggtccaaataca

SEQ ID NO: 9501352 - DNA, 22 bp, Homo sapiens
caattttactcttcctcttcca

SEQ ID NO: 9501353 - DNA, 22 bp, Homo sapiens
caattttattggtccaaataca

SEQ ID NO: 9501354 - DNA, 22 bp, Homo sapiens
caattttattggtccaaataca

SEQ ID NO: 9501355 - DNA, 22 bp, Homo sapiens
cacacatgaatccctagtacct

SEQ ID NO: 9501356 - DNA, 22 bp, Homo sapiens
cacacatgaatccctagtacct

SEQ ID NO: 9501357 - DNA, 22 bp, Homo sapiens
cacacatgaagttgctgagcta

SEQ ID NO: 9501358 - DNA, 22 bp, Homo sapiens
cacacatgcatgtaagacctct

SEQ ID NO: 9501359 - DNA, 22 bp, Homo sapiens
cacacatgcatgtaagacctct

SEQ ID NO: 9501360 - DNA, 22 bp, Homo sapiens
cacacatggctgccagggaggt

SEQ ID NO: 9501361 - DNA, 22 bp, Homo sapiens
cacacatgcatgtaagacctct

SEQ ID NO: 9501362 - DNA, 22 bp, Homo sapiens
cacacatggtagcaggtacaag

SEQ ID NO: 9501363 - DNA, 22 bp, Homo sapiens
cacacatggtagcaggtacaag

SEQ ID NO: 9501364 - DNA, 22 bp, Homo sapiens
cacacatggttccgcaggatgc

SEQ ID NO: 9501365 - DNA, 22 bp, Homo sapiens
cacacatggtcagtggctactc

SEQ ID NO: 9501366 - DNA, 22 bp, Homo sapiens
cacacatgtgggatccgcaggg

SEQ ID NO: 9501367 - DNA, 22 bp, Homo sapiens
cacactgttgaggacgagatgt

SEQ ID NO: 9501368 - DNA, 22 bp, Homo sapiens
cacagaaaaaggcttgaaaatc

SEQ ID NO: 9501369 - DNA, 22 bp, Homo sapiens
cacagaaaaaggcttgaaaatc

SEQ ID NO: 9501370 - DNA, 22 bp, Homo sapiens
cacagaaaaaggcttgaaaatc

SEQ ID NO: 9501371 - DNA, 22 bp, Homo sapiens
cacagaaaaaggcttgaaaatc

SEQ ID NO: 9501372 - DNA, 22 bp, Homo sapiens
cacagctggaatggggtacctg

SEQ ID NO: 9501373 - DNA, 19 bp, Homo sapiens
cacagctggcgctgaccgc

SEQ ID NO: 9501374 - DNA, 22 bp, Homo sapiens
cacagctgggaaaatttgtaca

SEQ ID NO: 9501375 - DNA, 22 bp, Homo sapiens
cacagctggggaagctgaggcc

SEQ ID NO: 9501376 - DNA, 22 bp, Homo sapiens
cacagctgggaaaatttgtaca

SEQ ID NO: 9501377 - DNA, 22 bp, Homo sapiens
cacagctggggaagctgaggcc

SEQ ID NO: 9501378 - DNA, 22 bp, Homo sapiens
cacagctggtgacagagcccag

SEQ ID NO: 9501379 - DNA, 22 bp, Homo sapiens
cacaggaaaaatgggtccttta

SEQ ID NO: 9501380 - DNA, 20 bp, Homo sapiens
cacaggaaagctactcagtt

SEQ ID NO: 9501381 - DNA, 20 bp, Homo sapiens
cacaggaaagctactcagtt

SEQ ID NO: 9501382 - DNA, 22 bp, Homo sapiens
cacaggaaaataaaagatctaa

SEQ ID NO: 9501383 - DNA, 22 bp, Homo sapiens
cacaggaaaataaaagatctaa

SEQ ID NO: 9501384 - DNA, 22 bp, Homo sapiens
cacaggaaagtcagccagaaga

SEQ ID NO: 9501385 - DNA, 22 bp, Homo sapiens
cacaggaaatattaggagggat

SEQ ID NO: 9501386 - DNA, 20 bp, Homo sapiens
cacaggaaagctactcagtt

SEQ ID NO: 9501387 - DNA, 20 bp, Homo sapiens
cacaggaaagctactcagtt

SEQ ID NO: 9501388 - DNA, 22 bp, Homo sapiens
agcaggcaggcccagcggctgg

SEQ ID NO: 9501389 - DNA, 22 bp, Homo sapiens
cacaggaagatctcccagaggt

SEQ ID NO: 9501390 - DNA, 22 bp, Homo sapiens
cacaggaagatctcccagaggt

SEQ ID NO: 9501391 - DNA, 22 bp, Homo sapiens
cacaggaagatctcccagaggt

SEQ ID NO: 9501392 - DNA, 22 bp, Homo sapiens
cacaggaagaggtatacaattc

SEQ ID NO: 9501393 - DNA, 22 bp, Homo sapiens
cacaggaagaggtatacaattc

SEQ ID NO: 9501394 - DNA, 22 bp, Homo sapiens
cacaggaacttactggccactt

SEQ ID NO: 9501395 - DNA, 22 bp, Homo sapiens
cacaggaacaaagaagacaatt

SEQ ID NO: 9501396 - DNA, 22 bp, Homo sapiens
cacaggaaatgattctgcagca

SEQ ID NO: 9501397 - DNA, 22 bp, Homo sapiens
cacaggaaatgattctgcagca

SEQ ID NO: 9501398 - DNA, 22 bp, Homo sapiens
cacaggaaatgattctgcagca

SEQ ID NO: 9501399 - DNA, 22 bp, Homo sapiens
cacagcagcgttcctccgtgtg

SEQ ID NO: 9501400 - DNA, 22 bp, Homo sapiens
cacagctgaccaccctgctccc

SEQ ID NO: 9501401 - DNA, 22 bp, Homo sapiens
cacagctgaccaccctgctccc

SEQ ID NO: 9501402 - DNA, 22 bp, Homo sapiens
cacagcagccagaacatttttg

SEQ ID NO: 9501403 - DNA, 22 bp, Homo sapiens
cacagcagccagaacatttttg

SEQ ID NO: 9501404 - DNA, 22 bp, Homo sapiens
cacagcagcatcatttatctgg

SEQ ID NO: 9501405 - DNA, 22 bp, Homo sapiens
cacagaacaccaaagaaccttc

SEQ ID NO: 9501406 - DNA, 20 bp, Homo sapiens
cacagaacaaattgcaggac

SEQ ID NO: 9501407 - DNA, 22 bp, Homo sapiens
cacagaaatattgtgtcccttg

SEQ ID NO: 9501408 - DNA, 22 bp, Homo sapiens
cacagaaatattgtgtcccttg

SEQ ID NO: 9501409 - DNA, 22 bp, Homo sapiens
cacagctgcttgttagaatagc

SEQ ID NO: 9501410 - DNA, 22 bp, Homo sapiens
cacagctgcttgttagaatagc

SEQ ID NO: 9501411 - DNA, 22 bp, Homo sapiens
cacagctgcttgttagaatagc

SEQ ID NO: 9501412 - DNA, 22 bp, Homo sapiens
cacagctgccccctctctaact

SEQ ID NO: 9501413 - DNA, 22 bp, Homo sapiens
cacagctgccctaactgtactc

SEQ ID NO: 9501414 - DNA, 22 bp, Homo sapiens
cacagctgccccctctctaact

SEQ ID NO: 9501415 - DNA, 22 bp, Homo sapiens
cacagctgccccctctctaact

SEQ ID NO: 9501416 - DNA, 22 bp, Homo sapiens
cacagctgccctactccatgtg

SEQ ID NO: 9501417 - DNA, 22 bp, Homo sapiens
cacagctgccctaactgtactc

SEQ ID NO: 9501418 - DNA, 22 bp, Homo sapiens
cacagctgaccaccctgctccc

SEQ ID NO: 9501419 - DNA, 22 bp, Homo sapiens
cacagctgcacagaggaggtgc

SEQ ID NO: 9501420 - DNA, 22 bp, Homo sapiens
cacagctgccatgcagtcagtg

SEQ ID NO: 9501421 - DNA, 22 bp, Homo sapiens
cacagctgccatgcagtcagtg

SEQ ID NO: 9501422 - DNA, 22 bp, Homo sapiens
cacagctgccatggctgcactt

SEQ ID NO: 9501423 - DNA, 22 bp, Homo sapiens
cacagctgccatggctgcactt

SEQ ID NO: 9501424 - DNA, 22 bp, Homo sapiens
cactgcacttcagcctgggtga

SEQ ID NO: 9501425 - DNA, 22 bp, Homo sapiens
cactgcacttcagcctgggtga

SEQ ID NO: 9501426 - DNA, 22 bp, Homo sapiens
cactgcacttcagcctgggtga

SEQ ID NO: 9501427 - DNA, 22 bp, Homo sapiens
cactgcacttcagcctgggtga

SEQ ID NO: 9501428 - DNA, 21 bp, Homo sapiens
agcattcaaaagatgccataa

SEQ ID NO: 9501429 - DNA, 21 bp, Homo sapiens
agcattcaaaagatgccataa

SEQ ID NO: 9501430 - DNA, 20 bp, Homo sapiens
agcatttagcctttatccac

SEQ ID NO: 9501431 - DNA, 22 bp, Homo sapiens
cactgcacttcagcctgggtga

SEQ ID NO: 9501432 - DNA, 22 bp, Homo sapiens
cactgcacttcagcctgggtga

SEQ ID NO: 9501433 - DNA, 22 bp, Homo sapiens
agcatttatttcttagaaattg

SEQ ID NO: 9501434 - DNA, 22 bp, Homo sapiens
agcatttatgactaatgtaaaa

SEQ ID NO: 9501435 - DNA, 22 bp, Homo sapiens
agcatttattgacctgctgctg

SEQ ID NO: 9501436 - DNA, 22 bp, Homo sapiens
agcatttccgccctcttctgcc

SEQ ID NO: 9501437 - DNA, 20 bp, Homo sapiens
agcatttgaaatatgactat

SEQ ID NO: 9501438 - DNA, 20 bp, Homo sapiens
agcatttgaaatatgactat

SEQ ID NO: 9501439 - DNA, 22 bp, Homo sapiens
agcatttgaaaactatttaatt

SEQ ID NO: 9501440 - DNA, 22 bp, Homo sapiens
agcatttgaaaactatttaatt

SEQ ID NO: 9501441 - DNA, 22 bp, Homo sapiens
agcatttagttagtaaatgttt

SEQ ID NO: 9501442 - DNA, 22 bp, Homo sapiens
agcatttagttagtaaatgttt

SEQ ID NO: 9501443 - DNA, 22 bp, Homo sapiens
agcatttagtctttattgcagc

SEQ ID NO: 9501444 - DNA, 22 bp, Homo sapiens
cactgcactccatcctgggaaa

SEQ ID NO: 9501445 - DNA, 22 bp, Homo sapiens
cactgcactccatcctgggaaa

SEQ ID NO: 9501446 - DNA, 22 bp, Homo sapiens
cactgcactccatcctgggaaa

SEQ ID NO: 9501447 - DNA, 22 bp, Homo sapiens
cactgcactccatcctgggaaa

SEQ ID NO: 9501448 - DNA, 22 bp, Homo sapiens
cactgcactccatcctgggaaa

SEQ ID NO: 9501449 - DNA, 22 bp, Homo sapiens
cactgcactccatcctgggaaa

SEQ ID NO: 9501450 - DNA, 22 bp, Homo sapiens
cactgcactccagcctcggtga

SEQ ID NO: 9501451 - DNA, 22 bp, Homo sapiens
cactgcactccagcccgggcaa

SEQ ID NO: 9501452 - DNA, 22 bp, Homo sapiens
cactgcactccagcccgggcaa

SEQ ID NO: 9501453 - DNA, 22 bp, Homo sapiens
cactgcactccagcccgggcaa

SEQ ID NO: 9501454 - DNA, 22 bp, Homo sapiens
cactgcactccagcccgggcaa

SEQ ID NO: 9501455 - DNA, 22 bp, Homo sapiens
cactgcactccagcccgggcaa

SEQ ID NO: 9501456 - DNA, 22 bp, Homo sapiens
cactgcaccctcaaactcctgg

SEQ ID NO: 9501457 - DNA, 22 bp, Homo sapiens
cactgcacaggtgagatgtggg

SEQ ID NO: 9501458 - DNA, 22 bp, Homo sapiens
cactgcaagctctgccacctgg

SEQ ID NO: 9501459 - DNA, 22 bp, Homo sapiens
cactgcactccagcactccagc

SEQ ID NO: 9501460 - DNA, 22 bp, Homo sapiens
cactgcactccagcactccagc

SEQ ID NO: 9501461 - DNA, 22 bp, Homo sapiens
cactgcactccagcccgggcaa

SEQ ID NO: 9501462 - DNA, 22 bp, Homo sapiens
cactgcaacctccatcttctgg

SEQ ID NO: 9501463 - DNA, 22 bp, Homo sapiens
cactgcaacctctgccacctgg

SEQ ID NO: 9501464 - DNA, 22 bp, Homo sapiens
cactgcaacctccacctcctgg

SEQ ID NO: 9501465 - DNA, 22 bp, Homo sapiens
cactgcaacctccacctcctgg

SEQ ID NO: 9501466 - DNA, 22 bp, Homo sapiens
cactgcaacctccacctcctgg

SEQ ID NO: 9501467 - DNA, 22 bp, Homo sapiens
agccaaaggcaccagagacact

SEQ ID NO: 9501468 - DNA, 22 bp, Homo sapiens
agccaaaggcaccagagacact

SEQ ID NO: 9501469 - DNA, 22 bp, Homo sapiens
agccaaaggcaccagagacact

SEQ ID NO: 9501470 - DNA, 20 bp, Homo sapiens
agccaaaggagaacagtgct

SEQ ID NO: 9501471 - DNA, 20 bp, Homo sapiens
agccaaaggagaacagtgct

SEQ ID NO: 9501472 - DNA, 22 bp, Homo sapiens
agccaaagatcagtgtgcaagt

SEQ ID NO: 9501473 - DNA, 22 bp, Homo sapiens
agccaacacatgtaaatgcacc

SEQ ID NO: 9501474 - DNA, 22 bp, Homo sapiens
agccaacagccagcatcaacca

SEQ ID NO: 9501475 - DNA, 22 bp, Homo sapiens
agccaacaactctgagcccagt

SEQ ID NO: 9501476 - DNA, 23 bp, Homo sapiens
agccaaatcttaacttctgttac

SEQ ID NO: 9501477 - DNA, 22 bp, Homo sapiens
agccaaaggcaccagagacact

SEQ ID NO: 9501478 - DNA, 22 bp, Homo sapiens
agccaaagatcagtgtgcaagt

SEQ ID NO: 9501479 - DNA, 22 bp, Homo sapiens
cagaaagacctgggctcaagag

SEQ ID NO: 9501480 - DNA, 22 bp, Homo sapiens
cagaaagacctgggctcaagag

SEQ ID NO: 9501481 - DNA, 20 bp, Homo sapiens
cagaaagaaggtagattttt

SEQ ID NO: 9501482 - DNA, 22 bp, Homo sapiens
cagaaagacctgattggcagtt

SEQ ID NO: 9501483 - DNA, 22 bp, Homo sapiens
cagaaagacctgattggcagtt

SEQ ID NO: 9501484 - DNA, 22 bp, Homo sapiens
cagaaagacctgattggcagtt

SEQ ID NO: 9501485 - DNA, 20 bp, Homo sapiens
cagaaagaaggtagattttt

SEQ ID NO: 9501486 - DNA, 22 bp, Homo sapiens
cagaaactttctttactgagca

SEQ ID NO: 9501487 - DNA, 22 bp, Homo sapiens
cagaaactttctttactgagca

SEQ ID NO: 9501488 - DNA, 22 bp, Homo sapiens
cagaaacttctggtgtcaaata

SEQ ID NO: 9501489 - DNA, 22 bp, Homo sapiens
cagaaacttctggtgtcaaata

SEQ ID NO: 9501490 - DNA, 22 bp, Homo sapiens
cagaaactgtttgttaatattt

SEQ ID NO: 9501491 - DNA, 22 bp, Homo sapiens
cagaaactgtttgttaatattt

SEQ ID NO: 9501492 - DNA, 22 bp, Homo sapiens
cagaaacatgtataaagttgta

SEQ ID NO: 9501493 - DNA, 22 bp, Homo sapiens
cagaaacatgtataaagttgta

SEQ ID NO: 9501494 - DNA, 22 bp, Homo sapiens
cagaaactagatttagacacaa

SEQ ID NO: 9501495 - DNA, 22 bp, Homo sapiens
cagaaactatgtaagaaagtga

SEQ ID NO: 9501496 - DNA, 22 bp, Homo sapiens
cagaaactatgtaagaaagtga

SEQ ID NO: 9501497 - DNA, 22 bp, Homo sapiens
cagaaactagatttagacacaa

SEQ ID NO: 9501498 - DNA, 22 bp, Homo sapiens
cactggtctttggctaggtgtg

SEQ ID NO: 9501499 - DNA, 22 bp, Homo sapiens
cagaaacatgtataaagttgta

SEQ ID NO: 9501500 - DNA, 22 bp, Homo sapiens
cactggtcagcatggtagacca

SEQ ID NO: 9501501 - DNA, 22 bp, Homo sapiens
cactggggtgggcctggtagag

SEQ ID NO: 9501502 - DNA, 22 bp, Homo sapiens
cactgggcacttgggttgcttc

SEQ ID NO: 9501503 - DNA, 22 bp, Homo sapiens
cactgggcaattctgagcctaa

SEQ ID NO: 9501504 - DNA, 22 bp, Homo sapiens
agccaaaacatgtgagttttga

SEQ ID NO: 9501505 - DNA, 22 bp, Homo sapiens
cactgggcaattctgagcctaa

SEQ ID NO: 9501506 - DNA, 22 bp, Homo sapiens
agcattttctgagagtatagat

SEQ ID NO: 9501507 - DNA, 22 bp, Homo sapiens
agcattttctgagagtatagat

SEQ ID NO: 9501508 - DNA, 20 bp, Homo sapiens
agcattttatggtaggaaac

SEQ ID NO: 9501509 - DNA, 22 bp, Homo sapiens
agcatttgaaaactatttaatt

SEQ ID NO: 9501510 - DNA, 17 bp, Homo sapiens
agcatttgtgttaacag

SEQ ID NO: 9501511 - DNA, 17 bp, Homo sapiens
agcatttgtgttaacag

SEQ ID NO: 9501512 - DNA, 19 bp, Homo sapiens
agcatttggaattctacac

SEQ ID NO: 9501513 - DNA, 22 bp, Homo sapiens
agcatttgatatgtttaaaaag

SEQ ID NO: 9501514 - DNA, 22 bp, Homo sapiens
agcatttgatatgtttaaaaag

SEQ ID NO: 9501515 - DNA, 19 bp, Homo sapiens
agcatttggaattctacac

SEQ ID NO: 9501516 - DNA, 19 bp, Homo sapiens
agcatttggaattctacac

SEQ ID NO: 9501517 - DNA, 22 bp, Homo sapiens
cactgggctgataccaggcttc

SEQ ID NO: 9501518 - DNA, 20 bp, Homo sapiens
cactgggctggagtcagggc

SEQ ID NO: 9501519 - DNA, 20 bp, Homo sapiens
cactgggctggagtcagggc

SEQ ID NO: 9501520 - DNA, 22 bp, Homo sapiens
cactgggcgtgtcctgggtgag

SEQ ID NO: 9501521 - DNA, 22 bp, Homo sapiens
cactgggcgtgtcctgggtgag

SEQ ID NO: 9501522 - DNA, 22 bp, Homo sapiens
cactgggcgtgtcctgggtgag

SEQ ID NO: 9501523 - DNA, 22 bp, Homo sapiens
cactgggcgccagctgctgagc

SEQ ID NO: 9501524 - DNA, 23 bp, Homo sapiens
cactgggcccagggtgtggaggc

SEQ ID NO: 9501525 - DNA, 23 bp, Homo sapiens
cactgggcccagggtgtggaggc

SEQ ID NO: 9501526 - DNA, 23 bp, Homo sapiens
cactgggcccagggtgtggaggc

SEQ ID NO: 9501527 - DNA, 22 bp, Homo sapiens
agcaggtggccacgaggaggag

SEQ ID NO: 9501528 - DNA, 22 bp, Homo sapiens
agcaggtggccacgaggaggag

SEQ ID NO: 9501529 - DNA, 22 bp, Homo sapiens
agcaggtggccacgaggaggag

SEQ ID NO: 9501530 - DNA, 22 bp, Homo sapiens
agcaggtggccacgaggaggag

SEQ ID NO: 9501531 - DNA, 22 bp, Homo sapiens
agcaggtggcctcctgtctgtc

SEQ ID NO: 9501532 - DNA, 22 bp, Homo sapiens
agcaggtgggatcaagctggca

SEQ ID NO: 9501533 - DNA, 18 bp, Homo sapiens
agcaggtggcgtctgcag

SEQ ID NO: 9501534 - DNA, 22 bp, Homo sapiens
agcaggtgggcatgaaagctga

SEQ ID NO: 9501535 - DNA, 22 bp, Homo sapiens
agcaggtgggatcaagctggca

SEQ ID NO: 9501536 - DNA, 22 bp, Homo sapiens
agcaggtgggatcaagctggca

SEQ ID NO: 9501537 - DNA, 22 bp, Homo sapiens
cactgaaatcgaaaaatgtagg

SEQ ID NO: 9501538 - DNA, 22 bp, Homo sapiens
cactaagttggtgttaattagt

SEQ ID NO: 9501539 - DNA, 22 bp, Homo sapiens
cactagaaaggtacagattatg

SEQ ID NO: 9501540 - DNA, 22 bp, Homo sapiens
cactagaaaggtacagattatg

SEQ ID NO: 9501541 - DNA, 22 bp, Homo sapiens
cactagaaaggtacagattatg

SEQ ID NO: 9501542 - DNA, 22 bp, Homo sapiens
agcaggtggacagaggaagaaa

SEQ ID NO: 9501543 - DNA, 22 bp, Homo sapiens
cacatttaagtgcttgttcaga

SEQ ID NO: 9501544 - DNA, 22 bp, Homo sapiens
cacatttaagtgcttgttcaga

SEQ ID NO: 9501545 - DNA, 22 bp, Homo sapiens
cacatttaagtgcttgttcaga

SEQ ID NO: 9501546 - DNA, 22 bp, Homo sapiens
cacatttaagtgcttgttcaga

SEQ ID NO: 9501547 - DNA, 22 bp, Homo sapiens
cacctgccaaatggggatgctg

SEQ ID NO: 9501548 - DNA, 22 bp, Homo sapiens
cacctgcaaggagctttcattt

SEQ ID NO: 9501549 - DNA, 22 bp, Homo sapiens
cacgtccacccaggctgcccag

SEQ ID NO: 9501550 - DNA, 22 bp, Homo sapiens
cacgggagacgtgatcttggac

SEQ ID NO: 9501551 - DNA, 22 bp, Homo sapiens
cacgggtggaatcagggactcc

SEQ ID NO: 9501552 - DNA, 22 bp, Homo sapiens
cacatttaagcagatgtggacc

SEQ ID NO: 9501553 - DNA, 22 bp, Homo sapiens
cacatttaagcagatgtggacc

SEQ ID NO: 9501554 - DNA, 22 bp, Homo sapiens
cacatttaagcagatgtggacc

SEQ ID NO: 9501555 - DNA, 22 bp, Homo sapiens
cacatttaaaaaatccacgatc

SEQ ID NO: 9501556 - DNA, 22 bp, Homo sapiens
cacatttaaaggttgaagctga

SEQ ID NO: 9501557 - DNA, 22 bp, Homo sapiens
cacatttaaaggttgaagctga

SEQ ID NO: 9501558 - DNA, 22 bp, Homo sapiens
cacatttaaaaaatccacgatc

SEQ ID NO: 9501559 - DNA, 22 bp, Homo sapiens
cacatttaaaaaatccacgatc

SEQ ID NO: 9501560 - DNA, 17 bp, Homo sapiens
cacatgtctacatggat

SEQ ID NO: 9501561 - DNA, 21 bp, Homo sapiens
cacattgcccctccacctcct

SEQ ID NO: 9501562 - DNA, 22 bp, Homo sapiens
cacattggcaaacggggttgca

SEQ ID NO: 9501563 - DNA, 22 bp, Homo sapiens
cacattgtagagattagaaaga

SEQ ID NO: 9501564 - DNA, 22 bp, Homo sapiens
cacattgtagagattagaaaga

SEQ ID NO: 9501565 - DNA, 22 bp, Homo sapiens
cacattgtattgtggaaagtta

SEQ ID NO: 9501566 - DNA, 22 bp, Homo sapiens
cacaggctgcccgcagctggga

SEQ ID NO: 9501567 - DNA, 22 bp, Homo sapiens
cacaggctctccagggcctgga

SEQ ID NO: 9501568 - DNA, 22 bp, Homo sapiens
cacaggctcttctcacttgatt

SEQ ID NO: 9501569 - DNA, 22 bp, Homo sapiens
cacaggctctccagggcctgga

SEQ ID NO: 9501570 - DNA, 22 bp, Homo sapiens
cacaggctctccagggcctgga

SEQ ID NO: 9501571 - DNA, 22 bp, Homo sapiens
cacaggctctccagggcctgga

SEQ ID NO: 9501572 - DNA, 22 bp, Homo sapiens
cacatgcttagatttcagtgga

SEQ ID NO: 9501573 - DNA, 22 bp, Homo sapiens
cacatgcttcttttgattatga

SEQ ID NO: 9501574 - DNA, 22 bp, Homo sapiens
cacatgggcttagcaggcaggg

SEQ ID NO: 9501575 - DNA, 22 bp, Homo sapiens
cacatggcctgtgtggccagac

SEQ ID NO: 9501576 - DNA, 22 bp, Homo sapiens
cacatggcagaatcatgcatct

SEQ ID NO: 9501577 - DNA, 22 bp, Homo sapiens
cacatgggtgtgcctggaggaa

SEQ ID NO: 9501578 - DNA, 22 bp, Homo sapiens
cacatgggtgtgcctggaggaa

SEQ ID NO: 9501579 - DNA, 22 bp, Homo sapiens
cacatgtcctgggaaaataact

SEQ ID NO: 9501580 - DNA, 22 bp, Homo sapiens
cacatgtcctggcgctgagccc

SEQ ID NO: 9501581 - DNA, 22 bp, Homo sapiens
cacatgtcctggcgctgagccc

SEQ ID NO: 9501582 - DNA, 17 bp, Homo sapiens
cacatgtctacatggat

SEQ ID NO: 9501583 - DNA, 17 bp, Homo sapiens
cacatgtctacatggat

SEQ ID NO: 9501584 - DNA, 19 bp, Homo sapiens
agcaggccaggcaggtggc

SEQ ID NO: 9501585 - DNA, 22 bp, Homo sapiens
agcaggcctcatgcaccagcta

SEQ ID NO: 9501586 - DNA, 22 bp, Homo sapiens
agcaggctactcctgtgttcgt

SEQ ID NO: 9501587 - DNA, 22 bp, Homo sapiens
agcaggctactcctgtgttcgt

SEQ ID NO: 9501588 - DNA, 22 bp, Homo sapiens
agcaggctaatcttgctgaaca

SEQ ID NO: 9501589 - DNA, 20 bp, Homo sapiens
agcaggccttggggagagga

SEQ ID NO: 9501590 - DNA, 20 bp, Homo sapiens
agcaggccttggggagagga

SEQ ID NO: 9501591 - DNA, 19 bp, Homo sapiens
agcaggctaggctgcctct

SEQ ID NO: 9501592 - DNA, 19 bp, Homo sapiens
agcaggctaggctgcctct

SEQ ID NO: 9501593 - DNA, 22 bp, Homo sapiens
agcaggctaggaacctcactgc

SEQ ID NO: 9501594 - DNA, 19 bp, Homo sapiens
agcaggctaggctgcctct

SEQ ID NO: 9501595 - DNA, 22 bp, Homo sapiens
cacaggctccggccttgcagcc

SEQ ID NO: 9501596 - DNA, 22 bp, Homo sapiens
cacaggctccggccttgcagcc

SEQ ID NO: 9501597 - DNA, 18 bp, Homo sapiens
cacaggctcccagtgagg

SEQ ID NO: 9501598 - DNA, 22 bp, Homo sapiens
atgatatagagagtagattaaa

SEQ ID NO: 9501599 - DNA, 22 bp, Homo sapiens
atgaggcacatcacagccaatg

SEQ ID NO: 9501600 - DNA, 22 bp, Homo sapiens
atgaggcaatcatggtccagtt

SEQ ID NO: 9501601 - DNA, 22 bp, Homo sapiens
atgaggcaatcatggtccagtt

SEQ ID NO: 9501602 - DNA, 22 bp, Homo sapiens
atgaggatgttagtggactgga

SEQ ID NO: 9501603 - DNA, 22 bp, Homo sapiens
atgaggataccgcagggggcag

SEQ ID NO: 9501604 - DNA, 22 bp, Homo sapiens
atgaggatgggaagggagccaa

SEQ ID NO: 9501605 - DNA, 22 bp, Homo sapiens
atgaggcaaaggtggaggtggg

SEQ ID NO: 9501606 - DNA, 22 bp, Homo sapiens
atgagaaaattgaggcccatag

SEQ ID NO: 9501607 - DNA, 22 bp, Homo sapiens
atgagaaaattgaggcccatag

SEQ ID NO: 9501608 - DNA, 22 bp, Homo sapiens
atgagaaaattgaggcccatag

SEQ ID NO: 9501609 - DNA, 22 bp, Homo sapiens
atgactttcctggcaaaagttg

SEQ ID NO: 9501610 - DNA, 22 bp, Homo sapiens
atgacttattacaagtcatatt

SEQ ID NO: 9501611 - DNA, 22 bp, Homo sapiens
atgacttattacaagtcatatt

SEQ ID NO: 9501612 - DNA, 22 bp, Homo sapiens
atgagaaaattcattccatcca

SEQ ID NO: 9501613 - DNA, 22 bp, Homo sapiens
atgagaaagagttgtatctaga

SEQ ID NO: 9501614 - DNA, 22 bp, Homo sapiens
atgaggaggccagtaagagcct

SEQ ID NO: 9501615 - DNA, 22 bp, Homo sapiens
atgattctcattttataaactt

SEQ ID NO: 9501616 - DNA, 21 bp, Homo sapiens
atgattctgcaaatgagtagt

SEQ ID NO: 9501617 - DNA, 22 bp, Homo sapiens
atgattctaggcattgaagata

SEQ ID NO: 9501618 - DNA, 20 bp, Homo sapiens
atgattcatgatgatgtctc

SEQ ID NO: 9501619 - DNA, 20 bp, Homo sapiens
atgattctgggctacactgg

SEQ ID NO: 9501620 - DNA, 22 bp, Homo sapiens
atgattctggtgagaatgagga

SEQ ID NO: 9501621 - DNA, 22 bp, Homo sapiens
atgattgaccatctgctgggct

SEQ ID NO: 9501622 - DNA, 22 bp, Homo sapiens
atgatttaaagtcattgtgaac

SEQ ID NO: 9501623 - DNA, 22 bp, Homo sapiens
atgatttccagttgttgctaag

SEQ ID NO: 9501624 - DNA, 22 bp, Homo sapiens
atgattttctgataaagaactg

SEQ ID NO: 9501625 - DNA, 22 bp, Homo sapiens
atgattttctgataaagaactg

SEQ ID NO: 9501626 - DNA, 22 bp, Homo sapiens
atgatttaaagtcattgtgaac

SEQ ID NO: 9501627 - DNA, 22 bp, Homo sapiens
atgcaaattaacatatagtaga

SEQ ID NO: 9501628 - DNA, 22 bp, Homo sapiens
atgcaaattaacatatagtaga

SEQ ID NO: 9501629 - DNA, 22 bp, Homo sapiens
atgcaaattaacatatagtaga

SEQ ID NO: 9501630 - DNA, 22 bp, Homo sapiens
atgcaaatgtttaagttactat

SEQ ID NO: 9501631 - DNA, 22 bp, Homo sapiens
atgcaaatggcaatgagtgacc

SEQ ID NO: 9501632 - DNA, 22 bp, Homo sapiens
atgcaaatgctagagaatgttg

SEQ ID NO: 9501633 - DNA, 22 bp, Homo sapiens
atgcaaatgctagagaatgttg

SEQ ID NO: 9501634 - DNA, 22 bp, Homo sapiens
atgcaaatgtcaccacttctaa

SEQ ID NO: 9501635 - DNA, 22 bp, Homo sapiens
atgcaaatgtcaccacttctaa

SEQ ID NO: 9501636 - DNA, 22 bp, Homo sapiens
atctggcttttaccccacggcc

SEQ ID NO: 9501637 - DNA, 22 bp, Homo sapiens
atctggcttgggtgtgggtagc

SEQ ID NO: 9501638 - DNA, 22 bp, Homo sapiens
atctggcttacgaagcactggt

SEQ ID NO: 9501639 - DNA, 22 bp, Homo sapiens
atctggcttacgaagcactggt

SEQ ID NO: 9501640 - DNA, 22 bp, Homo sapiens
atctggcttgactttgcgactt

SEQ ID NO: 9501641 - DNA, 22 bp, Homo sapiens
atctggctgagcgaggcccaca

SEQ ID NO: 9501642 - DNA, 22 bp, Homo sapiens
atctggctgactttgtgggaca

SEQ ID NO: 9501643 - DNA, 22 bp, Homo sapiens
atctggctgactttgtgggaca

SEQ ID NO: 9501644 - DNA, 17 bp, Homo sapiens
atctggctgcttctaga

SEQ ID NO: 9501645 - DNA, 17 bp, Homo sapiens
atctggctgcttctaga

SEQ ID NO: 9501646 - DNA, 22 bp, Homo sapiens
atctggcttacctagggtgcct

SEQ ID NO: 9501647 - DNA, 22 bp, Homo sapiens
atctggctggattcttagcgtt

SEQ ID NO: 9501648 - DNA, 22 bp, Homo sapiens
atctgggcctgttccctcacct

SEQ ID NO: 9501649 - DNA, 22 bp, Homo sapiens
atctgggccagccccaagagac

SEQ ID NO: 9501650 - DNA, 22 bp, Homo sapiens
atctgggccagccccaagagac

SEQ ID NO: 9501651 - DNA, 22 bp, Homo sapiens
atctgggccaatcctagtacca

SEQ ID NO: 9501652 - DNA, 22 bp, Homo sapiens
atctgggcatggaggaaagaga

SEQ ID NO: 9501653 - DNA, 23 bp, Homo sapiens
atctgggcatctggagtggtcct

SEQ ID NO: 9501654 - DNA, 23 bp, Homo sapiens
atctgggcatctggagtggtcct

SEQ ID NO: 9501655 - DNA, 22 bp, Homo sapiens
atctgggcagggcagcaaggcg

SEQ ID NO: 9501656 - DNA, 20 bp, Homo sapiens
atctgggcatcaattttgtg

SEQ ID NO: 9501657 - DNA, 22 bp, Homo sapiens
atctggcttttactgaattgct

SEQ ID NO: 9501658 - DNA, 23 bp, Homo sapiens
atctgttgtgcctcttatatgta

SEQ ID NO: 9501659 - DNA, 22 bp, Homo sapiens
atctgttgtttttcaccaccca

SEQ ID NO: 9501660 - DNA, 22 bp, Homo sapiens
atctgttgttttctcatatgtt

SEQ ID NO: 9501661 - DNA, 21 bp, Homo sapiens
atcttaaaaggtcttaacttt

SEQ ID NO: 9501662 - DNA, 21 bp, Homo sapiens
atcttaaaaggtcttaacttt

SEQ ID NO: 9501663 - DNA, 21 bp, Homo sapiens
atcttaaaaggtcttaacttt

SEQ ID NO: 9501664 - DNA, 21 bp, Homo sapiens
atcttaaaaggtcttaacttt

SEQ ID NO: 9501665 - DNA, 22 bp, Homo sapiens
atcttaaacagaggaatgactt

SEQ ID NO: 9501666 - DNA, 22 bp, Homo sapiens
atcttaaacagaggaatgactt

SEQ ID NO: 9501667 - DNA, 22 bp, Homo sapiens
atctggggccccggaagttcct

SEQ ID NO: 9501668 - DNA, 22 bp, Homo sapiens
atctggggaggtatctgtagtc

SEQ ID NO: 9501669 - DNA, 22 bp, Homo sapiens
atctgggctcgaatcctagctc

SEQ ID NO: 9501670 - DNA, 22 bp, Homo sapiens
atctgggcgtataggtgcaagt

SEQ ID NO: 9501671 - DNA, 22 bp, Homo sapiens
atctgggctcgaatcctagctc

SEQ ID NO: 9501672 - DNA, 22 bp, Homo sapiens
atctgggggagctgctcatgga

SEQ ID NO: 9501673 - DNA, 22 bp, Homo sapiens
atctgggtcacagtggcatcta

SEQ ID NO: 9501674 - DNA, 22 bp, Homo sapiens
atgaccagtgttgctggccccg

SEQ ID NO: 9501675 - DNA, 22 bp, Homo sapiens
atgaccagccgagataaacaga

SEQ ID NO: 9501676 - DNA, 22 bp, Homo sapiens
atgacattgacagacctgctgc

SEQ ID NO: 9501677 - DNA, 22 bp, Homo sapiens
atgacattgacagacctgctgc

SEQ ID NO: 9501678 - DNA, 22 bp, Homo sapiens
atgacaatatagctttgatttt

SEQ ID NO: 9501679 - DNA, 22 bp, Homo sapiens
atgacatttatacagtgagctt

SEQ ID NO: 9501680 - DNA, 22 bp, Homo sapiens
atgacatttatacagtgagctt

SEQ ID NO: 9501681 - DNA, 22 bp, Homo sapiens
atgaccagccgagataaacaga

SEQ ID NO: 9501682 - DNA, 22 bp, Homo sapiens
atgaccagccgagataaacaga

SEQ ID NO: 9501683 - DNA, 22 bp, Homo sapiens
atgacccttactgcatcataca

SEQ ID NO: 9501684 - DNA, 22 bp, Homo sapiens
atgacccccaagggcagcgtga

SEQ ID NO: 9501685 - DNA, 22 bp, Homo sapiens
atgacctgaggccttactctag

SEQ ID NO: 9501686 - DNA, 22 bp, Homo sapiens
atgactgctctgggctcccatg

SEQ ID NO: 9501687 - DNA, 19 bp, Homo sapiens
atgactcttattgtctgaa

SEQ ID NO: 9501688 - DNA, 22 bp, Homo sapiens
atgacttattacaagtcatatt

SEQ ID NO: 9501689 - DNA, 19 bp, Homo sapiens
atcttacagagcagagtac

SEQ ID NO: 9501690 - DNA, 22 bp, Homo sapiens
atcttacactgttgggtttctc

SEQ ID NO: 9501691 - DNA, 19 bp, Homo sapiens
atcttacagagcagagtac

SEQ ID NO: 9501692 - DNA, 22 bp, Homo sapiens
atcttacagcagcaaggaagta

SEQ ID NO: 9501693 - DNA, 22 bp, Homo sapiens
atcttacagcagcaaggaagta

SEQ ID NO: 9501694 - DNA, 22 bp, Homo sapiens
atcttacagcagcaaggaagta

SEQ ID NO: 9501695 - DNA, 22 bp, Homo sapiens
atcttacacgataactgttagt

SEQ ID NO: 9501696 - DNA, 22 bp, Homo sapiens
atcttacactgttgggtttctc

SEQ ID NO: 9501697 - DNA, 22 bp, Homo sapiens
atcttacacgataactgttagt

SEQ ID NO: 9501698 - DNA, 22 bp, Homo sapiens
atcttacacgataactgttagt

SEQ ID NO: 9501699 - DNA, 22 bp, Homo sapiens
atcttacacgataactgttagt

SEQ ID NO: 9501700 - DNA, 22 bp, Homo sapiens
atcttacaattacaagacactc

SEQ ID NO: 9501701 - DNA, 22 bp, Homo sapiens
atcttacaattacaagacactc

SEQ ID NO: 9501702 - DNA, 18 bp, Homo sapiens
atcttaacttgatggagt

SEQ ID NO: 9501703 - DNA, 22 bp, Homo sapiens
atcttaaacagaggaatgactt

SEQ ID NO: 9501704 - DNA, 23 bp, Homo sapiens
atcttagcatagacttgagtccc

SEQ ID NO: 9501705 - DNA, 22 bp, Homo sapiens
atgacaatacttcaataagctg

SEQ ID NO: 9501706 - DNA, 22 bp, Homo sapiens
atgacaagggttgacacatgtc

SEQ ID NO: 9501707 - DNA, 22 bp, Homo sapiens
atgacaatatagctttgatttt

SEQ ID NO: 9501708 - DNA, 22 bp, Homo sapiens
atcttacattccctcaccattt

SEQ ID NO: 9501709 - DNA, 23 bp, Homo sapiens
atcttacatatttagcacctgaa

SEQ ID NO: 9501710 - DNA, 23 bp, Homo sapiens
atcttacatatttagcacctgaa

SEQ ID NO: 9501711 - DNA, 22 bp, Homo sapiens
atcttacattccctcaccattt

SEQ ID NO: 9501712 - DNA, 22 bp, Homo sapiens
atgcttaatgagggtatatatg

SEQ ID NO: 9501713 - DNA, 22 bp, Homo sapiens
atgcttaatgagggtatatatg

SEQ ID NO: 9501714 - DNA, 22 bp, Homo sapiens
atgctgaggttgttgtcctatt

SEQ ID NO: 9501715 - DNA, 22 bp, Homo sapiens
atgctgagattcacctgaatgt

SEQ ID NO: 9501716 - DNA, 22 bp, Homo sapiens
atgctgagcagagctgacatgc

SEQ ID NO: 9501717 - DNA, 22 bp, Homo sapiens
atgctgagcagagctgacatgc

SEQ ID NO: 9501718 - DNA, 22 bp, Homo sapiens
atgctgagaaacctgtctggca

SEQ ID NO: 9501719 - DNA, 22 bp, Homo sapiens
atgctgaagagtgcacaggcta

SEQ ID NO: 9501720 - DNA, 22 bp, Homo sapiens
atgctgaagagtgcacaggcta

SEQ ID NO: 9501721 - DNA, 22 bp, Homo sapiens
atgctgaagagttcatgattat

SEQ ID NO: 9501722 - DNA, 22 bp, Homo sapiens
atgctgaaggtgaattgacaat

SEQ ID NO: 9501723 - DNA, 22 bp, Homo sapiens
atgctgaaggtgaattgacaat

SEQ ID NO: 9501724 - DNA, 22 bp, Homo sapiens
atgctgaaggtgaattgacaat

SEQ ID NO: 9501725 - DNA, 22 bp, Homo sapiens
atgctgaatagttcactcttct

SEQ ID NO: 9501726 - DNA, 22 bp, Homo sapiens
atgctgaattgatgcgagggag

SEQ ID NO: 9501727 - DNA, 22 bp, Homo sapiens
atgctgaatgaaagaaattagt

SEQ ID NO: 9501728 - DNA, 22 bp, Homo sapiens
atgctgaatgaaagaaattagt

SEQ ID NO: 9501729 - DNA, 22 bp, Homo sapiens
atgctgaatattagcctcatga

SEQ ID NO: 9501730 - DNA, 22 bp, Homo sapiens
atgctgaagtgtgtttgaagta

SEQ ID NO: 9501731 - DNA, 22 bp, Homo sapiens
atgctgaaaattggatttgaat

SEQ ID NO: 9501732 - DNA, 22 bp, Homo sapiens
atgctgaactgagatgtaactt

SEQ ID NO: 9501733 - DNA, 22 bp, Homo sapiens
atgctgaagaatcacagggact

SEQ ID NO: 9501734 - DNA, 22 bp, Homo sapiens
atgcgtgcaggggtcctcctgg

SEQ ID NO: 9501735 - DNA, 22 bp, Homo sapiens
atgcgtgtttgtatacacacaa

SEQ ID NO: 9501736 - DNA, 22 bp, Homo sapiens
atgcgtgtaggaacagtgtcta

SEQ ID NO: 9501737 - DNA, 22 bp, Homo sapiens
atgcgtgtgtgcaaaccattgc

SEQ ID NO: 9501738 - DNA, 22 bp, Homo sapiens
agagaacagacagatgcaatga

SEQ ID NO: 9501739 - DNA, 22 bp, Homo sapiens
agagaacagacagatgcaatga

SEQ ID NO: 9501740 - DNA, 22 bp, Homo sapiens
agagaacagacagatgcaatga

SEQ ID NO: 9501741 - DNA, 22 bp, Homo sapiens
agagaacagacagatgcaatga

SEQ ID NO: 9501742 - DNA, 22 bp, Homo sapiens
agagaacagcattgcagctttg

SEQ ID NO: 9501743 - DNA, 22 bp, Homo sapiens
agagaacacgtgcatctgcaat

SEQ ID NO: 9501744 - DNA, 22 bp, Homo sapiens
agagaacaaattaaaggtggtt

SEQ ID NO: 9501745 - DNA, 22 bp, Homo sapiens
agagaacaaattaaaggtggtt

SEQ ID NO: 9501746 - DNA, 22 bp, Homo sapiens
atgcttcttgtatttggctgac

SEQ ID NO: 9501747 - DNA, 22 bp, Homo sapiens
atgcttcttgagatagaaacac

SEQ ID NO: 9501748 - DNA, 22 bp, Homo sapiens
atgcttcttgagatagaaacac

SEQ ID NO: 9501749 - DNA, 22 bp, Homo sapiens
atgcttctggtataagaaaaat

SEQ ID NO: 9501750 - DNA, 22 bp, Homo sapiens
atgcttctgtaatgtgggaatg

SEQ ID NO: 9501751 - DNA, 22 bp, Homo sapiens
atgcttctgttgcttaggaggt

SEQ ID NO: 9501752 - DNA, 22 bp, Homo sapiens
atgcttctgtgtatgtttcagg

SEQ ID NO: 9501753 - DNA, 22 bp, Homo sapiens
atgcttccctttgctccacatg

SEQ ID NO: 9501754 - DNA, 22 bp, Homo sapiens
atgcttcagtgctaccttcaaa

SEQ ID NO: 9501755 - DNA, 22 bp, Homo sapiens
atgcttctcctgaacatccctg

SEQ ID NO: 9501756 - DNA, 22 bp, Homo sapiens
atgcttctgaagaagaaaagac

SEQ ID NO: 9501757 - DNA, 22 bp, Homo sapiens
atgcttctcctgaacatccctg

SEQ ID NO: 9501758 - DNA, 22 bp, Homo sapiens
atgcttcctcccttccactcaa

SEQ ID NO: 9501759 - DNA, 22 bp, Homo sapiens
atgcttccttaccagaagatga

SEQ ID NO: 9501760 - DNA, 18 bp, Homo sapiens
atgcttctgatagaagca

SEQ ID NO: 9501761 - DNA, 22 bp, Homo sapiens
atgcttctgaagaagaaaagac

SEQ ID NO: 9501762 - DNA, 22 bp, Homo sapiens
atgcttctgctcatatttcatt

SEQ ID NO: 9501763 - DNA, 22 bp, Homo sapiens
agacagtgtgagttcagggtgg

SEQ ID NO: 9501764 - DNA, 22 bp, Homo sapiens
agacataattaattagttctac

SEQ ID NO: 9501765 - DNA, 22 bp, Homo sapiens
agacataagcgagcatcacagg

SEQ ID NO: 9501766 - DNA, 22 bp, Homo sapiens
atgccagggtcatcccctgggt

SEQ ID NO: 9501767 - DNA, 22 bp, Homo sapiens
atgccagggtcatcccctgggt

SEQ ID NO: 9501768 - DNA, 22 bp, Homo sapiens
atgccagggtcatcccctgggt

SEQ ID NO: 9501769 - DNA, 22 bp, Homo sapiens
atgccagggtcccttcagagat

SEQ ID NO: 9501770 - DNA, 22 bp, Homo sapiens
atgccagggtcacagtcatatt

SEQ ID NO: 9501771 - DNA, 22 bp, Homo sapiens
atgccaggctgtttggcctcag

SEQ ID NO: 9501772 - DNA, 22 bp, Homo sapiens
atgccaggtacaggggtagggt

SEQ ID NO: 9501773 - DNA, 23 bp, Homo sapiens
agacagtggccgagaggtactag

SEQ ID NO: 9501774 - DNA, 22 bp, Homo sapiens
agacagtgctatcccatctgtg

SEQ ID NO: 9501775 - DNA, 22 bp, Homo sapiens
atgccattgctttaaaattaag

SEQ ID NO: 9501776 - DNA, 22 bp, Homo sapiens
atgccattgtatattcattgat

SEQ ID NO: 9501777 - DNA, 22 bp, Homo sapiens
atgccaggaacaaacagtggtg

SEQ ID NO: 9501778 - DNA, 22 bp, Homo sapiens
atgccaggaacaaacagtggtg

SEQ ID NO: 9501779 - DNA, 22 bp, Homo sapiens
atgccaggaacaaacagtggtg

SEQ ID NO: 9501780 - DNA, 22 bp, Homo sapiens
atgccaggaacaaacagtggtg

SEQ ID NO: 9501781 - DNA, 22 bp, Homo sapiens
atgccagcctctaagcacttta

SEQ ID NO: 9501782 - DNA, 22 bp, Homo sapiens
atgccagacattaacgactatg

SEQ ID NO: 9501783 - DNA, 22 bp, Homo sapiens
atgccaggctgtttggcctcag

SEQ ID NO: 9501784 - DNA, 23 bp, Homo sapiens
atgccaggctgcctggccagcct

SEQ ID NO: 9501785 - DNA, 22 bp, Homo sapiens
atgccaggagatggagcagagt

SEQ ID NO: 9501786 - DNA, 22 bp, Homo sapiens
atgccaggccccacgctgggca

SEQ ID NO: 9501787 - DNA, 22 bp, Homo sapiens
atgccagaaaatgatggctgca

SEQ ID NO: 9501788 - DNA, 22 bp, Homo sapiens
atgccacttcattccagcctcg

SEQ ID NO: 9501789 - DNA, 22 bp, Homo sapiens
atgccacttcattccagcctcg

SEQ ID NO: 9501790 - DNA, 22 bp, Homo sapiens
atgccacttcattccagcctcg

SEQ ID NO: 9501791 - DNA, 22 bp, Homo sapiens
atgccactgcactccagcctag

SEQ ID NO: 9501792 - DNA, 22 bp, Homo sapiens
atgcaacaaatgctacgaatcg

SEQ ID NO: 9501793 - DNA, 22 bp, Homo sapiens
atgcaacaaattgtgtgcaata

SEQ ID NO: 9501794 - DNA, 19 bp, Homo sapiens
atgcaacaaaagtgtaaga

SEQ ID NO: 9501795 - DNA, 22 bp, Homo sapiens
atgcaaattctttgcttcttct

SEQ ID NO: 9501796 - DNA, 22 bp, Homo sapiens
atgcaaattcttaggctccatc

SEQ ID NO: 9501797 - DNA, 22 bp, Homo sapiens
atgcaaattctttgcttcttct

SEQ ID NO: 9501798 - DNA, 22 bp, Homo sapiens
atgcaaattgccataaagtggg

SEQ ID NO: 9501799 - DNA, 22 bp, Homo sapiens
atgcaaattgccataaagtggg

SEQ ID NO: 9501800 - DNA, 22 bp, Homo sapiens
atgcaaattgccataaagtggg

SEQ ID NO: 9501801 - DNA, 22 bp, Homo sapiens
atgcaacagctgggaatatgta

SEQ ID NO: 9501802 - DNA, 22 bp, Homo sapiens
atgcaacagtcagtacatccgg

SEQ ID NO: 9501803 - DNA, 22 bp, Homo sapiens
atgcaacacccctatggatgga

SEQ ID NO: 9501804 - DNA, 18 bp, Homo sapiens
atgggaggggccaagaga

SEQ ID NO: 9501805 - DNA, 18 bp, Homo sapiens
atgggaggggccaagaga

SEQ ID NO: 9501806 - DNA, 22 bp, Homo sapiens
atgggcagtaacagtggcagtc

SEQ ID NO: 9501807 - DNA, 22 bp, Homo sapiens
atgggcagtaacagtggcagtc

SEQ ID NO: 9501808 - DNA, 22 bp, Homo sapiens
atggacaggtggataggtggat

SEQ ID NO: 9501809 - DNA, 22 bp, Homo sapiens
atgggaggcaggctcagaaccg

SEQ ID NO: 9501810 - DNA, 18 bp, Homo sapiens
atgggaggggccaagaga

SEQ ID NO: 9501811 - DNA, 22 bp, Homo sapiens
atggacaggtactgcagtgggt

SEQ ID NO: 9501812 - DNA, 22 bp, Homo sapiens
atggacaggtactgcagtgggt

SEQ ID NO: 9501813 - DNA, 23 bp, Homo sapiens
atggacagggtttcagggtcaca

SEQ ID NO: 9501814 - DNA, 22 bp, Homo sapiens
atggacaggcttataacagcaa

SEQ ID NO: 9501815 - DNA, 22 bp, Homo sapiens
atggacaggctgagcttcctca

SEQ ID NO: 9501816 - DNA, 22 bp, Homo sapiens
atgggcagttaggaggccagga

SEQ ID NO: 9501817 - DNA, 22 bp, Homo sapiens
atgggccaagtaaacattctca

SEQ ID NO: 9501818 - DNA, 22 bp, Homo sapiens
atgggcctgttcctatgctggt

SEQ ID NO: 9501819 - DNA, 21 bp, Homo sapiens
atgggccagggatacagagag

SEQ ID NO: 9501820 - DNA, 22 bp, Homo sapiens
atgggccacacacgattgggtg

SEQ ID NO: 9501821 - DNA, 22 bp, Homo sapiens
atgggccacacacgattgggtg

SEQ ID NO: 9501822 - DNA, 22 bp, Homo sapiens
atgggcagtgtattggaaggaa

SEQ ID NO: 9501823 - DNA, 22 bp, Homo sapiens
atgggcagtaacagtggcagtc

SEQ ID NO: 9501824 - DNA, 22 bp, Homo sapiens
atgggcagtaacagtggcagtc

SEQ ID NO: 9501825 - DNA, 22 bp, Homo sapiens
atgggcagtaacagtggcagtc

SEQ ID NO: 9501826 - DNA, 22 bp, Homo sapiens
atgggcagttaggaggccagga

SEQ ID NO: 9501827 - DNA, 22 bp, Homo sapiens
atgggcagttaggaggccagga

SEQ ID NO: 9501828 - DNA, 22 bp, Homo sapiens
atgggcagtgtattggaaggaa

SEQ ID NO: 9501829 - DNA, 22 bp, Homo sapiens
atgggcagtgtattggaaggaa

SEQ ID NO: 9501830 - DNA, 22 bp, Homo sapiens
agagaacagtgttttgaaggag

SEQ ID NO: 9501831 - DNA, 22 bp, Homo sapiens
agagaacatgacgtaatagtgg

SEQ ID NO: 9501832 - DNA, 22 bp, Homo sapiens
agagaacatattttgtatgatt

SEQ ID NO: 9501833 - DNA, 22 bp, Homo sapiens
agagaacatattttgtatgatt

SEQ ID NO: 9501834 - DNA, 22 bp, Homo sapiens
agagaacagcctcctagagaaa

SEQ ID NO: 9501835 - DNA, 22 bp, Homo sapiens
agagaacagcctcctagagaaa

SEQ ID NO: 9501836 - DNA, 22 bp, Homo sapiens
agagaacagcctcctagagaaa

SEQ ID NO: 9501837 - DNA, 22 bp, Homo sapiens
agagaacagcattgcagctttg

SEQ ID NO: 9501838 - DNA, 22 bp, Homo sapiens
agagaacattagcaaaaacagc

SEQ ID NO: 9501839 - DNA, 22 bp, Homo sapiens
agagaacattagcaaaaacagc

SEQ ID NO: 9501840 - DNA, 22 bp, Homo sapiens
agagaacattagcaaaaacagc

SEQ ID NO: 9501841 - DNA, 22 bp, Homo sapiens
agagaacattagcaaaaacagc

SEQ ID NO: 9501842 - DNA, 22 bp, Homo sapiens
agagaacattagcaaaaacagc

SEQ ID NO: 9501843 - DNA, 22 bp, Homo sapiens
agagaacatgacgtaatagtgg

SEQ ID NO: 9501844 - DNA, 22 bp, Homo sapiens
agagaactgtttctggggtctt

SEQ ID NO: 9501845 - DNA, 22 bp, Homo sapiens
agagaactactttttatatgtg

SEQ ID NO: 9501846 - DNA, 22 bp, Homo sapiens
agagaagacttacagccacagt

SEQ ID NO: 9501847 - DNA, 22 bp, Homo sapiens
agagaagacttacagccacagt

SEQ ID NO: 9501848 - DNA, 22 bp, Homo sapiens
agagaagacttacagccacagt

SEQ ID NO: 9501849 - DNA, 22 bp, Homo sapiens
agagaagacttacagccacagt

SEQ ID NO: 9501850 - DNA, 22 bp, Homo sapiens
atggaatgtttcctcttttatt

SEQ ID NO: 9501851 - DNA, 22 bp, Homo sapiens
atggaatgtttatacacagttg

SEQ ID NO: 9501852 - DNA, 22 bp, Homo sapiens
atggaatgtttatacacagttg

SEQ ID NO: 9501853 - DNA, 21 bp, Homo sapiens
atggacaattgagtgtctgtc

SEQ ID NO: 9501854 - DNA, 22 bp, Homo sapiens
atggacaatgccaatacagttt

SEQ ID NO: 9501855 - DNA, 22 bp, Homo sapiens
atggacagcaactggaagcttc

SEQ ID NO: 9501856 - DNA, 22 bp, Homo sapiens
atggacagctcttatgtgggca

SEQ ID NO: 9501857 - DNA, 22 bp, Homo sapiens
atggacagctggcctcaaggga

SEQ ID NO: 9501858 - DNA, 22 bp, Homo sapiens
atggacagattaacacagtaga

SEQ ID NO: 9501859 - DNA, 22 bp, Homo sapiens
atggacagattaacacagtaga

SEQ ID NO: 9501860 - DNA, 22 bp, Homo sapiens
agagactggcttctaaaatggc

SEQ ID NO: 9501861 - DNA, 22 bp, Homo sapiens
agagactgtaatgagaggtaca

SEQ ID NO: 9501862 - DNA, 22 bp, Homo sapiens
agagactgtaatgagaggtaca

SEQ ID NO: 9501863 - DNA, 22 bp, Homo sapiens
agagactgtaatgagaggtaca

SEQ ID NO: 9501864 - DNA, 22 bp, Homo sapiens
agagactggagatgggcagtgt

SEQ ID NO: 9501865 - DNA, 22 bp, Homo sapiens
agagactgcgtgtcagcgctgg

SEQ ID NO: 9501866 - DNA, 19 bp, Homo sapiens
agagactgccaccagctgt

SEQ ID NO: 9501867 - DNA, 22 bp, Homo sapiens
atgggctcggcgctgctgggat

SEQ ID NO: 9501868 - DNA, 22 bp, Homo sapiens
agagactgcaatgagtggtagg

SEQ ID NO: 9501869 - DNA, 22 bp, Homo sapiens
agagactgcaatgagtggtagg

SEQ ID NO: 9501870 - DNA, 22 bp, Homo sapiens
agagactgcaatgagtggtagg

SEQ ID NO: 9501871 - DNA, 22 bp, Homo sapiens
agagactgatggagctcactct

SEQ ID NO: 9501872 - DNA, 22 bp, Homo sapiens
agagactgatggatcaccaaat

SEQ ID NO: 9501873 - DNA, 17 bp, Homo sapiens
agagagaaaagggccat

SEQ ID NO: 9501874 - DNA, 22 bp, Homo sapiens
agagacttctgccttagcaaga

SEQ ID NO: 9501875 - DNA, 22 bp, Homo sapiens
agagactgtgccagccccatgc

SEQ ID NO: 9501876 - DNA, 22 bp, Homo sapiens
agagactgtcacataacagagg

SEQ ID NO: 9501877 - DNA, 22 bp, Homo sapiens
atgtagggaactaaattcactg

SEQ ID NO: 9501878 - DNA, 21 bp, Homo sapiens
atgtagggtttgccttctcta

SEQ ID NO: 9501879 - DNA, 22 bp, Homo sapiens
atgtacatactgcattttcaaa

SEQ ID NO: 9501880 - DNA, 22 bp, Homo sapiens
agagagaagcaatcagtggcca

SEQ ID NO: 9501881 - DNA, 18 bp, Homo sapiens
agagatgggagttggaaa

SEQ ID NO: 9501882 - DNA, 22 bp, Homo sapiens
agagatgggcgggggcttctgc

SEQ ID NO: 9501883 - DNA, 20 bp, Homo sapiens
agagatggggtatcaccgta

SEQ ID NO: 9501884 - DNA, 22 bp, Homo sapiens
agagatggtagaacagtcataa

SEQ ID NO: 9501885 - DNA, 22 bp, Homo sapiens
agagatgggaaggcagacttca

SEQ ID NO: 9501886 - DNA, 18 bp, Homo sapiens
agagatgggagttggaaa

SEQ ID NO: 9501887 - DNA, 22 bp, Homo sapiens
atgtatatgcatgcattcaaag

SEQ ID NO: 9501888 - DNA, 22 bp, Homo sapiens
agagatggcgtctcagagcctg

SEQ ID NO: 9501889 - DNA, 22 bp, Homo sapiens
agagatggcgtctcagagcctg

SEQ ID NO: 9501890 - DNA, 22 bp, Homo sapiens
atgtataggagttatctgttgt

SEQ ID NO: 9501891 - DNA, 22 bp, Homo sapiens
atgtataatgctaattagctag

SEQ ID NO: 9501892 - DNA, 22 bp, Homo sapiens
atgtataatgctaattagctag

SEQ ID NO: 9501893 - DNA, 22 bp, Homo sapiens
atgtatatacttacatgtgtgg

SEQ ID NO: 9501894 - DNA, 21 bp, Homo sapiens
atgtagtgacttcattccttc

SEQ ID NO: 9501895 - DNA, 22 bp, Homo sapiens
atgtagtgccctttgtcatcta

SEQ ID NO: 9501896 - DNA, 22 bp, Homo sapiens
atgtagtgtagagattagtctc

SEQ ID NO: 9501897 - DNA, 22 bp, Homo sapiens
atgtagtgccctttgtcatcta

SEQ ID NO: 9501898 - DNA, 21 bp, Homo sapiens
atgtagggtttgccttctcta

SEQ ID NO: 9501899 - DNA, 22 bp, Homo sapiens
atgtagtttggggctagattta

SEQ ID NO: 9501900 - DNA, 22 bp, Homo sapiens
atgtagttagaagattcaaaca

SEQ ID NO: 9501901 - DNA, 22 bp, Homo sapiens
atgtagttgaagtgctataaag

SEQ ID NO: 9501902 - DNA, 21 bp, Homo sapiens
agagctcaaggcaaaaataat

SEQ ID NO: 9501903 - DNA, 22 bp, Homo sapiens
agagctataacagcactgtaca

SEQ ID NO: 9501904 - DNA, 22 bp, Homo sapiens
agagctccagggttttgtagtg

SEQ ID NO: 9501905 - DNA, 22 bp, Homo sapiens
attaaatactgcaggctaagca

SEQ ID NO: 9501906 - DNA, 22 bp, Homo sapiens
attaaatactgcaggctaagca

SEQ ID NO: 9501907 - DNA, 22 bp, Homo sapiens
agagctctgcagctggcctcag

SEQ ID NO: 9501908 - DNA, 22 bp, Homo sapiens
agagctctggcctattggggcc

SEQ ID NO: 9501909 - DNA, 22 bp, Homo sapiens
agagctctgcagctggcctcag

SEQ ID NO: 9501910 - DNA, 22 bp, Homo sapiens
attaaggaggtaaactatggtt

SEQ ID NO: 9501911 - DNA, 18 bp, Homo sapiens
attaaggaattctttaga

SEQ ID NO: 9501912 - DNA, 22 bp, Homo sapiens
attaaggaatgtaggcaagaag

SEQ ID NO: 9501913 - DNA, 22 bp, Homo sapiens
attaagtgactaaagtaatgct

SEQ ID NO: 9501914 - DNA, 22 bp, Homo sapiens
attaagtgactaaagtaatgct

SEQ ID NO: 9501915 - DNA, 22 bp, Homo sapiens
attaagtgactaaagtaatgct

SEQ ID NO: 9501916 - DNA, 22 bp, Homo sapiens
attaagtgactaaagtaatgct

SEQ ID NO: 9501917 - DNA, 22 bp, Homo sapiens
attaagtgactaaagtaatgct

SEQ ID NO: 9501918 - DNA, 22 bp, Homo sapiens
attaagtgactaaagtaatgct

SEQ ID NO: 9501919 - DNA, 22 bp, Homo sapiens
atgttctacagatggaaagggg

SEQ ID NO: 9501920 - DNA, 22 bp, Homo sapiens
atgttctacagatggaaagggg

SEQ ID NO: 9501921 - DNA, 22 bp, Homo sapiens
atgttcctttaaaatatagatt

SEQ ID NO: 9501922 - DNA, 22 bp, Homo sapiens
atgttctaatccctgctatgta

SEQ ID NO: 9501923 - DNA, 22 bp, Homo sapiens
atgttctatatcattattgtga

SEQ ID NO: 9501924 - DNA, 22 bp, Homo sapiens
agagctaagaaacagaattgct

SEQ ID NO: 9501925 - DNA, 22 bp, Homo sapiens
agagctaaatcagactttcttt

SEQ ID NO: 9501926 - DNA, 22 bp, Homo sapiens
agagcggggatagttaatattc

SEQ ID NO: 9501927 - DNA, 22 bp, Homo sapiens
atgttcatgtggctgctggcag

SEQ ID NO: 9501928 - DNA, 22 bp, Homo sapiens
atgttcatgattggttttggcg

SEQ ID NO: 9501929 - DNA, 22 bp, Homo sapiens
atgttcatcaacacattacaag

SEQ ID NO: 9501930 - DNA, 22 bp, Homo sapiens
atgttcctcattcttgcaaccc

SEQ ID NO: 9501931 - DNA, 22 bp, Homo sapiens
atgttcctgatcctcgttctat

SEQ ID NO: 9501932 - DNA, 22 bp, Homo sapiens
atgttcctggtatatcatgacc

SEQ ID NO: 9501933 - DNA, 22 bp, Homo sapiens
atgttcctggtatatcatgacc

SEQ ID NO: 9501934 - DNA, 22 bp, Homo sapiens
atgttccttccagagagcagaa

SEQ ID NO: 9501935 - DNA, 22 bp, Homo sapiens
atgttcagcattctataaatat

SEQ ID NO: 9501936 - DNA, 18 bp, Homo sapiens
atgttcatatttttaggg

SEQ ID NO: 9501937 - DNA, 22 bp, Homo sapiens
atgttcaaagatcgtgctatcc

SEQ ID NO: 9501938 - DNA, 22 bp, Homo sapiens
atgttcaagtacctttgtgtct

SEQ ID NO: 9501939 - DNA, 22 bp, Homo sapiens
atgttcaaactttttacacacc

SEQ ID NO: 9501940 - DNA, 22 bp, Homo sapiens
atgttcaaacaagttaatgcca

SEQ ID NO: 9501941 - DNA, 22 bp, Homo sapiens
atgttcaaactttttacacacc

SEQ ID NO: 9501942 - DNA, 22 bp, Homo sapiens
agagccagcatttgacactggc

SEQ ID NO: 9501943 - DNA, 22 bp, Homo sapiens
agagccagcatttgacactggc

SEQ ID NO: 9501944 - DNA, 22 bp, Homo sapiens
agagccagccttctcagcttac

SEQ ID NO: 9501945 - DNA, 22 bp, Homo sapiens
agagccaggaagtggcgtgggg

SEQ ID NO: 9501946 - DNA, 22 bp, Homo sapiens
agagccagccttctcagcttac

SEQ ID NO: 9501947 - DNA, 22 bp, Homo sapiens
agagccagcatttgacactggc

SEQ ID NO: 9501948 - DNA, 22 bp, Homo sapiens
agagccagcatttgggccctgc

SEQ ID NO: 9501949 - DNA, 22 bp, Homo sapiens
agagccaggatgtcttctgggg

SEQ ID NO: 9501950 - DNA, 22 bp, Homo sapiens
agagccaggatgtcttctgggg

SEQ ID NO: 9501951 - DNA, 22 bp, Homo sapiens
atgttattttggaaaatacaaa

SEQ ID NO: 9501952 - DNA, 22 bp, Homo sapiens
atgttattttggaaaatacaaa

SEQ ID NO: 9501953 - DNA, 22 bp, Homo sapiens
atgttacagaaagcaaagatga

SEQ ID NO: 9501954 - DNA, 22 bp, Homo sapiens
agagccaggactgtgtctcact

SEQ ID NO: 9501955 - DNA, 22 bp, Homo sapiens
agagccaggactgtgtctcact

SEQ ID NO: 9501956 - DNA, 22 bp, Homo sapiens
agagccaggactgtgtctcact

SEQ ID NO: 9501957 - DNA, 22 bp, Homo sapiens
agagccaggactgtgtctcact

SEQ ID NO: 9501958 - DNA, 22 bp, Homo sapiens
agagccaggaagtggcgtgggg

SEQ ID NO: 9501959 - DNA, 22 bp, Homo sapiens
agagccaggaagtggcgtgggg

SEQ ID NO: 9501960 - DNA, 21 bp, Homo sapiens
atgtgcagcaagcagcatgct

SEQ ID NO: 9501961 - DNA, 22 bp, Homo sapiens
atgtgcagttggtggccaggag

SEQ ID NO: 9501962 - DNA, 22 bp, Homo sapiens
atgtgatcaagaatgtgggaga

SEQ ID NO: 9501963 - DNA, 22 bp, Homo sapiens
atgtgattcccactgaatcact

SEQ ID NO: 9501964 - DNA, 22 bp, Homo sapiens
atgtgagtgctatgatagacag

SEQ ID NO: 9501965 - DNA, 22 bp, Homo sapiens
atgtcttctgtggagacaggta

SEQ ID NO: 9501966 - DNA, 22 bp, Homo sapiens
agagattcatgtttactgtagg

SEQ ID NO: 9501967 - DNA, 22 bp, Homo sapiens
agagattcctttggggaaagca

SEQ ID NO: 9501968 - DNA, 22 bp, Homo sapiens
agagattctgtgtcaaaacgaa

SEQ ID NO: 9501969 - DNA, 22 bp, Homo sapiens
agagatggtagaacagtcataa

SEQ ID NO: 9501970 - DNA, 22 bp, Homo sapiens
agagatggtagaacagtcataa

SEQ ID NO: 9501971 - DNA, 18 bp, Homo sapiens
agagatggtgtagagttt

SEQ ID NO: 9501972 - DNA, 18 bp, Homo sapiens
agagatggtgtagagttt

SEQ ID NO: 9501973 - DNA, 22 bp, Homo sapiens
agagatgtagcaaagaaccaca

SEQ ID NO: 9501974 - DNA, 22 bp, Homo sapiens
agagatgtcgccttgcccaggg

SEQ ID NO: 9501975 - DNA, 22 bp, Homo sapiens
attcaaaagaccatgcagactc

SEQ ID NO: 9501976 - DNA, 22 bp, Homo sapiens
attcaaaagaccatgcagactc

SEQ ID NO: 9501977 - DNA, 22 bp, Homo sapiens
attcaaaccccatagacaactt

SEQ ID NO: 9501978 - DNA, 22 bp, Homo sapiens
attcaaaccccatagacaactt

SEQ ID NO: 9501979 - DNA, 22 bp, Homo sapiens
attcaaacactttgagaagttc

SEQ ID NO: 9501980 - DNA, 22 bp, Homo sapiens
attcaaacaggaagaaatcatt

SEQ ID NO: 9501981 - DNA, 22 bp, Homo sapiens
attcaaacaggaagaaatcatt

SEQ ID NO: 9501982 - DNA, 22 bp, Homo sapiens
attcaaacaggaagaaatcatt

SEQ ID NO: 9501983 - DNA, 22 bp, Homo sapiens
attcccataggcaatgcgtgat

SEQ ID NO: 9501984 - DNA, 22 bp, Homo sapiens
attcccatatatgtttgtcgct

SEQ ID NO: 9501985 - DNA, 22 bp, Homo sapiens
attcccatgtctttacctgttg

SEQ ID NO: 9501986 - DNA, 22 bp, Homo sapiens
attcccatctctgagtggaagg

SEQ ID NO: 9501987 - DNA, 22 bp, Homo sapiens
attcaaactgtgttaggcagca

SEQ ID NO: 9501988 - DNA, 22 bp, Homo sapiens
attcaaagaacctttagcattg

SEQ ID NO: 9501989 - DNA, 22 bp, Homo sapiens
attctacaaaagaactggatct

SEQ ID NO: 9501990 - DNA, 22 bp, Homo sapiens
attctaattagttctacatgtt

SEQ ID NO: 9501991 - DNA, 22 bp, Homo sapiens
attctaatggcagagactcctg

SEQ ID NO: 9501992 - DNA, 22 bp, Homo sapiens
attctaatgccctggccccagc

SEQ ID NO: 9501993 - DNA, 22 bp, Homo sapiens
attctaagtgcttgtggtggtt

SEQ ID NO: 9501994 - DNA, 22 bp, Homo sapiens
attctaagcacgctgaagtctt

SEQ ID NO: 9501995 - DNA, 22 bp, Homo sapiens
attctaagcacgctgaagtctt

SEQ ID NO: 9501996 - DNA, 23 bp, Homo sapiens
attctaagatgtgatcttataac

SEQ ID NO: 9501997 - DNA, 22 bp, Homo sapiens
attctaagcacgctgaagtctt

SEQ ID NO: 9501998 - DNA, 20 bp, Homo sapiens
attctaaagctctgctcttt

SEQ ID NO: 9501999 - DNA, 22 bp, Homo sapiens
attctaaagcttgtggagctta

SEQ ID NO: 9502000 - DNA, 22 bp, Homo sapiens
attctaaatcagagagctctgt

SEQ ID NO: 9502001 - DNA, 22 bp, Homo sapiens
attctaaagcttgtggagctta

SEQ ID NO: 9502002 - DNA, 22 bp, Homo sapiens
attctaaatcagagagctctgt

SEQ ID NO: 9502003 - DNA, 22 bp, Homo sapiens
attctaaatcagagagctctgt

SEQ ID NO: 9502004 - DNA, 20 bp, Homo sapiens
attctctgacaccgcccccg

SEQ ID NO: 9502005 - DNA, 22 bp, Homo sapiens
attctctgggttccagtaaatg

SEQ ID NO: 9502006 - DNA, 22 bp, Homo sapiens
attctctggctaaaacctgaag

SEQ ID NO: 9502007 - DNA, 19 bp, Homo sapiens
attcttctcttcctgctgt

SEQ ID NO: 9502008 - DNA, 22 bp, Homo sapiens
attcttctgcctactttcatcc

SEQ ID NO: 9502009 - DNA, 22 bp, Homo sapiens
attgaaaaatgactattgctta

SEQ ID NO: 9502010 - DNA, 22 bp, Homo sapiens
attgaaaaatgactattgctta

SEQ ID NO: 9502011 - DNA, 22 bp, Homo sapiens
attctccactgtaaggttatta

SEQ ID NO: 9502012 - DNA, 22 bp, Homo sapiens
attctccagtagtcattctatc

SEQ ID NO: 9502013 - DNA, 22 bp, Homo sapiens
attctccactgtaaggttatta

SEQ ID NO: 9502014 - DNA, 22 bp, Homo sapiens
attctccagctcactgtccata

SEQ ID NO: 9502015 - DNA, 22 bp, Homo sapiens
attctccatcaccactggcact

SEQ ID NO: 9502016 - DNA, 22 bp, Homo sapiens
attctccatcaccactggcact

SEQ ID NO: 9502017 - DNA, 20 bp, Homo sapiens
attctccctatactcacttt

SEQ ID NO: 9502018 - DNA, 22 bp, Homo sapiens
attctccctgttcctcgacacc

SEQ ID NO: 9502019 - DNA, 22 bp, Homo sapiens
attctctctagaagctgagatg

SEQ ID NO: 9502020 - DNA, 22 bp, Homo sapiens
agaggcctaattgctacccttt

SEQ ID NO: 9502021 - DNA, 22 bp, Homo sapiens
agaggcctaaccaagatgtcct

SEQ ID NO: 9502022 - DNA, 22 bp, Homo sapiens
agaggcctcaaaccagacctga

SEQ ID NO: 9502023 - DNA, 19 bp, Homo sapiens
agaggcctcagcagctggc

SEQ ID NO: 9502024 - DNA, 22 bp, Homo sapiens
agaggccggccgagcccatggg

SEQ ID NO: 9502025 - DNA, 22 bp, Homo sapiens
agaggccggccgagcccatggg

SEQ ID NO: 9502026 - DNA, 22 bp, Homo sapiens
agaggccctgggctggtgtgct

SEQ ID NO: 9502027 - DNA, 22 bp, Homo sapiens
agaggccctggctagagcagct

SEQ ID NO: 9502028 - DNA, 22 bp, Homo sapiens
agaggccctggctagagcagct

SEQ ID NO: 9502029 - DNA, 22 bp, Homo sapiens
agaggccctggctagagcagct

SEQ ID NO: 9502030 - DNA, 22 bp, Homo sapiens
agaggccctgggctggtgtgct

SEQ ID NO: 9502031 - DNA, 22 bp, Homo sapiens
agaggcctctttgcaagtaggt

SEQ ID NO: 9502032 - DNA, 22 bp, Homo sapiens
attatttctcactcacataata

SEQ ID NO: 9502033 - DNA, 22 bp, Homo sapiens
attatttgacttgagaacaggt

SEQ ID NO: 9502034 - DNA, 22 bp, Homo sapiens
agaggcctctgttgttcagacg

SEQ ID NO: 9502035 - DNA, 22 bp, Homo sapiens
agaggcctctagggcccctcag

SEQ ID NO: 9502036 - DNA, 22 bp, Homo sapiens
attattttatgtgcggcctgat

SEQ ID NO: 9502037 - DNA, 22 bp, Homo sapiens
attattttatgtgcggcctgat

SEQ ID NO: 9502038 - DNA, 22 bp, Homo sapiens
attattttatgtgcggcctgat

SEQ ID NO: 9502039 - DNA, 22 bp, Homo sapiens
attatttgtgtccacagaatac

SEQ ID NO: 9502040 - DNA, 22 bp, Homo sapiens
attatttggaataggcattgca

SEQ ID NO: 9502041 - DNA, 22 bp, Homo sapiens
agagcttttacttacattctat

SEQ ID NO: 9502042 - DNA, 22 bp, Homo sapiens
agagctttgtttgattgtcaga

SEQ ID NO: 9502043 - DNA, 22 bp, Homo sapiens
agagcttttacttacattctat

SEQ ID NO: 9502044 - DNA, 22 bp, Homo sapiens
agagcttttgggaattcaggta

SEQ ID NO: 9502045 - DNA, 22 bp, Homo sapiens
agagcttttctgtaataacatc

SEQ ID NO: 9502046 - DNA, 22 bp, Homo sapiens
attaatacattatagggattgt

SEQ ID NO: 9502047 - DNA, 22 bp, Homo sapiens
agagcttagaatttcagatgat

SEQ ID NO: 9502048 - DNA, 23 bp, Homo sapiens
agagcttagggaattcacatgag

SEQ ID NO: 9502049 - DNA, 22 bp, Homo sapiens
agagcttatatcttggccatcc

SEQ ID NO: 9502050 - DNA, 22 bp, Homo sapiens
agagcttagggggctttgcatc

SEQ ID NO: 9502051 - DNA, 22 bp, Homo sapiens
attaataaaataccactttgtt

SEQ ID NO: 9502052 - DNA, 22 bp, Homo sapiens
attaataaaataccactttgtt

SEQ ID NO: 9502053 - DNA, 22 bp, Homo sapiens
attaataaaataccactttgtt

SEQ ID NO: 9502054 - DNA, 22 bp, Homo sapiens
attaataaaataccactttgtt

SEQ ID NO: 9502055 - DNA, 22 bp, Homo sapiens
attaataaaataccactttgtt

SEQ ID NO: 9502056 - DNA, 22 bp, Homo sapiens
agaggaaacataggtttttaaa

SEQ ID NO: 9502057 - DNA, 22 bp, Homo sapiens
agaggaaaatgagttccagaat

SEQ ID NO: 9502058 - DNA, 22 bp, Homo sapiens
agagctttttgacatctctcta

SEQ ID NO: 9502059 - DNA, 22 bp, Homo sapiens
agaggaaatggataaagggtga

SEQ ID NO: 9502060 - DNA, 21 bp, Homo sapiens
agaggaagaagagtgtattat

SEQ ID NO: 9502061 - DNA, 22 bp, Homo sapiens
agaggaacccagacagggcttt

SEQ ID NO: 9502062 - DNA, 22 bp, Homo sapiens
agaggccctctctgctcagtct

SEQ ID NO: 9502063 - DNA, 22 bp, Homo sapiens
agaggccctggctagagcagct

SEQ ID NO: 9502064 - DNA, 22 bp, Homo sapiens
agaggccctctctgctcagtct

SEQ ID NO: 9502065 - DNA, 22 bp, Homo sapiens
agaggccagggacactgctcaa

SEQ ID NO: 9502066 - DNA, 22 bp, Homo sapiens
agaggccagggacactgctcaa

SEQ ID NO: 9502067 - DNA, 22 bp, Homo sapiens
agaggccagggacactgctcaa

SEQ ID NO: 9502068 - DNA, 22 bp, Homo sapiens
agaggccaggtccagagtttgt

SEQ ID NO: 9502069 - DNA, 22 bp, Homo sapiens
agaggaagattttattaaccag

SEQ ID NO: 9502070 - DNA, 22 bp, Homo sapiens
agaggaagccattgcttactga

SEQ ID NO: 9502071 - DNA, 22 bp, Homo sapiens
agatacaagaggcctgacgtgt

SEQ ID NO: 9502072 - DNA, 22 bp, Homo sapiens
agatacaactgtttaaacatta

SEQ ID NO: 9502073 - DNA, 22 bp, Homo sapiens
agatacaactgtttaaacatta

SEQ ID NO: 9502074 - DNA, 22 bp, Homo sapiens
agatacaagttaagagaaagga

SEQ ID NO: 9502075 - DNA, 22 bp, Homo sapiens
agatacaagttaagagaaagga

SEQ ID NO: 9502076 - DNA, 22 bp, Homo sapiens
agatacaagttaagagaaagga

SEQ ID NO: 9502077 - DNA, 22 bp, Homo sapiens
agatacaaggcagagatgtgca

SEQ ID NO: 9502078 - DNA, 22 bp, Homo sapiens
atttacagacgtggattagtgc

SEQ ID NO: 9502079 - DNA, 22 bp, Homo sapiens
agatacagcctgccaggttctt

SEQ ID NO: 9502080 - DNA, 23 bp, Homo sapiens
agatacagatctacgtgtcaatg

SEQ ID NO: 9502081 - DNA, 22 bp, Homo sapiens
agatacagcctgccaggttctt

SEQ ID NO: 9502082 - DNA, 22 bp, Homo sapiens
atttacagatgatgctatttga

SEQ ID NO: 9502083 - DNA, 22 bp, Homo sapiens
agatacaccggaacctgaggct

SEQ ID NO: 9502084 - DNA, 22 bp, Homo sapiens
agatacaaaagataagatttag

SEQ ID NO: 9502085 - DNA, 22 bp, Homo sapiens
agatacaaaagataagatttag

SEQ ID NO: 9502086 - DNA, 22 bp, Homo sapiens
agataatttgagtaaattaatt

SEQ ID NO: 9502087 - DNA, 22 bp, Homo sapiens
agataatttgagtaaattaatt

SEQ ID NO: 9502088 - DNA, 22 bp, Homo sapiens
agatacaaaaagggagaagatt

SEQ ID NO: 9502089 - DNA, 22 bp, Homo sapiens
agatacaaaggcctacagagca

SEQ ID NO: 9502090 - DNA, 22 bp, Homo sapiens
agatacaactgtttaaacatta

SEQ ID NO: 9502091 - DNA, 22 bp, Homo sapiens
agatacaactcagaagtgtggt

SEQ ID NO: 9502092 - DNA, 22 bp, Homo sapiens
attgttaataactattacattg

SEQ ID NO: 9502093 - DNA, 22 bp, Homo sapiens
agataattatttacttcaaagt

SEQ ID NO: 9502094 - DNA, 22 bp, Homo sapiens
agataattatttacttcaaagt

SEQ ID NO: 9502095 - DNA, 22 bp, Homo sapiens
agataattatgtcaatttcttg

SEQ ID NO: 9502096 - DNA, 22 bp, Homo sapiens
agataaattcctaagatttcag

SEQ ID NO: 9502097 - DNA, 22 bp, Homo sapiens
agataaattcctaagatttcag

SEQ ID NO: 9502098 - DNA, 22 bp, Homo sapiens
agataattatgtcaatttcttg

SEQ ID NO: 9502099 - DNA, 22 bp, Homo sapiens
attgttaaagtaataaccatgg

SEQ ID NO: 9502100 - DNA, 22 bp, Homo sapiens
attgttaataactattacattg

SEQ ID NO: 9502101 - DNA, 22 bp, Homo sapiens
attgttaaagtaataaccatgg

SEQ ID NO: 9502102 - DNA, 22 bp, Homo sapiens
attgttaaagtaataaccatgg

SEQ ID NO: 9502103 - DNA, 22 bp, Homo sapiens
attgttaaactgaagcattact

SEQ ID NO: 9502104 - DNA, 22 bp, Homo sapiens
attgttaaaaaggtggaaatgc

SEQ ID NO: 9502105 - DNA, 22 bp, Homo sapiens
attgtgtggtgaatgatcagct

SEQ ID NO: 9502106 - DNA, 22 bp, Homo sapiens
attgttaaactgaagcattact

SEQ ID NO: 9502107 - DNA, 19 bp, Homo sapiens
attgtgtcaatggtgttca

SEQ ID NO: 9502108 - DNA, 22 bp, Homo sapiens
attgtgtcctcattgaccttca

SEQ ID NO: 9502109 - DNA, 22 bp, Homo sapiens
attgtggtgtcagttataggca

SEQ ID NO: 9502110 - DNA, 22 bp, Homo sapiens
attgtggtgtcagttataggca

SEQ ID NO: 9502111 - DNA, 22 bp, Homo sapiens
attgtattataattaggccaaa

SEQ ID NO: 9502112 - DNA, 22 bp, Homo sapiens
attgtattagcacaatacaatt

SEQ ID NO: 9502113 - DNA, 22 bp, Homo sapiens
attgtattagcacaatacaatt

SEQ ID NO: 9502114 - DNA, 22 bp, Homo sapiens
attgtattagcacaatacaatt

SEQ ID NO: 9502115 - DNA, 22 bp, Homo sapiens
attgtattagcacaatacaatt

SEQ ID NO: 9502116 - DNA, 22 bp, Homo sapiens
attgtattagcacaatacaatt

SEQ ID NO: 9502117 - DNA, 22 bp, Homo sapiens
attgtatttaggagaaaagggt

SEQ ID NO: 9502118 - DNA, 22 bp, Homo sapiens
attgtattctgcacctttgtta

SEQ ID NO: 9502119 - DNA, 22 bp, Homo sapiens
attgtatttccagcttgaatgt

SEQ ID NO: 9502120 - DNA, 22 bp, Homo sapiens
attgtattcagttacaggtctt

SEQ ID NO: 9502121 - DNA, 22 bp, Homo sapiens
attgtattctgcacctttgtta

SEQ ID NO: 9502122 - DNA, 22 bp, Homo sapiens
attgtatttccagcttgaatgt

SEQ ID NO: 9502123 - DNA, 22 bp, Homo sapiens
attgtatttccagcttgaatgt

SEQ ID NO: 9502124 - DNA, 22 bp, Homo sapiens
attgtatttccagcttgaatgt

SEQ ID NO: 9502125 - DNA, 22 bp, Homo sapiens
attgtatttccagcttgaatgt

SEQ ID NO: 9502126 - DNA, 22 bp, Homo sapiens
attgtatttccagcttgaatgt

SEQ ID NO: 9502127 - DNA, 22 bp, Homo sapiens
attgaaaataaggccagaaaca

SEQ ID NO: 9502128 - DNA, 22 bp, Homo sapiens
attgaaaataaggccagaaaca

SEQ ID NO: 9502129 - DNA, 22 bp, Homo sapiens
attgaaaaattcacaattctgg

SEQ ID NO: 9502130 - DNA, 22 bp, Homo sapiens
attgaaaaatgactattgctta

SEQ ID NO: 9502131 - DNA, 22 bp, Homo sapiens
attgaaaaatgactattgctta

SEQ ID NO: 9502132 - DNA, 22 bp, Homo sapiens
attgaaaatataattctaggag

SEQ ID NO: 9502133 - DNA, 22 bp, Homo sapiens
attgaaaatataattctaggag

SEQ ID NO: 9502134 - DNA, 22 bp, Homo sapiens
attgaaatacataaaattgcca

SEQ ID NO: 9502135 - DNA, 22 bp, Homo sapiens
attgagaagcttgcagattttt

SEQ ID NO: 9502136 - DNA, 22 bp, Homo sapiens
attgagaagaaaatctaatata

SEQ ID NO: 9502137 - DNA, 22 bp, Homo sapiens
attgagaaaggcttatgtttgc

SEQ ID NO: 9502138 - DNA, 22 bp, Homo sapiens
attgagaaatataatctggaaa

SEQ ID NO: 9502139 - DNA, 22 bp, Homo sapiens
attgagaaaggcttatgtttgc

SEQ ID NO: 9502140 - DNA, 22 bp, Homo sapiens
attgagaaaattcgagcaagtt

SEQ ID NO: 9502141 - DNA, 22 bp, Homo sapiens
attgagaaaataagtatggata

SEQ ID NO: 9502142 - DNA, 22 bp, Homo sapiens
attgtataacagcatgtatttt

SEQ ID NO: 9502143 - DNA, 22 bp, Homo sapiens
attgtataacagcatgtatttt

SEQ ID NO: 9502144 - DNA, 22 bp, Homo sapiens
attgtataagtctatttacaat

SEQ ID NO: 9502145 - DNA, 22 bp, Homo sapiens
attgtataacagcatgtatttt

SEQ ID NO: 9502146 - DNA, 22 bp, Homo sapiens
attgtatacaagcttaattgtt

SEQ ID NO: 9502147 - DNA, 22 bp, Homo sapiens
attgtatacaagcttaattgtt

SEQ ID NO: 9502148 - DNA, 22 bp, Homo sapiens
attgtatacaagcttaattgtt

SEQ ID NO: 9502149 - DNA, 22 bp, Homo sapiens
attgtataagtctatttacaat

SEQ ID NO: 9502150 - DNA, 22 bp, Homo sapiens
attgagcacctacagtattacc

SEQ ID NO: 9502151 - DNA, 22 bp, Homo sapiens
attgagcacatgctatgtgcca

SEQ ID NO: 9502152 - DNA, 22 bp, Homo sapiens
attgagatctgcatcataagct

SEQ ID NO: 9502153 - DNA, 22 bp, Homo sapiens
attgagcacctactatgtgcta

SEQ ID NO: 9502154 - DNA, 22 bp, Homo sapiens
attgaggagcagagatggggta

SEQ ID NO: 9502155 - DNA, 23 bp, Homo sapiens
attgagaaggatacattgttctc

SEQ ID NO: 9502156 - DNA, 22 bp, Homo sapiens
attgagaatatgatttagtata

SEQ ID NO: 9502157 - DNA, 22 bp, Homo sapiens
attgagaatccatttgagatga

SEQ ID NO: 9502158 - DNA, 22 bp, Homo sapiens
attgagaatccatttgagatga

SEQ ID NO: 9502159 - DNA, 22 bp, Homo sapiens
attgagaattgtgagtttggag

SEQ ID NO: 9502160 - DNA, 23 bp, Homo sapiens
atttacagctgtgtgagcaagtt

SEQ ID NO: 9502161 - DNA, 22 bp, Homo sapiens
atttacaggacagcttggcatt

SEQ ID NO: 9502162 - DNA, 22 bp, Homo sapiens
atttacaggtagaattttaagt

SEQ ID NO: 9502163 - DNA, 22 bp, Homo sapiens
atttacaggacagcttggcatt

SEQ ID NO: 9502164 - DNA, 22 bp, Homo sapiens
atttacaggacagcttggcatt

SEQ ID NO: 9502165 - DNA, 22 bp, Homo sapiens
atttacagccttgaaaacagca

SEQ ID NO: 9502166 - DNA, 22 bp, Homo sapiens
atttacagccttgaaaacagca

SEQ ID NO: 9502167 - DNA, 22 bp, Homo sapiens
atttacagccttgaaaacagca

SEQ ID NO: 9502168 - DNA, 22 bp, Homo sapiens
atttacagccttgccatctata

SEQ ID NO: 9502169 - DNA, 23 bp, Homo sapiens
atttacagctgtgtgagcaagtt

SEQ ID NO: 9502170 - DNA, 22 bp, Homo sapiens
atttacagccttgaaaacagca

SEQ ID NO: 9502171 - DNA, 22 bp, Homo sapiens
atttacagccttgaaaacagca

SEQ ID NO: 9502172 - DNA, 23 bp, Homo sapiens
atttgaaactttcttgtttccag

SEQ ID NO: 9502173 - DNA, 23 bp, Homo sapiens
atttgaaactttcttgtttccag

SEQ ID NO: 9502174 - DNA, 22 bp, Homo sapiens
atttcttttcaagagggtgctt

SEQ ID NO: 9502175 - DNA, 22 bp, Homo sapiens
atttgaaaacctgagcctcccg

SEQ ID NO: 9502176 - DNA, 22 bp, Homo sapiens
atttctttctggccacggtttt

SEQ ID NO: 9502177 - DNA, 22 bp, Homo sapiens
atttcttttcaagagggtgctt

SEQ ID NO: 9502178 - DNA, 22 bp, Homo sapiens
atttcttttcaagagggtgctt

SEQ ID NO: 9502179 - DNA, 22 bp, Homo sapiens
atttctttctggccacggtttt

SEQ ID NO: 9502180 - DNA, 22 bp, Homo sapiens
atttctgataaacgtaagctgc

SEQ ID NO: 9502181 - DNA, 22 bp, Homo sapiens
atttctcttcctcctagggttg

SEQ ID NO: 9502182 - DNA, 22 bp, Homo sapiens
atttctcttcctcctagggttg

SEQ ID NO: 9502183 - DNA, 22 bp, Homo sapiens
atttacaggtagaattttaagt

SEQ ID NO: 9502184 - DNA, 22 bp, Homo sapiens
atttctcttagcaagacattac

SEQ ID NO: 9502185 - DNA, 22 bp, Homo sapiens
atttgaaatcccttctactgta

SEQ ID NO: 9502186 - DNA, 22 bp, Homo sapiens
atttgaaatctgggttactctg

SEQ ID NO: 9502187 - DNA, 19 bp, Homo sapiens
atttgaaagctgtgcttgc

SEQ ID NO: 9502188 - DNA, 22 bp, Homo sapiens
atttgaaatcccttctactgta

SEQ ID NO: 9502189 - DNA, 22 bp, Homo sapiens
atttgaatgcaggtagctgagt

SEQ ID NO: 9502190 - DNA, 22 bp, Homo sapiens
atttgaagtaagtaatgagtat

SEQ ID NO: 9502191 - DNA, 22 bp, Homo sapiens
atttgaagtcttcatgatttct

SEQ ID NO: 9502192 - DNA, 22 bp, Homo sapiens
atttgaagtaagtaatgagtat

SEQ ID NO: 9502193 - DNA, 22 bp, Homo sapiens
atttgaagaaagttttctagat

SEQ ID NO: 9502194 - DNA, 22 bp, Homo sapiens
atttgaaccactcagaactcat

SEQ ID NO: 9502195 - DNA, 22 bp, Homo sapiens
atttgaagtaagtaatgagtat

SEQ ID NO: 9502196 - DNA, 22 bp, Homo sapiens
atttgaatggcttaacacaacg

SEQ ID NO: 9502197 - DNA, 22 bp, Homo sapiens
atttgaatggcttaacacaacg

SEQ ID NO: 9502198 - DNA, 22 bp, Homo sapiens
agatgacagtagctcccccatt

SEQ ID NO: 9502199 - DNA, 22 bp, Homo sapiens
agatgacatggttcaagtttcc

SEQ ID NO: 9502200 - DNA, 22 bp, Homo sapiens
agatgacacaccatttttactt

SEQ ID NO: 9502201 - DNA, 22 bp, Homo sapiens
agatgacaatgaggttgttatt

SEQ ID NO: 9502202 - DNA, 22 bp, Homo sapiens
agatgagtaaatggagtcttcc

SEQ ID NO: 9502203 - DNA, 21 bp, Homo sapiens
agatgaggatactgaggccta

SEQ ID NO: 9502204 - DNA, 22 bp, Homo sapiens
agatgagaatttttagagtgct

SEQ ID NO: 9502205 - DNA, 22 bp, Homo sapiens
agatgagaatttttagagtgct

SEQ ID NO: 9502206 - DNA, 21 bp, Homo sapiens
agatgaggatactgaggccta

SEQ ID NO: 9502207 - DNA, 22 bp, Homo sapiens
agatttatgtggtcacactcag

SEQ ID NO: 9502208 - DNA, 22 bp, Homo sapiens
agatttatgtggtcacactcag

SEQ ID NO: 9502209 - DNA, 22 bp, Homo sapiens
agatttatgtggtcacactcag

SEQ ID NO: 9502210 - DNA, 22 bp, Homo sapiens
agatttatgtggtcacactcag

SEQ ID NO: 9502211 - DNA, 22 bp, Homo sapiens
agatttatgtggtcacactcag

SEQ ID NO: 9502212 - DNA, 22 bp, Homo sapiens
agatttatgtggtcacactcag

SEQ ID NO: 9502213 - DNA, 21 bp, Homo sapiens
attttgtacatagaatttgtc

SEQ ID NO: 9502214 - DNA, 22 bp, Homo sapiens
attttctgtaactatttctata

SEQ ID NO: 9502215 - DNA, 22 bp, Homo sapiens
agatttactcagctcctggaaa

SEQ ID NO: 9502216 - DNA, 22 bp, Homo sapiens
agatttactccctgcttccgcc

SEQ ID NO: 9502217 - DNA, 20 bp, Homo sapiens
agatttacctttgagccttc

SEQ ID NO: 9502218 - DNA, 22 bp, Homo sapiens
agatttacaaaggatttgcttt

SEQ ID NO: 9502219 - DNA, 19 bp, Homo sapiens
agatttacctcatatagtt

SEQ ID NO: 9502220 - DNA, 22 bp, Homo sapiens
agatttactgagaactgattac

SEQ ID NO: 9502221 - DNA, 22 bp, Homo sapiens
agatttactggagtctttggtg

SEQ ID NO: 9502222 - DNA, 22 bp, Homo sapiens
agatttaaatttgctacaattc

SEQ ID NO: 9502223 - DNA, 22 bp, Homo sapiens
agatttaaatttgctacaattc

SEQ ID NO: 9502224 - DNA, 22 bp, Homo sapiens
agatttaaatttgctacaattc

SEQ ID NO: 9502225 - DNA, 18 bp, Homo sapiens
agattgtgtctacaaatc

SEQ ID NO: 9502226 - DNA, 23 bp, Homo sapiens
agattgttattcccagttcatgt

SEQ ID NO: 9502227 - DNA, 22 bp, Homo sapiens
agattgtgtcaatttctcttta

SEQ ID NO: 9502228 - DNA, 22 bp, Homo sapiens
agattgtatcctcggagacttc

SEQ ID NO: 9502229 - DNA, 21 bp, Homo sapiens
agattcataatctgtaaaatg

SEQ ID NO: 9502230 - DNA, 22 bp, Homo sapiens
agattcagttaaggctggtaga

SEQ ID NO: 9502231 - DNA, 22 bp, Homo sapiens
agattcagttaaggctggtaga

SEQ ID NO: 9502232 - DNA, 22 bp, Homo sapiens
agattcatgggaaagctttagg

SEQ ID NO: 9502233 - DNA, 22 bp, Homo sapiens
agattcaggcatgtcttcattt

SEQ ID NO: 9502234 - DNA, 22 bp, Homo sapiens
agattcattatcttctttgtac

SEQ ID NO: 9502235 - DNA, 22 bp, Homo sapiens
agattcatgggtctaaccagtg

SEQ ID NO: 9502236 - DNA, 22 bp, Homo sapiens
agattcatgggaaagctttagg

SEQ ID NO: 9502237 - DNA, 22 bp, Homo sapiens
agattcattaggagacattcag

SEQ ID NO: 9502238 - DNA, 22 bp, Homo sapiens
agatgatgaccatgggaatgga

SEQ ID NO: 9502239 - DNA, 22 bp, Homo sapiens
agatgatatactacatggcttc

SEQ ID NO: 9502240 - DNA, 22 bp, Homo sapiens
agatgatgataattgaaaggca

SEQ ID NO: 9502241 - DNA, 22 bp, Homo sapiens
agatgatggccatgtcctctcc

SEQ ID NO: 9502242 - DNA, 22 bp, Homo sapiens
agatgatgttggagtctgtgct

SEQ ID NO: 9502243 - DNA, 22 bp, Homo sapiens
agatgatggccatgtcctctcc

SEQ ID NO: 9502244 - DNA, 22 bp, Homo sapiens
agatgtttcagtaatttatctt

SEQ ID NO: 9502245 - DNA, 22 bp, Homo sapiens
agattctaccagagctagtttg

SEQ ID NO: 9502246 - DNA, 22 bp, Homo sapiens
agattcgaaacctttaggtctt

SEQ ID NO: 9502247 - DNA, 22 bp, Homo sapiens
agattctaaacttgattctgct

SEQ ID NO: 9502248 - DNA, 22 bp, Homo sapiens
agattctcggtccgggcagccc

SEQ ID NO: 9502249 - DNA, 22 bp, Homo sapiens
agattccaggcctggggccaag

SEQ ID NO: 9502250 - DNA, 19 bp, Homo sapiens
agattggttccttttgagg

SEQ ID NO: 9502251 - DNA, 22 bp, Homo sapiens
agattggttgaactgatttgca

SEQ ID NO: 9502252 - DNA, 22 bp, Homo sapiens
agattggtttcccacatagctg

SEQ ID NO: 9502253 - DNA, 22 bp, Homo sapiens
agattggttccttgctttgaaa

SEQ ID NO: 9502254 - DNA, 22 bp, Homo sapiens
agattggttatttgataaggaa

SEQ ID NO: 9502255 - DNA, 22 bp, Homo sapiens
agattggggtccagactcctga

SEQ ID NO: 9502256 - DNA, 22 bp, Homo sapiens
agattggatcaagcagcagttg

SEQ ID NO: 9502257 - DNA, 22 bp, Homo sapiens
agattgggctctatggtgccac

SEQ ID NO: 9502258 - DNA, 23 bp, Homo sapiens
agattggtgtgtgcatcaaattg

SEQ ID NO: 9502259 - DNA, 22 bp, Homo sapiens
agattggtgaatgaaaagtaga

SEQ ID NO: 9502260 - DNA, 22 bp, Homo sapiens
agattgcattgacttgatacga

SEQ ID NO: 9502261 - DNA, 22 bp, Homo sapiens
agattgaatatagagattcttg

SEQ ID NO: 9502262 - DNA, 22 bp, Homo sapiens
agattgggctccagttaaaacg

SEQ ID NO: 9502263 - DNA, 22 bp, Homo sapiens
attttttcagattgagtgttaa

SEQ ID NO: 9502264 - DNA, 22 bp, Homo sapiens
attttttcagattgagtgttaa

SEQ ID NO: 9502265 - DNA, 22 bp, Homo sapiens
attttttcagattgagtgttaa

SEQ ID NO: 9502266 - DNA, 22 bp, Homo sapiens
attttttagccaagactctgca

SEQ ID NO: 9502267 - DNA, 22 bp, Homo sapiens
attttttatataccaaggtggg

SEQ ID NO: 9502268 - DNA, 22 bp, Homo sapiens
attttttatataccaaggtggg

SEQ ID NO: 9502269 - DNA, 22 bp, Homo sapiens
attttttagccaagactctgca

SEQ ID NO: 9502270 - DNA, 22 bp, Homo sapiens
attttttagccaagactctgca

SEQ ID NO: 9502271 - DNA, 22 bp, Homo sapiens
attttttagccaagactctgca

SEQ ID NO: 9502272 - DNA, 20 bp, Homo sapiens
attttgtttatgttcctctc

SEQ ID NO: 9502273 - DNA, 20 bp, Homo sapiens
attttgtttatgttcctctc

SEQ ID NO: 9502274 - DNA, 22 bp, Homo sapiens
attttgttatcagggctttgca

SEQ ID NO: 9502275 - DNA, 22 bp, Homo sapiens
attttgttataggagctgaaat

SEQ ID NO: 9502276 - DNA, 22 bp, Homo sapiens
attttgttataggagctgaaat

SEQ ID NO: 9502277 - DNA, 22 bp, Homo sapiens
attttgttataggagctgaaat

SEQ ID NO: 9502278 - DNA, 22 bp, Homo sapiens
attttgtgaaccctcaagcaat

SEQ ID NO: 9502279 - DNA, 22 bp, Homo sapiens
attttgtggcagatgcagaacc

SEQ ID NO: 9502280 - DNA, 22 bp, Homo sapiens
attttgttatagaactctgtga

SEQ ID NO: 9502281 - DNA, 17 bp, Homo sapiens
agcaaggcttaagtaaa

SEQ ID NO: 9502282 - DNA, 22 bp, Homo sapiens
agcaaggcttcagagctgtctg

SEQ ID NO: 9502283 - DNA, 22 bp, Homo sapiens
agcaaggcttcagagctgtctg

SEQ ID NO: 9502284 - DNA, 22 bp, Homo sapiens
agcaaggggcagtgaaagtgtg

SEQ ID NO: 9502285 - DNA, 22 bp, Homo sapiens
agcaaggctcttaatgcccaaa

SEQ ID NO: 9502286 - DNA, 22 bp, Homo sapiens
agcaaggctcttaatgcccaaa

SEQ ID NO: 9502287 - DNA, 22 bp, Homo sapiens
agcaaggctgggtctaatgggg

SEQ ID NO: 9502288 - DNA, 20 bp, Homo sapiens
agcaaggctggagcttatgg

SEQ ID NO: 9502289 - DNA, 22 bp, Homo sapiens
agcaaggctgggtctaatgggg

SEQ ID NO: 9502290 - DNA, 22 bp, Homo sapiens
agcaaggctgggtctaatgggg

SEQ ID NO: 9502291 - DNA, 22 bp, Homo sapiens
agcaaggtggagaaggatgggt

SEQ ID NO: 9502292 - DNA, 22 bp, Homo sapiens
agcaaggtggagaaggatgggt

SEQ ID NO: 9502293 - DNA, 22 bp, Homo sapiens
agcaaggggcagtgaaagtgtg

SEQ ID NO: 9502294 - DNA, 22 bp, Homo sapiens
agcaaggggcagtgaaagtgtg

SEQ ID NO: 9502295 - DNA, 22 bp, Homo sapiens
agcaagtgtaagaatgcagaat

SEQ ID NO: 9502296 - DNA, 22 bp, Homo sapiens
agcaagttgaatgataatactc

SEQ ID NO: 9502297 - DNA, 22 bp, Homo sapiens
agcaataaatgtaaaggttaag

SEQ ID NO: 9502298 - DNA, 22 bp, Homo sapiens
agcaataaccactctaatttat

SEQ ID NO: 9502299 - DNA, 23 bp, Homo sapiens
agcaataagaagggatacatgtg

SEQ ID NO: 9502300 - DNA, 22 bp, Homo sapiens
agcaaggcctacagagaggggc

SEQ ID NO: 9502301 - DNA, 20 bp, Homo sapiens
agcaaggctaaatcatgatt

SEQ ID NO: 9502302 - DNA, 22 bp, Homo sapiens
agcaaggctcggtcagggtgat

SEQ ID NO: 9502303 - DNA, 22 bp, Homo sapiens
agcaaggctcttaatgcccaaa

SEQ ID NO: 9502304 - DNA, 22 bp, Homo sapiens
agcaaggctcggtcagggtgat

SEQ ID NO: 9502305 - DNA, 22 bp, Homo sapiens
agcaaggctcggtcagggtgat

SEQ ID NO: 9502306 - DNA, 22 bp, Homo sapiens
attttttcccagttagccagga

SEQ ID NO: 9502307 - DNA, 22 bp, Homo sapiens
attttttcccagttagccagga

SEQ ID NO: 9502308 - DNA, 22 bp, Homo sapiens
attttttcccagttagccagga

SEQ ID NO: 9502309 - DNA, 22 bp, Homo sapiens
attttttctgtaaactggcctt

SEQ ID NO: 9502310 - DNA, 22 bp, Homo sapiens
attttttcccagttagccagga

SEQ ID NO: 9502311 - DNA, 22 bp, Homo sapiens
attttttctgtaaactggcctt

SEQ ID NO: 9502312 - DNA, 23 bp, Homo sapiens
attttttgtctttgtaactagat

SEQ ID NO: 9502313 - DNA, 23 bp, Homo sapiens
attttttgtctttgtaactagat

SEQ ID NO: 9502314 - DNA, 22 bp, Homo sapiens
caaagtgctgggattacaggct

SEQ ID NO: 9502315 - DNA, 22 bp, Homo sapiens
caaagtgctgggattacaggct

SEQ ID NO: 9502316 - DNA, 22 bp, Homo sapiens
caaagtgctgggattacaggtg

SEQ ID NO: 9502317 - DNA, 22 bp, Homo sapiens
caaagtgctgggattacaggct

SEQ ID NO: 9502318 - DNA, 22 bp, Homo sapiens
caaagtgctgggattacaggct

SEQ ID NO: 9502319 - DNA, 22 bp, Homo sapiens
caaagtgctgggattacaggtg

SEQ ID NO: 9502320 - DNA, 22 bp, Homo sapiens
caaagtgctgggattacaggtg

SEQ ID NO: 9502321 - DNA, 22 bp, Homo sapiens
caaagtgctgggattacaggtg

SEQ ID NO: 9502322 - DNA, 22 bp, Homo sapiens
caaagtgctgggattataggca

SEQ ID NO: 9502323 - DNA, 22 bp, Homo sapiens
caaagtgctgggattataggca

SEQ ID NO: 9502324 - DNA, 22 bp, Homo sapiens
caaagtgctgggattagtgctg

SEQ ID NO: 9502325 - DNA, 22 bp, Homo sapiens
caaagtgctgggattagtgctg

SEQ ID NO: 9502326 - DNA, 22 bp, Homo sapiens
caaacattttgagtggtttctg

SEQ ID NO: 9502327 - DNA, 22 bp, Homo sapiens
caaagggctctagactcagcag

SEQ ID NO: 9502328 - DNA, 22 bp, Homo sapiens
caaacattttgagtggtttctg

SEQ ID NO: 9502329 - DNA, 22 bp, Homo sapiens
caaacattttctacttccagga

SEQ ID NO: 9502330 - DNA, 22 bp, Homo sapiens
caaacatttgttggaacccctg

SEQ ID NO: 9502331 - DNA, 22 bp, Homo sapiens
caaacattgctaccagaggttt

SEQ ID NO: 9502332 - DNA, 22 bp, Homo sapiens
caaacattgctaccagaggttt

SEQ ID NO: 9502333 - DNA, 22 bp, Homo sapiens
caaacattgggggcttcaacac

SEQ ID NO: 9502334 - DNA, 22 bp, Homo sapiens
caaacattgggggcttcaacac

SEQ ID NO: 9502335 - DNA, 22 bp, Homo sapiens
caaacattgggggcttcaacac

SEQ ID NO: 9502336 - DNA, 22 bp, Homo sapiens
caaacatttgacttctctcagg

SEQ ID NO: 9502337 - DNA, 22 bp, Homo sapiens
caaacatttgacttctctcagg

SEQ ID NO: 9502338 - DNA, 22 bp, Homo sapiens
caaacattgctaccagaggttt

SEQ ID NO: 9502339 - DNA, 22 bp, Homo sapiens
agcaatcagcttctttgtgttt

SEQ ID NO: 9502340 - DNA, 22 bp, Homo sapiens
agcaatagacacaagatggata

SEQ ID NO: 9502341 - DNA, 22 bp, Homo sapiens
agcaataatttaggcctttcct

SEQ ID NO: 9502342 - DNA, 22 bp, Homo sapiens
agcaataagggatcctctataa

SEQ ID NO: 9502343 - DNA, 22 bp, Homo sapiens
agcaatagataaaacatttacc

SEQ ID NO: 9502344 - DNA, 22 bp, Homo sapiens
caaagtggagagcctgtggttg

SEQ ID NO: 9502345 - DNA, 22 bp, Homo sapiens
caaagtggctggccgggagatc

SEQ ID NO: 9502346 - DNA, 22 bp, Homo sapiens
caaagttatcaactgcaacatt

SEQ ID NO: 9502347 - DNA, 22 bp, Homo sapiens
caaagttatgaatgataagatt

SEQ ID NO: 9502348 - DNA, 22 bp, Homo sapiens
caaagttatcaactgcaacatt

SEQ ID NO: 9502349 - DNA, 22 bp, Homo sapiens
caaagtttaaagtagatttcag

SEQ ID NO: 9502350 - DNA, 22 bp, Homo sapiens
caaagttatgaatgataagatt

SEQ ID NO: 9502351 - DNA, 22 bp, Homo sapiens
caaagtttggctctcatgacat

SEQ ID NO: 9502352 - DNA, 22 bp, Homo sapiens
caaagttttagtaaacatatat

SEQ ID NO: 9502353 - DNA, 22 bp, Homo sapiens
caaagttttagtaaacatatat

SEQ ID NO: 9502354 - DNA, 22 bp, Homo sapiens
agcaatgtctttttggccatct

SEQ ID NO: 9502355 - DNA, 22 bp, Homo sapiens
agcaatgtaaaccctgaagttg

SEQ ID NO: 9502356 - DNA, 22 bp, Homo sapiens
agcaatgcttattgctgactat

SEQ ID NO: 9502357 - DNA, 22 bp, Homo sapiens
agcaatgttggggttagaggac

SEQ ID NO: 9502358 - DNA, 22 bp, Homo sapiens
agcaatgtggaccagctcaggg

SEQ ID NO: 9502359 - DNA, 22 bp, Homo sapiens
agcaatgtggaccagctcaggg

SEQ ID NO: 9502360 - DNA, 22 bp, Homo sapiens
agcaatgtgacccctgacagca

SEQ ID NO: 9502361 - DNA, 22 bp, Homo sapiens
agcaatgtgacccctgacagca

SEQ ID NO: 9502362 - DNA, 22 bp, Homo sapiens
agcaatgttggcctatatacct

SEQ ID NO: 9502363 - DNA, 22 bp, Homo sapiens
agcaatgcaatcttaaccttga

SEQ ID NO: 9502364 - DNA, 22 bp, Homo sapiens
agcaatgatgttttcaagtagg

SEQ ID NO: 9502365 - DNA, 22 bp, Homo sapiens
agcaatgcaatcttaaccttga

SEQ ID NO: 9502366 - DNA, 22 bp, Homo sapiens
agcaatgctaccgggtgattcg

SEQ ID NO: 9502367 - DNA, 22 bp, Homo sapiens
agcaatgcttattgctgactat

SEQ ID NO: 9502368 - DNA, 23 bp, Homo sapiens
agcaatgctgggagactctgtaa

SEQ ID NO: 9502369 - DNA, 23 bp, Homo sapiens
agcaatgctgggagactctgtaa

SEQ ID NO: 9502370 - DNA, 22 bp, Homo sapiens
agcaatgactggctatatgatt

SEQ ID NO: 9502371 - DNA, 22 bp, Homo sapiens
agcaatgactttgaaatcatga

SEQ ID NO: 9502372 - DNA, 22 bp, Homo sapiens
agcaatgaccagtgatcttgta

SEQ ID NO: 9502373 - DNA, 22 bp, Homo sapiens
agcaatgactttgaaatcatga

SEQ ID NO: 9502374 - DNA, 22 bp, Homo sapiens
agcaatgactttgaaatcatga

SEQ ID NO: 9502375 - DNA, 22 bp, Homo sapiens
agcaatgactttgaaatcatga

SEQ ID NO: 9502376 - DNA, 22 bp, Homo sapiens
agcaatgaccagtgatcttgta

SEQ ID NO: 9502377 - DNA, 22 bp, Homo sapiens
acagggccaggtgagaggtgct

SEQ ID NO: 9502378 - DNA, 22 bp, Homo sapiens
acagggccaggtgagaggtgct

SEQ ID NO: 9502379 - DNA, 22 bp, Homo sapiens
acagggccaggtgagaggtgct

SEQ ID NO: 9502380 - DNA, 22 bp, Homo sapiens
acagggccagcctgggacctgg

SEQ ID NO: 9502381 - DNA, 22 bp, Homo sapiens
acagggcctcagccagggcaga

SEQ ID NO: 9502382 - DNA, 22 bp, Homo sapiens
acagggcccttgccagcacaag

SEQ ID NO: 9502383 - DNA, 22 bp, Homo sapiens
acagggccctgtgggccccact

SEQ ID NO: 9502384 - DNA, 22 bp, Homo sapiens
acagggcctcagccagggcaga

SEQ ID NO: 9502385 - DNA, 22 bp, Homo sapiens
aggacagggattcaaactccca

SEQ ID NO: 9502386 - DNA, 22 bp, Homo sapiens
aggacaggattgagctgaactg

SEQ ID NO: 9502387 - DNA, 22 bp, Homo sapiens
aggacagggattcaaactccca

SEQ ID NO: 9502388 - DNA, 22 bp, Homo sapiens
aggacagggattcaaactccca

SEQ ID NO: 9502389 - DNA, 22 bp, Homo sapiens
aggacacaggtaagccagtgga

SEQ ID NO: 9502390 - DNA, 22 bp, Homo sapiens
aggacacaggtaagccagtgga

SEQ ID NO: 9502391 - DNA, 22 bp, Homo sapiens
acagggcctttgatggattata

SEQ ID NO: 9502392 - DNA, 22 bp, Homo sapiens
acagggctatattcctcagagc

SEQ ID NO: 9502393 - DNA, 22 bp, Homo sapiens
aggacaggtgtagtgggctctg

SEQ ID NO: 9502394 - DNA, 22 bp, Homo sapiens
aggacaggtgtagtgggctctg

SEQ ID NO: 9502395 - DNA, 22 bp, Homo sapiens
aggacaggtgtagtgggctctg

SEQ ID NO: 9502396 - DNA, 22 bp, Homo sapiens
aggacaggtgtagtgggctctg

SEQ ID NO: 9502397 - DNA, 22 bp, Homo sapiens
aggacaggtgtagtgggctctg

SEQ ID NO: 9502398 - DNA, 22 bp, Homo sapiens
aggacaggtgtagtgggctctg

SEQ ID NO: 9502399 - DNA, 22 bp, Homo sapiens
aggacagtccggggtcctccac

SEQ ID NO: 9502400 - DNA, 22 bp, Homo sapiens
aggacagtccggggtcctccac

SEQ ID NO: 9502401 - DNA, 23 bp, Homo sapiens
aggacagtggaatttagggattg

SEQ ID NO: 9502402 - DNA, 22 bp, Homo sapiens
aggacagtataggctttaggag

SEQ ID NO: 9502403 - DNA, 22 bp, Homo sapiens
aggacaggtgtagtgggctctg

SEQ ID NO: 9502404 - DNA, 22 bp, Homo sapiens
aggacaggtgtagtgggctctg

SEQ ID NO: 9502405 - DNA, 22 bp, Homo sapiens
aggacagtggacactagtccct

SEQ ID NO: 9502406 - DNA, 22 bp, Homo sapiens
aggacagtggacactagtccct

SEQ ID NO: 9502407 - DNA, 22 bp, Homo sapiens
aggacagtggcaaggcaggaca

SEQ ID NO: 9502408 - DNA, 22 bp, Homo sapiens
aggacagtggcaaggcaggaca

SEQ ID NO: 9502409 - DNA, 22 bp, Homo sapiens
aggacagtggcaaggcaggaca

SEQ ID NO: 9502410 - DNA, 22 bp, Homo sapiens
aggacatgaagaaagggcaagg

SEQ ID NO: 9502411 - DNA, 22 bp, Homo sapiens
aggacagttagttaggaagttt

SEQ ID NO: 9502412 - DNA, 22 bp, Homo sapiens
aggacagttaaaaatagatggc

SEQ ID NO: 9502413 - DNA, 22 bp, Homo sapiens
aggacagtgtggaagagggtgc

SEQ ID NO: 9502414 - DNA, 22 bp, Homo sapiens
aggacagttaaaaatagatggc

SEQ ID NO: 9502415 - DNA, 22 bp, Homo sapiens
aggactggcagtgtgaggggtc

SEQ ID NO: 9502416 - DNA, 22 bp, Homo sapiens
aggactggcagtgtgaggggtc

SEQ ID NO: 9502417 - DNA, 22 bp, Homo sapiens
aggactgatgatggtgctgaca

SEQ ID NO: 9502418 - DNA, 22 bp, Homo sapiens
aggactggccctgaggggaggc

SEQ ID NO: 9502419 - DNA, 22 bp, Homo sapiens
aggactgggtgcagagggcatc

SEQ ID NO: 9502420 - DNA, 22 bp, Homo sapiens
aggactggtgtgtgatcagcat

SEQ ID NO: 9502421 - DNA, 22 bp, Homo sapiens
aggactgttttttcttctaggg

SEQ ID NO: 9502422 - DNA, 22 bp, Homo sapiens
aggactggtgccagacaaggta

SEQ ID NO: 9502423 - DNA, 22 bp, Homo sapiens
aggactggtgccagacaaggta

SEQ ID NO: 9502424 - DNA, 19 bp, Homo sapiens
acagggcagcaataggata

SEQ ID NO: 9502425 - DNA, 22 bp, Homo sapiens
acagggcacctgaggtaggaag

SEQ ID NO: 9502426 - DNA, 21 bp, Homo sapiens
acaggctctggggatgctggg

SEQ ID NO: 9502427 - DNA, 22 bp, Homo sapiens
acaggctcgtgcgcgcacgtgt

SEQ ID NO: 9502428 - DNA, 22 bp, Homo sapiens
acaggctctcagccagttggca

SEQ ID NO: 9502429 - DNA, 22 bp, Homo sapiens
acaggctcagttcactggattt

SEQ ID NO: 9502430 - DNA, 22 bp, Homo sapiens
acaggctctctattgagtgcag

SEQ ID NO: 9502431 - DNA, 22 bp, Homo sapiens
acaggctctctattgagtgcag

SEQ ID NO: 9502432 - DNA, 22 bp, Homo sapiens
acaggctctctattgagtgcag

SEQ ID NO: 9502433 - DNA, 22 bp, Homo sapiens
acagggcatgtgcaagagacat

SEQ ID NO: 9502434 - DNA, 22 bp, Homo sapiens
acagggcatgtgcaagagacat

SEQ ID NO: 9502435 - DNA, 22 bp, Homo sapiens
acagggcatttcctctatgtgt

SEQ ID NO: 9502436 - DNA, 22 bp, Homo sapiens
acagggcatgtgcaagagacat

SEQ ID NO: 9502437 - DNA, 23 bp, Homo sapiens
acagggcattgctggcctcgagg

SEQ ID NO: 9502438 - DNA, 22 bp, Homo sapiens
aggaaaggttcagtgattgaaa

SEQ ID NO: 9502439 - DNA, 22 bp, Homo sapiens
aggaaaggttcagtgattgaaa

SEQ ID NO: 9502440 - DNA, 19 bp, Homo sapiens
aggaaaggtggccttagca

SEQ ID NO: 9502441 - DNA, 22 bp, Homo sapiens
aggaaaggtgagagcggccgcg

SEQ ID NO: 9502442 - DNA, 19 bp, Homo sapiens
aggaaaggtggccttagca

SEQ ID NO: 9502443 - DNA, 19 bp, Homo sapiens
aggaaaggtggccttagca

SEQ ID NO: 9502444 - DNA, 22 bp, Homo sapiens
aggaaaggggtaggtgtggacg

SEQ ID NO: 9502445 - DNA, 22 bp, Homo sapiens
aggaaaggtagcgtgccagcag

SEQ ID NO: 9502446 - DNA, 22 bp, Homo sapiens
aggaaaggtagcgtgccagcag

SEQ ID NO: 9502447 - DNA, 22 bp, Homo sapiens
aggaaataagggcacttcagat

SEQ ID NO: 9502448 - DNA, 22 bp, Homo sapiens
acaggcctggtgctgctgacag

SEQ ID NO: 9502449 - DNA, 22 bp, Homo sapiens
acaggcctgtgtgcacacgagg

SEQ ID NO: 9502450 - DNA, 22 bp, Homo sapiens
acaggcctgtgtgcacacgagg

SEQ ID NO: 9502451 - DNA, 22 bp, Homo sapiens
aggaaagtggtgggaaatcagg

SEQ ID NO: 9502452 - DNA, 22 bp, Homo sapiens
aggaaataagggcacttcagat

SEQ ID NO: 9502453 - DNA, 22 bp, Homo sapiens
aggaaataagggcacttcagat

SEQ ID NO: 9502454 - DNA, 22 bp, Homo sapiens
aggaaataagggacaagacaaa

SEQ ID NO: 9502455 - DNA, 22 bp, Homo sapiens
acaggccttggcaggcatgtga

SEQ ID NO: 9502456 - DNA, 22 bp, Homo sapiens
acaggccttggcaggcatgtga

SEQ ID NO: 9502457 - DNA, 21 bp, Homo sapiens
acaggccttaggggccattca

SEQ ID NO: 9502458 - DNA, 22 bp, Homo sapiens
acaggccttaggagagatgggg

SEQ ID NO: 9502459 - DNA, 22 bp, Homo sapiens
acaggcgctggcagagagaaaa

SEQ ID NO: 9502460 - DNA, 20 bp, Homo sapiens
acaggcgctggggagatggc

SEQ ID NO: 9502461 - DNA, 22 bp, Homo sapiens
acaggctcacagtcatttcatt

SEQ ID NO: 9502462 - DNA, 22 bp, Homo sapiens
acaggccttggtcctgacctaa

SEQ ID NO: 9502463 - DNA, 22 bp, Homo sapiens
agcttccacatctgtcttcagt

SEQ ID NO: 9502464 - DNA, 21 bp, Homo sapiens
agcttccagagcacattccat

SEQ ID NO: 9502465 - DNA, 22 bp, Homo sapiens
acaggagaaatctggtcaaaag

SEQ ID NO: 9502466 - DNA, 22 bp, Homo sapiens
acaggagaaatctggtcaaaag

SEQ ID NO: 9502467 - DNA, 22 bp, Homo sapiens
agcttccaatttctccaagaga

SEQ ID NO: 9502468 - DNA, 22 bp, Homo sapiens
agcttccatactaagacaaaag

SEQ ID NO: 9502469 - DNA, 22 bp, Homo sapiens
agcttcttagttcacttttaat

SEQ ID NO: 9502470 - DNA, 22 bp, Homo sapiens
agcttcttgggctttacacaaa

SEQ ID NO: 9502471 - DNA, 22 bp, Homo sapiens
agcttcttggctcagcacttgg

SEQ ID NO: 9502472 - DNA, 22 bp, Homo sapiens
agcttcttgacggatgttctgg

SEQ ID NO: 9502473 - DNA, 22 bp, Homo sapiens
agcttcttctgatttgtcagtc

SEQ ID NO: 9502474 - DNA, 22 bp, Homo sapiens
agcttcttgaccaagcctgtaa

SEQ ID NO: 9502475 - DNA, 22 bp, Homo sapiens
acaggacatggcttctgtgacg

SEQ ID NO: 9502476 - DNA, 22 bp, Homo sapiens
acaggacatgtaccaggtggtc

SEQ ID NO: 9502477 - DNA, 22 bp, Homo sapiens
acaggactagatgataaaatgt

SEQ ID NO: 9502478 - DNA, 22 bp, Homo sapiens
acaggactctctgaaaatgtac

SEQ ID NO: 9502479 - DNA, 22 bp, Homo sapiens
acaggacatgtaccaggtggtc

SEQ ID NO: 9502480 - DNA, 22 bp, Homo sapiens
acaggacagtctagtaacagta

SEQ ID NO: 9502481 - DNA, 22 bp, Homo sapiens
acaggacagtctagtaacagta

SEQ ID NO: 9502482 - DNA, 22 bp, Homo sapiens
acaggacatggcttctgtgacg

SEQ ID NO: 9502483 - DNA, 22 bp, Homo sapiens
acaggacagtctagtaacagta

SEQ ID NO: 9502484 - DNA, 22 bp, Homo sapiens
acaggacagtctagtaacagta

SEQ ID NO: 9502485 - DNA, 22 bp, Homo sapiens
acaggacagggaattcgaaatt

SEQ ID NO: 9502486 - DNA, 22 bp, Homo sapiens
acaggacaggtaggattcgcag

SEQ ID NO: 9502487 - DNA, 22 bp, Homo sapiens
acaggacaggctgggctagact

SEQ ID NO: 9502488 - DNA, 22 bp, Homo sapiens
acaggacaggctgggctagact

SEQ ID NO: 9502489 - DNA, 22 bp, Homo sapiens
aggaaagaagtacattctcatg

SEQ ID NO: 9502490 - DNA, 18 bp, Homo sapiens
aggaaagaaaggcaggtg

SEQ ID NO: 9502491 - DNA, 18 bp, Homo sapiens
aggaaagaaaggcaggtg

SEQ ID NO: 9502492 - DNA, 22 bp, Homo sapiens
acaggcaagtacacaggctcat

SEQ ID NO: 9502493 - DNA, 22 bp, Homo sapiens
acaggcaagaggaaagcaagta

SEQ ID NO: 9502494 - DNA, 22 bp, Homo sapiens
acaggcaagaggaaagcaagta

SEQ ID NO: 9502495 - DNA, 22 bp, Homo sapiens
acaggcaagaggaaagcaagta

SEQ ID NO: 9502496 - DNA, 22 bp, Homo sapiens
acaggcaaggccagtgagaaat

SEQ ID NO: 9502497 - DNA, 22 bp, Homo sapiens
acaggcaacttcaaatctcact

SEQ ID NO: 9502498 - DNA, 22 bp, Homo sapiens
acaggattagtggatttgtctt

SEQ ID NO: 9502499 - DNA, 22 bp, Homo sapiens
acaggatttcaccatgttggcc

SEQ ID NO: 9502500 - DNA, 22 bp, Homo sapiens
acaggcaaacacagaaagtagg

SEQ ID NO: 9502501 - DNA, 22 bp, Homo sapiens
acaggatgataaaggatggcca

SEQ ID NO: 9502502 - DNA, 22 bp, Homo sapiens
acaggatgataaaggatggcca

SEQ ID NO: 9502503 - DNA, 20 bp, Homo sapiens
acaggatgcctgccatttca

SEQ ID NO: 9502504 - DNA, 22 bp, Homo sapiens
acaggatggagataatagaaaa

SEQ ID NO: 9502505 - DNA, 22 bp, Homo sapiens
acaggatggccagctgatattg

SEQ ID NO: 9502506 - DNA, 22 bp, Homo sapiens
acaggatggccagctgatattg

SEQ ID NO: 9502507 - DNA, 22 bp, Homo sapiens
acaggatgggcgcacagagcta

SEQ ID NO: 9502508 - DNA, 22 bp, Homo sapiens
acaggattagcaagtaatcagg

SEQ ID NO: 9502509 - DNA, 22 bp, Homo sapiens
acaggattactggattatgaca

SEQ ID NO: 9502510 - DNA, 22 bp, Homo sapiens
acaggattactggattatgaca

SEQ ID NO: 9502511 - DNA, 19 bp, Homo sapiens
agcttctttggaaacattt

SEQ ID NO: 9502512 - DNA, 22 bp, Homo sapiens
agcttctttaattcagcatgat

SEQ ID NO: 9502513 - DNA, 22 bp, Homo sapiens
acaggatcgccctgttgcccag

SEQ ID NO: 9502514 - DNA, 22 bp, Homo sapiens
acaggatgagaatatcatattt

SEQ ID NO: 9502515 - DNA, 22 bp, Homo sapiens
acaggacaaggggaagaagata

SEQ ID NO: 9502516 - DNA, 22 bp, Homo sapiens
acaggacaaggggaagaagata

SEQ ID NO: 9502517 - DNA, 22 bp, Homo sapiens
acaggacaatttataatgggca

SEQ ID NO: 9502518 - DNA, 22 bp, Homo sapiens
acaggacaggctgggctagact

SEQ ID NO: 9502519 - DNA, 22 bp, Homo sapiens
acaggacaactcagcagccagc

SEQ ID NO: 9502520 - DNA, 22 bp, Homo sapiens
acaggacaaaaatctggatggc

SEQ ID NO: 9502521 - DNA, 22 bp, Homo sapiens
acaggaagtttggaaagcctca

SEQ ID NO: 9502522 - DNA, 22 bp, Homo sapiens
acaggaagtgggaagaaacagg

SEQ ID NO: 9502523 - DNA, 22 bp, Homo sapiens
acaggaagtttggaaagcctca

SEQ ID NO: 9502524 - DNA, 22 bp, Homo sapiens
acaggaagtttggaaagcctca

SEQ ID NO: 9502525 - DNA, 22 bp, Homo sapiens
acaggaatttcctaatattcga

SEQ ID NO: 9502526 - DNA, 22 bp, Homo sapiens
acaggacaaaaatctggatggc

SEQ ID NO: 9502527 - DNA, 22 bp, Homo sapiens
acaggacaaaaatctggatggc

SEQ ID NO: 9502528 - DNA, 22 bp, Homo sapiens
acaggaagaaagtgcagtagat

SEQ ID NO: 9502529 - DNA, 22 bp, Homo sapiens
acaggaagtgctggcacttaca

SEQ ID NO: 9502530 - DNA, 22 bp, Homo sapiens
acaggaagtgctggcacttaca

SEQ ID NO: 9502531 - DNA, 22 bp, Homo sapiens
acaggaagtgggaagaaacagg

SEQ ID NO: 9502532 - DNA, 22 bp, Homo sapiens
acaggaagtgggaagaaacagg

SEQ ID NO: 9502533 - DNA, 22 bp, Homo sapiens
acaggaagtgggaagaaacagg

SEQ ID NO: 9502534 - DNA, 22 bp, Homo sapiens
acaggaagtgctggcacttaca

SEQ ID NO: 9502535 - DNA, 22 bp, Homo sapiens
acaggaagtgctggcacttaca

SEQ ID NO: 9502536 - DNA, 22 bp, Homo sapiens
acaggaagaaagtgcagtagat

SEQ ID NO: 9502537 - DNA, 22 bp, Homo sapiens
acaggaagaaagtgcagtagat

SEQ ID NO: 9502538 - DNA, 22 bp, Homo sapiens
acaggaactgttatctcagatg

SEQ ID NO: 9502539 - DNA, 22 bp, Homo sapiens
acaggaactgttatctcagatg

SEQ ID NO: 9502540 - DNA, 22 bp, Homo sapiens
acaggaacgaatgtacattgtt

SEQ ID NO: 9502541 - DNA, 22 bp, Homo sapiens
acaggaacgaatgtacattgtt

SEQ ID NO: 9502542 - DNA, 20 bp, Homo sapiens
acagccagaggaggcagaca

SEQ ID NO: 9502543 - DNA, 22 bp, Homo sapiens
acagcatggataacaaggcact

SEQ ID NO: 9502544 - DNA, 22 bp, Homo sapiens
acagcatgtctagttaaatact

SEQ ID NO: 9502545 - DNA, 22 bp, Homo sapiens
acagcataatcacttctttctt

SEQ ID NO: 9502546 - DNA, 22 bp, Homo sapiens
acagcagtttagaggacagcca

SEQ ID NO: 9502547 - DNA, 22 bp, Homo sapiens
acagcagttaacgatcagactc

SEQ ID NO: 9502548 - DNA, 22 bp, Homo sapiens
acagcagttactgaaataaagt

SEQ ID NO: 9502549 - DNA, 22 bp, Homo sapiens
acagcagtgggttgccagtggg

SEQ ID NO: 9502550 - DNA, 22 bp, Homo sapiens
acagcagtggtgcactgagcca

SEQ ID NO: 9502551 - DNA, 22 bp, Homo sapiens
acagcagtgtctggtactgagt

SEQ ID NO: 9502552 - DNA, 22 bp, Homo sapiens
acagcagttaacgatcagactc

SEQ ID NO: 9502553 - DNA, 22 bp, Homo sapiens
acagcagtgtctggtactgagt

SEQ ID NO: 9502554 - DNA, 22 bp, Homo sapiens
acagcattcaataaataataac

SEQ ID NO: 9502555 - DNA, 22 bp, Homo sapiens
acagcattccctttggctgctt

SEQ ID NO: 9502556 - DNA, 21 bp, Homo sapiens
acagcatgtttgtgtgtttgc

SEQ ID NO: 9502557 - DNA, 21 bp, Homo sapiens
acagcatgtttgtgtgtttgc

SEQ ID NO: 9502558 - DNA, 22 bp, Homo sapiens
acagcattcaataaataataac

SEQ ID NO: 9502559 - DNA, 22 bp, Homo sapiens
acagcattgctccatctcaaga

SEQ ID NO: 9502560 - DNA, 22 bp, Homo sapiens
acagcatttaaagaaaatgaac

SEQ ID NO: 9502561 - DNA, 22 bp, Homo sapiens
acagcatttaaagaaaatgaac

SEQ ID NO: 9502562 - DNA, 22 bp, Homo sapiens
acagccagaggagccaggctgg

SEQ ID NO: 9502563 - DNA, 22 bp, Homo sapiens
acagccagaggagccaggctgg

SEQ ID NO: 9502564 - DNA, 22 bp, Homo sapiens
acagccagaggagccaggctgg

SEQ ID NO: 9502565 - DNA, 22 bp, Homo sapiens
acagccagaagtcagggtggga

SEQ ID NO: 9502566 - DNA, 22 bp, Homo sapiens
acagccactcaaagggccgaag

SEQ ID NO: 9502567 - DNA, 22 bp, Homo sapiens
acagccaaggaattaggaaggg

SEQ ID NO: 9502568 - DNA, 22 bp, Homo sapiens
acagccaacgtctttcttactt

SEQ ID NO: 9502569 - DNA, 22 bp, Homo sapiens
aggcagactcaatggctagata

SEQ ID NO: 9502570 - DNA, 22 bp, Homo sapiens
aggcagacaaggtccctggtct

SEQ ID NO: 9502571 - DNA, 22 bp, Homo sapiens
aggcagaagccagccagggtcc

SEQ ID NO: 9502572 - DNA, 22 bp, Homo sapiens
aggcagaatgttggaaaggaag

SEQ ID NO: 9502573 - DNA, 22 bp, Homo sapiens
aggcagaatgttggaaaggaag

SEQ ID NO: 9502574 - DNA, 21 bp, Homo sapiens
aggcagaaagagcccaggctg

SEQ ID NO: 9502575 - DNA, 22 bp, Homo sapiens
aggcagaagccagccagggtcc

SEQ ID NO: 9502576 - DNA, 22 bp, Homo sapiens
aggcagaagccagccagggtcc

SEQ ID NO: 9502577 - DNA, 22 bp, Homo sapiens
aggcagaaccagctgggacttt

SEQ ID NO: 9502578 - DNA, 22 bp, Homo sapiens
aggcagaaccagctgggacttt

SEQ ID NO: 9502579 - DNA, 22 bp, Homo sapiens
aggcagagaaaaaccagatatg

SEQ ID NO: 9502580 - DNA, 22 bp, Homo sapiens
aggcagagaaaaaccagatatg

SEQ ID NO: 9502581 - DNA, 22 bp, Homo sapiens
aggcagatcacttgaggccagg

SEQ ID NO: 9502582 - DNA, 22 bp, Homo sapiens
aggcagatcagtacagggttaa

SEQ ID NO: 9502583 - DNA, 22 bp, Homo sapiens
aggcagatatttcagttcacat

SEQ ID NO: 9502584 - DNA, 22 bp, Homo sapiens
aggcagatattggggtgatgtg

SEQ ID NO: 9502585 - DNA, 22 bp, Homo sapiens
aggcagatatttcagttcacat

SEQ ID NO: 9502586 - DNA, 22 bp, Homo sapiens
aggcagatgggagctggaagtt

SEQ ID NO: 9502587 - DNA, 22 bp, Homo sapiens
aggcagatgtgattaatttcct

SEQ ID NO: 9502588 - DNA, 22 bp, Homo sapiens
aggcagatgtgtcttctaaaat

SEQ ID NO: 9502589 - DNA, 22 bp, Homo sapiens
aggcagattacttgaggccagg

SEQ ID NO: 9502590 - DNA, 22 bp, Homo sapiens
aggcagcaaatgtctggaacag

SEQ ID NO: 9502591 - DNA, 22 bp, Homo sapiens
aggcagcaaagaaatgatgctg

SEQ ID NO: 9502592 - DNA, 22 bp, Homo sapiens
aggcagcaaagaaatgatgctg

SEQ ID NO: 9502593 - DNA, 22 bp, Homo sapiens
aggcagattttctttactcagt

SEQ ID NO: 9502594 - DNA, 22 bp, Homo sapiens
aggcagattttctttactcagt

SEQ ID NO: 9502595 - DNA, 22 bp, Homo sapiens
aggcagatttaggagaaaagaa

SEQ ID NO: 9502596 - DNA, 22 bp, Homo sapiens
aggcagcaaagaaatgatgctg

SEQ ID NO: 9502597 - DNA, 18 bp, Homo sapiens
aggcaggtgctggaagtc

SEQ ID NO: 9502598 - DNA, 18 bp, Homo sapiens
aggcaggtgctggaagtc

SEQ ID NO: 9502599 - DNA, 18 bp, Homo sapiens
aggcaggtgctggaagtc

SEQ ID NO: 9502600 - DNA, 22 bp, Homo sapiens
aggcaggggagctggaagggta

SEQ ID NO: 9502601 - DNA, 22 bp, Homo sapiens
aggcaggggagctggaagggta

SEQ ID NO: 9502602 - DNA, 22 bp, Homo sapiens
aggcagcaagattatttaatcc

SEQ ID NO: 9502603 - DNA, 22 bp, Homo sapiens
aggcaggtgggtcacttgagtc

SEQ ID NO: 9502604 - DNA, 22 bp, Homo sapiens
aggcaggtgttgggagacacca

SEQ ID NO: 9502605 - DNA, 22 bp, Homo sapiens
aggcaggtgttgggagacacca

SEQ ID NO: 9502606 - DNA, 22 bp, Homo sapiens
aggcaggtgttgggagacacca

SEQ ID NO: 9502607 - DNA, 22 bp, Homo sapiens
aggcaggtgttgggagacacca

SEQ ID NO: 9502608 - DNA, 22 bp, Homo sapiens
acatagttagcttagagatact

SEQ ID NO: 9502609 - DNA, 22 bp, Homo sapiens
acatctgagcaacagaacacta

SEQ ID NO: 9502610 - DNA, 22 bp, Homo sapiens
acatctgaccattacaagacat

SEQ ID NO: 9502611 - DNA, 22 bp, Homo sapiens
acatctgaggagaccagcctct

SEQ ID NO: 9502612 - DNA, 22 bp, Homo sapiens
acatctgacatgatcttcagta

SEQ ID NO: 9502613 - DNA, 22 bp, Homo sapiens
acatctgacatgatcttcagta

SEQ ID NO: 9502614 - DNA, 22 bp, Homo sapiens
acatctgaccattacaagacat

SEQ ID NO: 9502615 - DNA, 22 bp, Homo sapiens
acatctgaaagggattgcagaa

SEQ ID NO: 9502616 - DNA, 22 bp, Homo sapiens
acatctgaaagggattgcagaa

SEQ ID NO: 9502617 - DNA, 22 bp, Homo sapiens
acatatattactagtaaagaca

SEQ ID NO: 9502618 - DNA, 22 bp, Homo sapiens
acatatattactagtaaagaca

SEQ ID NO: 9502619 - DNA, 22 bp, Homo sapiens
acatctcttataaactctctga

SEQ ID NO: 9502620 - DNA, 22 bp, Homo sapiens
acatctcatgaatgataaatca

SEQ ID NO: 9502621 - DNA, 22 bp, Homo sapiens
acatctcatgaatgataaatca

SEQ ID NO: 9502622 - DNA, 22 bp, Homo sapiens
acatatatgtaaagtactttgt

SEQ ID NO: 9502623 - DNA, 22 bp, Homo sapiens
acatatatgtaaagtactttgt

SEQ ID NO: 9502624 - DNA, 22 bp, Homo sapiens
acatatattactagtaaagaca

SEQ ID NO: 9502625 - DNA, 22 bp, Homo sapiens
acatatattactagtaaagaca

SEQ ID NO: 9502626 - DNA, 22 bp, Homo sapiens
acatatatgtgcacatgtgcag

SEQ ID NO: 9502627 - DNA, 22 bp, Homo sapiens
acatatatgtaaagtactttgt

SEQ ID NO: 9502628 - DNA, 22 bp, Homo sapiens
acatatatgtaaagtactttgt

SEQ ID NO: 9502629 - DNA, 22 bp, Homo sapiens
acatcttcaaagtgctttgcaa

SEQ ID NO: 9502630 - DNA, 22 bp, Homo sapiens
acatctgtttgagaaaaagaag

SEQ ID NO: 9502631 - DNA, 22 bp, Homo sapiens
acatctgtttgagaaaaagaag

SEQ ID NO: 9502632 - DNA, 22 bp, Homo sapiens
acatctgtttgagaaaaagaag

SEQ ID NO: 9502633 - DNA, 22 bp, Homo sapiens
acatctgtttgagaaaaagaag

SEQ ID NO: 9502634 - DNA, 22 bp, Homo sapiens
acatctgtttaacgaaggcatt

SEQ ID NO: 9502635 - DNA, 22 bp, Homo sapiens
acatctgtcctctgcagagctc

SEQ ID NO: 9502636 - DNA, 22 bp, Homo sapiens
acatctgtaatctagtcaaccc

SEQ ID NO: 9502637 - DNA, 20 bp, Homo sapiens
aggcagtgtagagatgagta

SEQ ID NO: 9502638 - DNA, 22 bp, Homo sapiens
acatcttcccacacttgcaaaa

SEQ ID NO: 9502639 - DNA, 22 bp, Homo sapiens
acatcttcactggtttctggaa

SEQ ID NO: 9502640 - DNA, 22 bp, Homo sapiens
acatctttatactagtccttga

SEQ ID NO: 9502641 - DNA, 23 bp, Homo sapiens
aggcagtggtggtaacatgtcaa

SEQ ID NO: 9502642 - DNA, 20 bp, Homo sapiens
aggcagtgtagagatgagta

SEQ ID NO: 9502643 - DNA, 20 bp, Homo sapiens
aggcagtgtagagatgagta

SEQ ID NO: 9502644 - DNA, 22 bp, Homo sapiens
aggcagtggtgtttgctggtgg

SEQ ID NO: 9502645 - DNA, 23 bp, Homo sapiens
aggcagtgtctcttatcctgtcc

SEQ ID NO: 9502646 - DNA, 22 bp, Homo sapiens
aggcagtgtgtagctggaagag

SEQ ID NO: 9502647 - DNA, 22 bp, Homo sapiens
aggcagtgtgtagctggaagag

SEQ ID NO: 9502648 - DNA, 22 bp, Homo sapiens
aggcagtgtgtagctggaagag

SEQ ID NO: 9502649 - DNA, 22 bp, Homo sapiens
aggcagtgtgtagctggaagag

SEQ ID NO: 9502650 - DNA, 22 bp, Homo sapiens
aggcagaaaatagtcatccaaa

SEQ ID NO: 9502651 - DNA, 22 bp, Homo sapiens
aggcactttttgcattttagaa

SEQ ID NO: 9502652 - DNA, 22 bp, Homo sapiens
aggcactggtccattttctgca

SEQ ID NO: 9502653 - DNA, 22 bp, Homo sapiens
aggcactggtccattttctgca

SEQ ID NO: 9502654 - DNA, 22 bp, Homo sapiens
aggcactaatccctactatgag

SEQ ID NO: 9502655 - DNA, 22 bp, Homo sapiens
aggcactaatggtagtggactg

SEQ ID NO: 9502656 - DNA, 22 bp, Homo sapiens
aggcactagagttcaaagatga

SEQ ID NO: 9502657 - DNA, 23 bp, Homo sapiens
aggcactcgacagaaatattgga

SEQ ID NO: 9502658 - DNA, 20 bp, Homo sapiens
aggcacctgtcacaggtgag

SEQ ID NO: 9502659 - DNA, 20 bp, Homo sapiens
aggcacctgtcacaggtgag

SEQ ID NO: 9502660 - DNA, 22 bp, Homo sapiens
aggcaccttgagagcaggagct

SEQ ID NO: 9502661 - DNA, 22 bp, Homo sapiens
acagtggatgtgatgtccaggt

SEQ ID NO: 9502662 - DNA, 22 bp, Homo sapiens
acagtggatgacatccttttgc

SEQ ID NO: 9502663 - DNA, 22 bp, Homo sapiens
acagtggatatattaaatgaga

SEQ ID NO: 9502664 - DNA, 22 bp, Homo sapiens
acagtggatgtgatgtccaggt

SEQ ID NO: 9502665 - DNA, 22 bp, Homo sapiens
acagtggatgtgatgtccaggt

SEQ ID NO: 9502666 - DNA, 22 bp, Homo sapiens
acagtggatatattaaatgaga

SEQ ID NO: 9502667 - DNA, 22 bp, Homo sapiens
acagtggaggccatatggtcct

SEQ ID NO: 9502668 - DNA, 22 bp, Homo sapiens
acagtggagttggggtagccct

SEQ ID NO: 9502669 - DNA, 22 bp, Homo sapiens
acagtggagctcagatgaaaat

SEQ ID NO: 9502670 - DNA, 22 bp, Homo sapiens
acagtggaggccatatggtcct

SEQ ID NO: 9502671 - DNA, 22 bp, Homo sapiens
acagtggaagcatgatgctatc

SEQ ID NO: 9502672 - DNA, 20 bp, Homo sapiens
acagtggaaattgatgtctg

SEQ ID NO: 9502673 - DNA, 22 bp, Homo sapiens
acagtggaagaagcactgaact

SEQ ID NO: 9502674 - DNA, 20 bp, Homo sapiens
acagtggaaattgatgtctg

SEQ ID NO: 9502675 - DNA, 22 bp, Homo sapiens
acagtggaaatgtgggagggga

SEQ ID NO: 9502676 - DNA, 22 bp, Homo sapiens
acagtggaaatgtgggagggga

SEQ ID NO: 9502677 - DNA, 22 bp, Homo sapiens
acagtggaatttgtagatgtgt

SEQ ID NO: 9502678 - DNA, 22 bp, Homo sapiens
acagtggaatggtgggcctgca

SEQ ID NO: 9502679 - DNA, 22 bp, Homo sapiens
acagtggagaaggcatgaggct

SEQ ID NO: 9502680 - DNA, 22 bp, Homo sapiens
acagtggagaaggcatgaggct

SEQ ID NO: 9502681 - DNA, 22 bp, Homo sapiens
acagtggagaagcaaatgcagt

SEQ ID NO: 9502682 - DNA, 22 bp, Homo sapiens
acagtggagaagcaaatgcagt

SEQ ID NO: 9502683 - DNA, 22 bp, Homo sapiens
aggcacagcacacctggccccc

SEQ ID NO: 9502684 - DNA, 22 bp, Homo sapiens
aggcacagcacacctggccccc

SEQ ID NO: 9502685 - DNA, 21 bp, Homo sapiens
aggcaccacatctccctcccc

SEQ ID NO: 9502686 - DNA, 22 bp, Homo sapiens
aggcaccaggatcagttagaga

SEQ ID NO: 9502687 - DNA, 22 bp, Homo sapiens
acagtggctcatgcctgtcatc

SEQ ID NO: 9502688 - DNA, 22 bp, Homo sapiens
acagtggcctcaaagaaagaga

SEQ ID NO: 9502689 - DNA, 22 bp, Homo sapiens
aggcacctcagctgagcctggg

SEQ ID NO: 9502690 - DNA, 22 bp, Homo sapiens
aggcacctcttaggctgctact

SEQ ID NO: 9502691 - DNA, 22 bp, Homo sapiens
aggcaccagtaagagtagaact

SEQ ID NO: 9502692 - DNA, 22 bp, Homo sapiens
acagtggaaagaacatggattt

SEQ ID NO: 9502693 - DNA, 22 bp, Homo sapiens
acagtggaaagaaacgaattag

SEQ ID NO: 9502694 - DNA, 22 bp, Homo sapiens
acagtggaaagaacatggattt

SEQ ID NO: 9502695 - DNA, 22 bp, Homo sapiens
acagtgcttttgttcctctcct

SEQ ID NO: 9502696 - DNA, 22 bp, Homo sapiens
acagtgcttctgatatgatgcc

SEQ ID NO: 9502697 - DNA, 19 bp, Homo sapiens
acagtgcttctgagtgagg

SEQ ID NO: 9502698 - DNA, 19 bp, Homo sapiens
acagtgcttctgagtgagg

SEQ ID NO: 9502699 - DNA, 17 bp, Homo sapiens
aggaggccctggcgttt

SEQ ID NO: 9502700 - DNA, 17 bp, Homo sapiens
aggaggccctggcgttt

SEQ ID NO: 9502701 - DNA, 22 bp, Homo sapiens
aggaggccctagagctctagag

SEQ ID NO: 9502702 - DNA, 22 bp, Homo sapiens
aggaggccctagagctctagag

SEQ ID NO: 9502703 - DNA, 22 bp, Homo sapiens
aggaggccctagagctctagag

SEQ ID NO: 9502704 - DNA, 22 bp, Homo sapiens
acagtgcagggcgggaagaagg

SEQ ID NO: 9502705 - DNA, 22 bp, Homo sapiens
aggaggccgatttcagaggtcg

SEQ ID NO: 9502706 - DNA, 22 bp, Homo sapiens
acagtgcagggtgggaagaagg

SEQ ID NO: 9502707 - DNA, 22 bp, Homo sapiens
aggaggcccctcctgggttgct

SEQ ID NO: 9502708 - DNA, 22 bp, Homo sapiens
aggaggcccctcctgggttgct

SEQ ID NO: 9502709 - DNA, 22 bp, Homo sapiens
aggaggcccctcctgggttgct

SEQ ID NO: 9502710 - DNA, 22 bp, Homo sapiens
aggaggccctagagctctagag

SEQ ID NO: 9502711 - DNA, 22 bp, Homo sapiens
aggaggccctagagctctagag

SEQ ID NO: 9502712 - DNA, 22 bp, Homo sapiens
aggaggccattctctcagtagc

SEQ ID NO: 9502713 - DNA, 19 bp, Homo sapiens
aggaggccatgccactaga

SEQ ID NO: 9502714 - DNA, 19 bp, Homo sapiens
aggaggccatgccactaga

SEQ ID NO: 9502715 - DNA, 19 bp, Homo sapiens
aggaggccatgccactaga

SEQ ID NO: 9502716 - DNA, 21 bp, Homo sapiens
aggaggccagtactgctgaac

SEQ ID NO: 9502717 - DNA, 22 bp, Homo sapiens
aggaggcagtctgtcccttagc

SEQ ID NO: 9502718 - DNA, 22 bp, Homo sapiens
aggaggccaggccctcaagcct

SEQ ID NO: 9502719 - DNA, 21 bp, Homo sapiens
aggaggccagtactgctgaac

SEQ ID NO: 9502720 - DNA, 22 bp, Homo sapiens
aggaggccaggccctcaagcct

SEQ ID NO: 9502721 - DNA, 22 bp, Homo sapiens
aggaggccaggccctcaagcct

SEQ ID NO: 9502722 - DNA, 23 bp, Homo sapiens
acagtgaaacacgcagtaagagt

SEQ ID NO: 9502723 - DNA, 23 bp, Homo sapiens
acagtgaaacacgcagtaagagt

SEQ ID NO: 9502724 - DNA, 22 bp, Homo sapiens
acagtgaatgagaatggagaaa

SEQ ID NO: 9502725 - DNA, 22 bp, Homo sapiens
acagtgaaaagtagctaacaca

SEQ ID NO: 9502726 - DNA, 22 bp, Homo sapiens
acagtgaaaagaatattagaat

SEQ ID NO: 9502727 - DNA, 22 bp, Homo sapiens
acagtgaaaattctattgattt

SEQ ID NO: 9502728 - DNA, 22 bp, Homo sapiens
acagtgaaaattctattgattt

SEQ ID NO: 9502729 - DNA, 22 bp, Homo sapiens
acagtgaaaataatatcttcaa

SEQ ID NO: 9502730 - DNA, 22 bp, Homo sapiens
acagtgaaaagaatattagaat

SEQ ID NO: 9502731 - DNA, 22 bp, Homo sapiens
acagtctttgcaggagaaagga

SEQ ID NO: 9502732 - DNA, 22 bp, Homo sapiens
acagtgaaaagaatattagaat

SEQ ID NO: 9502733 - DNA, 22 bp, Homo sapiens
aggactgggtgcagagggcatc

SEQ ID NO: 9502734 - DNA, 22 bp, Homo sapiens
acagtctggaagcagggggcaa

SEQ ID NO: 9502735 - DNA, 22 bp, Homo sapiens
acagtctggaggctgcttcatt

SEQ ID NO: 9502736 - DNA, 22 bp, Homo sapiens
acagtgaatgcccaagaaaagt

SEQ ID NO: 9502737 - DNA, 22 bp, Homo sapiens
acagtgacgtttatttgagacg

SEQ ID NO: 9502738 - DNA, 22 bp, Homo sapiens
aggaggcagtctgtcccttagc

SEQ ID NO: 9502739 - DNA, 22 bp, Homo sapiens
aggaggcaggaagtctatggga

SEQ ID NO: 9502740 - DNA, 22 bp, Homo sapiens
acagtgagcggtagtgattgct

SEQ ID NO: 9502741 - DNA, 22 bp, Homo sapiens
acagtgaggaagcagctgtgct

SEQ ID NO: 9502742 - DNA, 22 bp, Homo sapiens
acagtgagcggtagtgattgct

SEQ ID NO: 9502743 - DNA, 22 bp, Homo sapiens
acagtgagcccactccaggaga

SEQ ID NO: 9502744 - DNA, 22 bp, Homo sapiens
acagtgagatccaagggcaggc

SEQ ID NO: 9502745 - DNA, 22 bp, Homo sapiens
acctcagctatttcaaaacaga

SEQ ID NO: 9502746 - DNA, 22 bp, Homo sapiens
acctcaggatgtggacacagaa

SEQ ID NO: 9502747 - DNA, 22 bp, Homo sapiens
acctccagctttttagagacat

SEQ ID NO: 9502748 - DNA, 22 bp, Homo sapiens
acctccagctttttagagacat

SEQ ID NO: 9502749 - DNA, 22 bp, Homo sapiens
acctcacaagtctctgtcagct

SEQ ID NO: 9502750 - DNA, 22 bp, Homo sapiens
acctcacaagtctctgtcagct

SEQ ID NO: 9502751 - DNA, 22 bp, Homo sapiens
acctcagagatacaaaccatgg

SEQ ID NO: 9502752 - DNA, 22 bp, Homo sapiens
accctttgtcaagcacagaaga

SEQ ID NO: 9502753 - DNA, 21 bp, Homo sapiens
acctcaagcaacaaccaaggt

SEQ ID NO: 9502754 - DNA, 22 bp, Homo sapiens
aggggccacctgtggcaccctg

SEQ ID NO: 9502755 - DNA, 22 bp, Homo sapiens
aggggccacctgtggcaccctg

SEQ ID NO: 9502756 - DNA, 22 bp, Homo sapiens
aggggccaccaccaaggaaggt

SEQ ID NO: 9502757 - DNA, 22 bp, Homo sapiens
aggggcctcgcaggaccgctcc

SEQ ID NO: 9502758 - DNA, 22 bp, Homo sapiens
aggggcctcagcctcctggtca

SEQ ID NO: 9502759 - DNA, 22 bp, Homo sapiens
aggggcctcctcattggagtgt

SEQ ID NO: 9502760 - DNA, 21 bp, Homo sapiens
aggggcccttgccaggacgcc

SEQ ID NO: 9502761 - DNA, 20 bp, Homo sapiens
aggggtgatcgggtgacact

SEQ ID NO: 9502762 - DNA, 22 bp, Homo sapiens
aggggtgatttgggacaggaca

SEQ ID NO: 9502763 - DNA, 22 bp, Homo sapiens
aggggtgacacatatcagtgca

SEQ ID NO: 9502764 - DNA, 22 bp, Homo sapiens
acctccagctttttagagacat

SEQ ID NO: 9502765 - DNA, 22 bp, Homo sapiens
aggggtgacacatatcagtgca

SEQ ID NO: 9502766 - DNA, 22 bp, Homo sapiens
aggggtggcctgccttactccc

SEQ ID NO: 9502767 - DNA, 22 bp, Homo sapiens
aggggtggagagtgttgccagt

SEQ ID NO: 9502768 - DNA, 22 bp, Homo sapiens
aggggtggagagtgttgccagt

SEQ ID NO: 9502769 - DNA, 22 bp, Homo sapiens
aggggtggagagtgttgccagt

SEQ ID NO: 9502770 - DNA, 22 bp, Homo sapiens
aggggtgatttgggacaggaca

SEQ ID NO: 9502771 - DNA, 22 bp, Homo sapiens
aggggtgatttgggacaggaca

SEQ ID NO: 9502772 - DNA, 22 bp, Homo sapiens
aggggtggagagtgttgccagt

SEQ ID NO: 9502773 - DNA, 22 bp, Homo sapiens
aggggtgatttgggacaggaca

SEQ ID NO: 9502774 - DNA, 20 bp, Homo sapiens
agggtcagtagcacagagct

SEQ ID NO: 9502775 - DNA, 19 bp, Homo sapiens
agggtacacgagagaagag

SEQ ID NO: 9502776 - DNA, 22 bp, Homo sapiens
aggggttggatttggcctagag

SEQ ID NO: 9502777 - DNA, 22 bp, Homo sapiens
agggtaaagtacatccttctca

SEQ ID NO: 9502778 - DNA, 22 bp, Homo sapiens
agggtcagtgatgagggagccc

SEQ ID NO: 9502779 - DNA, 22 bp, Homo sapiens
agggtcagtgatgagggagccc

SEQ ID NO: 9502780 - DNA, 22 bp, Homo sapiens
agggtcagtgatgagggagccc

SEQ ID NO: 9502781 - DNA, 22 bp, Homo sapiens
agggtcagtagtgatgcgtgaa

SEQ ID NO: 9502782 - DNA, 22 bp, Homo sapiens
aggggttggacataagacagaa

SEQ ID NO: 9502783 - DNA, 23 bp, Homo sapiens
aggggtggtcagtacccgcagtg

SEQ ID NO: 9502784 - DNA, 23 bp, Homo sapiens
aggggtggtcagtacccgcagtg

SEQ ID NO: 9502785 - DNA, 23 bp, Homo sapiens
aggggtggtcagtacccgcagtg

SEQ ID NO: 9502786 - DNA, 23 bp, Homo sapiens
aggggtggtcagtacccgcagtg

SEQ ID NO: 9502787 - DNA, 22 bp, Homo sapiens
agggctgaaacataatccttct

SEQ ID NO: 9502788 - DNA, 22 bp, Homo sapiens
agggctgaagggaggtgctcat

SEQ ID NO: 9502789 - DNA, 22 bp, Homo sapiens
agggctcagggtcaccatctgt

SEQ ID NO: 9502790 - DNA, 22 bp, Homo sapiens
agggctgacaaatggcagtgac

SEQ ID NO: 9502791 - DNA, 23 bp, Homo sapiens
agggctgaatgcagagaagcaga

SEQ ID NO: 9502792 - DNA, 23 bp, Homo sapiens
agggctgaatgcagagaagcaga

SEQ ID NO: 9502793 - DNA, 22 bp, Homo sapiens
agggctgacacaccttatcctc

SEQ ID NO: 9502794 - DNA, 22 bp, Homo sapiens
agggctgacagtaaaagtatga

SEQ ID NO: 9502795 - DNA, 22 bp, Homo sapiens
agggctgacagtgaggagtcaa

SEQ ID NO: 9502796 - DNA, 22 bp, Homo sapiens
agggctcagaaagcaggttttc

SEQ ID NO: 9502797 - DNA, 22 bp, Homo sapiens
agggctcactgggaggctataa

SEQ ID NO: 9502798 - DNA, 22 bp, Homo sapiens
agggctcactgggaggctataa

SEQ ID NO: 9502799 - DNA, 22 bp, Homo sapiens
agggctcaccactgtgcactcc

SEQ ID NO: 9502800 - DNA, 22 bp, Homo sapiens
agggctcagagcaaaagggcac

SEQ ID NO: 9502801 - DNA, 22 bp, Homo sapiens
agggctcagcctcctcctcagc

SEQ ID NO: 9502802 - DNA, 22 bp, Homo sapiens
agggctcagggcacgtcatcca

SEQ ID NO: 9502803 - DNA, 22 bp, Homo sapiens
agggctcaggggccccaagctg

SEQ ID NO: 9502804 - DNA, 22 bp, Homo sapiens
agggctcagcatctcattctgt

SEQ ID NO: 9502805 - DNA, 22 bp, Homo sapiens
agggctcagagtagttcggttt

SEQ ID NO: 9502806 - DNA, 22 bp, Homo sapiens
agggctcagccagcctgtgtgc

SEQ ID NO: 9502807 - DNA, 22 bp, Homo sapiens
agggctcagccagcctgtgtgc

SEQ ID NO: 9502808 - DNA, 22 bp, Homo sapiens
aggggcagttccaagttttgtg

SEQ ID NO: 9502809 - DNA, 22 bp, Homo sapiens
aggggcagttccaagttttgtg

SEQ ID NO: 9502810 - DNA, 22 bp, Homo sapiens
aggggcagttccaagttttgtg

SEQ ID NO: 9502811 - DNA, 22 bp, Homo sapiens
aggggcaggtgctgcacttaga

SEQ ID NO: 9502812 - DNA, 22 bp, Homo sapiens
aggggcaggtgctgcacttaga

SEQ ID NO: 9502813 - DNA, 22 bp, Homo sapiens
aggggagcgacattccgtgccg

SEQ ID NO: 9502814 - DNA, 22 bp, Homo sapiens
aggggagctaacaccagagccc

SEQ ID NO: 9502815 - DNA, 22 bp, Homo sapiens
aggggagctaacaccagagccc

SEQ ID NO: 9502816 - DNA, 22 bp, Homo sapiens
aggggagcttgcctggtcaccc

SEQ ID NO: 9502817 - DNA, 22 bp, Homo sapiens
aggggagcttgcctggtcaccc

SEQ ID NO: 9502818 - DNA, 22 bp, Homo sapiens
aggggagcttgaggcatggcct

SEQ ID NO: 9502819 - DNA, 22 bp, Homo sapiens
aggggagcttgcctggtcaccc

SEQ ID NO: 9502820 - DNA, 22 bp, Homo sapiens
aggggagcatctgtgatggtta

SEQ ID NO: 9502821 - DNA, 22 bp, Homo sapiens
aggggagcatctgtgatggtta

SEQ ID NO: 9502822 - DNA, 22 bp, Homo sapiens
aggggagcatctgtgatggtta

SEQ ID NO: 9502823 - DNA, 22 bp, Homo sapiens
aggggagcaaggccgtggtgta

SEQ ID NO: 9502824 - DNA, 22 bp, Homo sapiens
aggggagcaaggccgtggtgta

SEQ ID NO: 9502825 - DNA, 22 bp, Homo sapiens
aggggagcaaggccgtggtgta

SEQ ID NO: 9502826 - DNA, 22 bp, Homo sapiens
aggggagcaacatagtcactct

SEQ ID NO: 9502827 - DNA, 22 bp, Homo sapiens
aggggagccgaggggcatctgt

SEQ ID NO: 9502828 - DNA, 22 bp, Homo sapiens
aggggagccgaggggcatctgt

SEQ ID NO: 9502829 - DNA, 22 bp, Homo sapiens
aggggagcgacattccgtgccg

SEQ ID NO: 9502830 - DNA, 22 bp, Homo sapiens
aggggagccgaggggcatctgt

SEQ ID NO: 9502831 - DNA, 22 bp, Homo sapiens
aggggagccgaggggcatctgt

SEQ ID NO: 9502832 - DNA, 22 bp, Homo sapiens
aggggagccgaggggcatctgt

SEQ ID NO: 9502833 - DNA, 22 bp, Homo sapiens
aggggagcccctggtcctggtg

SEQ ID NO: 9502834 - DNA, 22 bp, Homo sapiens
aggggagcccctggtcctggtg

SEQ ID NO: 9502835 - DNA, 22 bp, Homo sapiens
aggggagccagggctgcgagtt

SEQ ID NO: 9502836 - DNA, 22 bp, Homo sapiens
aggggagccagggctgcgagtt

SEQ ID NO: 9502837 - DNA, 22 bp, Homo sapiens
accagagagcctaggctgggca

SEQ ID NO: 9502838 - DNA, 22 bp, Homo sapiens
accagagagcctaggctgggca

SEQ ID NO: 9502839 - DNA, 22 bp, Homo sapiens
accagagaaaacacagcaggct

SEQ ID NO: 9502840 - DNA, 20 bp, Homo sapiens
accagagactggggacaagt

SEQ ID NO: 9502841 - DNA, 20 bp, Homo sapiens
accagagacctgaatcagtt

SEQ ID NO: 9502842 - DNA, 20 bp, Homo sapiens
accagagacctgaatcagtt

SEQ ID NO: 9502843 - DNA, 22 bp, Homo sapiens
agggagctgactggctgccatt

SEQ ID NO: 9502844 - DNA, 22 bp, Homo sapiens
agggagctgactggctgccatt

SEQ ID NO: 9502845 - DNA, 22 bp, Homo sapiens
agggaggatagtagtcagttta

SEQ ID NO: 9502846 - DNA, 22 bp, Homo sapiens
agggaggatctgctccttgtct

SEQ ID NO: 9502847 - DNA, 22 bp, Homo sapiens
agggaggatctgctccttgtct

SEQ ID NO: 9502848 - DNA, 20 bp, Homo sapiens
accagagctctcagtatgtg

SEQ ID NO: 9502849 - DNA, 22 bp, Homo sapiens
accagagctcttcagcacagga

SEQ ID NO: 9502850 - DNA, 22 bp, Homo sapiens
agggaggtctttgaggggctta

SEQ ID NO: 9502851 - DNA, 22 bp, Homo sapiens
agggaggtctggctgccctgag

SEQ ID NO: 9502852 - DNA, 22 bp, Homo sapiens
agggaggtctggctgccctgag

SEQ ID NO: 9502853 - DNA, 20 bp, Homo sapiens
agggaggtgctgggcctgag

SEQ ID NO: 9502854 - DNA, 20 bp, Homo sapiens
agggaggtgctgggcctgag

SEQ ID NO: 9502855 - DNA, 20 bp, Homo sapiens
agggaggtgctgggcctgag

SEQ ID NO: 9502856 - DNA, 22 bp, Homo sapiens
agggaggtctggctgccctgag

SEQ ID NO: 9502857 - DNA, 22 bp, Homo sapiens
agggaggtaggagcttctagct

SEQ ID NO: 9502858 - DNA, 19 bp, Homo sapiens
agggaggtagcattggaaa

SEQ ID NO: 9502859 - DNA, 22 bp, Homo sapiens
agggaggcattagctactgcga

SEQ ID NO: 9502860 - DNA, 22 bp, Homo sapiens
agggaggcattagctactgcga

SEQ ID NO: 9502861 - DNA, 22 bp, Homo sapiens
agggatgtgacattacagaagc

SEQ ID NO: 9502862 - DNA, 22 bp, Homo sapiens
agggatgtgcagcatccagaca

SEQ ID NO: 9502863 - DNA, 20 bp, Homo sapiens
agggcaaaatccaaaagtct

SEQ ID NO: 9502864 - DNA, 22 bp, Homo sapiens
agggcaagggttgaagataaga

SEQ ID NO: 9502865 - DNA, 22 bp, Homo sapiens
agggcaatccagccagctgatc

SEQ ID NO: 9502866 - DNA, 22 bp, Homo sapiens
agggcaatgttgctgttcagaa

SEQ ID NO: 9502867 - DNA, 22 bp, Homo sapiens
agggcacatctgctgggaatgg

SEQ ID NO: 9502868 - DNA, 19 bp, Homo sapiens
agggcacagggacagaagg

SEQ ID NO: 9502869 - DNA, 22 bp, Homo sapiens
agggcacatctgctgggaatgg

SEQ ID NO: 9502870 - DNA, 21 bp, Homo sapiens
agggcacccccgctgcctacc

SEQ ID NO: 9502871 - DNA, 22 bp, Homo sapiens
agggcacaagactctgagcccc

SEQ ID NO: 9502872 - DNA, 22 bp, Homo sapiens
agggcacaagactctgagcccc

SEQ ID NO: 9502873 - DNA, 21 bp, Homo sapiens
agggctcaaatgtgcttgctg

SEQ ID NO: 9502874 - DNA, 22 bp, Homo sapiens
agggcctgtcagcggtgtcctg

SEQ ID NO: 9502875 - DNA, 22 bp, Homo sapiens
agggctcaccactgtgcactcc

SEQ ID NO: 9502876 - DNA, 22 bp, Homo sapiens
agggctcaccactgtgcactcc

SEQ ID NO: 9502877 - DNA, 22 bp, Homo sapiens
agggctcaatggtgggcatgta

SEQ ID NO: 9502878 - DNA, 22 bp, Homo sapiens
agggctcaatggtgggcatgta

SEQ ID NO: 9502879 - DNA, 22 bp, Homo sapiens
agggccagttctacctctgaat

SEQ ID NO: 9502880 - DNA, 22 bp, Homo sapiens
agggccagttctacctctgaat

SEQ ID NO: 9502881 - DNA, 22 bp, Homo sapiens
agggccagttctacctctgaat

SEQ ID NO: 9502882 - DNA, 22 bp, Homo sapiens
agggccagttctacctctgaat

SEQ ID NO: 9502883 - DNA, 22 bp, Homo sapiens
agggcctggttctgtgtaggga

SEQ ID NO: 9502884 - DNA, 22 bp, Homo sapiens
agggcctggttctgtgtaggga

SEQ ID NO: 9502885 - DNA, 22 bp, Homo sapiens
agggccagttcagaggacatgg

SEQ ID NO: 9502886 - DNA, 22 bp, Homo sapiens
agggccagttcagaggacatgg

SEQ ID NO: 9502887 - DNA, 22 bp, Homo sapiens
agggccagtaaatgtttcctca

SEQ ID NO: 9502888 - DNA, 22 bp, Homo sapiens
agggccagtaaatgtttcctca

SEQ ID NO: 9502889 - DNA, 22 bp, Homo sapiens
agggccagtattaaggtaatta

SEQ ID NO: 9502890 - DNA, 22 bp, Homo sapiens
agggccagtaccaggtgggtgg

SEQ ID NO: 9502891 - DNA, 22 bp, Homo sapiens
agggccagtaccaggtgggtgg

SEQ ID NO: 9502892 - DNA, 22 bp, Homo sapiens
agggccagtaccaggtgggtgg

SEQ ID NO: 9502893 - DNA, 22 bp, Homo sapiens
agggccagtgggttgaaaggca

SEQ ID NO: 9502894 - DNA, 22 bp, Homo sapiens
agggccagtgggttgaaaggca

SEQ ID NO: 9502895 - DNA, 22 bp, Homo sapiens
agggccagtattaaggtaatta

SEQ ID NO: 9502896 - DNA, 22 bp, Homo sapiens
agggccagttcagaggacatgg

SEQ ID NO: 9502897 - DNA, 22 bp, Homo sapiens
agggcatgctggaggagagaca

SEQ ID NO: 9502898 - DNA, 23 bp, Homo sapiens
agggcactgttgggtgttgagga

SEQ ID NO: 9502899 - DNA, 23 bp, Homo sapiens
agggcactgttgggtgttgagga

SEQ ID NO: 9502900 - DNA, 23 bp, Homo sapiens
agggcactgaagctggaattggg

SEQ ID NO: 9502901 - DNA, 22 bp, Homo sapiens
agggcactggcttgcaaactca

SEQ ID NO: 9502902 - DNA, 22 bp, Homo sapiens
agggcactgaacagctgtagca

SEQ ID NO: 9502903 - DNA, 22 bp, Homo sapiens
agggcactccttggcagctctg

SEQ ID NO: 9502904 - DNA, 22 bp, Homo sapiens
agggcactccttggcagctctg

SEQ ID NO: 9502905 - DNA, 22 bp, Homo sapiens
agggccagatgaagccacaagc

SEQ ID NO: 9502906 - DNA, 22 bp, Homo sapiens
agggccagatgaagccacaagc

SEQ ID NO: 9502907 - DNA, 21 bp, Homo sapiens
agggccagatcaccaaggagc

SEQ ID NO: 9502908 - DNA, 21 bp, Homo sapiens
agggccagatcaccaaggagc

SEQ ID NO: 9502909 - DNA, 22 bp, Homo sapiens
agggccagccaggccctacaaa

SEQ ID NO: 9502910 - DNA, 22 bp, Homo sapiens
agggccagccaggccctacaaa

SEQ ID NO: 9502911 - DNA, 22 bp, Homo sapiens
agggccagcccataatgccaaa

SEQ ID NO: 9502912 - DNA, 22 bp, Homo sapiens
agggccagccaggccctacaaa

SEQ ID NO: 9502913 - DNA, 22 bp, Homo sapiens
agggccagcagcttggccaacc

SEQ ID NO: 9502914 - DNA, 22 bp, Homo sapiens
agggccagcccataatgccaaa

SEQ ID NO: 9502915 - DNA, 22 bp, Homo sapiens
agggccagcccataatgccaaa

SEQ ID NO: 9502916 - DNA, 22 bp, Homo sapiens
agggccagcccataatgccaaa

SEQ ID NO: 9502917 - DNA, 22 bp, Homo sapiens
agggccagcactcctggcagga

SEQ ID NO: 9502918 - DNA, 22 bp, Homo sapiens
agggccagcactcctggcagga

SEQ ID NO: 9502919 - DNA, 22 bp, Homo sapiens
agggccagcactcctggcagga

SEQ ID NO: 9502920 - DNA, 22 bp, Homo sapiens
agggccagcactcctggcagga

SEQ ID NO: 9502921 - DNA, 22 bp, Homo sapiens
agggccagcactcctggcagga

SEQ ID NO: 9502922 - DNA, 22 bp, Homo sapiens
aggctctggcaacagctggtgt

SEQ ID NO: 9502923 - DNA, 22 bp, Homo sapiens
aggctctggcaacagctggtgt

SEQ ID NO: 9502924 - DNA, 22 bp, Homo sapiens
aggctctggctactacagagct

SEQ ID NO: 9502925 - DNA, 22 bp, Homo sapiens
aggctgctctgcgaagtcagct

SEQ ID NO: 9502926 - DNA, 22 bp, Homo sapiens
aggctgctctgcgaagtcagct

SEQ ID NO: 9502927 - DNA, 22 bp, Homo sapiens
aggctgctgaggccaccacgct

SEQ ID NO: 9502928 - DNA, 23 bp, Homo sapiens
aggctgctgagatgggtgtgtca

SEQ ID NO: 9502929 - DNA, 17 bp, Homo sapiens
aggctgctgggccaggg

SEQ ID NO: 9502930 - DNA, 21 bp, Homo sapiens
aggctgctggctcagggtcct

SEQ ID NO: 9502931 - DNA, 22 bp, Homo sapiens
aggctgcttcagctgcagggag

SEQ ID NO: 9502932 - DNA, 22 bp, Homo sapiens
acatttctcagggagttttgct

SEQ ID NO: 9502933 - DNA, 21 bp, Homo sapiens
aggctgctggctcagggtcct

SEQ ID NO: 9502934 - DNA, 21 bp, Homo sapiens
aggctgctggctcagggtcct

SEQ ID NO: 9502935 - DNA, 22 bp, Homo sapiens
aggctgctggcaggcgtggacg

SEQ ID NO: 9502936 - DNA, 22 bp, Homo sapiens
aggctgctgctctacagttgct

SEQ ID NO: 9502937 - DNA, 22 bp, Homo sapiens
aggctgctggaggatttatgcc

SEQ ID NO: 9502938 - DNA, 22 bp, Homo sapiens
aggctgctgccttggagagtgt

SEQ ID NO: 9502939 - DNA, 22 bp, Homo sapiens
acatttctcaggtaagtcattt

SEQ ID NO: 9502940 - DNA, 22 bp, Homo sapiens
acatttctcaggtaagtcattt

SEQ ID NO: 9502941 - DNA, 22 bp, Homo sapiens
acatttctcaggtaagtcattt

SEQ ID NO: 9502942 - DNA, 22 bp, Homo sapiens
acatttctcatctagtagagta

SEQ ID NO: 9502943 - DNA, 22 bp, Homo sapiens
acatttctcaggtaagtcattt

SEQ ID NO: 9502944 - DNA, 22 bp, Homo sapiens
acatttctcataggagagccac

SEQ ID NO: 9502945 - DNA, 22 bp, Homo sapiens
acatttctcatctagtagagta

SEQ ID NO: 9502946 - DNA, 22 bp, Homo sapiens
acatttctccctgcatgcctgc

SEQ ID NO: 9502947 - DNA, 22 bp, Homo sapiens
acatttctcattctcccctaac

SEQ ID NO: 9502948 - DNA, 22 bp, Homo sapiens
acatttctccctgcatgcctgc

SEQ ID NO: 9502949 - DNA, 22 bp, Homo sapiens
acatttctccctgcatgcctgc

SEQ ID NO: 9502950 - DNA, 22 bp, Homo sapiens
acatttctcctacttgttattt

SEQ ID NO: 9502951 - DNA, 18 bp, Homo sapiens
acatttctccttctgacc

SEQ ID NO: 9502952 - DNA, 18 bp, Homo sapiens
acatttctccttctgacc

SEQ ID NO: 9502953 - DNA, 18 bp, Homo sapiens
acatttctctctgcgtga

SEQ ID NO: 9502954 - DNA, 22 bp, Homo sapiens
aggctggcatacatttgttctt

SEQ ID NO: 9502955 - DNA, 18 bp, Homo sapiens
acatttctctctgcgtga

SEQ ID NO: 9502956 - DNA, 22 bp, Homo sapiens
aggctggctggggatgcgtctt

SEQ ID NO: 9502957 - DNA, 22 bp, Homo sapiens
aggctggctggggatgcgtctt

SEQ ID NO: 9502958 - DNA, 23 bp, Homo sapiens
aggctggcttcaggagcctctcc

SEQ ID NO: 9502959 - DNA, 22 bp, Homo sapiens
aggctggccagtgctgcagtgg

SEQ ID NO: 9502960 - DNA, 22 bp, Homo sapiens
aggctggcttggctctcctgtg

SEQ ID NO: 9502961 - DNA, 23 bp, Homo sapiens
aggctggcttcaggagcctctcc

SEQ ID NO: 9502962 - DNA, 22 bp, Homo sapiens
aggctggcttcccaagcgtcct

SEQ ID NO: 9502963 - DNA, 22 bp, Homo sapiens
aggctggcttcccaagcgtcct

SEQ ID NO: 9502964 - DNA, 22 bp, Homo sapiens
accacaggacccatgagtcagt

SEQ ID NO: 9502965 - DNA, 22 bp, Homo sapiens
accactgcccatggtgaaaact

SEQ ID NO: 9502966 - DNA, 22 bp, Homo sapiens
accacaggacccatgagtcagt

SEQ ID NO: 9502967 - DNA, 22 bp, Homo sapiens
accactgcccatggtgaaaact

SEQ ID NO: 9502968 - DNA, 21 bp, Homo sapiens
accactgcctccaaggttcag

SEQ ID NO: 9502969 - DNA, 22 bp, Homo sapiens
accactgcccatggtgaaaact

SEQ ID NO: 9502970 - DNA, 22 bp, Homo sapiens
accactggcctggtggggacca

SEQ ID NO: 9502971 - DNA, 19 bp, Homo sapiens
accactggccacacactcc

SEQ ID NO: 9502972 - DNA, 22 bp, Homo sapiens
accactggatatcagagatgta

SEQ ID NO: 9502973 - DNA, 22 bp, Homo sapiens
accactggctcaggagctggga

SEQ ID NO: 9502974 - DNA, 22 bp, Homo sapiens
accagaaaggaataatagaatt

SEQ ID NO: 9502975 - DNA, 22 bp, Homo sapiens
accagaaaggatgcctccttcc

SEQ ID NO: 9502976 - DNA, 22 bp, Homo sapiens
accagaaaggaataatagaatt

SEQ ID NO: 9502977 - DNA, 22 bp, Homo sapiens
accagaaaggaataatagaatt

SEQ ID NO: 9502978 - DNA, 22 bp, Homo sapiens
accagaaaggaataatagaatt

SEQ ID NO: 9502979 - DNA, 22 bp, Homo sapiens
aggctggctttggtagcatggt

SEQ ID NO: 9502980 - DNA, 22 bp, Homo sapiens
aggctgggaaacctgaagttgt

SEQ ID NO: 9502981 - DNA, 22 bp, Homo sapiens
aggctgggaaacctgaagttgt

SEQ ID NO: 9502982 - DNA, 22 bp, Homo sapiens
aggctggcttggctctcctgtg

SEQ ID NO: 9502983 - DNA, 22 bp, Homo sapiens
aggctggctttggtagcatggt

SEQ ID NO: 9502984 - DNA, 22 bp, Homo sapiens
aggctgggaaatgtagtcttcc

SEQ ID NO: 9502985 - DNA, 22 bp, Homo sapiens
aggctgggaaatgtagtcttcc

SEQ ID NO: 9502986 - DNA, 22 bp, Homo sapiens
aggctgggaaatgtagtcttcc

SEQ ID NO: 9502987 - DNA, 22 bp, Homo sapiens
aggctgggaaacctgaagttgt

SEQ ID NO: 9502988 - DNA, 22 bp, Homo sapiens
aggctgggaaacctgaagttgt

SEQ ID NO: 9502989 - DNA, 22 bp, Homo sapiens
aggctgggaaatgtagtcttcc

SEQ ID NO: 9502990 - DNA, 22 bp, Homo sapiens
aggctgggaaatgtattccagc

SEQ ID NO: 9502991 - DNA, 22 bp, Homo sapiens
aggctgggaaatgtattccagc

SEQ ID NO: 9502992 - DNA, 21 bp, Homo sapiens
aggctgtgacttacactatct

SEQ ID NO: 9502993 - DNA, 22 bp, Homo sapiens
aggctgggaaatgtattccagc

SEQ ID NO: 9502994 - DNA, 22 bp, Homo sapiens
aggctgggaaatgtagtcttcc

SEQ ID NO: 9502995 - DNA, 22 bp, Homo sapiens
aggctgggaaatgtattccagc

SEQ ID NO: 9502996 - DNA, 19 bp, Homo sapiens
aggctgtgaggggaaggaa

SEQ ID NO: 9502997 - DNA, 19 bp, Homo sapiens
aggctgtgagggaggactc

SEQ ID NO: 9502998 - DNA, 19 bp, Homo sapiens
aggctgtgaggggaaggaa

SEQ ID NO: 9502999 - DNA, 19 bp, Homo sapiens
aggctgtgagggaggactc

SEQ ID NO: 9503000 - DNA, 22 bp, Homo sapiens
aggctgtgagttttgtctcaga

SEQ ID NO: 9503001 - DNA, 22 bp, Homo sapiens
aggctgtgatctcatgatttgt

SEQ ID NO: 9503002 - DNA, 19 bp, Homo sapiens
aggctgtgaggggaaggaa

SEQ ID NO: 9503003 - DNA, 22 bp, Homo sapiens
aggctgtgagcaagaacaccta

SEQ ID NO: 9503004 - DNA, 19 bp, Homo sapiens
aggctgtgagggaggactc

SEQ ID NO: 9503005 - DNA, 19 bp, Homo sapiens
aggctgtgagggaggactc

SEQ ID NO: 9503006 - DNA, 19 bp, Homo sapiens
aggctgtgagggaggactc

SEQ ID NO: 9503007 - DNA, 22 bp, Homo sapiens
aggctgtgagaagtccttcagt

SEQ ID NO: 9503008 - DNA, 22 bp, Homo sapiens
acatgtaaaaggaacatgcatg

SEQ ID NO: 9503009 - DNA, 22 bp, Homo sapiens
acatgtaaaaggaacatgcatg

SEQ ID NO: 9503010 - DNA, 22 bp, Homo sapiens
acatgtaaacatttacagtatt

SEQ ID NO: 9503011 - DNA, 22 bp, Homo sapiens
acatgtaaaaggaacatgcatg

SEQ ID NO: 9503012 - DNA, 22 bp, Homo sapiens
acatgtaacatatatgtagcat

SEQ ID NO: 9503013 - DNA, 22 bp, Homo sapiens
acatgtaagactagcttaaagt

SEQ ID NO: 9503014 - DNA, 22 bp, Homo sapiens
acatgtaagactagcttaaagt

SEQ ID NO: 9503015 - DNA, 21 bp, Homo sapiens
acatgtaagagagtttcaaga

SEQ ID NO: 9503016 - DNA, 21 bp, Homo sapiens
acatgtaagagagtttcaaga

SEQ ID NO: 9503017 - DNA, 22 bp, Homo sapiens
acatgtaacatatatgtagcat

SEQ ID NO: 9503018 - DNA, 22 bp, Homo sapiens
acatgtaacatatatgtagcat

SEQ ID NO: 9503019 - DNA, 22 bp, Homo sapiens
acatgtaaaagataaattaaca

SEQ ID NO: 9503020 - DNA, 22 bp, Homo sapiens
acatgtaaaagataaattaaca

SEQ ID NO: 9503021 - DNA, 22 bp, Homo sapiens
acatgtaaaagataaattaaca

SEQ ID NO: 9503022 - DNA, 22 bp, Homo sapiens
acatggctaaagcaagtctaga

SEQ ID NO: 9503023 - DNA, 22 bp, Homo sapiens
aggcagtgtgtagctggaagag

SEQ ID NO: 9503024 - DNA, 22 bp, Homo sapiens
aggcagtgtgtagctggaagag

SEQ ID NO: 9503025 - DNA, 22 bp, Homo sapiens
acatgtacatacacatatgtaa

SEQ ID NO: 9503026 - DNA, 22 bp, Homo sapiens
acatgtacatacacatatgtaa

SEQ ID NO: 9503027 - DNA, 20 bp, Homo sapiens
acatgtacagacaggtttct

SEQ ID NO: 9503028 - DNA, 21 bp, Homo sapiens
acatgtacacatgtatgcaca

SEQ ID NO: 9503029 - DNA, 21 bp, Homo sapiens
acatgtaagagagtttcaaga

SEQ ID NO: 9503030 - DNA, 22 bp, Homo sapiens
acatgtatacaatgtgtaatga

SEQ ID NO: 9503031 - DNA, 22 bp, Homo sapiens
acatgtatacaatgtgtaatga

SEQ ID NO: 9503032 - DNA, 20 bp, Homo sapiens
acatgtactaatgaatacag

SEQ ID NO: 9503033 - DNA, 20 bp, Homo sapiens
acatgtactaatgaatacag

SEQ ID NO: 9503034 - DNA, 20 bp, Homo sapiens
acatgtactaatgaatacag

SEQ ID NO: 9503035 - DNA, 22 bp, Homo sapiens
acatgtaggagagtcacaatgc

SEQ ID NO: 9503036 - DNA, 22 bp, Homo sapiens
acatgtactgttggtgaagagg

SEQ ID NO: 9503037 - DNA, 22 bp, Homo sapiens
acatgtctacacattctgcaat

SEQ ID NO: 9503038 - DNA, 22 bp, Homo sapiens
acatgtcaatttagtactctta

SEQ ID NO: 9503039 - DNA, 22 bp, Homo sapiens
acatgtatgctttatgaagtag

SEQ ID NO: 9503040 - DNA, 22 bp, Homo sapiens
acatgtattgacattatattct

SEQ ID NO: 9503041 - DNA, 22 bp, Homo sapiens
acatgtcttttaaagtctaata

SEQ ID NO: 9503042 - DNA, 22 bp, Homo sapiens
acatgtgaggtgtgagtgatac

SEQ ID NO: 9503043 - DNA, 22 bp, Homo sapiens
acatgtcttttaaagtctaata

SEQ ID NO: 9503044 - DNA, 22 bp, Homo sapiens
acatgtctcttctgaaagacaa

SEQ ID NO: 9503045 - DNA, 21 bp, Homo sapiens
acatgtctctaatctcagtga

SEQ ID NO: 9503046 - DNA, 21 bp, Homo sapiens
acatgtctctaatctcagtga

SEQ ID NO: 9503047 - DNA, 22 bp, Homo sapiens
acatgtctccacccatcttaaa

SEQ ID NO: 9503048 - DNA, 22 bp, Homo sapiens
acatgtgcagacagcaagcagg

SEQ ID NO: 9503049 - DNA, 20 bp, Homo sapiens
aggctcactcaccttgtgga

SEQ ID NO: 9503050 - DNA, 22 bp, Homo sapiens
aggctcaggcaggaatggcgga

SEQ ID NO: 9503051 - DNA, 22 bp, Homo sapiens
aggctcaggcaggaatggcgga

SEQ ID NO: 9503052 - DNA, 22 bp, Homo sapiens
aggctcaggaggagctgccgga

SEQ ID NO: 9503053 - DNA, 22 bp, Homo sapiens
aggctcagggactccctccctc

SEQ ID NO: 9503054 - DNA, 22 bp, Homo sapiens
aggctcaggcaggaatggcgga

SEQ ID NO: 9503055 - DNA, 22 bp, Homo sapiens
aggctcagggacggggcccctt

SEQ ID NO: 9503056 - DNA, 22 bp, Homo sapiens
aggctcagacaggaaaagtaac

SEQ ID NO: 9503057 - DNA, 20 bp, Homo sapiens
aggctcagctgagctcttgg

SEQ ID NO: 9503058 - DNA, 20 bp, Homo sapiens
aggctcagctgagctcttgg

SEQ ID NO: 9503059 - DNA, 20 bp, Homo sapiens
aggctcagggtgtttaggaa

SEQ ID NO: 9503060 - DNA, 20 bp, Homo sapiens
aggctcagggtgtttaggaa

SEQ ID NO: 9503061 - DNA, 22 bp, Homo sapiens
aggctcaggtctcaggtctggc

SEQ ID NO: 9503062 - DNA, 22 bp, Homo sapiens
aggctcaggtctcaggtctggc

SEQ ID NO: 9503063 - DNA, 19 bp, Homo sapiens
acatgttttgcagaacagc

SEQ ID NO: 9503064 - DNA, 22 bp, Homo sapiens
aggctcaggtctcaggtctggc

SEQ ID NO: 9503065 - DNA, 22 bp, Homo sapiens
aggctcaggtctcaggtctggc

SEQ ID NO: 9503066 - DNA, 19 bp, Homo sapiens
acatgttttgcagaacagc

SEQ ID NO: 9503067 - DNA, 22 bp, Homo sapiens
acatgttttgtgccttgactag

SEQ ID NO: 9503068 - DNA, 22 bp, Homo sapiens
acattaaaatggagaattttga

SEQ ID NO: 9503069 - DNA, 22 bp, Homo sapiens
acattaaacttgcttggctgta

SEQ ID NO: 9503070 - DNA, 22 bp, Homo sapiens
acattaaatttcatagtgatta

SEQ ID NO: 9503071 - DNA, 22 bp, Homo sapiens
acattaaatttcatagtgatta

SEQ ID NO: 9503072 - DNA, 22 bp, Homo sapiens
aggctcgcatgccctgcaccac

SEQ ID NO: 9503073 - DNA, 22 bp, Homo sapiens
aggctccagtctcctctggcag

SEQ ID NO: 9503074 - DNA, 22 bp, Homo sapiens
acattaacaccataagtgtgtt

SEQ ID NO: 9503075 - DNA, 22 bp, Homo sapiens
acattaacaccgtgagtttggt

SEQ ID NO: 9503076 - DNA, 22 bp, Homo sapiens
aggctccagtctcctctggcag

SEQ ID NO: 9503077 - DNA, 22 bp, Homo sapiens
aggctctggacagtgaggagtt

SEQ ID NO: 9503078 - DNA, 22 bp, Homo sapiens
aggctctggacagtgaggagtt

SEQ ID NO: 9503079 - DNA, 22 bp, Homo sapiens
aggctctggacagtgaggagtt

SEQ ID NO: 9503080 - DNA, 22 bp, Homo sapiens
aggctctggacagtgaggagtt

SEQ ID NO: 9503081 - DNA, 22 bp, Homo sapiens
aggctctgacccatgggaccca

SEQ ID NO: 9503082 - DNA, 22 bp, Homo sapiens
aggctctgacccatgggaccca

SEQ ID NO: 9503083 - DNA, 22 bp, Homo sapiens
aggctctgacccatgggaccca

SEQ ID NO: 9503084 - DNA, 22 bp, Homo sapiens
aggctctggagtgtggtgctgg

SEQ ID NO: 9503085 - DNA, 22 bp, Homo sapiens
aggctctgaaggagaacctgtt

SEQ ID NO: 9503086 - DNA, 22 bp, Homo sapiens
aggctctgaaggagaacctgtt

SEQ ID NO: 9503087 - DNA, 22 bp, Homo sapiens
aggctctctctgcccctgggac

SEQ ID NO: 9503088 - DNA, 22 bp, Homo sapiens
aggctctcctccccaggaccat

SEQ ID NO: 9503089 - DNA, 22 bp, Homo sapiens
aggctctctagaaactgtgcct

SEQ ID NO: 9503090 - DNA, 21 bp, Homo sapiens
aggctctcatccagggaccca

SEQ ID NO: 9503091 - DNA, 22 bp, Homo sapiens
aggctctcagatcagccacatt

SEQ ID NO: 9503092 - DNA, 22 bp, Homo sapiens
aggctctcctccccaggaccat

SEQ ID NO: 9503093 - DNA, 22 bp, Homo sapiens
aggctctcagatcagccacatt

SEQ ID NO: 9503094 - DNA, 22 bp, Homo sapiens
aggctctcaccctctgaccaga

SEQ ID NO: 9503095 - DNA, 22 bp, Homo sapiens
aggctctcaatatgatccagtc

SEQ ID NO: 9503096 - DNA, 22 bp, Homo sapiens
agtcagtcaaaatataaattgt

SEQ ID NO: 9503097 - DNA, 22 bp, Homo sapiens
agtcaggttgcattttaagtaa

SEQ ID NO: 9503098 - DNA, 22 bp, Homo sapiens
agtcagtgaatggtgtatgcta

SEQ ID NO: 9503099 - DNA, 22 bp, Homo sapiens
agtcagtgacttttgctgagag

SEQ ID NO: 9503100 - DNA, 23 bp, Homo sapiens
agtcagtgcgggatggtcagggg

SEQ ID NO: 9503101 - DNA, 22 bp, Homo sapiens
agtcagtgggcttggcacagaa

SEQ ID NO: 9503102 - DNA, 22 bp, Homo sapiens
agtcagtgggcttggcacagaa

SEQ ID NO: 9503103 - DNA, 22 bp, Homo sapiens
agtcagtgggagaagtgtgaag

SEQ ID NO: 9503104 - DNA, 22 bp, Homo sapiens
agtcagtggatttaccatgcgt

SEQ ID NO: 9503105 - DNA, 22 bp, Homo sapiens
agtcagtggctccgagcctggt

SEQ ID NO: 9503106 - DNA, 22 bp, Homo sapiens
agtcacttctattctattaagt

SEQ ID NO: 9503107 - DNA, 22 bp, Homo sapiens
agtcacttcgtgagcactgact

SEQ ID NO: 9503108 - DNA, 22 bp, Homo sapiens
agtcacttcgtgagcactgact

SEQ ID NO: 9503109 - DNA, 22 bp, Homo sapiens
agtaataatagctgtaaagtgc

SEQ ID NO: 9503110 - DNA, 22 bp, Homo sapiens
agtaataaactctttttatctc

SEQ ID NO: 9503111 - DNA, 22 bp, Homo sapiens
agtcacttcctgcttgacctga

SEQ ID NO: 9503112 - DNA, 22 bp, Homo sapiens
agtcaggtgggggctgcagtgg

SEQ ID NO: 9503113 - DNA, 22 bp, Homo sapiens
agtcaggtgaatgttatacaca

SEQ ID NO: 9503114 - DNA, 22 bp, Homo sapiens
agtcacttgattctcctgagct

SEQ ID NO: 9503115 - DNA, 22 bp, Homo sapiens
agtcacttggattagcaattct

SEQ ID NO: 9503116 - DNA, 22 bp, Homo sapiens
agtcacttgggaagcaaagcct

SEQ ID NO: 9503117 - DNA, 22 bp, Homo sapiens
agtcaggggatctagacttgaa

SEQ ID NO: 9503118 - DNA, 22 bp, Homo sapiens
agtcacttgggaagcaaagcct

SEQ ID NO: 9503119 - DNA, 22 bp, Homo sapiens
agtcaggtaccacattacattg

SEQ ID NO: 9503120 - DNA, 22 bp, Homo sapiens
agtcagggttgtaggctcaccc

SEQ ID NO: 9503121 - DNA, 22 bp, Homo sapiens
agtcaggggttggacggggcca

SEQ ID NO: 9503122 - DNA, 22 bp, Homo sapiens
actcagcttcctacagctagaa

SEQ ID NO: 9503123 - DNA, 22 bp, Homo sapiens
agtaacaggtgtacagactatc

SEQ ID NO: 9503124 - DNA, 22 bp, Homo sapiens
agtaacatctttgacatttgtt

SEQ ID NO: 9503125 - DNA, 22 bp, Homo sapiens
agtaacatatagcacttttgga

SEQ ID NO: 9503126 - DNA, 22 bp, Homo sapiens
agtaacatctttgacatttgtt

SEQ ID NO: 9503127 - DNA, 23 bp, Homo sapiens
agtaacatgcaaataacagtctg

SEQ ID NO: 9503128 - DNA, 22 bp, Homo sapiens
agtaacttaagcaattgtgtat

SEQ ID NO: 9503129 - DNA, 23 bp, Homo sapiens
agtaacatgcaaataacagtctg

SEQ ID NO: 9503130 - DNA, 22 bp, Homo sapiens
agtaactatgcttgagaatcag

SEQ ID NO: 9503131 - DNA, 22 bp, Homo sapiens
agtaacttaggagatacatggg

SEQ ID NO: 9503132 - DNA, 22 bp, Homo sapiens
agtaagcaccgggatggtcaag

SEQ ID NO: 9503133 - DNA, 22 bp, Homo sapiens
agtaaggcaatgccactaagat

SEQ ID NO: 9503134 - DNA, 22 bp, Homo sapiens
actcagctcaggagctggctgg

SEQ ID NO: 9503135 - DNA, 22 bp, Homo sapiens
actcagctaaactcagtctatg

SEQ ID NO: 9503136 - DNA, 22 bp, Homo sapiens
actcagagtgcatctcctattt

SEQ ID NO: 9503137 - DNA, 22 bp, Homo sapiens
actcagagcttggctccttgct

SEQ ID NO: 9503138 - DNA, 22 bp, Homo sapiens
actctgggtcctgccattcact

SEQ ID NO: 9503139 - DNA, 22 bp, Homo sapiens
actctggggtgatgtctctgag

SEQ ID NO: 9503140 - DNA, 20 bp, Homo sapiens
actctggggctcattagggg

SEQ ID NO: 9503141 - DNA, 22 bp, Homo sapiens
actctggtctttctgaaagcaa

SEQ ID NO: 9503142 - DNA, 22 bp, Homo sapiens
actctggtagacaaggagaggt

SEQ ID NO: 9503143 - DNA, 22 bp, Homo sapiens
actctggtctttctgaaagcaa

SEQ ID NO: 9503144 - DNA, 22 bp, Homo sapiens
actctgggttctttcacttgac

SEQ ID NO: 9503145 - DNA, 22 bp, Homo sapiens
actctgggttctttcacttgac

SEQ ID NO: 9503146 - DNA, 22 bp, Homo sapiens
actctgggctgttaggagctgt

SEQ ID NO: 9503147 - DNA, 22 bp, Homo sapiens
actctgggccccaggtggagct

SEQ ID NO: 9503148 - DNA, 22 bp, Homo sapiens
actctgggccccaggtggagct

SEQ ID NO: 9503149 - DNA, 22 bp, Homo sapiens
actctgggctttgatttgttac

SEQ ID NO: 9503150 - DNA, 22 bp, Homo sapiens
actctggggcgctactccaact

SEQ ID NO: 9503151 - DNA, 22 bp, Homo sapiens
actctggggcgctactccaact

SEQ ID NO: 9503152 - DNA, 22 bp, Homo sapiens
actctgggctgttaggagctgt

SEQ ID NO: 9503153 - DNA, 22 bp, Homo sapiens
actctgggctttgatttgttac

SEQ ID NO: 9503154 - DNA, 22 bp, Homo sapiens
agtcctgtgcaaatgcatctga

SEQ ID NO: 9503155 - DNA, 22 bp, Homo sapiens
agtcctgttggttccagaggtg

SEQ ID NO: 9503156 - DNA, 22 bp, Homo sapiens
agtccttcccatctgacaccct

SEQ ID NO: 9503157 - DNA, 22 bp, Homo sapiens
agtcctgggttctggtgttttg

SEQ ID NO: 9503158 - DNA, 22 bp, Homo sapiens
agtcctgggtgtgcaaggcaga

SEQ ID NO: 9503159 - DNA, 22 bp, Homo sapiens
agtcctgggtgtgcaaggcaga

SEQ ID NO: 9503160 - DNA, 22 bp, Homo sapiens
agtcctgggtgtgcaaggcaga

SEQ ID NO: 9503161 - DNA, 22 bp, Homo sapiens
agtcctggtgacactcctcttc

SEQ ID NO: 9503162 - DNA, 22 bp, Homo sapiens
agtcctggtgacactcctcttc

SEQ ID NO: 9503163 - DNA, 22 bp, Homo sapiens
agtcctggtgacactcctcttc

SEQ ID NO: 9503164 - DNA, 22 bp, Homo sapiens
agtcctggttctgattctgaca

SEQ ID NO: 9503165 - DNA, 21 bp, Homo sapiens
agtccaggaggaggccaggtt

SEQ ID NO: 9503166 - DNA, 21 bp, Homo sapiens
agtccaggaggaggccaggtt

SEQ ID NO: 9503167 - DNA, 22 bp, Homo sapiens
agtccaggcaagttgttgtgta

SEQ ID NO: 9503168 - DNA, 22 bp, Homo sapiens
agtccaggcattccagccattc

SEQ ID NO: 9503169 - DNA, 21 bp, Homo sapiens
agtccaggagtcacccaagcc

SEQ ID NO: 9503170 - DNA, 22 bp, Homo sapiens
agtccaggagttgggtgacatt

SEQ ID NO: 9503171 - DNA, 22 bp, Homo sapiens
agtccagccttcaatcttagtg

SEQ ID NO: 9503172 - DNA, 22 bp, Homo sapiens
agtccagagaggaggctgtgtg

SEQ ID NO: 9503173 - DNA, 22 bp, Homo sapiens
agtccagaccccggcagctggt

SEQ ID NO: 9503174 - DNA, 22 bp, Homo sapiens
agtccagaccccggcagctggt

SEQ ID NO: 9503175 - DNA, 22 bp, Homo sapiens
agtccagaccccggcagctggt

SEQ ID NO: 9503176 - DNA, 22 bp, Homo sapiens
agtccaggaagcatcatggtct

SEQ ID NO: 9503177 - DNA, 22 bp, Homo sapiens
agtccaggaaaataagctaggt

SEQ ID NO: 9503178 - DNA, 22 bp, Homo sapiens
agtccaggaagcatcatggtct

SEQ ID NO: 9503179 - DNA, 22 bp, Homo sapiens
agtccaggaaaataagctaggt

SEQ ID NO: 9503180 - DNA, 22 bp, Homo sapiens
agtccaggcattccagccattc

SEQ ID NO: 9503181 - DNA, 22 bp, Homo sapiens
agtccaggcctccctctcctgc

SEQ ID NO: 9503182 - DNA, 22 bp, Homo sapiens
agtccaggcctccctctcctgc

SEQ ID NO: 9503183 - DNA, 22 bp, Homo sapiens
agtccaggcctcctcttttcct

SEQ ID NO: 9503184 - DNA, 22 bp, Homo sapiens
actctgggatcttgaaaagagt

SEQ ID NO: 9503185 - DNA, 22 bp, Homo sapiens
actctgggagaggacaaacaaa

SEQ ID NO: 9503186 - DNA, 18 bp, Homo sapiens
actctgggacctgttatt

SEQ ID NO: 9503187 - DNA, 18 bp, Homo sapiens
actctgggacctgttatt

SEQ ID NO: 9503188 - DNA, 22 bp, Homo sapiens
actctgggattgtttctggtat

SEQ ID NO: 9503189 - DNA, 22 bp, Homo sapiens
actctgggatgagaaaagggtt

SEQ ID NO: 9503190 - DNA, 22 bp, Homo sapiens
actctgggcccaccctcagagt

SEQ ID NO: 9503191 - DNA, 22 bp, Homo sapiens
actctgggattgtttctggtat

SEQ ID NO: 9503192 - DNA, 22 bp, Homo sapiens
actctgggcccaccctcagagt

SEQ ID NO: 9503193 - DNA, 22 bp, Homo sapiens
aggtgtctggacttgtgaagca

SEQ ID NO: 9503194 - DNA, 20 bp, Homo sapiens
aggtgtccacgtggcagggt

SEQ ID NO: 9503195 - DNA, 22 bp, Homo sapiens
aggtggtgtttggttacatgag

SEQ ID NO: 9503196 - DNA, 22 bp, Homo sapiens
aggtggtgatgacagaagacag

SEQ ID NO: 9503197 - DNA, 20 bp, Homo sapiens
aggttccagccacaaccagc

SEQ ID NO: 9503198 - DNA, 22 bp, Homo sapiens
aggttccagggattaggatgtg

SEQ ID NO: 9503199 - DNA, 22 bp, Homo sapiens
aggttccaggtctgggttatgt

SEQ ID NO: 9503200 - DNA, 21 bp, Homo sapiens
aggttccagcagccagagaat

SEQ ID NO: 9503201 - DNA, 20 bp, Homo sapiens
aggttccagccacaaccagc

SEQ ID NO: 9503202 - DNA, 22 bp, Homo sapiens
aggttccaagaaatcatcagtg

SEQ ID NO: 9503203 - DNA, 21 bp, Homo sapiens
aggttccagcagccagagaat

SEQ ID NO: 9503204 - DNA, 22 bp, Homo sapiens
aggttcccagagatagagctgt

SEQ ID NO: 9503205 - DNA, 22 bp, Homo sapiens
aggttccaggttcgaatcccat

SEQ ID NO: 9503206 - DNA, 22 bp, Homo sapiens
aggttccatcacctgcagtgga

SEQ ID NO: 9503207 - DNA, 22 bp, Homo sapiens
aggttcccaggatctgtctggg

SEQ ID NO: 9503208 - DNA, 22 bp, Homo sapiens
aggttcctcttcctctggcctg

SEQ ID NO: 9503209 - DNA, 22 bp, Homo sapiens
aggttctcacacgtctacaccc

SEQ ID NO: 9503210 - DNA, 22 bp, Homo sapiens
aggttctcacacgtctacaccc

SEQ ID NO: 9503211 - DNA, 20 bp, Homo sapiens
aggttcctttgtggagaatt

SEQ ID NO: 9503212 - DNA, 22 bp, Homo sapiens
aggttccttatggggatggcta

SEQ ID NO: 9503213 - DNA, 22 bp, Homo sapiens
aggttccttatggggatggcta

SEQ ID NO: 9503214 - DNA, 23 bp, Homo sapiens
aggttctcttatcatctctgccc

SEQ ID NO: 9503215 - DNA, 22 bp, Homo sapiens
aggttcttggtgagcatttggt

SEQ ID NO: 9503216 - DNA, 22 bp, Homo sapiens
actcacagggcctcagttttcc

SEQ ID NO: 9503217 - DNA, 22 bp, Homo sapiens
aggttcttgactctaccttcca

SEQ ID NO: 9503218 - DNA, 22 bp, Homo sapiens
actcacatttcatcaggccaag

SEQ ID NO: 9503219 - DNA, 22 bp, Homo sapiens
actcacagggcctcagttttcc

SEQ ID NO: 9503220 - DNA, 22 bp, Homo sapiens
actcagagcctcgagggactgc

SEQ ID NO: 9503221 - DNA, 22 bp, Homo sapiens
aggtggagacccagagaaggcg

SEQ ID NO: 9503222 - DNA, 22 bp, Homo sapiens
aggtggagacccagagaaggcg

SEQ ID NO: 9503223 - DNA, 22 bp, Homo sapiens
aggtggagacccagagaaggcg

SEQ ID NO: 9503224 - DNA, 22 bp, Homo sapiens
aggtggagacccagagaaggcg

SEQ ID NO: 9503225 - DNA, 16 bp, Homo sapiens
aggtggagaagttcac

SEQ ID NO: 9503226 - DNA, 22 bp, Homo sapiens
aggtggagacccagagaaggcg

SEQ ID NO: 9503227 - DNA, 22 bp, Homo sapiens
aggtggaacgttcaggtgctag

SEQ ID NO: 9503228 - DNA, 22 bp, Homo sapiens
aggtggaacgttcaggtgctag

SEQ ID NO: 9503229 - DNA, 22 bp, Homo sapiens
aggtggagaagagatgggcagt

SEQ ID NO: 9503230 - DNA, 22 bp, Homo sapiens
aggtggagaagagatgggcagt

SEQ ID NO: 9503231 - DNA, 22 bp, Homo sapiens
aggtggagaagagatgggcagt

SEQ ID NO: 9503232 - DNA, 22 bp, Homo sapiens
aggtggagaagagatgggcagt

SEQ ID NO: 9503233 - DNA, 22 bp, Homo sapiens
aggtggagaagagatgggcagt

SEQ ID NO: 9503234 - DNA, 22 bp, Homo sapiens
aggtggtcttggcccacccagg

SEQ ID NO: 9503235 - DNA, 22 bp, Homo sapiens
aggtgggttcccgactctggct

SEQ ID NO: 9503236 - DNA, 17 bp, Homo sapiens
aggtgggtggatcacct

SEQ ID NO: 9503237 - DNA, 22 bp, Homo sapiens
aggtgggttccgcggcggcccg

SEQ ID NO: 9503238 - DNA, 22 bp, Homo sapiens
aggtgggtcctggctctgccat

SEQ ID NO: 9503239 - DNA, 22 bp, Homo sapiens
aggtgggtgccgtctgtcctct

SEQ ID NO: 9503240 - DNA, 22 bp, Homo sapiens
aggtgggtatcatgagagatta

SEQ ID NO: 9503241 - DNA, 22 bp, Homo sapiens
aggtggggttcagtctcagccg

SEQ ID NO: 9503242 - DNA, 19 bp, Homo sapiens
aggtgggtaagcagttctc

SEQ ID NO: 9503243 - DNA, 22 bp, Homo sapiens
aggtggggttcagtctcagccg

SEQ ID NO: 9503244 - DNA, 22 bp, Homo sapiens
agggtgagggtctggccttgag

SEQ ID NO: 9503245 - DNA, 22 bp, Homo sapiens
agggtgcaaaagcaaggacagt

SEQ ID NO: 9503246 - DNA, 22 bp, Homo sapiens
agggtcctaagcctcagataag

SEQ ID NO: 9503247 - DNA, 23 bp, Homo sapiens
agggtgagcaagctatggagacc

SEQ ID NO: 9503248 - DNA, 23 bp, Homo sapiens
agggtgagcaagctatggagacc

SEQ ID NO: 9503249 - DNA, 23 bp, Homo sapiens
agggtgagcaagctatggagacc

SEQ ID NO: 9503250 - DNA, 23 bp, Homo sapiens
agggtgagcaagctatggagacc

SEQ ID NO: 9503251 - DNA, 22 bp, Homo sapiens
agggtgcagaaggagcctagga

SEQ ID NO: 9503252 - DNA, 22 bp, Homo sapiens
agggtgcagggacaggtgtgca

SEQ ID NO: 9503253 - DNA, 22 bp, Homo sapiens
agggtgcagaaggagcctagga

SEQ ID NO: 9503254 - DNA, 22 bp, Homo sapiens
agggtgcaggtgtggagtctag

SEQ ID NO: 9503255 - DNA, 22 bp, Homo sapiens
agggtgcaggggaagctgccct

SEQ ID NO: 9503256 - DNA, 22 bp, Homo sapiens
agggtgcaggggaagctgccct

SEQ ID NO: 9503257 - DNA, 22 bp, Homo sapiens
agggtcccgtccctctgcaccc

SEQ ID NO: 9503258 - DNA, 22 bp, Homo sapiens
agggtcccgaaggagacagcaa

SEQ ID NO: 9503259 - DNA, 23 bp, Homo sapiens
agggtccagggatcaccaggtgt

SEQ ID NO: 9503260 - DNA, 18 bp, Homo sapiens
agggtcagtgtcactggc

SEQ ID NO: 9503261 - DNA, 18 bp, Homo sapiens
agggtcagtgtcactggc

SEQ ID NO: 9503262 - DNA, 22 bp, Homo sapiens
agggtcagtgatgagggagccc

SEQ ID NO: 9503263 - DNA, 22 bp, Homo sapiens
agggtcagttctgtgaggtgtt

SEQ ID NO: 9503264 - DNA, 22 bp, Homo sapiens
agggtcagttctgtgaggtgtt

SEQ ID NO: 9503265 - DNA, 22 bp, Homo sapiens
agggtcagtgatgagggagccc

SEQ ID NO: 9503266 - DNA, 22 bp, Homo sapiens
agggtcagttctgtgaggtgtt

SEQ ID NO: 9503267 - DNA, 22 bp, Homo sapiens
aggtgcagtgaaggaaaaggaa

SEQ ID NO: 9503268 - DNA, 22 bp, Homo sapiens
aggtgccaaagcctgcgggtgt

SEQ ID NO: 9503269 - DNA, 22 bp, Homo sapiens
aggtgcagtgtttaaaagtagc

SEQ ID NO: 9503270 - DNA, 22 bp, Homo sapiens
aggtgccaagatgtcacagaca

SEQ ID NO: 9503271 - DNA, 22 bp, Homo sapiens
aggtggaaatggctttcctagg

SEQ ID NO: 9503272 - DNA, 22 bp, Homo sapiens
aggtgccagatgcacagctgaa

SEQ ID NO: 9503273 - DNA, 22 bp, Homo sapiens
aggtgccactctcatgggctac

SEQ ID NO: 9503274 - DNA, 22 bp, Homo sapiens
aggtgccactctcatgggctac

SEQ ID NO: 9503275 - DNA, 22 bp, Homo sapiens
aggtgccacctctggtgctgtc

SEQ ID NO: 9503276 - DNA, 22 bp, Homo sapiens
agggtgccaggattcgctgcag

SEQ ID NO: 9503277 - DNA, 22 bp, Homo sapiens
agggtgccctggagccagttcc

SEQ ID NO: 9503278 - DNA, 22 bp, Homo sapiens
agggtgcccaccgcttctgccc

SEQ ID NO: 9503279 - DNA, 22 bp, Homo sapiens
agggtgcagtcacaggaaatgt

SEQ ID NO: 9503280 - DNA, 19 bp, Homo sapiens
aggtgaggggcaccatgtc

SEQ ID NO: 9503281 - DNA, 22 bp, Homo sapiens
aggtgagaaaacgagggttgca

SEQ ID NO: 9503282 - DNA, 22 bp, Homo sapiens
aggtgaggataggtggccaagg

SEQ ID NO: 9503283 - DNA, 22 bp, Homo sapiens
aggtgaggataggtggccaagg

SEQ ID NO: 9503284 - DNA, 21 bp, Homo sapiens
aggtgcaggcctcaagcccca

SEQ ID NO: 9503285 - DNA, 21 bp, Homo sapiens
aggtgcaggcctcaagcccca

SEQ ID NO: 9503286 - DNA, 22 bp, Homo sapiens
aggtgcaggagctgtgcaggga

SEQ ID NO: 9503287 - DNA, 22 bp, Homo sapiens
aggtgcaggagctgtgcaggga

SEQ ID NO: 9503288 - DNA, 22 bp, Homo sapiens
aggtgcaggagctgtgcaggga

SEQ ID NO: 9503289 - DNA, 22 bp, Homo sapiens
aggtgcaggagctgtgcaggga

SEQ ID NO: 9503290 - DNA, 19 bp, Homo sapiens
aggtgcaggtcacagggga

SEQ ID NO: 9503291 - DNA, 22 bp, Homo sapiens
agtggcagacagagacagtacc

SEQ ID NO: 9503292 - DNA, 22 bp, Homo sapiens
agtggcagacacaatgtgggca

SEQ ID NO: 9503293 - DNA, 22 bp, Homo sapiens
agtggcagagcaggtgctggaa

SEQ ID NO: 9503294 - DNA, 22 bp, Homo sapiens
agtggcagacacaatgtgggca

SEQ ID NO: 9503295 - DNA, 22 bp, Homo sapiens
agtggcagaagtcactgggtag

SEQ ID NO: 9503296 - DNA, 22 bp, Homo sapiens
agtgctttggtatagaactatt

SEQ ID NO: 9503297 - DNA, 22 bp, Homo sapiens
agtgctttgagcgtttgaaaag

SEQ ID NO: 9503298 - DNA, 22 bp, Homo sapiens
agtgctttggatgatgtgggat

SEQ ID NO: 9503299 - DNA, 22 bp, Homo sapiens
agtgctttgagcgtttgaaaag

SEQ ID NO: 9503300 - DNA, 22 bp, Homo sapiens
agtgctttgaatgttctgggca

SEQ ID NO: 9503301 - DNA, 22 bp, Homo sapiens
agtgctttcttgctccatcagt

SEQ ID NO: 9503302 - DNA, 22 bp, Homo sapiens
agtgctttgaacgaaaggctga

SEQ ID NO: 9503303 - DNA, 22 bp, Homo sapiens
agtgctgttggataatgctgtc

SEQ ID NO: 9503304 - DNA, 22 bp, Homo sapiens
agtgctgttaggttaatatagt

SEQ ID NO: 9503305 - DNA, 22 bp, Homo sapiens
agtgcttaaaaccctgcactag

SEQ ID NO: 9503306 - DNA, 22 bp, Homo sapiens
agtgcttaatagatgtccagca

SEQ ID NO: 9503307 - DNA, 22 bp, Homo sapiens
agtgcttataccaaagactctt

SEQ ID NO: 9503308 - DNA, 22 bp, Homo sapiens
agtgctttagaccttttggggt

SEQ ID NO: 9503309 - DNA, 22 bp, Homo sapiens
agtgctttacctagataatgtt

SEQ ID NO: 9503310 - DNA, 22 bp, Homo sapiens
agtgcttctggtgggcgtgagg

SEQ ID NO: 9503311 - DNA, 22 bp, Homo sapiens
agtgctttagcatccaactgtc

SEQ ID NO: 9503312 - DNA, 22 bp, Homo sapiens
agtgctttagagaaatggtgct

SEQ ID NO: 9503313 - DNA, 22 bp, Homo sapiens
agtgctttatgttgttgtgcaa

SEQ ID NO: 9503314 - DNA, 22 bp, Homo sapiens
agtgctttcagtgtgctctttt

SEQ ID NO: 9503315 - DNA, 22 bp, Homo sapiens
agtgctttccttcttgtgacat

SEQ ID NO: 9503316 - DNA, 22 bp, Homo sapiens
agtgctttccttcttgtgacat

SEQ ID NO: 9503317 - DNA, 22 bp, Homo sapiens
agtgctttccctgaaaccttcc

SEQ ID NO: 9503318 - DNA, 22 bp, Homo sapiens
agtggctggaattgcaggtgcg

SEQ ID NO: 9503319 - DNA, 20 bp, Homo sapiens
agtgggagagggcagactgc

SEQ ID NO: 9503320 - DNA, 20 bp, Homo sapiens
agtgggagagggcagactgc

SEQ ID NO: 9503321 - DNA, 22 bp, Homo sapiens
agtgggagccagcagcttgggg

SEQ ID NO: 9503322 - DNA, 22 bp, Homo sapiens
agtggcagagccaagtagagcc

SEQ ID NO: 9503323 - DNA, 22 bp, Homo sapiens
agtggcagagccaagatatgat

SEQ ID NO: 9503324 - DNA, 22 bp, Homo sapiens
agtggcagagcaggtgctggaa

SEQ ID NO: 9503325 - DNA, 22 bp, Homo sapiens
agtggcagagccaagtagagcc

SEQ ID NO: 9503326 - DNA, 22 bp, Homo sapiens
agtgggaggaagtggtgatatt

SEQ ID NO: 9503327 - DNA, 22 bp, Homo sapiens
agtgggagcggcagtcggggac

SEQ ID NO: 9503328 - DNA, 22 bp, Homo sapiens
agtggggccgcggtcctgccct

SEQ ID NO: 9503329 - DNA, 22 bp, Homo sapiens
agtggggccgcggtcctgccct

SEQ ID NO: 9503330 - DNA, 22 bp, Homo sapiens
agtgggaggcggctgacgggcg

SEQ ID NO: 9503331 - DNA, 22 bp, Homo sapiens
agtgggaggcggctgacgggcg

SEQ ID NO: 9503332 - DNA, 22 bp, Homo sapiens
agtgggaggcggctgacgggcg

SEQ ID NO: 9503333 - DNA, 22 bp, Homo sapiens
agtgctgtctccttcccccggg

SEQ ID NO: 9503334 - DNA, 22 bp, Homo sapiens
agtgctgtctccttcccccggg

SEQ ID NO: 9503335 - DNA, 22 bp, Homo sapiens
agtgctgtccagtttcacaggt

SEQ ID NO: 9503336 - DNA, 23 bp, Homo sapiens
agtgctgaattgaaagctccagg

SEQ ID NO: 9503337 - DNA, 22 bp, Homo sapiens
agtgcaaagcagcctgtacacc

SEQ ID NO: 9503338 - DNA, 22 bp, Homo sapiens
agtgcaaagcagcctgtacacc

SEQ ID NO: 9503339 - DNA, 22 bp, Homo sapiens
agtgcaaagaaatcagctttgt

SEQ ID NO: 9503340 - DNA, 20 bp, Homo sapiens
agtgcaagaaagcacagctg

SEQ ID NO: 9503341 - DNA, 20 bp, Homo sapiens
agtgcaagaaagcacagctg

SEQ ID NO: 9503342 - DNA, 22 bp, Homo sapiens
agtgcaaagcagcctgtacacc

SEQ ID NO: 9503343 - DNA, 22 bp, Homo sapiens
agtgcaaaattcagaagcaatt

SEQ ID NO: 9503344 - DNA, 22 bp, Homo sapiens
agtgattttgctttgaagtgac

SEQ ID NO: 9503345 - DNA, 22 bp, Homo sapiens
agtgatttgcagtatttactaa

SEQ ID NO: 9503346 - DNA, 22 bp, Homo sapiens
agtgatttggttcatacttcca

SEQ ID NO: 9503347 - DNA, 22 bp, Homo sapiens
agtgattttaacttccagcaat

SEQ ID NO: 9503348 - DNA, 20 bp, Homo sapiens
agtgatttgttagtacattg

SEQ ID NO: 9503349 - DNA, 20 bp, Homo sapiens
agtgatttgttagtacattg

SEQ ID NO: 9503350 - DNA, 22 bp, Homo sapiens
agtgattttatcaatttactca

SEQ ID NO: 9503351 - DNA, 22 bp, Homo sapiens
agtgattttatcaatttactca

SEQ ID NO: 9503352 - DNA, 22 bp, Homo sapiens
agtcctttgggaaaaatgacta

SEQ ID NO: 9503353 - DNA, 22 bp, Homo sapiens
agtccttttgttttgagatgag

SEQ ID NO: 9503354 - DNA, 22 bp, Homo sapiens
agtgaatgagaggtgagtattg

SEQ ID NO: 9503355 - DNA, 22 bp, Homo sapiens
agtgaatgtccccgcgggtcag

SEQ ID NO: 9503356 - DNA, 22 bp, Homo sapiens
agtgaatgtccccgcgggtcag

SEQ ID NO: 9503357 - DNA, 21 bp, Homo sapiens
agtccttgaaactctttcttg

SEQ ID NO: 9503358 - DNA, 21 bp, Homo sapiens
agtccttgaaactctttcttg

SEQ ID NO: 9503359 - DNA, 21 bp, Homo sapiens
agtccttgaaactctttcttg

SEQ ID NO: 9503360 - DNA, 22 bp, Homo sapiens
agtccttgaattaatttgactc

SEQ ID NO: 9503361 - DNA, 22 bp, Homo sapiens
agtccttgaattaatttgactc

SEQ ID NO: 9503362 - DNA, 22 bp, Homo sapiens
agtcctttgctgaactgtcaca

SEQ ID NO: 9503363 - DNA, 22 bp, Homo sapiens
agtgagagtattaatgtgaact

SEQ ID NO: 9503364 - DNA, 22 bp, Homo sapiens
agtgagagtattaatgtgaact

SEQ ID NO: 9503365 - DNA, 19 bp, Homo sapiens
agtgagaacatgtgcacac

SEQ ID NO: 9503366 - DNA, 17 bp, Homo sapiens
agtgagaatgtcatgta

SEQ ID NO: 9503367 - DNA, 19 bp, Homo sapiens
agtgagcatccagagaggt

SEQ ID NO: 9503368 - DNA, 22 bp, Homo sapiens
agtgagcatccagagaggtggg

SEQ ID NO: 9503369 - DNA, 19 bp, Homo sapiens
agtgagcatccagagaggt

SEQ ID NO: 9503370 - DNA, 22 bp, Homo sapiens
agtgagcattcgtttggaaccc

SEQ ID NO: 9503371 - DNA, 23 bp, Homo sapiens
agtgagcagctgtagggcaagga

SEQ ID NO: 9503372 - DNA, 22 bp, Homo sapiens
agtgagcaagacttcgttgtcc

SEQ ID NO: 9503373 - DNA, 22 bp, Homo sapiens
agtgagcactgttgttggttcc

SEQ ID NO: 9503374 - DNA, 20 bp, Homo sapiens
agtgagattgctgctctagc

SEQ ID NO: 9503375 - DNA, 22 bp, Homo sapiens
agtgagcaacagaagcgtgggt

SEQ ID NO: 9503376 - DNA, 22 bp, Homo sapiens
agtgagcaacagaagcgtgggt

SEQ ID NO: 9503377 - DNA, 20 bp, Homo sapiens
agtgaggcagttcagtgggc

SEQ ID NO: 9503378 - DNA, 20 bp, Homo sapiens
agtgaggcagttcagtgggc

SEQ ID NO: 9503379 - DNA, 22 bp, Homo sapiens
agtgggggccaacgagggcagc

SEQ ID NO: 9503380 - DNA, 22 bp, Homo sapiens
agtgggggccaacgagggcagc

SEQ ID NO: 9503381 - DNA, 22 bp, Homo sapiens
agtgggggccaacgagggcagc

SEQ ID NO: 9503382 - DNA, 22 bp, Homo sapiens
agtgggggcagagcctctctcg

SEQ ID NO: 9503383 - DNA, 22 bp, Homo sapiens
agtgggggccaacgagggcagc

SEQ ID NO: 9503384 - DNA, 22 bp, Homo sapiens
agtgggggccaacgagggcagc

SEQ ID NO: 9503385 - DNA, 22 bp, Homo sapiens
agtgggggctggctctgtctgt

SEQ ID NO: 9503386 - DNA, 22 bp, Homo sapiens
agtgggggctggctctgtctgt

SEQ ID NO: 9503387 - DNA, 22 bp, Homo sapiens
agtgggggctggctctgtctgt

SEQ ID NO: 9503388 - DNA, 22 bp, Homo sapiens
agtgggggctggctctgtctgt

SEQ ID NO: 9503389 - DNA, 21 bp, Homo sapiens
agtgtctctggaagcacgtgt

SEQ ID NO: 9503390 - DNA, 22 bp, Homo sapiens
agtggggccggtgaggccgagg

SEQ ID NO: 9503391 - DNA, 22 bp, Homo sapiens
agtggggcggacaggaccagga

SEQ ID NO: 9503392 - DNA, 22 bp, Homo sapiens
agtgggggcagagcctctctcg

SEQ ID NO: 9503393 - DNA, 22 bp, Homo sapiens
agtggggcggacaggaccagga

SEQ ID NO: 9503394 - DNA, 22 bp, Homo sapiens
agtgggggcagagcctctctcg

SEQ ID NO: 9503395 - DNA, 22 bp, Homo sapiens
agtgtctgtgatgaggtcagga

SEQ ID NO: 9503396 - DNA, 22 bp, Homo sapiens
agtgtctgtgttttctattgct

SEQ ID NO: 9503397 - DNA, 22 bp, Homo sapiens
agtgtctgtgctttgcagcaaa

SEQ ID NO: 9503398 - DNA, 22 bp, Homo sapiens
agtgtctgtgctttgcagcaaa

SEQ ID NO: 9503399 - DNA, 22 bp, Homo sapiens
agtgtctgttacgcttgcagaa

SEQ ID NO: 9503400 - DNA, 22 bp, Homo sapiens
agtgtctgttgagtttcaaaag

SEQ ID NO: 9503401 - DNA, 20 bp, Homo sapiens
agtgtctggtgcagggcctc

SEQ ID NO: 9503402 - DNA, 22 bp, Homo sapiens
agtgtctgtgaggggaattcct

SEQ ID NO: 9503403 - DNA, 22 bp, Homo sapiens
agtgtctgtgatgaggtcagga

SEQ ID NO: 9503404 - DNA, 20 bp, Homo sapiens
agtgtctggtgcagggcctc

SEQ ID NO: 9503405 - DNA, 22 bp, Homo sapiens
agtgtctggtgagggctctctc

SEQ ID NO: 9503406 - DNA, 22 bp, Homo sapiens
agtgtctgaacctgcagtggga

SEQ ID NO: 9503407 - DNA, 22 bp, Homo sapiens
agtgtctggtgagggctctctc

SEQ ID NO: 9503408 - DNA, 22 bp, Homo sapiens
agtgtctgaaccaccggggcat

SEQ ID NO: 9503409 - DNA, 17 bp, Homo sapiens
agtgtgtgaaatggtgg

SEQ ID NO: 9503410 - DNA, 22 bp, Homo sapiens
agtgtgtgaccttttaatttaa

SEQ ID NO: 9503411 - DNA, 23 bp, Homo sapiens
actgggctgaaattaaaggtgtc

SEQ ID NO: 9503412 - DNA, 23 bp, Homo sapiens
actgggctgaaattaaaggtgtc

SEQ ID NO: 9503413 - DNA, 23 bp, Homo sapiens
actgggctgaaatttttcatggc

SEQ ID NO: 9503414 - DNA, 17 bp, Homo sapiens
agtgtgtgaaatggtgg

SEQ ID NO: 9503415 - DNA, 22 bp, Homo sapiens
agtgtgtcttatcctgggagaa

SEQ ID NO: 9503416 - DNA, 20 bp, Homo sapiens
agtgtgtctcggaggtaagt

SEQ ID NO: 9503417 - DNA, 17 bp, Homo sapiens
agtgtgtgaaatggtgg

SEQ ID NO: 9503418 - DNA, 17 bp, Homo sapiens
agtgtgtgaaatggtgg

SEQ ID NO: 9503419 - DNA, 17 bp, Homo sapiens
agtgtgtgaaatggtgg

SEQ ID NO: 9503420 - DNA, 22 bp, Homo sapiens
agtgtgtcgagggagggtccag

SEQ ID NO: 9503421 - DNA, 20 bp, Homo sapiens
agtgtgtctcggaggtaagt

SEQ ID NO: 9503422 - DNA, 22 bp, Homo sapiens
agtgtgtctgatcacttgtgag

SEQ ID NO: 9503423 - DNA, 22 bp, Homo sapiens
agtgtgtccaggaagcagatgg

SEQ ID NO: 9503424 - DNA, 22 bp, Homo sapiens
agtgtgtcgagggagggtccag

SEQ ID NO: 9503425 - DNA, 22 bp, Homo sapiens
agtgtgtccagaaatctgtatt

SEQ ID NO: 9503426 - DNA, 22 bp, Homo sapiens
agtgtgtacataattgtacgcc

SEQ ID NO: 9503427 - DNA, 19 bp, Homo sapiens
agtgtgtactgaaagcact

SEQ ID NO: 9503428 - DNA, 22 bp, Homo sapiens
agtgtgtagcatttggcaggca

SEQ ID NO: 9503429 - DNA, 22 bp, Homo sapiens
agtgtgtcagttgaaagagatt

SEQ ID NO: 9503430 - DNA, 22 bp, Homo sapiens
agtgtgtagcaatatgctggca

SEQ ID NO: 9503431 - DNA, 22 bp, Homo sapiens
agtgtggtcgggagcgcggggc

SEQ ID NO: 9503432 - DNA, 22 bp, Homo sapiens
agtgtgtaagggatcaaagagt

SEQ ID NO: 9503433 - DNA, 17 bp, Homo sapiens
agtgtgtaacttgtgta

SEQ ID NO: 9503434 - DNA, 22 bp, Homo sapiens
agtgtgtacataattgtacgcc

SEQ ID NO: 9503435 - DNA, 22 bp, Homo sapiens
agtgtgggtgagggaggccctc

SEQ ID NO: 9503436 - DNA, 22 bp, Homo sapiens
agtgtgggttttatggagccct

SEQ ID NO: 9503437 - DNA, 22 bp, Homo sapiens
agtgtgggttttatggagccct

SEQ ID NO: 9503438 - DNA, 22 bp, Homo sapiens
agtgtgggtgagggaggccctc

SEQ ID NO: 9503439 - DNA, 22 bp, Homo sapiens
agtgtctttagcaagtttagtc

SEQ ID NO: 9503440 - DNA, 22 bp, Homo sapiens
agtgtcttcatgatgtggcagc

SEQ ID NO: 9503441 - DNA, 22 bp, Homo sapiens
agtgtcttagtccatttgggct

SEQ ID NO: 9503442 - DNA, 22 bp, Homo sapiens
agtgtctttcatatcctccatc

SEQ ID NO: 9503443 - DNA, 22 bp, Homo sapiens
agtgtctttcatatcctccatc

SEQ ID NO: 9503444 - DNA, 22 bp, Homo sapiens
agtgtggggtcaccggcccagg

SEQ ID NO: 9503445 - DNA, 22 bp, Homo sapiens
agtgtctttatagactgacaat

SEQ ID NO: 9503446 - DNA, 22 bp, Homo sapiens
agtgtcttacatgaattgattt

SEQ ID NO: 9503447 - DNA, 22 bp, Homo sapiens
agtgtcttacatgaattgattt

SEQ ID NO: 9503448 - DNA, 22 bp, Homo sapiens
agtgtctgttgttcagaactct

SEQ ID NO: 9503449 - DNA, 22 bp, Homo sapiens
agtgtctgttgcttttgcagtg

SEQ ID NO: 9503450 - DNA, 22 bp, Homo sapiens
agttcaaaaaggtaaagtttat

SEQ ID NO: 9503451 - DNA, 22 bp, Homo sapiens
agttcaaaaaggtaaagtttat

SEQ ID NO: 9503452 - DNA, 22 bp, Homo sapiens
agttcaaactctataagaactt

SEQ ID NO: 9503453 - DNA, 22 bp, Homo sapiens
agttcaaactctataagaactt

SEQ ID NO: 9503454 - DNA, 22 bp, Homo sapiens
agttcaaagctgcagtaatgga

SEQ ID NO: 9503455 - DNA, 22 bp, Homo sapiens
agttcaaagtcaaggaaactgt

SEQ ID NO: 9503456 - DNA, 22 bp, Homo sapiens
agttcaacctaatacagcagaa

SEQ ID NO: 9503457 - DNA, 22 bp, Homo sapiens
agttcaatagaaaaatatatta

SEQ ID NO: 9503458 - DNA, 22 bp, Homo sapiens
agttattttggaaaatgagtca

SEQ ID NO: 9503459 - DNA, 19 bp, Homo sapiens
agttatttctaaatttacc

SEQ ID NO: 9503460 - DNA, 22 bp, Homo sapiens
agttacatgtgaatagaaagta

SEQ ID NO: 9503461 - DNA, 19 bp, Homo sapiens
agttatttctaaatttacc

SEQ ID NO: 9503462 - DNA, 21 bp, Homo sapiens
agttacatgtatagataaagt

SEQ ID NO: 9503463 - DNA, 22 bp, Homo sapiens
agttacaactgtttgaatgtca

SEQ ID NO: 9503464 - DNA, 22 bp, Homo sapiens
agttacaaccatgacacaagca

SEQ ID NO: 9503465 - DNA, 22 bp, Homo sapiens
agttacaagctattttacttaa

SEQ ID NO: 9503466 - DNA, 21 bp, Homo sapiens
agttacaagtttattcagagg

SEQ ID NO: 9503467 - DNA, 21 bp, Homo sapiens
agttacaagtttattcagagg

SEQ ID NO: 9503468 - DNA, 22 bp, Homo sapiens
actggggattagggactcagtg

SEQ ID NO: 9503469 - DNA, 22 bp, Homo sapiens
actggggcaggaaagtatgctg

SEQ ID NO: 9503470 - DNA, 22 bp, Homo sapiens
actggggcaggaaagtatgctg

SEQ ID NO: 9503471 - DNA, 22 bp, Homo sapiens
actggggattagggactcagtg

SEQ ID NO: 9503472 - DNA, 22 bp, Homo sapiens
actggggattagggactcagtg

SEQ ID NO: 9503473 - DNA, 22 bp, Homo sapiens
actggggagttgaagcactttc

SEQ ID NO: 9503474 - DNA, 22 bp, Homo sapiens
actggggcagtgggcagtggtt

SEQ ID NO: 9503475 - DNA, 22 bp, Homo sapiens
actggggcagtgggcagtggtt

SEQ ID NO: 9503476 - DNA, 22 bp, Homo sapiens
actggggcagtgggcagtggtt

SEQ ID NO: 9503477 - DNA, 22 bp, Homo sapiens
actggggcctcctccatgctct

SEQ ID NO: 9503478 - DNA, 22 bp, Homo sapiens
actggggcctcctccatgctct

SEQ ID NO: 9503479 - DNA, 22 bp, Homo sapiens
actggggcctcctccatgctct

SEQ ID NO: 9503480 - DNA, 22 bp, Homo sapiens
actgggtgtaaaggacttaagc

SEQ ID NO: 9503481 - DNA, 22 bp, Homo sapiens
actgggtggctgcctccttctc

SEQ ID NO: 9503482 - DNA, 22 bp, Homo sapiens
actgggtggctgcctccttctc

SEQ ID NO: 9503483 - DNA, 23 bp, Homo sapiens
actgggtctatctccagagaaga

SEQ ID NO: 9503484 - DNA, 22 bp, Homo sapiens
agttacaaacactatcagttct

SEQ ID NO: 9503485 - DNA, 22 bp, Homo sapiens
agttacaaacactatcagttct

SEQ ID NO: 9503486 - DNA, 19 bp, Homo sapiens
agttaatgagcttttgatc

SEQ ID NO: 9503487 - DNA, 22 bp, Homo sapiens
agttaatgagcattttggaatg

SEQ ID NO: 9503488 - DNA, 22 bp, Homo sapiens
agttaataatggaaagacacat

SEQ ID NO: 9503489 - DNA, 22 bp, Homo sapiens
agttaataatggaaagacacat

SEQ ID NO: 9503490 - DNA, 22 bp, Homo sapiens
actggttgaagaaaagctagta

SEQ ID NO: 9503491 - DNA, 22 bp, Homo sapiens
actggttgaagaaaagctagta

SEQ ID NO: 9503492 - DNA, 22 bp, Homo sapiens
actggtgttgatttggaagggg

SEQ ID NO: 9503493 - DNA, 22 bp, Homo sapiens
actggtctaagacattgggacc

SEQ ID NO: 9503494 - DNA, 22 bp, Homo sapiens
actggtcctctgccagcagctg

SEQ ID NO: 9503495 - DNA, 22 bp, Homo sapiens
actggtaacaatggaagcttct

SEQ ID NO: 9503496 - DNA, 22 bp, Homo sapiens
actggtggccctcagtgttctc

SEQ ID NO: 9503497 - DNA, 22 bp, Homo sapiens
actggtctagaagggagaagac

SEQ ID NO: 9503498 - DNA, 20 bp, Homo sapiens
actggtggactgttcattga

SEQ ID NO: 9503499 - DNA, 20 bp, Homo sapiens
agaaatattgagttcagagg

SEQ ID NO: 9503500 - DNA, 20 bp, Homo sapiens
agaaatattgagttcagagg

SEQ ID NO: 9503501 - DNA, 22 bp, Homo sapiens
agaaatatgctgattagatgaa

SEQ ID NO: 9503502 - DNA, 20 bp, Homo sapiens
agaaatattgagttcagagg

SEQ ID NO: 9503503 - DNA, 22 bp, Homo sapiens
agaaatcaatatctatatgttg

SEQ ID NO: 9503504 - DNA, 22 bp, Homo sapiens
agaaatcaatatctatatgttg

SEQ ID NO: 9503505 - DNA, 22 bp, Homo sapiens
agaaatcacttagaggaagtga

SEQ ID NO: 9503506 - DNA, 22 bp, Homo sapiens
agaaatcacttagaggaagtga

SEQ ID NO: 9503507 - DNA, 22 bp, Homo sapiens
agaaatcagaaccctgaagttc

SEQ ID NO: 9503508 - DNA, 22 bp, Homo sapiens
agaaatcagaaccctgaagttc

SEQ ID NO: 9503509 - DNA, 22 bp, Homo sapiens
agaaatcacaggaggcagaagg

SEQ ID NO: 9503510 - DNA, 22 bp, Homo sapiens
agaaatcacttaatgaacgtag

SEQ ID NO: 9503511 - DNA, 19 bp, Homo sapiens
agaaatagccttccttgtc

SEQ ID NO: 9503512 - DNA, 19 bp, Homo sapiens
agaaatagccttccttgtc

SEQ ID NO: 9503513 - DNA, 22 bp, Homo sapiens
agaaatatgctgattagatgaa

SEQ ID NO: 9503514 - DNA, 22 bp, Homo sapiens
agaaatatgctgattagatgaa

SEQ ID NO: 9503515 - DNA, 22 bp, Homo sapiens
agaaatatgctgattagatgaa

SEQ ID NO: 9503516 - DNA, 22 bp, Homo sapiens
atattaattatttacacatgag

SEQ ID NO: 9503517 - DNA, 22 bp, Homo sapiens
atattacacacggtatcacggg

SEQ ID NO: 9503518 - DNA, 22 bp, Homo sapiens
atcaattttgaggatacaagaa

SEQ ID NO: 9503519 - DNA, 22 bp, Homo sapiens
atcaatgcttgccaaatggaag

SEQ ID NO: 9503520 - DNA, 22 bp, Homo sapiens
atcaatgttttgatagcccaga

SEQ ID NO: 9503521 - DNA, 22 bp, Homo sapiens
atcaatgttgggccaaagcaaa

SEQ ID NO: 9503522 - DNA, 22 bp, Homo sapiens
agaaatgcaaattttcatagag

SEQ ID NO: 9503523 - DNA, 22 bp, Homo sapiens
agaaatgcagtttcaagacaaa

SEQ ID NO: 9503524 - DNA, 22 bp, Homo sapiens
agaaatgcagtttcaagacaaa

SEQ ID NO: 9503525 - DNA, 22 bp, Homo sapiens
agaaatgctcttcctgaccaga

SEQ ID NO: 9503526 - DNA, 22 bp, Homo sapiens
agaaatgcattagcacatatag

SEQ ID NO: 9503527 - DNA, 22 bp, Homo sapiens
agaaatgcattagcacatatag

SEQ ID NO: 9503528 - DNA, 22 bp, Homo sapiens
atcaatatcagatcagacagga

SEQ ID NO: 9503529 - DNA, 22 bp, Homo sapiens
atcaatatcagatcagacagga

SEQ ID NO: 9503530 - DNA, 22 bp, Homo sapiens
atcaatgctctgtacccagaat

SEQ ID NO: 9503531 - DNA, 18 bp, Homo sapiens
atcaaggaggggaaggtc

SEQ ID NO: 9503532 - DNA, 22 bp, Homo sapiens
atcaagtgaagggctcttgaag

SEQ ID NO: 9503533 - DNA, 22 bp, Homo sapiens
atcaagcatatataaaactgca

SEQ ID NO: 9503534 - DNA, 22 bp, Homo sapiens
atcaagctacaccctttggaaa

SEQ ID NO: 9503535 - DNA, 22 bp, Homo sapiens
atcaagctggcatatgtagttc

SEQ ID NO: 9503536 - DNA, 22 bp, Homo sapiens
atcaagcagtgaaaaatgctag

SEQ ID NO: 9503537 - DNA, 22 bp, Homo sapiens
atcaagcacttctacatgacat

SEQ ID NO: 9503538 - DNA, 22 bp, Homo sapiens
atcaagcacttctacatgacat

SEQ ID NO: 9503539 - DNA, 22 bp, Homo sapiens
atcaagcagtgaaaaatgctag

SEQ ID NO: 9503540 - DNA, 22 bp, Homo sapiens
atcaagcatatataaaactgca

SEQ ID NO: 9503541 - DNA, 22 bp, Homo sapiens
atcaagcatatataaaactgca

SEQ ID NO: 9503542 - DNA, 22 bp, Homo sapiens
atcaagagttatatttcatagt

SEQ ID NO: 9503543 - DNA, 22 bp, Homo sapiens
atcaagagttatatttcatagt

SEQ ID NO: 9503544 - DNA, 22 bp, Homo sapiens
atcaagagtattgacaagacca

SEQ ID NO: 9503545 - DNA, 17 bp, Homo sapiens
agaaagaggatccacag

SEQ ID NO: 9503546 - DNA, 17 bp, Homo sapiens
agaaagaggatccacag

SEQ ID NO: 9503547 - DNA, 17 bp, Homo sapiens
agaaagaggatccacag

SEQ ID NO: 9503548 - DNA, 22 bp, Homo sapiens
agaaagaggatgcagatctcat

SEQ ID NO: 9503549 - DNA, 22 bp, Homo sapiens
agaaagaggatgcagatctcat

SEQ ID NO: 9503550 - DNA, 17 bp, Homo sapiens
agaaagaggatccacag

SEQ ID NO: 9503551 - DNA, 22 bp, Homo sapiens
agaaagacgtgatgaagaagta

SEQ ID NO: 9503552 - DNA, 22 bp, Homo sapiens
agaaagacgtgatgaagaagta

SEQ ID NO: 9503553 - DNA, 22 bp, Homo sapiens
agaaagagctcgggattaacag

SEQ ID NO: 9503554 - DNA, 22 bp, Homo sapiens
agaaagagctcgggattaacag

SEQ ID NO: 9503555 - DNA, 22 bp, Homo sapiens
agaaagagctcgggattaacag

SEQ ID NO: 9503556 - DNA, 22 bp, Homo sapiens
agaaagaacgttggttatctta

SEQ ID NO: 9503557 - DNA, 22 bp, Homo sapiens
agaaagaacgttggttatctta

SEQ ID NO: 9503558 - DNA, 22 bp, Homo sapiens
agaaagacgtgatgaagaagta

SEQ ID NO: 9503559 - DNA, 22 bp, Homo sapiens
agaaagacgtgatgaagaagta

SEQ ID NO: 9503560 - DNA, 22 bp, Homo sapiens
agaaagacaaaatgcagtggct

SEQ ID NO: 9503561 - DNA, 22 bp, Homo sapiens
atattaaaactatggttttcag

SEQ ID NO: 9503562 - DNA, 22 bp, Homo sapiens
agaaagaggatgcagatctcat

SEQ ID NO: 9503563 - DNA, 22 bp, Homo sapiens
atattaaatggattttgggagc

SEQ ID NO: 9503564 - DNA, 22 bp, Homo sapiens
atattaaaactatggttttcag

SEQ ID NO: 9503565 - DNA, 22 bp, Homo sapiens
atattaaatggattttgggagc

SEQ ID NO: 9503566 - DNA, 22 bp, Homo sapiens
atattaatgagcaagtaagtga

SEQ ID NO: 9503567 - DNA, 22 bp, Homo sapiens
atattaatgagcaagtaagtga

SEQ ID NO: 9503568 - DNA, 22 bp, Homo sapiens
atattaagatgctattggtttt

SEQ ID NO: 9503569 - DNA, 22 bp, Homo sapiens
atattaaatggattttgggagc

SEQ ID NO: 9503570 - DNA, 22 bp, Homo sapiens
atattaatgagcaagtaagtga

SEQ ID NO: 9503571 - DNA, 22 bp, Homo sapiens
atattaatgggatttagtcagg

SEQ ID NO: 9503572 - DNA, 22 bp, Homo sapiens
atattaatgggatttagtcagg

SEQ ID NO: 9503573 - DNA, 22 bp, Homo sapiens
atattaattatttacacatgag

SEQ ID NO: 9503574 - DNA, 22 bp, Homo sapiens
atattaatgggatttagtcagg

SEQ ID NO: 9503575 - DNA, 22 bp, Homo sapiens
atattaatgggatttagtcagg

SEQ ID NO: 9503576 - DNA, 22 bp, Homo sapiens
atatagaaggtgctatttacat

SEQ ID NO: 9503577 - DNA, 22 bp, Homo sapiens
atatagaaggtgctatttacat

SEQ ID NO: 9503578 - DNA, 22 bp, Homo sapiens
atatagaatacacagggaaagt

SEQ ID NO: 9503579 - DNA, 22 bp, Homo sapiens
atataggttatcatatttgccc

SEQ ID NO: 9503580 - DNA, 22 bp, Homo sapiens
atatagtatgtcctccagaatt

SEQ ID NO: 9503581 - DNA, 22 bp, Homo sapiens
atatagtaagcagtctgtaaat

SEQ ID NO: 9503582 - DNA, 19 bp, Homo sapiens
atatagcattattcaattt

SEQ ID NO: 9503583 - DNA, 22 bp, Homo sapiens
agaaacttcagctattcttttg

SEQ ID NO: 9503584 - DNA, 22 bp, Homo sapiens
agaaacttcagctattcttttg

SEQ ID NO: 9503585 - DNA, 22 bp, Homo sapiens
agaaactgcagctcagagaagt

SEQ ID NO: 9503586 - DNA, 22 bp, Homo sapiens
agaaactgcagctcagagaagt

SEQ ID NO: 9503587 - DNA, 22 bp, Homo sapiens
atatagtttaagaaagtacagt

SEQ ID NO: 9503588 - DNA, 22 bp, Homo sapiens
atatagttgggtttcattctac

SEQ ID NO: 9503589 - DNA, 22 bp, Homo sapiens
atatagtttaagaaagtacagt

SEQ ID NO: 9503590 - DNA, 22 bp, Homo sapiens
atatagtcaaacatatatgtgt

SEQ ID NO: 9503591 - DNA, 22 bp, Homo sapiens
atatagtcacactttgcaggca

SEQ ID NO: 9503592 - DNA, 20 bp, Homo sapiens
agaaacatttcttgagaact

SEQ ID NO: 9503593 - DNA, 20 bp, Homo sapiens
agaaacatttcttgagaact

SEQ ID NO: 9503594 - DNA, 22 bp, Homo sapiens
agaagccatgtttagtaggatg

SEQ ID NO: 9503595 - DNA, 22 bp, Homo sapiens
agaagccatgtttagtaggatg

SEQ ID NO: 9503596 - DNA, 22 bp, Homo sapiens
agaagccattccctgtaggctc

SEQ ID NO: 9503597 - DNA, 22 bp, Homo sapiens
agaagccatgtttagtaggatg

SEQ ID NO: 9503598 - DNA, 22 bp, Homo sapiens
agaagccattccctgtaggctc

SEQ ID NO: 9503599 - DNA, 22 bp, Homo sapiens
agaagccattccctgtaggctc

SEQ ID NO: 9503600 - DNA, 22 bp, Homo sapiens
agaagccattctcagttcctga

SEQ ID NO: 9503601 - DNA, 22 bp, Homo sapiens
agaagcctcatcctctctagtg

SEQ ID NO: 9503602 - DNA, 21 bp, Homo sapiens
agaagccatttgttaggactt

SEQ ID NO: 9503603 - DNA, 19 bp, Homo sapiens
agaagcccagatcccagcc

SEQ ID NO: 9503604 - DNA, 19 bp, Homo sapiens
agaagcccagatcccagcc

SEQ ID NO: 9503605 - DNA, 20 bp, Homo sapiens
agaagctgagactgggtttt

SEQ ID NO: 9503606 - DNA, 22 bp, Homo sapiens
agaagctgcctacatgaccagc

SEQ ID NO: 9503607 - DNA, 22 bp, Homo sapiens
agaagctgcgtttatttaaatc

SEQ ID NO: 9503608 - DNA, 20 bp, Homo sapiens
agaagctgatactgatggaa

SEQ ID NO: 9503609 - DNA, 22 bp, Homo sapiens
atctgcttttgagaatttactt

SEQ ID NO: 9503610 - DNA, 22 bp, Homo sapiens
atctgcttttgagaatttactt

SEQ ID NO: 9503611 - DNA, 22 bp, Homo sapiens
agaagctggaggaagactaagc

SEQ ID NO: 9503612 - DNA, 20 bp, Homo sapiens
atctgcttgcctgtcctcgg

SEQ ID NO: 9503613 - DNA, 22 bp, Homo sapiens
atcctggaggctggaggcttgc

SEQ ID NO: 9503614 - DNA, 22 bp, Homo sapiens
atcctggacagtttcccctatt

SEQ ID NO: 9503615 - DNA, 22 bp, Homo sapiens
atcctggacagtttcccctatt

SEQ ID NO: 9503616 - DNA, 22 bp, Homo sapiens
atcctggaggctggaggcttgc

SEQ ID NO: 9503617 - DNA, 20 bp, Homo sapiens
atcctggaatccaaatggag

SEQ ID NO: 9503618 - DNA, 22 bp, Homo sapiens
atcctgcttgttacttatagag

SEQ ID NO: 9503619 - DNA, 22 bp, Homo sapiens
atcctggcgccacacggctcta

SEQ ID NO: 9503620 - DNA, 22 bp, Homo sapiens
atcctgcagggggttttattca

SEQ ID NO: 9503621 - DNA, 22 bp, Homo sapiens
atcctgctgctgtggacttctc

SEQ ID NO: 9503622 - DNA, 22 bp, Homo sapiens
atcctgagttctcagagtctcc

SEQ ID NO: 9503623 - DNA, 22 bp, Homo sapiens
atcctgagttctcagagtctcc

SEQ ID NO: 9503624 - DNA, 22 bp, Homo sapiens
atcctgagttctcagagtctcc

SEQ ID NO: 9503625 - DNA, 22 bp, Homo sapiens
atcctgagttcctgcctctaaa

SEQ ID NO: 9503626 - DNA, 22 bp, Homo sapiens
atcctgagttcctgcctctaaa

SEQ ID NO: 9503627 - DNA, 22 bp, Homo sapiens
atcctgaggaaggtgcagagat

SEQ ID NO: 9503628 - DNA, 22 bp, Homo sapiens
atcctgaggaaggtgcagagat

SEQ ID NO: 9503629 - DNA, 22 bp, Homo sapiens
atcctgaggaaggtgcagagat

SEQ ID NO: 9503630 - DNA, 22 bp, Homo sapiens
atcctgagttcctgcctctaaa

SEQ ID NO: 9503631 - DNA, 22 bp, Homo sapiens
atcctgagttcctgcctctaaa

SEQ ID NO: 9503632 - DNA, 22 bp, Homo sapiens
atcctgagctacacctgctcct

SEQ ID NO: 9503633 - DNA, 22 bp, Homo sapiens
atcctgaagcatgaatgtcaaa

SEQ ID NO: 9503634 - DNA, 22 bp, Homo sapiens
atcctgagctacacctgctcct

SEQ ID NO: 9503635 - DNA, 22 bp, Homo sapiens
agaagccatagtctgggaggca

SEQ ID NO: 9503636 - DNA, 22 bp, Homo sapiens
agaagccatatttagggaggag

SEQ ID NO: 9503637 - DNA, 22 bp, Homo sapiens
agaagccatatttagggaggag

SEQ ID NO: 9503638 - DNA, 21 bp, Homo sapiens
agaagccatgccagtaaaatt

SEQ ID NO: 9503639 - DNA, 22 bp, Homo sapiens
agaagccatggggtcaccagag

SEQ ID NO: 9503640 - DNA, 22 bp, Homo sapiens
agaagccatggtatgcaactac

SEQ ID NO: 9503641 - DNA, 22 bp, Homo sapiens
agaagccatggtatgcaactac

SEQ ID NO: 9503642 - DNA, 22 bp, Homo sapiens
agaagccatggggtcaccagag

SEQ ID NO: 9503643 - DNA, 21 bp, Homo sapiens
agaagccatgtggtggagaac

SEQ ID NO: 9503644 - DNA, 21 bp, Homo sapiens
agaagccatgtggtggagaac

SEQ ID NO: 9503645 - DNA, 22 bp, Homo sapiens
atcctgggaatgggagggtcat

SEQ ID NO: 9503646 - DNA, 22 bp, Homo sapiens
agaagccaccagctgaggaaga

SEQ ID NO: 9503647 - DNA, 22 bp, Homo sapiens
atcctgggaagtggcctcctcc

SEQ ID NO: 9503648 - DNA, 22 bp, Homo sapiens
atcctgggaagtggcctcctcc

SEQ ID NO: 9503649 - DNA, 22 bp, Homo sapiens
atcctgggaagtggcctcctcc

SEQ ID NO: 9503650 - DNA, 22 bp, Homo sapiens
atcctgggaagctgacattgaa

SEQ ID NO: 9503651 - DNA, 22 bp, Homo sapiens
agaagccatagtatctcagggt

SEQ ID NO: 9503652 - DNA, 22 bp, Homo sapiens
agaagccatagtctgggaggca

SEQ ID NO: 9503653 - DNA, 22 bp, Homo sapiens
agaagccatagtatctcagggt

SEQ ID NO: 9503654 - DNA, 22 bp, Homo sapiens
agaagccaccagctgaggaaga

SEQ ID NO: 9503655 - DNA, 22 bp, Homo sapiens
agaagccagtcgctctcccgca

SEQ ID NO: 9503656 - DNA, 22 bp, Homo sapiens
agaaatgtccagggctaggatc

SEQ ID NO: 9503657 - DNA, 22 bp, Homo sapiens
agaaatgtgaatttcatttcct

SEQ ID NO: 9503658 - DNA, 20 bp, Homo sapiens
agaaatgtgaaaggctgagt

SEQ ID NO: 9503659 - DNA, 20 bp, Homo sapiens
agaaatgtgaaaggctgagt

SEQ ID NO: 9503660 - DNA, 20 bp, Homo sapiens
agaaatgtgaaaggctgagt

SEQ ID NO: 9503661 - DNA, 22 bp, Homo sapiens
agaaatgtgaatttcatttcct

SEQ ID NO: 9503662 - DNA, 22 bp, Homo sapiens
agaaatgtggaggaacagggct

SEQ ID NO: 9503663 - DNA, 22 bp, Homo sapiens
agaaatgtggaggaacagggct

SEQ ID NO: 9503664 - DNA, 22 bp, Homo sapiens
agaaatgtgagccccttatcaa

SEQ ID NO: 9503665 - DNA, 22 bp, Homo sapiens
agaaatgtgagccccttatcaa

SEQ ID NO: 9503666 - DNA, 22 bp, Homo sapiens
agaaatgttacagttgttattt

SEQ ID NO: 9503667 - DNA, 22 bp, Homo sapiens
agaaatgtggatcgttttaaaa

SEQ ID NO: 9503668 - DNA, 22 bp, Homo sapiens
agaaatgtggatcgttttaaaa

SEQ ID NO: 9503669 - DNA, 22 bp, Homo sapiens
agaaatgttgaatacacaaaat

SEQ ID NO: 9503670 - DNA, 22 bp, Homo sapiens
agaaatgttgaatacacaaaat

SEQ ID NO: 9503671 - DNA, 22 bp, Homo sapiens
agaaatgttcttcatttgccat

SEQ ID NO: 9503672 - DNA, 22 bp, Homo sapiens
agaaatgttacagttgttattt

SEQ ID NO: 9503673 - DNA, 22 bp, Homo sapiens
agaaatggaaatccaagcaact

SEQ ID NO: 9503674 - DNA, 22 bp, Homo sapiens
agaaatgctcttcctgaccaga

SEQ ID NO: 9503675 - DNA, 22 bp, Homo sapiens
agaaatggaaatccaagcaact

SEQ ID NO: 9503676 - DNA, 22 bp, Homo sapiens
agaaatggtgagtgagagcccc

SEQ ID NO: 9503677 - DNA, 22 bp, Homo sapiens
agaaatggtgagtgagagcccc

SEQ ID NO: 9503678 - DNA, 22 bp, Homo sapiens
agaaatggtgagtgagagcccc

SEQ ID NO: 9503679 - DNA, 22 bp, Homo sapiens
agaaatggtgagtgagagcccc

SEQ ID NO: 9503680 - DNA, 22 bp, Homo sapiens
agaaatgtaattgcaactgtct

SEQ ID NO: 9503681 - DNA, 22 bp, Homo sapiens
agaaatgtaattgcaactgtct

SEQ ID NO: 9503682 - DNA, 22 bp, Homo sapiens
agaaatgtacacgacacccaga

SEQ ID NO: 9503683 - DNA, 22 bp, Homo sapiens
agaaatgtacacgacacccaga

SEQ ID NO: 9503684 - DNA, 22 bp, Homo sapiens
agaaatgtacgatgttatgcag

SEQ ID NO: 9503685 - DNA, 22 bp, Homo sapiens
agaaatgtaggcatataaggaa

SEQ ID NO: 9503686 - DNA, 22 bp, Homo sapiens
agaaatgtatagtgaatttttc

SEQ ID NO: 9503687 - DNA, 22 bp, Homo sapiens
agaaatgtcaggaaagaagtcc

SEQ ID NO: 9503688 - DNA, 22 bp, Homo sapiens
agaaatgtcaggaaagaagtcc

SEQ ID NO: 9503689 - DNA, 22 bp, Homo sapiens
agaaatgtcaggaaagaagtcc

SEQ ID NO: 9503690 - DNA, 22 bp, Homo sapiens
agaaatgtcaggaaagaagtcc

SEQ ID NO: 9503691 - DNA, 21 bp, Homo sapiens
agaaatgtatcattcttttcc

SEQ ID NO: 9503692 - DNA, 21 bp, Homo sapiens
agaaatgtatcattcttttcc

SEQ ID NO: 9503693 - DNA, 22 bp, Homo sapiens
agaaatgtattctgtatgtttt

SEQ ID NO: 9503694 - DNA, 22 bp, Homo sapiens
agaaatgtattctgtatgtttt

SEQ ID NO: 9503695 - DNA, 22 bp, Homo sapiens
agaagccaaatgccagtgacct

SEQ ID NO: 9503696 - DNA, 22 bp, Homo sapiens
agaagccaaatgccagtgacct

SEQ ID NO: 9503697 - DNA, 22 bp, Homo sapiens
agaagccaacagggcaggagag

SEQ ID NO: 9503698 - DNA, 22 bp, Homo sapiens
agaagcattggaccaggggccc

SEQ ID NO: 9503699 - DNA, 20 bp, Homo sapiens
agaagcattcaaagaaaact

SEQ ID NO: 9503700 - DNA, 20 bp, Homo sapiens
agaagcattcaaagaaaact

SEQ ID NO: 9503701 - DNA, 22 bp, Homo sapiens
agaagcagttattttttgcaca

SEQ ID NO: 9503702 - DNA, 20 bp, Homo sapiens
agaagcatcattctgatgtc

SEQ ID NO: 9503703 - DNA, 22 bp, Homo sapiens
agaagcattatttaattttact

SEQ ID NO: 9503704 - DNA, 22 bp, Homo sapiens
agaagcattatttaattttact

SEQ ID NO: 9503705 - DNA, 22 bp, Homo sapiens
agaagcattataacatgcaagg

SEQ ID NO: 9503706 - DNA, 22 bp, Homo sapiens
agaagcaggcctcacagatctg

SEQ ID NO: 9503707 - DNA, 22 bp, Homo sapiens
agaagcagggcagggaaaagca

SEQ ID NO: 9503708 - DNA, 22 bp, Homo sapiens
agaagcagggcagggaaaagca

SEQ ID NO: 9503709 - DNA, 22 bp, Homo sapiens
agaagcaggcctcacagatctg

SEQ ID NO: 9503710 - DNA, 22 bp, Homo sapiens
agaaatgtttatggctgcctat

SEQ ID NO: 9503711 - DNA, 22 bp, Homo sapiens
agaaatgtttactcaccccctt

SEQ ID NO: 9503712 - DNA, 22 bp, Homo sapiens
agaaatgttgtgggttttgtta

SEQ ID NO: 9503713 - DNA, 22 bp, Homo sapiens
agaaatgtttactcaccccctt

SEQ ID NO: 9503714 - DNA, 22 bp, Homo sapiens
agaagcacggttttgtctagca

SEQ ID NO: 9503715 - DNA, 22 bp, Homo sapiens
agaaatgttgaatacatcagga

SEQ ID NO: 9503716 - DNA, 22 bp, Homo sapiens
agaaatgttgaatacatcagga

SEQ ID NO: 9503717 - DNA, 22 bp, Homo sapiens
agaaatgttgaatacacaaaat

SEQ ID NO: 9503718 - DNA, 22 bp, Homo sapiens
atacacctgtggagtgtctctc

SEQ ID NO: 9503719 - DNA, 22 bp, Homo sapiens
atacacgtgtgtgtacatgcac

SEQ ID NO: 9503720 - DNA, 19 bp, Homo sapiens
atacactaatataaaccac

SEQ ID NO: 9503721 - DNA, 22 bp, Homo sapiens
atacactactaagcacagattg

SEQ ID NO: 9503722 - DNA, 22 bp, Homo sapiens
atacactactaagcacagattg

SEQ ID NO: 9503723 - DNA, 22 bp, Homo sapiens
atacactaatcatgtgctcagt

SEQ ID NO: 9503724 - DNA, 22 bp, Homo sapiens
atacacatttgctagagatggg

SEQ ID NO: 9503725 - DNA, 22 bp, Homo sapiens
atacacaattgtgtttttatga

SEQ ID NO: 9503726 - DNA, 22 bp, Homo sapiens
atacaatgggtgcaaagatgtg

SEQ ID NO: 9503727 - DNA, 22 bp, Homo sapiens
atacaatgattggttctcaccc

SEQ ID NO: 9503728 - DNA, 22 bp, Homo sapiens
atacaatctagtctgtcagcaa

SEQ ID NO: 9503729 - DNA, 22 bp, Homo sapiens
atacaatgataatagtacttta

SEQ ID NO: 9503730 - DNA, 22 bp, Homo sapiens
atacaatagtgtttgttttgag

SEQ ID NO: 9503731 - DNA, 22 bp, Homo sapiens
atacaatagtgtttgttttgag

SEQ ID NO: 9503732 - DNA, 22 bp, Homo sapiens
atacaatagtgtttgttttgag

SEQ ID NO: 9503733 - DNA, 22 bp, Homo sapiens
atacaatccagccattgccaca

SEQ ID NO: 9503734 - DNA, 20 bp, Homo sapiens
atacaatcatgaggaaaaag

SEQ ID NO: 9503735 - DNA, 22 bp, Homo sapiens
atacaagttgtgataatgtaaa

SEQ ID NO: 9503736 - DNA, 22 bp, Homo sapiens
atacaaagacaaatctcaatct

SEQ ID NO: 9503737 - DNA, 22 bp, Homo sapiens
atacaaagacaaatctcaatct

SEQ ID NO: 9503738 - DNA, 22 bp, Homo sapiens
ataaggcatatagtcacttttt

SEQ ID NO: 9503739 - DNA, 22 bp, Homo sapiens
ataaggtataaggcctattttt

SEQ ID NO: 9503740 - DNA, 20 bp, Homo sapiens
ataaggctgtgatagtctga

SEQ ID NO: 9503741 - DNA, 22 bp, Homo sapiens
ataaggcttctggctgctttct

SEQ ID NO: 9503742 - DNA, 22 bp, Homo sapiens
ataagctttgctggagagacct

SEQ ID NO: 9503743 - DNA, 22 bp, Homo sapiens
ataaggaaaattggagaaattg

SEQ ID NO: 9503744 - DNA, 22 bp, Homo sapiens
ataaggaaaattggagaaattg

SEQ ID NO: 9503745 - DNA, 22 bp, Homo sapiens
ataaggaaaattggagaaattg

SEQ ID NO: 9503746 - DNA, 22 bp, Homo sapiens
ataaggaacctgggcttaagag

SEQ ID NO: 9503747 - DNA, 22 bp, Homo sapiens
ataaggaaatgaaactctaata

SEQ ID NO: 9503748 - DNA, 22 bp, Homo sapiens
ataaggaacctgggcttaagag

SEQ ID NO: 9503749 - DNA, 22 bp, Homo sapiens
ataaggaacctgggcttaagag

SEQ ID NO: 9503750 - DNA, 22 bp, Homo sapiens
ataaggaatgatgtatcagttt

SEQ ID NO: 9503751 - DNA, 22 bp, Homo sapiens
ataaggaatgatgtatcagttt

SEQ ID NO: 9503752 - DNA, 22 bp, Homo sapiens
ataaggaagttgcagaagtgga

SEQ ID NO: 9503753 - DNA, 22 bp, Homo sapiens
ataaggaagatgtcctcatctg

SEQ ID NO: 9503754 - DNA, 22 bp, Homo sapiens
ataaggacttgaattagacatt

SEQ ID NO: 9503755 - DNA, 22 bp, Homo sapiens
ataaggaatttagaatagggaa

SEQ ID NO: 9503756 - DNA, 22 bp, Homo sapiens
ataaggaatgatgtatcagttt

SEQ ID NO: 9503757 - DNA, 22 bp, Homo sapiens
ataaggcagaaatagggaaagt

SEQ ID NO: 9503758 - DNA, 22 bp, Homo sapiens
ataaggacttgaattagacatt

SEQ ID NO: 9503759 - DNA, 22 bp, Homo sapiens
ataaggcacacatagatagggt

SEQ ID NO: 9503760 - DNA, 22 bp, Homo sapiens
ataaggcacacatagatagggt

SEQ ID NO: 9503761 - DNA, 22 bp, Homo sapiens
agttcacaatagaagaggtggc

SEQ ID NO: 9503762 - DNA, 22 bp, Homo sapiens
agttcacatatctgttttattt

SEQ ID NO: 9503763 - DNA, 22 bp, Homo sapiens
agttcactttctgtagtggaag

SEQ ID NO: 9503764 - DNA, 22 bp, Homo sapiens
agttcactttctgtagtggaag

SEQ ID NO: 9503765 - DNA, 22 bp, Homo sapiens
agttcagaaatgtctttgcaaa

SEQ ID NO: 9503766 - DNA, 22 bp, Homo sapiens
agttcactatagaagacagtgt

SEQ ID NO: 9503767 - DNA, 22 bp, Homo sapiens
agttcactctttatgagaaagt

SEQ ID NO: 9503768 - DNA, 22 bp, Homo sapiens
agttcagtagtccttcattgta

SEQ ID NO: 9503769 - DNA, 22 bp, Homo sapiens
agttcaggcataaggcatgaac

SEQ ID NO: 9503770 - DNA, 22 bp, Homo sapiens
agttcagagtaaatgttgaagg

SEQ ID NO: 9503771 - DNA, 22 bp, Homo sapiens
agttcagaggttaatttatttg

SEQ ID NO: 9503772 - DNA, 22 bp, Homo sapiens
agttgaaggttggctgatccat

SEQ ID NO: 9503773 - DNA, 22 bp, Homo sapiens
agttgaagtcttcaataagctt

SEQ ID NO: 9503774 - DNA, 22 bp, Homo sapiens
agttgaaattaagagagagttt

SEQ ID NO: 9503775 - DNA, 22 bp, Homo sapiens
agttgacatccagagacattct

SEQ ID NO: 9503776 - DNA, 22 bp, Homo sapiens
agttctttgtcatctctggagt

SEQ ID NO: 9503777 - DNA, 22 bp, Homo sapiens
agttctttgtaaaaggtctcta

SEQ ID NO: 9503778 - DNA, 22 bp, Homo sapiens
agttctttctagacacgtagac

SEQ ID NO: 9503779 - DNA, 22 bp, Homo sapiens
agttcttttgtgaacatatgct

SEQ ID NO: 9503780 - DNA, 22 bp, Homo sapiens
agttcttttgtgaacatatgct

SEQ ID NO: 9503781 - DNA, 22 bp, Homo sapiens
agttctttgtgagtaatacaga

SEQ ID NO: 9503782 - DNA, 22 bp, Homo sapiens
agttcttttctagattctggat

SEQ ID NO: 9503783 - DNA, 22 bp, Homo sapiens
agttgactctcaagatcctgtt

SEQ ID NO: 9503784 - DNA, 22 bp, Homo sapiens
agttgcagacgcagagatgttg

SEQ ID NO: 9503785 - DNA, 22 bp, Homo sapiens
agttgcagacgcagagatgttg

SEQ ID NO: 9503786 - DNA, 19 bp, Homo sapiens
ataaataaaaagtgggaga

SEQ ID NO: 9503787 - DNA, 19 bp, Homo sapiens
ataaataaaaagtgggaga

SEQ ID NO: 9503788 - DNA, 19 bp, Homo sapiens
ataaataaaaagtgggaga

SEQ ID NO: 9503789 - DNA, 22 bp, Homo sapiens
agttgcagacgcagagatgttg

SEQ ID NO: 9503790 - DNA, 19 bp, Homo sapiens
ataaataaaaagtgggaga

SEQ ID NO: 9503791 - DNA, 22 bp, Homo sapiens
ataaattcaaagcatttaggac

SEQ ID NO: 9503792 - DNA, 22 bp, Homo sapiens
ataaattctctgatgtatagta

SEQ ID NO: 9503793 - DNA, 22 bp, Homo sapiens
ataaattctctgatgtatagta

SEQ ID NO: 9503794 - DNA, 22 bp, Homo sapiens
ataaattctctgatgtatagta

SEQ ID NO: 9503795 - DNA, 22 bp, Homo sapiens
ataaattctctgatgtatagta

SEQ ID NO: 9503796 - DNA, 22 bp, Homo sapiens
ataaattgtgcttttgacatct

SEQ ID NO: 9503797 - DNA, 22 bp, Homo sapiens
ataaattgtgcttttgacatct

SEQ ID NO: 9503798 - DNA, 22 bp, Homo sapiens
ataaattgtgcttttgacatct

SEQ ID NO: 9503799 - DNA, 22 bp, Homo sapiens
ataacaatagtggtagtgctgg

SEQ ID NO: 9503800 - DNA, 22 bp, Homo sapiens
ataaattttcttgctgtactta

SEQ ID NO: 9503801 - DNA, 22 bp, Homo sapiens
ataaatttataattgtttcctg

SEQ ID NO: 9503802 - DNA, 22 bp, Homo sapiens
ataaatttataattgtttcctg

SEQ ID NO: 9503803 - DNA, 22 bp, Homo sapiens
ataacactaaatgtatgtaaca

SEQ ID NO: 9503804 - DNA, 22 bp, Homo sapiens
ataacactaaatgtatgtaaca

SEQ ID NO: 9503805 - DNA, 22 bp, Homo sapiens
ataacactaaatgtatgtaaca

SEQ ID NO: 9503806 - DNA, 22 bp, Homo sapiens
ataacagaataagtcattaccg

SEQ ID NO: 9503807 - DNA, 22 bp, Homo sapiens
ataacagaataagtcattaccg

SEQ ID NO: 9503808 - DNA, 22 bp, Homo sapiens
ataacagagagctactgaactg

SEQ ID NO: 9503809 - DNA, 22 bp, Homo sapiens
ataacagacttagagttacaag

SEQ ID NO: 9503810 - DNA, 22 bp, Homo sapiens
ataacagacttagagttacaag

SEQ ID NO: 9503811 - DNA, 22 bp, Homo sapiens
ataacagactgatttttaaatg

SEQ ID NO: 9503812 - DNA, 22 bp, Homo sapiens
actttactacatccacagatgg

SEQ ID NO: 9503813 - DNA, 22 bp, Homo sapiens
actttacaggcacttcaagtat

SEQ ID NO: 9503814 - DNA, 22 bp, Homo sapiens
actttacaggcacttcaagtat

SEQ ID NO: 9503815 - DNA, 22 bp, Homo sapiens
actttacaggcacttcaagtat

SEQ ID NO: 9503816 - DNA, 22 bp, Homo sapiens
atagaataaggcacagattctt

SEQ ID NO: 9503817 - DNA, 22 bp, Homo sapiens
atagaataaggcacagattctt

SEQ ID NO: 9503818 - DNA, 20 bp, Homo sapiens
atagaagtattatgtaatgt

SEQ ID NO: 9503819 - DNA, 22 bp, Homo sapiens
atagaagtggtctgcatttgca

SEQ ID NO: 9503820 - DNA, 22 bp, Homo sapiens
atagaatagcatagaaaattga

SEQ ID NO: 9503821 - DNA, 22 bp, Homo sapiens
atagaatagcatagaaaattga

SEQ ID NO: 9503822 - DNA, 20 bp, Homo sapiens
actttacagagaagactgac

SEQ ID NO: 9503823 - DNA, 22 bp, Homo sapiens
actttagaaaagcatccataga

SEQ ID NO: 9503824 - DNA, 22 bp, Homo sapiens
atagatgtacgtatgtaaatca

SEQ ID NO: 9503825 - DNA, 22 bp, Homo sapiens
atagcatttacttttcagaaat

SEQ ID NO: 9503826 - DNA, 22 bp, Homo sapiens
atagatgtcattgtcatccatc

SEQ ID NO: 9503827 - DNA, 22 bp, Homo sapiens
atagcatataagttataaaact

SEQ ID NO: 9503828 - DNA, 22 bp, Homo sapiens
atagcatataagttataaaact

SEQ ID NO: 9503829 - DNA, 22 bp, Homo sapiens
atagaacacagatgggcgtggc

SEQ ID NO: 9503830 - DNA, 22 bp, Homo sapiens
atagaacaaggtagacagcttt

SEQ ID NO: 9503831 - DNA, 22 bp, Homo sapiens
atagaacagaaacagatgcaca

SEQ ID NO: 9503832 - DNA, 22 bp, Homo sapiens
atagaacagaaacagatgcaca

SEQ ID NO: 9503833 - DNA, 19 bp, Homo sapiens
atagaacctgcagtttcaa

SEQ ID NO: 9503834 - DNA, 22 bp, Homo sapiens
atagaactcgggctttggaatc

SEQ ID NO: 9503835 - DNA, 22 bp, Homo sapiens
atagaagaggaaactgaggttg

SEQ ID NO: 9503836 - DNA, 23 bp, Homo sapiens
atagaagattattgcaacagtcc

SEQ ID NO: 9503837 - DNA, 23 bp, Homo sapiens
atagaagattattgcaacagtcc

SEQ ID NO: 9503838 - DNA, 22 bp, Homo sapiens
atagaagcttttaaataacagg

SEQ ID NO: 9503839 - DNA, 22 bp, Homo sapiens
atagaagtggtctgcatttgca

SEQ ID NO: 9503840 - DNA, 20 bp, Homo sapiens
atagaagtattatgtaatgt

SEQ ID NO: 9503841 - DNA, 22 bp, Homo sapiens
atacttaatgtcagtttgatgt

SEQ ID NO: 9503842 - DNA, 22 bp, Homo sapiens
atacttaatgtcagtttgatgt

SEQ ID NO: 9503843 - DNA, 22 bp, Homo sapiens
atagaaatgtattttggactag

SEQ ID NO: 9503844 - DNA, 22 bp, Homo sapiens
atacacttgacctggagtgaag

SEQ ID NO: 9503845 - DNA, 22 bp, Homo sapiens
atacacttgacctggagtgaag

SEQ ID NO: 9503846 - DNA, 20 bp, Homo sapiens
atacacttgcccagcttgtg

SEQ ID NO: 9503847 - DNA, 22 bp, Homo sapiens
atacactgttcactagatcttc

SEQ ID NO: 9503848 - DNA, 22 bp, Homo sapiens
atacacttcatgttttcatctg

SEQ ID NO: 9503849 - DNA, 22 bp, Homo sapiens
atacacttcatgttttcatctg

SEQ ID NO: 9503850 - DNA, 22 bp, Homo sapiens
atacactggtttatgatattgt

SEQ ID NO: 9503851 - DNA, 22 bp, Homo sapiens
atacactggacatcattgcatt

SEQ ID NO: 9503852 - DNA, 22 bp, Homo sapiens
agaaaacttgtcacagctctca

SEQ ID NO: 9503853 - DNA, 22 bp, Homo sapiens
agaaaacttgtcacagctctca

SEQ ID NO: 9503854 - DNA, 22 bp, Homo sapiens
agaaaacttgctcgagcctgtt

SEQ ID NO: 9503855 - DNA, 20 bp, Homo sapiens
agaaaaagtgtggaaatttc

SEQ ID NO: 9503856 - DNA, 20 bp, Homo sapiens
agaaaaagtgtggaaatttc

SEQ ID NO: 9503857 - DNA, 20 bp, Homo sapiens
agaaaaagtgtggaaatttc

SEQ ID NO: 9503858 - DNA, 22 bp, Homo sapiens
atagttcttaagccatgttgct

SEQ ID NO: 9503859 - DNA, 22 bp, Homo sapiens
atagttctggatgtacttatag

SEQ ID NO: 9503860 - DNA, 22 bp, Homo sapiens
atagttctcactcagaatttga

SEQ ID NO: 9503861 - DNA, 23 bp, Homo sapiens
atagttctgcttagaaatcagtg

SEQ ID NO: 9503862 - DNA, 23 bp, Homo sapiens
atagttctgcttagaaatcagtg

SEQ ID NO: 9503863 - DNA, 22 bp, Homo sapiens
atagttctcactcagaatttga

SEQ ID NO: 9503864 - DNA, 22 bp, Homo sapiens
atagttctagacctatagttct

SEQ ID NO: 9503865 - DNA, 22 bp, Homo sapiens
atagttctagacctatagttct

SEQ ID NO: 9503866 - DNA, 22 bp, Homo sapiens
agaaaagaggctttctaagcat

SEQ ID NO: 9503867 - DNA, 22 bp, Homo sapiens
agaaaagcggtcaggaccctca

SEQ ID NO: 9503868 - DNA, 22 bp, Homo sapiens
agaaaagcggtcaggaccctca

SEQ ID NO: 9503869 - DNA, 22 bp, Homo sapiens
agaaaagaggctttctaagcat

SEQ ID NO: 9503870 - DNA, 22 bp, Homo sapiens
agaaaagcggtcaggaccctca

SEQ ID NO: 9503871 - DNA, 17 bp, Homo sapiens
agaaaagagaccagcag

SEQ ID NO: 9503872 - DNA, 17 bp, Homo sapiens
agaaaagagaccagcag

SEQ ID NO: 9503873 - DNA, 17 bp, Homo sapiens
agaaaagagaccagcag

SEQ ID NO: 9503874 - DNA, 22 bp, Homo sapiens
agaaaagaggctttctaagcat

SEQ ID NO: 9503875 - DNA, 22 bp, Homo sapiens
agaaaagaggctttctaagcat

SEQ ID NO: 9503876 - DNA, 22 bp, Homo sapiens
agaaaagggcaggagggataca

SEQ ID NO: 9503877 - DNA, 22 bp, Homo sapiens
agaaaaggattgatggatcaga

SEQ ID NO: 9503878 - DNA, 22 bp, Homo sapiens
agaaaaggcttgaagaggtttt

SEQ ID NO: 9503879 - DNA, 23 bp, Homo sapiens
agaaaagcttggacacatggcct

SEQ ID NO: 9503880 - DNA, 22 bp, Homo sapiens
agaaaaggattgatggatcaga

SEQ ID NO: 9503881 - DNA, 22 bp, Homo sapiens
agaaaaggattgatggatcaga

SEQ ID NO: 9503882 - DNA, 22 bp, Homo sapiens
atagccagcatatagcagggag

SEQ ID NO: 9503883 - DNA, 22 bp, Homo sapiens
atagccaggagatgatggggga

SEQ ID NO: 9503884 - DNA, 22 bp, Homo sapiens
atagcttacaggtgatatcagc

SEQ ID NO: 9503885 - DNA, 22 bp, Homo sapiens
atagctttttgtcatagagtct

SEQ ID NO: 9503886 - DNA, 22 bp, Homo sapiens
atagctttcttaaatatataaa

SEQ ID NO: 9503887 - DNA, 22 bp, Homo sapiens
atagctttcttaaatatataaa

SEQ ID NO: 9503888 - DNA, 22 bp, Homo sapiens
atagctttcttaaatatataaa

SEQ ID NO: 9503889 - DNA, 22 bp, Homo sapiens
atagctttttgtcatagagtct

SEQ ID NO: 9503890 - DNA, 22 bp, Homo sapiens
ataggaaagaaaattatgtagg

SEQ ID NO: 9503891 - DNA, 20 bp, Homo sapiens
ataggaaagggaggggcttt

SEQ ID NO: 9503892 - DNA, 22 bp, Homo sapiens
atagtgtgactgaggagttgaa

SEQ ID NO: 9503893 - DNA, 22 bp, Homo sapiens
atagtgtgtaaagtgcagtgat

SEQ ID NO: 9503894 - DNA, 22 bp, Homo sapiens
atagtgtctttcttcacaggca

SEQ ID NO: 9503895 - DNA, 22 bp, Homo sapiens
atagtgtgtggtataggtagag

SEQ ID NO: 9503896 - DNA, 22 bp, Homo sapiens
atagtgtgttagtgacataggc

SEQ ID NO: 9503897 - DNA, 22 bp, Homo sapiens
atagtgttacccttcttaaagt

SEQ ID NO: 9503898 - DNA, 22 bp, Homo sapiens
atagtgttagagccagtatgtt

SEQ ID NO: 9503899 - DNA, 22 bp, Homo sapiens
atagtgttacccttcttaaagt

SEQ ID NO: 9503900 - DNA, 22 bp, Homo sapiens
atagtgttgatagcagtggagt

SEQ ID NO: 9503901 - DNA, 23 bp, Homo sapiens
atagttagcacacttacaactgc

SEQ ID NO: 9503902 - DNA, 22 bp, Homo sapiens
atagttacatacagaaatattt

SEQ ID NO: 9503903 - DNA, 22 bp, Homo sapiens
atagttacaaagactttttaaa

SEQ ID NO: 9503904 - DNA, 22 bp, Homo sapiens
ggcaggcatggggtctgccatt

SEQ ID NO: 9503905 - DNA, 22 bp, Homo sapiens
ggcaggcatggggtctgccatt

SEQ ID NO: 9503906 - DNA, 20 bp, Homo sapiens
ggcagggagggatactgagg

SEQ ID NO: 9503907 - DNA, 22 bp, Homo sapiens
ggcagggaggaggtgaaagtga

SEQ ID NO: 9503908 - DNA, 22 bp, Homo sapiens
ggcagggaggaggtgaaagtga

SEQ ID NO: 9503909 - DNA, 22 bp, Homo sapiens
ggcaggcatggccactccctag

SEQ ID NO: 9503910 - DNA, 22 bp, Homo sapiens
ggcaggcatcatgtggtcatta

SEQ ID NO: 9503911 - DNA, 22 bp, Homo sapiens
ggcaggcatggccactccctag

SEQ ID NO: 9503912 - DNA, 22 bp, Homo sapiens
ggcaggcatggccactccctag

SEQ ID NO: 9503913 - DNA, 22 bp, Homo sapiens
ggcaggcatggggtctgccatt

SEQ ID NO: 9503914 - DNA, 22 bp, Homo sapiens
ggcaggcagtgtggtgtgaaac

SEQ ID NO: 9503915 - DNA, 22 bp, Homo sapiens
ggcaggcagtgtggtgtgaaac

SEQ ID NO: 9503916 - DNA, 22 bp, Homo sapiens
ggcaggcaggtcttcatggccc

SEQ ID NO: 9503917 - DNA, 22 bp, Homo sapiens
ggcaggcaggtcttcatggccc

SEQ ID NO: 9503918 - DNA, 22 bp, Homo sapiens
ggcaggcaggtcttcatggccc

SEQ ID NO: 9503919 - DNA, 22 bp, Homo sapiens
ggcaggcaggagctctgtctcc

SEQ ID NO: 9503920 - DNA, 22 bp, Homo sapiens
cacatttatttgaggctaattg

SEQ ID NO: 9503921 - DNA, 22 bp, Homo sapiens
cacatttaattggtttagggtg

SEQ ID NO: 9503922 - DNA, 22 bp, Homo sapiens
cacattctttcacagttctgaa

SEQ ID NO: 9503923 - DNA, 22 bp, Homo sapiens
cacattcttggtcaccttgtgg

SEQ ID NO: 9503924 - DNA, 18 bp, Homo sapiens
cacatttacctggctccc

SEQ ID NO: 9503925 - DNA, 18 bp, Homo sapiens
cacatttacctggctccc

SEQ ID NO: 9503926 - DNA, 22 bp, Homo sapiens
cacatttacatataaaactttc

SEQ ID NO: 9503927 - DNA, 22 bp, Homo sapiens
cacatttacatataaaactttc

SEQ ID NO: 9503928 - DNA, 22 bp, Homo sapiens
cacatttacatataaaactttc

SEQ ID NO: 9503929 - DNA, 23 bp, Homo sapiens
cacatatagcagccactaaggtc

SEQ ID NO: 9503930 - DNA, 22 bp, Homo sapiens
cacatatacctcttcttgagtt

SEQ ID NO: 9503931 - DNA, 23 bp, Homo sapiens
cacatatagcagccactaaggtc

SEQ ID NO: 9503932 - DNA, 22 bp, Homo sapiens
cacattctgtccttgaactgca

SEQ ID NO: 9503933 - DNA, 22 bp, Homo sapiens
cacattctgtgaagctgatttt

SEQ ID NO: 9503934 - DNA, 22 bp, Homo sapiens
cacatagataggcagaagaaca

SEQ ID NO: 9503935 - DNA, 22 bp, Homo sapiens
cacatttatctgttctttctag

SEQ ID NO: 9503936 - DNA, 22 bp, Homo sapiens
cacatttatctctctccggtga

SEQ ID NO: 9503937 - DNA, 22 bp, Homo sapiens
cacatttatctctctccggtga

SEQ ID NO: 9503938 - DNA, 22 bp, Homo sapiens
cacatttatgggctgggaggca

SEQ ID NO: 9503939 - DNA, 22 bp, Homo sapiens
cacatttatctgttctttctag

SEQ ID NO: 9503940 - DNA, 22 bp, Homo sapiens
cacatttatctgttctttctag

SEQ ID NO: 9503941 - DNA, 22 bp, Homo sapiens
cacatttaggttcctatagcca

SEQ ID NO: 9503942 - DNA, 22 bp, Homo sapiens
cacatttaggttcctatagcca

SEQ ID NO: 9503943 - DNA, 22 bp, Homo sapiens
cacatttacttttatcccttgg

SEQ ID NO: 9503944 - DNA, 18 bp, Homo sapiens
cacatttacctggctccc

SEQ ID NO: 9503945 - DNA, 22 bp, Homo sapiens
cacatttagaggttagcatggt

SEQ ID NO: 9503946 - DNA, 22 bp, Homo sapiens
cacatttagaggttagcatggt

SEQ ID NO: 9503947 - DNA, 22 bp, Homo sapiens
cacatttagaggttagcatggt

SEQ ID NO: 9503948 - DNA, 22 bp, Homo sapiens
cacatttagaggttagcatggt

SEQ ID NO: 9503949 - DNA, 22 bp, Homo sapiens
cacatttagaggttagcatggt

SEQ ID NO: 9503950 - DNA, 22 bp, Homo sapiens
cacatttaggaggtggggaagc

SEQ ID NO: 9503951 - DNA, 22 bp, Homo sapiens
cacatacttgtgtgtacatatg

SEQ ID NO: 9503952 - DNA, 22 bp, Homo sapiens
cacatacattcatgttactcta

SEQ ID NO: 9503953 - DNA, 22 bp, Homo sapiens
cacatacatgcacacctaaata

SEQ ID NO: 9503954 - DNA, 22 bp, Homo sapiens
cacatacatgcacacctaaata

SEQ ID NO: 9503955 - DNA, 22 bp, Homo sapiens
cacatacatgcacacctaaata

SEQ ID NO: 9503956 - DNA, 22 bp, Homo sapiens
cacatacatgcacacctaaata

SEQ ID NO: 9503957 - DNA, 22 bp, Homo sapiens
cacatacatgcacacctaaata

SEQ ID NO: 9503958 - DNA, 19 bp, Homo sapiens
cacatacagaaaagagtaa

SEQ ID NO: 9503959 - DNA, 22 bp, Homo sapiens
cacatacatacgtatgtataca

SEQ ID NO: 9503960 - DNA, 22 bp, Homo sapiens
cacatacatacgtatgtataca

SEQ ID NO: 9503961 - DNA, 22 bp, Homo sapiens
cacatacatacgtatgtataca

SEQ ID NO: 9503962 - DNA, 22 bp, Homo sapiens
cacatacatacgtatgtataca

SEQ ID NO: 9503963 - DNA, 22 bp, Homo sapiens
cacataaatggtgccatgtttt

SEQ ID NO: 9503964 - DNA, 22 bp, Homo sapiens
cacataaatggtgccatgtttt

SEQ ID NO: 9503965 - DNA, 22 bp, Homo sapiens
cacataaatggtgccatgtttt

SEQ ID NO: 9503966 - DNA, 22 bp, Homo sapiens
cacataagaaatgaatatgaga

SEQ ID NO: 9503967 - DNA, 22 bp, Homo sapiens
cacatacaatggtgttatttgg

SEQ ID NO: 9503968 - DNA, 22 bp, Homo sapiens
cacatacaatggtgttatttgg

SEQ ID NO: 9503969 - DNA, 22 bp, Homo sapiens
cacataatcaccaagtcctttc

SEQ ID NO: 9503970 - DNA, 22 bp, Homo sapiens
cacataattgaacgtgatgagt

SEQ ID NO: 9503971 - DNA, 22 bp, Homo sapiens
cacataatacatgttccactta

SEQ ID NO: 9503972 - DNA, 22 bp, Homo sapiens
cacataataaatgttcctgatg

SEQ ID NO: 9503973 - DNA, 22 bp, Homo sapiens
cacataataaatgttcctgatg

SEQ ID NO: 9503974 - DNA, 22 bp, Homo sapiens
ggaggtgcagagtagggttggt

SEQ ID NO: 9503975 - DNA, 22 bp, Homo sapiens
ggaggtgatcagagttttgagg

SEQ ID NO: 9503976 - DNA, 22 bp, Homo sapiens
ggaggtgctgatcccagtcaac

SEQ ID NO: 9503977 - DNA, 22 bp, Homo sapiens
ggaggtgactggatcatgggca

SEQ ID NO: 9503978 - DNA, 22 bp, Homo sapiens
ggaggtgacgaaaagaaattgt

SEQ ID NO: 9503979 - DNA, 22 bp, Homo sapiens
ggaggtgaggccgtagggtgtg

SEQ ID NO: 9503980 - DNA, 22 bp, Homo sapiens
ggaggtgactggatcatgggca

SEQ ID NO: 9503981 - DNA, 22 bp, Homo sapiens
cacaggcttgtcagcatgaggc

SEQ ID NO: 9503982 - DNA, 22 bp, Homo sapiens
ggaggtgaggccgtagggtgtg

SEQ ID NO: 9503983 - DNA, 22 bp, Homo sapiens
ggaggtgaggccgtagggtgtg

SEQ ID NO: 9503984 - DNA, 22 bp, Homo sapiens
cacagggaaccaaggctgggcc

SEQ ID NO: 9503985 - DNA, 22 bp, Homo sapiens
cacagggaaccaaggctgggcc

SEQ ID NO: 9503986 - DNA, 22 bp, Homo sapiens
cacagggaacaactagaacaaa

SEQ ID NO: 9503987 - DNA, 22 bp, Homo sapiens
cacagggaaccaaggctgggcc

SEQ ID NO: 9503988 - DNA, 22 bp, Homo sapiens
cacagggaaccaaggctgggcc

SEQ ID NO: 9503989 - DNA, 22 bp, Homo sapiens
cacaggcttttttggctgatgt

SEQ ID NO: 9503990 - DNA, 22 bp, Homo sapiens
cacaggcttttttggctgatgt

SEQ ID NO: 9503991 - DNA, 22 bp, Homo sapiens
cacagggaacaactagaacaaa

SEQ ID NO: 9503992 - DNA, 22 bp, Homo sapiens
cacaggcttttttggctgatgt

SEQ ID NO: 9503993 - DNA, 22 bp, Homo sapiens
cacaggcttttctgacataggc

SEQ ID NO: 9503994 - DNA, 22 bp, Homo sapiens
ggaggtggaggttgcaatgagc

SEQ ID NO: 9503995 - DNA, 22 bp, Homo sapiens
ggaggtgctggcggccagctct

SEQ ID NO: 9503996 - DNA, 22 bp, Homo sapiens
ggaggtggagctggaagttcca

SEQ ID NO: 9503997 - DNA, 22 bp, Homo sapiens
cacagttttatcttatactgat

SEQ ID NO: 9503998 - DNA, 22 bp, Homo sapiens
ggaggtggaggttgcagtgagc

SEQ ID NO: 9503999 - DNA, 22 bp, Homo sapiens
cacagtgtgggcatggtgcctg

SEQ ID NO: 9504000 - DNA, 22 bp, Homo sapiens
ggaggtggaggttgcaatgagc

SEQ ID NO: 9504001 - DNA, 22 bp, Homo sapiens
ggcagggcagcgctgattaggg

SEQ ID NO: 9504002 - DNA, 22 bp, Homo sapiens
ggcagggcagcgctgattaggg

SEQ ID NO: 9504003 - DNA, 22 bp, Homo sapiens
ggcagggagtggagactcccta

SEQ ID NO: 9504004 - DNA, 22 bp, Homo sapiens
ggcagggcaggaaagtcaggaa

SEQ ID NO: 9504005 - DNA, 22 bp, Homo sapiens
ggcagggcaggaaagtcaggaa

SEQ ID NO: 9504006 - DNA, 22 bp, Homo sapiens
ggcagggcaggaaagtcaggaa

SEQ ID NO: 9504007 - DNA, 22 bp, Homo sapiens
ggcagggcaggaaagtcaggaa

SEQ ID NO: 9504008 - DNA, 22 bp, Homo sapiens
ggcagggcaggaaagtcaggaa

SEQ ID NO: 9504009 - DNA, 22 bp, Homo sapiens
ggcaggtgccagttggcttggg

SEQ ID NO: 9504010 - DNA, 22 bp, Homo sapiens
ggcaggtgcccagagagcacga

SEQ ID NO: 9504011 - DNA, 22 bp, Homo sapiens
ggcaggtgcccagagagcacga

SEQ ID NO: 9504012 - DNA, 22 bp, Homo sapiens
ggcaggtgcacctgagccatct

SEQ ID NO: 9504013 - DNA, 22 bp, Homo sapiens
ggcaggtgcacctgagccatct

SEQ ID NO: 9504014 - DNA, 22 bp, Homo sapiens
ggcaggtgcacctgagccatct

SEQ ID NO: 9504015 - DNA, 22 bp, Homo sapiens
ggcaggtgatctagagtcaata

SEQ ID NO: 9504016 - DNA, 22 bp, Homo sapiens
ggcatttgactcagtgactggg

SEQ ID NO: 9504017 - DNA, 22 bp, Homo sapiens
ggcatttaggcagataacagac

SEQ ID NO: 9504018 - DNA, 22 bp, Homo sapiens
ggcatcagcccggtcctgggct

SEQ ID NO: 9504019 - DNA, 22 bp, Homo sapiens
ggcattaggtgaatgctcagca

SEQ ID NO: 9504020 - DNA, 22 bp, Homo sapiens
ggcattgatgggagatggtgga

SEQ ID NO: 9504021 - DNA, 22 bp, Homo sapiens
ggcattgtaaaggattcataga

SEQ ID NO: 9504022 - DNA, 22 bp, Homo sapiens
ggcatttgagccattggcctgt

SEQ ID NO: 9504023 - DNA, 21 bp, Homo sapiens
ggcatttgccaaagtgatcct

SEQ ID NO: 9504024 - DNA, 22 bp, Homo sapiens
ggcatttgactcagtgactggg

SEQ ID NO: 9504025 - DNA, 17 bp, Homo sapiens
ggcatttgtcaggcaga

SEQ ID NO: 9504026 - DNA, 22 bp, Homo sapiens
ggccaaatcctccatggtggct

SEQ ID NO: 9504027 - DNA, 22 bp, Homo sapiens
ggccaaaagcataatcctcaca

SEQ ID NO: 9504028 - DNA, 22 bp, Homo sapiens
ggccaagaatgataggctcagt

SEQ ID NO: 9504029 - DNA, 22 bp, Homo sapiens
ggccaagatggaaggagagatg

SEQ ID NO: 9504030 - DNA, 21 bp, Homo sapiens
ggccaacatggtctcatctct

SEQ ID NO: 9504031 - DNA, 21 bp, Homo sapiens
ggcatttgccaaagtgatcct

SEQ ID NO: 9504032 - DNA, 23 bp, Homo sapiens
ggccactgaattttctgcatctt

SEQ ID NO: 9504033 - DNA, 22 bp, Homo sapiens
ggccactcggccacccctgccg

SEQ ID NO: 9504034 - DNA, 23 bp, Homo sapiens
ggccactgaattttctgcatctt

SEQ ID NO: 9504035 - DNA, 23 bp, Homo sapiens
ggccactgaattttctgcatctt

SEQ ID NO: 9504036 - DNA, 19 bp, Homo sapiens
ggccactcctggtgactgg

SEQ ID NO: 9504037 - DNA, 22 bp, Homo sapiens
ggccactccgctgctactggaa

SEQ ID NO: 9504038 - DNA, 22 bp, Homo sapiens
ggccaaggatggtggctctggt

SEQ ID NO: 9504039 - DNA, 22 bp, Homo sapiens
ggccctgtctgtctgcccagct

SEQ ID NO: 9504040 - DNA, 22 bp, Homo sapiens
ggccctgtctgtctgcccagct

SEQ ID NO: 9504041 - DNA, 22 bp, Homo sapiens
ggccctgtcctggctgtctccg

SEQ ID NO: 9504042 - DNA, 22 bp, Homo sapiens
ggccctgtccctggccgtctgt

SEQ ID NO: 9504043 - DNA, 22 bp, Homo sapiens
ggccctgtccccttcagttttg

SEQ ID NO: 9504044 - DNA, 22 bp, Homo sapiens
ggccctgtcctggctgtctccg

SEQ ID NO: 9504045 - DNA, 22 bp, Homo sapiens
ggccctgtcctggctgtctccg

SEQ ID NO: 9504046 - DNA, 22 bp, Homo sapiens
ggccccagggattaggccaacc

SEQ ID NO: 9504047 - DNA, 22 bp, Homo sapiens
ggccccaggtagaagatataga

SEQ ID NO: 9504048 - DNA, 21 bp, Homo sapiens
ggccctggttacgcctcctct

SEQ ID NO: 9504049 - DNA, 19 bp, Homo sapiens
ggccctgtaggatgtgagt

SEQ ID NO: 9504050 - DNA, 22 bp, Homo sapiens
ggcccttgcagcaggcgctggc

SEQ ID NO: 9504051 - DNA, 22 bp, Homo sapiens
ggccctgtggttttgcaaagtc

SEQ ID NO: 9504052 - DNA, 22 bp, Homo sapiens
ggccctgtggttttgcaaagtc

SEQ ID NO: 9504053 - DNA, 22 bp, Homo sapiens
ggccctgtgatggatgtattag

SEQ ID NO: 9504054 - DNA, 22 bp, Homo sapiens
ggccctgtgatggatgtattag

SEQ ID NO: 9504055 - DNA, 22 bp, Homo sapiens
ggccctgttagagctcccacaa

SEQ ID NO: 9504056 - DNA, 22 bp, Homo sapiens
ggccctgttagagctcccacaa

SEQ ID NO: 9504057 - DNA, 22 bp, Homo sapiens
ggcccttcctcttgtgctggca

SEQ ID NO: 9504058 - DNA, 22 bp, Homo sapiens
ggccactgctgctctggtggag

SEQ ID NO: 9504059 - DNA, 22 bp, Homo sapiens
ggccactgctctccagcctggg

SEQ ID NO: 9504060 - DNA, 22 bp, Homo sapiens
ggccactgctctccagcctggg

SEQ ID NO: 9504061 - DNA, 22 bp, Homo sapiens
ggccactgccctggctacaccg

SEQ ID NO: 9504062 - DNA, 22 bp, Homo sapiens
ggccactgacctacatctgggg

SEQ ID NO: 9504063 - DNA, 20 bp, Homo sapiens
caccttcaaatttcctggca

SEQ ID NO: 9504064 - DNA, 22 bp, Homo sapiens
caccttccatctccttggctag

SEQ ID NO: 9504065 - DNA, 22 bp, Homo sapiens
caccttcagaatgctccaggca

SEQ ID NO: 9504066 - DNA, 22 bp, Homo sapiens
cacctttgcaaaccaaatctga

SEQ ID NO: 9504067 - DNA, 22 bp, Homo sapiens
caccttttgtgtctgcgtttgt

SEQ ID NO: 9504068 - DNA, 22 bp, Homo sapiens
cacctttgttctcggccagagt

SEQ ID NO: 9504069 - DNA, 22 bp, Homo sapiens
cacctttgaccttgcagcgcac

SEQ ID NO: 9504070 - DNA, 22 bp, Homo sapiens
cacctttaatgagcaccagccg

SEQ ID NO: 9504071 - DNA, 21 bp, Homo sapiens
caccttggaaggtggagagtt

SEQ ID NO: 9504072 - DNA, 22 bp, Homo sapiens
ggcctctctccagtcagtgcag

SEQ ID NO: 9504073 - DNA, 22 bp, Homo sapiens
cacgagtaacacattaacatgg

SEQ ID NO: 9504074 - DNA, 21 bp, Homo sapiens
ggccgccgccttgtgctctgc

SEQ ID NO: 9504075 - DNA, 20 bp, Homo sapiens
ggccggggagctctccaggg

SEQ ID NO: 9504076 - DNA, 22 bp, Homo sapiens
ggccggggcctccccgcgtcgc

SEQ ID NO: 9504077 - DNA, 20 bp, Homo sapiens
ggccggggagctctccaggg

SEQ ID NO: 9504078 - DNA, 22 bp, Homo sapiens
cacctgtccacgcagtctgcct

SEQ ID NO: 9504079 - DNA, 22 bp, Homo sapiens
cacctgtacagggccgggctgg

SEQ ID NO: 9504080 - DNA, 22 bp, Homo sapiens
cacctgttagctctaattttct

SEQ ID NO: 9504081 - DNA, 22 bp, Homo sapiens
cacctgttgtttattcatctct

SEQ ID NO: 9504082 - DNA, 22 bp, Homo sapiens
cacctgttcattacccatccca

SEQ ID NO: 9504083 - DNA, 22 bp, Homo sapiens
cacctgggtcattgctggtgtt

SEQ ID NO: 9504084 - DNA, 22 bp, Homo sapiens
cacctgggtcattgctggtgtt

SEQ ID NO: 9504085 - DNA, 22 bp, Homo sapiens
cacctgggtcattgctggtgtt

SEQ ID NO: 9504086 - DNA, 22 bp, Homo sapiens
ggccggggcctgctcgcctgtg

SEQ ID NO: 9504087 - DNA, 22 bp, Homo sapiens
ggccggttcaagggcagtcaga

SEQ ID NO: 9504088 - DNA, 22 bp, Homo sapiens
ggccgtgctccaaagtcatcgt

SEQ ID NO: 9504089 - DNA, 22 bp, Homo sapiens
ggctcaatgcaacttctgcctc

SEQ ID NO: 9504090 - DNA, 22 bp, Homo sapiens
ggcctgtgtcctccttgccctg

SEQ ID NO: 9504091 - DNA, 22 bp, Homo sapiens
ggcctgtgtcctccttgccctg

SEQ ID NO: 9504092 - DNA, 22 bp, Homo sapiens
ggcctgtgtctgtgcctgtcct

SEQ ID NO: 9504093 - DNA, 22 bp, Homo sapiens
ggcctgtgtcggccccgggttc

SEQ ID NO: 9504094 - DNA, 22 bp, Homo sapiens
ggcctgtgtcctccttgccctg

SEQ ID NO: 9504095 - DNA, 22 bp, Homo sapiens
ggcctgtgctgagaacctggct

SEQ ID NO: 9504096 - DNA, 19 bp, Homo sapiens
ggcctgtgcagagcccgtc

SEQ ID NO: 9504097 - DNA, 22 bp, Homo sapiens
ggcctgtgcacatgtgcaggaa

SEQ ID NO: 9504098 - DNA, 22 bp, Homo sapiens
ggcctgtgggaggacagctggg

SEQ ID NO: 9504099 - DNA, 22 bp, Homo sapiens
ggcctgtgggaggacagctggg

SEQ ID NO: 9504100 - DNA, 22 bp, Homo sapiens
ggcctgtggctttggcgtctaa

SEQ ID NO: 9504101 - DNA, 19 bp, Homo sapiens
ggctcagggcgctgccgcc

SEQ ID NO: 9504102 - DNA, 22 bp, Homo sapiens
ggctcagggaatgaggaagaat

SEQ ID NO: 9504103 - DNA, 22 bp, Homo sapiens
ggctcagggaatgaggaagaat

SEQ ID NO: 9504104 - DNA, 22 bp, Homo sapiens
ggctcaggggccaggcctgtcc

SEQ ID NO: 9504105 - DNA, 22 bp, Homo sapiens
ggctcagggaatgaggaagaat

SEQ ID NO: 9504106 - DNA, 22 bp, Homo sapiens
ggctcaggctggagtgcagtgg

SEQ ID NO: 9504107 - DNA, 22 bp, Homo sapiens
ggctcaggctggagtgcagtgg

SEQ ID NO: 9504108 - DNA, 18 bp, Homo sapiens
ggctcaggctatcctaac

SEQ ID NO: 9504109 - DNA, 18 bp, Homo sapiens
ggctcaggctatcctaac

SEQ ID NO: 9504110 - DNA, 22 bp, Homo sapiens
ggctcacacatgactgggctct

SEQ ID NO: 9504111 - DNA, 22 bp, Homo sapiens
ggctcacacatgactgggctct

SEQ ID NO: 9504112 - DNA, 22 bp, Homo sapiens
ggctcacaacagttttctgtaa

SEQ ID NO: 9504113 - DNA, 22 bp, Homo sapiens
ggcctgaggccaccagcagccc

SEQ ID NO: 9504114 - DNA, 19 bp, Homo sapiens
ggcctgaggccacagatcc

SEQ ID NO: 9504115 - DNA, 22 bp, Homo sapiens
ggcctgaggccaccagcagccc

SEQ ID NO: 9504116 - DNA, 20 bp, Homo sapiens
ggcctggtgaatgagagaat

SEQ ID NO: 9504117 - DNA, 22 bp, Homo sapiens
ggcctgaggcgtcccagctgtg

SEQ ID NO: 9504118 - DNA, 22 bp, Homo sapiens
ggcctgaggccaccagcagccc

SEQ ID NO: 9504119 - DNA, 22 bp, Homo sapiens
ggcctgtgagcccttgcatgta

SEQ ID NO: 9504120 - DNA, 22 bp, Homo sapiens
ggcctgtgcaagacagcacccc

SEQ ID NO: 9504121 - DNA, 22 bp, Homo sapiens
ggcctgtccagcctgcctggct

SEQ ID NO: 9504122 - DNA, 22 bp, Homo sapiens
ggcctgtctcacccccgggtgc

SEQ ID NO: 9504123 - DNA, 22 bp, Homo sapiens
ggcctgagctctggggaggcaa

SEQ ID NO: 9504124 - DNA, 22 bp, Homo sapiens
ggcctgagctctggggaggcaa

SEQ ID NO: 9504125 - DNA, 20 bp, Homo sapiens
ggcctgagcatggctggcag

SEQ ID NO: 9504126 - DNA, 20 bp, Homo sapiens
ggcctgagcatggctggcag

SEQ ID NO: 9504127 - DNA, 22 bp, Homo sapiens
ggcctgagcagacagcatgatg

SEQ ID NO: 9504128 - DNA, 22 bp, Homo sapiens
ggctccagggtacccctggatg

SEQ ID NO: 9504129 - DNA, 22 bp, Homo sapiens
ggctccagggagtggagagaag

SEQ ID NO: 9504130 - DNA, 22 bp, Homo sapiens
ggctcaggttgggtcacatgac

SEQ ID NO: 9504131 - DNA, 22 bp, Homo sapiens
ggctcaggttaccagtccctcc

SEQ ID NO: 9504132 - DNA, 22 bp, Homo sapiens
ggctcaggttaccagtccctcc

SEQ ID NO: 9504133 - DNA, 22 bp, Homo sapiens
ggctcaggttaccagtccctcc

SEQ ID NO: 9504134 - DNA, 22 bp, Homo sapiens
ggctcaggttgggtcacatgac

SEQ ID NO: 9504135 - DNA, 22 bp, Homo sapiens
ggctcaggttgggtcacatgac

SEQ ID NO: 9504136 - DNA, 22 bp, Homo sapiens
ggctccagggtctctccttgtg

SEQ ID NO: 9504137 - DNA, 22 bp, Homo sapiens
ggctccaggtacgtatgggagg

SEQ ID NO: 9504138 - DNA, 22 bp, Homo sapiens
ggctccagggtacccctggatg

SEQ ID NO: 9504139 - DNA, 22 bp, Homo sapiens
ggctccagggtctctccttgtg

SEQ ID NO: 9504140 - DNA, 22 bp, Homo sapiens
ggctccaggtttaagggtatgt

SEQ ID NO: 9504141 - DNA, 20 bp, Homo sapiens
ggctctggaatctggtgggc

SEQ ID NO: 9504142 - DNA, 18 bp, Homo sapiens
ggctccagtcttcagtgg

SEQ ID NO: 9504143 - DNA, 22 bp, Homo sapiens
ggctccaggtgcatgccaggct

SEQ ID NO: 9504144 - DNA, 22 bp, Homo sapiens
ggctctggaatgtgtagtcagg

SEQ ID NO: 9504145 - DNA, 22 bp, Homo sapiens
ggctctgggttctgcaatgcgt

SEQ ID NO: 9504146 - DNA, 22 bp, Homo sapiens
ggctctggtcagtgaggggcct

SEQ ID NO: 9504147 - DNA, 22 bp, Homo sapiens
ggctctggtcagtgaggggcct

SEQ ID NO: 9504148 - DNA, 22 bp, Homo sapiens
ggctctgggttctgcaatgcgt

SEQ ID NO: 9504149 - DNA, 22 bp, Homo sapiens
ggctctggtcagtgaggggcct

SEQ ID NO: 9504150 - DNA, 22 bp, Homo sapiens
ggctgagcctggagcatctggt

SEQ ID NO: 9504151 - DNA, 22 bp, Homo sapiens
ggctgagcctggagcatctggt

SEQ ID NO: 9504152 - DNA, 22 bp, Homo sapiens
ggctgagcctggagcatctggt

SEQ ID NO: 9504153 - DNA, 22 bp, Homo sapiens
ggctgagcgtggctgccgtggg

SEQ ID NO: 9504154 - DNA, 19 bp, Homo sapiens
ggctgagcgccttggctgc

SEQ ID NO: 9504155 - DNA, 22 bp, Homo sapiens
ggctgaggcggcgatgcccttg

SEQ ID NO: 9504156 - DNA, 22 bp, Homo sapiens
ggctgagctcaggggcagcagg

SEQ ID NO: 9504157 - DNA, 22 bp, Homo sapiens
ggctgagcttatatatgtgctg

SEQ ID NO: 9504158 - DNA, 22 bp, Homo sapiens
ggctgagcttttcatgatggtt

SEQ ID NO: 9504159 - DNA, 22 bp, Homo sapiens
ggctgagcttttcatgatggtt

SEQ ID NO: 9504160 - DNA, 22 bp, Homo sapiens
ggctctggtgggaaggttagat

SEQ ID NO: 9504161 - DNA, 22 bp, Homo sapiens
ggctctggtgggaaggttagat

SEQ ID NO: 9504162 - DNA, 22 bp, Homo sapiens
ggctctggtgggaaggttagat

SEQ ID NO: 9504163 - DNA, 22 bp, Homo sapiens
ggctgagccccctctgcgtagg

SEQ ID NO: 9504164 - DNA, 22 bp, Homo sapiens
ggctgagccccctctgcgtagg

SEQ ID NO: 9504165 - DNA, 22 bp, Homo sapiens
ggctctggtggcaattgactgg

SEQ ID NO: 9504166 - DNA, 22 bp, Homo sapiens
ggctctggtggcaattgactgg

SEQ ID NO: 9504167 - DNA, 22 bp, Homo sapiens
ggctctggtggcaattgactgg

SEQ ID NO: 9504168 - DNA, 22 bp, Homo sapiens
ggctctggtggcaattgactgg

SEQ ID NO: 9504169 - DNA, 22 bp, Homo sapiens
ggctctggtgccctggctccca

SEQ ID NO: 9504170 - DNA, 22 bp, Homo sapiens
ggctctggtcagtgaggggcct

SEQ ID NO: 9504171 - DNA, 22 bp, Homo sapiens
ggctctggtgagggtaggagat

SEQ ID NO: 9504172 - DNA, 22 bp, Homo sapiens
ggctctggtgagggtaggagat

SEQ ID NO: 9504173 - DNA, 22 bp, Homo sapiens
ggctctggtgagggtaggagat

SEQ ID NO: 9504174 - DNA, 22 bp, Homo sapiens
ggctctggtgagggtaggagat

SEQ ID NO: 9504175 - DNA, 22 bp, Homo sapiens
ggctctggtgagggtaggagat

SEQ ID NO: 9504176 - DNA, 22 bp, Homo sapiens
ggctctggtgccctggctccca

SEQ ID NO: 9504177 - DNA, 22 bp, Homo sapiens
ggctctggtgccctggctccca

SEQ ID NO: 9504178 - DNA, 22 bp, Homo sapiens
ggctctggtgccctggctccca

SEQ ID NO: 9504179 - DNA, 22 bp, Homo sapiens
ggctctggtgccctggctccca

SEQ ID NO: 9504180 - DNA, 22 bp, Homo sapiens
cagaaagccctatgtacagtgg

SEQ ID NO: 9504181 - DNA, 23 bp, Homo sapiens
cagaaagccctttccccacagta

SEQ ID NO: 9504182 - DNA, 22 bp, Homo sapiens
cagaaagcgggatgcagcatgt

SEQ ID NO: 9504183 - DNA, 22 bp, Homo sapiens
cagaaagctctttcaatcttgc

SEQ ID NO: 9504184 - DNA, 22 bp, Homo sapiens
cagaaagcgggatgcagcatgt

SEQ ID NO: 9504185 - DNA, 22 bp, Homo sapiens
cagaaagccgacttacaatgga

SEQ ID NO: 9504186 - DNA, 22 bp, Homo sapiens
cagaaagcagttgtcaatgggc

SEQ ID NO: 9504187 - DNA, 20 bp, Homo sapiens
cagaaagcatgttccagggc

SEQ ID NO: 9504188 - DNA, 22 bp, Homo sapiens
cagaaagccctatgtacagtgg

SEQ ID NO: 9504189 - DNA, 22 bp, Homo sapiens
cagaaagccctatgtacagtgg

SEQ ID NO: 9504190 - DNA, 22 bp, Homo sapiens
cagaaagccaactccaactgtc

SEQ ID NO: 9504191 - DNA, 22 bp, Homo sapiens
ggctgcctaacccttaagtgtc

SEQ ID NO: 9504192 - DNA, 22 bp, Homo sapiens
ggctgcctactttcccagagtt

SEQ ID NO: 9504193 - DNA, 22 bp, Homo sapiens
ggctgccctgggaggcaagggt

SEQ ID NO: 9504194 - DNA, 22 bp, Homo sapiens
ggctgccctgggaggcaagggt

SEQ ID NO: 9504195 - DNA, 22 bp, Homo sapiens
ggctgccctcgtctactgccca

SEQ ID NO: 9504196 - DNA, 22 bp, Homo sapiens
ggctgccctctgctgactgcaa

SEQ ID NO: 9504197 - DNA, 22 bp, Homo sapiens
ggctgccctctgctgactgcaa

SEQ ID NO: 9504198 - DNA, 22 bp, Homo sapiens
ggctgccctcggggtcgcaggc

SEQ ID NO: 9504199 - DNA, 22 bp, Homo sapiens
ggctgccctagagctggcaagg

SEQ ID NO: 9504200 - DNA, 22 bp, Homo sapiens
ggctgccctcggggtcgcaggc

SEQ ID NO: 9504201 - DNA, 22 bp, Homo sapiens
ggctgccctcgtctactgccca

SEQ ID NO: 9504202 - DNA, 22 bp, Homo sapiens
ggctgccctcggggtcgcaggc

SEQ ID NO: 9504203 - DNA, 22 bp, Homo sapiens
cagaaacatgtataaagttgta

SEQ ID NO: 9504204 - DNA, 22 bp, Homo sapiens
cagaaacatgtataaagttgta

SEQ ID NO: 9504205 - DNA, 22 bp, Homo sapiens
cagaaacatgtataaagttgta

SEQ ID NO: 9504206 - DNA, 22 bp, Homo sapiens
cagaaagcaaaatggatctctg

SEQ ID NO: 9504207 - DNA, 22 bp, Homo sapiens
cagaaagacctgggctcaagag

SEQ ID NO: 9504208 - DNA, 22 bp, Homo sapiens
ggctgcctactttcccagagtt

SEQ ID NO: 9504209 - DNA, 22 bp, Homo sapiens
ggctgcctactttcccagagtt

SEQ ID NO: 9504210 - DNA, 22 bp, Homo sapiens
ggctgcctagacttggaatttc

SEQ ID NO: 9504211 - DNA, 22 bp, Homo sapiens
ggctgccccagtgctcatggct

SEQ ID NO: 9504212 - DNA, 22 bp, Homo sapiens
ggctgccccatgggctgggctg

SEQ ID NO: 9504213 - DNA, 22 bp, Homo sapiens
ggctgccccatgggctgggctg

SEQ ID NO: 9504214 - DNA, 20 bp, Homo sapiens
ggctgcccactccagagtac

SEQ ID NO: 9504215 - DNA, 22 bp, Homo sapiens
cagaaaataaacatttgtggaa

SEQ ID NO: 9504216 - DNA, 22 bp, Homo sapiens
cagaaaataaagtttctacgca

SEQ ID NO: 9504217 - DNA, 22 bp, Homo sapiens
cagaaaataaacatttgtggaa

SEQ ID NO: 9504218 - DNA, 22 bp, Homo sapiens
cagaaaaggaagagctatgtaa

SEQ ID NO: 9504219 - DNA, 22 bp, Homo sapiens
cagaaaaggaagagctatgtaa

SEQ ID NO: 9504220 - DNA, 22 bp, Homo sapiens
cagaaaacaaacctatcctgag

SEQ ID NO: 9504221 - DNA, 23 bp, Homo sapiens
cagaaaacccagagctcagtccc

SEQ ID NO: 9504222 - DNA, 22 bp, Homo sapiens
cagaaaacaaacctatcctgag

SEQ ID NO: 9504223 - DNA, 22 bp, Homo sapiens
cacttttaacaggagaattccc

SEQ ID NO: 9504224 - DNA, 22 bp, Homo sapiens
cacttttaacaggagaattccc

SEQ ID NO: 9504225 - DNA, 22 bp, Homo sapiens
cagaaaacctgactctagaact

SEQ ID NO: 9504226 - DNA, 22 bp, Homo sapiens
cagaaaacctgactctagaact

SEQ ID NO: 9504227 - DNA, 22 bp, Homo sapiens
cactttggttcacctgagtttc

SEQ ID NO: 9504228 - DNA, 22 bp, Homo sapiens
cacttttaacaggagaattccc

SEQ ID NO: 9504229 - DNA, 22 bp, Homo sapiens
cacttttaaatgggtccgtgtt

SEQ ID NO: 9504230 - DNA, 22 bp, Homo sapiens
cactttaactcacatttcagct

SEQ ID NO: 9504231 - DNA, 22 bp, Homo sapiens
cactttggggtatgacaagttt

SEQ ID NO: 9504232 - DNA, 22 bp, Homo sapiens
cactttggatgccactggtcta

SEQ ID NO: 9504233 - DNA, 22 bp, Homo sapiens
ggctgtctctgtgactgccacc

SEQ ID NO: 9504234 - DNA, 22 bp, Homo sapiens
ggctgtgaaccctggcagtgtg

SEQ ID NO: 9504235 - DNA, 22 bp, Homo sapiens
ggctgtgaacactcttagcatc

SEQ ID NO: 9504236 - DNA, 22 bp, Homo sapiens
ggctgtgaaccctggcagtgtg

SEQ ID NO: 9504237 - DNA, 22 bp, Homo sapiens
ggctgtgttccaagtgtcagga

SEQ ID NO: 9504238 - DNA, 22 bp, Homo sapiens
ggctgtgtttctgtttgacatt

SEQ ID NO: 9504239 - DNA, 22 bp, Homo sapiens
ggctgtgttccaagtgtcagga

SEQ ID NO: 9504240 - DNA, 22 bp, Homo sapiens
ggcttaaagttttctagaataa

SEQ ID NO: 9504241 - DNA, 22 bp, Homo sapiens
ggctgtttttatagagtccata

SEQ ID NO: 9504242 - DNA, 22 bp, Homo sapiens
ggctgtagtcagtgacatggta

SEQ ID NO: 9504243 - DNA, 22 bp, Homo sapiens
ggctgtatatactgtatacagt

SEQ ID NO: 9504244 - DNA, 19 bp, Homo sapiens
ggctgtctcggcccagcca

SEQ ID NO: 9504245 - DNA, 22 bp, Homo sapiens
ggctggtgttacagtcggcagc

SEQ ID NO: 9504246 - DNA, 22 bp, Homo sapiens
ggctggtgttacagtcggcagc

SEQ ID NO: 9504247 - DNA, 22 bp, Homo sapiens
ggctggtgttacagtcggcagc

SEQ ID NO: 9504248 - DNA, 22 bp, Homo sapiens
ggctggtgttgagtgcctgtag

SEQ ID NO: 9504249 - DNA, 22 bp, Homo sapiens
ggctggtgttgagtgcctgtag

SEQ ID NO: 9504250 - DNA, 21 bp, Homo sapiens
ggctggtgtttagctgtgata

SEQ ID NO: 9504251 - DNA, 21 bp, Homo sapiens
ggctggtgtttagctgtgata

SEQ ID NO: 9504252 - DNA, 22 bp, Homo sapiens
ggctggtttgacaaactgacaa

SEQ ID NO: 9504253 - DNA, 22 bp, Homo sapiens
cagaaataaagtggacagagta

SEQ ID NO: 9504254 - DNA, 22 bp, Homo sapiens
cagaaataaagtggacagagta

SEQ ID NO: 9504255 - DNA, 22 bp, Homo sapiens
cagaaatacccagcatttggag

SEQ ID NO: 9504256 - DNA, 22 bp, Homo sapiens
ggctgggaggatgacttgctac

SEQ ID NO: 9504257 - DNA, 22 bp, Homo sapiens
cagaaatacccagcatttggag

SEQ ID NO: 9504258 - DNA, 22 bp, Homo sapiens
cagaaataaacttctcacatcg

SEQ ID NO: 9504259 - DNA, 22 bp, Homo sapiens
cagaaataaacttctcacatcg

SEQ ID NO: 9504260 - DNA, 22 bp, Homo sapiens
cagaaataaacttctcacatcg

SEQ ID NO: 9504261 - DNA, 22 bp, Homo sapiens
cagaaataaacttctcacatcg

SEQ ID NO: 9504262 - DNA, 23 bp, Homo sapiens
cagaaataaactggtttgtagat

SEQ ID NO: 9504263 - DNA, 23 bp, Homo sapiens
cagaaataaactggtttgtagat

SEQ ID NO: 9504264 - DNA, 18 bp, Homo sapiens
cagaaagttatttactct

SEQ ID NO: 9504265 - DNA, 18 bp, Homo sapiens
cagaaagttatttactct

SEQ ID NO: 9504266 - DNA, 23 bp, Homo sapiens
cagaaagtttgagaagatacatc

SEQ ID NO: 9504267 - DNA, 23 bp, Homo sapiens
cagaaagtttgagaagatacatc

SEQ ID NO: 9504268 - DNA, 23 bp, Homo sapiens
cagaaagtttgagaagatacatc

SEQ ID NO: 9504269 - DNA, 22 bp, Homo sapiens
cagaaagtgatttgctattcca

SEQ ID NO: 9504270 - DNA, 22 bp, Homo sapiens
cagaaaggtatgtgtgcctttg

SEQ ID NO: 9504271 - DNA, 22 bp, Homo sapiens
cagaaaggtatgtgtgcctttg

SEQ ID NO: 9504272 - DNA, 22 bp, Homo sapiens
cagaaaggcacccactgggtct

SEQ ID NO: 9504273 - DNA, 22 bp, Homo sapiens
cagaaagcttggtacaatatgc

SEQ ID NO: 9504274 - DNA, 22 bp, Homo sapiens
cagaaagcttggtacaatatgc

SEQ ID NO: 9504275 - DNA, 22 bp, Homo sapiens
cagaaagcttaggcaagttgga

SEQ ID NO: 9504276 - DNA, 22 bp, Homo sapiens
cagaaagctctttcaatcttgc

SEQ ID NO: 9504277 - DNA, 22 bp, Homo sapiens
cagaaagctctttcaatcttgc

SEQ ID NO: 9504278 - DNA, 22 bp, Homo sapiens
cagaaaggactttggttggctt

SEQ ID NO: 9504279 - DNA, 22 bp, Homo sapiens
cagaaaggactttggttggctt

SEQ ID NO: 9504280 - DNA, 22 bp, Homo sapiens
cagaaaggcacccactgggtct

SEQ ID NO: 9504281 - DNA, 22 bp, Homo sapiens
cagaaaggactttggttggctt

SEQ ID NO: 9504282 - DNA, 22 bp, Homo sapiens
cagaaaggactttggttggctt

SEQ ID NO: 9504283 - DNA, 22 bp, Homo sapiens
cagaaaggactttggttggctt

SEQ ID NO: 9504284 - DNA, 22 bp, Homo sapiens
cagaaaggacagagtgagggtg

SEQ ID NO: 9504285 - DNA, 22 bp, Homo sapiens
cagaaaggacagagtgagggtg

SEQ ID NO: 9504286 - DNA, 22 bp, Homo sapiens
cagaaaggacagagtgagggtg

SEQ ID NO: 9504287 - DNA, 22 bp, Homo sapiens
cagaaagcttggtacaatatgc

SEQ ID NO: 9504288 - DNA, 22 bp, Homo sapiens
cagaaaggacagagtgagggtg

SEQ ID NO: 9504289 - DNA, 20 bp, Homo sapiens
ggagctggcatccagcctct

SEQ ID NO: 9504290 - DNA, 22 bp, Homo sapiens
ggagctggcagcgcaacccaga

SEQ ID NO: 9504291 - DNA, 22 bp, Homo sapiens
ggagctggcagcgcaacccaga

SEQ ID NO: 9504292 - DNA, 22 bp, Homo sapiens
ggagctggagagtacagagttt

SEQ ID NO: 9504293 - DNA, 22 bp, Homo sapiens
ggagctggagagtacagagttt

SEQ ID NO: 9504294 - DNA, 23 bp, Homo sapiens
ggagctgctgttgggggagctgc

SEQ ID NO: 9504295 - DNA, 22 bp, Homo sapiens
ggagctgcttcttgctgtgggt

SEQ ID NO: 9504296 - DNA, 22 bp, Homo sapiens
ggagctgcttcttgctgtgggt

SEQ ID NO: 9504297 - DNA, 22 bp, Homo sapiens
ggagctggagagctagcctagg

SEQ ID NO: 9504298 - DNA, 22 bp, Homo sapiens
ggagctggagagctagcctagg

SEQ ID NO: 9504299 - DNA, 22 bp, Homo sapiens
ggagcctgacagtgcccagcat

SEQ ID NO: 9504300 - DNA, 22 bp, Homo sapiens
ggagctgctccttcagccaagt

SEQ ID NO: 9504301 - DNA, 22 bp, Homo sapiens
ggagcctgagggccctcttgga

SEQ ID NO: 9504302 - DNA, 19 bp, Homo sapiens
cacagatgattgacacata

SEQ ID NO: 9504303 - DNA, 22 bp, Homo sapiens
cacagataaggatgttaatttt

SEQ ID NO: 9504304 - DNA, 22 bp, Homo sapiens
cacagatacctagtgaaacata

SEQ ID NO: 9504305 - DNA, 22 bp, Homo sapiens
cacagaggtgatagtggtcaag

SEQ ID NO: 9504306 - DNA, 22 bp, Homo sapiens
cacagataaggatgttaatttt

SEQ ID NO: 9504307 - DNA, 22 bp, Homo sapiens
cacagaggtgatagtggtcaag

SEQ ID NO: 9504308 - DNA, 22 bp, Homo sapiens
cacagaggtgatagtggtcaag

SEQ ID NO: 9504309 - DNA, 22 bp, Homo sapiens
ggagcaggcagggccgtgtctg

SEQ ID NO: 9504310 - DNA, 22 bp, Homo sapiens
cacagatttctggtcttcaccc

SEQ ID NO: 9504311 - DNA, 22 bp, Homo sapiens
ggagcaggcagggccgtgtctg

SEQ ID NO: 9504312 - DNA, 22 bp, Homo sapiens
ggagcaggcagggccgtgtctg

SEQ ID NO: 9504313 - DNA, 22 bp, Homo sapiens
ggagccctcaccggcgagtgcc

SEQ ID NO: 9504314 - DNA, 22 bp, Homo sapiens
ggagccctccatcccttgcggc

SEQ ID NO: 9504315 - DNA, 22 bp, Homo sapiens
ggagccctgccctaggcagctc

SEQ ID NO: 9504316 - DNA, 22 bp, Homo sapiens
ggagcccttgctgaccttccaa

SEQ ID NO: 9504317 - DNA, 19 bp, Homo sapiens
ggagccgccgcccttcatt

SEQ ID NO: 9504318 - DNA, 22 bp, Homo sapiens
ggagcccttggcacctagtagg

SEQ ID NO: 9504319 - DNA, 22 bp, Homo sapiens
ggaggccaaggcaggcggatca

SEQ ID NO: 9504320 - DNA, 20 bp, Homo sapiens
cacaggccttgtgagcagac

SEQ ID NO: 9504321 - DNA, 20 bp, Homo sapiens
cacaggccttgtgagcagac

SEQ ID NO: 9504322 - DNA, 22 bp, Homo sapiens
ggaggccaaggagggcggatca

SEQ ID NO: 9504323 - DNA, 22 bp, Homo sapiens
ggaggccaaggaggagcttgcc

SEQ ID NO: 9504324 - DNA, 22 bp, Homo sapiens
ggaggccaaggaggagcttgcc

SEQ ID NO: 9504325 - DNA, 22 bp, Homo sapiens
ggaggccaaagtgtgggcggct

SEQ ID NO: 9504326 - DNA, 22 bp, Homo sapiens
ggaggcaggaaagacaggttca

SEQ ID NO: 9504327 - DNA, 22 bp, Homo sapiens
ggaggcaggaaagacaggttca

SEQ ID NO: 9504328 - DNA, 22 bp, Homo sapiens
ggaggcaggaaagacaggttca

SEQ ID NO: 9504329 - DNA, 20 bp, Homo sapiens
cacaggcttacagtttagat

SEQ ID NO: 9504330 - DNA, 22 bp, Homo sapiens
cacaggcttccagtccccagct

SEQ ID NO: 9504331 - DNA, 21 bp, Homo sapiens
cacaggcttctatacacaatg

SEQ ID NO: 9504332 - DNA, 20 bp, Homo sapiens
cacaggctatatgagagcca

SEQ ID NO: 9504333 - DNA, 23 bp, Homo sapiens
cacaggctgcgcataagcttctc

SEQ ID NO: 9504334 - DNA, 22 bp, Homo sapiens
cacaggctgggaagcctaggcc

SEQ ID NO: 9504335 - DNA, 22 bp, Homo sapiens
cacaggcttgtcagcatgaggc

SEQ ID NO: 9504336 - DNA, 22 bp, Homo sapiens
cacaggcttgtcagcatgaggc

SEQ ID NO: 9504337 - DNA, 21 bp, Homo sapiens
cacaggcttctatacacaatg

SEQ ID NO: 9504338 - DNA, 22 bp, Homo sapiens
cacaggcttgtcagcatgaggc

SEQ ID NO: 9504339 - DNA, 22 bp, Homo sapiens
cacaggcttgtcagcatgaggc

SEQ ID NO: 9504340 - DNA, 22 bp, Homo sapiens
cacaggactcgactgcagacag

SEQ ID NO: 9504341 - DNA, 22 bp, Homo sapiens
cacaggaattagcagcctaaaa

SEQ ID NO: 9504342 - DNA, 22 bp, Homo sapiens
cacaggaatgaacagggaaaga

SEQ ID NO: 9504343 - DNA, 22 bp, Homo sapiens
cacaggaatgaacagggaaaga

SEQ ID NO: 9504344 - DNA, 22 bp, Homo sapiens
cacaggaatctgcattttgacc

SEQ ID NO: 9504345 - DNA, 22 bp, Homo sapiens
cacaggaatctgcattttgacc

SEQ ID NO: 9504346 - DNA, 22 bp, Homo sapiens
ggaggcagaatagagtgtgggt

SEQ ID NO: 9504347 - DNA, 22 bp, Homo sapiens
ggaggcagaatagagtgtgggt

SEQ ID NO: 9504348 - DNA, 22 bp, Homo sapiens
cacaggagaaaggggaagctcg

SEQ ID NO: 9504349 - DNA, 22 bp, Homo sapiens
ggaggcagaatagagtgtgggt

SEQ ID NO: 9504350 - DNA, 22 bp, Homo sapiens
cacaggaataagtcaaacttca

SEQ ID NO: 9504351 - DNA, 22 bp, Homo sapiens
cacaggaataagtcaaacttca

SEQ ID NO: 9504352 - DNA, 22 bp, Homo sapiens
cacaggaataagtcaaacttca

SEQ ID NO: 9504353 - DNA, 22 bp, Homo sapiens
cacaggaatataagtttgagtt

SEQ ID NO: 9504354 - DNA, 22 bp, Homo sapiens
cacaggaatataagtttgagtt

SEQ ID NO: 9504355 - DNA, 22 bp, Homo sapiens
cacaggaatataagtttgagtt

SEQ ID NO: 9504356 - DNA, 22 bp, Homo sapiens
cacaggaatcgtcacttagcgc

SEQ ID NO: 9504357 - DNA, 22 bp, Homo sapiens
cacaggaatcgtcacttagcgc

SEQ ID NO: 9504358 - DNA, 22 bp, Homo sapiens
cacaggaatcagcattaatggc

SEQ ID NO: 9504359 - DNA, 22 bp, Homo sapiens
cacaggaatcagcattaatggc

SEQ ID NO: 9504360 - DNA, 22 bp, Homo sapiens
cacaggaatcagcattaatggc

SEQ ID NO: 9504361 - DNA, 22 bp, Homo sapiens
cacaggaagtggtcagtgccag

SEQ ID NO: 9504362 - DNA, 18 bp, Homo sapiens
cacaggaaggggaatatc

SEQ ID NO: 9504363 - DNA, 22 bp, Homo sapiens
cacagctttgctttccttaata

SEQ ID NO: 9504364 - DNA, 22 bp, Homo sapiens
cacaggaaggccttctcacaat

SEQ ID NO: 9504365 - DNA, 20 bp, Homo sapiens
ggagctggcatccagcctct

SEQ ID NO: 9504366 - DNA, 20 bp, Homo sapiens
ggagctggcatccagcctct

SEQ ID NO: 9504367 - DNA, 22 bp, Homo sapiens
cacagagctgaacctgggtcat

SEQ ID NO: 9504368 - DNA, 22 bp, Homo sapiens
cacagagctggaaaggctgggc

SEQ ID NO: 9504369 - DNA, 22 bp, Homo sapiens
cacagagctggaaaggctgggc

SEQ ID NO: 9504370 - DNA, 22 bp, Homo sapiens
cacagaggaaatgactttctta

SEQ ID NO: 9504371 - DNA, 22 bp, Homo sapiens
cacagaggaaaggcagttggta

SEQ ID NO: 9504372 - DNA, 22 bp, Homo sapiens
cacagaggaaaggcagttggta

SEQ ID NO: 9504373 - DNA, 22 bp, Homo sapiens
cacagaggaaatgactttctta

SEQ ID NO: 9504374 - DNA, 22 bp, Homo sapiens
cacagaggcggaaaattctgaa

SEQ ID NO: 9504375 - DNA, 21 bp, Homo sapiens
cacagaggcgctgtatggctg

SEQ ID NO: 9504376 - DNA, 21 bp, Homo sapiens
cacagaggcgctgtatggctg

SEQ ID NO: 9504377 - DNA, 22 bp, Homo sapiens
cacagaggcaaccttctggggt

SEQ ID NO: 9504378 - DNA, 22 bp, Homo sapiens
cacagaggatttttagggcagt

SEQ ID NO: 9504379 - DNA, 22 bp, Homo sapiens
cacagaggcaaccttctggggt

SEQ ID NO: 9504380 - DNA, 22 bp, Homo sapiens
cacagaggatttttagggcagt

SEQ ID NO: 9504381 - DNA, 22 bp, Homo sapiens
cacagaggatgcccaagcgatc

SEQ ID NO: 9504382 - DNA, 22 bp, Homo sapiens
cacagaggatgcccaagcgatc

SEQ ID NO: 9504383 - DNA, 22 bp, Homo sapiens
ggactgggccaggggttggact

SEQ ID NO: 9504384 - DNA, 22 bp, Homo sapiens
ggactgggccaggggttggact

SEQ ID NO: 9504385 - DNA, 17 bp, Homo sapiens
ggactgggcggggcagg

SEQ ID NO: 9504386 - DNA, 22 bp, Homo sapiens
cacagagaccccttctggggcc

SEQ ID NO: 9504387 - DNA, 22 bp, Homo sapiens
cacagagaccccttctggggcc

SEQ ID NO: 9504388 - DNA, 22 bp, Homo sapiens
ggactgggtaggagcccagggc

SEQ ID NO: 9504389 - DNA, 22 bp, Homo sapiens
ggactgggcatgggtgctctgc

SEQ ID NO: 9504390 - DNA, 22 bp, Homo sapiens
ggactgggcatgggtgctctgc

SEQ ID NO: 9504391 - DNA, 22 bp, Homo sapiens
ggactgggcatgggtgctctgc

SEQ ID NO: 9504392 - DNA, 22 bp, Homo sapiens
ggactgggcatgggtgctctgc

SEQ ID NO: 9504393 - DNA, 22 bp, Homo sapiens
ggactgggcatgggtgctctgc

SEQ ID NO: 9504394 - DNA, 22 bp, Homo sapiens
ggactgggattctggatctgct

SEQ ID NO: 9504395 - DNA, 22 bp, Homo sapiens
ggactgggattctggatctgct

SEQ ID NO: 9504396 - DNA, 22 bp, Homo sapiens
ggactgggattctggatctgct

SEQ ID NO: 9504397 - DNA, 22 bp, Homo sapiens
ggactgggattctggatctgct

SEQ ID NO: 9504398 - DNA, 22 bp, Homo sapiens
cacagaatggaccagttttaga

SEQ ID NO: 9504399 - DNA, 22 bp, Homo sapiens
cacagaattaagggagaaatat

SEQ ID NO: 9504400 - DNA, 22 bp, Homo sapiens
cacagaattttctctttacaat

SEQ ID NO: 9504401 - DNA, 22 bp, Homo sapiens
cacagacccagaagggatgaag

SEQ ID NO: 9504402 - DNA, 20 bp, Homo sapiens
cacagactgtatgggcacca

SEQ ID NO: 9504403 - DNA, 22 bp, Homo sapiens
ggactgggagaatggaggcaag

SEQ ID NO: 9504404 - DNA, 22 bp, Homo sapiens
cacagagaaaatgttggtgctt

SEQ ID NO: 9504405 - DNA, 22 bp, Homo sapiens
ggactgggagaatggaggcaag

SEQ ID NO: 9504406 - DNA, 22 bp, Homo sapiens
caatgtttgttagagctctaga

SEQ ID NO: 9504407 - DNA, 22 bp, Homo sapiens
cacacagacagctctctgaaga

SEQ ID NO: 9504408 - DNA, 22 bp, Homo sapiens
cacacagatggtaagggaggga

SEQ ID NO: 9504409 - DNA, 21 bp, Homo sapiens
cacacagctgcccttaggtag

SEQ ID NO: 9504410 - DNA, 22 bp, Homo sapiens
ggaagggcaataaaatctcagg

SEQ ID NO: 9504411 - DNA, 22 bp, Homo sapiens
cacacagcaacaagaatagcca

SEQ ID NO: 9504412 - DNA, 22 bp, Homo sapiens
cacacagctagtgacaggagaa

SEQ ID NO: 9504413 - DNA, 22 bp, Homo sapiens
cacacagctcaggggcactgcc

SEQ ID NO: 9504414 - DNA, 22 bp, Homo sapiens
cacacagctcaggggcactgcc

SEQ ID NO: 9504415 - DNA, 22 bp, Homo sapiens
cacacagctagtgacaggagaa

SEQ ID NO: 9504416 - DNA, 22 bp, Homo sapiens
cacacagctcaggggcactgcc

SEQ ID NO: 9504417 - DNA, 22 bp, Homo sapiens
cacacagctcaggggcactgcc

SEQ ID NO: 9504418 - DNA, 21 bp, Homo sapiens
cacagaatatacattttagtt

SEQ ID NO: 9504419 - DNA, 22 bp, Homo sapiens
cacagaagtttcatagtctcga

SEQ ID NO: 9504420 - DNA, 22 bp, Homo sapiens
cacactgtctttatgagctgta

SEQ ID NO: 9504421 - DNA, 22 bp, Homo sapiens
cacactgtctttcagaatggtt

SEQ ID NO: 9504422 - DNA, 22 bp, Homo sapiens
cacagaactggttaatagcaga

SEQ ID NO: 9504423 - DNA, 22 bp, Homo sapiens
ggaaggggccttgagcaaactg

SEQ ID NO: 9504424 - DNA, 22 bp, Homo sapiens
ggaaggggccttgagcaaactg

SEQ ID NO: 9504425 - DNA, 22 bp, Homo sapiens
cacactgtccccttctccccag

SEQ ID NO: 9504426 - DNA, 22 bp, Homo sapiens
ggaaggggagctggaaagggta

SEQ ID NO: 9504427 - DNA, 22 bp, Homo sapiens
ggaaggggagctggaaagggta

SEQ ID NO: 9504428 - DNA, 22 bp, Homo sapiens
ggaagggcctcgggcgtgggac

SEQ ID NO: 9504429 - DNA, 21 bp, Homo sapiens
ggaagggctctgaggacggct

SEQ ID NO: 9504430 - DNA, 20 bp, Homo sapiens
ggaaggggcaaagtgtgtga

SEQ ID NO: 9504431 - DNA, 20 bp, Homo sapiens
ggaaggggcaaagtgtgtga

SEQ ID NO: 9504432 - DNA, 22 bp, Homo sapiens
ggaaggggagctggaaagggta

SEQ ID NO: 9504433 - DNA, 22 bp, Homo sapiens
ggaaggggagctggaaagggta

SEQ ID NO: 9504434 - DNA, 22 bp, Homo sapiens
ggaaggggagctggaaagggta

SEQ ID NO: 9504435 - DNA, 22 bp, Homo sapiens
caagtacaaaatgatatttagt

SEQ ID NO: 9504436 - DNA, 22 bp, Homo sapiens
caagtacaaaatgatatttagt

SEQ ID NO: 9504437 - DNA, 22 bp, Homo sapiens
caagtaaacaatatgtgattca

SEQ ID NO: 9504438 - DNA, 22 bp, Homo sapiens
caagtaaacaatatgtgattca

SEQ ID NO: 9504439 - DNA, 22 bp, Homo sapiens
caagtaaagaatcacatttctt

SEQ ID NO: 9504440 - DNA, 22 bp, Homo sapiens
caagtaaagaatcacatttctt

SEQ ID NO: 9504441 - DNA, 22 bp, Homo sapiens
caagtaaatgtgaactggaagg

SEQ ID NO: 9504442 - DNA, 22 bp, Homo sapiens
caagtaaagaatcacatttctt

SEQ ID NO: 9504443 - DNA, 22 bp, Homo sapiens
caagtaaatgtgaactggaagg

SEQ ID NO: 9504444 - DNA, 22 bp, Homo sapiens
caagtactttgaaaagttgaat

SEQ ID NO: 9504445 - DNA, 22 bp, Homo sapiens
caagtactgtgatagctgaagt

SEQ ID NO: 9504446 - DNA, 22 bp, Homo sapiens
caagtacaatagctctggaact

SEQ ID NO: 9504447 - DNA, 22 bp, Homo sapiens
caagtatttcctgatggcctgt

SEQ ID NO: 9504448 - DNA, 22 bp, Homo sapiens
caagtatatttgaacatgtaaa

SEQ ID NO: 9504449 - DNA, 22 bp, Homo sapiens
caagtatatttgaacatgtaaa

SEQ ID NO: 9504450 - DNA, 22 bp, Homo sapiens
caagtatatttgaacatgtaaa

SEQ ID NO: 9504451 - DNA, 18 bp, Homo sapiens
caagtatagaattaggtt

SEQ ID NO: 9504452 - DNA, 22 bp, Homo sapiens
caaggtgccatgctgggcgggg

SEQ ID NO: 9504453 - DNA, 22 bp, Homo sapiens
caaggttctatagcaaaatctg

SEQ ID NO: 9504454 - DNA, 22 bp, Homo sapiens
caaggtgcagctggctgtgtga

SEQ ID NO: 9504455 - DNA, 22 bp, Homo sapiens
caaggtgaacttgctgtacagc

SEQ ID NO: 9504456 - DNA, 22 bp, Homo sapiens
caaggtgcagcgttgtcaagct

SEQ ID NO: 9504457 - DNA, 22 bp, Homo sapiens
caaggtcacataacttgtcaaa

SEQ ID NO: 9504458 - DNA, 20 bp, Homo sapiens
caagggtttgcattggcttt

SEQ ID NO: 9504459 - DNA, 22 bp, Homo sapiens
caagggtggtattgggagcata

SEQ ID NO: 9504460 - DNA, 22 bp, Homo sapiens
caagtcaaagactagaactagt

SEQ ID NO: 9504461 - DNA, 22 bp, Homo sapiens
caagtattttaaggactagtgg

SEQ ID NO: 9504462 - DNA, 22 bp, Homo sapiens
caagtatttgcggagttccacg

SEQ ID NO: 9504463 - DNA, 22 bp, Homo sapiens
caagtatttgcggagttccacg

SEQ ID NO: 9504464 - DNA, 22 bp, Homo sapiens
gctgtggcctggcgcagagctg

SEQ ID NO: 9504465 - DNA, 22 bp, Homo sapiens
gctgtggcctggcgcagagctg

SEQ ID NO: 9504466 - DNA, 22 bp, Homo sapiens
caagtcaatacctgtggacaaa

SEQ ID NO: 9504467 - DNA, 22 bp, Homo sapiens
gctgttcagggcactcatgggc

SEQ ID NO: 9504468 - DNA, 22 bp, Homo sapiens
gctgttcacagactctgctctg

SEQ ID NO: 9504469 - DNA, 19 bp, Homo sapiens
gctgttaaggaccctcgga

SEQ ID NO: 9504470 - DNA, 22 bp, Homo sapiens
gctgttctgcaccagacttcag

SEQ ID NO: 9504471 - DNA, 22 bp, Homo sapiens
gctgttctgcgtcccaggctgg

SEQ ID NO: 9504472 - DNA, 22 bp, Homo sapiens
gctgttctgcaccagacttcag

SEQ ID NO: 9504473 - DNA, 22 bp, Homo sapiens
gctgttctgtccccatgggtaa

SEQ ID NO: 9504474 - DNA, 22 bp, Homo sapiens
gctgttctctgtaacatgcatt

SEQ ID NO: 9504475 - DNA, 20 bp, Homo sapiens
gctgttctgaagcagaaggc

SEQ ID NO: 9504476 - DNA, 19 bp, Homo sapiens
gctgttctgaccatcaccc

SEQ ID NO: 9504477 - DNA, 22 bp, Homo sapiens
gctgttctagcttcagtttcgc

SEQ ID NO: 9504478 - DNA, 22 bp, Homo sapiens
gctgttctccgatgaccccgtg

SEQ ID NO: 9504479 - DNA, 22 bp, Homo sapiens
gctgttctaggagctgtgagca

SEQ ID NO: 9504480 - DNA, 22 bp, Homo sapiens
gctgttctttgcatctctggtg

SEQ ID NO: 9504481 - DNA, 22 bp, Homo sapiens
gctgttctttggtcaaaggtat

SEQ ID NO: 9504482 - DNA, 22 bp, Homo sapiens
gctgttctttgcatctctggtg

SEQ ID NO: 9504483 - DNA, 22 bp, Homo sapiens
gctgttctttcagcccagggct

SEQ ID NO: 9504484 - DNA, 21 bp, Homo sapiens
gctgttctttcagctggtctt

SEQ ID NO: 9504485 - DNA, 18 bp, Homo sapiens
gctgttcttcgcactggc

SEQ ID NO: 9504486 - DNA, 22 bp, Homo sapiens
gctgttgcaatcaaggccatgg

SEQ ID NO: 9504487 - DNA, 22 bp, Homo sapiens
caagtttaaggcactgataagt

SEQ ID NO: 9504488 - DNA, 17 bp, Homo sapiens
gcttgggctgcctgttg

SEQ ID NO: 9504489 - DNA, 17 bp, Homo sapiens
gcttgggctgcctgttg

SEQ ID NO: 9504490 - DNA, 17 bp, Homo sapiens
gcttgggctgcctgttg

SEQ ID NO: 9504491 - DNA, 22 bp, Homo sapiens
gcttggggagctcagtgtcctt

SEQ ID NO: 9504492 - DNA, 22 bp, Homo sapiens
gcttgggcttaactgtaggttc

SEQ ID NO: 9504493 - DNA, 22 bp, Homo sapiens
gcttggggagctcagtgtcctt

SEQ ID NO: 9504494 - DNA, 22 bp, Homo sapiens
gctttctggttctcaaagcact

SEQ ID NO: 9504495 - DNA, 22 bp, Homo sapiens
gctttctggagcctgggggaac

SEQ ID NO: 9504496 - DNA, 22 bp, Homo sapiens
gctttctgggctatagaacggg

SEQ ID NO: 9504497 - DNA, 22 bp, Homo sapiens
gctttctgctctgtaaaatggg

SEQ ID NO: 9504498 - DNA, 22 bp, Homo sapiens
gctttctgtggtgatgtaaagg

SEQ ID NO: 9504499 - DNA, 22 bp, Homo sapiens
gctttctgtgcagtgaacacta

SEQ ID NO: 9504500 - DNA, 21 bp, Homo sapiens
gctttctgtggactctgcacc

SEQ ID NO: 9504501 - DNA, 22 bp, Homo sapiens
gctttctgtgcagtgaacacta

SEQ ID NO: 9504502 - DNA, 21 bp, Homo sapiens
gctttctgtggactctgcacc

SEQ ID NO: 9504503 - DNA, 21 bp, Homo sapiens
gctttctgtggactctgcacc

SEQ ID NO: 9504504 - DNA, 21 bp, Homo sapiens
gctttctgtggactctgcacc

SEQ ID NO: 9504505 - DNA, 22 bp, Homo sapiens
gctttctggtttgtgctacagg

SEQ ID NO: 9504506 - DNA, 18 bp, Homo sapiens
gctttctgtagaaaaggg

SEQ ID NO: 9504507 - DNA, 22 bp, Homo sapiens
gctttctgtaggtagttactgt

SEQ ID NO: 9504508 - DNA, 18 bp, Homo sapiens
gctttctgtgcagcggag

SEQ ID NO: 9504509 - DNA, 22 bp, Homo sapiens
caagtttgtgttctatcattct

SEQ ID NO: 9504510 - DNA, 22 bp, Homo sapiens
caagtttgtgttctatcattct

SEQ ID NO: 9504511 - DNA, 22 bp, Homo sapiens
caagtttgctgatccttgtttt

SEQ ID NO: 9504512 - DNA, 22 bp, Homo sapiens
caagttttagcaagtggaaagg

SEQ ID NO: 9504513 - DNA, 22 bp, Homo sapiens
caagttttctgggttcagagca

SEQ ID NO: 9504514 - DNA, 22 bp, Homo sapiens
caagttttagaaatatctggat

SEQ ID NO: 9504515 - DNA, 22 bp, Homo sapiens
caagttttagaaatatctggat

SEQ ID NO: 9504516 - DNA, 22 bp, Homo sapiens
caataaagaagatttttgcaat

SEQ ID NO: 9504517 - DNA, 21 bp, Homo sapiens
caataaactgcacattgagac

SEQ ID NO: 9504518 - DNA, 22 bp, Homo sapiens
caagttttgcatagttctgtat

SEQ ID NO: 9504519 - DNA, 22 bp, Homo sapiens
caagttttgcatagttctgtat

SEQ ID NO: 9504520 - DNA, 21 bp, Homo sapiens
caataaactgcacattgagac

SEQ ID NO: 9504521 - DNA, 21 bp, Homo sapiens
caataaactgcacattgagac

SEQ ID NO: 9504522 - DNA, 22 bp, Homo sapiens
caagttttgcatagttctgtat

SEQ ID NO: 9504523 - DNA, 22 bp, Homo sapiens
caagttttgattttgcagtaaa

SEQ ID NO: 9504524 - DNA, 22 bp, Homo sapiens
caatgtttgagtaggagcataa

SEQ ID NO: 9504525 - DNA, 21 bp, Homo sapiens
caatgtctgctctctgcctag

SEQ ID NO: 9504526 - DNA, 22 bp, Homo sapiens
caatgtgtgtgtttttctcaac

SEQ ID NO: 9504527 - DNA, 22 bp, Homo sapiens
caatgtcagagaagctcatatc

SEQ ID NO: 9504528 - DNA, 22 bp, Homo sapiens
caatgtcagtcaagcagcaaat

SEQ ID NO: 9504529 - DNA, 22 bp, Homo sapiens
caatgtcatgattttccattag

SEQ ID NO: 9504530 - DNA, 22 bp, Homo sapiens
caatgtctgaccgttttgccca

SEQ ID NO: 9504531 - DNA, 22 bp, Homo sapiens
caatgtcagaattacagttgat

SEQ ID NO: 9504532 - DNA, 22 bp, Homo sapiens
caatgtcaaggagaccaaaacg

SEQ ID NO: 9504533 - DNA, 22 bp, Homo sapiens
caatgtatcaagaagcatcagt

SEQ ID NO: 9504534 - DNA, 22 bp, Homo sapiens
gctttgctagcactgcgcttcc

SEQ ID NO: 9504535 - DNA, 22 bp, Homo sapiens
caatgtcaaggagaccaaaacg

SEQ ID NO: 9504536 - DNA, 22 bp, Homo sapiens
gctttcttttcaagaatgtatt

SEQ ID NO: 9504537 - DNA, 22 bp, Homo sapiens
gctttcttatttagaagatttg

SEQ ID NO: 9504538 - DNA, 22 bp, Homo sapiens
gctttcttcatactcaagcatc

SEQ ID NO: 9504539 - DNA, 22 bp, Homo sapiens
gctttcttatttagaagatttg

SEQ ID NO: 9504540 - DNA, 21 bp, Homo sapiens
gctttgatgctgccttgctcc

SEQ ID NO: 9504541 - DNA, 22 bp, Homo sapiens
gctttgattcttggcttatcag

SEQ ID NO: 9504542 - DNA, 22 bp, Homo sapiens
gctttgcccaagggccctaccc

SEQ ID NO: 9504543 - DNA, 22 bp, Homo sapiens
gctttgcccaagggccctaccc

SEQ ID NO: 9504544 - DNA, 22 bp, Homo sapiens
gctttgcccctttagtgggtgc

SEQ ID NO: 9504545 - DNA, 22 bp, Homo sapiens
gctttgcctccaaagaaaaagt

SEQ ID NO: 9504546 - DNA, 22 bp, Homo sapiens
gctttgccacattcttcacatt

SEQ ID NO: 9504547 - DNA, 22 bp, Homo sapiens
gctttgcctcttctccttccag

SEQ ID NO: 9504548 - DNA, 22 bp, Homo sapiens
gctttgcctgccatatggggtc

SEQ ID NO: 9504549 - DNA, 22 bp, Homo sapiens
gctttgccttgaactctcatgt

SEQ ID NO: 9504550 - DNA, 22 bp, Homo sapiens
gctttgcctgtagcattggcct

SEQ ID NO: 9504551 - DNA, 22 bp, Homo sapiens
gctttgccttgaactctcatgt

SEQ ID NO: 9504552 - DNA, 22 bp, Homo sapiens
gctggaggcagttcagacacca

SEQ ID NO: 9504553 - DNA, 22 bp, Homo sapiens
gctggaggcagttcagacacca

SEQ ID NO: 9504554 - DNA, 22 bp, Homo sapiens
gctggaggcagttcagacacca

SEQ ID NO: 9504555 - DNA, 22 bp, Homo sapiens
gctggaggcagttcagacacca

SEQ ID NO: 9504556 - DNA, 22 bp, Homo sapiens
caaggcaggaagcctgtcttat

SEQ ID NO: 9504557 - DNA, 22 bp, Homo sapiens
caaggcagcttaatagaatttg

SEQ ID NO: 9504558 - DNA, 22 bp, Homo sapiens
caaggccaagtctctgtgaaga

SEQ ID NO: 9504559 - DNA, 22 bp, Homo sapiens
caaggccaagtctctgtgaaga

SEQ ID NO: 9504560 - DNA, 22 bp, Homo sapiens
caaggccactccagagactggt

SEQ ID NO: 9504561 - DNA, 22 bp, Homo sapiens
caaggccataagagatacaaaa

SEQ ID NO: 9504562 - DNA, 17 bp, Homo sapiens
caaggccagcatcttca

SEQ ID NO: 9504563 - DNA, 22 bp, Homo sapiens
caaggcctcctgggcccagaga

SEQ ID NO: 9504564 - DNA, 22 bp, Homo sapiens
caaggcctgcctctggcagaaa

SEQ ID NO: 9504565 - DNA, 22 bp, Homo sapiens
caaggcctgactgcttgtctaa

SEQ ID NO: 9504566 - DNA, 22 bp, Homo sapiens
caaggcctaatcatactgctaa

SEQ ID NO: 9504567 - DNA, 22 bp, Homo sapiens
caaggccctgcaacctgacttg

SEQ ID NO: 9504568 - DNA, 22 bp, Homo sapiens
caaggccctgcaacctgacttg

SEQ ID NO: 9504569 - DNA, 22 bp, Homo sapiens
caaggccatattgcctgtatgt

SEQ ID NO: 9504570 - DNA, 22 bp, Homo sapiens
caagggttctgtgcctcctgct

SEQ ID NO: 9504571 - DNA, 19 bp, Homo sapiens
caagggttgggtctgtcat

SEQ ID NO: 9504572 - DNA, 22 bp, Homo sapiens
caagggaagaggacagggacct

SEQ ID NO: 9504573 - DNA, 22 bp, Homo sapiens
gctggctgtatcacctggccag

SEQ ID NO: 9504574 - DNA, 22 bp, Homo sapiens
gctggctgtatcacctggccag

SEQ ID NO: 9504575 - DNA, 22 bp, Homo sapiens
caaggcttatcagccaggagcc

SEQ ID NO: 9504576 - DNA, 22 bp, Homo sapiens
gctggctgtatcacctggccag

SEQ ID NO: 9504577 - DNA, 22 bp, Homo sapiens
gctggctggtccagcaggggct

SEQ ID NO: 9504578 - DNA, 22 bp, Homo sapiens
gctggctggtccagcaggggct

SEQ ID NO: 9504579 - DNA, 22 bp, Homo sapiens
gctggctgggtccctgagaggc

SEQ ID NO: 9504580 - DNA, 22 bp, Homo sapiens
gctggctgggtccctgagaggc

SEQ ID NO: 9504581 - DNA, 22 bp, Homo sapiens
gctggctgggtccctgagaggc

SEQ ID NO: 9504582 - DNA, 22 bp, Homo sapiens
gctggctgggtccctgagaggc

SEQ ID NO: 9504583 - DNA, 22 bp, Homo sapiens
gctggctgggtccctgagaggc

SEQ ID NO: 9504584 - DNA, 22 bp, Homo sapiens
gctggctggctgtgcaaaggca

SEQ ID NO: 9504585 - DNA, 22 bp, Homo sapiens
gctggctgggacagattccatt

SEQ ID NO: 9504586 - DNA, 22 bp, Homo sapiens
caaggccttcgtctcctagctt

SEQ ID NO: 9504587 - DNA, 22 bp, Homo sapiens
gctggctggctgtgcaaaggca

SEQ ID NO: 9504588 - DNA, 22 bp, Homo sapiens
gctggctggctgtgcaaaggca

SEQ ID NO: 9504589 - DNA, 22 bp, Homo sapiens
gctggagcttgagaggacaggg

SEQ ID NO: 9504590 - DNA, 22 bp, Homo sapiens
gctggaggaggaagtgtgaggg

SEQ ID NO: 9504591 - DNA, 22 bp, Homo sapiens
caagccagtttgtagttctctc

SEQ ID NO: 9504592 - DNA, 22 bp, Homo sapiens
caagccagtgacagccagggaa

SEQ ID NO: 9504593 - DNA, 22 bp, Homo sapiens
caagccagtgacagccagggaa

SEQ ID NO: 9504594 - DNA, 22 bp, Homo sapiens
gctggaggatcacttgagccca

SEQ ID NO: 9504595 - DNA, 22 bp, Homo sapiens
gctggaggaggaagtgtgaggg

SEQ ID NO: 9504596 - DNA, 22 bp, Homo sapiens
gctggaggaggaagtgtgaggg

SEQ ID NO: 9504597 - DNA, 22 bp, Homo sapiens
gctggaggatggactggaagaa

SEQ ID NO: 9504598 - DNA, 22 bp, Homo sapiens
gctggaggatggactggaagaa

SEQ ID NO: 9504599 - DNA, 22 bp, Homo sapiens
gctggaggatcacttgagccca

SEQ ID NO: 9504600 - DNA, 22 bp, Homo sapiens
gctggaggatcacttgagccca

SEQ ID NO: 9504601 - DNA, 22 bp, Homo sapiens
gctggaggatggactggaagaa

SEQ ID NO: 9504602 - DNA, 22 bp, Homo sapiens
gctggaggatggactggaagaa

SEQ ID NO: 9504603 - DNA, 22 bp, Homo sapiens
caagcatactgtgagagtttta

SEQ ID NO: 9504604 - DNA, 22 bp, Homo sapiens
caagcatttattataattatca

SEQ ID NO: 9504605 - DNA, 21 bp, Homo sapiens
caagccagaccaatagcagcc

SEQ ID NO: 9504606 - DNA, 22 bp, Homo sapiens
caagcatgtcttcttaagcaat

SEQ ID NO: 9504607 - DNA, 22 bp, Homo sapiens
caagcagggagcatcaagggag

SEQ ID NO: 9504608 - DNA, 22 bp, Homo sapiens
caagcaggtttgctattttctt

SEQ ID NO: 9504609 - DNA, 22 bp, Homo sapiens
caagccagctcctgccacagag

SEQ ID NO: 9504610 - DNA, 22 bp, Homo sapiens
caagccagagagcaactgttct

SEQ ID NO: 9504611 - DNA, 22 bp, Homo sapiens
caagccagcttgatgacctgtc

SEQ ID NO: 9504612 - DNA, 22 bp, Homo sapiens
caagccagctcctgccacagag

SEQ ID NO: 9504613 - DNA, 22 bp, Homo sapiens
caagccaggtgaacataacaag

SEQ ID NO: 9504614 - DNA, 22 bp, Homo sapiens
caagccaggaaggatccagcac

SEQ ID NO: 9504615 - DNA, 20 bp, Homo sapiens
caagccaggccctgctgctg

SEQ ID NO: 9504616 - DNA, 22 bp, Homo sapiens
caagccagtcagctcagtagat

SEQ ID NO: 9504617 - DNA, 22 bp, Homo sapiens
caagccagtcagctcagtagat

SEQ ID NO: 9504618 - DNA, 22 bp, Homo sapiens
caaatgtaatggcaggttttgc

SEQ ID NO: 9504619 - DNA, 22 bp, Homo sapiens
caaatgtaataaggagtttccc

SEQ ID NO: 9504620 - DNA, 22 bp, Homo sapiens
caaatgtaataaggagtttccc

SEQ ID NO: 9504621 - DNA, 22 bp, Homo sapiens
caaatgtaaattcttttgaagc

SEQ ID NO: 9504622 - DNA, 22 bp, Homo sapiens
caaatgtaaattcttttgaagc

SEQ ID NO: 9504623 - DNA, 22 bp, Homo sapiens
caaatgtaaattcttttgaagc

SEQ ID NO: 9504624 - DNA, 22 bp, Homo sapiens
caaatggtcatttctcttttgt

SEQ ID NO: 9504625 - DNA, 22 bp, Homo sapiens
caaatggctggcatccttctac

SEQ ID NO: 9504626 - DNA, 20 bp, Homo sapiens
caaatggcttttatttcctt

SEQ ID NO: 9504627 - DNA, 19 bp, Homo sapiens
caaatgggacaggaaggca

SEQ ID NO: 9504628 - DNA, 22 bp, Homo sapiens
caaatgtataaatgtactttct

SEQ ID NO: 9504629 - DNA, 22 bp, Homo sapiens
caaatgtataaatgtactttct

SEQ ID NO: 9504630 - DNA, 22 bp, Homo sapiens
caaatgtataaatgtactttct

SEQ ID NO: 9504631 - DNA, 22 bp, Homo sapiens
caaatgtataaatgtactttct

SEQ ID NO: 9504632 - DNA, 22 bp, Homo sapiens
caaatgtatcagcccagggatt

SEQ ID NO: 9504633 - DNA, 22 bp, Homo sapiens
caaatgtatcagcccagggatt

SEQ ID NO: 9504634 - DNA, 22 bp, Homo sapiens
caaatgtatgttttcctatgta

SEQ ID NO: 9504635 - DNA, 22 bp, Homo sapiens
caaatgtatgttttcctatgta

SEQ ID NO: 9504636 - DNA, 22 bp, Homo sapiens
caaatgtaattgcggtttttgc

SEQ ID NO: 9504637 - DNA, 22 bp, Homo sapiens
caaatgtaatggcaggttttgc

SEQ ID NO: 9504638 - DNA, 22 bp, Homo sapiens
caaatgtaatggcaggttttgc

SEQ ID NO: 9504639 - DNA, 22 bp, Homo sapiens
caaatgtaattgcggtttttgc

SEQ ID NO: 9504640 - DNA, 22 bp, Homo sapiens
caaatgtaattgcggtttttgc

SEQ ID NO: 9504641 - DNA, 23 bp, Homo sapiens
caaatgtagtgtgtccacccctg

SEQ ID NO: 9504642 - DNA, 23 bp, Homo sapiens
caaatgtagtgtgtccacccctg

SEQ ID NO: 9504643 - DNA, 22 bp, Homo sapiens
caagattcagccctcctgacct

SEQ ID NO: 9504644 - DNA, 22 bp, Homo sapiens
caagatttaagagtcagccttg

SEQ ID NO: 9504645 - DNA, 22 bp, Homo sapiens
caagcaggatgaagcccaggga

SEQ ID NO: 9504646 - DNA, 22 bp, Homo sapiens
caagcaggaggagaagtttctg

SEQ ID NO: 9504647 - DNA, 22 bp, Homo sapiens
caagcaggaggagaagtttctg

SEQ ID NO: 9504648 - DNA, 22 bp, Homo sapiens
caaatgtattctcacttcaggg

SEQ ID NO: 9504649 - DNA, 22 bp, Homo sapiens
caaatgtattctcacttcaggg

SEQ ID NO: 9504650 - DNA, 22 bp, Homo sapiens
caaatgtattctcacttcaggg

SEQ ID NO: 9504651 - DNA, 22 bp, Homo sapiens
caaatgtattctcacttcaggg

SEQ ID NO: 9504652 - DNA, 22 bp, Homo sapiens
caagattatcttcttcttgtta

SEQ ID NO: 9504653 - DNA, 22 bp, Homo sapiens
caaatgtggtttctcagcattc

SEQ ID NO: 9504654 - DNA, 22 bp, Homo sapiens
cagcaagacttcagggcttggt

SEQ ID NO: 9504655 - DNA, 22 bp, Homo sapiens
cagcaagagttggggttgttgg

SEQ ID NO: 9504656 - DNA, 22 bp, Homo sapiens
cagcaagagggtaaggttgaag

SEQ ID NO: 9504657 - DNA, 22 bp, Homo sapiens
cagcaagagttggggttgttgg

SEQ ID NO: 9504658 - DNA, 22 bp, Homo sapiens
cagcaagagaggcagggcaaat

SEQ ID NO: 9504659 - DNA, 22 bp, Homo sapiens
cagcaagagaggcagggcaaat

SEQ ID NO: 9504660 - DNA, 21 bp, Homo sapiens
cagcaaggaagtcgagtaggt

SEQ ID NO: 9504661 - DNA, 22 bp, Homo sapiens
cagcaagccaaatgtggcccga

SEQ ID NO: 9504662 - DNA, 22 bp, Homo sapiens
cagcaagatttttaaagcaagg

SEQ ID NO: 9504663 - DNA, 22 bp, Homo sapiens
cagcaagattaagggcagaaaa

SEQ ID NO: 9504664 - DNA, 22 bp, Homo sapiens
ggtgactcatgtgtgttttcag

SEQ ID NO: 9504665 - DNA, 22 bp, Homo sapiens
ggtgactcccagctgctctctt

SEQ ID NO: 9504666 - DNA, 22 bp, Homo sapiens
ggtgacgaatccatagcatcga

SEQ ID NO: 9504667 - DNA, 22 bp, Homo sapiens
ggtgacgaatccatagcatcga

SEQ ID NO: 9504668 - DNA, 22 bp, Homo sapiens
ggtgagactttagaagagccag

SEQ ID NO: 9504669 - DNA, 22 bp, Homo sapiens
ggtgagaaaaatgagtatgatt

SEQ ID NO: 9504670 - DNA, 22 bp, Homo sapiens
cagcaaagtaagctgacatgta

SEQ ID NO: 9504671 - DNA, 22 bp, Homo sapiens
cagcaaagtaagctgacatgta

SEQ ID NO: 9504672 - DNA, 22 bp, Homo sapiens
cagcaagacagtttcctaagtg

SEQ ID NO: 9504673 - DNA, 22 bp, Homo sapiens
ggtctgagtgccagggagagaa

SEQ ID NO: 9504674 - DNA, 22 bp, Homo sapiens
ggtctgagtgccagggagagaa

SEQ ID NO: 9504675 - DNA, 22 bp, Homo sapiens
ggtctgagtgggcaggggccgg

SEQ ID NO: 9504676 - DNA, 22 bp, Homo sapiens
ggtctgccctgggtggaggcgc

SEQ ID NO: 9504677 - DNA, 22 bp, Homo sapiens
ggtctgctttccttgccactgt

SEQ ID NO: 9504678 - DNA, 22 bp, Homo sapiens
ggtctgctttccttgccactgt

SEQ ID NO: 9504679 - DNA, 22 bp, Homo sapiens
ggtctgcccactactctccatt

SEQ ID NO: 9504680 - DNA, 22 bp, Homo sapiens
ggtctgagatatttgttcagct

SEQ ID NO: 9504681 - DNA, 18 bp, Homo sapiens
ggtctgagatcgtttttc

SEQ ID NO: 9504682 - DNA, 22 bp, Homo sapiens
ggtctgagcttgagcccatgct

SEQ ID NO: 9504683 - DNA, 22 bp, Homo sapiens
ggtctgagcttgagcccatgct

SEQ ID NO: 9504684 - DNA, 22 bp, Homo sapiens
ggtctgagcttgagcccatgct

SEQ ID NO: 9504685 - DNA, 22 bp, Homo sapiens
ggtctgaggctccaaggaggtg

SEQ ID NO: 9504686 - DNA, 22 bp, Homo sapiens
ggtctgaggtgggacccaggaa

SEQ ID NO: 9504687 - DNA, 22 bp, Homo sapiens
ggtctgaggctccaaggaggtg

SEQ ID NO: 9504688 - DNA, 22 bp, Homo sapiens
ggtctgaggctccaaggaggtg

SEQ ID NO: 9504689 - DNA, 22 bp, Homo sapiens
ggtctgagtagagggctggcga

SEQ ID NO: 9504690 - DNA, 22 bp, Homo sapiens
ggtctgagtagagggctggcga

SEQ ID NO: 9504691 - DNA, 22 bp, Homo sapiens
ggtctgaggtgggacccaggaa

SEQ ID NO: 9504692 - DNA, 22 bp, Homo sapiens
ggtctggaataaggtccaggaa

SEQ ID NO: 9504693 - DNA, 22 bp, Homo sapiens
ggtgacagtggttaaaatttgt

SEQ ID NO: 9504694 - DNA, 22 bp, Homo sapiens
ggtgacagttccggaggtacag

SEQ ID NO: 9504695 - DNA, 22 bp, Homo sapiens
ggtgacagtggttaaaatttgt

SEQ ID NO: 9504696 - DNA, 22 bp, Homo sapiens
ggtgacagtggttaaaatttgt

SEQ ID NO: 9504697 - DNA, 19 bp, Homo sapiens
ggtgaccacctggtcagtg

SEQ ID NO: 9504698 - DNA, 22 bp, Homo sapiens
ggtgacatgcacctatcccttg

SEQ ID NO: 9504699 - DNA, 22 bp, Homo sapiens
ggtgacattatcattattttaa

SEQ ID NO: 9504700 - DNA, 22 bp, Homo sapiens
ggtgacatagttacttcaggct

SEQ ID NO: 9504701 - DNA, 22 bp, Homo sapiens
ggtgacatctagagacatccaa

SEQ ID NO: 9504702 - DNA, 22 bp, Homo sapiens
ggtgacatcagtaaccgtggtt

SEQ ID NO: 9504703 - DNA, 22 bp, Homo sapiens
ggtgacctcacctggtcccacc

SEQ ID NO: 9504704 - DNA, 22 bp, Homo sapiens
ggtgacctcacctggtcccacc

SEQ ID NO: 9504705 - DNA, 22 bp, Homo sapiens
ggtgacctcacctggtcccacc

SEQ ID NO: 9504706 - DNA, 22 bp, Homo sapiens
ggtgacctcacctggtcccacc

SEQ ID NO: 9504707 - DNA, 22 bp, Homo sapiens
ggtgacctcacctggtcccacc

SEQ ID NO: 9504708 - DNA, 22 bp, Homo sapiens
ggtgctgggaacgaggaattca

SEQ ID NO: 9504709 - DNA, 22 bp, Homo sapiens
ggtgctggacacgtggcactcc

SEQ ID NO: 9504710 - DNA, 22 bp, Homo sapiens
ggtgctgctgctgaacccagct

SEQ ID NO: 9504711 - DNA, 22 bp, Homo sapiens
cagcacagtacaaggcacggat

SEQ ID NO: 9504712 - DNA, 22 bp, Homo sapiens
cagcacaattttcaggagtcca

SEQ ID NO: 9504713 - DNA, 22 bp, Homo sapiens
cagcacaattttcaggagtcca

SEQ ID NO: 9504714 - DNA, 22 bp, Homo sapiens
ggtgctgggaacgaggaattca

SEQ ID NO: 9504715 - DNA, 23 bp, Homo sapiens
cagcacagtacatttcctgtctc

SEQ ID NO: 9504716 - DNA, 22 bp, Homo sapiens
ggtgctgacattcagagtctgg

SEQ ID NO: 9504717 - DNA, 22 bp, Homo sapiens
cagcaaggactgggcatgtgaa

SEQ ID NO: 9504718 - DNA, 21 bp, Homo sapiens
cagcaaggaagtcgagtaggt

SEQ ID NO: 9504719 - DNA, 22 bp, Homo sapiens
cagcaaggactgggcatgtgaa

SEQ ID NO: 9504720 - DNA, 22 bp, Homo sapiens
cagcaaggactgggcatgtgaa

SEQ ID NO: 9504721 - DNA, 22 bp, Homo sapiens
ggtgctgactgaggatggcttg

SEQ ID NO: 9504722 - DNA, 22 bp, Homo sapiens
ggtgctgagtgagctagaggct

SEQ ID NO: 9504723 - DNA, 22 bp, Homo sapiens
cagcacagtgcagatgctgact

SEQ ID NO: 9504724 - DNA, 22 bp, Homo sapiens
cagcacagtttcccccatgagc

SEQ ID NO: 9504725 - DNA, 22 bp, Homo sapiens
cagcacagtcctttgcttactg

SEQ ID NO: 9504726 - DNA, 22 bp, Homo sapiens
cagcacagtagagtagttgtaa

SEQ ID NO: 9504727 - DNA, 22 bp, Homo sapiens
cagcacagtgaccagacccact

SEQ ID NO: 9504728 - DNA, 22 bp, Homo sapiens
cagcacagtgaccagacccact

SEQ ID NO: 9504729 - DNA, 22 bp, Homo sapiens
cagcacagtgaccagacccact

SEQ ID NO: 9504730 - DNA, 22 bp, Homo sapiens
cagcacagtgcagatgctgact

SEQ ID NO: 9504731 - DNA, 22 bp, Homo sapiens
cagcacagtgcagatgctgact

SEQ ID NO: 9504732 - DNA, 22 bp, Homo sapiens
cagcaccatttgcagcctcttt

SEQ ID NO: 9504733 - DNA, 22 bp, Homo sapiens
cagcaccaggcagacctggagc

SEQ ID NO: 9504734 - DNA, 22 bp, Homo sapiens
cagcaccagcatattccagggc

SEQ ID NO: 9504735 - DNA, 22 bp, Homo sapiens
cagcaccagcatattccagggc

SEQ ID NO: 9504736 - DNA, 22 bp, Homo sapiens
cagcacatttactcagccctca

SEQ ID NO: 9504737 - DNA, 22 bp, Homo sapiens
cagcacatgctcatcagggaag

SEQ ID NO: 9504738 - DNA, 22 bp, Homo sapiens
cagcacatggatggagttagga

SEQ ID NO: 9504739 - DNA, 22 bp, Homo sapiens
cagcacatttactcagccctca

SEQ ID NO: 9504740 - DNA, 22 bp, Homo sapiens
cagcacagtttgcttggcagag

SEQ ID NO: 9504741 - DNA, 22 bp, Homo sapiens
cagcacataagccgaagactgt

SEQ ID NO: 9504742 - DNA, 22 bp, Homo sapiens
cagcacataatcagtgattgtg

SEQ ID NO: 9504743 - DNA, 22 bp, Homo sapiens
cagcacatctgattatatgact

SEQ ID NO: 9504744 - DNA, 22 bp, Homo sapiens
cagcacatagcatgcttgtcag

SEQ ID NO: 9504745 - DNA, 22 bp, Homo sapiens
cagcacatagcatgcttgtcag

SEQ ID NO: 9504746 - DNA, 22 bp, Homo sapiens
ggggagagtattttattcaagt

SEQ ID NO: 9504747 - DNA, 22 bp, Homo sapiens
ggggagagtcctttccagttcc

SEQ ID NO: 9504748 - DNA, 19 bp, Homo sapiens
cagaggcaccaggtataga

SEQ ID NO: 9504749 - DNA, 19 bp, Homo sapiens
cagaggcaccaggtataga

SEQ ID NO: 9504750 - DNA, 16 bp, Homo sapiens
cagaggcacctggctc

SEQ ID NO: 9504751 - DNA, 22 bp, Homo sapiens
cagaggcacaagaaagcaaggc

SEQ ID NO: 9504752 - DNA, 22 bp, Homo sapiens
cagaggcacagcttcttttaat

SEQ ID NO: 9504753 - DNA, 19 bp, Homo sapiens
cagaggcaccaggtataga

SEQ ID NO: 9504754 - DNA, 22 bp, Homo sapiens
cagaggcacagtgcgggccact

SEQ ID NO: 9504755 - DNA, 22 bp, Homo sapiens
cagaggcacagtgcgggccact

SEQ ID NO: 9504756 - DNA, 22 bp, Homo sapiens
cagaggcacagtgcgggccact

SEQ ID NO: 9504757 - DNA, 22 bp, Homo sapiens
ggggagctgggaggtgagttac

SEQ ID NO: 9504758 - DNA, 22 bp, Homo sapiens
ggggagctgggaggtgagttac

SEQ ID NO: 9504759 - DNA, 22 bp, Homo sapiens
ggggagcttagggtctctgaat

SEQ ID NO: 9504760 - DNA, 22 bp, Homo sapiens
ggggagctgggaggtgagttac

SEQ ID NO: 9504761 - DNA, 22 bp, Homo sapiens
ggggagcttcaggtggcttaca

SEQ ID NO: 9504762 - DNA, 22 bp, Homo sapiens
ggggagcttggttattcatgca

SEQ ID NO: 9504763 - DNA, 22 bp, Homo sapiens
ggggagcttcaggtggcttaca

SEQ ID NO: 9504764 - DNA, 22 bp, Homo sapiens
ggggagctcatgatgtctttgt

SEQ ID NO: 9504765 - DNA, 22 bp, Homo sapiens
ggggagctgacaaccacatcct

SEQ ID NO: 9504766 - DNA, 22 bp, Homo sapiens
ggggagctgccacagttctctg

SEQ ID NO: 9504767 - DNA, 22 bp, Homo sapiens
ggggagctgagacactgccctc

SEQ ID NO: 9504768 - DNA, 22 bp, Homo sapiens
ggggagcaggctgggctgtctg

SEQ ID NO: 9504769 - DNA, 22 bp, Homo sapiens
ggggagcagaagcagcaacaac

SEQ ID NO: 9504770 - DNA, 22 bp, Homo sapiens
ggggagcaatagttgaggtgtg

SEQ ID NO: 9504771 - DNA, 22 bp, Homo sapiens
ggggagcaatagttgaggtgtg

SEQ ID NO: 9504772 - DNA, 22 bp, Homo sapiens
cagagggtcaccaggaagtgca

SEQ ID NO: 9504773 - DNA, 22 bp, Homo sapiens
cagaggggtgtagagatcactg

SEQ ID NO: 9504774 - DNA, 22 bp, Homo sapiens
cagagggtgtgaaggggatgaa

SEQ ID NO: 9504775 - DNA, 23 bp, Homo sapiens
cagagggttccatggagcatggt

SEQ ID NO: 9504776 - DNA, 22 bp, Homo sapiens
cagaggggataacaggtgtaga

SEQ ID NO: 9504777 - DNA, 22 bp, Homo sapiens
cagaggggctgacacccttggc

SEQ ID NO: 9504778 - DNA, 21 bp, Homo sapiens
cagaggggctagcctggctgc

SEQ ID NO: 9504779 - DNA, 22 bp, Homo sapiens
cagagggctcttggctgcctgc

SEQ ID NO: 9504780 - DNA, 22 bp, Homo sapiens
cagagggctcttggctgcctgc

SEQ ID NO: 9504781 - DNA, 22 bp, Homo sapiens
cagagggcttcaggttcaggat

SEQ ID NO: 9504782 - DNA, 22 bp, Homo sapiens
cagagggctgtgtaaggatgtt

SEQ ID NO: 9504783 - DNA, 22 bp, Homo sapiens
cagagggctcggcggccgctcc

SEQ ID NO: 9504784 - DNA, 22 bp, Homo sapiens
cagagggctcggcggccgctcc

SEQ ID NO: 9504785 - DNA, 22 bp, Homo sapiens
cagagggaaaaggggagtaata

SEQ ID NO: 9504786 - DNA, 22 bp, Homo sapiens
cagagggaaaaggggagtaata

SEQ ID NO: 9504787 - DNA, 22 bp, Homo sapiens
cagagggaaaaggggagtaata

SEQ ID NO: 9504788 - DNA, 22 bp, Homo sapiens
cagaggctttgccctggaaacc

SEQ ID NO: 9504789 - DNA, 22 bp, Homo sapiens
ggtcagtggcagggggtacttc

SEQ ID NO: 9504790 - DNA, 22 bp, Homo sapiens
ggtcagtgcgatttcccactcc

SEQ ID NO: 9504791 - DNA, 23 bp, Homo sapiens
ggtcagtgagttcgtttctctgg

SEQ ID NO: 9504792 - DNA, 22 bp, Homo sapiens
ggtcagtgacttttttctgtgg

SEQ ID NO: 9504793 - DNA, 22 bp, Homo sapiens
cagagggttgatgtgaggctta

SEQ ID NO: 9504794 - DNA, 23 bp, Homo sapiens
cagagggttccatggagcatggt

SEQ ID NO: 9504795 - DNA, 21 bp, Homo sapiens
cagagggtttctcaggtgttt

SEQ ID NO: 9504796 - DNA, 21 bp, Homo sapiens
cagagggtttctcaggtgttt

SEQ ID NO: 9504797 - DNA, 22 bp, Homo sapiens
cagaggtacaagctaagttggg

SEQ ID NO: 9504798 - DNA, 22 bp, Homo sapiens
cagaggtacagccattgaagat

SEQ ID NO: 9504799 - DNA, 22 bp, Homo sapiens
cagaggtaccagcagcctctgg

SEQ ID NO: 9504800 - DNA, 22 bp, Homo sapiens
ggtcaggtaggaagttaactat

SEQ ID NO: 9504801 - DNA, 22 bp, Homo sapiens
ggtcacagggaagggctctcaa

SEQ ID NO: 9504802 - DNA, 22 bp, Homo sapiens
ggtcacaggggagaagagtgat

SEQ ID NO: 9504803 - DNA, 22 bp, Homo sapiens
cagaggtagaactggccctcac

SEQ ID NO: 9504804 - DNA, 22 bp, Homo sapiens
cagaggtagaaggcatgcagtg

SEQ ID NO: 9504805 - DNA, 22 bp, Homo sapiens
cagaggtagcatgctgtggctt

SEQ ID NO: 9504806 - DNA, 22 bp, Homo sapiens
ggtcacagggaagggctctcaa

SEQ ID NO: 9504807 - DNA, 22 bp, Homo sapiens
cagagtcccagatgcccctcct

SEQ ID NO: 9504808 - DNA, 22 bp, Homo sapiens
cagagtccaattgctcagagcg

SEQ ID NO: 9504809 - DNA, 22 bp, Homo sapiens
cagagtcattgacttccaggag

SEQ ID NO: 9504810 - DNA, 22 bp, Homo sapiens
cagagtcagtattgaattgaaa

SEQ ID NO: 9504811 - DNA, 22 bp, Homo sapiens
cagagtcagctagtcttgggat

SEQ ID NO: 9504812 - DNA, 22 bp, Homo sapiens
ggtcatcttgaatttccattct

SEQ ID NO: 9504813 - DNA, 20 bp, Homo sapiens
ggtcatcttccaatcccagg

SEQ ID NO: 9504814 - DNA, 22 bp, Homo sapiens
ggtccagaagctggtagggtag

SEQ ID NO: 9504815 - DNA, 22 bp, Homo sapiens
ggtcctgggaagatgctcatga

SEQ ID NO: 9504816 - DNA, 22 bp, Homo sapiens
ggtcctgggaagatgctcatga

SEQ ID NO: 9504817 - DNA, 22 bp, Homo sapiens
ggtctgagatatttgttcagct

SEQ ID NO: 9504818 - DNA, 22 bp, Homo sapiens
cagagtctggactgcaggctcc

SEQ ID NO: 9504819 - DNA, 22 bp, Homo sapiens
cagagtctggactgcaggctcc

SEQ ID NO: 9504820 - DNA, 17 bp, Homo sapiens
cagagtctgtctgcatc

SEQ ID NO: 9504821 - DNA, 22 bp, Homo sapiens
cagagtcttgtgtgttcagccc

SEQ ID NO: 9504822 - DNA, 17 bp, Homo sapiens
cagagtctgtctgcatc

SEQ ID NO: 9504823 - DNA, 19 bp, Homo sapiens
cagagtccttgaccagtcc

SEQ ID NO: 9504824 - DNA, 22 bp, Homo sapiens
cagagtctctgggaggctgggt

SEQ ID NO: 9504825 - DNA, 22 bp, Homo sapiens
cagagtctctgggaggctgggt

SEQ ID NO: 9504826 - DNA, 22 bp, Homo sapiens
cagagtcctggacacagagaca

SEQ ID NO: 9504827 - DNA, 22 bp, Homo sapiens
cagagacaggatctcgaagact

SEQ ID NO: 9504828 - DNA, 22 bp, Homo sapiens
cagagacaggatctcgaagact

SEQ ID NO: 9504829 - DNA, 22 bp, Homo sapiens
cagagacaggatctcgaagact

SEQ ID NO: 9504830 - DNA, 22 bp, Homo sapiens
cagagacaggagtgctcccagt

SEQ ID NO: 9504831 - DNA, 22 bp, Homo sapiens
cagagacaggagtgctcccagt

SEQ ID NO: 9504832 - DNA, 22 bp, Homo sapiens
cagagacaggagtgctcccagt

SEQ ID NO: 9504833 - DNA, 22 bp, Homo sapiens
cagagacaggagtgctcccagt

SEQ ID NO: 9504834 - DNA, 22 bp, Homo sapiens
gggcaggtatttatcttctatt

SEQ ID NO: 9504835 - DNA, 22 bp, Homo sapiens
cagagacagggcagggagtgtg

SEQ ID NO: 9504836 - DNA, 22 bp, Homo sapiens
cagagacaggcttgccctccac

SEQ ID NO: 9504837 - DNA, 22 bp, Homo sapiens
cagagacaggatctcgaagact

SEQ ID NO: 9504838 - DNA, 22 bp, Homo sapiens
cagagacaggcttgccctccac

SEQ ID NO: 9504839 - DNA, 22 bp, Homo sapiens
cagagacaggcttgccctccac

SEQ ID NO: 9504840 - DNA, 22 bp, Homo sapiens
cagagacaggcttgccctccac

SEQ ID NO: 9504841 - DNA, 22 bp, Homo sapiens
gggcagtgggtggctgcagcct

SEQ ID NO: 9504842 - DNA, 22 bp, Homo sapiens
gggcagtgggaccaggcaccag

SEQ ID NO: 9504843 - DNA, 22 bp, Homo sapiens
gggcagtggttacacagctgag

SEQ ID NO: 9504844 - DNA, 22 bp, Homo sapiens
gggcagtggtccaggctacagc

SEQ ID NO: 9504845 - DNA, 22 bp, Homo sapiens
gggcagtgtcgaggtctggtcc

SEQ ID NO: 9504846 - DNA, 22 bp, Homo sapiens
gggcagtgtcgaggtctggtcc

SEQ ID NO: 9504847 - DNA, 22 bp, Homo sapiens
gggcagtggttacacagctgag

SEQ ID NO: 9504848 - DNA, 22 bp, Homo sapiens
gggcagtgggtggctgcagcct

SEQ ID NO: 9504849 - DNA, 22 bp, Homo sapiens
gggcagtgggtggctgcagcct

SEQ ID NO: 9504850 - DNA, 22 bp, Homo sapiens
gggcagtggtccaggctacagc

SEQ ID NO: 9504851 - DNA, 22 bp, Homo sapiens
cagagacaggaatcagctgcag

SEQ ID NO: 9504852 - DNA, 22 bp, Homo sapiens
cagagacaggaatcagctgcag

SEQ ID NO: 9504853 - DNA, 22 bp, Homo sapiens
cagagacagcctgggagggaca

SEQ ID NO: 9504854 - DNA, 22 bp, Homo sapiens
cagagacagcctgggagggaca

SEQ ID NO: 9504855 - DNA, 22 bp, Homo sapiens
gggcagcatttgaaaaacagat

SEQ ID NO: 9504856 - DNA, 22 bp, Homo sapiens
gggcagcattctgtgggcaggt

SEQ ID NO: 9504857 - DNA, 22 bp, Homo sapiens
gggcagcattctgtgggcaggt

SEQ ID NO: 9504858 - DNA, 22 bp, Homo sapiens
gggcagcatgtcactagcatgg

SEQ ID NO: 9504859 - DNA, 22 bp, Homo sapiens
gggcagcatgaggaccctcatc

SEQ ID NO: 9504860 - DNA, 22 bp, Homo sapiens
gggcagcagcaggaggtctctg

SEQ ID NO: 9504861 - DNA, 22 bp, Homo sapiens
gggcagcagcaggaggtctctg

SEQ ID NO: 9504862 - DNA, 22 bp, Homo sapiens
gggcagcagcaggaggtctctg

SEQ ID NO: 9504863 - DNA, 22 bp, Homo sapiens
gggcagcagccactcatttagc

SEQ ID NO: 9504864 - DNA, 22 bp, Homo sapiens
gggcagcagagccctgccgagt

SEQ ID NO: 9504865 - DNA, 21 bp, Homo sapiens
gggcagcagcagcaacaaggg

SEQ ID NO: 9504866 - DNA, 21 bp, Homo sapiens
gggcagcagcagcaacaaggg

SEQ ID NO: 9504867 - DNA, 22 bp, Homo sapiens
gggcagcagaggatcccttaat

SEQ ID NO: 9504868 - DNA, 22 bp, Homo sapiens
gggcagcatgaggaccctcatc

SEQ ID NO: 9504869 - DNA, 22 bp, Homo sapiens
gggcagcatcaggaggggcttt

SEQ ID NO: 9504870 - DNA, 22 bp, Homo sapiens
gggcagcatcaggaggggcttt

SEQ ID NO: 9504871 - DNA, 22 bp, Homo sapiens
gggcagcagttgccctaatcaa

SEQ ID NO: 9504872 - DNA, 22 bp, Homo sapiens
gggcagcaggctccacgttcct

SEQ ID NO: 9504873 - DNA, 22 bp, Homo sapiens
gggcagcataacaatcactgaa

SEQ ID NO: 9504874 - DNA, 22 bp, Homo sapiens
gggcagcagttgccctaatcaa

SEQ ID NO: 9504875 - DNA, 22 bp, Homo sapiens
cagactctgatgcagccttgtg

SEQ ID NO: 9504876 - DNA, 22 bp, Homo sapiens
cagactctcttccatgcatcac

SEQ ID NO: 9504877 - DNA, 22 bp, Homo sapiens
cagactgactttctgtggctat

SEQ ID NO: 9504878 - DNA, 22 bp, Homo sapiens
cagactgaaaatccctggtagt

SEQ ID NO: 9504879 - DNA, 22 bp, Homo sapiens
cagactggccacatctgcactg

SEQ ID NO: 9504880 - DNA, 22 bp, Homo sapiens
cagactgagggcatcacatacg

SEQ ID NO: 9504881 - DNA, 22 bp, Homo sapiens
cagactgagggcatcacatacg

SEQ ID NO: 9504882 - DNA, 22 bp, Homo sapiens
cagactggccacatctgcactg

SEQ ID NO: 9504883 - DNA, 22 bp, Homo sapiens
cagactgggagtcaggaagaag

SEQ ID NO: 9504884 - DNA, 22 bp, Homo sapiens
cagactgggctggtggaaagct

SEQ ID NO: 9504885 - DNA, 22 bp, Homo sapiens
gggcagcagagccctgccgagt

SEQ ID NO: 9504886 - DNA, 19 bp, Homo sapiens
cagacctgtccagcctgtg

SEQ ID NO: 9504887 - DNA, 22 bp, Homo sapiens
cagactctcttccatgcatcac

SEQ ID NO: 9504888 - DNA, 20 bp, Homo sapiens
cagacctgcacccacttcga

SEQ ID NO: 9504889 - DNA, 22 bp, Homo sapiens
cagacctgaggagcactgagcc

SEQ ID NO: 9504890 - DNA, 22 bp, Homo sapiens
cagacctgaggagcactgagcc

SEQ ID NO: 9504891 - DNA, 22 bp, Homo sapiens
cagacctgaggagcactgagcc

SEQ ID NO: 9504892 - DNA, 22 bp, Homo sapiens
cagacccaggatccaaatgttg

SEQ ID NO: 9504893 - DNA, 23 bp, Homo sapiens
cagaccctcaatccacttgtttt

SEQ ID NO: 9504894 - DNA, 22 bp, Homo sapiens
cagaccagaaggaagccgacaa

SEQ ID NO: 9504895 - DNA, 22 bp, Homo sapiens
cagacatggcgccaagtgctag

SEQ ID NO: 9504896 - DNA, 22 bp, Homo sapiens
cagaccagtagggctcatccca

SEQ ID NO: 9504897 - DNA, 22 bp, Homo sapiens
cagaccagtagggctcatccca

SEQ ID NO: 9504898 - DNA, 22 bp, Homo sapiens
cagaccagctctatgaacccaa

SEQ ID NO: 9504899 - DNA, 23 bp, Homo sapiens
cagaccctcaatccacttgtttt

SEQ ID NO: 9504900 - DNA, 22 bp, Homo sapiens
cagaccctcgggtgagttggcc

SEQ ID NO: 9504901 - DNA, 21 bp, Homo sapiens
cagaccctctagaggccacct

SEQ ID NO: 9504902 - DNA, 22 bp, Homo sapiens
cagaccctgggccacagaggag

SEQ ID NO: 9504903 - DNA, 21 bp, Homo sapiens
cagaccctctagaggccacct

SEQ ID NO: 9504904 - DNA, 22 bp, Homo sapiens
cagaccctcttctattggtggg

SEQ ID NO: 9504905 - DNA, 22 bp, Homo sapiens
cagaccctgggccacagaggag

SEQ ID NO: 9504906 - DNA, 22 bp, Homo sapiens
cagaccctgggccacagaggag

SEQ ID NO: 9504907 - DNA, 22 bp, Homo sapiens
cagaccctcttctattggtggg

SEQ ID NO: 9504908 - DNA, 22 bp, Homo sapiens
cagacccttttctgagaggacc

SEQ ID NO: 9504909 - DNA, 22 bp, Homo sapiens
cagacctcaaagctgcagtgct

SEQ ID NO: 9504910 - DNA, 22 bp, Homo sapiens
cagacagggtcctgtccgtcac

SEQ ID NO: 9504911 - DNA, 22 bp, Homo sapiens
ggcttcagaggggaggtagtgc

SEQ ID NO: 9504912 - DNA, 22 bp, Homo sapiens
ggcttcagatttctcagttgtt

SEQ ID NO: 9504913 - DNA, 22 bp, Homo sapiens
ggcttcagaggagaagagggtg

SEQ ID NO: 9504914 - DNA, 22 bp, Homo sapiens
ggcttcaatgtattcacattca

SEQ ID NO: 9504915 - DNA, 22 bp, Homo sapiens
ggctgttcctctgagagctgat

SEQ ID NO: 9504916 - DNA, 22 bp, Homo sapiens
ggcttagaaggcaaatgacttg

SEQ ID NO: 9504917 - DNA, 22 bp, Homo sapiens
ggcttaataaataacatgtcat

SEQ ID NO: 9504918 - DNA, 22 bp, Homo sapiens
ggcttagcaactcctgaggctc

SEQ ID NO: 9504919 - DNA, 22 bp, Homo sapiens
gggccagagcttggcagctggg

SEQ ID NO: 9504920 - DNA, 22 bp, Homo sapiens
gggccagagcttggcagctggg

SEQ ID NO: 9504921 - DNA, 22 bp, Homo sapiens
gggccagacctcttctcaggga

SEQ ID NO: 9504922 - DNA, 22 bp, Homo sapiens
gggccagacctcttctcaggga

SEQ ID NO: 9504923 - DNA, 22 bp, Homo sapiens
gggccagagcacagaggatgtt

SEQ ID NO: 9504924 - DNA, 22 bp, Homo sapiens
gggccagagcacagaggatgtt

SEQ ID NO: 9504925 - DNA, 22 bp, Homo sapiens
gggccagcagtatcggaggcat

SEQ ID NO: 9504926 - DNA, 22 bp, Homo sapiens
gggccagcagtatcggaggcat

SEQ ID NO: 9504927 - DNA, 22 bp, Homo sapiens
gggccagcagtatcggaggcat

SEQ ID NO: 9504928 - DNA, 22 bp, Homo sapiens
gggccagcctactgctagaccc

SEQ ID NO: 9504929 - DNA, 22 bp, Homo sapiens
gggccagcctactgctagaccc

SEQ ID NO: 9504930 - DNA, 22 bp, Homo sapiens
gggctctgcgggcccggactcc

SEQ ID NO: 9504931 - DNA, 20 bp, Homo sapiens
gggctctgcttggcagaagt

SEQ ID NO: 9504932 - DNA, 22 bp, Homo sapiens
gggctctgtgttctagctctcg

SEQ ID NO: 9504933 - DNA, 22 bp, Homo sapiens
gggcagtgtcggggcccaggga

SEQ ID NO: 9504934 - DNA, 22 bp, Homo sapiens
gggcagtgtctgcaaatgaaca

SEQ ID NO: 9504935 - DNA, 22 bp, Homo sapiens
gggcagtgtggtcgtgcctttg

SEQ ID NO: 9504936 - DNA, 22 bp, Homo sapiens
gggccagacccttggcgatctg

SEQ ID NO: 9504937 - DNA, 22 bp, Homo sapiens
gggccagacccttggcgatctg

SEQ ID NO: 9504938 - DNA, 22 bp, Homo sapiens
gggctgacagtttcccctgaaa

SEQ ID NO: 9504939 - DNA, 22 bp, Homo sapiens
gggctgaccccacccctcactc

SEQ ID NO: 9504940 - DNA, 22 bp, Homo sapiens
gggctgacatatttggtgctct

SEQ ID NO: 9504941 - DNA, 22 bp, Homo sapiens
gggctgacaccacccaggcgca

SEQ ID NO: 9504942 - DNA, 22 bp, Homo sapiens
gggctgacaaccatctgacaag

SEQ ID NO: 9504943 - DNA, 22 bp, Homo sapiens
gggctctgtttagaccagagat

SEQ ID NO: 9504944 - DNA, 22 bp, Homo sapiens
gggctctgtttagaccagagat

SEQ ID NO: 9504945 - DNA, 22 bp, Homo sapiens
gggctctgtttagaccagagat

SEQ ID NO: 9504946 - DNA, 22 bp, Homo sapiens
gggctctgtttagatcagagat

SEQ ID NO: 9504947 - DNA, 22 bp, Homo sapiens
gggctctgtttagatcagagat

SEQ ID NO: 9504948 - DNA, 22 bp, Homo sapiens
gggctgacaaccatctgacaag

SEQ ID NO: 9504949 - DNA, 22 bp, Homo sapiens
gggctgaaaggccgcctcagat

SEQ ID NO: 9504950 - DNA, 22 bp, Homo sapiens
gggctgaaaggccgcctcagat

SEQ ID NO: 9504951 - DNA, 20 bp, Homo sapiens
gggctcttaggtagcagggg

SEQ ID NO: 9504952 - DNA, 22 bp, Homo sapiens
gggctgactcaaccttgcaaag

SEQ ID NO: 9504953 - DNA, 22 bp, Homo sapiens
cagagcctcagaatcctgtgga

SEQ ID NO: 9504954 - DNA, 22 bp, Homo sapiens
cagagcctcatcatccactcca

SEQ ID NO: 9504955 - DNA, 22 bp, Homo sapiens
cagagcctctgccctgggcact

SEQ ID NO: 9504956 - DNA, 22 bp, Homo sapiens
cagagcctctcagccccttggg

SEQ ID NO: 9504957 - DNA, 22 bp, Homo sapiens
cagagcctctcagaggtcagac

SEQ ID NO: 9504958 - DNA, 22 bp, Homo sapiens
cagagcctgcctctggctgtgg

SEQ ID NO: 9504959 - DNA, 22 bp, Homo sapiens
cagagctgggcatggtgaaagg

SEQ ID NO: 9504960 - DNA, 22 bp, Homo sapiens
cagagctgggtttgggaaacct

SEQ ID NO: 9504961 - DNA, 22 bp, Homo sapiens
cagagctggggactgttggatg

SEQ ID NO: 9504962 - DNA, 22 bp, Homo sapiens
cagagctggggactgttggatg

SEQ ID NO: 9504963 - DNA, 20 bp, Homo sapiens
cagagctgggatttgaacac

SEQ ID NO: 9504964 - DNA, 22 bp, Homo sapiens
cagagctgggatcccatgggcg

SEQ ID NO: 9504965 - DNA, 23 bp, Homo sapiens
cagagctggcttcatgggtgtgc

SEQ ID NO: 9504966 - DNA, 22 bp, Homo sapiens
cagagctggctctgcatgtaca

SEQ ID NO: 9504967 - DNA, 23 bp, Homo sapiens
cagagctggcttcatgggtgtgc

SEQ ID NO: 9504968 - DNA, 22 bp, Homo sapiens
cagagctgggatcccatgggcg

SEQ ID NO: 9504969 - DNA, 23 bp, Homo sapiens
cagagctggcttcatgggtgtgc

SEQ ID NO: 9504970 - DNA, 22 bp, Homo sapiens
gggctgagtcatctggggcctc

SEQ ID NO: 9504971 - DNA, 22 bp, Homo sapiens
gggctgagtcatctggggcctc

SEQ ID NO: 9504972 - DNA, 22 bp, Homo sapiens
gggctgagtcatctggggcctc

SEQ ID NO: 9504973 - DNA, 22 bp, Homo sapiens
gggctgaggggtatctcatggg

SEQ ID NO: 9504974 - DNA, 22 bp, Homo sapiens
gggctgaggggtatctcatggg

SEQ ID NO: 9504975 - DNA, 22 bp, Homo sapiens
gggctgagtctgctgcctgtca

SEQ ID NO: 9504976 - DNA, 22 bp, Homo sapiens
gggctgagtcatctggggcctc

SEQ ID NO: 9504977 - DNA, 22 bp, Homo sapiens
gggctgagtcatctggggcctc

SEQ ID NO: 9504978 - DNA, 22 bp, Homo sapiens
gggctgagtgacctcaggccaa

SEQ ID NO: 9504979 - DNA, 22 bp, Homo sapiens
gggctgagtgacctcaggccaa

SEQ ID NO: 9504980 - DNA, 22 bp, Homo sapiens
cagaggcaaaagaggtggaggt

SEQ ID NO: 9504981 - DNA, 22 bp, Homo sapiens
cagaggcacaagaaagcaaggc

SEQ ID NO: 9504982 - DNA, 20 bp, Homo sapiens
cagaggcaaggagacttgga

SEQ ID NO: 9504983 - DNA, 20 bp, Homo sapiens
cagaggcaaggagacttgga

SEQ ID NO: 9504984 - DNA, 20 bp, Homo sapiens
cagaggcaaggagacttgga

SEQ ID NO: 9504985 - DNA, 20 bp, Homo sapiens
cagaggcaaggagacttgga

SEQ ID NO: 9504986 - DNA, 22 bp, Homo sapiens
cagaggacttcccactcatctg

SEQ ID NO: 9504987 - DNA, 22 bp, Homo sapiens
cagaggacttcccactcatctg

SEQ ID NO: 9504988 - DNA, 22 bp, Homo sapiens
cagaggagaattgcgggatcat

SEQ ID NO: 9504989 - DNA, 22 bp, Homo sapiens
cagaggagaattgcgggatcat

SEQ ID NO: 9504990 - DNA, 22 bp, Homo sapiens
cagaggattccctagtgacctg

SEQ ID NO: 9504991 - DNA, 22 bp, Homo sapiens
cagaggattccctagtgacctg

SEQ ID NO: 9504992 - DNA, 22 bp, Homo sapiens
cagaggcaaaagaggtggaggt

SEQ ID NO: 9504993 - DNA, 22 bp, Homo sapiens
cagaggcaaaagaggtggaggt

SEQ ID NO: 9504994 - DNA, 22 bp, Homo sapiens
cagaggatgatctggcctctct

SEQ ID NO: 9504995 - DNA, 22 bp, Homo sapiens
cagaggatgatctggcctctct

SEQ ID NO: 9504996 - DNA, 22 bp, Homo sapiens
gtccctgggggtttaggactca

SEQ ID NO: 9504997 - DNA, 22 bp, Homo sapiens
gtccctgggtagctcagtggct

SEQ ID NO: 9504998 - DNA, 22 bp, Homo sapiens
gtccctgggtctaaggcagtaa

SEQ ID NO: 9504999 - DNA, 22 bp, Homo sapiens
gtccctgggtctaaggcagtaa

SEQ ID NO: 9505000 - DNA, 22 bp, Homo sapiens
gtccctggtctaccgtggcttc

SEQ ID NO: 9505001 - DNA, 22 bp, Homo sapiens
gtccctggtttgcccaggacca

SEQ ID NO: 9505002 - DNA, 22 bp, Homo sapiens
gtccctgggtctaaggcagtaa

SEQ ID NO: 9505003 - DNA, 19 bp, Homo sapiens
gtcccttcactcctgctgg

SEQ ID NO: 9505004 - DNA, 19 bp, Homo sapiens
gtcccttcactcctgctgg

SEQ ID NO: 9505005 - DNA, 22 bp, Homo sapiens
gtctcttctttgccggtcctgc

SEQ ID NO: 9505006 - DNA, 22 bp, Homo sapiens
gtcccttcctcattccacttta

SEQ ID NO: 9505007 - DNA, 22 bp, Homo sapiens
gtcccttcctcattccacttta

SEQ ID NO: 9505008 - DNA, 22 bp, Homo sapiens
gtctcttttatggtgagttgat

SEQ ID NO: 9505009 - DNA, 22 bp, Homo sapiens
gtccctggatctgggacagctg

SEQ ID NO: 9505010 - DNA, 22 bp, Homo sapiens
gtcccagggaagaaggcagcac

SEQ ID NO: 9505011 - DNA, 22 bp, Homo sapiens
gtcccaggcttatgtggagctt

SEQ ID NO: 9505012 - DNA, 19 bp, Homo sapiens
gtccctgggcagaggcacc

SEQ ID NO: 9505013 - DNA, 22 bp, Homo sapiens
gtccctgggaaaggagagggca

SEQ ID NO: 9505014 - DNA, 22 bp, Homo sapiens
gtccctgggcgcctccgtgctc

SEQ ID NO: 9505015 - DNA, 22 bp, Homo sapiens
gtccctgggcgcctccgtgctc

SEQ ID NO: 9505016 - DNA, 22 bp, Homo sapiens
gtctggaagaacctgtgccagt

SEQ ID NO: 9505017 - DNA, 22 bp, Homo sapiens
gtctggacagcagcacctcggc

SEQ ID NO: 9505018 - DNA, 22 bp, Homo sapiens
gtctggactttatcccaaggtt

SEQ ID NO: 9505019 - DNA, 22 bp, Homo sapiens
gtctggagagctgagcagagtt

SEQ ID NO: 9505020 - DNA, 22 bp, Homo sapiens
gtctggagagctgagcagagtt

SEQ ID NO: 9505021 - DNA, 22 bp, Homo sapiens
gtctggagacttgggtcatcaa

SEQ ID NO: 9505022 - DNA, 22 bp, Homo sapiens
gtctggagacttgggtcatcaa

SEQ ID NO: 9505023 - DNA, 22 bp, Homo sapiens
gtctggagacttgggtcatcaa

SEQ ID NO: 9505024 - DNA, 22 bp, Homo sapiens
gtctggagccccagtcaatgag

SEQ ID NO: 9505025 - DNA, 22 bp, Homo sapiens
gtctggagccccagtcaatgag

SEQ ID NO: 9505026 - DNA, 22 bp, Homo sapiens
gtctggagccaccctaagcatt

SEQ ID NO: 9505027 - DNA, 22 bp, Homo sapiens
gtctggagccactgctgctgct

SEQ ID NO: 9505028 - DNA, 22 bp, Homo sapiens
cagccaggcctggtgaccaaag

SEQ ID NO: 9505029 - DNA, 22 bp, Homo sapiens
cagccaggcccccgagtcgttg

SEQ ID NO: 9505030 - DNA, 22 bp, Homo sapiens
cagccaggcctggtgaccaaag

SEQ ID NO: 9505031 - DNA, 22 bp, Homo sapiens
cagccaggcctggtgaccaaag

SEQ ID NO: 9505032 - DNA, 22 bp, Homo sapiens
cagccaggcctggtgaccaaag

SEQ ID NO: 9505033 - DNA, 22 bp, Homo sapiens
cagccagggagcaaagagttga

SEQ ID NO: 9505034 - DNA, 22 bp, Homo sapiens
cagccaggcctggtgaccaaag

SEQ ID NO: 9505035 - DNA, 22 bp, Homo sapiens
cagccagggagcaaagagttga

SEQ ID NO: 9505036 - DNA, 22 bp, Homo sapiens
cagccagggagggcaaatgaga

SEQ ID NO: 9505037 - DNA, 22 bp, Homo sapiens
cagccaggttcaagtccttata

SEQ ID NO: 9505038 - DNA, 22 bp, Homo sapiens
cagccaggttagtgctaattgt

SEQ ID NO: 9505039 - DNA, 22 bp, Homo sapiens
cagcccaggctcagatgttggg

SEQ ID NO: 9505040 - DNA, 22 bp, Homo sapiens
cagcccaggctcagatgttggg

SEQ ID NO: 9505041 - DNA, 22 bp, Homo sapiens
cagcccaggctcagatgttggg

SEQ ID NO: 9505042 - DNA, 22 bp, Homo sapiens
cagccaggtatgggcgtgcggg

SEQ ID NO: 9505043 - DNA, 22 bp, Homo sapiens
cagccagggagggcaaatgaga

SEQ ID NO: 9505044 - DNA, 22 bp, Homo sapiens
cagccagggagggcaaatgaga

SEQ ID NO: 9505045 - DNA, 22 bp, Homo sapiens
cagccagggagggcaaatgaga

SEQ ID NO: 9505046 - DNA, 22 bp, Homo sapiens
cagccagggtcaggcagcttct

SEQ ID NO: 9505047 - DNA, 22 bp, Homo sapiens
cagccaggggctggcgtgttga

SEQ ID NO: 9505048 - DNA, 22 bp, Homo sapiens
cagccagggtcaggcagcttct

SEQ ID NO: 9505049 - DNA, 22 bp, Homo sapiens
cagccagggtcaggcagcttct

SEQ ID NO: 9505050 - DNA, 22 bp, Homo sapiens
cagcccctcacagagctgtcct

SEQ ID NO: 9505051 - DNA, 22 bp, Homo sapiens
cagccccatggtgtgctccagc

SEQ ID NO: 9505052 - DNA, 22 bp, Homo sapiens
cagccccatggtgtgctccagc

SEQ ID NO: 9505053 - DNA, 22 bp, Homo sapiens
cagcccctcacagagctgtcct

SEQ ID NO: 9505054 - DNA, 22 bp, Homo sapiens
cagcccctcacagagctgtcct

SEQ ID NO: 9505055 - DNA, 22 bp, Homo sapiens
cagcccctcacagagctgtcct

SEQ ID NO: 9505056 - DNA, 22 bp, Homo sapiens
cagcccctccctcaggcaggtg

SEQ ID NO: 9505057 - DNA, 22 bp, Homo sapiens
cagcccctggcgcacgccgagc

SEQ ID NO: 9505058 - DNA, 22 bp, Homo sapiens
cagcccgccctgaactttcggg

SEQ ID NO: 9505059 - DNA, 22 bp, Homo sapiens
cagccccttcctggcatctgga

SEQ ID NO: 9505060 - DNA, 22 bp, Homo sapiens
cagccccttcctggcatctgga

SEQ ID NO: 9505061 - DNA, 22 bp, Homo sapiens
cagccctcaaaccacttccagg

SEQ ID NO: 9505062 - DNA, 22 bp, Homo sapiens
cagccctcaggtcctcagcagc

SEQ ID NO: 9505063 - DNA, 22 bp, Homo sapiens
cagccctcaggtcctcagcagc

SEQ ID NO: 9505064 - DNA, 22 bp, Homo sapiens
cagccctcatcccgcctgcgtt

SEQ ID NO: 9505065 - DNA, 22 bp, Homo sapiens
cagccctcatcccgcctgcgtt

SEQ ID NO: 9505066 - DNA, 22 bp, Homo sapiens
gtctgtacccacgtcctgctag

SEQ ID NO: 9505067 - DNA, 22 bp, Homo sapiens
gtctgtagatattcactccttc

SEQ ID NO: 9505068 - DNA, 22 bp, Homo sapiens
gtctgtccatcagcaaaggctt

SEQ ID NO: 9505069 - DNA, 22 bp, Homo sapiens
gtctgtatcagaggagtgaatg

SEQ ID NO: 9505070 - DNA, 22 bp, Homo sapiens
gtctgtgcttattcagcagggg

SEQ ID NO: 9505071 - DNA, 22 bp, Homo sapiens
gtctgtgcagttactagctggt

SEQ ID NO: 9505072 - DNA, 19 bp, Homo sapiens
gtctgtgtatttgttgctg

SEQ ID NO: 9505073 - DNA, 22 bp, Homo sapiens
gtctgtgtgcacagagctttgg

SEQ ID NO: 9505074 - DNA, 22 bp, Homo sapiens
gtctgtgggccaaatacagccc

SEQ ID NO: 9505075 - DNA, 22 bp, Homo sapiens
gtctgtgtgcacagcgagtgcc

SEQ ID NO: 9505076 - DNA, 22 bp, Homo sapiens
gtctgtgtgcacagcgagtgcc

SEQ ID NO: 9505077 - DNA, 22 bp, Homo sapiens
gtctgtgtgcacagcgagtgcc

SEQ ID NO: 9505078 - DNA, 18 bp, Homo sapiens
gtctgtgtggcttgggga

SEQ ID NO: 9505079 - DNA, 22 bp, Homo sapiens
cagccctgaaacaacctcctct

SEQ ID NO: 9505080 - DNA, 18 bp, Homo sapiens
gtctgtgtggcttgggga

SEQ ID NO: 9505081 - DNA, 22 bp, Homo sapiens
cagcaggaaagacatctgagca

SEQ ID NO: 9505082 - DNA, 22 bp, Homo sapiens
cagcaggaaggtttcccctgca

SEQ ID NO: 9505083 - DNA, 22 bp, Homo sapiens
cagcaggaaggtttcccctgca

SEQ ID NO: 9505084 - DNA, 20 bp, Homo sapiens
cagcaggaaaagtgcctcag

SEQ ID NO: 9505085 - DNA, 20 bp, Homo sapiens
cagcaggaaaagtgcctcag

SEQ ID NO: 9505086 - DNA, 20 bp, Homo sapiens
cagcaggaaaagtgcctcag

SEQ ID NO: 9505087 - DNA, 22 bp, Homo sapiens
cagcaggaaacttaaaggtaat

SEQ ID NO: 9505088 - DNA, 22 bp, Homo sapiens
cagcaggaaacttaaaggtaat

SEQ ID NO: 9505089 - DNA, 22 bp, Homo sapiens
cagcaggaaaatcaattctgtg

SEQ ID NO: 9505090 - DNA, 22 bp, Homo sapiens
gtcagcctgcactcagggagcg

SEQ ID NO: 9505091 - DNA, 22 bp, Homo sapiens
gtcataaagacagaaacattcc

SEQ ID NO: 9505092 - DNA, 22 bp, Homo sapiens
gtcataaagacagaaacattcc

SEQ ID NO: 9505093 - DNA, 22 bp, Homo sapiens
cagcaggacatggaggagtaaa

SEQ ID NO: 9505094 - DNA, 22 bp, Homo sapiens
cagcaggaagtactagctttga

SEQ ID NO: 9505095 - DNA, 22 bp, Homo sapiens
cagcaggacatggaggagtaaa

SEQ ID NO: 9505096 - DNA, 22 bp, Homo sapiens
cagcagctggttatacctgtgg

SEQ ID NO: 9505097 - DNA, 22 bp, Homo sapiens
cagcagctggttatacctgtgg

SEQ ID NO: 9505098 - DNA, 22 bp, Homo sapiens
cagcagctggttgaatccttct

SEQ ID NO: 9505099 - DNA, 22 bp, Homo sapiens
cagcagctggttgaatccttct

SEQ ID NO: 9505100 - DNA, 22 bp, Homo sapiens
cagcagctgtttacggaacacc

SEQ ID NO: 9505101 - DNA, 22 bp, Homo sapiens
cagcagctggtgagacacagcc

SEQ ID NO: 9505102 - DNA, 22 bp, Homo sapiens
cagcagctggtgagacacagcc

SEQ ID NO: 9505103 - DNA, 22 bp, Homo sapiens
cagcagctggtgagacacagcc

SEQ ID NO: 9505104 - DNA, 22 bp, Homo sapiens
cagcagcttctgttgatcagaa

SEQ ID NO: 9505105 - DNA, 22 bp, Homo sapiens
cagcagctttgccaagtcagcc

SEQ ID NO: 9505106 - DNA, 22 bp, Homo sapiens
cagcagcttctgttgatcagaa

SEQ ID NO: 9505107 - DNA, 22 bp, Homo sapiens
cagcagctttgccaagtcagcc

SEQ ID NO: 9505108 - DNA, 22 bp, Homo sapiens
cagcagcttttgcattctcatt

SEQ ID NO: 9505109 - DNA, 22 bp, Homo sapiens
cagcagctttgccaagtcagcc

SEQ ID NO: 9505110 - DNA, 22 bp, Homo sapiens
cagcagcttttgcattctcatt

SEQ ID NO: 9505111 - DNA, 20 bp, Homo sapiens
cagcaggaaaagtgcctcag

SEQ ID NO: 9505112 - DNA, 22 bp, Homo sapiens
cagcagcttttgcattctcatt

SEQ ID NO: 9505113 - DNA, 22 bp, Homo sapiens
cagcaccattttcctggtcagc

SEQ ID NO: 9505114 - DNA, 22 bp, Homo sapiens
cagcaccattttcctggtcagc

SEQ ID NO: 9505115 - DNA, 22 bp, Homo sapiens
cagcacccctcctggctatgaa

SEQ ID NO: 9505116 - DNA, 22 bp, Homo sapiens
cagcaccctcggaggctgccgt

SEQ ID NO: 9505117 - DNA, 22 bp, Homo sapiens
cagcaccctttccactgccttg

SEQ ID NO: 9505118 - DNA, 22 bp, Homo sapiens
cagcaccctttccactgccttg

SEQ ID NO: 9505119 - DNA, 22 bp, Homo sapiens
cagcacctacccatcctgagtc

SEQ ID NO: 9505120 - DNA, 22 bp, Homo sapiens
cagcacctaggacagtagtcag

SEQ ID NO: 9505121 - DNA, 22 bp, Homo sapiens
cagcagctacttggagcagcag

SEQ ID NO: 9505122 - DNA, 22 bp, Homo sapiens
cagcagctagaggaagggcaga

SEQ ID NO: 9505123 - DNA, 22 bp, Homo sapiens
cagcacctgttagcattaaata

SEQ ID NO: 9505124 - DNA, 22 bp, Homo sapiens
cagcacctggcacaggagggcc

SEQ ID NO: 9505125 - DNA, 22 bp, Homo sapiens
cagcaccttccttaactccagg

SEQ ID NO: 9505126 - DNA, 22 bp, Homo sapiens
cagcaccttcctatccaggaga

SEQ ID NO: 9505127 - DNA, 22 bp, Homo sapiens
cagcagctgatggggaagtgat

SEQ ID NO: 9505128 - DNA, 22 bp, Homo sapiens
cagcagctgatggggaagtgat

SEQ ID NO: 9505129 - DNA, 23 bp, Homo sapiens
cagcagctgcctggttttttggt

SEQ ID NO: 9505130 - DNA, 22 bp, Homo sapiens
cagcagctgcctcagctgggga

SEQ ID NO: 9505131 - DNA, 22 bp, Homo sapiens
cagcagctgcctcagctgggga

SEQ ID NO: 9505132 - DNA, 22 bp, Homo sapiens
cagcagctgcaaatggaaacag

SEQ ID NO: 9505133 - DNA, 22 bp, Homo sapiens
cagcagctgcctcagctgggga

SEQ ID NO: 9505134 - DNA, 22 bp, Homo sapiens
cagcagctgggaaggaggctga

SEQ ID NO: 9505135 - DNA, 22 bp, Homo sapiens
cagcagctgggaaggaggctga

SEQ ID NO: 9505136 - DNA, 22 bp, Homo sapiens
cagcagctggtgagacacagcc

SEQ ID NO: 9505137 - DNA, 22 bp, Homo sapiens
cagcagctgcgtgcccaggccg

SEQ ID NO: 9505138 - DNA, 22 bp, Homo sapiens
cagcagctgcgtgcccaggccg

SEQ ID NO: 9505139 - DNA, 22 bp, Homo sapiens
cagcagctgcgtgcccaggccg

SEQ ID NO: 9505140 - DNA, 22 bp, Homo sapiens
gtcatcttaaggactgctatag

SEQ ID NO: 9505141 - DNA, 22 bp, Homo sapiens
gtcatattgaagaagactggca

SEQ ID NO: 9505142 - DNA, 22 bp, Homo sapiens
gtcatattataaatgttctgtt

SEQ ID NO: 9505143 - DNA, 22 bp, Homo sapiens
gtcatatacactgcatgtaatc

SEQ ID NO: 9505144 - DNA, 22 bp, Homo sapiens
gtcatagtagtggaacagcagc

SEQ ID NO: 9505145 - DNA, 22 bp, Homo sapiens
gtcataggttcaaaaggcagat

SEQ ID NO: 9505146 - DNA, 22 bp, Homo sapiens
gtcataatcacagttttatgca

SEQ ID NO: 9505147 - DNA, 22 bp, Homo sapiens
gtcatgtgaaatttggcaggcc

SEQ ID NO: 9505148 - DNA, 22 bp, Homo sapiens
gtcatgtgaataagtgtggggt

SEQ ID NO: 9505149 - DNA, 22 bp, Homo sapiens
gtcatgtgacccaacctgagcc

SEQ ID NO: 9505150 - DNA, 22 bp, Homo sapiens
gtcatggtgctagcgggaatgt

SEQ ID NO: 9505151 - DNA, 22 bp, Homo sapiens
gtcatggaggattgtgagtggt

SEQ ID NO: 9505152 - DNA, 22 bp, Homo sapiens
cagcaggcggcccgcgggcccg

SEQ ID NO: 9505153 - DNA, 20 bp, Homo sapiens
cagcaggctatggggcaccc

SEQ ID NO: 9505154 - DNA, 22 bp, Homo sapiens
cagcaggctgcgattgctcatt

SEQ ID NO: 9505155 - DNA, 22 bp, Homo sapiens
cagcaggctgcgattgctcatt

SEQ ID NO: 9505156 - DNA, 22 bp, Homo sapiens
cagcaggctgcgattgctcatt

SEQ ID NO: 9505157 - DNA, 22 bp, Homo sapiens
cagcaggctctgagtggctgcc

SEQ ID NO: 9505158 - DNA, 22 bp, Homo sapiens
cagcaggctctgagtggctgcc

SEQ ID NO: 9505159 - DNA, 22 bp, Homo sapiens
cagcaggctctgagtggctgcc

SEQ ID NO: 9505160 - DNA, 22 bp, Homo sapiens
cagcaggctggacttcagtccc

SEQ ID NO: 9505161 - DNA, 22 bp, Homo sapiens
cagcaggctggacttcagtccc

SEQ ID NO: 9505162 - DNA, 22 bp, Homo sapiens
cagcaggctgcgattgctcatt

SEQ ID NO: 9505163 - DNA, 22 bp, Homo sapiens
cagcaggctgtggaaatcctgg

SEQ ID NO: 9505164 - DNA, 22 bp, Homo sapiens
cagcaggctgtggaaatcctgg

SEQ ID NO: 9505165 - DNA, 22 bp, Homo sapiens
gtccagccagctggtccttgcc

SEQ ID NO: 9505166 - DNA, 22 bp, Homo sapiens
gtccagccaccctggaggcacg

SEQ ID NO: 9505167 - DNA, 22 bp, Homo sapiens
gtccagccactcaccttccagc

SEQ ID NO: 9505168 - DNA, 22 bp, Homo sapiens
gtccagccagctggtccttgcc

SEQ ID NO: 9505169 - DNA, 22 bp, Homo sapiens
gtcccagaaacatattgctggt

SEQ ID NO: 9505170 - DNA, 22 bp, Homo sapiens
gtcccaggaacattctggctag

SEQ ID NO: 9505171 - DNA, 22 bp, Homo sapiens
gtcccaggaacattctggctag

SEQ ID NO: 9505172 - DNA, 22 bp, Homo sapiens
gtcccaggaacattctggctag

SEQ ID NO: 9505173 - DNA, 22 bp, Homo sapiens
gtcccagcttcccactagcagc

SEQ ID NO: 9505174 - DNA, 22 bp, Homo sapiens
gtcccagaggacagggtcacat

SEQ ID NO: 9505175 - DNA, 22 bp, Homo sapiens
gtcccagagagcactagtccat

SEQ ID NO: 9505176 - DNA, 22 bp, Homo sapiens
gtcccagaggctttggccacag

SEQ ID NO: 9505177 - DNA, 22 bp, Homo sapiens
gtcccagatgtctggaactccc

SEQ ID NO: 9505178 - DNA, 22 bp, Homo sapiens
gtcccaggcagagtcaggaggg

SEQ ID NO: 9505179 - DNA, 22 bp, Homo sapiens
gtcccaggagttgctgggcctt

SEQ ID NO: 9505180 - DNA, 22 bp, Homo sapiens
gtcccaggcagagtcaggaggg

SEQ ID NO: 9505181 - DNA, 22 bp, Homo sapiens
gtcccaggctccatggcagcca

SEQ ID NO: 9505182 - DNA, 22 bp, Homo sapiens
gtgccctccgtgttcatagagc

SEQ ID NO: 9505183 - DNA, 22 bp, Homo sapiens
gtgccctcctgaagccatcaca

SEQ ID NO: 9505184 - DNA, 21 bp, Homo sapiens
gtgcccgtcccaggagccgac

SEQ ID NO: 9505185 - DNA, 22 bp, Homo sapiens
gtgctgagtagaatgaatgcct

SEQ ID NO: 9505186 - DNA, 20 bp, Homo sapiens
gtgctgagtgaaatgagatt

SEQ ID NO: 9505187 - DNA, 22 bp, Homo sapiens
gtgctgtgcgctttttctgtat

SEQ ID NO: 9505188 - DNA, 22 bp, Homo sapiens
gtgcccagttgaggccaggact

SEQ ID NO: 9505189 - DNA, 22 bp, Homo sapiens
gtgcccagttgaggccaggact

SEQ ID NO: 9505190 - DNA, 22 bp, Homo sapiens
gtgcccagttgaggccaggact

SEQ ID NO: 9505191 - DNA, 22 bp, Homo sapiens
gtgcccagttgaggccaggact

SEQ ID NO: 9505192 - DNA, 22 bp, Homo sapiens
gtgcccagttgaggccaggact

SEQ ID NO: 9505193 - DNA, 22 bp, Homo sapiens
gtgcccagtgcaggcccgcagg

SEQ ID NO: 9505194 - DNA, 22 bp, Homo sapiens
gtgcccagtgcaggcccgcagg

SEQ ID NO: 9505195 - DNA, 22 bp, Homo sapiens
gtgccccagacacgcatgtggg

SEQ ID NO: 9505196 - DNA, 20 bp, Homo sapiens
gtgcccagttggtgacagac

SEQ ID NO: 9505197 - DNA, 20 bp, Homo sapiens
gtgcccagttggtgacagac

SEQ ID NO: 9505198 - DNA, 20 bp, Homo sapiens
gtgcccagttggtgacagac

SEQ ID NO: 9505199 - DNA, 20 bp, Homo sapiens
gtgcccagttggtgacagac

SEQ ID NO: 9505200 - DNA, 18 bp, Homo sapiens
gtgctgtgggcagtggcc

SEQ ID NO: 9505201 - DNA, 18 bp, Homo sapiens
gtgctgtgggcagtggcc

SEQ ID NO: 9505202 - DNA, 18 bp, Homo sapiens
gtgctgtgggcagtggcc

SEQ ID NO: 9505203 - DNA, 22 bp, Homo sapiens
gtgctgtgcgctttttctgtat

SEQ ID NO: 9505204 - DNA, 22 bp, Homo sapiens
gtgctgtgtgatccatgctggc

SEQ ID NO: 9505205 - DNA, 22 bp, Homo sapiens
gtgctgtgtgatccatgctggc

SEQ ID NO: 9505206 - DNA, 22 bp, Homo sapiens
cagcctgagccttctgtagcaa

SEQ ID NO: 9505207 - DNA, 22 bp, Homo sapiens
cagcctgagccttctgtagcaa

SEQ ID NO: 9505208 - DNA, 22 bp, Homo sapiens
cagcctgactatggctgcaggt

SEQ ID NO: 9505209 - DNA, 22 bp, Homo sapiens
cagcctgactatggctgcaggt

SEQ ID NO: 9505210 - DNA, 22 bp, Homo sapiens
cagcctctttccacatcaggca

SEQ ID NO: 9505211 - DNA, 22 bp, Homo sapiens
cagcctgactatggctgcaggt

SEQ ID NO: 9505212 - DNA, 22 bp, Homo sapiens
cagcctgactatggctgcaggt

SEQ ID NO: 9505213 - DNA, 22 bp, Homo sapiens
cagcctgacaccagctttgggc

SEQ ID NO: 9505214 - DNA, 22 bp, Homo sapiens
cagcctgactatggctgcaggt

SEQ ID NO: 9505215 - DNA, 22 bp, Homo sapiens
cagcctgcctcagtttccctct

SEQ ID NO: 9505216 - DNA, 22 bp, Homo sapiens
cagcctgcagggctgcctgttg

SEQ ID NO: 9505217 - DNA, 16 bp, Homo sapiens
cagcctgcagtggtca

SEQ ID NO: 9505218 - DNA, 23 bp, Homo sapiens
cagccctggagatgtgggaggca

SEQ ID NO: 9505219 - DNA, 22 bp, Homo sapiens
cagccctggaacagctgactca

SEQ ID NO: 9505220 - DNA, 23 bp, Homo sapiens
cagccctggagatgtgggaggca

SEQ ID NO: 9505221 - DNA, 22 bp, Homo sapiens
cagccctggaacagctgactca

SEQ ID NO: 9505222 - DNA, 22 bp, Homo sapiens
cagccctggaacagctgactca

SEQ ID NO: 9505223 - DNA, 22 bp, Homo sapiens
cagccctgcttccccgctagtt

SEQ ID NO: 9505224 - DNA, 22 bp, Homo sapiens
cagccctggaacagctgactca

SEQ ID NO: 9505225 - DNA, 22 bp, Homo sapiens
cagccctggaacagctgactca

SEQ ID NO: 9505226 - DNA, 20 bp, Homo sapiens
cagcctccactcactcagct

SEQ ID NO: 9505227 - DNA, 20 bp, Homo sapiens
cagcctccactcactcagct

SEQ ID NO: 9505228 - DNA, 22 bp, Homo sapiens
cagcctctttccacatcaggca

SEQ ID NO: 9505229 - DNA, 20 bp, Homo sapiens
cagcctccactcactcagct

SEQ ID NO: 9505230 - DNA, 22 bp, Homo sapiens
cagccctggcccaggtgcctta

SEQ ID NO: 9505231 - DNA, 22 bp, Homo sapiens
cagccctggcagctttcagggt

SEQ ID NO: 9505232 - DNA, 22 bp, Homo sapiens
cagccctgcttccccgctagtt

SEQ ID NO: 9505233 - DNA, 22 bp, Homo sapiens
cagccctgcttccccgctagtt

SEQ ID NO: 9505234 - DNA, 22 bp, Homo sapiens
cagccctgcttccccgctagtt

SEQ ID NO: 9505235 - DNA, 22 bp, Homo sapiens
cagccctgcttccccgctagtt

SEQ ID NO: 9505236 - DNA, 22 bp, Homo sapiens
cagccctgctggcaatgatgag

SEQ ID NO: 9505237 - DNA, 22 bp, Homo sapiens
cagccctgctggttttgggcaa

SEQ ID NO: 9505238 - DNA, 22 bp, Homo sapiens
cagccctgcttccccgctagtt

SEQ ID NO: 9505239 - DNA, 22 bp, Homo sapiens
cagccctgctcttagtgtctcc

SEQ ID NO: 9505240 - DNA, 22 bp, Homo sapiens
cagccctgctcttagtgtctcc

SEQ ID NO: 9505241 - DNA, 22 bp, Homo sapiens
cagccctgctcttagtgtctcc

SEQ ID NO: 9505242 - DNA, 22 bp, Homo sapiens
cagccctgctgacactgtctga

SEQ ID NO: 9505243 - DNA, 22 bp, Homo sapiens
cagccctgctgccttagtgcct

SEQ ID NO: 9505244 - DNA, 17 bp, Homo sapiens
cagccctgccgttccca

SEQ ID NO: 9505245 - DNA, 17 bp, Homo sapiens
cagccctgccgttccca

SEQ ID NO: 9505246 - DNA, 22 bp, Homo sapiens
cagccctgcggaggtgtatact

SEQ ID NO: 9505247 - DNA, 22 bp, Homo sapiens
cagccctgcggaggtgtatact

SEQ ID NO: 9505248 - DNA, 22 bp, Homo sapiens
cagccctgcggaggtgtatact

SEQ ID NO: 9505249 - DNA, 22 bp, Homo sapiens
cagccctgccatggagcctcct

SEQ ID NO: 9505250 - DNA, 22 bp, Homo sapiens
cagccctgccatggagcctcct

SEQ ID NO: 9505251 - DNA, 22 bp, Homo sapiens
cagccctgccatggagcctcct

SEQ ID NO: 9505252 - DNA, 22 bp, Homo sapiens
cagccctgccatggagcctcct

SEQ ID NO: 9505253 - DNA, 23 bp, Homo sapiens
cagccctgaaatcgaggtgacac

SEQ ID NO: 9505254 - DNA, 22 bp, Homo sapiens
cagccctgaaacaacctcctct

SEQ ID NO: 9505255 - DNA, 22 bp, Homo sapiens
cagccctgcagccatggcctgt

SEQ ID NO: 9505256 - DNA, 22 bp, Homo sapiens
cagccctgcagccatggcctgt

SEQ ID NO: 9505257 - DNA, 22 bp, Homo sapiens
cagccctgcagccatggcctgt

SEQ ID NO: 9505258 - DNA, 22 bp, Homo sapiens
cagccctgcagctggatctcac

SEQ ID NO: 9505259 - DNA, 22 bp, Homo sapiens
cagccctgcagctggatctcac

SEQ ID NO: 9505260 - DNA, 22 bp, Homo sapiens
cagccctgcagctggatctcac

SEQ ID NO: 9505261 - DNA, 22 bp, Homo sapiens
cagcctggacagcgaccagagt

SEQ ID NO: 9505262 - DNA, 22 bp, Homo sapiens
cagcctggagccacagcccagg

SEQ ID NO: 9505263 - DNA, 22 bp, Homo sapiens
cagcctggagccacagcccagg

SEQ ID NO: 9505264 - DNA, 22 bp, Homo sapiens
cagcctggagccacagcccagg

SEQ ID NO: 9505265 - DNA, 22 bp, Homo sapiens
cagcctggagccacagcccagg

SEQ ID NO: 9505266 - DNA, 22 bp, Homo sapiens
cagcctggattgcagaatgcta

SEQ ID NO: 9505267 - DNA, 22 bp, Homo sapiens
cagcctggattgcagaatgcta

SEQ ID NO: 9505268 - DNA, 22 bp, Homo sapiens
cagcctggattgcagaatgcta

SEQ ID NO: 9505269 - DNA, 22 bp, Homo sapiens
cagcctggattgcagaatgcta

SEQ ID NO: 9505270 - DNA, 22 bp, Homo sapiens
cagcctggacagcgaccagagt

SEQ ID NO: 9505271 - DNA, 22 bp, Homo sapiens
cagcctggacagcgaccagagt

SEQ ID NO: 9505272 - DNA, 22 bp, Homo sapiens
cagcctggacagcgaccagagt

SEQ ID NO: 9505273 - DNA, 21 bp, Homo sapiens
cagcctgctgctccagggcca

SEQ ID NO: 9505274 - DNA, 22 bp, Homo sapiens
cagcctgctagggcaatgcctt

SEQ ID NO: 9505275 - DNA, 22 bp, Homo sapiens
cagcctgtagtctggtccaggt

SEQ ID NO: 9505276 - DNA, 22 bp, Homo sapiens
cagcctgtggcagaggtctaat

SEQ ID NO: 9505277 - DNA, 22 bp, Homo sapiens
cagcctgtggcagaggtctaat

SEQ ID NO: 9505278 - DNA, 22 bp, Homo sapiens
cagcctggtccccggctcaccc

SEQ ID NO: 9505279 - DNA, 22 bp, Homo sapiens
cagcctggtccccggctcaccc

SEQ ID NO: 9505280 - DNA, 22 bp, Homo sapiens
cagcctggcctgggactgctga

SEQ ID NO: 9505281 - DNA, 22 bp, Homo sapiens
cagcctgggctccagagtccct

SEQ ID NO: 9505282 - DNA, 22 bp, Homo sapiens
cagcctggcctgggactgctga

SEQ ID NO: 9505283 - DNA, 22 bp, Homo sapiens
cagcctggcctgggactgctga

SEQ ID NO: 9505284 - DNA, 22 bp, Homo sapiens
cagcctgggctccagagtccct

SEQ ID NO: 9505285 - DNA, 22 bp, Homo sapiens
cagcctggtccccggctcaccc

SEQ ID NO: 9505286 - DNA, 22 bp, Homo sapiens
cagcctgggctccagagtccct

SEQ ID NO: 9505287 - DNA, 22 bp, Homo sapiens
gtgcccagtcctgccttgacag

SEQ ID NO: 9505288 - DNA, 22 bp, Homo sapiens
gtgcccagtcctgccttgacag

SEQ ID NO: 9505289 - DNA, 22 bp, Homo sapiens
cagctattattttctctaaatt

SEQ ID NO: 9505290 - DNA, 22 bp, Homo sapiens
cagctattccaggagtagaatc

SEQ ID NO: 9505291 - DNA, 22 bp, Homo sapiens
gtgcccaggtgtccctgagaag

SEQ ID NO: 9505292 - DNA, 22 bp, Homo sapiens
gtgcccagtaaatgaaagcttt

SEQ ID NO: 9505293 - DNA, 22 bp, Homo sapiens
gtgcccagtaaatgaaagcttt

SEQ ID NO: 9505294 - DNA, 22 bp, Homo sapiens
cagctagggagtggcagagctt

SEQ ID NO: 9505295 - DNA, 22 bp, Homo sapiens
cagctagggagtggcagagctt

SEQ ID NO: 9505296 - DNA, 22 bp, Homo sapiens
cagctagtacaatgggagagca

SEQ ID NO: 9505297 - DNA, 22 bp, Homo sapiens
cagctagtcagaggcagggcca

SEQ ID NO: 9505298 - DNA, 20 bp, Homo sapiens
cagctagtggtaggagtcgg

SEQ ID NO: 9505299 - DNA, 22 bp, Homo sapiens
cagctagagggatgctgtgtga

SEQ ID NO: 9505300 - DNA, 22 bp, Homo sapiens
cagctaccatggtttgttccag

SEQ ID NO: 9505301 - DNA, 22 bp, Homo sapiens
cagctactcctcccatgacttc

SEQ ID NO: 9505302 - DNA, 22 bp, Homo sapiens
cagctaaggctccttctaggta

SEQ ID NO: 9505303 - DNA, 22 bp, Homo sapiens
cagctacaaatacttttgtatg

SEQ ID NO: 9505304 - DNA, 22 bp, Homo sapiens
cagctacacaccagaactatta

SEQ ID NO: 9505305 - DNA, 22 bp, Homo sapiens
attcacagtttcctcatattct

SEQ ID NO: 9505306 - DNA, 20 bp, Homo sapiens
attcacatataccagggagg

SEQ ID NO: 9505307 - DNA, 22 bp, Homo sapiens
attcacagtttcctcatattct

SEQ ID NO: 9505308 - DNA, 22 bp, Homo sapiens
attcacaatgatacataagcga

SEQ ID NO: 9505309 - DNA, 19 bp, Homo sapiens
attcacatccctgggaagg

SEQ ID NO: 9505310 - DNA, 22 bp, Homo sapiens
attcacatgatgtatgtagggc

SEQ ID NO: 9505311 - DNA, 22 bp, Homo sapiens
attcacatgatgtatgtagggc

SEQ ID NO: 9505312 - DNA, 22 bp, Homo sapiens
attcacaatgatacataagcga

SEQ ID NO: 9505313 - DNA, 22 bp, Homo sapiens
gcactaaaccaacatgtaataa

SEQ ID NO: 9505314 - DNA, 22 bp, Homo sapiens
gcacgtggaatgctcatgagcc

SEQ ID NO: 9505315 - DNA, 22 bp, Homo sapiens
gcacggctaatttttgtatttt

SEQ ID NO: 9505316 - DNA, 22 bp, Homo sapiens
gcacggctaatttttgtatttt

SEQ ID NO: 9505317 - DNA, 22 bp, Homo sapiens
attcaaggtatttaaaacataa

SEQ ID NO: 9505318 - DNA, 22 bp, Homo sapiens
attcaagattaattctatgtca

SEQ ID NO: 9505319 - DNA, 22 bp, Homo sapiens
attcaagaggaacaatgaagat

SEQ ID NO: 9505320 - DNA, 22 bp, Homo sapiens
attcaaggtttattcagtttag

SEQ ID NO: 9505321 - DNA, 22 bp, Homo sapiens
attcaaggttggctcaggaatt

SEQ ID NO: 9505322 - DNA, 22 bp, Homo sapiens
gcacctggggtacacagctaca

SEQ ID NO: 9505323 - DNA, 22 bp, Homo sapiens
gcacctggggtacacagctaca

SEQ ID NO: 9505324 - DNA, 22 bp, Homo sapiens
attcaagtaaacactgaaggaa

SEQ ID NO: 9505325 - DNA, 22 bp, Homo sapiens
attcaagtacagttttcttctt

SEQ ID NO: 9505326 - DNA, 22 bp, Homo sapiens
gcacctggtttatataatcata

SEQ ID NO: 9505327 - DNA, 22 bp, Homo sapiens
gcacctggggtacacagctaca

SEQ ID NO: 9505328 - DNA, 22 bp, Homo sapiens
gcacctggtttatataatcata

SEQ ID NO: 9505329 - DNA, 22 bp, Homo sapiens
gcacctggggtacacagctaca

SEQ ID NO: 9505330 - DNA, 22 bp, Homo sapiens
gcacctggtttatataatcata

SEQ ID NO: 9505331 - DNA, 22 bp, Homo sapiens
gcacggctaatttttgtatttt

SEQ ID NO: 9505332 - DNA, 22 bp, Homo sapiens
gcacggcaagacggggcctcct

SEQ ID NO: 9505333 - DNA, 22 bp, Homo sapiens
attcacatttagcctctgacat

SEQ ID NO: 9505334 - DNA, 22 bp, Homo sapiens
attcacatttagcctctgacat

SEQ ID NO: 9505335 - DNA, 22 bp, Homo sapiens
attcacattttatttcactgga

SEQ ID NO: 9505336 - DNA, 22 bp, Homo sapiens
attcacattttatttcactgga

SEQ ID NO: 9505337 - DNA, 22 bp, Homo sapiens
attcacattttatttcactgga

SEQ ID NO: 9505338 - DNA, 22 bp, Homo sapiens
attcacatttacaaagcactca

SEQ ID NO: 9505339 - DNA, 15 bp, Homo sapiens
attcacattgcttca

SEQ ID NO: 9505340 - DNA, 15 bp, Homo sapiens
attcacattgcttca

SEQ ID NO: 9505341 - DNA, 22 bp, Homo sapiens
attcacatttacaaagcactca

SEQ ID NO: 9505342 - DNA, 22 bp, Homo sapiens
attcacatttagacatcaggta

SEQ ID NO: 9505343 - DNA, 22 bp, Homo sapiens
attcacatttagacatcaggta

SEQ ID NO: 9505344 - DNA, 22 bp, Homo sapiens
attcacatttagcctctgacat

SEQ ID NO: 9505345 - DNA, 22 bp, Homo sapiens
attcacattgagcttcactgtg

SEQ ID NO: 9505346 - DNA, 22 bp, Homo sapiens
attcacattgagcttcactgtg

SEQ ID NO: 9505347 - DNA, 22 bp, Homo sapiens
attcacattgagcttcactgtg

SEQ ID NO: 9505348 - DNA, 22 bp, Homo sapiens
attcacatgttgaagccctaac

SEQ ID NO: 9505349 - DNA, 22 bp, Homo sapiens
attcacatgttgaagccctaac

SEQ ID NO: 9505350 - DNA, 22 bp, Homo sapiens
attcacatgttgaagccctaac

SEQ ID NO: 9505351 - DNA, 22 bp, Homo sapiens
attcacattctagggccctact

SEQ ID NO: 9505352 - DNA, 22 bp, Homo sapiens
attcacattctagggccctact

SEQ ID NO: 9505353 - DNA, 22 bp, Homo sapiens
attcacatgtgcttcttatcac

SEQ ID NO: 9505354 - DNA, 22 bp, Homo sapiens
attcacatgtgcttcttatcac

SEQ ID NO: 9505355 - DNA, 22 bp, Homo sapiens
attcacatgcccaagcagcacc

SEQ ID NO: 9505356 - DNA, 22 bp, Homo sapiens
attcacatgcccaagcagcacc

SEQ ID NO: 9505357 - DNA, 22 bp, Homo sapiens
attcacatgcccaagcagcacc

SEQ ID NO: 9505358 - DNA, 21 bp, Homo sapiens
attcagaaagggaataaactc

SEQ ID NO: 9505359 - DNA, 21 bp, Homo sapiens
attcagaaagggaataaactc

SEQ ID NO: 9505360 - DNA, 22 bp, Homo sapiens
attcagaaagcaagtgctgggt

SEQ ID NO: 9505361 - DNA, 21 bp, Homo sapiens
attcagaaagggaataaactc

SEQ ID NO: 9505362 - DNA, 22 bp, Homo sapiens
attcagaagcaatcacagtgag

SEQ ID NO: 9505363 - DNA, 22 bp, Homo sapiens
attcagaaatagaaaatttgat

SEQ ID NO: 9505364 - DNA, 22 bp, Homo sapiens
attcagaaagttgtcatatttg

SEQ ID NO: 9505365 - DNA, 22 bp, Homo sapiens
attcagaaagttgtcatatttg

SEQ ID NO: 9505366 - DNA, 22 bp, Homo sapiens
attcagaaagggttgcctggtt

SEQ ID NO: 9505367 - DNA, 22 bp, Homo sapiens
attcactgtgggtcctttggat

SEQ ID NO: 9505368 - DNA, 22 bp, Homo sapiens
attcacttattctcaaagtcct

SEQ ID NO: 9505369 - DNA, 22 bp, Homo sapiens
attcagaaagatatgcctggtt

SEQ ID NO: 9505370 - DNA, 22 bp, Homo sapiens
attcagaaactctgggcagaac

SEQ ID NO: 9505371 - DNA, 22 bp, Homo sapiens
attcacctgttagtaaaaatct

SEQ ID NO: 9505372 - DNA, 22 bp, Homo sapiens
attcactgaatttcatgattat

SEQ ID NO: 9505373 - DNA, 22 bp, Homo sapiens
gcagcagagaccccaggaagga

SEQ ID NO: 9505374 - DNA, 22 bp, Homo sapiens
gcagcagagaccccaggaagga

SEQ ID NO: 9505375 - DNA, 22 bp, Homo sapiens
gcagcagagaccccaggaagga

SEQ ID NO: 9505376 - DNA, 22 bp, Homo sapiens
gcagcagagaacacaatgatgg

SEQ ID NO: 9505377 - DNA, 20 bp, Homo sapiens
gcagcagacagacaggggac

SEQ ID NO: 9505378 - DNA, 21 bp, Homo sapiens
gcagcagaggcttgacagaca

SEQ ID NO: 9505379 - DNA, 22 bp, Homo sapiens
gcagcagagtagacagagccct

SEQ ID NO: 9505380 - DNA, 21 bp, Homo sapiens
gcagcagaggcttgacagaca

SEQ ID NO: 9505381 - DNA, 22 bp, Homo sapiens
attcagactcttgagcagtccc

SEQ ID NO: 9505382 - DNA, 22 bp, Homo sapiens
gcagatgctgctcctctctaga

SEQ ID NO: 9505383 - DNA, 22 bp, Homo sapiens
attcagactatgaacacgtcag

SEQ ID NO: 9505384 - DNA, 22 bp, Homo sapiens
attcagaattttggggagctaa

SEQ ID NO: 9505385 - DNA, 23 bp, Homo sapiens
attcagaattgtgtgtttgtata

SEQ ID NO: 9505386 - DNA, 23 bp, Homo sapiens
attcagaattgtgtgtttgtata

SEQ ID NO: 9505387 - DNA, 22 bp, Homo sapiens
attcagaattgtgggcagtaca

SEQ ID NO: 9505388 - DNA, 22 bp, Homo sapiens
attcagaatggcaaacttctag

SEQ ID NO: 9505389 - DNA, 22 bp, Homo sapiens
attcagaatggcaaacttctag

SEQ ID NO: 9505390 - DNA, 22 bp, Homo sapiens
attcagaattgtgggcagtaca

SEQ ID NO: 9505391 - DNA, 22 bp, Homo sapiens
attcagaagcaatcacagtgag

SEQ ID NO: 9505392 - DNA, 22 bp, Homo sapiens
attcagaagcaatcacagtgag

SEQ ID NO: 9505393 - DNA, 22 bp, Homo sapiens
attcagaagcaatcacagtgag

SEQ ID NO: 9505394 - DNA, 22 bp, Homo sapiens
gcagcagagtttgggagatggt

SEQ ID NO: 9505395 - DNA, 22 bp, Homo sapiens
gcagcagatgctttcatggaca

SEQ ID NO: 9505396 - DNA, 22 bp, Homo sapiens
gcagcagatgctttcatggaca

SEQ ID NO: 9505397 - DNA, 22 bp, Homo sapiens
gcagcagagtagacagagccct

SEQ ID NO: 9505398 - DNA, 22 bp, Homo sapiens
gcagcagagtagacagagccct

SEQ ID NO: 9505399 - DNA, 22 bp, Homo sapiens
attcagttccttgtgattgtag

SEQ ID NO: 9505400 - DNA, 22 bp, Homo sapiens
attcagttctggctgccttcct

SEQ ID NO: 9505401 - DNA, 22 bp, Homo sapiens
attcagttctgctggttctgct

SEQ ID NO: 9505402 - DNA, 22 bp, Homo sapiens
attcagttctaaggtcagtgcc

SEQ ID NO: 9505403 - DNA, 23 bp, Homo sapiens
attcagttgtgagagaagacaca

SEQ ID NO: 9505404 - DNA, 22 bp, Homo sapiens
attcagtttcaatcattgtagt

SEQ ID NO: 9505405 - DNA, 22 bp, Homo sapiens
attcagttgtaatctttgttag

SEQ ID NO: 9505406 - DNA, 22 bp, Homo sapiens
attcagttgtctactactgcct

SEQ ID NO: 9505407 - DNA, 22 bp, Homo sapiens
attcataacggcaaatgtcacc

SEQ ID NO: 9505408 - DNA, 22 bp, Homo sapiens
attcataacggcaaatgtcacc

SEQ ID NO: 9505409 - DNA, 22 bp, Homo sapiens
attcagtttttgaagggaaatt

SEQ ID NO: 9505410 - DNA, 21 bp, Homo sapiens
attcagtttgacatctagcag

SEQ ID NO: 9505411 - DNA, 22 bp, Homo sapiens
attcagtttttattggaccagc

SEQ ID NO: 9505412 - DNA, 22 bp, Homo sapiens
attcagtttcatggcacagcta

SEQ ID NO: 9505413 - DNA, 22 bp, Homo sapiens
attcatatcatagagttattga

SEQ ID NO: 9505414 - DNA, 22 bp, Homo sapiens
attcatatcatagagttattga

SEQ ID NO: 9505415 - DNA, 22 bp, Homo sapiens
attcatagctcagtacagactc

SEQ ID NO: 9505416 - DNA, 22 bp, Homo sapiens
attcataacggcaaatgtcacc

SEQ ID NO: 9505417 - DNA, 22 bp, Homo sapiens
attcataagtaaatgattacct

SEQ ID NO: 9505418 - DNA, 22 bp, Homo sapiens
attcatctgtacttcaatatct

SEQ ID NO: 9505419 - DNA, 22 bp, Homo sapiens
attcatctctgcatatagagtc

SEQ ID NO: 9505420 - DNA, 22 bp, Homo sapiens
attcatctgtacttcaatatct

SEQ ID NO: 9505421 - DNA, 22 bp, Homo sapiens
attcatcagctaatggacattt

SEQ ID NO: 9505422 - DNA, 22 bp, Homo sapiens
attcatccttaccagtccccgg

SEQ ID NO: 9505423 - DNA, 22 bp, Homo sapiens
attcatctatgactctaatgtg

SEQ ID NO: 9505424 - DNA, 22 bp, Homo sapiens
gatatgtgcttgtaatatttat

SEQ ID NO: 9505425 - DNA, 22 bp, Homo sapiens
gatatgtattgaatgatcattt

SEQ ID NO: 9505426 - DNA, 22 bp, Homo sapiens
gatatgtttaatgcctcagtat

SEQ ID NO: 9505427 - DNA, 22 bp, Homo sapiens
gatattcaaagattactgatat

SEQ ID NO: 9505428 - DNA, 22 bp, Homo sapiens
gatattcaactaaagtgaatta

SEQ ID NO: 9505429 - DNA, 22 bp, Homo sapiens
gatattcctgaaggacagggtt

SEQ ID NO: 9505430 - DNA, 22 bp, Homo sapiens
attacaatcgagagaaacaaat

SEQ ID NO: 9505431 - DNA, 22 bp, Homo sapiens
attacagtggacagctatgcac

SEQ ID NO: 9505432 - DNA, 22 bp, Homo sapiens
attacatatgttggcaacattt

SEQ ID NO: 9505433 - DNA, 21 bp, Homo sapiens
attacatccctggtgatacat

SEQ ID NO: 9505434 - DNA, 22 bp, Homo sapiens
attacctatgctctagtaatca

SEQ ID NO: 9505435 - DNA, 23 bp, Homo sapiens
attacatgagcaaatatagctat

SEQ ID NO: 9505436 - DNA, 22 bp, Homo sapiens
attacatgagagaatgtaaata

SEQ ID NO: 9505437 - DNA, 22 bp, Homo sapiens
attactcctagaatgcatttag

SEQ ID NO: 9505438 - DNA, 22 bp, Homo sapiens
attacctatttcattttctgtc

SEQ ID NO: 9505439 - DNA, 22 bp, Homo sapiens
attacctatttcattttctgtc

SEQ ID NO: 9505440 - DNA, 22 bp, Homo sapiens
attactctgtctgcctctgacc

SEQ ID NO: 9505441 - DNA, 22 bp, Homo sapiens
attactgttggcaaagtcttat

SEQ ID NO: 9505442 - DNA, 22 bp, Homo sapiens
attactgaggcaaagtagtttt

SEQ ID NO: 9505443 - DNA, 22 bp, Homo sapiens
attagaaaaactcaagggctct

SEQ ID NO: 9505444 - DNA, 22 bp, Homo sapiens
gatttctcaatcctagtactat

SEQ ID NO: 9505445 - DNA, 22 bp, Homo sapiens
gatttctcaatcctagtactat

SEQ ID NO: 9505446 - DNA, 19 bp, Homo sapiens
gatttctacaaatgtcaga

SEQ ID NO: 9505447 - DNA, 22 bp, Homo sapiens
gatttctacttgaacttgctaa

SEQ ID NO: 9505448 - DNA, 22 bp, Homo sapiens
gatttctaaggaggctgaactt

SEQ ID NO: 9505449 - DNA, 22 bp, Homo sapiens
gatttctaaggaggctgaactt

SEQ ID NO: 9505450 - DNA, 22 bp, Homo sapiens
gatttctagtaagtcatgaagg

SEQ ID NO: 9505451 - DNA, 22 bp, Homo sapiens
gatttctagttcattatctatt

SEQ ID NO: 9505452 - DNA, 22 bp, Homo sapiens
gatttctagttcattatctatt

SEQ ID NO: 9505453 - DNA, 22 bp, Homo sapiens
gatttctagttcattatctatt

SEQ ID NO: 9505454 - DNA, 22 bp, Homo sapiens
gatttctacttgaacttgctaa

SEQ ID NO: 9505455 - DNA, 22 bp, Homo sapiens
gatttctagtaagtcatgaagg

SEQ ID NO: 9505456 - DNA, 22 bp, Homo sapiens
attagctgttgtgaaaggggtg

SEQ ID NO: 9505457 - DNA, 22 bp, Homo sapiens
attagcttatcacacaagctgc

SEQ ID NO: 9505458 - DNA, 22 bp, Homo sapiens
attaggaaatgtgttgcaagca

SEQ ID NO: 9505459 - DNA, 22 bp, Homo sapiens
attagctttatttgaaatagga

SEQ ID NO: 9505460 - DNA, 22 bp, Homo sapiens
attaggtggggttgttactgtt

SEQ ID NO: 9505461 - DNA, 22 bp, Homo sapiens
attagtaaaacattgtatatgt

SEQ ID NO: 9505462 - DNA, 22 bp, Homo sapiens
attagtaaaacattgtatatgt

SEQ ID NO: 9505463 - DNA, 22 bp, Homo sapiens
attagtaaaacattgtatatgt

SEQ ID NO: 9505464 - DNA, 22 bp, Homo sapiens
attagtagtagttagcagcctc

SEQ ID NO: 9505465 - DNA, 22 bp, Homo sapiens
attagtattcagtttataacac

SEQ ID NO: 9505466 - DNA, 22 bp, Homo sapiens
attaggcatatatgcttttaat

SEQ ID NO: 9505467 - DNA, 22 bp, Homo sapiens
attaggcaattctgggcatctc

SEQ ID NO: 9505468 - DNA, 22 bp, Homo sapiens
attaggcactagaatgtcaatt

SEQ ID NO: 9505469 - DNA, 22 bp, Homo sapiens
attaggcattatggggataagg

SEQ ID NO: 9505470 - DNA, 22 bp, Homo sapiens
attaggcattctgaatgaggtc

SEQ ID NO: 9505471 - DNA, 22 bp, Homo sapiens
attcaacatattctgagtaaaa

SEQ ID NO: 9505472 - DNA, 22 bp, Homo sapiens
attcaaattaagttaattcagc

SEQ ID NO: 9505473 - DNA, 22 bp, Homo sapiens
attcaacatattctgagtaaaa

SEQ ID NO: 9505474 - DNA, 22 bp, Homo sapiens
attcaaattaagttaattcagc

SEQ ID NO: 9505475 - DNA, 22 bp, Homo sapiens
attcaaattaagttaattcagc

SEQ ID NO: 9505476 - DNA, 22 bp, Homo sapiens
attcaaattaagttaattcagc

SEQ ID NO: 9505477 - DNA, 22 bp, Homo sapiens
attcaaattaagttaattcagc

SEQ ID NO: 9505478 - DNA, 22 bp, Homo sapiens
attcaaattaagttaattcagc

SEQ ID NO: 9505479 - DNA, 22 bp, Homo sapiens
attcaaattaagttaattcagc

SEQ ID NO: 9505480 - DNA, 22 bp, Homo sapiens
attcaaatgtcaaatccaccag

SEQ ID NO: 9505481 - DNA, 22 bp, Homo sapiens
attcaaatgtcaaatccaccag

SEQ ID NO: 9505482 - DNA, 22 bp, Homo sapiens
attcaaagtagatgaagtttca

SEQ ID NO: 9505483 - DNA, 22 bp, Homo sapiens
attcaaagtactagctattttt

SEQ ID NO: 9505484 - DNA, 22 bp, Homo sapiens
attcaaagtactagctattttt

SEQ ID NO: 9505485 - DNA, 22 bp, Homo sapiens
attcaaagtaataaccagaact

SEQ ID NO: 9505486 - DNA, 22 bp, Homo sapiens
attcaaagtactagctattttt

SEQ ID NO: 9505487 - DNA, 22 bp, Homo sapiens
attatttcagtcagacactggc

SEQ ID NO: 9505488 - DNA, 22 bp, Homo sapiens
attagtgttcttatcttctagg

SEQ ID NO: 9505489 - DNA, 22 bp, Homo sapiens
attagtgttgtaagaagctgcc

SEQ ID NO: 9505490 - DNA, 22 bp, Homo sapiens
attagtgttgtaagaagctgcc

SEQ ID NO: 9505491 - DNA, 22 bp, Homo sapiens
attagtgttgtaagaagctgcc

SEQ ID NO: 9505492 - DNA, 22 bp, Homo sapiens
attagtgttgtggcttcatggc

SEQ ID NO: 9505493 - DNA, 22 bp, Homo sapiens
attagtgttgtggcttcatggc

SEQ ID NO: 9505494 - DNA, 22 bp, Homo sapiens
attagtgttgtggcttcatggc

SEQ ID NO: 9505495 - DNA, 22 bp, Homo sapiens
attagtgtgtaggctggaaaaa

SEQ ID NO: 9505496 - DNA, 22 bp, Homo sapiens
attagtgtggaccctaatttaa

SEQ ID NO: 9505497 - DNA, 22 bp, Homo sapiens
attagtgtgtaggctggaaaaa

SEQ ID NO: 9505498 - DNA, 22 bp, Homo sapiens
attagtgttcttatcttctagg

SEQ ID NO: 9505499 - DNA, 22 bp, Homo sapiens
attagtgtctgtgaataattct

SEQ ID NO: 9505500 - DNA, 22 bp, Homo sapiens
attagtgtggaccctaatttaa

SEQ ID NO: 9505501 - DNA, 22 bp, Homo sapiens
attagtgtctgtgaataattct

SEQ ID NO: 9505502 - DNA, 22 bp, Homo sapiens
attagtgtcatgttgaggactt

SEQ ID NO: 9505503 - DNA, 22 bp, Homo sapiens
attagtgtcatgttgaggactt

SEQ ID NO: 9505504 - DNA, 22 bp, Homo sapiens
attagtgtacatctcacacgca

SEQ ID NO: 9505505 - DNA, 22 bp, Homo sapiens
attagtgtacatctcacacgca

SEQ ID NO: 9505506 - DNA, 20 bp, Homo sapiens
attagtgcatctggacatgc

SEQ ID NO: 9505507 - DNA, 22 bp, Homo sapiens
attagtgcccaggctgcctctt

SEQ ID NO: 9505508 - DNA, 22 bp, Homo sapiens
attcttcttgagtcttggactc

SEQ ID NO: 9505509 - DNA, 23 bp, Homo sapiens
attcttggggaaatagtatgagc

SEQ ID NO: 9505510 - DNA, 22 bp, Homo sapiens
attccttgtatatctacatgca

SEQ ID NO: 9505511 - DNA, 22 bp, Homo sapiens
attccttgtatatctacatgca

SEQ ID NO: 9505512 - DNA, 22 bp, Homo sapiens
attccttgtatatctacatgca

SEQ ID NO: 9505513 - DNA, 22 bp, Homo sapiens
attccttgggctgccttattat

SEQ ID NO: 9505514 - DNA, 22 bp, Homo sapiens
attccttgggctgccttattat

SEQ ID NO: 9505515 - DNA, 22 bp, Homo sapiens
attccttggaacagatgcgaag

SEQ ID NO: 9505516 - DNA, 22 bp, Homo sapiens
attccttgctctcatcaacctt

SEQ ID NO: 9505517 - DNA, 22 bp, Homo sapiens
attccttggcattctggacttg

SEQ ID NO: 9505518 - DNA, 22 bp, Homo sapiens
attccttggaacagatgcgaag

SEQ ID NO: 9505519 - DNA, 22 bp, Homo sapiens
attccttggcattctggacttg

SEQ ID NO: 9505520 - DNA, 22 bp, Homo sapiens
attccttgggaattattgaatg

SEQ ID NO: 9505521 - DNA, 22 bp, Homo sapiens
attccttgggaattattgaatg

SEQ ID NO: 9505522 - DNA, 22 bp, Homo sapiens
attctttaattcaattgaagga

SEQ ID NO: 9505523 - DNA, 22 bp, Homo sapiens
attctttaattcaattgaagga

SEQ ID NO: 9505524 - DNA, 22 bp, Homo sapiens
attctttcaaggaatagttatt

SEQ ID NO: 9505525 - DNA, 22 bp, Homo sapiens
attctttcatataaaggctcag

SEQ ID NO: 9505526 - DNA, 19 bp, Homo sapiens
gcaggcctcttgggaatta

SEQ ID NO: 9505527 - DNA, 22 bp, Homo sapiens
attctttagttggcttcttgcc

SEQ ID NO: 9505528 - DNA, 22 bp, Homo sapiens
attccttctttgagaataagca

SEQ ID NO: 9505529 - DNA, 22 bp, Homo sapiens
gcagctggaagtgacactctgt

SEQ ID NO: 9505530 - DNA, 22 bp, Homo sapiens
attccttggaacagatgcgaag

SEQ ID NO: 9505531 - DNA, 22 bp, Homo sapiens
attccttgctctcatcaacctt

SEQ ID NO: 9505532 - DNA, 22 bp, Homo sapiens
attccttgctctcatcaacctt

SEQ ID NO: 9505533 - DNA, 22 bp, Homo sapiens
attccttgcacatcagatagtt

SEQ ID NO: 9505534 - DNA, 22 bp, Homo sapiens
attccttgcacatcagatagtt

SEQ ID NO: 9505535 - DNA, 22 bp, Homo sapiens
attccttgcacatcagatagtt

SEQ ID NO: 9505536 - DNA, 22 bp, Homo sapiens
gcagctgctgggatcatttagg

SEQ ID NO: 9505537 - DNA, 22 bp, Homo sapiens
gcagctgctgtggcatcaagct

SEQ ID NO: 9505538 - DNA, 22 bp, Homo sapiens
gcagctgccttcagctggatgg

SEQ ID NO: 9505539 - DNA, 22 bp, Homo sapiens
gcagctgcctattcagggcttg

SEQ ID NO: 9505540 - DNA, 22 bp, Homo sapiens
gcagcgaggtgatgaaatagct

SEQ ID NO: 9505541 - DNA, 22 bp, Homo sapiens
gcagctgctcacattctcacaa

SEQ ID NO: 9505542 - DNA, 22 bp, Homo sapiens
gcagctgctggaagttcctgcc

SEQ ID NO: 9505543 - DNA, 22 bp, Homo sapiens
gcagctgctggaagttcctgcc

SEQ ID NO: 9505544 - DNA, 22 bp, Homo sapiens
gcagctgctggagggaggcagg

SEQ ID NO: 9505545 - DNA, 22 bp, Homo sapiens
attgattctgtaagtcaacaat

SEQ ID NO: 9505546 - DNA, 22 bp, Homo sapiens
attgatttaggcttgttatgac

SEQ ID NO: 9505547 - DNA, 22 bp, Homo sapiens
attgatttaggcttgttatgac

SEQ ID NO: 9505548 - DNA, 22 bp, Homo sapiens
attgatttgaacaaagatatta

SEQ ID NO: 9505549 - DNA, 22 bp, Homo sapiens
attgatttgaacaaagatatta

SEQ ID NO: 9505550 - DNA, 22 bp, Homo sapiens
attgcaaaattgtcctgtggaa

SEQ ID NO: 9505551 - DNA, 22 bp, Homo sapiens
attgcaaagcattgtgagcgca

SEQ ID NO: 9505552 - DNA, 22 bp, Homo sapiens
attgcaaagaaatacatgctta

SEQ ID NO: 9505553 - DNA, 22 bp, Homo sapiens
attgcaaagaaatacatgctta

SEQ ID NO: 9505554 - DNA, 22 bp, Homo sapiens
gcagggctgagtcatgtgtgcc

SEQ ID NO: 9505555 - DNA, 22 bp, Homo sapiens
gcagggctgatggcttccctca

SEQ ID NO: 9505556 - DNA, 22 bp, Homo sapiens
gcagggctgctgaaacttgttt

SEQ ID NO: 9505557 - DNA, 22 bp, Homo sapiens
gcagggctgcagagggcactgt

SEQ ID NO: 9505558 - DNA, 22 bp, Homo sapiens
attgatggtgcttatagtcatg

SEQ ID NO: 9505559 - DNA, 22 bp, Homo sapiens
attgatgggtgccaatggagtg

SEQ ID NO: 9505560 - DNA, 22 bp, Homo sapiens
attgatggtgatagtgctgtgg

SEQ ID NO: 9505561 - DNA, 22 bp, Homo sapiens
attgatggaaaacaaatgatga

SEQ ID NO: 9505562 - DNA, 22 bp, Homo sapiens
attgatatcagtttgctgattg

SEQ ID NO: 9505563 - DNA, 22 bp, Homo sapiens
attgatatattatttctaactg

SEQ ID NO: 9505564 - DNA, 22 bp, Homo sapiens
attgatcatgcagatgcttcac

SEQ ID NO: 9505565 - DNA, 22 bp, Homo sapiens
gcaggcctttatccctgcctca

SEQ ID NO: 9505566 - DNA, 22 bp, Homo sapiens
gcaggcctttatccctgcctca

SEQ ID NO: 9505567 - DNA, 23 bp, Homo sapiens
attgaccagctgtctcattttca

SEQ ID NO: 9505568 - DNA, 23 bp, Homo sapiens
attgaccagctgtctcattttca

SEQ ID NO: 9505569 - DNA, 22 bp, Homo sapiens
attgactttcccttctcctcat

SEQ ID NO: 9505570 - DNA, 22 bp, Homo sapiens
attgatatattatttctaactg

SEQ ID NO: 9505571 - DNA, 22 bp, Homo sapiens
attgataaattgcaatggggct

SEQ ID NO: 9505572 - DNA, 22 bp, Homo sapiens
gcaggcctgcccagcaggatgg

SEQ ID NO: 9505573 - DNA, 22 bp, Homo sapiens
gcaggcctgcccagcaggatgg

SEQ ID NO: 9505574 - DNA, 22 bp, Homo sapiens
gcaggcctgcccagcaggatgg

SEQ ID NO: 9505575 - DNA, 22 bp, Homo sapiens
gcaggcctgggagtcatcttgt

SEQ ID NO: 9505576 - DNA, 22 bp, Homo sapiens
gcaggcctgactgtagggggca

SEQ ID NO: 9505577 - DNA, 22 bp, Homo sapiens
gcaggcctgcaggtatggccgg

SEQ ID NO: 9505578 - DNA, 22 bp, Homo sapiens
gcaggcctggtttacatggtag

SEQ ID NO: 9505579 - DNA, 22 bp, Homo sapiens
gcaggcctgtaatgaagggaca

SEQ ID NO: 9505580 - DNA, 22 bp, Homo sapiens
gcaggcctggtttacatggtag

SEQ ID NO: 9505581 - DNA, 22 bp, Homo sapiens
gcaggcctggtttacatggtag

SEQ ID NO: 9505582 - DNA, 22 bp, Homo sapiens
gcaggcctgtcttgctcgccct

SEQ ID NO: 9505583 - DNA, 22 bp, Homo sapiens
gcaggcctgtaatgaagggaca

SEQ ID NO: 9505584 - DNA, 22 bp, Homo sapiens
gcaggccttggcaatgagcctg

SEQ ID NO: 9505585 - DNA, 22 bp, Homo sapiens
gcaggccttggcaatgagcctg

SEQ ID NO: 9505586 - DNA, 22 bp, Homo sapiens
gcaggcctgtcttgctcgccct

SEQ ID NO: 9505587 - DNA, 22 bp, Homo sapiens
attgtcgtcaatggacacatag

SEQ ID NO: 9505588 - DNA, 22 bp, Homo sapiens
attgtcctgtgtaattcaatgg

SEQ ID NO: 9505589 - DNA, 22 bp, Homo sapiens
attgtcattccagtcattgtta

SEQ ID NO: 9505590 - DNA, 22 bp, Homo sapiens
attgtcattccagtcattgtta

SEQ ID NO: 9505591 - DNA, 22 bp, Homo sapiens
attgtcctatctcagtgccatg

SEQ ID NO: 9505592 - DNA, 22 bp, Homo sapiens
attgtcattggcttctatgtct

SEQ ID NO: 9505593 - DNA, 22 bp, Homo sapiens
attgtcattggcttctatgtct

SEQ ID NO: 9505594 - DNA, 18 bp, Homo sapiens
attgtcagaagtcatgtg

SEQ ID NO: 9505595 - DNA, 22 bp, Homo sapiens
attgtcacttaaaagtgcatgt

SEQ ID NO: 9505596 - DNA, 22 bp, Homo sapiens
attgtatttgtacaagacatgt

SEQ ID NO: 9505597 - DNA, 22 bp, Homo sapiens
attgtatttgtacaagacatgt

SEQ ID NO: 9505598 - DNA, 22 bp, Homo sapiens
attgtatttgtacaagacatgt

SEQ ID NO: 9505599 - DNA, 22 bp, Homo sapiens
attgtcagctcgaaatgcatca

SEQ ID NO: 9505600 - DNA, 22 bp, Homo sapiens
attgtcagctcgaaatgcatca

SEQ ID NO: 9505601 - DNA, 22 bp, Homo sapiens
attgtacttttattacatgtag

SEQ ID NO: 9505602 - DNA, 22 bp, Homo sapiens
attgtagcaatttctcttaatt

SEQ ID NO: 9505603 - DNA, 22 bp, Homo sapiens
attgtacttttattacatgtag

SEQ ID NO: 9505604 - DNA, 22 bp, Homo sapiens
gcatcaagacgatgtgaaatcg

SEQ ID NO: 9505605 - DNA, 22 bp, Homo sapiens
gcatattttcacaagctcttgg

SEQ ID NO: 9505606 - DNA, 22 bp, Homo sapiens
gcatattttcacaagctcttgg

SEQ ID NO: 9505607 - DNA, 22 bp, Homo sapiens
gcatcaagacgatgtgaaatcg

SEQ ID NO: 9505608 - DNA, 22 bp, Homo sapiens
gcatattttcacaagctcttgg

SEQ ID NO: 9505609 - DNA, 22 bp, Homo sapiens
gcatatgatcacgtgtgtcggt

SEQ ID NO: 9505610 - DNA, 22 bp, Homo sapiens
gcatatgatcacgtgtgtcggt

SEQ ID NO: 9505611 - DNA, 22 bp, Homo sapiens
gcatagctttgatgctgcctta

SEQ ID NO: 9505612 - DNA, 22 bp, Homo sapiens
gcagtgtgtttggataacacac

SEQ ID NO: 9505613 - DNA, 22 bp, Homo sapiens
gcagtgtgtgtccccacactgg

SEQ ID NO: 9505614 - DNA, 22 bp, Homo sapiens
gcagtgtgtgtccccacactgg

SEQ ID NO: 9505615 - DNA, 22 bp, Homo sapiens
gcagtgttaaacaactgctgct

SEQ ID NO: 9505616 - DNA, 22 bp, Homo sapiens
gcatacagagaggatgtggcat

SEQ ID NO: 9505617 - DNA, 22 bp, Homo sapiens
gcatacatgggtgcagggacat

SEQ ID NO: 9505618 - DNA, 22 bp, Homo sapiens
gcatacattgcaccctggtagt

SEQ ID NO: 9505619 - DNA, 18 bp, Homo sapiens
gcatacagaggggaagta

SEQ ID NO: 9505620 - DNA, 22 bp, Homo sapiens
gcatacagtccttgtattcttc

SEQ ID NO: 9505621 - DNA, 22 bp, Homo sapiens
gcatacatacaatagctgccac

SEQ ID NO: 9505622 - DNA, 22 bp, Homo sapiens
gcatacatgaaaaggtactgac

SEQ ID NO: 9505623 - DNA, 22 bp, Homo sapiens
gcagtgtggcgtggggacctaa

SEQ ID NO: 9505624 - DNA, 22 bp, Homo sapiens
gcagtgtggcgtggggacctaa

SEQ ID NO: 9505625 - DNA, 22 bp, Homo sapiens
gcagtgtggccccagtatcacg

SEQ ID NO: 9505626 - DNA, 22 bp, Homo sapiens
gcagtgtggccccagtatcacg

SEQ ID NO: 9505627 - DNA, 22 bp, Homo sapiens
gcagtgtgacgctgttctccgt

SEQ ID NO: 9505628 - DNA, 22 bp, Homo sapiens
gcagtgtgatgcttccagccac

SEQ ID NO: 9505629 - DNA, 22 bp, Homo sapiens
gcagtgtgtctcttggcttcct

SEQ ID NO: 9505630 - DNA, 22 bp, Homo sapiens
gcagtgtgtggtgagggctgcc

SEQ ID NO: 9505631 - DNA, 22 bp, Homo sapiens
gcagtgtgtctggagtacatgg

SEQ ID NO: 9505632 - DNA, 22 bp, Homo sapiens
gcagtgtgatgcttccagccac

SEQ ID NO: 9505633 - DNA, 22 bp, Homo sapiens
gcagtgcttgaagaggtggcca

SEQ ID NO: 9505634 - DNA, 22 bp, Homo sapiens
gccaaagtccacttgctttctg

SEQ ID NO: 9505635 - DNA, 22 bp, Homo sapiens
gccaaagtcctccagccatgca

SEQ ID NO: 9505636 - DNA, 22 bp, Homo sapiens
gccaaaggttggcctgtgagtt

SEQ ID NO: 9505637 - DNA, 22 bp, Homo sapiens
gccaaagtacctagccctctgc

SEQ ID NO: 9505638 - DNA, 22 bp, Homo sapiens
gccaaaggattctatggagata

SEQ ID NO: 9505639 - DNA, 23 bp, Homo sapiens
gccaaaggtctgttcagtggtga

SEQ ID NO: 9505640 - DNA, 22 bp, Homo sapiens
gccaaaggcccttctgaaggca

SEQ ID NO: 9505641 - DNA, 22 bp, Homo sapiens
gccaacagctgggtgcatgtcc

SEQ ID NO: 9505642 - DNA, 22 bp, Homo sapiens
gccaaatctggatttagcaaga

SEQ ID NO: 9505643 - DNA, 22 bp, Homo sapiens
gccaaatcacagggccaaaagc

SEQ ID NO: 9505644 - DNA, 22 bp, Homo sapiens
gccaaccattggcttcttgtca

SEQ ID NO: 9505645 - DNA, 22 bp, Homo sapiens
gccaagaaatgtgtcgggcagc

SEQ ID NO: 9505646 - DNA, 21 bp, Homo sapiens
gccaagaacaagacagacatg

SEQ ID NO: 9505647 - DNA, 22 bp, Homo sapiens
gccacagggcgagcggaggcca

SEQ ID NO: 9505648 - DNA, 22 bp, Homo sapiens
gccacagggcagatgcgcagag

SEQ ID NO: 9505649 - DNA, 22 bp, Homo sapiens
gccacagggcagatgcgcagag

SEQ ID NO: 9505650 - DNA, 22 bp, Homo sapiens
gccacagggaggcgttttcagg

SEQ ID NO: 9505651 - DNA, 22 bp, Homo sapiens
gccacagggattgttttgtgag

SEQ ID NO: 9505652 - DNA, 22 bp, Homo sapiens
gccacagggcagatgcgcagag

SEQ ID NO: 9505653 - DNA, 22 bp, Homo sapiens
gccaagcactgaggacattgtt

SEQ ID NO: 9505654 - DNA, 22 bp, Homo sapiens
gccaagagtttccagctgcaag

SEQ ID NO: 9505655 - DNA, 22 bp, Homo sapiens
gccaagcctgggaagagcccat

SEQ ID NO: 9505656 - DNA, 22 bp, Homo sapiens
gccaagcctgggaagagcccat

SEQ ID NO: 9505657 - DNA, 22 bp, Homo sapiens
gccaagagtttccagctgcaag

SEQ ID NO: 9505658 - DNA, 21 bp, Homo sapiens
gccaagaacaagacagacatg

SEQ ID NO: 9505659 - DNA, 22 bp, Homo sapiens
gccaagaaggtggggacatgca

SEQ ID NO: 9505660 - DNA, 22 bp, Homo sapiens
attgtgaattgagagtacttct

SEQ ID NO: 9505661 - DNA, 22 bp, Homo sapiens
attgtgaatagtgccgcagtaa

SEQ ID NO: 9505662 - DNA, 22 bp, Homo sapiens
attgtgaatagtgccgcagtaa

SEQ ID NO: 9505663 - DNA, 22 bp, Homo sapiens
attgtgaatagtgccgcagtaa

SEQ ID NO: 9505664 - DNA, 22 bp, Homo sapiens
attgtgaatagtgccgcagtaa

SEQ ID NO: 9505665 - DNA, 23 bp, Homo sapiens
attgtgagattactatcacactg

SEQ ID NO: 9505666 - DNA, 22 bp, Homo sapiens
attgtgaattgagagtacttct

SEQ ID NO: 9505667 - DNA, 22 bp, Homo sapiens
gcattccttgttagcatttgat

SEQ ID NO: 9505668 - DNA, 22 bp, Homo sapiens
gcattcctttataggaaaatgg

SEQ ID NO: 9505669 - DNA, 22 bp, Homo sapiens
gcattctagacagctacagaaa

SEQ ID NO: 9505670 - DNA, 22 bp, Homo sapiens
gcattctatagtctacattaca

SEQ ID NO: 9505671 - DNA, 22 bp, Homo sapiens
attgtgcaatgttttacaattt

SEQ ID NO: 9505672 - DNA, 22 bp, Homo sapiens
gcattctgtgctacagccattc

SEQ ID NO: 9505673 - DNA, 22 bp, Homo sapiens
gcattctatagtctacattaca

SEQ ID NO: 9505674 - DNA, 22 bp, Homo sapiens
gcattctgtgctacagccattc

SEQ ID NO: 9505675 - DNA, 22 bp, Homo sapiens
attgtctgtactttaaaaatgt

SEQ ID NO: 9505676 - DNA, 22 bp, Homo sapiens
attgtcttaaacaaatgtgttt

SEQ ID NO: 9505677 - DNA, 22 bp, Homo sapiens
attgtcttacatactgtggagg

SEQ ID NO: 9505678 - DNA, 22 bp, Homo sapiens
attgtcttacatactgtggagg

SEQ ID NO: 9505679 - DNA, 22 bp, Homo sapiens
attgtcttaaacaaatgtgttt

SEQ ID NO: 9505680 - DNA, 22 bp, Homo sapiens
attgtcttggcattcaaattag

SEQ ID NO: 9505681 - DNA, 22 bp, Homo sapiens
attgtcttctgtcttatagttc

SEQ ID NO: 9505682 - DNA, 22 bp, Homo sapiens
attgtcttctggtcttatcttt

SEQ ID NO: 9505683 - DNA, 22 bp, Homo sapiens
attgtcttctggtcttatcttt

SEQ ID NO: 9505684 - DNA, 22 bp, Homo sapiens
attgtcttctgtcttaggtgat

SEQ ID NO: 9505685 - DNA, 22 bp, Homo sapiens
attgtcttagtcagctcggact

SEQ ID NO: 9505686 - DNA, 22 bp, Homo sapiens
attgtcttctgtcttatagttc

SEQ ID NO: 9505687 - DNA, 22 bp, Homo sapiens
attgtctttccactgagaagtt

SEQ ID NO: 9505688 - DNA, 22 bp, Homo sapiens
attgtcttgtacgtttgcctgt

SEQ ID NO: 9505689 - DNA, 22 bp, Homo sapiens
attgtctttaaaaatatacaac

SEQ ID NO: 9505690 - DNA, 22 bp, Homo sapiens
attgtctttaaaaatatacaac

SEQ ID NO: 9505691 - DNA, 22 bp, Homo sapiens
attgtctttaaaaatatacaac

SEQ ID NO: 9505692 - DNA, 20 bp, Homo sapiens
attgtgaatactgcatatgt

SEQ ID NO: 9505693 - DNA, 20 bp, Homo sapiens
attgtgaatactgcatatgt

SEQ ID NO: 9505694 - DNA, 20 bp, Homo sapiens
attgtgaatactgcatatgt

SEQ ID NO: 9505695 - DNA, 22 bp, Homo sapiens
attgtctttggtgcttccagga

SEQ ID NO: 9505696 - DNA, 22 bp, Homo sapiens
attgtctttccactgagaagtt

SEQ ID NO: 9505697 - DNA, 22 bp, Homo sapiens
attgtctttggtgcttccagga

SEQ ID NO: 9505698 - DNA, 18 bp, Homo sapiens
atttttcccagatggata

SEQ ID NO: 9505699 - DNA, 18 bp, Homo sapiens
atttttcccagatggata

SEQ ID NO: 9505700 - DNA, 22 bp, Homo sapiens
atttttcctgctggatctgctc

SEQ ID NO: 9505701 - DNA, 22 bp, Homo sapiens
atttttccattctctgttagta

SEQ ID NO: 9505702 - DNA, 22 bp, Homo sapiens
atttttccatgatacttatctg

SEQ ID NO: 9505703 - DNA, 22 bp, Homo sapiens
atttttccattctctgttagta

SEQ ID NO: 9505704 - DNA, 23 bp, Homo sapiens
atttttcctggaacagtcaccca

SEQ ID NO: 9505705 - DNA, 23 bp, Homo sapiens
atttttcctggaacagtcaccca

SEQ ID NO: 9505706 - DNA, 22 bp, Homo sapiens
atttttcctgctggatctgctc

SEQ ID NO: 9505707 - DNA, 22 bp, Homo sapiens
atttttcctgggtgctttagtt

SEQ ID NO: 9505708 - DNA, 22 bp, Homo sapiens
atttttcctgggtgctttagtt

SEQ ID NO: 9505709 - DNA, 22 bp, Homo sapiens
atttttctctcacacttaccag

SEQ ID NO: 9505710 - DNA, 22 bp, Homo sapiens
atttttctctcacacttaccag

SEQ ID NO: 9505711 - DNA, 22 bp, Homo sapiens
atttttctctcacacttaccag

SEQ ID NO: 9505712 - DNA, 22 bp, Homo sapiens
atttttctctcacacttaccag

SEQ ID NO: 9505713 - DNA, 22 bp, Homo sapiens
atttttctctccactccattaa

SEQ ID NO: 9505714 - DNA, 22 bp, Homo sapiens
atttttctctccactccattaa

SEQ ID NO: 9505715 - DNA, 22 bp, Homo sapiens
atttttctctccactccattaa

SEQ ID NO: 9505716 - DNA, 22 bp, Homo sapiens
atttttctctcacacttaccag

SEQ ID NO: 9505717 - DNA, 22 bp, Homo sapiens
atttttctctttccactgagat

SEQ ID NO: 9505718 - DNA, 22 bp, Homo sapiens
atttttctctccactccattaa

SEQ ID NO: 9505719 - DNA, 19 bp, Homo sapiens
atttttcttcctctgtgca

SEQ ID NO: 9505720 - DNA, 22 bp, Homo sapiens
atttttgagctgtgaacatagc

SEQ ID NO: 9505721 - DNA, 19 bp, Homo sapiens
atttttcttcctctgtgca

SEQ ID NO: 9505722 - DNA, 22 bp, Homo sapiens
atttttctctttccactgagat

SEQ ID NO: 9505723 - DNA, 22 bp, Homo sapiens
caaaagcagttctatctgagtt

SEQ ID NO: 9505724 - DNA, 22 bp, Homo sapiens
atttttgagctgtgaacatagc

SEQ ID NO: 9505725 - DNA, 22 bp, Homo sapiens
caaaataccacgacttgtttta

SEQ ID NO: 9505726 - DNA, 22 bp, Homo sapiens
caaaataccacgacttgtttta

SEQ ID NO: 9505727 - DNA, 22 bp, Homo sapiens
caaaagcagttctatctgagtt

SEQ ID NO: 9505728 - DNA, 22 bp, Homo sapiens
atttttatgacaaaccatcctc

SEQ ID NO: 9505729 - DNA, 22 bp, Homo sapiens
attttgctttatgtaaatatgt

SEQ ID NO: 9505730 - DNA, 22 bp, Homo sapiens
attttgctttatgtaaatatgt

SEQ ID NO: 9505731 - DNA, 22 bp, Homo sapiens
atttttcagcttcattgaggca

SEQ ID NO: 9505732 - DNA, 22 bp, Homo sapiens
atttttcaactttggaaatggc

SEQ ID NO: 9505733 - DNA, 22 bp, Homo sapiens
atttttcagcttcattgaggca

SEQ ID NO: 9505734 - DNA, 22 bp, Homo sapiens
atttttccaattaggataaaga

SEQ ID NO: 9505735 - DNA, 22 bp, Homo sapiens
atttttccatgatacttatctg

SEQ ID NO: 9505736 - DNA, 22 bp, Homo sapiens
atttttccaattaggataaaga

SEQ ID NO: 9505737 - DNA, 22 bp, Homo sapiens
attttactttgtgaatattgac

SEQ ID NO: 9505738 - DNA, 22 bp, Homo sapiens
attttacttagtgtaatgtcca

SEQ ID NO: 9505739 - DNA, 22 bp, Homo sapiens
attttacttcatttgaaatgcc

SEQ ID NO: 9505740 - DNA, 22 bp, Homo sapiens
attttagagctccaagtacagc

SEQ ID NO: 9505741 - DNA, 22 bp, Homo sapiens
attttagagctccaagtacagc

SEQ ID NO: 9505742 - DNA, 22 bp, Homo sapiens
attttgctttatgtaaatatgt

SEQ ID NO: 9505743 - DNA, 22 bp, Homo sapiens
attttagagctccaagtacagc

SEQ ID NO: 9505744 - DNA, 22 bp, Homo sapiens
attttagagaaacaaacgtagg

SEQ ID NO: 9505745 - DNA, 22 bp, Homo sapiens
attttagagaaacaaacgtagg

SEQ ID NO: 9505746 - DNA, 22 bp, Homo sapiens
caaagcagcctgcagtgtggac

SEQ ID NO: 9505747 - DNA, 22 bp, Homo sapiens
caaagcagcctgcagtgtggac

SEQ ID NO: 9505748 - DNA, 22 bp, Homo sapiens
caaagcagagaactgtctcatt

SEQ ID NO: 9505749 - DNA, 22 bp, Homo sapiens
caaagcagacgcagtaagggta

SEQ ID NO: 9505750 - DNA, 22 bp, Homo sapiens
caaagcagagccagagcttgtc

SEQ ID NO: 9505751 - DNA, 22 bp, Homo sapiens
caaagcagagaactgtctcatt

SEQ ID NO: 9505752 - DNA, 22 bp, Homo sapiens
caaagcagagaactgtctcatt

SEQ ID NO: 9505753 - DNA, 22 bp, Homo sapiens
caaagcagagaactgtctcatt

SEQ ID NO: 9505754 - DNA, 22 bp, Homo sapiens
caaagaggttttgagggcagct

SEQ ID NO: 9505755 - DNA, 22 bp, Homo sapiens
caaacattccgcttctcccagg

SEQ ID NO: 9505756 - DNA, 22 bp, Homo sapiens
caaacattcaagtacaagtctt

SEQ ID NO: 9505757 - DNA, 22 bp, Homo sapiens
caaacattcaagtacaagtctt

SEQ ID NO: 9505758 - DNA, 22 bp, Homo sapiens
caaacattcaagtacaagtctt

SEQ ID NO: 9505759 - DNA, 22 bp, Homo sapiens
caaacattcaagtacaagtctt

SEQ ID NO: 9505760 - DNA, 22 bp, Homo sapiens
caaacattcaagtacaagtctt

SEQ ID NO: 9505761 - DNA, 22 bp, Homo sapiens
caaagccatagagtagataaga

SEQ ID NO: 9505762 - DNA, 22 bp, Homo sapiens
caaagccatagagtagataaga

SEQ ID NO: 9505763 - DNA, 22 bp, Homo sapiens
caaagccatagagtagataaga

SEQ ID NO: 9505764 - DNA, 22 bp, Homo sapiens
caaagccaggctttctaatgta

SEQ ID NO: 9505765 - DNA, 21 bp, Homo sapiens
caaagccaggcaactctctcc

SEQ ID NO: 9505766 - DNA, 22 bp, Homo sapiens
caaagcagttttaatcaagtag

SEQ ID NO: 9505767 - DNA, 20 bp, Homo sapiens
caaagcagtaggataaaaat

SEQ ID NO: 9505768 - DNA, 22 bp, Homo sapiens
caaagcagtattggattcttta

SEQ ID NO: 9505769 - DNA, 20 bp, Homo sapiens
caaagcagtaggataaaaat

SEQ ID NO: 9505770 - DNA, 22 bp, Homo sapiens
caaagcagtgatccttaaagga

SEQ ID NO: 9505771 - DNA, 22 bp, Homo sapiens
caaagcagtattggattcttta

SEQ ID NO: 9505772 - DNA, 22 bp, Homo sapiens
caaagcaggaagctcctgacag

SEQ ID NO: 9505773 - DNA, 22 bp, Homo sapiens
caaagcaggaagctcctgacag

SEQ ID NO: 9505774 - DNA, 22 bp, Homo sapiens
caaagcaggaagctcctgacag

SEQ ID NO: 9505775 - DNA, 22 bp, Homo sapiens
caaagcaggaagctcctgacag

SEQ ID NO: 9505776 - DNA, 18 bp, Homo sapiens
caaagcaggtgacagtgt

SEQ ID NO: 9505777 - DNA, 18 bp, Homo sapiens
caaagcaggtgacagtgt

SEQ ID NO: 9505778 - DNA, 18 bp, Homo sapiens
caaagcaggtgacagtgt

SEQ ID NO: 9505779 - DNA, 22 bp, Homo sapiens
caaaattctgcatttctaataa

SEQ ID NO: 9505780 - DNA, 22 bp, Homo sapiens
caaaattctgcatttctaataa

SEQ ID NO: 9505781 - DNA, 22 bp, Homo sapiens
caaaattctgcatttctaataa

SEQ ID NO: 9505782 - DNA, 22 bp, Homo sapiens
caaaattagggagtgagctgga

SEQ ID NO: 9505783 - DNA, 22 bp, Homo sapiens
caaaattagggagtgagctgga

SEQ ID NO: 9505784 - DNA, 22 bp, Homo sapiens
caaacatagtgaagcaatgaca

SEQ ID NO: 9505785 - DNA, 22 bp, Homo sapiens
caaacatagtgaagcaatgaca

SEQ ID NO: 9505786 - DNA, 22 bp, Homo sapiens
caaacatagtgaagcaatgaca

SEQ ID NO: 9505787 - DNA, 22 bp, Homo sapiens
caaaatgtgagtcccacctcaa

SEQ ID NO: 9505788 - DNA, 22 bp, Homo sapiens
caaaattagaaatgcagctgtt

SEQ ID NO: 9505789 - DNA, 22 bp, Homo sapiens
caaaattagaaatgcagctgtt

SEQ ID NO: 9505790 - DNA, 22 bp, Homo sapiens
caaaattagaaatgcagctgtt

SEQ ID NO: 9505791 - DNA, 22 bp, Homo sapiens
caaaatgatgtgattttattgt

SEQ ID NO: 9505792 - DNA, 22 bp, Homo sapiens
caaaatagatgttaacctggaa

SEQ ID NO: 9505793 - DNA, 22 bp, Homo sapiens
caaaatagatgttaacctggaa

SEQ ID NO: 9505794 - DNA, 22 bp, Homo sapiens
caaaataccacgacttgtttta

SEQ ID NO: 9505795 - DNA, 22 bp, Homo sapiens
caaaataccacgacttgtttta

SEQ ID NO: 9505796 - DNA, 22 bp, Homo sapiens
caaaatgatgtgattttattgt

SEQ ID NO: 9505797 - DNA, 22 bp, Homo sapiens
caaaatgatgtgattttattgt

SEQ ID NO: 9505798 - DNA, 22 bp, Homo sapiens
caaaatgatgtgattttattgt

SEQ ID NO: 9505799 - DNA, 22 bp, Homo sapiens
caaatggcaacaagaacactgg

SEQ ID NO: 9505800 - DNA, 22 bp, Homo sapiens
caaatggaaagagcagaagctt

SEQ ID NO: 9505801 - DNA, 21 bp, Homo sapiens
caaatgctggctggatgagga

SEQ ID NO: 9505802 - DNA, 22 bp, Homo sapiens
caaatgctggccctgctactta

SEQ ID NO: 9505803 - DNA, 22 bp, Homo sapiens
caaatgctatgattttgagttt

SEQ ID NO: 9505804 - DNA, 22 bp, Homo sapiens
caaatgctatgattttgagttt

SEQ ID NO: 9505805 - DNA, 22 bp, Homo sapiens
caaatgctactaataggcaagt

SEQ ID NO: 9505806 - DNA, 22 bp, Homo sapiens
caaatgctaacttctttccaaa

SEQ ID NO: 9505807 - DNA, 22 bp, Homo sapiens
caaatgctactaataggcaagt

SEQ ID NO: 9505808 - DNA, 22 bp, Homo sapiens
caaatgctactaataggcaagt

SEQ ID NO: 9505809 - DNA, 22 bp, Homo sapiens
caaatgcatgagaaataagagg

SEQ ID NO: 9505810 - DNA, 22 bp, Homo sapiens
caaatgcatgagaaataagagg

SEQ ID NO: 9505811 - DNA, 22 bp, Homo sapiens
caaatgcatgagaaataagagg

SEQ ID NO: 9505812 - DNA, 22 bp, Homo sapiens
caaatgcatgagaaataagagg

SEQ ID NO: 9505813 - DNA, 22 bp, Homo sapiens
gctgactggttcaggtcccgct

SEQ ID NO: 9505814 - DNA, 22 bp, Homo sapiens
gctgactgctcagggccagctg

SEQ ID NO: 9505815 - DNA, 22 bp, Homo sapiens
gctgactgatggacacagcacc

SEQ ID NO: 9505816 - DNA, 22 bp, Homo sapiens
gctgactcagatgcagctggat

SEQ ID NO: 9505817 - DNA, 22 bp, Homo sapiens
gctgacctttgccaggaaggca

SEQ ID NO: 9505818 - DNA, 22 bp, Homo sapiens
gctgacctgtggcagaagctca

SEQ ID NO: 9505819 - DNA, 22 bp, Homo sapiens
gctgacctgctctcagcagaga

SEQ ID NO: 9505820 - DNA, 22 bp, Homo sapiens
gctgactgtccgctgctcccgg

SEQ ID NO: 9505821 - DNA, 23 bp, Homo sapiens
gctgactgtgaaattctggagct

SEQ ID NO: 9505822 - DNA, 22 bp, Homo sapiens
caaatgaatttccctgcaaatg

SEQ ID NO: 9505823 - DNA, 22 bp, Homo sapiens
caaatgatacctattactaggc

SEQ ID NO: 9505824 - DNA, 22 bp, Homo sapiens
caaatgatacctattactaggc

SEQ ID NO: 9505825 - DNA, 22 bp, Homo sapiens
caaatgatacctattactaggc

SEQ ID NO: 9505826 - DNA, 22 bp, Homo sapiens
caaatgaatttccctgcaaatg

SEQ ID NO: 9505827 - DNA, 22 bp, Homo sapiens
caaatgaatttccctgcaaatg

SEQ ID NO: 9505828 - DNA, 22 bp, Homo sapiens
caaatgcatagtttataagaag

SEQ ID NO: 9505829 - DNA, 22 bp, Homo sapiens
caaatgcatagtttataagaag

SEQ ID NO: 9505830 - DNA, 22 bp, Homo sapiens
caaatgcatagtttataagaag

SEQ ID NO: 9505831 - DNA, 22 bp, Homo sapiens
gctcttgggggacagatggagt

SEQ ID NO: 9505832 - DNA, 18 bp, Homo sapiens
gctctggttccttcaacc

SEQ ID NO: 9505833 - DNA, 22 bp, Homo sapiens
gctcttggtctcagcctctgaa

SEQ ID NO: 9505834 - DNA, 22 bp, Homo sapiens
gctcttgtcaaaaattagttga

SEQ ID NO: 9505835 - DNA, 18 bp, Homo sapiens
gctctggttccttcaacc

SEQ ID NO: 9505836 - DNA, 18 bp, Homo sapiens
gctctggttccttcaacc

SEQ ID NO: 9505837 - DNA, 22 bp, Homo sapiens
gctctggttccagttccgcacc

SEQ ID NO: 9505838 - DNA, 22 bp, Homo sapiens
gctctggttccagttccgcacc

SEQ ID NO: 9505839 - DNA, 18 bp, Homo sapiens
gctctggttccttcaacc

SEQ ID NO: 9505840 - DNA, 22 bp, Homo sapiens
gctctggttccagcgcgcccga

SEQ ID NO: 9505841 - DNA, 22 bp, Homo sapiens
caaatagactctagaatttatt

SEQ ID NO: 9505842 - DNA, 22 bp, Homo sapiens
caaatagactctagaatttatt

SEQ ID NO: 9505843 - DNA, 22 bp, Homo sapiens
gctctttgcacagctctgccct

SEQ ID NO: 9505844 - DNA, 18 bp, Homo sapiens
gctctttctgtctccagc

SEQ ID NO: 9505845 - DNA, 22 bp, Homo sapiens
gctcttgtcaaaaattagttga

SEQ ID NO: 9505846 - DNA, 22 bp, Homo sapiens
gctcttgtcagagaggccagct

SEQ ID NO: 9505847 - DNA, 22 bp, Homo sapiens
gctcttgtcaaaaattagttga

SEQ ID NO: 9505848 - DNA, 22 bp, Homo sapiens
gctgacagagtgcctggcctca

SEQ ID NO: 9505849 - DNA, 22 bp, Homo sapiens
gctgaaatgaaaacacaggtcg

SEQ ID NO: 9505850 - DNA, 20 bp, Homo sapiens
gctctttgtaagggaatttg

SEQ ID NO: 9505851 - DNA, 22 bp, Homo sapiens
gctctttggattcctttacaaa

SEQ ID NO: 9505852 - DNA, 22 bp, Homo sapiens
gctctttgtattttggaatcaa

SEQ ID NO: 9505853 - DNA, 23 bp, Homo sapiens
gctctttgttcatgtggatgcct

SEQ ID NO: 9505854 - DNA, 20 bp, Homo sapiens
gctgaccataaatcacactg

SEQ ID NO: 9505855 - DNA, 22 bp, Homo sapiens
gctgacagttgtacctgcccct

SEQ ID NO: 9505856 - DNA, 22 bp, Homo sapiens
gctgacagttactgctgtaaca

SEQ ID NO: 9505857 - DNA, 22 bp, Homo sapiens
gctgacagcgtttccagtgatg

SEQ ID NO: 9505858 - DNA, 22 bp, Homo sapiens
gctgacagcaaggggctgccct

SEQ ID NO: 9505859 - DNA, 22 bp, Homo sapiens
caaatactaaacataagatttt

SEQ ID NO: 9505860 - DNA, 22 bp, Homo sapiens
caaatactaaacataagatttt

SEQ ID NO: 9505861 - DNA, 22 bp, Homo sapiens
caaaggaggtgataggccctct

SEQ ID NO: 9505862 - DNA, 22 bp, Homo sapiens
caaaggaggtaatgggtgtgag

SEQ ID NO: 9505863 - DNA, 22 bp, Homo sapiens
caaaggacccataattaaaacc

SEQ ID NO: 9505864 - DNA, 22 bp, Homo sapiens
caaagtgctggaattacaggtg

SEQ ID NO: 9505865 - DNA, 22 bp, Homo sapiens
caaagtgctggaattacaggtg

SEQ ID NO: 9505866 - DNA, 22 bp, Homo sapiens
caaataattactatcctcactt

SEQ ID NO: 9505867 - DNA, 22 bp, Homo sapiens
caaataattactatcctcactt

SEQ ID NO: 9505868 - DNA, 22 bp, Homo sapiens
caaagtgctggaattacaggtg

SEQ ID NO: 9505869 - DNA, 22 bp, Homo sapiens
caaagtgctggaattacaggtg

SEQ ID NO: 9505870 - DNA, 22 bp, Homo sapiens
caaaggaaatactaatctggaa

SEQ ID NO: 9505871 - DNA, 22 bp, Homo sapiens
caaaggaagctccttgatggcg

SEQ ID NO: 9505872 - DNA, 22 bp, Homo sapiens
caaaggaaatactaatctggaa

SEQ ID NO: 9505873 - DNA, 22 bp, Homo sapiens
caaaggaaatactaatctggaa

SEQ ID NO: 9505874 - DNA, 22 bp, Homo sapiens
caaagctcagccctccaatgaa

SEQ ID NO: 9505875 - DNA, 22 bp, Homo sapiens
caaagctcgccacctctgaggg

SEQ ID NO: 9505876 - DNA, 22 bp, Homo sapiens
caaagctgacgaggtcagcatc

SEQ ID NO: 9505877 - DNA, 22 bp, Homo sapiens
caaagccctggaaagatgaaga

SEQ ID NO: 9505878 - DNA, 22 bp, Homo sapiens
caaagcgcagaggagcctccgg

SEQ ID NO: 9505879 - DNA, 22 bp, Homo sapiens
caaagctataaattcagacaga

SEQ ID NO: 9505880 - DNA, 22 bp, Homo sapiens
caaatacttttagcctattgag

SEQ ID NO: 9505881 - DNA, 22 bp, Homo sapiens
caaatagaactcacagacaaga

SEQ ID NO: 9505882 - DNA, 22 bp, Homo sapiens
caaatagaactcacagacaaga

SEQ ID NO: 9505883 - DNA, 22 bp, Homo sapiens
caaatagaactcacagacaaga

SEQ ID NO: 9505884 - DNA, 22 bp, Homo sapiens
caaatagaactcacagacaaga

SEQ ID NO: 9505885 - DNA, 22 bp, Homo sapiens
caaatagaaggtactcagagaa

SEQ ID NO: 9505886 - DNA, 22 bp, Homo sapiens
caaatagaaggtactcagagaa

SEQ ID NO: 9505887 - DNA, 22 bp, Homo sapiens
caaatagaaggtactcagagaa

SEQ ID NO: 9505888 - DNA, 22 bp, Homo sapiens
caaatagacaagatggcaggaa

SEQ ID NO: 9505889 - DNA, 22 bp, Homo sapiens
caaatagacaagatggcaggaa

SEQ ID NO: 9505890 - DNA, 21 bp, Homo sapiens
caaatagacatggctagagga

SEQ ID NO: 9505891 - DNA, 21 bp, Homo sapiens
caaatagacatggctagagga

SEQ ID NO: 9505892 - DNA, 21 bp, Homo sapiens
caaatacttagaaacttaaga

SEQ ID NO: 9505893 - DNA, 21 bp, Homo sapiens
caaatacttagaaacttaaga

SEQ ID NO: 9505894 - DNA, 22 bp, Homo sapiens
caaatacttactgaacctgtgc

SEQ ID NO: 9505895 - DNA, 22 bp, Homo sapiens
caaatactttatatacttcaaa

SEQ ID NO: 9505896 - DNA, 22 bp, Homo sapiens
caaatactttatatacttcaaa

SEQ ID NO: 9505897 - DNA, 22 bp, Homo sapiens
caaatactctggatgtgtttgt

SEQ ID NO: 9505898 - DNA, 22 bp, Homo sapiens
caaatactgagcacgcaatcaa

SEQ ID NO: 9505899 - DNA, 22 bp, Homo sapiens
caaatactacgattcttgcagt

SEQ ID NO: 9505900 - DNA, 22 bp, Homo sapiens
caaatactctggatgtgtttgt

SEQ ID NO: 9505901 - DNA, 22 bp, Homo sapiens
caaatactgagtttattttcaa

SEQ ID NO: 9505902 - DNA, 22 bp, Homo sapiens
caaatactgagtttattttcaa

SEQ ID NO: 9505903 - DNA, 18 bp, Homo sapiens
caaatactgttgtcttat

SEQ ID NO: 9505904 - DNA, 22 bp, Homo sapiens
caaatactgtactgaacactgt

SEQ ID NO: 9505905 - DNA, 18 bp, Homo sapiens
caaatactgttgtcttat

SEQ ID NO: 9505906 - DNA, 22 bp, Homo sapiens
caaatactgggtaagttaattt

SEQ ID NO: 9505907 - DNA, 22 bp, Homo sapiens
caaatactgggtaagttaattt

SEQ ID NO: 9505908 - DNA, 22 bp, Homo sapiens
caaatactgggtaagttaattt

SEQ ID NO: 9505909 - DNA, 22 bp, Homo sapiens
caaatactgtactgaacactgt

SEQ ID NO: 9505910 - DNA, 22 bp, Homo sapiens
atttccatgaagtttagttata

SEQ ID NO: 9505911 - DNA, 22 bp, Homo sapiens
atttccatgtcggtattttata

SEQ ID NO: 9505912 - DNA, 22 bp, Homo sapiens
atttccatgtcggtattttata

SEQ ID NO: 9505913 - DNA, 22 bp, Homo sapiens
atttccattatcatgacaaatt

SEQ ID NO: 9505914 - DNA, 22 bp, Homo sapiens
atttccattatcatgacaaatt

SEQ ID NO: 9505915 - DNA, 21 bp, Homo sapiens
gcccacagtgaggaggatccc

SEQ ID NO: 9505916 - DNA, 22 bp, Homo sapiens
gcccacagtctatcagtttgcg

SEQ ID NO: 9505917 - DNA, 22 bp, Homo sapiens
gcccacagtctatcagtttgcg

SEQ ID NO: 9505918 - DNA, 21 bp, Homo sapiens
gcccacagtgaggaggatccc

SEQ ID NO: 9505919 - DNA, 22 bp, Homo sapiens
gcccacagttaatgggggctct

SEQ ID NO: 9505920 - DNA, 22 bp, Homo sapiens
gcccacagtgtagcaggtactc

SEQ ID NO: 9505921 - DNA, 23 bp, Homo sapiens
gcccaccctcagcgtcctcacgg

SEQ ID NO: 9505922 - DNA, 23 bp, Homo sapiens
gcccaccctcagcgtcctcacgg

SEQ ID NO: 9505923 - DNA, 17 bp, Homo sapiens
gcccacccttaggagct

SEQ ID NO: 9505924 - DNA, 17 bp, Homo sapiens
gcccacccttaggagct

SEQ ID NO: 9505925 - DNA, 17 bp, Homo sapiens
gcccacccttaggagct

SEQ ID NO: 9505926 - DNA, 23 bp, Homo sapiens
gcccaccctcagcgtcctcacgg

SEQ ID NO: 9505927 - DNA, 23 bp, Homo sapiens
gcccaccctcagcgtcctcacgg

SEQ ID NO: 9505928 - DNA, 23 bp, Homo sapiens
gcccaccctcagcgtcctcacgg

SEQ ID NO: 9505929 - DNA, 22 bp, Homo sapiens
gcccacatttttggcttagagg

SEQ ID NO: 9505930 - DNA, 22 bp, Homo sapiens
atttctgtagtccacattcttt

SEQ ID NO: 9505931 - DNA, 22 bp, Homo sapiens
atttctgtaacttatgaaagtt

SEQ ID NO: 9505932 - DNA, 22 bp, Homo sapiens
atttctgtaacttatgaaagtt

SEQ ID NO: 9505933 - DNA, 22 bp, Homo sapiens
atttctgccatagccaggggat

SEQ ID NO: 9505934 - DNA, 22 bp, Homo sapiens
gcccacctaacctgctcacctt

SEQ ID NO: 9505935 - DNA, 22 bp, Homo sapiens
atttctgataaacgtaagctgc

SEQ ID NO: 9505936 - DNA, 22 bp, Homo sapiens
atttctgatacccggtcaccct

SEQ ID NO: 9505937 - DNA, 22 bp, Homo sapiens
atttctcagttcctactgttta

SEQ ID NO: 9505938 - DNA, 22 bp, Homo sapiens
atttctgtgcagtaaatggtga

SEQ ID NO: 9505939 - DNA, 22 bp, Homo sapiens
atttctgtgcagtaaatggtga

SEQ ID NO: 9505940 - DNA, 22 bp, Homo sapiens
atttctgtgcagtaaatggtga

SEQ ID NO: 9505941 - DNA, 22 bp, Homo sapiens
atttctgtatcctgctgtcaga

SEQ ID NO: 9505942 - DNA, 22 bp, Homo sapiens
atttctgttatacctttctcag

SEQ ID NO: 9505943 - DNA, 22 bp, Homo sapiens
atttctgttatacctttctcag

SEQ ID NO: 9505944 - DNA, 22 bp, Homo sapiens
atttctgtggcttcattctcct

SEQ ID NO: 9505945 - DNA, 22 bp, Homo sapiens
atttctgtggcttcattctcct

SEQ ID NO: 9505946 - DNA, 22 bp, Homo sapiens
atttctgtggcttcattctcct

SEQ ID NO: 9505947 - DNA, 22 bp, Homo sapiens
gccccaggttgcctgtcccagg

SEQ ID NO: 9505948 - DNA, 22 bp, Homo sapiens
atttctgttgcttataaattac

SEQ ID NO: 9505949 - DNA, 22 bp, Homo sapiens
gcccccacaggcgggctcgggt

SEQ ID NO: 9505950 - DNA, 22 bp, Homo sapiens
gcccccacaggcgggctcgggt

SEQ ID NO: 9505951 - DNA, 22 bp, Homo sapiens
gccacaggtcggctagagggtc

SEQ ID NO: 9505952 - DNA, 22 bp, Homo sapiens
gccacaggtaggaacctacctc

SEQ ID NO: 9505953 - DNA, 22 bp, Homo sapiens
gccacaggtactatgggagaga

SEQ ID NO: 9505954 - DNA, 22 bp, Homo sapiens
gccacaggtactatgggagaga

SEQ ID NO: 9505955 - DNA, 22 bp, Homo sapiens
gccacaggtactatgggagaga

SEQ ID NO: 9505956 - DNA, 22 bp, Homo sapiens
gccacaggtgggctctgggaaa

SEQ ID NO: 9505957 - DNA, 22 bp, Homo sapiens
gccacaggtggaattaagaaat

SEQ ID NO: 9505958 - DNA, 22 bp, Homo sapiens
gccacaggtgggctctgggaaa

SEQ ID NO: 9505959 - DNA, 22 bp, Homo sapiens
gccacagtcactgctgcagggg

SEQ ID NO: 9505960 - DNA, 19 bp, Homo sapiens
gccaggcctggacctgcag

SEQ ID NO: 9505961 - DNA, 19 bp, Homo sapiens
gccaggcctggacctgcag

SEQ ID NO: 9505962 - DNA, 19 bp, Homo sapiens
gccaggcctggacctgcag

SEQ ID NO: 9505963 - DNA, 22 bp, Homo sapiens
gccaggctgctggctgctgtcc

SEQ ID NO: 9505964 - DNA, 22 bp, Homo sapiens
gccaggctggccagcaccttct

SEQ ID NO: 9505965 - DNA, 22 bp, Homo sapiens
gccaggctggggggagatgtct

SEQ ID NO: 9505966 - DNA, 22 bp, Homo sapiens
gccaggctggggggagatgtct

SEQ ID NO: 9505967 - DNA, 22 bp, Homo sapiens
gccaggctggccagcaccttct

SEQ ID NO: 9505968 - DNA, 22 bp, Homo sapiens
gccaggtggctgagcagctgca

SEQ ID NO: 9505969 - DNA, 22 bp, Homo sapiens
atttccagtgactctcacaggt

SEQ ID NO: 9505970 - DNA, 22 bp, Homo sapiens
atttccaggctgttttgtgaat

SEQ ID NO: 9505971 - DNA, 22 bp, Homo sapiens
atttccaggctgttttgtgaat

SEQ ID NO: 9505972 - DNA, 22 bp, Homo sapiens
gccaggtgcatggctgagtctc

SEQ ID NO: 9505973 - DNA, 22 bp, Homo sapiens
gccaggtggaggttgcagtgag

SEQ ID NO: 9505974 - DNA, 19 bp, Homo sapiens
gccaggtcttgggtccagg

SEQ ID NO: 9505975 - DNA, 19 bp, Homo sapiens
gccaggtcttgggtccagg

SEQ ID NO: 9505976 - DNA, 19 bp, Homo sapiens
gccaggtcttgggtccagg

SEQ ID NO: 9505977 - DNA, 22 bp, Homo sapiens
gccaggtctgggtagcagagga

SEQ ID NO: 9505978 - DNA, 22 bp, Homo sapiens
gccaggtctgggtagcagagga

SEQ ID NO: 9505979 - DNA, 22 bp, Homo sapiens
gccaggtgcacctgccctggcc

SEQ ID NO: 9505980 - DNA, 22 bp, Homo sapiens
gccaggtgagaggactgaggct

SEQ ID NO: 9505981 - DNA, 22 bp, Homo sapiens
gccaggtgagaggactgaggct

SEQ ID NO: 9505982 - DNA, 22 bp, Homo sapiens
gcctggaggaatgtagctgagg

SEQ ID NO: 9505983 - DNA, 22 bp, Homo sapiens
gcctggagttgtggtgaagcca

SEQ ID NO: 9505984 - DNA, 22 bp, Homo sapiens
gcctggagttcagccaagtccc

SEQ ID NO: 9505985 - DNA, 22 bp, Homo sapiens
gcctggattccttgtttctcag

SEQ ID NO: 9505986 - DNA, 22 bp, Homo sapiens
gcctggattccttgtttctcag

SEQ ID NO: 9505987 - DNA, 22 bp, Homo sapiens
gcctggattccttgtttctcag

SEQ ID NO: 9505988 - DNA, 22 bp, Homo sapiens
gcctggattacaaacagccaac

SEQ ID NO: 9505989 - DNA, 22 bp, Homo sapiens
attttactactccaattaatga

SEQ ID NO: 9505990 - DNA, 22 bp, Homo sapiens
attttactactccaattaatga

SEQ ID NO: 9505991 - DNA, 22 bp, Homo sapiens
attttactactccaattaatga

SEQ ID NO: 9505992 - DNA, 22 bp, Homo sapiens
attttactactccaattaatga

SEQ ID NO: 9505993 - DNA, 22 bp, Homo sapiens
attttacttagtgtaatgtcca

SEQ ID NO: 9505994 - DNA, 22 bp, Homo sapiens
gcctggcacattgcagtggatt

SEQ ID NO: 9505995 - DNA, 22 bp, Homo sapiens
gcctggagttgtggtgaagcca

SEQ ID NO: 9505996 - DNA, 22 bp, Homo sapiens
gcctggcaatggcctcaggaag

SEQ ID NO: 9505997 - DNA, 22 bp, Homo sapiens
gcctggcaatggcctcaggaag

SEQ ID NO: 9505998 - DNA, 22 bp, Homo sapiens
atttggaagaaatctgtcacag

SEQ ID NO: 9505999 - DNA, 22 bp, Homo sapiens
atttggaaggtttacaaagaga

SEQ ID NO: 9506000 - DNA, 22 bp, Homo sapiens
atttggaaggtttacaaagaga

SEQ ID NO: 9506001 - DNA, 22 bp, Homo sapiens
atttggaaggcgtttctctgta

SEQ ID NO: 9506002 - DNA, 22 bp, Homo sapiens
atttggaaggcgtttctctgta

SEQ ID NO: 9506003 - DNA, 22 bp, Homo sapiens
gcctgagatcaggagaaagcca

SEQ ID NO: 9506004 - DNA, 22 bp, Homo sapiens
gcctgagacagtgtggtccaat

SEQ ID NO: 9506005 - DNA, 22 bp, Homo sapiens
gcctgagagaactgaccaagag

SEQ ID NO: 9506006 - DNA, 22 bp, Homo sapiens
gcctgagagacccatggggcaa

SEQ ID NO: 9506007 - DNA, 22 bp, Homo sapiens
gcctgagaaggacacagcaggt

SEQ ID NO: 9506008 - DNA, 22 bp, Homo sapiens
gcctgagaaggataggaagcga

SEQ ID NO: 9506009 - DNA, 22 bp, Homo sapiens
gcctgagaaggacacagcaggt

SEQ ID NO: 9506010 - DNA, 22 bp, Homo sapiens
gcctgaagtttcatgcctctat

SEQ ID NO: 9506011 - DNA, 22 bp, Homo sapiens
gcctgaaggagtcagagagggc

SEQ ID NO: 9506012 - DNA, 22 bp, Homo sapiens
gcctgaaggagtcagagagggc

SEQ ID NO: 9506013 - DNA, 22 bp, Homo sapiens
gcctgacctcttctgccctggg

SEQ ID NO: 9506014 - DNA, 22 bp, Homo sapiens
gcctgacttgtgtattttacat

SEQ ID NO: 9506015 - DNA, 22 bp, Homo sapiens
gcccccagctctcaagctcaaa

SEQ ID NO: 9506016 - DNA, 22 bp, Homo sapiens
gcccccagctctcaagctcaaa

SEQ ID NO: 9506017 - DNA, 22 bp, Homo sapiens
gcccccaggcactacatgtgaa

SEQ ID NO: 9506018 - DNA, 22 bp, Homo sapiens
gcccccaggcactacatgtgaa

SEQ ID NO: 9506019 - DNA, 22 bp, Homo sapiens
gcccccaggcactacatgtgaa

SEQ ID NO: 9506020 - DNA, 22 bp, Homo sapiens
gcccccaggctctggagaacct

SEQ ID NO: 9506021 - DNA, 22 bp, Homo sapiens
gcccccaggtgacttatccaca

SEQ ID NO: 9506022 - DNA, 22 bp, Homo sapiens
gcccccaggtgacttatccaca

SEQ ID NO: 9506023 - DNA, 22 bp, Homo sapiens
gcccccaggctctggagaacct

SEQ ID NO: 9506024 - DNA, 22 bp, Homo sapiens
gcccccaggctctggagaacct

SEQ ID NO: 9506025 - DNA, 22 bp, Homo sapiens
gcccccagacctcagtgggctg

SEQ ID NO: 9506026 - DNA, 22 bp, Homo sapiens
gcccccagacctcagtgggctg

SEQ ID NO: 9506027 - DNA, 22 bp, Homo sapiens
gcccccagaagggccacagatt

SEQ ID NO: 9506028 - DNA, 22 bp, Homo sapiens
gcccccagacctcagtgggctg

SEQ ID NO: 9506029 - DNA, 22 bp, Homo sapiens
gcccccagagaatgaggtacga

SEQ ID NO: 9506030 - DNA, 22 bp, Homo sapiens
gcccccagagaatgaggtacga

SEQ ID NO: 9506031 - DNA, 22 bp, Homo sapiens
gcccccagagaatgaggtacga

SEQ ID NO: 9506032 - DNA, 18 bp, Homo sapiens
gcccccagatgctactga

SEQ ID NO: 9506033 - DNA, 18 bp, Homo sapiens
gcccccagatgctactga

SEQ ID NO: 9506034 - DNA, 18 bp, Homo sapiens
gcccccagatgctactga

SEQ ID NO: 9506035 - DNA, 22 bp, Homo sapiens
gcccccagaagggccacagatt

SEQ ID NO: 9506036 - DNA, 22 bp, Homo sapiens
gcccccagaagggccacagatt

SEQ ID NO: 9506037 - DNA, 22 bp, Homo sapiens
gcccccagaagggccacagatt

SEQ ID NO: 9506038 - DNA, 22 bp, Homo sapiens
atttggaaacaattatattctt

SEQ ID NO: 9506039 - DNA, 22 bp, Homo sapiens
atttggaaatgcatctcttgag

SEQ ID NO: 9506040 - DNA, 19 bp, Homo sapiens
atttggaaataaggtcttc

SEQ ID NO: 9506041 - DNA, 22 bp, Homo sapiens
gccccctctttggagccagcca

SEQ ID NO: 9506042 - DNA, 22 bp, Homo sapiens
atttgccttttaaactcacaat

SEQ ID NO: 9506043 - DNA, 22 bp, Homo sapiens
atttggaacttataataagttt

SEQ ID NO: 9506044 - DNA, 22 bp, Homo sapiens
atttggaacttataataagttt

SEQ ID NO: 9506045 - DNA, 22 bp, Homo sapiens
atttggaacaaatattagtaaa

SEQ ID NO: 9506046 - DNA, 22 bp, Homo sapiens
atttggaaatgtaagaatgcaa

SEQ ID NO: 9506047 - DNA, 22 bp, Homo sapiens
atttggaaatgtaagaatgcaa

SEQ ID NO: 9506048 - DNA, 22 bp, Homo sapiens
gcctaggagtggggatggcggt

SEQ ID NO: 9506049 - DNA, 22 bp, Homo sapiens
atttggaacttataataagttt

SEQ ID NO: 9506050 - DNA, 22 bp, Homo sapiens
atttggaagaaatctgtcacag

SEQ ID NO: 9506051 - DNA, 22 bp, Homo sapiens
gcctaggggtaagagtactggc

SEQ ID NO: 9506052 - DNA, 21 bp, Homo sapiens
gcctagggagatgggactgcc

SEQ ID NO: 9506053 - DNA, 22 bp, Homo sapiens
gcctaggattgtaaaagagctt

SEQ ID NO: 9506054 - DNA, 22 bp, Homo sapiens
gcctaggatcaaccacatgaaa

SEQ ID NO: 9506055 - DNA, 22 bp, Homo sapiens
gcctcacatattcatggttact

SEQ ID NO: 9506056 - DNA, 22 bp, Homo sapiens
gcctcacatattcatggttact

SEQ ID NO: 9506057 - DNA, 19 bp, Homo sapiens
gcctctgagggcaggacac

SEQ ID NO: 9506058 - DNA, 19 bp, Homo sapiens
gcctcacaggtctcaggcc

SEQ ID NO: 9506059 - DNA, 22 bp, Homo sapiens
gcctgaagaacagctgtgagga

SEQ ID NO: 9506060 - DNA, 22 bp, Homo sapiens
gcctcttgtttccttacatgga

SEQ ID NO: 9506061 - DNA, 18 bp, Homo sapiens
gcctctgttgcttgcctg

SEQ ID NO: 9506062 - DNA, 22 bp, Homo sapiens
gcctctgatggaggccagcgct

SEQ ID NO: 9506063 - DNA, 22 bp, Homo sapiens
gcctctgagtttggagaagagc

SEQ ID NO: 9506064 - DNA, 22 bp, Homo sapiens
gcctctgagtttggagaagagc

SEQ ID NO: 9506065 - DNA, 22 bp, Homo sapiens
gcctctgatggaggccagcgct

SEQ ID NO: 9506066 - DNA, 22 bp, Homo sapiens
gcctctgatggaggccagcgct

SEQ ID NO: 9506067 - DNA, 20 bp, Homo sapiens
gcctagggtcacttcagtga

SEQ ID NO: 9506068 - DNA, 22 bp, Homo sapiens
gcctaggtaccagcagagagcc

SEQ ID NO: 9506069 - DNA, 19 bp, Homo sapiens
gcctatgtcttcaaatcat

SEQ ID NO: 9506070 - DNA, 22 bp, Homo sapiens
gcctattttattatgcatgtaa

SEQ ID NO: 9506071 - DNA, 22 bp, Homo sapiens
gcctcaaatgtggagcactatt

SEQ ID NO: 9506072 - DNA, 22 bp, Homo sapiens
gacacccctttcaacttggtgg

SEQ ID NO: 9506073 - DNA, 22 bp, Homo sapiens
gacaccagtaaatattcaaaag

SEQ ID NO: 9506074 - DNA, 22 bp, Homo sapiens
gacaccattacctttctatatt

SEQ ID NO: 9506075 - DNA, 22 bp, Homo sapiens
gacacccctttcaacttggtgg

SEQ ID NO: 9506076 - DNA, 23 bp, Homo sapiens
gacaccaggcgtggccctcgaca

SEQ ID NO: 9506077 - DNA, 22 bp, Homo sapiens
gacaccaggaatagttctgtct

SEQ ID NO: 9506078 - DNA, 22 bp, Homo sapiens
gacaccagcaaggctgtgagga

SEQ ID NO: 9506079 - DNA, 22 bp, Homo sapiens
gacaccagagactgatgaggcc

SEQ ID NO: 9506080 - DNA, 22 bp, Homo sapiens
gacaccagagactgatgaggcc

SEQ ID NO: 9506081 - DNA, 22 bp, Homo sapiens
gacaccagaagacataagcaga

SEQ ID NO: 9506082 - DNA, 18 bp, Homo sapiens
gacaccagcctctgcccc

SEQ ID NO: 9506083 - DNA, 18 bp, Homo sapiens
gacaccagcctctgcccc

SEQ ID NO: 9506084 - DNA, 22 bp, Homo sapiens
gacaccagcaaggctgtgagga

SEQ ID NO: 9506085 - DNA, 22 bp, Homo sapiens
gacaccagcaaggctgtgagga

SEQ ID NO: 9506086 - DNA, 22 bp, Homo sapiens
gacacatagatctatctcactc

SEQ ID NO: 9506087 - DNA, 18 bp, Homo sapiens
gacacatccccaggcctc

SEQ ID NO: 9506088 - DNA, 22 bp, Homo sapiens
gacaattgcttttgccgaataa

SEQ ID NO: 9506089 - DNA, 22 bp, Homo sapiens
gacaattgcttttgccgaataa

SEQ ID NO: 9506090 - DNA, 22 bp, Homo sapiens
gacaatttctcaatatagaaac

SEQ ID NO: 9506091 - DNA, 21 bp, Homo sapiens
gacacaaagggtagtaatggt

SEQ ID NO: 9506092 - DNA, 22 bp, Homo sapiens
gacaattgcttttgccgaataa

SEQ ID NO: 9506093 - DNA, 22 bp, Homo sapiens
gacacaaagtttgtcagaaatt

SEQ ID NO: 9506094 - DNA, 22 bp, Homo sapiens
gacacaaagtttgtcagaaatt

SEQ ID NO: 9506095 - DNA, 22 bp, Homo sapiens
gacacaaagtttgtcagaaatt

SEQ ID NO: 9506096 - DNA, 22 bp, Homo sapiens
gacacaaagtttgtcagaaatt

SEQ ID NO: 9506097 - DNA, 22 bp, Homo sapiens
gacacaaagtttgtcagaaatt

SEQ ID NO: 9506098 - DNA, 22 bp, Homo sapiens
gacacaaagtttgtcagaaatt

SEQ ID NO: 9506099 - DNA, 21 bp, Homo sapiens
gacacaaagggtagtaatggt

SEQ ID NO: 9506100 - DNA, 21 bp, Homo sapiens
gacacaaagggtagtaatggt

SEQ ID NO: 9506101 - DNA, 21 bp, Homo sapiens
gacacaaagggtagtaatggt

SEQ ID NO: 9506102 - DNA, 22 bp, Homo sapiens
gacacaaagtttgtcagaaatt

SEQ ID NO: 9506103 - DNA, 21 bp, Homo sapiens
gacacaaagggtagtaatggt

SEQ ID NO: 9506104 - DNA, 21 bp, Homo sapiens
gacacaaagggtagtaatggt

SEQ ID NO: 9506105 - DNA, 22 bp, Homo sapiens
gaccacagactggaaagagggc

SEQ ID NO: 9506106 - DNA, 22 bp, Homo sapiens
gaccacagagcacggcctgctt

SEQ ID NO: 9506107 - DNA, 22 bp, Homo sapiens
gaccacagactggaaagagggc

SEQ ID NO: 9506108 - DNA, 22 bp, Homo sapiens
gaccacagaggtgtgggagaga

SEQ ID NO: 9506109 - DNA, 22 bp, Homo sapiens
gaccacagaggtgtgggagaga

SEQ ID NO: 9506110 - DNA, 22 bp, Homo sapiens
atgctattccagaatgtaaatt

SEQ ID NO: 9506111 - DNA, 22 bp, Homo sapiens
atgctattaatatccagtctga

SEQ ID NO: 9506112 - DNA, 22 bp, Homo sapiens
atgctatgtttggtgttggaga

SEQ ID NO: 9506113 - DNA, 22 bp, Homo sapiens
gaccaaggccaggccagggcgt

SEQ ID NO: 9506114 - DNA, 22 bp, Homo sapiens
gacatttattggattttacgag

SEQ ID NO: 9506115 - DNA, 22 bp, Homo sapiens
gacatttattggattttacgag

SEQ ID NO: 9506116 - DNA, 22 bp, Homo sapiens
gacatttattagaaaactatca

SEQ ID NO: 9506117 - DNA, 22 bp, Homo sapiens
gacatttattagaaaactatca

SEQ ID NO: 9506118 - DNA, 22 bp, Homo sapiens
gacatttattagaaaactatca

SEQ ID NO: 9506119 - DNA, 22 bp, Homo sapiens
gacatttattagaaaactatca

SEQ ID NO: 9506120 - DNA, 22 bp, Homo sapiens
gacatttattagaaaactatca

SEQ ID NO: 9506121 - DNA, 22 bp, Homo sapiens
gacataaatgaagtttgactat

SEQ ID NO: 9506122 - DNA, 22 bp, Homo sapiens
gacataaagttcttgcttgaat

SEQ ID NO: 9506123 - DNA, 22 bp, Homo sapiens
gacacccttcctcctgaggcta

SEQ ID NO: 9506124 - DNA, 22 bp, Homo sapiens
gacatttatgaaggagatatgc

SEQ ID NO: 9506125 - DNA, 22 bp, Homo sapiens
gacataatcctcctcacctact

SEQ ID NO: 9506126 - DNA, 22 bp, Homo sapiens
gacataataatctgacctagat

SEQ ID NO: 9506127 - DNA, 22 bp, Homo sapiens
atgctctgggcaggagccctgg

SEQ ID NO: 9506128 - DNA, 22 bp, Homo sapiens
gaccctggcagataccgtcaca

SEQ ID NO: 9506129 - DNA, 22 bp, Homo sapiens
gaccttgtgatccacctgcctt

SEQ ID NO: 9506130 - DNA, 22 bp, Homo sapiens
gaccttgtgatccacccgcttt

SEQ ID NO: 9506131 - DNA, 22 bp, Homo sapiens
gaccttgtgatccacccgcttt

SEQ ID NO: 9506132 - DNA, 22 bp, Homo sapiens
atgctctgatgctgttaaatgt

SEQ ID NO: 9506133 - DNA, 22 bp, Homo sapiens
atgctctctgtcctgctcagag

SEQ ID NO: 9506134 - DNA, 22 bp, Homo sapiens
atgctctctgtcctgctcagag

SEQ ID NO: 9506135 - DNA, 22 bp, Homo sapiens
gaccttgtgatctgcctgcctt

SEQ ID NO: 9506136 - DNA, 22 bp, Homo sapiens
gaccttgtgatctgcctgcctt

SEQ ID NO: 9506137 - DNA, 22 bp, Homo sapiens
gaccttgtgatctgcccacctt

SEQ ID NO: 9506138 - DNA, 22 bp, Homo sapiens
gaccttgtgatctgcccacctt

SEQ ID NO: 9506139 - DNA, 22 bp, Homo sapiens
gaccttgtgatctgcccacctt

SEQ ID NO: 9506140 - DNA, 21 bp, Homo sapiens
gacctttacatttttcactgt

SEQ ID NO: 9506141 - DNA, 22 bp, Homo sapiens
gacctttaatgtttctaccact

SEQ ID NO: 9506142 - DNA, 22 bp, Homo sapiens
gaccttgtgctccgaggcgggc

SEQ ID NO: 9506143 - DNA, 22 bp, Homo sapiens
gaccttgtgatccacctgcctt

SEQ ID NO: 9506144 - DNA, 22 bp, Homo sapiens
gaccttgtgatccagccacctt

SEQ ID NO: 9506145 - DNA, 22 bp, Homo sapiens
gaccttgtgatccagccacctt

SEQ ID NO: 9506146 - DNA, 22 bp, Homo sapiens
gaccttgtgatccccctgcctt

SEQ ID NO: 9506147 - DNA, 22 bp, Homo sapiens
gaccttgtgatccccctgcctt

SEQ ID NO: 9506148 - DNA, 22 bp, Homo sapiens
gaccttgtgatccgcccgcctt

SEQ ID NO: 9506149 - DNA, 22 bp, Homo sapiens
gaccttgtgatccgcccgcctt

SEQ ID NO: 9506150 - DNA, 22 bp, Homo sapiens
atgctcacttcagagaagatga

SEQ ID NO: 9506151 - DNA, 22 bp, Homo sapiens
atgctcagagaaatataaagtt

SEQ ID NO: 9506152 - DNA, 22 bp, Homo sapiens
atgctcagggcacactctggac

SEQ ID NO: 9506153 - DNA, 22 bp, Homo sapiens
atgctattccagaatgtaaatt

SEQ ID NO: 9506154 - DNA, 22 bp, Homo sapiens
atgctcctcgagtgtctcacag

SEQ ID NO: 9506155 - DNA, 22 bp, Homo sapiens
atgctccaccttttgcaggaac

SEQ ID NO: 9506156 - DNA, 18 bp, Homo sapiens
atgctcctatctctgagc

SEQ ID NO: 9506157 - DNA, 22 bp, Homo sapiens
atgctccttggcttcaaagcca

SEQ ID NO: 9506158 - DNA, 22 bp, Homo sapiens
atgctccttggcttcaaagcca

SEQ ID NO: 9506159 - DNA, 22 bp, Homo sapiens
atgctccttggcttcaaagcca

SEQ ID NO: 9506160 - DNA, 22 bp, Homo sapiens
gacgggtgtccctatgtccatt

SEQ ID NO: 9506161 - DNA, 22 bp, Homo sapiens
gacgggtgtatgctcccagcca

SEQ ID NO: 9506162 - DNA, 22 bp, Homo sapiens
gactacaggccggcatcagaga

SEQ ID NO: 9506163 - DNA, 22 bp, Homo sapiens
gactacaggccggcatcagaga

SEQ ID NO: 9506164 - DNA, 22 bp, Homo sapiens
gacgcactgaaggctggttacc

SEQ ID NO: 9506165 - DNA, 22 bp, Homo sapiens
gacctttagtgtccaatattca

SEQ ID NO: 9506166 - DNA, 22 bp, Homo sapiens
gacctttagtgtcatgttatat

SEQ ID NO: 9506167 - DNA, 22 bp, Homo sapiens
gacctttagtgtcatgttatat

SEQ ID NO: 9506168 - DNA, 22 bp, Homo sapiens
gacggagctggttgctgcggct

SEQ ID NO: 9506169 - DNA, 22 bp, Homo sapiens
gactggcctggagatgcagctg

SEQ ID NO: 9506170 - DNA, 22 bp, Homo sapiens
gactggctctatcaggataaat

SEQ ID NO: 9506171 - DNA, 22 bp, Homo sapiens
gactggcctggggctgggcaca

SEQ ID NO: 9506172 - DNA, 22 bp, Homo sapiens
gactggatgttttgaacatgag

SEQ ID NO: 9506173 - DNA, 22 bp, Homo sapiens
gactgggcagccggtagggaag

SEQ ID NO: 9506174 - DNA, 22 bp, Homo sapiens
gactgggagggttcagctgggt

SEQ ID NO: 9506175 - DNA, 22 bp, Homo sapiens
gactggctctatctccttggcg

SEQ ID NO: 9506176 - DNA, 22 bp, Homo sapiens
gactggaaagcctgtcctcaga

SEQ ID NO: 9506177 - DNA, 22 bp, Homo sapiens
gactggagataaaaccatgagt

SEQ ID NO: 9506178 - DNA, 21 bp, Homo sapiens
gactggagagaggaagtctgg

SEQ ID NO: 9506179 - DNA, 22 bp, Homo sapiens
gaataacattttttcctttaca

SEQ ID NO: 9506180 - DNA, 22 bp, Homo sapiens
gaataacattttttcctttaca

SEQ ID NO: 9506181 - DNA, 22 bp, Homo sapiens
gaataactaaatggcagttctt

SEQ ID NO: 9506182 - DNA, 22 bp, Homo sapiens
gaataactgctatctttctggc

SEQ ID NO: 9506183 - DNA, 22 bp, Homo sapiens
gaataactccatgatatgcttt

SEQ ID NO: 9506184 - DNA, 22 bp, Homo sapiens
gaataatagcagaaattagcag

SEQ ID NO: 9506185 - DNA, 22 bp, Homo sapiens
gaataatagcagaaattagcag

SEQ ID NO: 9506186 - DNA, 22 bp, Homo sapiens
gaataatagcagaaattagcag

SEQ ID NO: 9506187 - DNA, 22 bp, Homo sapiens
gaataatattgactttgcaggc

SEQ ID NO: 9506188 - DNA, 22 bp, Homo sapiens
gaataatattgactttgcaggc

SEQ ID NO: 9506189 - DNA, 22 bp, Homo sapiens
gaatacaaagcagaactcatac

SEQ ID NO: 9506190 - DNA, 22 bp, Homo sapiens
gaatacaaacttaaggctttac

SEQ ID NO: 9506191 - DNA, 22 bp, Homo sapiens
gaataattttgatcagaaggga

SEQ ID NO: 9506192 - DNA, 22 bp, Homo sapiens
gaataattttgatcagaaggga

SEQ ID NO: 9506193 - DNA, 22 bp, Homo sapiens
gaataattgtgatgcttgaagt

SEQ ID NO: 9506194 - DNA, 22 bp, Homo sapiens
gaataatcatgaaattcagtga

SEQ ID NO: 9506195 - DNA, 22 bp, Homo sapiens
gaataatattgactttgcaggc

SEQ ID NO: 9506196 - DNA, 22 bp, Homo sapiens
gaataatattgactttgcaggc

SEQ ID NO: 9506197 - DNA, 22 bp, Homo sapiens
gaataattgtgatgcttgaagt

SEQ ID NO: 9506198 - DNA, 22 bp, Homo sapiens
gaataatcatatcgtctcacat

SEQ ID NO: 9506199 - DNA, 22 bp, Homo sapiens
gaatattttcagtacagatggt

SEQ ID NO: 9506200 - DNA, 22 bp, Homo sapiens
gaatattttcagtacagatggt

SEQ ID NO: 9506201 - DNA, 22 bp, Homo sapiens
gaatattttcagtacagatggt

SEQ ID NO: 9506202 - DNA, 22 bp, Homo sapiens
gaatatttttaaagggactaat

SEQ ID NO: 9506203 - DNA, 22 bp, Homo sapiens
gaatattttcagtacagatggt

SEQ ID NO: 9506204 - DNA, 22 bp, Homo sapiens
gaatattttcagtacagatggt

SEQ ID NO: 9506205 - DNA, 22 bp, Homo sapiens
gaatattttcagtacagatggt

SEQ ID NO: 9506206 - DNA, 22 bp, Homo sapiens
gaatcacagaggcaaattctga

SEQ ID NO: 9506207 - DNA, 22 bp, Homo sapiens
gaatcagaaccactggagggtt

SEQ ID NO: 9506208 - DNA, 22 bp, Homo sapiens
gaatcacactcgtaagtgagtt

SEQ ID NO: 9506209 - DNA, 22 bp, Homo sapiens
gaatcacactcgtaagtgagtt

SEQ ID NO: 9506210 - DNA, 22 bp, Homo sapiens
gaatcaaatcaagttcttttga

SEQ ID NO: 9506211 - DNA, 22 bp, Homo sapiens
gaatcaaatcaagttcttttga

SEQ ID NO: 9506212 - DNA, 22 bp, Homo sapiens
gaatcaaatcaagttcttttga

SEQ ID NO: 9506213 - DNA, 22 bp, Homo sapiens
gaatcaatggtagattaagtaa

SEQ ID NO: 9506214 - DNA, 22 bp, Homo sapiens
gaatcaattgtgaagactatga

SEQ ID NO: 9506215 - DNA, 22 bp, Homo sapiens
gaatcaattatccaggctgttg

SEQ ID NO: 9506216 - DNA, 22 bp, Homo sapiens
gacaataaagtgatacatggga

SEQ ID NO: 9506217 - DNA, 22 bp, Homo sapiens
gacaataaaatgatcttacagt

SEQ ID NO: 9506218 - DNA, 22 bp, Homo sapiens
gaattttatcttattacttgca

SEQ ID NO: 9506219 - DNA, 22 bp, Homo sapiens
gaatcagactacaaatgacccc

SEQ ID NO: 9506220 - DNA, 22 bp, Homo sapiens
gaatcagataataagcaagcat

SEQ ID NO: 9506221 - DNA, 22 bp, Homo sapiens
gaatcagatactgatttcagtc

SEQ ID NO: 9506222 - DNA, 22 bp, Homo sapiens
gaatcagatgcggtttagctta

SEQ ID NO: 9506223 - DNA, 22 bp, Homo sapiens
gaatcagactgacctgagttca

SEQ ID NO: 9506224 - DNA, 22 bp, Homo sapiens
gaatcagaatctgcatttttaa

SEQ ID NO: 9506225 - DNA, 22 bp, Homo sapiens
gaatcagaatctctaaggtggg

SEQ ID NO: 9506226 - DNA, 22 bp, Homo sapiens
gaatcagaatctctggggttgg

SEQ ID NO: 9506227 - DNA, 22 bp, Homo sapiens
gaatcagaatctgcatgttaag

SEQ ID NO: 9506228 - DNA, 22 bp, Homo sapiens
gacaataagaaaagaggaggca

SEQ ID NO: 9506229 - DNA, 22 bp, Homo sapiens
gacaataagaacagatactgtg

SEQ ID NO: 9506230 - DNA, 21 bp, Homo sapiens
gacaatgcagtcttttttgga

SEQ ID NO: 9506231 - DNA, 22 bp, Homo sapiens
gacaatgcattgtgattgtgac

SEQ ID NO: 9506232 - DNA, 22 bp, Homo sapiens
gacaatgcattgtgattgtgac

SEQ ID NO: 9506233 - DNA, 22 bp, Homo sapiens
gacaatgcagaagtacttgttc

SEQ ID NO: 9506234 - DNA, 22 bp, Homo sapiens
gacaatgagtgaggcacctggg

SEQ ID NO: 9506235 - DNA, 22 bp, Homo sapiens
gacaatgagtgaggcacctggg

SEQ ID NO: 9506236 - DNA, 22 bp, Homo sapiens
gaacaatacaggctttattcct

SEQ ID NO: 9506237 - DNA, 22 bp, Homo sapiens
gaacaatacaggctttattcct

SEQ ID NO: 9506238 - DNA, 22 bp, Homo sapiens
gaaggcaacaccaggatgcact

SEQ ID NO: 9506239 - DNA, 22 bp, Homo sapiens
gaacaatagtggtaacaaagcc

SEQ ID NO: 9506240 - DNA, 22 bp, Homo sapiens
gaaggctgctgggaagtgtggt

SEQ ID NO: 9506241 - DNA, 22 bp, Homo sapiens
gaaggcaacaccaggatgcact

SEQ ID NO: 9506242 - DNA, 22 bp, Homo sapiens
gaaggcaagatctcagtggagg

SEQ ID NO: 9506243 - DNA, 22 bp, Homo sapiens
gaaggctgctgggaagtgtggt

SEQ ID NO: 9506244 - DNA, 22 bp, Homo sapiens
gaaggctggaaggcaagtagga

SEQ ID NO: 9506245 - DNA, 22 bp, Homo sapiens
gaaggctggaaggcaagtagga

SEQ ID NO: 9506246 - DNA, 22 bp, Homo sapiens
gaaggctggctttctgagagca

SEQ ID NO: 9506247 - DNA, 22 bp, Homo sapiens
gaaggctggctttctgagagca

SEQ ID NO: 9506248 - DNA, 22 bp, Homo sapiens
gaaggctggaaggcaagtagga

SEQ ID NO: 9506249 - DNA, 22 bp, Homo sapiens
gaaggctggctttctgagagca

SEQ ID NO: 9506250 - DNA, 22 bp, Homo sapiens
gaaggctggctttctgagagca

SEQ ID NO: 9506251 - DNA, 22 bp, Homo sapiens
gaacaaattggagaaatcagga

SEQ ID NO: 9506252 - DNA, 22 bp, Homo sapiens
gaacaaattggagaaatcagga

SEQ ID NO: 9506253 - DNA, 22 bp, Homo sapiens
gaacaactcttcttgagagatg

SEQ ID NO: 9506254 - DNA, 22 bp, Homo sapiens
gaacaactttgaaacatgaaga

SEQ ID NO: 9506255 - DNA, 22 bp, Homo sapiens
gaacaaattctcatcaacttgt

SEQ ID NO: 9506256 - DNA, 22 bp, Homo sapiens
gaacaaattggagaaatcagga

SEQ ID NO: 9506257 - DNA, 22 bp, Homo sapiens
gaacaaatcccttcctgtctcc

SEQ ID NO: 9506258 - DNA, 22 bp, Homo sapiens
gaacaaatcccttcctgtctcc

SEQ ID NO: 9506259 - DNA, 22 bp, Homo sapiens
gaacaaactgggtcccaatgat

SEQ ID NO: 9506260 - DNA, 22 bp, Homo sapiens
gaacaaacatttttggcagtat

SEQ ID NO: 9506261 - DNA, 22 bp, Homo sapiens
gaacaaactgggtcccaatgat

SEQ ID NO: 9506262 - DNA, 19 bp, Homo sapiens
gaacaaacttaaacttttc

SEQ ID NO: 9506263 - DNA, 22 bp, Homo sapiens
gaacaaacagtcaggacagtct

SEQ ID NO: 9506264 - DNA, 22 bp, Homo sapiens
gaacaaacacatcccagcagtg

SEQ ID NO: 9506265 - DNA, 22 bp, Homo sapiens
gaacaaacacatcccagcagtg

SEQ ID NO: 9506266 - DNA, 22 bp, Homo sapiens
gaacaaacacatcccagcagtg

SEQ ID NO: 9506267 - DNA, 22 bp, Homo sapiens
atgcacaggacagcctctactc

SEQ ID NO: 9506268 - DNA, 22 bp, Homo sapiens
atgcacagctgaacactctaaa

SEQ ID NO: 9506269 - DNA, 22 bp, Homo sapiens
atgcacagctgaacactctaaa

SEQ ID NO: 9506270 - DNA, 22 bp, Homo sapiens
atgcacacgtaccctacaaggc

SEQ ID NO: 9506271 - DNA, 22 bp, Homo sapiens
atgcacaatgttttgatttgag

SEQ ID NO: 9506272 - DNA, 22 bp, Homo sapiens
atgcacaattaggatatagctt

SEQ ID NO: 9506273 - DNA, 22 bp, Homo sapiens
atgcacaattaggatatagctt

SEQ ID NO: 9506274 - DNA, 22 bp, Homo sapiens
gaaggctgtttctggtagtgat

SEQ ID NO: 9506275 - DNA, 22 bp, Homo sapiens
gaaggctgtttctggtagtgat

SEQ ID NO: 9506276 - DNA, 22 bp, Homo sapiens
gaaggctgtttctggtagtgat

SEQ ID NO: 9506277 - DNA, 22 bp, Homo sapiens
gaaggctgtcagagaggagggc

SEQ ID NO: 9506278 - DNA, 22 bp, Homo sapiens
gaaggctgtcagagaggagggc

SEQ ID NO: 9506279 - DNA, 22 bp, Homo sapiens
gaaggctgtggctggtctcagt

SEQ ID NO: 9506280 - DNA, 22 bp, Homo sapiens
gaaggctgtcagagaggagggc

SEQ ID NO: 9506281 - DNA, 16 bp, Homo sapiens
gaaggctgggtgatcc

SEQ ID NO: 9506282 - DNA, 22 bp, Homo sapiens
gaaggctggggccttctcatct

SEQ ID NO: 9506283 - DNA, 21 bp, Homo sapiens
gaaatactgccttaggagctg

SEQ ID NO: 9506284 - DNA, 22 bp, Homo sapiens
gaaatactgcacaccctgtaag

SEQ ID NO: 9506285 - DNA, 22 bp, Homo sapiens
gaaatacagttgggaggaggta

SEQ ID NO: 9506286 - DNA, 22 bp, Homo sapiens
gaaagtgcagtcagacaaggca

SEQ ID NO: 9506287 - DNA, 22 bp, Homo sapiens
gaaagtgcagtcagacaaggca

SEQ ID NO: 9506288 - DNA, 22 bp, Homo sapiens
gaaagtgcagtcagacaaggca

SEQ ID NO: 9506289 - DNA, 22 bp, Homo sapiens
gaaatactgtaaagttattatt

SEQ ID NO: 9506290 - DNA, 20 bp, Homo sapiens
gaaatacttacccaactgtt

SEQ ID NO: 9506291 - DNA, 22 bp, Homo sapiens
gaaatagaagctgccaatttct

SEQ ID NO: 9506292 - DNA, 22 bp, Homo sapiens
gaaatagaagctgccaatttct

SEQ ID NO: 9506293 - DNA, 22 bp, Homo sapiens
gaaatagacactttctatgaat

SEQ ID NO: 9506294 - DNA, 22 bp, Homo sapiens
gaaatagacactttctatgaat

SEQ ID NO: 9506295 - DNA, 22 bp, Homo sapiens
gaaatagacactttctatgaat

SEQ ID NO: 9506296 - DNA, 22 bp, Homo sapiens
gaaatagacactttctatgaat

SEQ ID NO: 9506297 - DNA, 22 bp, Homo sapiens
gaaagtattcacaaagttcttg

SEQ ID NO: 9506298 - DNA, 22 bp, Homo sapiens
gaaagtattcacaaagttcttg

SEQ ID NO: 9506299 - DNA, 22 bp, Homo sapiens
gaaagtattctccctgaatttt

SEQ ID NO: 9506300 - DNA, 22 bp, Homo sapiens
gaaagtattagcctagaagtca

SEQ ID NO: 9506301 - DNA, 22 bp, Homo sapiens
gaaagtattagcctagaagtca

SEQ ID NO: 9506302 - DNA, 22 bp, Homo sapiens
gaaagtaacatttcttgaatta

SEQ ID NO: 9506303 - DNA, 22 bp, Homo sapiens
gaaagtatgccatctacctctt

SEQ ID NO: 9506304 - DNA, 22 bp, Homo sapiens
gaaagtatgccatctacctctt

SEQ ID NO: 9506305 - DNA, 22 bp, Homo sapiens
gaaagtaacatttcttgaatta

SEQ ID NO: 9506306 - DNA, 22 bp, Homo sapiens
gaaagtatttacattaacatct

SEQ ID NO: 9506307 - DNA, 22 bp, Homo sapiens
gaaagtatttacattaacatct

SEQ ID NO: 9506308 - DNA, 22 bp, Homo sapiens
gaaagtatttacattaacatct

SEQ ID NO: 9506309 - DNA, 22 bp, Homo sapiens
gaaagtatttaagtccatattt

SEQ ID NO: 9506310 - DNA, 22 bp, Homo sapiens
gaaagtatttaagtccatattt

SEQ ID NO: 9506311 - DNA, 22 bp, Homo sapiens
gaaagtatttaagtccatattt

SEQ ID NO: 9506312 - DNA, 22 bp, Homo sapiens
gaaagtattctccctgaatttt

SEQ ID NO: 9506313 - DNA, 22 bp, Homo sapiens
gaaagtatttaagtccatattt

SEQ ID NO: 9506314 - DNA, 19 bp, Homo sapiens
atgatacaggtgaaaattg

SEQ ID NO: 9506315 - DNA, 19 bp, Homo sapiens
atgatacaggtgaaaattg

SEQ ID NO: 9506316 - DNA, 22 bp, Homo sapiens
gaaatatacatgaagtcggctg

SEQ ID NO: 9506317 - DNA, 22 bp, Homo sapiens
gaaatagtacagcatagttctt

SEQ ID NO: 9506318 - DNA, 22 bp, Homo sapiens
gaaatatacatgaagtcggctg

SEQ ID NO: 9506319 - DNA, 22 bp, Homo sapiens
gaaatagatctctgggatgcaa

SEQ ID NO: 9506320 - DNA, 22 bp, Homo sapiens
gaaatagatctctgggatgcaa

SEQ ID NO: 9506321 - DNA, 22 bp, Homo sapiens
gaaatagaggacagctggatca

SEQ ID NO: 9506322 - DNA, 22 bp, Homo sapiens
gaaatagaggacagctggatca

SEQ ID NO: 9506323 - DNA, 22 bp, Homo sapiens
atgatatatgtgttgagcttgc

SEQ ID NO: 9506324 - DNA, 22 bp, Homo sapiens
atgatatttgcaatgtgcttgc

SEQ ID NO: 9506325 - DNA, 22 bp, Homo sapiens
atgatcagcagttttcagtgtt

SEQ ID NO: 9506326 - DNA, 22 bp, Homo sapiens
atgatgaaaactgaaggttagg

SEQ ID NO: 9506327 - DNA, 22 bp, Homo sapiens
atgatgaaactaggaactagag

SEQ ID NO: 9506328 - DNA, 22 bp, Homo sapiens
atgatctgataatcatccacta

SEQ ID NO: 9506329 - DNA, 22 bp, Homo sapiens
atgatctcattctttcaaaggg

SEQ ID NO: 9506330 - DNA, 19 bp, Homo sapiens
atgatctgcccttgtaata

SEQ ID NO: 9506331 - DNA, 22 bp, Homo sapiens
atgatcatacagagccctggta

SEQ ID NO: 9506332 - DNA, 22 bp, Homo sapiens
atgatcatacagagccctggta

SEQ ID NO: 9506333 - DNA, 22 bp, Homo sapiens
atgatcagggcagaagcagaag

SEQ ID NO: 9506334 - DNA, 22 bp, Homo sapiens
atgatcagggcagaagcagaag

SEQ ID NO: 9506335 - DNA, 22 bp, Homo sapiens
atgatcatggaagtgcacccat

SEQ ID NO: 9506336 - DNA, 22 bp, Homo sapiens
atgatggaatattattcaggca

SEQ ID NO: 9506337 - DNA, 22 bp, Homo sapiens
atgatggaccatcccaatgtga

SEQ ID NO: 9506338 - DNA, 22 bp, Homo sapiens
atgatggaaaaagatcagtcaa

SEQ ID NO: 9506339 - DNA, 22 bp, Homo sapiens
gaaatttattatctacatcatt

SEQ ID NO: 9506340 - DNA, 22 bp, Homo sapiens
gaaagcagtaaatgggtcccat

SEQ ID NO: 9506341 - DNA, 22 bp, Homo sapiens
atgacatgacctggtagagaca

SEQ ID NO: 9506342 - DNA, 22 bp, Homo sapiens
atgacatcactacattattcct

SEQ ID NO: 9506343 - DNA, 22 bp, Homo sapiens
gaaagcagtatttagttctgtt

SEQ ID NO: 9506344 - DNA, 22 bp, Homo sapiens
gaaagcataactaatatttatt

SEQ ID NO: 9506345 - DNA, 22 bp, Homo sapiens
atgacatcaacagtggtgctgt

SEQ ID NO: 9506346 - DNA, 22 bp, Homo sapiens
atgacagtaggtaaatgatagc

SEQ ID NO: 9506347 - DNA, 22 bp, Homo sapiens
atgacagtgggtcttgcaaaga

SEQ ID NO: 9506348 - DNA, 22 bp, Homo sapiens
atgacagtactggtgacaatac

SEQ ID NO: 9506349 - DNA, 21 bp, Homo sapiens
atgacagatgctgcagatcgt

SEQ ID NO: 9506350 - DNA, 20 bp, Homo sapiens
gaaaccagaacgcagccctg

SEQ ID NO: 9506351 - DNA, 22 bp, Homo sapiens
gaaaccacagtacccaggaaaa

SEQ ID NO: 9506352 - DNA, 22 bp, Homo sapiens
gaaacatttgttgagtacttgc

SEQ ID NO: 9506353 - DNA, 22 bp, Homo sapiens
gaaacatttgttgagtacttgc

SEQ ID NO: 9506354 - DNA, 22 bp, Homo sapiens
gaaacatttgttgagtacttgc

SEQ ID NO: 9506355 - DNA, 22 bp, Homo sapiens
gaaacatttgttgagtacttgc

SEQ ID NO: 9506356 - DNA, 22 bp, Homo sapiens
atgacagctctagcacacagta

SEQ ID NO: 9506357 - DNA, 22 bp, Homo sapiens
atgacaggaataactatgatgg

SEQ ID NO: 9506358 - DNA, 22 bp, Homo sapiens
atgacagctaaggaatgtgtag

SEQ ID NO: 9506359 - DNA, 22 bp, Homo sapiens
atgacagtactggtgacaatac

SEQ ID NO: 9506360 - DNA, 22 bp, Homo sapiens
atgacaggaggcagctgggcag

SEQ ID NO: 9506361 - DNA, 22 bp, Homo sapiens
atgacaggaggcagctgggcag

SEQ ID NO: 9506362 - DNA, 22 bp, Homo sapiens
atgacagcattttcttctaagg

SEQ ID NO: 9506363 - DNA, 22 bp, Homo sapiens
atgacagccttgggtacgagag

SEQ ID NO: 9506364 - DNA, 22 bp, Homo sapiens
atgacagcattcaagacataga

SEQ ID NO: 9506365 - DNA, 22 bp, Homo sapiens
atgacagcattcaagacataga

SEQ ID NO: 9506366 - DNA, 22 bp, Homo sapiens
atgacagatgctgtggggaggt

SEQ ID NO: 9506367 - DNA, 22 bp, Homo sapiens
atgacagatgctgtggggaggt

SEQ ID NO: 9506368 - DNA, 22 bp, Homo sapiens
atgacagcagaagcggacgaag

SEQ ID NO: 9506369 - DNA, 17 bp, Homo sapiens
atgacagcattaaggta

SEQ ID NO: 9506370 - DNA, 22 bp, Homo sapiens
gaaaatgttagcttcatagtca

SEQ ID NO: 9506371 - DNA, 22 bp, Homo sapiens
gaaaatgtgtcatccctactgt

SEQ ID NO: 9506372 - DNA, 22 bp, Homo sapiens
ctttctttcgaagacgtgatta

SEQ ID NO: 9506373 - DNA, 22 bp, Homo sapiens
gaaacaggtggcaggctagatt

SEQ ID NO: 9506374 - DNA, 22 bp, Homo sapiens
gaaacaggtggcaggctagatt

SEQ ID NO: 9506375 - DNA, 22 bp, Homo sapiens
ctttcttggtcctgaagatggc

SEQ ID NO: 9506376 - DNA, 22 bp, Homo sapiens
ctttctttcgaagacgtgatta

SEQ ID NO: 9506377 - DNA, 22 bp, Homo sapiens
ctttctttcgaagacgtgatta

SEQ ID NO: 9506378 - DNA, 22 bp, Homo sapiens
ctttctttcgaagacgtgatta

SEQ ID NO: 9506379 - DNA, 22 bp, Homo sapiens
gaaacatagttgagacactgct

SEQ ID NO: 9506380 - DNA, 22 bp, Homo sapiens
gaaacatagttgagacactgct

SEQ ID NO: 9506381 - DNA, 22 bp, Homo sapiens
gaaacattcatatgagaaacct

SEQ ID NO: 9506382 - DNA, 22 bp, Homo sapiens
gaaacattcagtcaacagtgtt

SEQ ID NO: 9506383 - DNA, 22 bp, Homo sapiens
gaaacattcagtcaacagtgtt

SEQ ID NO: 9506384 - DNA, 22 bp, Homo sapiens
gaaacattcagtcaacagtgtt

SEQ ID NO: 9506385 - DNA, 22 bp, Homo sapiens
gaaacattgagcagaaggagaa

SEQ ID NO: 9506386 - DNA, 20 bp, Homo sapiens
gaaacattggcagcaactga

SEQ ID NO: 9506387 - DNA, 20 bp, Homo sapiens
gaaacattggcagcaactga

SEQ ID NO: 9506388 - DNA, 22 bp, Homo sapiens
gaaacattgtgttctacagatt

SEQ ID NO: 9506389 - DNA, 22 bp, Homo sapiens
gaaacattgtgttctacagatt

SEQ ID NO: 9506390 - DNA, 22 bp, Homo sapiens
atgaacatcggaaatgagactg

SEQ ID NO: 9506391 - DNA, 18 bp, Homo sapiens
atgaacactgagctgaat

SEQ ID NO: 9506392 - DNA, 22 bp, Homo sapiens
atgaaattcatctgagaatgct

SEQ ID NO: 9506393 - DNA, 22 bp, Homo sapiens
atgaacagaggaatagaattct

SEQ ID NO: 9506394 - DNA, 22 bp, Homo sapiens
atgaaacagtgaattagtcaag

SEQ ID NO: 9506395 - DNA, 22 bp, Homo sapiens
atgaaacagtgtgtatagcaaa

SEQ ID NO: 9506396 - DNA, 22 bp, Homo sapiens
atgaaacagtgtgtatagcaaa

SEQ ID NO: 9506397 - DNA, 22 bp, Homo sapiens
atgaaacagtgtgtatagcaaa

SEQ ID NO: 9506398 - DNA, 22 bp, Homo sapiens
atgaaattaatcaacacataca

SEQ ID NO: 9506399 - DNA, 22 bp, Homo sapiens
atgaaaatgtacatgtgtataa

SEQ ID NO: 9506400 - DNA, 22 bp, Homo sapiens
atgaaaatgtacatgtgtataa

SEQ ID NO: 9506401 - DNA, 22 bp, Homo sapiens
atgaaaatgtacatgtgtataa

SEQ ID NO: 9506402 - DNA, 22 bp, Homo sapiens
atgaaacacacacgcgcatact

SEQ ID NO: 9506403 - DNA, 22 bp, Homo sapiens
atgaaacagagtacttaatata

SEQ ID NO: 9506404 - DNA, 22 bp, Homo sapiens
atgaaacagagtacttaatata

SEQ ID NO: 9506405 - DNA, 22 bp, Homo sapiens
ctttcttaatttttaaggacac

SEQ ID NO: 9506406 - DNA, 22 bp, Homo sapiens
ctttcttaatttttaaggacac

SEQ ID NO: 9506407 - DNA, 22 bp, Homo sapiens
ctttctggacaagacagaggga

SEQ ID NO: 9506408 - DNA, 22 bp, Homo sapiens
ctttctggcacagccgcgggat

SEQ ID NO: 9506409 - DNA, 22 bp, Homo sapiens
ctttcttaatttttaaggacac

SEQ ID NO: 9506410 - DNA, 22 bp, Homo sapiens
ctttctgattttaagctctaat

SEQ ID NO: 9506411 - DNA, 22 bp, Homo sapiens
ctttctcttcgaaaacctgccc

SEQ ID NO: 9506412 - DNA, 22 bp, Homo sapiens
ctttctcttcgaaaacctgccc

SEQ ID NO: 9506413 - DNA, 22 bp, Homo sapiens
ctttctgaagtttaagttctaa

SEQ ID NO: 9506414 - DNA, 22 bp, Homo sapiens
ctttctcttgagcaagagctgt

SEQ ID NO: 9506415 - DNA, 22 bp, Homo sapiens
atgaagaaaaatccagctgtcc

SEQ ID NO: 9506416 - DNA, 22 bp, Homo sapiens
atgaagaaaaatccagctgtcc

SEQ ID NO: 9506417 - DNA, 22 bp, Homo sapiens
atgaagacaaactgggtagaaa

SEQ ID NO: 9506418 - DNA, 22 bp, Homo sapiens
atgaagacaaactgggtagaaa

SEQ ID NO: 9506419 - DNA, 22 bp, Homo sapiens
atgaacatctctgatccaagca

SEQ ID NO: 9506420 - DNA, 22 bp, Homo sapiens
atgaacatgtgactcagacctg

SEQ ID NO: 9506421 - DNA, 22 bp, Homo sapiens
atgaaccttgatttgttcatct

SEQ ID NO: 9506422 - DNA, 22 bp, Homo sapiens
atgaactaagagtcattagtgt

SEQ ID NO: 9506423 - DNA, 22 bp, Homo sapiens
atgaactatcatcagttccacc

SEQ ID NO: 9506424 - DNA, 22 bp, Homo sapiens
atgaaccataggcaagacaata

SEQ ID NO: 9506425 - DNA, 22 bp, Homo sapiens
atctggaggcattactctgtct

SEQ ID NO: 9506426 - DNA, 22 bp, Homo sapiens
atctggaggcctgtcttatccc

SEQ ID NO: 9506427 - DNA, 22 bp, Homo sapiens
atctggaggtcatcgtttgttc

SEQ ID NO: 9506428 - DNA, 22 bp, Homo sapiens
atctggaggctaagtcatttgc

SEQ ID NO: 9506429 - DNA, 22 bp, Homo sapiens
atctggagtagaaaaatcgctt

SEQ ID NO: 9506430 - DNA, 23 bp, Homo sapiens
atctggagtgttgagtaggtact

SEQ ID NO: 9506431 - DNA, 22 bp, Homo sapiens
atctggagtgggacacagaaat

SEQ ID NO: 9506432 - DNA, 22 bp, Homo sapiens
atctggagtttcagttttctgg

SEQ ID NO: 9506433 - DNA, 22 bp, Homo sapiens
atctggagtttcagttttctgg

SEQ ID NO: 9506434 - DNA, 22 bp, Homo sapiens
atctggagcttgttagatgttt

SEQ ID NO: 9506435 - DNA, 22 bp, Homo sapiens
atctggagctctgcacacctgg

SEQ ID NO: 9506436 - DNA, 22 bp, Homo sapiens
atctggagcttaagcttatata

SEQ ID NO: 9506437 - DNA, 22 bp, Homo sapiens
atctggaggcaaaggggcgtga

SEQ ID NO: 9506438 - DNA, 22 bp, Homo sapiens
atctggaggcaaaggggcgtga

SEQ ID NO: 9506439 - DNA, 22 bp, Homo sapiens
atctggaggattctgggacttg

SEQ ID NO: 9506440 - DNA, 22 bp, Homo sapiens
atctggaggattctgggacttg

SEQ ID NO: 9506441 - DNA, 22 bp, Homo sapiens
atctggagcaagattaagagat

SEQ ID NO: 9506442 - DNA, 22 bp, Homo sapiens
atctggagcagggccacaaggc

SEQ ID NO: 9506443 - DNA, 22 bp, Homo sapiens
atctggagatctgaattttgtg

SEQ ID NO: 9506444 - DNA, 22 bp, Homo sapiens
atctggagatttcttttcaata

SEQ ID NO: 9506445 - DNA, 22 bp, Homo sapiens
atctggagatgggtctgtcacc

SEQ ID NO: 9506446 - DNA, 22 bp, Homo sapiens
cttcttgtgcccatacgttaga

SEQ ID NO: 9506447 - DNA, 22 bp, Homo sapiens
cttcttgttgttagggtcctgt

SEQ ID NO: 9506448 - DNA, 22 bp, Homo sapiens
cttcttgtcaatttgccattgt

SEQ ID NO: 9506449 - DNA, 22 bp, Homo sapiens
cttcttgtcagtgatttcttcc

SEQ ID NO: 9506450 - DNA, 22 bp, Homo sapiens
cttcttgtgcactctctatgta

SEQ ID NO: 9506451 - DNA, 22 bp, Homo sapiens
cttcttgttttagccctcatac

SEQ ID NO: 9506452 - DNA, 18 bp, Homo sapiens
cttcttgtttgatttggg

SEQ ID NO: 9506453 - DNA, 22 bp, Homo sapiens
cttctttaatgtatacaaaaga

SEQ ID NO: 9506454 - DNA, 22 bp, Homo sapiens
atctggagatcagctggtggca

SEQ ID NO: 9506455 - DNA, 22 bp, Homo sapiens
atctggagagctggcagcccag

SEQ ID NO: 9506456 - DNA, 22 bp, Homo sapiens
atctggagagatcttcacaaaa

SEQ ID NO: 9506457 - DNA, 22 bp, Homo sapiens
atctggagaatgtttgtctccg

SEQ ID NO: 9506458 - DNA, 22 bp, Homo sapiens
ctttcccttagccccattctat

SEQ ID NO: 9506459 - DNA, 22 bp, Homo sapiens
ctttccctgcttagaaggattt

SEQ ID NO: 9506460 - DNA, 22 bp, Homo sapiens
ctttccctgcttagaaggattt

SEQ ID NO: 9506461 - DNA, 22 bp, Homo sapiens
ctttcccacgcagtggatgaga

SEQ ID NO: 9506462 - DNA, 22 bp, Homo sapiens
ctttcccagagtagttgatgct

SEQ ID NO: 9506463 - DNA, 22 bp, Homo sapiens
atgaaaagttcgatctagaagg

SEQ ID NO: 9506464 - DNA, 22 bp, Homo sapiens
ctttcccttttgccttgcgtgg

SEQ ID NO: 9506465 - DNA, 22 bp, Homo sapiens
atctggctatttctggtcgggg

SEQ ID NO: 9506466 - DNA, 22 bp, Homo sapiens
atctggctcacttagtctagga

SEQ ID NO: 9506467 - DNA, 22 bp, Homo sapiens
ctttcaaagaccttggcatggg

SEQ ID NO: 9506468 - DNA, 22 bp, Homo sapiens
ctttcaaagagtaggaggtttt

SEQ ID NO: 9506469 - DNA, 22 bp, Homo sapiens
ctttccagcatttccttgtgaa

SEQ ID NO: 9506470 - DNA, 22 bp, Homo sapiens
ctttccagtttctaagtacagt

SEQ ID NO: 9506471 - DNA, 22 bp, Homo sapiens
ctttccaggctgagtttgcttg

SEQ ID NO: 9506472 - DNA, 22 bp, Homo sapiens
ctttccaggtctaaaggcaggg

SEQ ID NO: 9506473 - DNA, 22 bp, Homo sapiens
ctttccaggctgagtttgcttg

SEQ ID NO: 9506474 - DNA, 19 bp, Homo sapiens
ctttccaggagatgctgag

SEQ ID NO: 9506475 - DNA, 22 bp, Homo sapiens
ctttccaggacttgcatttctg

SEQ ID NO: 9506476 - DNA, 22 bp, Homo sapiens
ctttccaggaatcctcacagcc

SEQ ID NO: 9506477 - DNA, 22 bp, Homo sapiens
atgggctgaaagagtaagctgt

SEQ ID NO: 9506478 - DNA, 22 bp, Homo sapiens
atgggctgacaagacatgcata

SEQ ID NO: 9506479 - DNA, 22 bp, Homo sapiens
atgggagaaacatcatgaggca

SEQ ID NO: 9506480 - DNA, 22 bp, Homo sapiens
atgggcagggcagtgtataaga

SEQ ID NO: 9506481 - DNA, 22 bp, Homo sapiens
atgggagaaacatcatgaggca

SEQ ID NO: 9506482 - DNA, 22 bp, Homo sapiens
atgggctgacccagtcgtggca

SEQ ID NO: 9506483 - DNA, 22 bp, Homo sapiens
atgggctgacaagacatgcata

SEQ ID NO: 9506484 - DNA, 22 bp, Homo sapiens
atgggctgagaatcaagaatat

SEQ ID NO: 9506485 - DNA, 22 bp, Homo sapiens
atgggctgacccagtcgtggca

SEQ ID NO: 9506486 - DNA, 22 bp, Homo sapiens
atgggctgacccagtcgtggca

SEQ ID NO: 9506487 - DNA, 22 bp, Homo sapiens
atgggctgaggtgggatagaag

SEQ ID NO: 9506488 - DNA, 22 bp, Homo sapiens
atgggctgcttctccagcacct

SEQ ID NO: 9506489 - DNA, 22 bp, Homo sapiens
atgggctgaggaagctcctgag

SEQ ID NO: 9506490 - DNA, 22 bp, Homo sapiens
atgggctgaggaagctcctgag

SEQ ID NO: 9506491 - DNA, 22 bp, Homo sapiens
atgggctgaggaagctcctgag

SEQ ID NO: 9506492 - DNA, 22 bp, Homo sapiens
atgggaagtgaagtcagggagg

SEQ ID NO: 9506493 - DNA, 22 bp, Homo sapiens
atgggaaggttttgagagcggg

SEQ ID NO: 9506494 - DNA, 19 bp, Homo sapiens
atgggaagcggccagcgga

SEQ ID NO: 9506495 - DNA, 19 bp, Homo sapiens
atgggaagcggccagcgga

SEQ ID NO: 9506496 - DNA, 22 bp, Homo sapiens
atgggaaggttttgagagcggg

SEQ ID NO: 9506497 - DNA, 22 bp, Homo sapiens
atgggaaggttttgagagcggg

SEQ ID NO: 9506498 - DNA, 22 bp, Homo sapiens
atgggacacacaaggaagtaaa

SEQ ID NO: 9506499 - DNA, 22 bp, Homo sapiens
atgggacacagtccgccctcta

SEQ ID NO: 9506500 - DNA, 22 bp, Homo sapiens
atgggacagcatcttggtatta

SEQ ID NO: 9506501 - DNA, 22 bp, Homo sapiens
atgggacacgttttaaggaaaa

SEQ ID NO: 9506502 - DNA, 22 bp, Homo sapiens
atgggacaaacctttgatttga

SEQ ID NO: 9506503 - DNA, 22 bp, Homo sapiens
atgggacaatttgaacacagtg

SEQ ID NO: 9506504 - DNA, 22 bp, Homo sapiens
atgggacaatttgaacacagtg

SEQ ID NO: 9506505 - DNA, 22 bp, Homo sapiens
atgggacaggcatgggacttag

SEQ ID NO: 9506506 - DNA, 22 bp, Homo sapiens
atgggacaggtactagaaaggg

SEQ ID NO: 9506507 - DNA, 22 bp, Homo sapiens
atgggacagggctggctggtcc

SEQ ID NO: 9506508 - DNA, 22 bp, Homo sapiens
atgggacatagatccttgaggt

SEQ ID NO: 9506509 - DNA, 22 bp, Homo sapiens
atgggagaaacatcatgaggca

SEQ ID NO: 9506510 - DNA, 22 bp, Homo sapiens
atgggctggcctttcccgctct

SEQ ID NO: 9506511 - DNA, 22 bp, Homo sapiens
atgggctggcctttcccgctct

SEQ ID NO: 9506512 - DNA, 22 bp, Homo sapiens
atgggctgcttctccagcacct

SEQ ID NO: 9506513 - DNA, 22 bp, Homo sapiens
atgggctgcttctccagcacct

SEQ ID NO: 9506514 - DNA, 22 bp, Homo sapiens
atgggctgcttggcttccaccc

SEQ ID NO: 9506515 - DNA, 22 bp, Homo sapiens
atgggctgcttggcttccaccc

SEQ ID NO: 9506516 - DNA, 22 bp, Homo sapiens
atgggctgcttggcttccaccc

SEQ ID NO: 9506517 - DNA, 22 bp, Homo sapiens
atgggctgggaatacacagggg

SEQ ID NO: 9506518 - DNA, 22 bp, Homo sapiens
atgggctgggaatacacagggg

SEQ ID NO: 9506519 - DNA, 22 bp, Homo sapiens
atgggctggggaagctcactcc

SEQ ID NO: 9506520 - DNA, 22 bp, Homo sapiens
atgggctggggaagctcactcc

SEQ ID NO: 9506521 - DNA, 22 bp, Homo sapiens
atgggctgggatctgagtgtca

SEQ ID NO: 9506522 - DNA, 22 bp, Homo sapiens
atgggctgggatctgagtgtca

SEQ ID NO: 9506523 - DNA, 22 bp, Homo sapiens
atgggctgtcctagtccagccc

SEQ ID NO: 9506524 - DNA, 22 bp, Homo sapiens
atgggctgtgaggtccggcagg

SEQ ID NO: 9506525 - DNA, 22 bp, Homo sapiens
atgggctgtcctagtccagccc

SEQ ID NO: 9506526 - DNA, 22 bp, Homo sapiens
atgggctgtccattgctggctg

SEQ ID NO: 9506527 - DNA, 22 bp, Homo sapiens
atgggctgtcctagtccagccc

SEQ ID NO: 9506528 - DNA, 22 bp, Homo sapiens
atgggctgtcctagtccagccc

SEQ ID NO: 9506529 - DNA, 22 bp, Homo sapiens
atgggctgtccattgctggctg

SEQ ID NO: 9506530 - DNA, 22 bp, Homo sapiens
atgggctgtccattgctggctg

SEQ ID NO: 9506531 - DNA, 20 bp, Homo sapiens
atgggctggttaggaagtgt

SEQ ID NO: 9506532 - DNA, 22 bp, Homo sapiens
atgggctggggaagctcactcc

SEQ ID NO: 9506533 - DNA, 22 bp, Homo sapiens
atgggctggggaagctcactcc

SEQ ID NO: 9506534 - DNA, 22 bp, Homo sapiens
atggggcagaggttaaaggtgg

SEQ ID NO: 9506535 - DNA, 23 bp, Homo sapiens
atggggctcaacacttagtagct

SEQ ID NO: 9506536 - DNA, 22 bp, Homo sapiens
atggggagctcaccacctgttt

SEQ ID NO: 9506537 - DNA, 22 bp, Homo sapiens
atggggagctcaccacctgttt

SEQ ID NO: 9506538 - DNA, 22 bp, Homo sapiens
atggggagagaagggctgagct

SEQ ID NO: 9506539 - DNA, 22 bp, Homo sapiens
atggggagagaagggctgagct

SEQ ID NO: 9506540 - DNA, 22 bp, Homo sapiens
atggggagagaagggctgagct

SEQ ID NO: 9506541 - DNA, 22 bp, Homo sapiens
atggggagagcctctgtcccca

SEQ ID NO: 9506542 - DNA, 22 bp, Homo sapiens
atggggagagcctctgtcccca

SEQ ID NO: 9506543 - DNA, 22 bp, Homo sapiens
atggggagagaagggctgagct

SEQ ID NO: 9506544 - DNA, 22 bp, Homo sapiens
atggggagagaagggctgagct

SEQ ID NO: 9506545 - DNA, 22 bp, Homo sapiens
atgggctgtgggaccctggacc

SEQ ID NO: 9506546 - DNA, 22 bp, Homo sapiens
gaggcagcatggtaccttggag

SEQ ID NO: 9506547 - DNA, 22 bp, Homo sapiens
gaggcagcattcgcatagacag

SEQ ID NO: 9506548 - DNA, 22 bp, Homo sapiens
gaggcagcattcgcatagacag

SEQ ID NO: 9506549 - DNA, 22 bp, Homo sapiens
gaggcagcatctatggtgggaa

SEQ ID NO: 9506550 - DNA, 22 bp, Homo sapiens
gaggcagcatggtaccttggag

SEQ ID NO: 9506551 - DNA, 22 bp, Homo sapiens
gaggcagcatggtaccttggag

SEQ ID NO: 9506552 - DNA, 22 bp, Homo sapiens
gaggcagcctcagtggacctcg

SEQ ID NO: 9506553 - DNA, 22 bp, Homo sapiens
gaggcagcctcagtggacctcg

SEQ ID NO: 9506554 - DNA, 22 bp, Homo sapiens
atggttatgcaaacatgatgca

SEQ ID NO: 9506555 - DNA, 22 bp, Homo sapiens
atggttattactgctgttccag

SEQ ID NO: 9506556 - DNA, 22 bp, Homo sapiens
gaggcacatatatacagagccc

SEQ ID NO: 9506557 - DNA, 22 bp, Homo sapiens
gaggcacatatatacagagccc

SEQ ID NO: 9506558 - DNA, 22 bp, Homo sapiens
gaggcacatatatacagagccc

SEQ ID NO: 9506559 - DNA, 22 bp, Homo sapiens
gaggcagcagggctggttcctt

SEQ ID NO: 9506560 - DNA, 22 bp, Homo sapiens
atggtggatttgtgattcagct

SEQ ID NO: 9506561 - DNA, 22 bp, Homo sapiens
atggtggactcttgattcaggc

SEQ ID NO: 9506562 - DNA, 22 bp, Homo sapiens
atggtgtacagccagatgtaga

SEQ ID NO: 9506563 - DNA, 22 bp, Homo sapiens
atggtggtagaagcactatgtg

SEQ ID NO: 9506564 - DNA, 22 bp, Homo sapiens
atggtggtgaagagcacagtga

SEQ ID NO: 9506565 - DNA, 22 bp, Homo sapiens
atggtggtgaagagcacagtga

SEQ ID NO: 9506566 - DNA, 22 bp, Homo sapiens
atggtgtacagcaatgtgtcag

SEQ ID NO: 9506567 - DNA, 22 bp, Homo sapiens
atggtgaagcttcatgggtgtt

SEQ ID NO: 9506568 - DNA, 22 bp, Homo sapiens
atggtgccaaagatttctaagc

SEQ ID NO: 9506569 - DNA, 21 bp, Homo sapiens
atggtgagatactgggtgtgg

SEQ ID NO: 9506570 - DNA, 18 bp, Homo sapiens
atggtctcatactgggag

SEQ ID NO: 9506571 - DNA, 22 bp, Homo sapiens
atggtcttgggcttaggcagag

SEQ ID NO: 9506572 - DNA, 22 bp, Homo sapiens
atggtcttgtgagagtaacagt

SEQ ID NO: 9506573 - DNA, 18 bp, Homo sapiens
atggtctcatactgggag

SEQ ID NO: 9506574 - DNA, 22 bp, Homo sapiens
gaggagaatgcgcaccacatat

SEQ ID NO: 9506575 - DNA, 17 bp, Homo sapiens
atggtctcactgagcaa

SEQ ID NO: 9506576 - DNA, 22 bp, Homo sapiens
gaggagaagggcacggagaaaa

SEQ ID NO: 9506577 - DNA, 22 bp, Homo sapiens
gaggagaagggcacggagaaaa

SEQ ID NO: 9506578 - DNA, 22 bp, Homo sapiens
gaggagaaatttggggacctga

SEQ ID NO: 9506579 - DNA, 22 bp, Homo sapiens
gaggagaaatttggggacctga

SEQ ID NO: 9506580 - DNA, 22 bp, Homo sapiens
gaggagaaatttggggacctga

SEQ ID NO: 9506581 - DNA, 22 bp, Homo sapiens
gaggagaagctaagaaacacag

SEQ ID NO: 9506582 - DNA, 22 bp, Homo sapiens
gaggagaaattatccttggtgt

SEQ ID NO: 9506583 - DNA, 22 bp, Homo sapiens
gaggagaagctaagaaacacag

SEQ ID NO: 9506584 - DNA, 22 bp, Homo sapiens
gaggagaaattatccttggtgt

SEQ ID NO: 9506585 - DNA, 22 bp, Homo sapiens
gaggagaagctattggaaggac

SEQ ID NO: 9506586 - DNA, 22 bp, Homo sapiens
gaggagaagctattggaaggac

SEQ ID NO: 9506587 - DNA, 22 bp, Homo sapiens
gaggagaagctattggaaggac

SEQ ID NO: 9506588 - DNA, 22 bp, Homo sapiens
gaggagaagctattggaaggac

SEQ ID NO: 9506589 - DNA, 22 bp, Homo sapiens
gaggagaagctaagaaacacag

SEQ ID NO: 9506590 - DNA, 22 bp, Homo sapiens
gaggagaagctattggaaggac

SEQ ID NO: 9506591 - DNA, 22 bp, Homo sapiens
gaggagaagctaagaaacacag

SEQ ID NO: 9506592 - DNA, 22 bp, Homo sapiens
gagatgggcgagaaggtggact

SEQ ID NO: 9506593 - DNA, 22 bp, Homo sapiens
gagatggcttgctctcacgtgg

SEQ ID NO: 9506594 - DNA, 22 bp, Homo sapiens
gagatggcttgctctcacgtgg

SEQ ID NO: 9506595 - DNA, 22 bp, Homo sapiens
gagatgggcgagaaggtggact

SEQ ID NO: 9506596 - DNA, 22 bp, Homo sapiens
gagatgggcgagaaggtggact

SEQ ID NO: 9506597 - DNA, 22 bp, Homo sapiens
gagatgggcgagaaggtggact

SEQ ID NO: 9506598 - DNA, 22 bp, Homo sapiens
gagatggccctggcatgtagct

SEQ ID NO: 9506599 - DNA, 22 bp, Homo sapiens
gagatggctctcagatctttga

SEQ ID NO: 9506600 - DNA, 23 bp, Homo sapiens
gagatggctggttgtcctctgaa

SEQ ID NO: 9506601 - DNA, 22 bp, Homo sapiens
gagatggccagtgccaggacaa

SEQ ID NO: 9506602 - DNA, 22 bp, Homo sapiens
atggagggtgtcagagagcgaa

SEQ ID NO: 9506603 - DNA, 22 bp, Homo sapiens
gagaggtgtgtttcagataaga

SEQ ID NO: 9506604 - DNA, 22 bp, Homo sapiens
gagaggttgaacaacatactct

SEQ ID NO: 9506605 - DNA, 22 bp, Homo sapiens
gagagtcactgtctgcatttcc

SEQ ID NO: 9506606 - DNA, 22 bp, Homo sapiens
gagatggcaggtgtgtgggaca

SEQ ID NO: 9506607 - DNA, 22 bp, Homo sapiens
gagatggagtctttttctgtca

SEQ ID NO: 9506608 - DNA, 22 bp, Homo sapiens
gagatggagtctttttctgtca

SEQ ID NO: 9506609 - DNA, 21 bp, Homo sapiens
atggagggaccagggaagcag

SEQ ID NO: 9506610 - DNA, 22 bp, Homo sapiens
atggagggtggtaagacagaga

SEQ ID NO: 9506611 - DNA, 22 bp, Homo sapiens
atggagggaaaagtggagagcc

SEQ ID NO: 9506612 - DNA, 22 bp, Homo sapiens
atggagggaaaagtggagagcc

SEQ ID NO: 9506613 - DNA, 21 bp, Homo sapiens
atggagggaccagggaagcag

SEQ ID NO: 9506614 - DNA, 21 bp, Homo sapiens
atggagggaccagggaagcag

SEQ ID NO: 9506615 - DNA, 22 bp, Homo sapiens
atggagggaaaagtggagagcc

SEQ ID NO: 9506616 - DNA, 22 bp, Homo sapiens
atggagggaaaagtggagagcc

SEQ ID NO: 9506617 - DNA, 22 bp, Homo sapiens
atggaggatgtgcagcatgggc

SEQ ID NO: 9506618 - DNA, 22 bp, Homo sapiens
atggaggatgtgcagcatgggc

SEQ ID NO: 9506619 - DNA, 22 bp, Homo sapiens
gagagcagactctcaaagctgg

SEQ ID NO: 9506620 - DNA, 22 bp, Homo sapiens
gagagcaatggggacgggcagg

SEQ ID NO: 9506621 - DNA, 22 bp, Homo sapiens
gagagcaatggggacgggcagg

SEQ ID NO: 9506622 - DNA, 22 bp, Homo sapiens
gagagcaatggggacgggcagg

SEQ ID NO: 9506623 - DNA, 22 bp, Homo sapiens
gagagatccagactgtgggtga

SEQ ID NO: 9506624 - DNA, 23 bp, Homo sapiens
gagagcaatgagatgtaaacact

SEQ ID NO: 9506625 - DNA, 23 bp, Homo sapiens
gagagagattgctaaaccactcc

SEQ ID NO: 9506626 - DNA, 22 bp, Homo sapiens
gagagagctctgtgcctgggat

SEQ ID NO: 9506627 - DNA, 22 bp, Homo sapiens
gagagaggcctccatgtactga

SEQ ID NO: 9506628 - DNA, 22 bp, Homo sapiens
gagagaggcctccatgtactga

SEQ ID NO: 9506629 - DNA, 22 bp, Homo sapiens
gagagaggcctccatgtactga

SEQ ID NO: 9506630 - DNA, 21 bp, Homo sapiens
gactgggctgacttgtgctgg

SEQ ID NO: 9506631 - DNA, 22 bp, Homo sapiens
gactgggctccaagagggagag

SEQ ID NO: 9506632 - DNA, 22 bp, Homo sapiens
gactgggccaaggtcagcagct

SEQ ID NO: 9506633 - DNA, 22 bp, Homo sapiens
gagagagaggtgctgccaggca

SEQ ID NO: 9506634 - DNA, 22 bp, Homo sapiens
gagagagaggtgctgccaggca

SEQ ID NO: 9506635 - DNA, 22 bp, Homo sapiens
gagagagagctaatattaagct

SEQ ID NO: 9506636 - DNA, 22 bp, Homo sapiens
gagagagagctaatattaagct

SEQ ID NO: 9506637 - DNA, 22 bp, Homo sapiens
gagagagaagtgggtgtcacct

SEQ ID NO: 9506638 - DNA, 22 bp, Homo sapiens
gagagagaagtgggtgtcacct

SEQ ID NO: 9506639 - DNA, 22 bp, Homo sapiens
gagagagaaggcctgtgggtgt

SEQ ID NO: 9506640 - DNA, 22 bp, Homo sapiens
atggctttccggactttggcca

SEQ ID NO: 9506641 - DNA, 22 bp, Homo sapiens
atggcttggcaccatctccttg

SEQ ID NO: 9506642 - DNA, 22 bp, Homo sapiens
atggcttgcttttagagagatc

SEQ ID NO: 9506643 - DNA, 22 bp, Homo sapiens
atggctttttagactttggtac

SEQ ID NO: 9506644 - DNA, 22 bp, Homo sapiens
atggctttctgtgtttccgtag

SEQ ID NO: 9506645 - DNA, 22 bp, Homo sapiens
atggctttgaagtaatgtaatt

SEQ ID NO: 9506646 - DNA, 22 bp, Homo sapiens
atggcttctagcattgtcacaa

SEQ ID NO: 9506647 - DNA, 21 bp, Homo sapiens
atggcttctcaggtgcactga

SEQ ID NO: 9506648 - DNA, 18 bp, Homo sapiens
atggcttctgagtggagg

SEQ ID NO: 9506649 - DNA, 17 bp, Homo sapiens
atggcttccattgacca

SEQ ID NO: 9506650 - DNA, 22 bp, Homo sapiens
atggcttccaaggccctccgtg

SEQ ID NO: 9506651 - DNA, 17 bp, Homo sapiens
atggcttccattgacca

SEQ ID NO: 9506652 - DNA, 22 bp, Homo sapiens
atggccagagaggccagcctgg

SEQ ID NO: 9506653 - DNA, 22 bp, Homo sapiens
atggccagagaggccagcctgg

SEQ ID NO: 9506654 - DNA, 22 bp, Homo sapiens
atggccagagagagcacacctg

SEQ ID NO: 9506655 - DNA, 22 bp, Homo sapiens
atggctggcatccaggtgggct

SEQ ID NO: 9506656 - DNA, 22 bp, Homo sapiens
atggctggcactggcctgggtt

SEQ ID NO: 9506657 - DNA, 22 bp, Homo sapiens
atggctggcactggcctgggtt

SEQ ID NO: 9506658 - DNA, 22 bp, Homo sapiens
atggctgtgttgttcctctgaa

SEQ ID NO: 9506659 - DNA, 22 bp, Homo sapiens
atggctgttttgtgacttctca

SEQ ID NO: 9506660 - DNA, 22 bp, Homo sapiens
atggctgtttagcttctctgct

SEQ ID NO: 9506661 - DNA, 22 bp, Homo sapiens
atggccagagagagcacacctg

SEQ ID NO: 9506662 - DNA, 22 bp, Homo sapiens
atggccagagaaggcagggtca

SEQ ID NO: 9506663 - DNA, 22 bp, Homo sapiens
atggccagagaaggcagggtca

SEQ ID NO: 9506664 - DNA, 22 bp, Homo sapiens
atggccaaggggcctaggcagg

SEQ ID NO: 9506665 - DNA, 22 bp, Homo sapiens
atggccaaagccacagcagagg

SEQ ID NO: 9506666 - DNA, 22 bp, Homo sapiens
atggcattcacatttccagaga

SEQ ID NO: 9506667 - DNA, 17 bp, Homo sapiens
gagatgggtggatcacc

SEQ ID NO: 9506668 - DNA, 17 bp, Homo sapiens
gagatgggtggatcacc

SEQ ID NO: 9506669 - DNA, 17 bp, Homo sapiens
gagatgggtggatcacc

SEQ ID NO: 9506670 - DNA, 17 bp, Homo sapiens
gagatgggtggatcacc

SEQ ID NO: 9506671 - DNA, 22 bp, Homo sapiens
gagatggggtcttgctatgttg

SEQ ID NO: 9506672 - DNA, 22 bp, Homo sapiens
gagatggggtcttgctatgttg

SEQ ID NO: 9506673 - DNA, 22 bp, Homo sapiens
gagatggggtcagctgggacat

SEQ ID NO: 9506674 - DNA, 22 bp, Homo sapiens
gagatggggtcagctgggacat

SEQ ID NO: 9506675 - DNA, 22 bp, Homo sapiens
gagatggggaataggagcaagc

SEQ ID NO: 9506676 - DNA, 22 bp, Homo sapiens
gagatggggtcagctgggacat

SEQ ID NO: 9506677 - DNA, 22 bp, Homo sapiens
gagatggggaataggagcaagc

SEQ ID NO: 9506678 - DNA, 22 bp, Homo sapiens
gagatggggaataggagcaagc

SEQ ID NO: 9506679 - DNA, 22 bp, Homo sapiens
gagatgggcgagaaggtggact

SEQ ID NO: 9506680 - DNA, 22 bp, Homo sapiens
gagatggggaataggagcaagc

SEQ ID NO: 9506681 - DNA, 22 bp, Homo sapiens
gagatggggaataggagcaagc

SEQ ID NO: 9506682 - DNA, 22 bp, Homo sapiens
gagggctccattccccgtgccc

SEQ ID NO: 9506683 - DNA, 22 bp, Homo sapiens
gagggctcactgagaaagcagt

SEQ ID NO: 9506684 - DNA, 23 bp, Homo sapiens
gagggctctgagtgcttgggcca

SEQ ID NO: 9506685 - DNA, 22 bp, Homo sapiens
gagggctgaagattgtggcccc

SEQ ID NO: 9506686 - DNA, 22 bp, Homo sapiens
gagggctgaagattgtggcccc

SEQ ID NO: 9506687 - DNA, 22 bp, Homo sapiens
gagggctctgtctggaagggaa

SEQ ID NO: 9506688 - DNA, 22 bp, Homo sapiens
gagggctctgtctggaagggaa

SEQ ID NO: 9506689 - DNA, 19 bp, Homo sapiens
atgtctctgtagcacatac

SEQ ID NO: 9506690 - DNA, 19 bp, Homo sapiens
atgtctctgtagcacatac

SEQ ID NO: 9506691 - DNA, 22 bp, Homo sapiens
atgtctctttagagcaacagta

SEQ ID NO: 9506692 - DNA, 22 bp, Homo sapiens
atgtctgataaataatgcataa

SEQ ID NO: 9506693 - DNA, 22 bp, Homo sapiens
atgtctgcggcccaggccaggg

SEQ ID NO: 9506694 - DNA, 22 bp, Homo sapiens
atgtctgcgttatatcaatatc

SEQ ID NO: 9506695 - DNA, 22 bp, Homo sapiens
atgtctgagtctgctccagttg

SEQ ID NO: 9506696 - DNA, 20 bp, Homo sapiens
atgtctgaagtaatccattt

SEQ ID NO: 9506697 - DNA, 20 bp, Homo sapiens
atgtctgaagtaatccattt

SEQ ID NO: 9506698 - DNA, 22 bp, Homo sapiens
gagggcgatggtttcagtttct

SEQ ID NO: 9506699 - DNA, 22 bp, Homo sapiens
gagggcagaaaattatgcggtg

SEQ ID NO: 9506700 - DNA, 20 bp, Homo sapiens
atgtgaagtaggaagggtgt

SEQ ID NO: 9506701 - DNA, 21 bp, Homo sapiens
atgtgaaatatcatcagagca

SEQ ID NO: 9506702 - DNA, 21 bp, Homo sapiens
atgtgaaatatcatcagagca

SEQ ID NO: 9506703 - DNA, 22 bp, Homo sapiens
atgtgaaactgaagcatccata

SEQ ID NO: 9506704 - DNA, 22 bp, Homo sapiens
atgtgaaacgcaatgggatcat

SEQ ID NO: 9506705 - DNA, 22 bp, Homo sapiens
gagggctgaagattgtggcccc

SEQ ID NO: 9506706 - DNA, 22 bp, Homo sapiens
gagggctgaagattgtggcccc

SEQ ID NO: 9506707 - DNA, 20 bp, Homo sapiens
atgtgaaagatcagttgtct

SEQ ID NO: 9506708 - DNA, 22 bp, Homo sapiens
atgtgactccaggcagttttgt

SEQ ID NO: 9506709 - DNA, 22 bp, Homo sapiens
atgtgagactaaaaagatgtgc

SEQ ID NO: 9506710 - DNA, 22 bp, Homo sapiens
atgtgagatgcacataattata

SEQ ID NO: 9506711 - DNA, 20 bp, Homo sapiens
gaggtagggcttaaggcaag

SEQ ID NO: 9506712 - DNA, 22 bp, Homo sapiens
gaggtggatgttgcagtgagct

SEQ ID NO: 9506713 - DNA, 22 bp, Homo sapiens
gaggtggatgttgcagtgagct

SEQ ID NO: 9506714 - DNA, 22 bp, Homo sapiens
gaggtggatgttgcagtgagct

SEQ ID NO: 9506715 - DNA, 22 bp, Homo sapiens
atgtgagggctcaggctgactg

SEQ ID NO: 9506716 - DNA, 22 bp, Homo sapiens
gaggtagggcagaggctgaatg

SEQ ID NO: 9506717 - DNA, 22 bp, Homo sapiens
gaggtagggcagaggctgaatg

SEQ ID NO: 9506718 - DNA, 22 bp, Homo sapiens
gaggcagcgggtcaggaccgtg

SEQ ID NO: 9506719 - DNA, 22 bp, Homo sapiens
gaggcagcggctcacagagaaa

SEQ ID NO: 9506720 - DNA, 22 bp, Homo sapiens
atgtagaaataatttcagttcc

SEQ ID NO: 9506721 - DNA, 22 bp, Homo sapiens
atgtagaacaggttaatgacag

SEQ ID NO: 9506722 - DNA, 22 bp, Homo sapiens
atgtagaacaggttaatgacag

SEQ ID NO: 9506723 - DNA, 22 bp, Homo sapiens
atgtagaattccttctactttg

SEQ ID NO: 9506724 - DNA, 22 bp, Homo sapiens
atgtagaggagtttctggtctg

SEQ ID NO: 9506725 - DNA, 22 bp, Homo sapiens
atgtagaagctgacagtgctgt

SEQ ID NO: 9506726 - DNA, 22 bp, Homo sapiens
atgtagaacaggttaatgacag

SEQ ID NO: 9506727 - DNA, 22 bp, Homo sapiens
atgtagaacaggttaatgacag

SEQ ID NO: 9506728 - DNA, 22 bp, Homo sapiens
atgtagaagtgggcattataga

SEQ ID NO: 9506729 - DNA, 22 bp, Homo sapiens
atgtagaagtgggcattataga

SEQ ID NO: 9506730 - DNA, 22 bp, Homo sapiens
atgtagaagtgggcattataga

SEQ ID NO: 9506731 - DNA, 22 bp, Homo sapiens
atgtagcatctatcctgataaa

SEQ ID NO: 9506732 - DNA, 22 bp, Homo sapiens
atgtcatgaaatgctactaact

SEQ ID NO: 9506733 - DNA, 22 bp, Homo sapiens
atgtagctgcagatgataatgc

SEQ ID NO: 9506734 - DNA, 22 bp, Homo sapiens
atgtagatttgcttctcctgcc

SEQ ID NO: 9506735 - DNA, 22 bp, Homo sapiens
atgtagatgttcacttgatttt

SEQ ID NO: 9506736 - DNA, 22 bp, Homo sapiens
atgtccctcactcctcattcag

SEQ ID NO: 9506737 - DNA, 22 bp, Homo sapiens
atgtcatgggccaaaaatagtt

SEQ ID NO: 9506738 - DNA, 22 bp, Homo sapiens
atgtcctgttttggcttgctct

SEQ ID NO: 9506739 - DNA, 23 bp, Homo sapiens
atgtcctgtgatgcttaatgacc

SEQ ID NO: 9506740 - DNA, 22 bp, Homo sapiens
atgtcctgctgattcacattat

SEQ ID NO: 9506741 - DNA, 22 bp, Homo sapiens
atgtccttaatctgaatgttag

SEQ ID NO: 9506742 - DNA, 22 bp, Homo sapiens
atgtccttaatctgaatgttag

SEQ ID NO: 9506743 - DNA, 22 bp, Homo sapiens
atgtccttccattttgatctgt

SEQ ID NO: 9506744 - DNA, 22 bp, Homo sapiens
atgtccttccattttgatctgt

SEQ ID NO: 9506745 - DNA, 22 bp, Homo sapiens
atgtccttcatctaggagatgg

SEQ ID NO: 9506746 - DNA, 22 bp, Homo sapiens
atgtccttcctgagatccctgt

SEQ ID NO: 9506747 - DNA, 22 bp, Homo sapiens
atgtccttcctgagatccctgt

SEQ ID NO: 9506748 - DNA, 22 bp, Homo sapiens
atgtccttcggacaaaattctt

SEQ ID NO: 9506749 - DNA, 22 bp, Homo sapiens
atgtccttcgtaggggcagcag

SEQ ID NO: 9506750 - DNA, 22 bp, Homo sapiens
atgtccttggagtccactttcc

SEQ ID NO: 9506751 - DNA, 22 bp, Homo sapiens
atgtccttggaacacctgaggt

SEQ ID NO: 9506752 - DNA, 22 bp, Homo sapiens
atgtccttgagaccctcctcgg

SEQ ID NO: 9506753 - DNA, 22 bp, Homo sapiens
atgtccttgagaccctcctcgg

SEQ ID NO: 9506754 - DNA, 22 bp, Homo sapiens
atgtccttcttgagggcttgtt

SEQ ID NO: 9506755 - DNA, 22 bp, Homo sapiens
atgtccttctcctcttacctgc

SEQ ID NO: 9506756 - DNA, 22 bp, Homo sapiens
atgtccttctctggggcccaga

SEQ ID NO: 9506757 - DNA, 22 bp, Homo sapiens
atgtccttgttttggtgacact

SEQ ID NO: 9506758 - DNA, 22 bp, Homo sapiens
atgtccttgtgagtaaatgatg

SEQ ID NO: 9506759 - DNA, 21 bp, Homo sapiens
atgtcctttgctctcccacat

SEQ ID NO: 9506760 - DNA, 22 bp, Homo sapiens
atgtcctttaaatgacttaata

SEQ ID NO: 9506761 - DNA, 22 bp, Homo sapiens
atgtccttgggccagggtgcct

SEQ ID NO: 9506762 - DNA, 22 bp, Homo sapiens
atgtccttggggctggggaact

SEQ ID NO: 9506763 - DNA, 22 bp, Homo sapiens
atgtctctctctgagtgccaga

SEQ ID NO: 9506764 - DNA, 22 bp, Homo sapiens
atgtctctgccccagagagctt

SEQ ID NO: 9506765 - DNA, 22 bp, Homo sapiens
atgtctctgctgtggttagctt

SEQ ID NO: 9506766 - DNA, 19 bp, Homo sapiens
atgtctctgtagcacatac

SEQ ID NO: 9506767 - DNA, 22 bp, Homo sapiens
atgtctctcatgaccaaagaag

SEQ ID NO: 9506768 - DNA, 22 bp, Homo sapiens
atgtctctctctgagtgccaga

SEQ ID NO: 9506769 - DNA, 22 bp, Homo sapiens
atgtctctgccccagagagctt

SEQ ID NO: 9506770 - DNA, 22 bp, Homo sapiens
atgtctctcaggtttaacttta

SEQ ID NO: 9506771 - DNA, 22 bp, Homo sapiens
atgtctatatagtcaataatca

SEQ ID NO: 9506772 - DNA, 21 bp, Homo sapiens
atgtctatgacatatttcctt

SEQ ID NO: 9506773 - DNA, 22 bp, Homo sapiens
atgtctatatagtcaataatca

SEQ ID NO: 9506774 - DNA, 22 bp, Homo sapiens
atgtccttttaaaatgtgagaa

SEQ ID NO: 9506775 - DNA, 22 bp, Homo sapiens
atgtccttttaaaatgtgagaa

SEQ ID NO: 9506776 - DNA, 22 bp, Homo sapiens
atgtcctttgttctgagggagt

SEQ ID NO: 9506777 - DNA, 22 bp, Homo sapiens
atgtccttttatttaaagcagg

SEQ ID NO: 9506778 - DNA, 22 bp, Homo sapiens
atgtccttttatttaaagcagg

SEQ ID NO: 9506779 - DNA, 22 bp, Homo sapiens
atgtcctttgtatgcttgtact

SEQ ID NO: 9506780 - DNA, 22 bp, Homo sapiens
atgtcctttgtatccctaggca

SEQ ID NO: 9506781 - DNA, 22 bp, Homo sapiens
atgtcctttgtatccctaggca

SEQ ID NO: 9506782 - DNA, 22 bp, Homo sapiens
atgtcctttgcttctctggtcc

SEQ ID NO: 9506783 - DNA, 22 bp, Homo sapiens
atgtcctttgttctgagggagt

SEQ ID NO: 9506784 - DNA, 22 bp, Homo sapiens
atgtcctttgtgtgtagctctc

SEQ ID NO: 9506785 - DNA, 22 bp, Homo sapiens
atgttggagtcgtaaggcatgg

SEQ ID NO: 9506786 - DNA, 22 bp, Homo sapiens
atgttgggaaggccgcaggcac

SEQ ID NO: 9506787 - DNA, 22 bp, Homo sapiens
atgtttaaaggagtcagagact

SEQ ID NO: 9506788 - DNA, 22 bp, Homo sapiens
atgttgtgtttgactgttaccc

SEQ ID NO: 9506789 - DNA, 22 bp, Homo sapiens
atgtttaaggaactggtttgct

SEQ ID NO: 9506790 - DNA, 22 bp, Homo sapiens
atgtttaagaaagtcttccata

SEQ ID NO: 9506791 - DNA, 22 bp, Homo sapiens
atgtttaagaaagtcttccata

SEQ ID NO: 9506792 - DNA, 22 bp, Homo sapiens
atgtttaaatttatagacagtg

SEQ ID NO: 9506793 - DNA, 22 bp, Homo sapiens
atgtttaaatttatagacagtg

SEQ ID NO: 9506794 - DNA, 22 bp, Homo sapiens
atgtttaaagggttgagaaata

SEQ ID NO: 9506795 - DNA, 22 bp, Homo sapiens
atgtttaaaggagtcagagact

SEQ ID NO: 9506796 - DNA, 22 bp, Homo sapiens
gataatatctggtttattcacc

SEQ ID NO: 9506797 - DNA, 22 bp, Homo sapiens
atgtttaatcggctgcctttcc

SEQ ID NO: 9506798 - DNA, 22 bp, Homo sapiens
gataatggggaatgataagtca

SEQ ID NO: 9506799 - DNA, 22 bp, Homo sapiens
gataatgtgccgataatttcta

SEQ ID NO: 9506800 - DNA, 22 bp, Homo sapiens
gataatgtggatttattgtgat

SEQ ID NO: 9506801 - DNA, 22 bp, Homo sapiens
gataatttctccatctcaaggt

SEQ ID NO: 9506802 - DNA, 22 bp, Homo sapiens
gataatttctccatctcaaggt

SEQ ID NO: 9506803 - DNA, 22 bp, Homo sapiens
gataatttgatacctcaatcag

SEQ ID NO: 9506804 - DNA, 22 bp, Homo sapiens
gataattataggctaagccact

SEQ ID NO: 9506805 - DNA, 22 bp, Homo sapiens
gataattataggctaagccact

SEQ ID NO: 9506806 - DNA, 22 bp, Homo sapiens
gataattttagtctgaaaattg

SEQ ID NO: 9506807 - DNA, 22 bp, Homo sapiens
gataatttgatacctcaatcag

SEQ ID NO: 9506808 - DNA, 22 bp, Homo sapiens
gataattttagtctgaaaattg

SEQ ID NO: 9506809 - DNA, 22 bp, Homo sapiens
gatacaaaatataaatggagag

SEQ ID NO: 9506810 - DNA, 22 bp, Homo sapiens
gatacaaaatataaatggagag

SEQ ID NO: 9506811 - DNA, 18 bp, Homo sapiens
gatatggaaggccatgcc

SEQ ID NO: 9506812 - DNA, 22 bp, Homo sapiens
gatatgtatgaggagtatgtat

SEQ ID NO: 9506813 - DNA, 22 bp, Homo sapiens
gatatgtaccacctcttaaaag

SEQ ID NO: 9506814 - DNA, 18 bp, Homo sapiens
gatatggaaggccatgcc

SEQ ID NO: 9506815 - DNA, 22 bp, Homo sapiens
gatatcattgagcccaggagtt

SEQ ID NO: 9506816 - DNA, 22 bp, Homo sapiens
gatatcatgggaaggtgtactt

SEQ ID NO: 9506817 - DNA, 22 bp, Homo sapiens
gatatgaagtggcattgtgaag

SEQ ID NO: 9506818 - DNA, 22 bp, Homo sapiens
gatacaaattcatgtctgaatt

SEQ ID NO: 9506819 - DNA, 22 bp, Homo sapiens
gatacaaattcatgtctgaatt

SEQ ID NO: 9506820 - DNA, 22 bp, Homo sapiens
gatacaaattcatgtctgaatt

SEQ ID NO: 9506821 - DNA, 22 bp, Homo sapiens
gatacacaagtggaaggagacg

SEQ ID NO: 9506822 - DNA, 22 bp, Homo sapiens
gatacaagactaataggaaaca

SEQ ID NO: 9506823 - DNA, 22 bp, Homo sapiens
gatacacaagtggaaggagacg

SEQ ID NO: 9506824 - DNA, 22 bp, Homo sapiens
atgtgtctggcatggctctatt

SEQ ID NO: 9506825 - DNA, 22 bp, Homo sapiens
atgtgtctggttattgacatgc

SEQ ID NO: 9506826 - DNA, 20 bp, Homo sapiens
atgtgtctgtaaacaactct

SEQ ID NO: 9506827 - DNA, 20 bp, Homo sapiens
atgtgtcttagagcatcagg

SEQ ID NO: 9506828 - DNA, 22 bp, Homo sapiens
atgtgtctgtgggcacacacac

SEQ ID NO: 9506829 - DNA, 20 bp, Homo sapiens
atgtgtcttagagcatcagg

SEQ ID NO: 9506830 - DNA, 22 bp, Homo sapiens
atgtgtcttatttgattccaca

SEQ ID NO: 9506831 - DNA, 22 bp, Homo sapiens
atgtgtcttctaagccaagcct

SEQ ID NO: 9506832 - DNA, 22 bp, Homo sapiens
atgttatttctgaaagatcatt

SEQ ID NO: 9506833 - DNA, 22 bp, Homo sapiens
atgttcttagcaaagtacttgc

SEQ ID NO: 9506834 - DNA, 20 bp, Homo sapiens
atgttcttcatttaatgttc

SEQ ID NO: 9506835 - DNA, 20 bp, Homo sapiens
atgttcttcatttaatgttc

SEQ ID NO: 9506836 - DNA, 22 bp, Homo sapiens
atgttcttctatctttattaaa

SEQ ID NO: 9506837 - DNA, 22 bp, Homo sapiens
atgttcttccttcaatttggaa

SEQ ID NO: 9506838 - DNA, 22 bp, Homo sapiens
atgttcttccaaatctgtaaca

SEQ ID NO: 9506839 - DNA, 22 bp, Homo sapiens
atgttcttggatgttgtgtata

SEQ ID NO: 9506840 - DNA, 22 bp, Homo sapiens
atgttcttggatgttgtgtata

SEQ ID NO: 9506841 - DNA, 22 bp, Homo sapiens
atgttcttgactttcctgcctg

SEQ ID NO: 9506842 - DNA, 22 bp, Homo sapiens
atgttcttgttcaaatgtcagt

SEQ ID NO: 9506843 - DNA, 22 bp, Homo sapiens
atgttcttgttcaaatgtcagt

SEQ ID NO: 9506844 - DNA, 22 bp, Homo sapiens
atgttctttcagccagtgcatc

SEQ ID NO: 9506845 - DNA, 22 bp, Homo sapiens
atgttctttgaaatattttaga

SEQ ID NO: 9506846 - DNA, 22 bp, Homo sapiens
atgttctttcagccagtgcatc

SEQ ID NO: 9506847 - DNA, 22 bp, Homo sapiens
atgttctttgaaatattttaga

SEQ ID NO: 9506848 - DNA, 22 bp, Homo sapiens
atgttgcacaaagtccatccat

SEQ ID NO: 9506849 - DNA, 22 bp, Homo sapiens
gaggtggcaatttaatgcagtc

SEQ ID NO: 9506850 - DNA, 22 bp, Homo sapiens
gaggtggcactgtgaggagcac

SEQ ID NO: 9506851 - DNA, 22 bp, Homo sapiens
gaggtggcagaggcctggacct

SEQ ID NO: 9506852 - DNA, 22 bp, Homo sapiens
gaggtggcccttgctcagcctt

SEQ ID NO: 9506853 - DNA, 22 bp, Homo sapiens
gaggtggcccttgctcagcctt

SEQ ID NO: 9506854 - DNA, 22 bp, Homo sapiens
gaggtggcctcaagcagtcttc

SEQ ID NO: 9506855 - DNA, 22 bp, Homo sapiens
gaggtggcctcaagcagtcttc

SEQ ID NO: 9506856 - DNA, 22 bp, Homo sapiens
gaggtggccagagtcaagagcc

SEQ ID NO: 9506857 - DNA, 22 bp, Homo sapiens
gaggtggccagagtcaagagcc

SEQ ID NO: 9506858 - DNA, 22 bp, Homo sapiens
atgtgtctaattccaggagcac

SEQ ID NO: 9506859 - DNA, 22 bp, Homo sapiens
atgtgtctagattgctgtaccg

SEQ ID NO: 9506860 - DNA, 17 bp, Homo sapiens
atgtgtctagtgcaacc

SEQ ID NO: 9506861 - DNA, 22 bp, Homo sapiens
atgtgtctctaaaatttagtaa

SEQ ID NO: 9506862 - DNA, 22 bp, Homo sapiens
gaggtggcgcgccatccctgcc

SEQ ID NO: 9506863 - DNA, 20 bp, Homo sapiens
atgtgtctgcctctgtgttc

SEQ ID NO: 9506864 - DNA, 22 bp, Homo sapiens
atgtgtctgatggccctgaatt

SEQ ID NO: 9506865 - DNA, 22 bp, Homo sapiens
atgtgtctggcatggaaagtgt

SEQ ID NO: 9506866 - DNA, 17 bp, Homo sapiens
atgtgtctgagtgtcct

SEQ ID NO: 9506867 - DNA, 22 bp, Homo sapiens
atgtgtctgaccactgtattgg

SEQ ID NO: 9506868 - DNA, 22 bp, Homo sapiens
atgtgtctctaccaatgcaatt

SEQ ID NO: 9506869 - DNA, 22 bp, Homo sapiens
atattacttcctggtataaaat

SEQ ID NO: 9506870 - DNA, 22 bp, Homo sapiens
atattactctgatttagtaaat

SEQ ID NO: 9506871 - DNA, 22 bp, Homo sapiens
atattacttcctggtataaaat

SEQ ID NO: 9506872 - DNA, 22 bp, Homo sapiens
atattacataaacatgagtgaa

SEQ ID NO: 9506873 - DNA, 22 bp, Homo sapiens
atattataagttatttcaagtt

SEQ ID NO: 9506874 - DNA, 22 bp, Homo sapiens
atattataagttatttcaagtt

SEQ ID NO: 9506875 - DNA, 22 bp, Homo sapiens
atattataagttatttcaagtt

SEQ ID NO: 9506876 - DNA, 22 bp, Homo sapiens
atattagtgtaggtagctaata

SEQ ID NO: 9506877 - DNA, 22 bp, Homo sapiens
atattagtttggagactacaat

SEQ ID NO: 9506878 - DNA, 22 bp, Homo sapiens
atattaaaactatggttttcag

SEQ ID NO: 9506879 - DNA, 22 bp, Homo sapiens
atattacataaacatgagtgaa

SEQ ID NO: 9506880 - DNA, 22 bp, Homo sapiens
atatgtttttggaaagaacaca

SEQ ID NO: 9506881 - DNA, 21 bp, Homo sapiens
atatgccaaatgccagtaacc

SEQ ID NO: 9506882 - DNA, 22 bp, Homo sapiens
atatgcatttacctggcatata

SEQ ID NO: 9506883 - DNA, 22 bp, Homo sapiens
atatgccatactgtacaatact

SEQ ID NO: 9506884 - DNA, 22 bp, Homo sapiens
ctgggctgagcctgggctgtgt

SEQ ID NO: 9506885 - DNA, 22 bp, Homo sapiens
ctgggctgagcctgggctgtgt

SEQ ID NO: 9506886 - DNA, 22 bp, Homo sapiens
ctgggctgaaggctccccacac

SEQ ID NO: 9506887 - DNA, 22 bp, Homo sapiens
ctgggctgaaggctccccacac

SEQ ID NO: 9506888 - DNA, 22 bp, Homo sapiens
ctgggctgagcctgggctgtgt

SEQ ID NO: 9506889 - DNA, 19 bp, Homo sapiens
ctgggctgaggtctgcctt

SEQ ID NO: 9506890 - DNA, 22 bp, Homo sapiens
ctgggctgagctgtggaaactc

SEQ ID NO: 9506891 - DNA, 22 bp, Homo sapiens
ctgggctgagcctgggctgtgt

SEQ ID NO: 9506892 - DNA, 22 bp, Homo sapiens
atattcactgggtactaaaaag

SEQ ID NO: 9506893 - DNA, 19 bp, Homo sapiens
ctgggctgaggtctgcctt

SEQ ID NO: 9506894 - DNA, 19 bp, Homo sapiens
ctgggctgaggtctgcctt

SEQ ID NO: 9506895 - DNA, 22 bp, Homo sapiens
atattcactgagcataaagcca

SEQ ID NO: 9506896 - DNA, 22 bp, Homo sapiens
atattcactgggtactaaaaag

SEQ ID NO: 9506897 - DNA, 22 bp, Homo sapiens
ctgggctctgtgtttcagtttc

SEQ ID NO: 9506898 - DNA, 22 bp, Homo sapiens
ctgggctcttcccagatccaga

SEQ ID NO: 9506899 - DNA, 22 bp, Homo sapiens
ctgggctctggggtcccggtgc

SEQ ID NO: 9506900 - DNA, 22 bp, Homo sapiens
ctgggctctggggtcccggtgc

SEQ ID NO: 9506901 - DNA, 22 bp, Homo sapiens
ctgggctcttctcaccctgttt

SEQ ID NO: 9506902 - DNA, 22 bp, Homo sapiens
ctgggctcttctcaccctgttt

SEQ ID NO: 9506903 - DNA, 22 bp, Homo sapiens
ctgggctgaaagtgttccttga

SEQ ID NO: 9506904 - DNA, 22 bp, Homo sapiens
ctgggctgaaggctccccacac

SEQ ID NO: 9506905 - DNA, 22 bp, Homo sapiens
atattatagacagagtcttctg

SEQ ID NO: 9506906 - DNA, 22 bp, Homo sapiens
atattatagacagagtcttctg

SEQ ID NO: 9506907 - DNA, 22 bp, Homo sapiens
atattataagttatttcaagtt

SEQ ID NO: 9506908 - DNA, 22 bp, Homo sapiens
atattataagttatttcaagtt

SEQ ID NO: 9506909 - DNA, 22 bp, Homo sapiens
ctgggctctgcggtgtcgctct

SEQ ID NO: 9506910 - DNA, 22 bp, Homo sapiens
ctgggctctgcggtgtcgctct

SEQ ID NO: 9506911 - DNA, 22 bp, Homo sapiens
atattatgctaagggaaataag

SEQ ID NO: 9506912 - DNA, 22 bp, Homo sapiens
atatgcagagagcatgaatagg

SEQ ID NO: 9506913 - DNA, 22 bp, Homo sapiens
atatgcagtctcttgcccttct

SEQ ID NO: 9506914 - DNA, 22 bp, Homo sapiens
atatgcacatacatacataggt

SEQ ID NO: 9506915 - DNA, 22 bp, Homo sapiens
atatgcaagcacatagaatact

SEQ ID NO: 9506916 - DNA, 22 bp, Homo sapiens
atatgcagtctcttgcccttct

SEQ ID NO: 9506917 - DNA, 22 bp, Homo sapiens
atatgcatatgtcaaaacttat

SEQ ID NO: 9506918 - DNA, 20 bp, Homo sapiens
ctgggctcaagtgatcctcc

SEQ ID NO: 9506919 - DNA, 22 bp, Homo sapiens
ctgggctcacctgtggctggca

SEQ ID NO: 9506920 - DNA, 22 bp, Homo sapiens
ctgggctcacctgtggctggca

SEQ ID NO: 9506921 - DNA, 22 bp, Homo sapiens
ctgggctcagatgagaggaagg

SEQ ID NO: 9506922 - DNA, 22 bp, Homo sapiens
ctgggctcagatgagaggaagg

SEQ ID NO: 9506923 - DNA, 20 bp, Homo sapiens
ctgggctcaagtgatcctcc

SEQ ID NO: 9506924 - DNA, 20 bp, Homo sapiens
ctgggctcaagtgatcctcc

SEQ ID NO: 9506925 - DNA, 20 bp, Homo sapiens
ctgggctcaagtgatcctcc

SEQ ID NO: 9506926 - DNA, 22 bp, Homo sapiens
ctgggctcaagtgatccaccca

SEQ ID NO: 9506927 - DNA, 22 bp, Homo sapiens
ctgggctcaagtgatccaccca

SEQ ID NO: 9506928 - DNA, 22 bp, Homo sapiens
ctgggctcaagtgatccaccca

SEQ ID NO: 9506929 - DNA, 21 bp, Homo sapiens
ctgggctcaagcaatcctttc

SEQ ID NO: 9506930 - DNA, 20 bp, Homo sapiens
ctgggctcaagtgagcctcc

SEQ ID NO: 9506931 - DNA, 20 bp, Homo sapiens
ctgggctcaagtgagcctcc

SEQ ID NO: 9506932 - DNA, 20 bp, Homo sapiens
ctgggctcaagtgagcctcc

SEQ ID NO: 9506933 - DNA, 21 bp, Homo sapiens
ctgggctcaagcaatcctttc

SEQ ID NO: 9506934 - DNA, 21 bp, Homo sapiens
ctgggctcaagcaatcctttc

SEQ ID NO: 9506935 - DNA, 22 bp, Homo sapiens
ctgggcctggtagggcttgaaa

SEQ ID NO: 9506936 - DNA, 22 bp, Homo sapiens
ctgggctcaagaagtcttccct

SEQ ID NO: 9506937 - DNA, 22 bp, Homo sapiens
ctgggctcaagaagtcttccct

SEQ ID NO: 9506938 - DNA, 22 bp, Homo sapiens
ctgggcctggggctgttgagag

SEQ ID NO: 9506939 - DNA, 20 bp, Homo sapiens
ctggcttcgggaactagttt

SEQ ID NO: 9506940 - DNA, 22 bp, Homo sapiens
ctgggcctggtagggcttgaaa

SEQ ID NO: 9506941 - DNA, 22 bp, Homo sapiens
ctggctggccggaggcatccct

SEQ ID NO: 9506942 - DNA, 22 bp, Homo sapiens
ctggctggccggagcgaggcgg

SEQ ID NO: 9506943 - DNA, 22 bp, Homo sapiens
ctggctgtgtccacagagtaag

SEQ ID NO: 9506944 - DNA, 22 bp, Homo sapiens
ctggctgtgtcttggaggagct

SEQ ID NO: 9506945 - DNA, 22 bp, Homo sapiens
ctggctgggagcgagctgctca

SEQ ID NO: 9506946 - DNA, 22 bp, Homo sapiens
ctggctgtggattatcacaggc

SEQ ID NO: 9506947 - DNA, 22 bp, Homo sapiens
ctggctgtggattatcacaggc

SEQ ID NO: 9506948 - DNA, 22 bp, Homo sapiens
ctggctgtggattatcacaggc

SEQ ID NO: 9506949 - DNA, 22 bp, Homo sapiens
ctggctgggagcgagctgctca

SEQ ID NO: 9506950 - DNA, 22 bp, Homo sapiens
ctggctgggagcgagctgctca

SEQ ID NO: 9506951 - DNA, 22 bp, Homo sapiens
ctggctgttttcaatgttgatg

SEQ ID NO: 9506952 - DNA, 22 bp, Homo sapiens
ctggcttcagctgccatcaatg

SEQ ID NO: 9506953 - DNA, 22 bp, Homo sapiens
ctggctgtgtcttggaggagct

SEQ ID NO: 9506954 - DNA, 22 bp, Homo sapiens
ctggctgtgtccacagagtaag

SEQ ID NO: 9506955 - DNA, 22 bp, Homo sapiens
ctggctgtttcaggcagtgtcc

SEQ ID NO: 9506956 - DNA, 22 bp, Homo sapiens
ctggcttccctgtcttatggaa

SEQ ID NO: 9506957 - DNA, 22 bp, Homo sapiens
ctggcttccctgtcttatggaa

SEQ ID NO: 9506958 - DNA, 22 bp, Homo sapiens
ctggcttccctgtcttatggaa

SEQ ID NO: 9506959 - DNA, 22 bp, Homo sapiens
ctggcttcctgagtccattacc

SEQ ID NO: 9506960 - DNA, 22 bp, Homo sapiens
ctggcttccatgctgtagtggc

SEQ ID NO: 9506961 - DNA, 22 bp, Homo sapiens
atcaaaatggaagaatttggct

SEQ ID NO: 9506962 - DNA, 22 bp, Homo sapiens
atcaaaatggaagaatttggct

SEQ ID NO: 9506963 - DNA, 22 bp, Homo sapiens
atcaaaatgctccagtgatggt

SEQ ID NO: 9506964 - DNA, 22 bp, Homo sapiens
atcaaagaatgtgactgaaata

SEQ ID NO: 9506965 - DNA, 22 bp, Homo sapiens
atcaaagaatgtgactgaaata

SEQ ID NO: 9506966 - DNA, 22 bp, Homo sapiens
atcaaagaatgtgactgaaata

SEQ ID NO: 9506967 - DNA, 22 bp, Homo sapiens
atcaaagaatgtgactgaaata

SEQ ID NO: 9506968 - DNA, 22 bp, Homo sapiens
atatttaaacagggtaccaata

SEQ ID NO: 9506969 - DNA, 22 bp, Homo sapiens
atatttaaacagggtaccaata

SEQ ID NO: 9506970 - DNA, 22 bp, Homo sapiens
atatttaactggtcccaatata

SEQ ID NO: 9506971 - DNA, 22 bp, Homo sapiens
atatttaactggtcccaatata

SEQ ID NO: 9506972 - DNA, 22 bp, Homo sapiens
atatttactgctgtggtgaagg

SEQ ID NO: 9506973 - DNA, 22 bp, Homo sapiens
atattttggcaaatgtctagat

SEQ ID NO: 9506974 - DNA, 22 bp, Homo sapiens
atcaaagtgatttgtaaacagg

SEQ ID NO: 9506975 - DNA, 22 bp, Homo sapiens
atcaaagtgatttgtaaacagg

SEQ ID NO: 9506976 - DNA, 22 bp, Homo sapiens
atcaaagtccatcagaaggtag

SEQ ID NO: 9506977 - DNA, 22 bp, Homo sapiens
atcaaagtccatcagaaggtag

SEQ ID NO: 9506978 - DNA, 22 bp, Homo sapiens
atcaaagttcgtaactgataac

SEQ ID NO: 9506979 - DNA, 22 bp, Homo sapiens
atcaaagttcgtaactgataac

SEQ ID NO: 9506980 - DNA, 22 bp, Homo sapiens
atcaaagagtgagatttttact

SEQ ID NO: 9506981 - DNA, 23 bp, Homo sapiens
atcaaaggatgtagagaagaagc

SEQ ID NO: 9506982 - DNA, 22 bp, Homo sapiens
atcaaaggtatctatgctgtct

SEQ ID NO: 9506983 - DNA, 22 bp, Homo sapiens
atattcttgtgattataaagta

SEQ ID NO: 9506984 - DNA, 22 bp, Homo sapiens
atattcttgtgattataaagta

SEQ ID NO: 9506985 - DNA, 22 bp, Homo sapiens
atattcttgaagggagattata

SEQ ID NO: 9506986 - DNA, 22 bp, Homo sapiens
atattcttgtgattataaagta

SEQ ID NO: 9506987 - DNA, 22 bp, Homo sapiens
atatttaaacagggtaccaata

SEQ ID NO: 9506988 - DNA, 22 bp, Homo sapiens
atatttaaacagggtaccaata

SEQ ID NO: 9506989 - DNA, 22 bp, Homo sapiens
atatttaaacagggtaccaata

SEQ ID NO: 9506990 - DNA, 22 bp, Homo sapiens
atattgttgactataagagtaa

SEQ ID NO: 9506991 - DNA, 22 bp, Homo sapiens
atattgttgactataagagtaa

SEQ ID NO: 9506992 - DNA, 21 bp, Homo sapiens
atattgtaggtaaagtgcagg

SEQ ID NO: 9506993 - DNA, 22 bp, Homo sapiens
atattgttagtaatatttcgaa

SEQ ID NO: 9506994 - DNA, 22 bp, Homo sapiens
atattggtaaagtggattaaca

SEQ ID NO: 9506995 - DNA, 21 bp, Homo sapiens
atattggtatctttttaaatc

SEQ ID NO: 9506996 - DNA, 22 bp, Homo sapiens
atattgtactagggttacatgt

SEQ ID NO: 9506997 - DNA, 22 bp, Homo sapiens
atattgtactagggttacatgt

SEQ ID NO: 9506998 - DNA, 21 bp, Homo sapiens
atattgtaggtaaagtgcagg

SEQ ID NO: 9506999 - DNA, 22 bp, Homo sapiens
atattgtactagggttacatgt

SEQ ID NO: 9507000 - DNA, 22 bp, Homo sapiens
atcaaatacaaagggcataagg

SEQ ID NO: 9507001 - DNA, 22 bp, Homo sapiens
atcaaatacaaagggcataagg

SEQ ID NO: 9507002 - DNA, 22 bp, Homo sapiens
atcaaatataataattttcgct

SEQ ID NO: 9507003 - DNA, 22 bp, Homo sapiens
atcaaatacaaagggcataagg

SEQ ID NO: 9507004 - DNA, 22 bp, Homo sapiens
atcaaataaaggtacctagctt

SEQ ID NO: 9507005 - DNA, 22 bp, Homo sapiens
atcaaagtttcccagaagttgt

SEQ ID NO: 9507006 - DNA, 22 bp, Homo sapiens
atcaaattatgtgctacaagaa

SEQ ID NO: 9507007 - DNA, 22 bp, Homo sapiens
atcaaattatgtgctacaagaa

SEQ ID NO: 9507008 - DNA, 23 bp, Homo sapiens
atcaaatgattggccattcagtg

SEQ ID NO: 9507009 - DNA, 23 bp, Homo sapiens
atcaaatgattggccattcagtg

SEQ ID NO: 9507010 - DNA, 22 bp, Homo sapiens
atcaaatcattgcattaatgtt

SEQ ID NO: 9507011 - DNA, 22 bp, Homo sapiens
atcaaatcattgcattaatgtt

SEQ ID NO: 9507012 - DNA, 22 bp, Homo sapiens
atcaaatataataattttcgct

SEQ ID NO: 9507013 - DNA, 22 bp, Homo sapiens
atcaaatataataattttcgct

SEQ ID NO: 9507014 - DNA, 22 bp, Homo sapiens
atcaacatgaatttctctgaag

SEQ ID NO: 9507015 - DNA, 18 bp, Homo sapiens
atcaactgctgtttcctt

SEQ ID NO: 9507016 - DNA, 22 bp, Homo sapiens
atcaacttaaagaaaagatact

SEQ ID NO: 9507017 - DNA, 22 bp, Homo sapiens
atcaacttaaagaaaagatact

SEQ ID NO: 9507018 - DNA, 22 bp, Homo sapiens
atcactttggtaccaattcagc

SEQ ID NO: 9507019 - DNA, 22 bp, Homo sapiens
atcactttggtaccaattcagc

SEQ ID NO: 9507020 - DNA, 22 bp, Homo sapiens
atcagaaaaacataatgttatt

SEQ ID NO: 9507021 - DNA, 22 bp, Homo sapiens
atcagaaaaacataatgttatt

SEQ ID NO: 9507022 - DNA, 22 bp, Homo sapiens
atcacattatgtagtgaaaagg

SEQ ID NO: 9507023 - DNA, 22 bp, Homo sapiens
atcacattgccagtgattaccc

SEQ ID NO: 9507024 - DNA, 22 bp, Homo sapiens
atcacattgccagtgattaccc

SEQ ID NO: 9507025 - DNA, 22 bp, Homo sapiens
atcagaaaggtgggcaagcaga

SEQ ID NO: 9507026 - DNA, 22 bp, Homo sapiens
atcagaaactcttagagcaggg

SEQ ID NO: 9507027 - DNA, 22 bp, Homo sapiens
atcagaaaggtgggcaagcaga

SEQ ID NO: 9507028 - DNA, 22 bp, Homo sapiens
atcagaaaggtgggcaagcaga

SEQ ID NO: 9507029 - DNA, 22 bp, Homo sapiens
atcagaaagttcatcatgtttg

SEQ ID NO: 9507030 - DNA, 22 bp, Homo sapiens
atcagaaaggtgggcaagcaga

SEQ ID NO: 9507031 - DNA, 22 bp, Homo sapiens
atcagaaatagtcatgttactt

SEQ ID NO: 9507032 - DNA, 22 bp, Homo sapiens
atcagaaatagtcatgttactt

SEQ ID NO: 9507033 - DNA, 22 bp, Homo sapiens
atcagaaaaacataatgttatt

SEQ ID NO: 9507034 - DNA, 22 bp, Homo sapiens
atcagaaaaatgagaagagctg

SEQ ID NO: 9507035 - DNA, 22 bp, Homo sapiens
atcagaaactcttagagcaggg

SEQ ID NO: 9507036 - DNA, 22 bp, Homo sapiens
atcagaaactcttagagcaggg

SEQ ID NO: 9507037 - DNA, 21 bp, Homo sapiens
atcagaaaatgtaatggagca

SEQ ID NO: 9507038 - DNA, 21 bp, Homo sapiens
atcagaaaatgtaatggagca

SEQ ID NO: 9507039 - DNA, 22 bp, Homo sapiens
atcagaagaaatggatgtgact

SEQ ID NO: 9507040 - DNA, 22 bp, Homo sapiens
atcagaacaaaagaacagttta

SEQ ID NO: 9507041 - DNA, 22 bp, Homo sapiens
atcagaaattgctaccagtgga

SEQ ID NO: 9507042 - DNA, 22 bp, Homo sapiens
atcagaacaaaagaacagttta

SEQ ID NO: 9507043 - DNA, 22 bp, Homo sapiens
atcagaaattgctaccagtgga

SEQ ID NO: 9507044 - DNA, 22 bp, Homo sapiens
atcagaagcaggaggaatgaag

SEQ ID NO: 9507045 - DNA, 22 bp, Homo sapiens
atcagaagcaggaggaatgaag

SEQ ID NO: 9507046 - DNA, 22 bp, Homo sapiens
atcagaagaaatggatgtgact

SEQ ID NO: 9507047 - DNA, 22 bp, Homo sapiens
atcagaagcttgtagtctctct

SEQ ID NO: 9507048 - DNA, 22 bp, Homo sapiens
atcagaaggggaggtaaagaag

SEQ ID NO: 9507049 - DNA, 22 bp, Homo sapiens
atcagaaggggaggtaaagaag

SEQ ID NO: 9507050 - DNA, 22 bp, Homo sapiens
atcagaagttgtgcatgcatgg

SEQ ID NO: 9507051 - DNA, 22 bp, Homo sapiens
atcagaagtgatgtgtgttatt

SEQ ID NO: 9507052 - DNA, 21 bp, Homo sapiens
atcagaagttttggtcagtag

SEQ ID NO: 9507053 - DNA, 22 bp, Homo sapiens
atcagaagtgatgtgtgttatt

SEQ ID NO: 9507054 - DNA, 20 bp, Homo sapiens
atcagaagtgatattaacca

SEQ ID NO: 9507055 - DNA, 21 bp, Homo sapiens
atcagaatctctagatttgga

SEQ ID NO: 9507056 - DNA, 22 bp, Homo sapiens
atcagaatactatcaacagtga

SEQ ID NO: 9507057 - DNA, 22 bp, Homo sapiens
atctctgatttacagcatctct

SEQ ID NO: 9507058 - DNA, 22 bp, Homo sapiens
atctctgatttacagcatctct

SEQ ID NO: 9507059 - DNA, 22 bp, Homo sapiens
atctctgatttacagcatctct

SEQ ID NO: 9507060 - DNA, 22 bp, Homo sapiens
atctctgatttacagcatctct

SEQ ID NO: 9507061 - DNA, 22 bp, Homo sapiens
cttcctcccggcccatgctctg

SEQ ID NO: 9507062 - DNA, 22 bp, Homo sapiens
cttcctccgaagaagttgctgg

SEQ ID NO: 9507063 - DNA, 22 bp, Homo sapiens
atctgaaactctgacattgtct

SEQ ID NO: 9507064 - DNA, 22 bp, Homo sapiens
atctgaaactctgacattgtct

SEQ ID NO: 9507065 - DNA, 23 bp, Homo sapiens
atctgaaaagcatttgcagtttg

SEQ ID NO: 9507066 - DNA, 22 bp, Homo sapiens
atctgaaagctaggagttctca

SEQ ID NO: 9507067 - DNA, 21 bp, Homo sapiens
atctgaaaggttagtgttgag

SEQ ID NO: 9507068 - DNA, 22 bp, Homo sapiens
atctgaaagctaggagttctca

SEQ ID NO: 9507069 - DNA, 22 bp, Homo sapiens
atctgaagaatgaatggaatta

SEQ ID NO: 9507070 - DNA, 22 bp, Homo sapiens
atctgaagaatgaatggaatta

SEQ ID NO: 9507071 - DNA, 19 bp, Homo sapiens
atctgaagtaggtgcagct

SEQ ID NO: 9507072 - DNA, 22 bp, Homo sapiens
atctgaagggaagtggaaggca

SEQ ID NO: 9507073 - DNA, 22 bp, Homo sapiens
atctgaagaggtcatggctgac

SEQ ID NO: 9507074 - DNA, 22 bp, Homo sapiens
atctgaagctatctgcacttca

SEQ ID NO: 9507075 - DNA, 22 bp, Homo sapiens
atctgaagggaagtggaaggca

SEQ ID NO: 9507076 - DNA, 21 bp, Homo sapiens
atctgaagtttgagaggaaag

SEQ ID NO: 9507077 - DNA, 21 bp, Homo sapiens
atctgaagtttgagaggaaag

SEQ ID NO: 9507078 - DNA, 22 bp, Homo sapiens
atctgaagtggagaaaaatata

SEQ ID NO: 9507079 - DNA, 22 bp, Homo sapiens
atctgaagtccttataatctga

SEQ ID NO: 9507080 - DNA, 22 bp, Homo sapiens
atctgcatcagactttgcatga

SEQ ID NO: 9507081 - DNA, 22 bp, Homo sapiens
atctgcagtttgttttctcttg

SEQ ID NO: 9507082 - DNA, 22 bp, Homo sapiens
atctgcagtttgttttctcttg

SEQ ID NO: 9507083 - DNA, 20 bp, Homo sapiens
cttcttggagatggtgtttt

SEQ ID NO: 9507084 - DNA, 22 bp, Homo sapiens
cttcttggaagtcgtccttcca

SEQ ID NO: 9507085 - DNA, 22 bp, Homo sapiens
atctgacatctactagaacaga

SEQ ID NO: 9507086 - DNA, 22 bp, Homo sapiens
atctgacaagttgtgtgtatag

SEQ ID NO: 9507087 - DNA, 22 bp, Homo sapiens
atctgacaaggccacatattct

SEQ ID NO: 9507088 - DNA, 22 bp, Homo sapiens
atctgacaaggccacatattct

SEQ ID NO: 9507089 - DNA, 22 bp, Homo sapiens
atctgacatctccctctgacat

SEQ ID NO: 9507090 - DNA, 22 bp, Homo sapiens
atctgacttcacgcccatgcca

SEQ ID NO: 9507091 - DNA, 19 bp, Homo sapiens
atctgaggcctcatctggg

SEQ ID NO: 9507092 - DNA, 19 bp, Homo sapiens
atctgagattataaacaga

SEQ ID NO: 9507093 - DNA, 20 bp, Homo sapiens
atctgaggctgtcgctggaa

SEQ ID NO: 9507094 - DNA, 22 bp, Homo sapiens
atctgagctccgcctcctgtca

SEQ ID NO: 9507095 - DNA, 22 bp, Homo sapiens
atctgcaggaatgtgtgcagag

SEQ ID NO: 9507096 - DNA, 22 bp, Homo sapiens
atctgagaagattttggcataa

SEQ ID NO: 9507097 - DNA, 21 bp, Homo sapiens
atctgatgtataaatacctct

SEQ ID NO: 9507098 - DNA, 22 bp, Homo sapiens
cttagaacattctgcctgggaa

SEQ ID NO: 9507099 - DNA, 18 bp, Homo sapiens
cttagaacatcattcctt

SEQ ID NO: 9507100 - DNA, 20 bp, Homo sapiens
cttagaaatttttaccctgg

SEQ ID NO: 9507101 - DNA, 22 bp, Homo sapiens
cttagaacatacttagtgtgat

SEQ ID NO: 9507102 - DNA, 22 bp, Homo sapiens
cttagaacagtgtctgccagag

SEQ ID NO: 9507103 - DNA, 22 bp, Homo sapiens
cttagaaattgttactcattca

SEQ ID NO: 9507104 - DNA, 22 bp, Homo sapiens
cttagaaattgttactcattca

SEQ ID NO: 9507105 - DNA, 22 bp, Homo sapiens
atcctgtggctccagggagccg

SEQ ID NO: 9507106 - DNA, 22 bp, Homo sapiens
atcctgtggggcggctgcaggg

SEQ ID NO: 9507107 - DNA, 22 bp, Homo sapiens
atcctgtggctccagggagccg

SEQ ID NO: 9507108 - DNA, 22 bp, Homo sapiens
atcctgtgcaatgactgcatct

SEQ ID NO: 9507109 - DNA, 22 bp, Homo sapiens
atcctgtgttgctactggagga

SEQ ID NO: 9507110 - DNA, 22 bp, Homo sapiens
atcctgtgttgctactggagga

SEQ ID NO: 9507111 - DNA, 22 bp, Homo sapiens
atcctgtttggttgtctgcctt

SEQ ID NO: 9507112 - DNA, 20 bp, Homo sapiens
atccttaaagagaatttcta

SEQ ID NO: 9507113 - DNA, 22 bp, Homo sapiens
atcctgttttagataagcttat

SEQ ID NO: 9507114 - DNA, 22 bp, Homo sapiens
atccttaaaggaattctgattt

SEQ ID NO: 9507115 - DNA, 22 bp, Homo sapiens
atccttaagaaagttttctata

SEQ ID NO: 9507116 - DNA, 22 bp, Homo sapiens
cttagaattttaatccagaaag

SEQ ID NO: 9507117 - DNA, 22 bp, Homo sapiens
cttagaattttgcctactacaa

SEQ ID NO: 9507118 - DNA, 22 bp, Homo sapiens
cttagagatgggttttacttag

SEQ ID NO: 9507119 - DNA, 22 bp, Homo sapiens
cttagagatgggttttacttag

SEQ ID NO: 9507120 - DNA, 22 bp, Homo sapiens
cttagagatgggttttacttag

SEQ ID NO: 9507121 - DNA, 22 bp, Homo sapiens
cttagagatgggttttacttag

SEQ ID NO: 9507122 - DNA, 22 bp, Homo sapiens
cttagatgaagtcacagaaccc

SEQ ID NO: 9507123 - DNA, 22 bp, Homo sapiens
cttcattaactattggaatgca

SEQ ID NO: 9507124 - DNA, 22 bp, Homo sapiens
cttccaggtgctggcctggcct

SEQ ID NO: 9507125 - DNA, 22 bp, Homo sapiens
cttccaggtccttcttgagaag

SEQ ID NO: 9507126 - DNA, 22 bp, Homo sapiens
cttccaggttctggttgggaag

SEQ ID NO: 9507127 - DNA, 23 bp, Homo sapiens
cttccagtactgcacactcaagg

SEQ ID NO: 9507128 - DNA, 22 bp, Homo sapiens
cttccagtctagagctatctgt

SEQ ID NO: 9507129 - DNA, 22 bp, Homo sapiens
cttccagtagtatcattctcat

SEQ ID NO: 9507130 - DNA, 22 bp, Homo sapiens
cttccagtgcataggtagatca

SEQ ID NO: 9507131 - DNA, 22 bp, Homo sapiens
cttcccaagactgtattgcaag

SEQ ID NO: 9507132 - DNA, 22 bp, Homo sapiens
cttcccaagtaaatttgtattt

SEQ ID NO: 9507133 - DNA, 17 bp, Homo sapiens
cttcccaccatctcctg

SEQ ID NO: 9507134 - DNA, 17 bp, Homo sapiens
cttcccaccatctcctg

SEQ ID NO: 9507135 - DNA, 22 bp, Homo sapiens
cttcctcatgtgcaatgcaagc

SEQ ID NO: 9507136 - DNA, 18 bp, Homo sapiens
cttcctcatcgctctccc

SEQ ID NO: 9507137 - DNA, 22 bp, Homo sapiens
cttcctcccggcccatgctctg

SEQ ID NO: 9507138 - DNA, 22 bp, Homo sapiens
cttcctaaaagcttcaagagaa

SEQ ID NO: 9507139 - DNA, 22 bp, Homo sapiens
cttcctagcttcagagtctgtt

SEQ ID NO: 9507140 - DNA, 22 bp, Homo sapiens
atcagaccatccagcgtggatg

SEQ ID NO: 9507141 - DNA, 22 bp, Homo sapiens
atcagacctgtctcctcttgcc

SEQ ID NO: 9507142 - DNA, 22 bp, Homo sapiens
atcagacagggaattatagcag

SEQ ID NO: 9507143 - DNA, 22 bp, Homo sapiens
atcagacaattgttgagtactg

SEQ ID NO: 9507144 - DNA, 22 bp, Homo sapiens
atcagaatgcagccagcagtta

SEQ ID NO: 9507145 - DNA, 22 bp, Homo sapiens
atcagaatgattagtaaccaat

SEQ ID NO: 9507146 - DNA, 22 bp, Homo sapiens
atcagaatgcagccagcagtta

SEQ ID NO: 9507147 - DNA, 22 bp, Homo sapiens
ctgtggagtgtagatgctgggt

SEQ ID NO: 9507148 - DNA, 22 bp, Homo sapiens
ctgtggccttggaccagcatct

SEQ ID NO: 9507149 - DNA, 22 bp, Homo sapiens
ctgtggcctttgttggaggtcc

SEQ ID NO: 9507150 - DNA, 22 bp, Homo sapiens
ctgtggccttggaccagcatct

SEQ ID NO: 9507151 - DNA, 23 bp, Homo sapiens
ctgtggccctgcttcatgcagcc

SEQ ID NO: 9507152 - DNA, 23 bp, Homo sapiens
ctgtggccctgcttcatgcagcc

SEQ ID NO: 9507153 - DNA, 22 bp, Homo sapiens
ctgtggccctgtgatctggcac

SEQ ID NO: 9507154 - DNA, 19 bp, Homo sapiens
ctgtggcctccaggaggga

SEQ ID NO: 9507155 - DNA, 22 bp, Homo sapiens
ctgtggagtgtagatgctgggt

SEQ ID NO: 9507156 - DNA, 22 bp, Homo sapiens
ctgtgggaacactgaggacttc

SEQ ID NO: 9507157 - DNA, 22 bp, Homo sapiens
ctgtgggagaagctagcacagg

SEQ ID NO: 9507158 - DNA, 22 bp, Homo sapiens
ctgtgggagaagctagcacagg

SEQ ID NO: 9507159 - DNA, 22 bp, Homo sapiens
ctgtgggagaagttgctggagt

SEQ ID NO: 9507160 - DNA, 22 bp, Homo sapiens
ctgtgggactctgaggaaaagc

SEQ ID NO: 9507161 - DNA, 21 bp, Homo sapiens
ctgtgggaccaagcactggga

SEQ ID NO: 9507162 - DNA, 22 bp, Homo sapiens
ctgtggctttggggcggaggac

SEQ ID NO: 9507163 - DNA, 22 bp, Homo sapiens
ctgtggctttggggcggaggac

SEQ ID NO: 9507164 - DNA, 22 bp, Homo sapiens
ctgtggcttttccggggagcct

SEQ ID NO: 9507165 - DNA, 22 bp, Homo sapiens
ctgtggcttttccggggagcct

SEQ ID NO: 9507166 - DNA, 22 bp, Homo sapiens
ctgtgggaaaggatgagattgc

SEQ ID NO: 9507167 - DNA, 22 bp, Homo sapiens
ctgtggctttgcagggcttgtt

SEQ ID NO: 9507168 - DNA, 22 bp, Homo sapiens
ctgtggctttgcagggcttgtt

SEQ ID NO: 9507169 - DNA, 22 bp, Homo sapiens
ctgtggctttgcagggcttgtt

SEQ ID NO: 9507170 - DNA, 22 bp, Homo sapiens
ctgtggctaggaagctgtggga

SEQ ID NO: 9507171 - DNA, 22 bp, Homo sapiens
ctgtggctaggaagctgtggga

SEQ ID NO: 9507172 - DNA, 22 bp, Homo sapiens
ctgtggctcaaaatcccatgat

SEQ ID NO: 9507173 - DNA, 22 bp, Homo sapiens
ctgtggctcaattgcctactga

SEQ ID NO: 9507174 - DNA, 22 bp, Homo sapiens
ctgtggctcaattgcctactga

SEQ ID NO: 9507175 - DNA, 22 bp, Homo sapiens
atccaggcgaatgcagaaggcc

SEQ ID NO: 9507176 - DNA, 22 bp, Homo sapiens
atccaggcctgagtctggtcct

SEQ ID NO: 9507177 - DNA, 22 bp, Homo sapiens
atccaggcattctgacttcaag

SEQ ID NO: 9507178 - DNA, 22 bp, Homo sapiens
atccaccctgtggtggctttct

SEQ ID NO: 9507179 - DNA, 22 bp, Homo sapiens
atccaccctgtggtggctttct

SEQ ID NO: 9507180 - DNA, 22 bp, Homo sapiens
atccagggataaaagtaaggtt

SEQ ID NO: 9507181 - DNA, 22 bp, Homo sapiens
atccagggataaaagtaaggtt

SEQ ID NO: 9507182 - DNA, 22 bp, Homo sapiens
atccaggctgctttctatgccc

SEQ ID NO: 9507183 - DNA, 22 bp, Homo sapiens
atccaggctgcgggtctcaagt

SEQ ID NO: 9507184 - DNA, 22 bp, Homo sapiens
ctgtgtgcaacttgcagttttg

SEQ ID NO: 9507185 - DNA, 22 bp, Homo sapiens
ctgtgtgcagggcacaatggaa

SEQ ID NO: 9507186 - DNA, 22 bp, Homo sapiens
atccagttccaaagatcattta

SEQ ID NO: 9507187 - DNA, 22 bp, Homo sapiens
atccagttctcagtgcttacag

SEQ ID NO: 9507188 - DNA, 22 bp, Homo sapiens
ctgtgtgcctagagggtggccg

SEQ ID NO: 9507189 - DNA, 22 bp, Homo sapiens
ctgtgtgcatagttgtgctcaa

SEQ ID NO: 9507190 - DNA, 22 bp, Homo sapiens
ctgtgtgcaggtgctgggtacc

SEQ ID NO: 9507191 - DNA, 22 bp, Homo sapiens
ctgtgtgcaggtgctgggtacc

SEQ ID NO: 9507192 - DNA, 22 bp, Homo sapiens
ctgtgtgcagggcacaatggaa

SEQ ID NO: 9507193 - DNA, 22 bp, Homo sapiens
atccagtctggggtgctgcatg

SEQ ID NO: 9507194 - DNA, 22 bp, Homo sapiens
atccagtgagtgcagctgttgt

SEQ ID NO: 9507195 - DNA, 22 bp, Homo sapiens
atccagtcaaaattagtaaggt

SEQ ID NO: 9507196 - DNA, 22 bp, Homo sapiens
atccagtccatgacattctgtt

SEQ ID NO: 9507197 - DNA, 22 bp, Homo sapiens
atccagtcccacacatgctctg

SEQ ID NO: 9507198 - DNA, 22 bp, Homo sapiens
atccagggtgtggagagagctc

SEQ ID NO: 9507199 - DNA, 22 bp, Homo sapiens
atccagggtgtggagagagctc

SEQ ID NO: 9507200 - DNA, 22 bp, Homo sapiens
atccagggtgtggagagagctc

SEQ ID NO: 9507201 - DNA, 22 bp, Homo sapiens
atccagggataaaagtaaggtt

SEQ ID NO: 9507202 - DNA, 22 bp, Homo sapiens
ctgtgtggactggttgaggccc

SEQ ID NO: 9507203 - DNA, 22 bp, Homo sapiens
ctgtgtggcctcaagccagcct

SEQ ID NO: 9507204 - DNA, 22 bp, Homo sapiens
ctgtgtggcctcaagccagcct

SEQ ID NO: 9507205 - DNA, 22 bp, Homo sapiens
ctgtgtgctgaaatgcagtgag

SEQ ID NO: 9507206 - DNA, 22 bp, Homo sapiens
ctgtgtgctgttagggagctgc

SEQ ID NO: 9507207 - DNA, 22 bp, Homo sapiens
ctgtgtgctgttagggagctgc

SEQ ID NO: 9507208 - DNA, 22 bp, Homo sapiens
ctgtgtgctgaaatgcagtgag

SEQ ID NO: 9507209 - DNA, 22 bp, Homo sapiens
ctgtgtgcctagagggtggccg

SEQ ID NO: 9507210 - DNA, 22 bp, Homo sapiens
ctgtgtgctcggatggactcgt

SEQ ID NO: 9507211 - DNA, 22 bp, Homo sapiens
ctgtgtgcctcctgtgatcagg

SEQ ID NO: 9507212 - DNA, 22 bp, Homo sapiens
ctgtgtgtcatttgtcaatcct

SEQ ID NO: 9507213 - DNA, 22 bp, Homo sapiens
ctgtgtgtcctcggacgagttt

SEQ ID NO: 9507214 - DNA, 22 bp, Homo sapiens
ctgtgtgtcatttgtcaatcct

SEQ ID NO: 9507215 - DNA, 22 bp, Homo sapiens
ctgtgtgtcatttgtcaatcct

SEQ ID NO: 9507216 - DNA, 22 bp, Homo sapiens
ctgtgtgtcctcggacgagttt

SEQ ID NO: 9507217 - DNA, 22 bp, Homo sapiens
ctgtgtgtcatttgtcaatcct

SEQ ID NO: 9507218 - DNA, 22 bp, Homo sapiens
atcctgaaaacttacgaagtgg

SEQ ID NO: 9507219 - DNA, 22 bp, Homo sapiens
ctgtgtgtcctcggacgagttt

SEQ ID NO: 9507220 - DNA, 22 bp, Homo sapiens
ctgtgtgtcctcggacgagttt

SEQ ID NO: 9507221 - DNA, 22 bp, Homo sapiens
atcctgtgaggataagcccttg

SEQ ID NO: 9507222 - DNA, 22 bp, Homo sapiens
atcctgtctttgttttaaatat

SEQ ID NO: 9507223 - DNA, 22 bp, Homo sapiens
atcctgtctctacccatcggct

SEQ ID NO: 9507224 - DNA, 22 bp, Homo sapiens
atcctgtctatgagtagataat

SEQ ID NO: 9507225 - DNA, 22 bp, Homo sapiens
atcctgggtttgtgagtttatg

SEQ ID NO: 9507226 - DNA, 19 bp, Homo sapiens
atcctgggtcctccagctg

SEQ ID NO: 9507227 - DNA, 19 bp, Homo sapiens
atcctgggtcctccagctg

SEQ ID NO: 9507228 - DNA, 19 bp, Homo sapiens
atcctgggtcctccagctg

SEQ ID NO: 9507229 - DNA, 22 bp, Homo sapiens
atcctgggcctcagaggtgtgt

SEQ ID NO: 9507230 - DNA, 22 bp, Homo sapiens
atcctgggctgcaccctcagcc

SEQ ID NO: 9507231 - DNA, 19 bp, Homo sapiens
atcctgggtcctccagctg

SEQ ID NO: 9507232 - DNA, 22 bp, Homo sapiens
atcctgggggcagctggaaaca

SEQ ID NO: 9507233 - DNA, 22 bp, Homo sapiens
atcctgggtaagttccttttaa

SEQ ID NO: 9507234 - DNA, 22 bp, Homo sapiens
atcctgggtaagttccttttaa

SEQ ID NO: 9507235 - DNA, 22 bp, Homo sapiens
atcctgggcaaagtatgctgtc

SEQ ID NO: 9507236 - DNA, 22 bp, Homo sapiens
atcctgggcagtgtgtcactct

SEQ ID NO: 9507237 - DNA, 22 bp, Homo sapiens
atcctgggcaagtcaatgtccc

SEQ ID NO: 9507238 - DNA, 22 bp, Homo sapiens
atcctgggcaaagtatgctgtc

SEQ ID NO: 9507239 - DNA, 22 bp, Homo sapiens
atcctgaaaacttacgaagtgg

SEQ ID NO: 9507240 - DNA, 18 bp, Homo sapiens
atcctgggccagtctttc

SEQ ID NO: 9507241 - DNA, 18 bp, Homo sapiens
atcctgggccagtctttc

SEQ ID NO: 9507242 - DNA, 22 bp, Homo sapiens
atcctgggcagttttgagtgct

SEQ ID NO: 9507243 - DNA, 22 bp, Homo sapiens
atcctgggcaagtcaatgtccc

SEQ ID NO: 9507244 - DNA, 22 bp, Homo sapiens
atcctgggcagtgtgtcactct

SEQ ID NO: 9507245 - DNA, 22 bp, Homo sapiens
atcctgggcagtgtgtcactct

SEQ ID NO: 9507246 - DNA, 22 bp, Homo sapiens
atacatagctgaaaacttgtag

SEQ ID NO: 9507247 - DNA, 22 bp, Homo sapiens
atacatagtaccacatttgaca

SEQ ID NO: 9507248 - DNA, 22 bp, Homo sapiens
atacatgtgtgtgcatacatgt

SEQ ID NO: 9507249 - DNA, 22 bp, Homo sapiens
atacatgttcgtgtacatgttc

SEQ ID NO: 9507250 - DNA, 22 bp, Homo sapiens
atacatgttcgtgtacatgttc

SEQ ID NO: 9507251 - DNA, 22 bp, Homo sapiens
ataccaaagcacatactgtttg

SEQ ID NO: 9507252 - DNA, 22 bp, Homo sapiens
ataccaattagagtttgttgca

SEQ ID NO: 9507253 - DNA, 22 bp, Homo sapiens
atacattcctactgactagcta

SEQ ID NO: 9507254 - DNA, 22 bp, Homo sapiens
atacattcagcagtgctcatga

SEQ ID NO: 9507255 - DNA, 22 bp, Homo sapiens
ataccatttccatgttacatta

SEQ ID NO: 9507256 - DNA, 22 bp, Homo sapiens
ataccacaacatggctcagagg

SEQ ID NO: 9507257 - DNA, 22 bp, Homo sapiens
ataccacaacatggctcagagg

SEQ ID NO: 9507258 - DNA, 22 bp, Homo sapiens
atacccagccccagctgcagga

SEQ ID NO: 9507259 - DNA, 22 bp, Homo sapiens
atacccattccttgtgttcagt

SEQ ID NO: 9507260 - DNA, 22 bp, Homo sapiens
ataccctgttctggagtgaatg

SEQ ID NO: 9507261 - DNA, 22 bp, Homo sapiens
atacctctggcactcaagactt

SEQ ID NO: 9507262 - DNA, 22 bp, Homo sapiens
atacctgtgtatccacaagcgt

SEQ ID NO: 9507263 - DNA, 22 bp, Homo sapiens
ataccttttactcattatccat

SEQ ID NO: 9507264 - DNA, 22 bp, Homo sapiens
atacctttaggcattttgcatc

SEQ ID NO: 9507265 - DNA, 22 bp, Homo sapiens
ataccttatttcctggtgacat

SEQ ID NO: 9507266 - DNA, 22 bp, Homo sapiens
atacctgtgtatccacaagcgt

SEQ ID NO: 9507267 - DNA, 22 bp, Homo sapiens
atacagtgccccttttcacatg

SEQ ID NO: 9507268 - DNA, 22 bp, Homo sapiens
atacagtcagactttagccatt

SEQ ID NO: 9507269 - DNA, 22 bp, Homo sapiens
atacagtgccccttttcacatg

SEQ ID NO: 9507270 - DNA, 22 bp, Homo sapiens
atacagtattacctgttcagga

SEQ ID NO: 9507271 - DNA, 22 bp, Homo sapiens
atacagtattacctgttcagga

SEQ ID NO: 9507272 - DNA, 22 bp, Homo sapiens
atacagtattacctgttcagga

SEQ ID NO: 9507273 - DNA, 22 bp, Homo sapiens
atacagtataactaataaaccc

SEQ ID NO: 9507274 - DNA, 22 bp, Homo sapiens
atacatagatagataatctggc

SEQ ID NO: 9507275 - DNA, 22 bp, Homo sapiens
atacatagatagataatctggc

SEQ ID NO: 9507276 - DNA, 22 bp, Homo sapiens
atacatagcagggtagtagatc

SEQ ID NO: 9507277 - DNA, 22 bp, Homo sapiens
atacatagcagggtagtagatc

SEQ ID NO: 9507278 - DNA, 22 bp, Homo sapiens
atacatacgtacatacgtatgt

SEQ ID NO: 9507279 - DNA, 22 bp, Homo sapiens
atacatacatgtatgcacatac

SEQ ID NO: 9507280 - DNA, 23 bp, Homo sapiens
atacatacagtcttactgacttt

SEQ ID NO: 9507281 - DNA, 17 bp, Homo sapiens
atacagtttattttaca

SEQ ID NO: 9507282 - DNA, 17 bp, Homo sapiens
atacagtttattttaca

SEQ ID NO: 9507283 - DNA, 22 bp, Homo sapiens
atacataattacttccgatgtt

SEQ ID NO: 9507284 - DNA, 22 bp, Homo sapiens
ctggaataaacgatcttcagca

SEQ ID NO: 9507285 - DNA, 22 bp, Homo sapiens
ctggaagtttccttcctggtca

SEQ ID NO: 9507286 - DNA, 22 bp, Homo sapiens
ctggaagtttccttcctggtca

SEQ ID NO: 9507287 - DNA, 22 bp, Homo sapiens
ctggaagtggggttggcttgaa

SEQ ID NO: 9507288 - DNA, 22 bp, Homo sapiens
ctgctgccattagggcacagac

SEQ ID NO: 9507289 - DNA, 22 bp, Homo sapiens
ctggaagactcaatggcctgcc

SEQ ID NO: 9507290 - DNA, 22 bp, Homo sapiens
ctggaagagcatttgcataggg

SEQ ID NO: 9507291 - DNA, 22 bp, Homo sapiens
ctggaagagcatttgcataggg

SEQ ID NO: 9507292 - DNA, 22 bp, Homo sapiens
ctggaagagcatttgcataggg

SEQ ID NO: 9507293 - DNA, 22 bp, Homo sapiens
ctgctgccaagggtgccacagg

SEQ ID NO: 9507294 - DNA, 18 bp, Homo sapiens
ctgctgcaggcactcagg

SEQ ID NO: 9507295 - DNA, 22 bp, Homo sapiens
ctgctgcaggatgggcactctg

SEQ ID NO: 9507296 - DNA, 19 bp, Homo sapiens
ctggaatgatagagacctc

SEQ ID NO: 9507297 - DNA, 22 bp, Homo sapiens
ctggaatgcctccctgtcagag

SEQ ID NO: 9507298 - DNA, 22 bp, Homo sapiens
ctggaatgattgaaaaggaatg

SEQ ID NO: 9507299 - DNA, 22 bp, Homo sapiens
ctggaatgcctccctgtcagag

SEQ ID NO: 9507300 - DNA, 22 bp, Homo sapiens
ctggaatgagagcccggggatc

SEQ ID NO: 9507301 - DNA, 22 bp, Homo sapiens
ctggaatgagcagggcttatgg

SEQ ID NO: 9507302 - DNA, 22 bp, Homo sapiens
ctggaatgagcagggcttatgg

SEQ ID NO: 9507303 - DNA, 19 bp, Homo sapiens
ctggaatgagaacatgccc

SEQ ID NO: 9507304 - DNA, 22 bp, Homo sapiens
ctggaatgaagctatgtacatt

SEQ ID NO: 9507305 - DNA, 20 bp, Homo sapiens
ctggaatgggtgtgggttag

SEQ ID NO: 9507306 - DNA, 22 bp, Homo sapiens
ctggaatgggtttcaggcactg

SEQ ID NO: 9507307 - DNA, 22 bp, Homo sapiens
ctggaatgggtttcaggcactg

SEQ ID NO: 9507308 - DNA, 22 bp, Homo sapiens
ctggaatgtatgggaacccaaa

SEQ ID NO: 9507309 - DNA, 22 bp, Homo sapiens
ctggaatgtagagacagcttag

SEQ ID NO: 9507310 - DNA, 22 bp, Homo sapiens
ctggaatgggccatttgaggcc

SEQ ID NO: 9507311 - DNA, 22 bp, Homo sapiens
ctggaatgggagtcagacagag

SEQ ID NO: 9507312 - DNA, 22 bp, Homo sapiens
ctggaatgggaatcaggaaaga

SEQ ID NO: 9507313 - DNA, 22 bp, Homo sapiens
ctggaatggcaatgggaagtcc

SEQ ID NO: 9507314 - DNA, 22 bp, Homo sapiens
ctggaatgctggtaaaatagca

SEQ ID NO: 9507315 - DNA, 22 bp, Homo sapiens
ctggaatgcggagagttggaga

SEQ ID NO: 9507316 - DNA, 22 bp, Homo sapiens
ctggaatgcggagagttggaga

SEQ ID NO: 9507317 - DNA, 22 bp, Homo sapiens
ctggagagaatgtggaatgatt

SEQ ID NO: 9507318 - DNA, 22 bp, Homo sapiens
ctggagagaatgttcattgcag

SEQ ID NO: 9507319 - DNA, 22 bp, Homo sapiens
ctggagagaatgttcattgcag

SEQ ID NO: 9507320 - DNA, 19 bp, Homo sapiens
atacagatgtatccatgat

SEQ ID NO: 9507321 - DNA, 19 bp, Homo sapiens
atacagtaaggtgtttgcc

SEQ ID NO: 9507322 - DNA, 22 bp, Homo sapiens
atacagtagggaccatgtctga

SEQ ID NO: 9507323 - DNA, 22 bp, Homo sapiens
atacagtagacaatctcatgaa

SEQ ID NO: 9507324 - DNA, 22 bp, Homo sapiens
atacagtagacaatctcatgaa

SEQ ID NO: 9507325 - DNA, 22 bp, Homo sapiens
atacagtaatttgtaactcatc

SEQ ID NO: 9507326 - DNA, 22 bp, Homo sapiens
atacagtaagtgtccctgaaac

SEQ ID NO: 9507327 - DNA, 22 bp, Homo sapiens
atacagtaatttgtaactcatc

SEQ ID NO: 9507328 - DNA, 17 bp, Homo sapiens
ctggagaagcctgtgga

SEQ ID NO: 9507329 - DNA, 22 bp, Homo sapiens
ctggagaagccaaactagtcac

SEQ ID NO: 9507330 - DNA, 22 bp, Homo sapiens
ctggagaagtactgagacattt

SEQ ID NO: 9507331 - DNA, 22 bp, Homo sapiens
ctggagaagccaaactagtcac

SEQ ID NO: 9507332 - DNA, 22 bp, Homo sapiens
ctggaatgtatgtatcttaaga

SEQ ID NO: 9507333 - DNA, 22 bp, Homo sapiens
ctggaatgtctgctcaatgttt

SEQ ID NO: 9507334 - DNA, 22 bp, Homo sapiens
ctggaatgtctgctcaatgttt

SEQ ID NO: 9507335 - DNA, 22 bp, Homo sapiens
ctggagagaaatgacaaagcta

SEQ ID NO: 9507336 - DNA, 22 bp, Homo sapiens
ctggagagaatgtggaatgatt

SEQ ID NO: 9507337 - DNA, 22 bp, Homo sapiens
ctggagacctctcctgagagtg

SEQ ID NO: 9507338 - DNA, 22 bp, Homo sapiens
ctggagagaaatgacaaagcta

SEQ ID NO: 9507339 - DNA, 22 bp, Homo sapiens
ctggagacctctcctgagagtg

SEQ ID NO: 9507340 - DNA, 22 bp, Homo sapiens
atagcaatttgcccaattacct

SEQ ID NO: 9507341 - DNA, 22 bp, Homo sapiens
atagcagcatcagtttatctcc

SEQ ID NO: 9507342 - DNA, 22 bp, Homo sapiens
atagcagcatttcttccaagga

SEQ ID NO: 9507343 - DNA, 22 bp, Homo sapiens
atagcagcatcagtttatctcc

SEQ ID NO: 9507344 - DNA, 22 bp, Homo sapiens
atagcaaggtatgactggagcc

SEQ ID NO: 9507345 - DNA, 22 bp, Homo sapiens
atagcaaatattttaatgagca

SEQ ID NO: 9507346 - DNA, 22 bp, Homo sapiens
atagcaaatattttaatgagca

SEQ ID NO: 9507347 - DNA, 22 bp, Homo sapiens
atagcaaatattttaatgagca

SEQ ID NO: 9507348 - DNA, 22 bp, Homo sapiens
atagcaatcagtgtatttgaaa

SEQ ID NO: 9507349 - DNA, 22 bp, Homo sapiens
atagcaatcagtgtatttgaaa

SEQ ID NO: 9507350 - DNA, 22 bp, Homo sapiens
atagcaatggcaacaactaagc

SEQ ID NO: 9507351 - DNA, 22 bp, Homo sapiens
atagcaatgatcaagacagaca

SEQ ID NO: 9507352 - DNA, 22 bp, Homo sapiens
ctggctggccggagcgaggcgg

SEQ ID NO: 9507353 - DNA, 22 bp, Homo sapiens
ctggctggccatgtagagatga

SEQ ID NO: 9507354 - DNA, 22 bp, Homo sapiens
ctggctggcagatgctcttgct

SEQ ID NO: 9507355 - DNA, 22 bp, Homo sapiens
ctggctggccatgcagcgccag

SEQ ID NO: 9507356 - DNA, 22 bp, Homo sapiens
ctggctggcagatgctcttgct

SEQ ID NO: 9507357 - DNA, 22 bp, Homo sapiens
ctggctggcagatgctcttgct

SEQ ID NO: 9507358 - DNA, 19 bp, Homo sapiens
atagcagctatacccagat

SEQ ID NO: 9507359 - DNA, 22 bp, Homo sapiens
atagcagtaacactgacatttt

SEQ ID NO: 9507360 - DNA, 19 bp, Homo sapiens
ctggctgcaatgccagggt

SEQ ID NO: 9507361 - DNA, 22 bp, Homo sapiens
ctggctgcagctccgaggaaga

SEQ ID NO: 9507362 - DNA, 22 bp, Homo sapiens
ctggctggagtgcaggtgagtg

SEQ ID NO: 9507363 - DNA, 22 bp, Homo sapiens
ctggctcccgttgtccttgaag

SEQ ID NO: 9507364 - DNA, 22 bp, Homo sapiens
atagcaaaggacaatagtcagt

SEQ ID NO: 9507365 - DNA, 22 bp, Homo sapiens
ctggctccctcgctgaggtgct

SEQ ID NO: 9507366 - DNA, 22 bp, Homo sapiens
ctggctcccgaagccctcagtg

SEQ ID NO: 9507367 - DNA, 22 bp, Homo sapiens
ctggctcccgaagccctcagtg

SEQ ID NO: 9507368 - DNA, 22 bp, Homo sapiens
ctggctcccgtctggtggccat

SEQ ID NO: 9507369 - DNA, 22 bp, Homo sapiens
ctggctcccatgagctctcacg

SEQ ID NO: 9507370 - DNA, 22 bp, Homo sapiens
ctggctcccatgagctctcacg

SEQ ID NO: 9507371 - DNA, 22 bp, Homo sapiens
ctggctcccagctttcagggag

SEQ ID NO: 9507372 - DNA, 22 bp, Homo sapiens
ctggctcccgaagccctcagtg

SEQ ID NO: 9507373 - DNA, 22 bp, Homo sapiens
ctggctcccgaagccctcagtg

SEQ ID NO: 9507374 - DNA, 22 bp, Homo sapiens
ctggctcccatgagctctcacg

SEQ ID NO: 9507375 - DNA, 22 bp, Homo sapiens
ctggctcccatgagctctcacg

SEQ ID NO: 9507376 - DNA, 22 bp, Homo sapiens
ctggctcacaggtgagatgcat

SEQ ID NO: 9507377 - DNA, 22 bp, Homo sapiens
ctggcccggctgcctggtcatt

SEQ ID NO: 9507378 - DNA, 22 bp, Homo sapiens
ctggctcacaggtgagatgcat

SEQ ID NO: 9507379 - DNA, 22 bp, Homo sapiens
ctggctcacaggtgagatgcat

SEQ ID NO: 9507380 - DNA, 22 bp, Homo sapiens
ctggctcacaggtgagatgcat

SEQ ID NO: 9507381 - DNA, 22 bp, Homo sapiens
ctggctccatcactgggtgatg

SEQ ID NO: 9507382 - DNA, 22 bp, Homo sapiens
ctggctccagtgacaagtcgat

SEQ ID NO: 9507383 - DNA, 22 bp, Homo sapiens
ctggctccatcactgggtgatg

SEQ ID NO: 9507384 - DNA, 22 bp, Homo sapiens
ctggctccatcactgggtgatg

SEQ ID NO: 9507385 - DNA, 22 bp, Homo sapiens
ctggctccatcctaggcaaatg

SEQ ID NO: 9507386 - DNA, 22 bp, Homo sapiens
ctggctccattactcagcatct

SEQ ID NO: 9507387 - DNA, 22 bp, Homo sapiens
ctggctccatctttgcttcctg

SEQ ID NO: 9507388 - DNA, 22 bp, Homo sapiens
ctggctccatctttgcttcctg

SEQ ID NO: 9507389 - DNA, 22 bp, Homo sapiens
ctggctccatccttgagctctg

SEQ ID NO: 9507390 - DNA, 22 bp, Homo sapiens
ctggctccatccttgagctctg

SEQ ID NO: 9507391 - DNA, 22 bp, Homo sapiens
ctggctccatccttgagctctg

SEQ ID NO: 9507392 - DNA, 22 bp, Homo sapiens
ctggctccatctttgcttcctg

SEQ ID NO: 9507393 - DNA, 22 bp, Homo sapiens
atactacaaggtatgtgctaaa

SEQ ID NO: 9507394 - DNA, 22 bp, Homo sapiens
atactaagctcattacattttg

SEQ ID NO: 9507395 - DNA, 22 bp, Homo sapiens
atactaaagtatagaacttagt

SEQ ID NO: 9507396 - DNA, 22 bp, Homo sapiens
atactacaatcataattgtaca

SEQ ID NO: 9507397 - DNA, 22 bp, Homo sapiens
atactacatactatgtaaacat

SEQ ID NO: 9507398 - DNA, 22 bp, Homo sapiens
atactacatcacagccaagaag

SEQ ID NO: 9507399 - DNA, 22 bp, Homo sapiens
atactacatcacagccaagaag

SEQ ID NO: 9507400 - DNA, 22 bp, Homo sapiens
atactacacattgactatattt

SEQ ID NO: 9507401 - DNA, 22 bp, Homo sapiens
atactacactatgcatggatgt

SEQ ID NO: 9507402 - DNA, 22 bp, Homo sapiens
atactcaaggttaatgattgaa

SEQ ID NO: 9507403 - DNA, 22 bp, Homo sapiens
atagagatgggtttagttataa

SEQ ID NO: 9507404 - DNA, 22 bp, Homo sapiens
atagagattctggagtttgcac

SEQ ID NO: 9507405 - DNA, 22 bp, Homo sapiens
atagatgttcaatcagatattt

SEQ ID NO: 9507406 - DNA, 22 bp, Homo sapiens
atagatgtgtgtaagtacataa

SEQ ID NO: 9507407 - DNA, 22 bp, Homo sapiens
atagagctataagaattttgtg

SEQ ID NO: 9507408 - DNA, 22 bp, Homo sapiens
atagattatttgctcattactt

SEQ ID NO: 9507409 - DNA, 22 bp, Homo sapiens
atagattatttgctcattactt

SEQ ID NO: 9507410 - DNA, 22 bp, Homo sapiens
atagattagccctatagtttta

SEQ ID NO: 9507411 - DNA, 22 bp, Homo sapiens
atagatgttttagtaatactgt

SEQ ID NO: 9507412 - DNA, 22 bp, Homo sapiens
atagatgttttagtaatactgt

SEQ ID NO: 9507413 - DNA, 22 bp, Homo sapiens
atagatgttttctcctaattgg

SEQ ID NO: 9507414 - DNA, 22 bp, Homo sapiens
atagatttgaatttaagacttg

SEQ ID NO: 9507415 - DNA, 22 bp, Homo sapiens
atagattgctagttttaaaatt

SEQ ID NO: 9507416 - DNA, 22 bp, Homo sapiens
atagcaaactggcagcttgtgg

SEQ ID NO: 9507417 - DNA, 22 bp, Homo sapiens
atagcaaactggagcttgcttt

SEQ ID NO: 9507418 - DNA, 22 bp, Homo sapiens
atagcaaaaggcaccagagtga

SEQ ID NO: 9507419 - DNA, 22 bp, Homo sapiens
atagcaaaacccactgcattac

SEQ ID NO: 9507420 - DNA, 22 bp, Homo sapiens
atagcaaaagcatgtgcaatac

SEQ ID NO: 9507421 - DNA, 22 bp, Homo sapiens
atagcaaagcctggcacaatga

SEQ ID NO: 9507422 - DNA, 22 bp, Homo sapiens
atagcaaagcctggcacaatga

SEQ ID NO: 9507423 - DNA, 22 bp, Homo sapiens
atagcaaagatgtcaattcccc

SEQ ID NO: 9507424 - DNA, 22 bp, Homo sapiens
atagcaaagatgtcaattcccc

SEQ ID NO: 9507425 - DNA, 22 bp, Homo sapiens
ctggcccagttctgcgttttgc

SEQ ID NO: 9507426 - DNA, 22 bp, Homo sapiens
atagcaaaggacaatagtcagt

SEQ ID NO: 9507427 - DNA, 22 bp, Homo sapiens
atagcaaaggacaatagtcagt

SEQ ID NO: 9507428 - DNA, 22 bp, Homo sapiens
atagcaaaggacaatagtcagt

SEQ ID NO: 9507429 - DNA, 22 bp, Homo sapiens
ctggccccaggcagcctgctgg

SEQ ID NO: 9507430 - DNA, 22 bp, Homo sapiens
ctggccccaggcagcctgctgg

SEQ ID NO: 9507431 - DNA, 22 bp, Homo sapiens
ctggccccatctggagtctgag

SEQ ID NO: 9507432 - DNA, 22 bp, Homo sapiens
ctggccccatctggagtctgag

SEQ ID NO: 9507433 - DNA, 22 bp, Homo sapiens
ctggcccccacacctgtcaggg

SEQ ID NO: 9507434 - DNA, 22 bp, Homo sapiens
ctggcccccacacctgtcaggg

SEQ ID NO: 9507435 - DNA, 22 bp, Homo sapiens
ctggcccatggtgagctctggg

SEQ ID NO: 9507436 - DNA, 20 bp, Homo sapiens
ctggcccatctaccgctctg

SEQ ID NO: 9507437 - DNA, 20 bp, Homo sapiens
ctggcccatctaccgctctg

SEQ ID NO: 9507438 - DNA, 22 bp, Homo sapiens
ctggcccatggtgagctctggg

SEQ ID NO: 9507439 - DNA, 22 bp, Homo sapiens
ctggcccatggtgagctctggg

SEQ ID NO: 9507440 - DNA, 22 bp, Homo sapiens
ctggcccatggtgagctctggg

SEQ ID NO: 9507441 - DNA, 22 bp, Homo sapiens
ctggcccatggtgagctctggg

SEQ ID NO: 9507442 - DNA, 22 bp, Homo sapiens
ctggcccattgccttctctctc

SEQ ID NO: 9507443 - DNA, 22 bp, Homo sapiens
ctggcccatggtgagctctggg

SEQ ID NO: 9507444 - DNA, 22 bp, Homo sapiens
ctggcccattgccttctctctc

SEQ ID NO: 9507445 - DNA, 22 bp, Homo sapiens
ataacttattagattggagctg

SEQ ID NO: 9507446 - DNA, 22 bp, Homo sapiens
ataacttagagtaggcaaaagt

SEQ ID NO: 9507447 - DNA, 22 bp, Homo sapiens
ataacttagagtaggcaaaagt

SEQ ID NO: 9507448 - DNA, 22 bp, Homo sapiens
ataacttaatgggtcatgctct

SEQ ID NO: 9507449 - DNA, 23 bp, Homo sapiens
ataactgagccgaggcttaagaa

SEQ ID NO: 9507450 - DNA, 22 bp, Homo sapiens
ataacttaatgggtcatgctct

SEQ ID NO: 9507451 - DNA, 22 bp, Homo sapiens
ataacttgatgttatttgtcca

SEQ ID NO: 9507452 - DNA, 22 bp, Homo sapiens
ataagagctacagccagttctg

SEQ ID NO: 9507453 - DNA, 17 bp, Homo sapiens
ataagacagaagacaat

SEQ ID NO: 9507454 - DNA, 22 bp, Homo sapiens
ataagacacgcaaataggtacg

SEQ ID NO: 9507455 - DNA, 22 bp, Homo sapiens
ataagacacgccccactcactc

SEQ ID NO: 9507456 - DNA, 23 bp, Homo sapiens
ataagaaaacagtaggctcagag

SEQ ID NO: 9507457 - DNA, 22 bp, Homo sapiens
ataagaaacattattctttcca

SEQ ID NO: 9507458 - DNA, 22 bp, Homo sapiens
ataagaaacattattctttcca

SEQ ID NO: 9507459 - DNA, 22 bp, Homo sapiens
ataagaaacattattctttcca

SEQ ID NO: 9507460 - DNA, 22 bp, Homo sapiens
ataatttactaagctctacctt

SEQ ID NO: 9507461 - DNA, 22 bp, Homo sapiens
ataatttactaagctctacctt

SEQ ID NO: 9507462 - DNA, 20 bp, Homo sapiens
ataatttaccctgcaccact

SEQ ID NO: 9507463 - DNA, 22 bp, Homo sapiens
atacaaagctaaatatggtttc

SEQ ID NO: 9507464 - DNA, 17 bp, Homo sapiens
atacaaagccataaacc

SEQ ID NO: 9507465 - DNA, 17 bp, Homo sapiens
atacaaagccataaacc

SEQ ID NO: 9507466 - DNA, 22 bp, Homo sapiens
atacaaagctaaatatggtttc

SEQ ID NO: 9507467 - DNA, 22 bp, Homo sapiens
atacaaagctaaatatggtttc

SEQ ID NO: 9507468 - DNA, 22 bp, Homo sapiens
atacaaagctaaatatggtttc

SEQ ID NO: 9507469 - DNA, 22 bp, Homo sapiens
ataagagtcttgttttcttatt

SEQ ID NO: 9507470 - DNA, 22 bp, Homo sapiens
ataagagtcttgttttcttatt

SEQ ID NO: 9507471 - DNA, 22 bp, Homo sapiens
ataagatataaatccacagagt

SEQ ID NO: 9507472 - DNA, 22 bp, Homo sapiens
ataagatgagatcagctttctg

SEQ ID NO: 9507473 - DNA, 21 bp, Homo sapiens
ataagcatgctgattacattt

SEQ ID NO: 9507474 - DNA, 22 bp, Homo sapiens
atacaaatttatagatgcattt

SEQ ID NO: 9507475 - DNA, 22 bp, Homo sapiens
atacaaatttatagatgcattt

SEQ ID NO: 9507476 - DNA, 22 bp, Homo sapiens
atacaaatcctctgggatggta

SEQ ID NO: 9507477 - DNA, 22 bp, Homo sapiens
atacaaattataggccccatcc

SEQ ID NO: 9507478 - DNA, 22 bp, Homo sapiens
atacaaagtattgatcctgagt

SEQ ID NO: 9507479 - DNA, 22 bp, Homo sapiens
atacaaagtattgatcctgagt

SEQ ID NO: 9507480 - DNA, 22 bp, Homo sapiens
atacaaagtattgatcctgagt

SEQ ID NO: 9507481 - DNA, 22 bp, Homo sapiens
atacaaagtattaatcctggat

SEQ ID NO: 9507482 - DNA, 22 bp, Homo sapiens
atacaaaggaacacaggcatgt

SEQ ID NO: 9507483 - DNA, 22 bp, Homo sapiens
atacaaaggaacacaggcatgt

SEQ ID NO: 9507484 - DNA, 22 bp, Homo sapiens
atacaaaggaacacaggcatgt

SEQ ID NO: 9507485 - DNA, 22 bp, Homo sapiens
ctgctgaggtccttgctcagac

SEQ ID NO: 9507486 - DNA, 22 bp, Homo sapiens
ctgctgaggtccttgctcagac

SEQ ID NO: 9507487 - DNA, 22 bp, Homo sapiens
ctgctgaggtccttgctcagac

SEQ ID NO: 9507488 - DNA, 22 bp, Homo sapiens
ctgctgaggtccttgctcagac

SEQ ID NO: 9507489 - DNA, 22 bp, Homo sapiens
ctgctgattcttaaatgtggtt

SEQ ID NO: 9507490 - DNA, 22 bp, Homo sapiens
ctgctgaggtatactatgtgac

SEQ ID NO: 9507491 - DNA, 22 bp, Homo sapiens
ctgctgaggccttccctgtcct

SEQ ID NO: 9507492 - DNA, 22 bp, Homo sapiens
ctgctgaggctccggaccaagt

SEQ ID NO: 9507493 - DNA, 22 bp, Homo sapiens
atacaactgccttagaaggaaa

SEQ ID NO: 9507494 - DNA, 22 bp, Homo sapiens
atacaactgccttagaaggaaa

SEQ ID NO: 9507495 - DNA, 22 bp, Homo sapiens
atacaactgctctcagataagt

SEQ ID NO: 9507496 - DNA, 22 bp, Homo sapiens
ctgcctctcaggtccctgagat

SEQ ID NO: 9507497 - DNA, 22 bp, Homo sapiens
ctgcctctcaggtccctgagat

SEQ ID NO: 9507498 - DNA, 22 bp, Homo sapiens
ctgcctctcaggtccctgagat

SEQ ID NO: 9507499 - DNA, 22 bp, Homo sapiens
ctgcctctccccagagtggccc

SEQ ID NO: 9507500 - DNA, 22 bp, Homo sapiens
ctgcctctccccagagtggccc

SEQ ID NO: 9507501 - DNA, 22 bp, Homo sapiens
ctgcctctccccagagtggccc

SEQ ID NO: 9507502 - DNA, 22 bp, Homo sapiens
ctgcctctcaggtccctgagat

SEQ ID NO: 9507503 - DNA, 22 bp, Homo sapiens
ctgccctgtttggacagcccgg

SEQ ID NO: 9507504 - DNA, 22 bp, Homo sapiens
ctgcctctcagcctgaccgcca

SEQ ID NO: 9507505 - DNA, 22 bp, Homo sapiens
ctgcctctcagcctgaccgcca

SEQ ID NO: 9507506 - DNA, 22 bp, Homo sapiens
ataaatgcctcagaatcatccc

SEQ ID NO: 9507507 - DNA, 22 bp, Homo sapiens
ataaatgtgaaatgagcagtta

SEQ ID NO: 9507508 - DNA, 22 bp, Homo sapiens
ataaatgattcagcaggaaata

SEQ ID NO: 9507509 - DNA, 22 bp, Homo sapiens
ataaatgaacattcacagagct

SEQ ID NO: 9507510 - DNA, 22 bp, Homo sapiens
ataaatgattcagcaggaaata

SEQ ID NO: 9507511 - DNA, 22 bp, Homo sapiens
ataaatgattcagcaggaaata

SEQ ID NO: 9507512 - DNA, 22 bp, Homo sapiens
ctgcctctccccagagtggccc

SEQ ID NO: 9507513 - DNA, 22 bp, Homo sapiens
ctgcctctgcgtcccacagagt

SEQ ID NO: 9507514 - DNA, 22 bp, Homo sapiens
ctgcctctgcgtcccacagagt

SEQ ID NO: 9507515 - DNA, 22 bp, Homo sapiens
ctgcctctgcgtcccacagagt

SEQ ID NO: 9507516 - DNA, 22 bp, Homo sapiens
ataaatgaacattcacagagct

SEQ ID NO: 9507517 - DNA, 22 bp, Homo sapiens
ataaatgaacattcacagagct

SEQ ID NO: 9507518 - DNA, 22 bp, Homo sapiens
ataaatctcttaagactcaaca

SEQ ID NO: 9507519 - DNA, 23 bp, Homo sapiens
ataaattactatctccctagagc

SEQ ID NO: 9507520 - DNA, 23 bp, Homo sapiens
ataaattactatctccctagagc

SEQ ID NO: 9507521 - DNA, 22 bp, Homo sapiens
ataaatgtttgttgaatgaata

SEQ ID NO: 9507522 - DNA, 22 bp, Homo sapiens
ataaatgtgaattagagctttg

SEQ ID NO: 9507523 - DNA, 22 bp, Homo sapiens
ataaatgtttgttgaatgaata

SEQ ID NO: 9507524 - DNA, 22 bp, Homo sapiens
ataaatgtttgttgaatgaata

SEQ ID NO: 9507525 - DNA, 22 bp, Homo sapiens
ataaatgtgaaatgagcagtta

SEQ ID NO: 9507526 - DNA, 22 bp, Homo sapiens
ataaatgtgaaatgagcagtta

SEQ ID NO: 9507527 - DNA, 22 bp, Homo sapiens
ataaatgtgaaatgagcagtta

SEQ ID NO: 9507528 - DNA, 22 bp, Homo sapiens
ataaatgtgaattagagctttg

SEQ ID NO: 9507529 - DNA, 22 bp, Homo sapiens
ataaatgtgaattagagctttg

SEQ ID NO: 9507530 - DNA, 22 bp, Homo sapiens
ataaatgtgaattagagctttg

SEQ ID NO: 9507531 - DNA, 22 bp, Homo sapiens
ataacagagttgggaagtgaaa

SEQ ID NO: 9507532 - DNA, 22 bp, Homo sapiens
ataaattaggatctggggttcc

SEQ ID NO: 9507533 - DNA, 22 bp, Homo sapiens
ataaattaggatctggggttcc

SEQ ID NO: 9507534 - DNA, 22 bp, Homo sapiens
ataacctggatataaacagatg

SEQ ID NO: 9507535 - DNA, 22 bp, Homo sapiens
ataacattttgacaactggtga

SEQ ID NO: 9507536 - DNA, 22 bp, Homo sapiens
ataacattttgacaactggtga

SEQ ID NO: 9507537 - DNA, 22 bp, Homo sapiens
ataacattttgacaactggtga

SEQ ID NO: 9507538 - DNA, 22 bp, Homo sapiens
ataactgagagcaatctttctt

SEQ ID NO: 9507539 - DNA, 22 bp, Homo sapiens
ataactctgtttttttcatgca

SEQ ID NO: 9507540 - DNA, 22 bp, Homo sapiens
ataactctgtttttttcatgca

SEQ ID NO: 9507541 - DNA, 22 bp, Homo sapiens
ataacgaaggctgatgcgggat

SEQ ID NO: 9507542 - DNA, 22 bp, Homo sapiens
ataacctgtttcagacatttgt

SEQ ID NO: 9507543 - DNA, 22 bp, Homo sapiens
ataacctggtagtattaaatgt

SEQ ID NO: 9507544 - DNA, 22 bp, Homo sapiens
ataacagatactctctgtgagg

SEQ ID NO: 9507545 - DNA, 22 bp, Homo sapiens
ataacagatgtgaagtgctaat

SEQ ID NO: 9507546 - DNA, 22 bp, Homo sapiens
ataacatgacctgtgcttcaca

SEQ ID NO: 9507547 - DNA, 22 bp, Homo sapiens
ataacatggagtttgtcattta

SEQ ID NO: 9507548 - DNA, 22 bp, Homo sapiens
ctgcagggttttaacaatggac

SEQ ID NO: 9507549 - DNA, 22 bp, Homo sapiens
ctgcagggtttcgccagttgtg

SEQ ID NO: 9507550 - DNA, 22 bp, Homo sapiens
ctgcatccatgttgctgcaaag

SEQ ID NO: 9507551 - DNA, 22 bp, Homo sapiens
ctgcagggttcggagagttccc

SEQ ID NO: 9507552 - DNA, 22 bp, Homo sapiens
ctgcagggttcggagagttccc

SEQ ID NO: 9507553 - DNA, 20 bp, Homo sapiens
ctgcagggttagaggctcca

SEQ ID NO: 9507554 - DNA, 20 bp, Homo sapiens
ctgcagggttagaggctcca

SEQ ID NO: 9507555 - DNA, 20 bp, Homo sapiens
ctgcagggttagaggctcca

SEQ ID NO: 9507556 - DNA, 22 bp, Homo sapiens
ctgcagggttcggagagttccc

SEQ ID NO: 9507557 - DNA, 22 bp, Homo sapiens
ctgcagggttcggagagttccc

SEQ ID NO: 9507558 - DNA, 22 bp, Homo sapiens
ctgcagggtttcgccagttgtg

SEQ ID NO: 9507559 - DNA, 22 bp, Homo sapiens
ctgcagggtttcgccagttgtg

SEQ ID NO: 9507560 - DNA, 22 bp, Homo sapiens
ctgcagggtttcgccagttgtg

SEQ ID NO: 9507561 - DNA, 22 bp, Homo sapiens
ctgcatgttttcttaattgtga

SEQ ID NO: 9507562 - DNA, 22 bp, Homo sapiens
ctgcattacagcctccttagga

SEQ ID NO: 9507563 - DNA, 22 bp, Homo sapiens
ctgcatgtcactctgctgtccc

SEQ ID NO: 9507564 - DNA, 22 bp, Homo sapiens
ctgcatgtcactctgctgtccc

SEQ ID NO: 9507565 - DNA, 22 bp, Homo sapiens
ctgcatgtgttatatttggttc

SEQ ID NO: 9507566 - DNA, 22 bp, Homo sapiens
ctgcatgtgtttctgctgggtt

SEQ ID NO: 9507567 - DNA, 22 bp, Homo sapiens
ctgcatgtttacatttttgaga

SEQ ID NO: 9507568 - DNA, 21 bp, Homo sapiens
ctgcatctcatagaacatgtc

SEQ ID NO: 9507569 - DNA, 22 bp, Homo sapiens
ctgcatctctgctagtcagtca

SEQ ID NO: 9507570 - DNA, 20 bp, Homo sapiens
ctgcatctgtgacttgcaaa

SEQ ID NO: 9507571 - DNA, 22 bp, Homo sapiens
ctgcatctgcataatcaacttc

SEQ ID NO: 9507572 - DNA, 21 bp, Homo sapiens
ctgcatctgagtcattatgcc

SEQ ID NO: 9507573 - DNA, 22 bp, Homo sapiens
ctgcatgagctgtcagtggagg

SEQ ID NO: 9507574 - DNA, 22 bp, Homo sapiens
ctgcatctgttagattatcacc

SEQ ID NO: 9507575 - DNA, 22 bp, Homo sapiens
ctgcacacatatggcttctctc

SEQ ID NO: 9507576 - DNA, 23 bp, Homo sapiens
ctgcagagaactgagggacagcc

SEQ ID NO: 9507577 - DNA, 22 bp, Homo sapiens
ctgcagagaattgtggggcttc

SEQ ID NO: 9507578 - DNA, 22 bp, Homo sapiens
ctgcagagaattgtggggcttc

SEQ ID NO: 9507579 - DNA, 23 bp, Homo sapiens
ctgcagagaactgagggacagcc

SEQ ID NO: 9507580 - DNA, 22 bp, Homo sapiens
ctgcagagagtaactgaaatat

SEQ ID NO: 9507581 - DNA, 22 bp, Homo sapiens
ctgcagagagtgccgggcagcc

SEQ ID NO: 9507582 - DNA, 22 bp, Homo sapiens
ctgcagagatgaagaaggtggc

SEQ ID NO: 9507583 - DNA, 22 bp, Homo sapiens
ctgcagagatgaagaaggtggc

SEQ ID NO: 9507584 - DNA, 22 bp, Homo sapiens
ctgcagagatgaagaaggtggc

SEQ ID NO: 9507585 - DNA, 22 bp, Homo sapiens
ctgcagagcaagtaacatcctc

SEQ ID NO: 9507586 - DNA, 22 bp, Homo sapiens
ctgcagagatgaagaaggtggc

SEQ ID NO: 9507587 - DNA, 22 bp, Homo sapiens
ctgcagagcaagtaacatcctc

SEQ ID NO: 9507588 - DNA, 22 bp, Homo sapiens
ctgcagggagaggggacagcct

SEQ ID NO: 9507589 - DNA, 22 bp, Homo sapiens
ctgcaggggtgtcctgtattgg

SEQ ID NO: 9507590 - DNA, 22 bp, Homo sapiens
ctgcaggggtgtcctgtattgg

SEQ ID NO: 9507591 - DNA, 20 bp, Homo sapiens
ctgcagggtgagtgggcgat

SEQ ID NO: 9507592 - DNA, 20 bp, Homo sapiens
ctgcagggtgagtgggcgat

SEQ ID NO: 9507593 - DNA, 22 bp, Homo sapiens
ctgcagggtgacgttgcccacc

SEQ ID NO: 9507594 - DNA, 22 bp, Homo sapiens
ctgcaggggtgtcctgtattgg

SEQ ID NO: 9507595 - DNA, 20 bp, Homo sapiens
ctgcagggtgagtgggcgat

SEQ ID NO: 9507596 - DNA, 20 bp, Homo sapiens
ctgcagggtgagtgggcgat

SEQ ID NO: 9507597 - DNA, 22 bp, Homo sapiens
ctgcaaatcctcagaaagggtt

SEQ ID NO: 9507598 - DNA, 21 bp, Homo sapiens
ctgcaaatgcaaggtgaccag

SEQ ID NO: 9507599 - DNA, 22 bp, Homo sapiens
ctgcaaatcaagttcttataat

SEQ ID NO: 9507600 - DNA, 22 bp, Homo sapiens
ctgcaaatccctactgggcaca

SEQ ID NO: 9507601 - DNA, 23 bp, Homo sapiens
ctgcaactcagtctggagcagtt

SEQ ID NO: 9507602 - DNA, 22 bp, Homo sapiens
ctgcaaattggtggtgaggcaa

SEQ ID NO: 9507603 - DNA, 21 bp, Homo sapiens
ctgcaaatgtaatgagtttgg

SEQ ID NO: 9507604 - DNA, 22 bp, Homo sapiens
ctgcaaatgggctttaggtggc

SEQ ID NO: 9507605 - DNA, 22 bp, Homo sapiens
ctgcaaatgccgtgagagcagg

SEQ ID NO: 9507606 - DNA, 22 bp, Homo sapiens
ctgcaaatgcctcggtgtgcgg

SEQ ID NO: 9507607 - DNA, 22 bp, Homo sapiens
ctgatcccattggcagtccagt

SEQ ID NO: 9507608 - DNA, 22 bp, Homo sapiens
ctgcaaataggggtgtgaataa

SEQ ID NO: 9507609 - DNA, 21 bp, Homo sapiens
ctgatcccaaacctctgccct

SEQ ID NO: 9507610 - DNA, 22 bp, Homo sapiens
ctgatccagagccaaccaaggc

SEQ ID NO: 9507611 - DNA, 22 bp, Homo sapiens
ctgatcccattggcagtccagt

SEQ ID NO: 9507612 - DNA, 22 bp, Homo sapiens
ctgcaagctacccctagcatca

SEQ ID NO: 9507613 - DNA, 20 bp, Homo sapiens
ctgcaagcaggttattccag

SEQ ID NO: 9507614 - DNA, 22 bp, Homo sapiens
ctgcaagcaaatcaactctttg

SEQ ID NO: 9507615 - DNA, 22 bp, Homo sapiens
ctgcaactctctccagaggctg

SEQ ID NO: 9507616 - DNA, 22 bp, Homo sapiens
ctgcaactctagtccagggctg

SEQ ID NO: 9507617 - DNA, 22 bp, Homo sapiens
ctgcaactctctccagaggctg

SEQ ID NO: 9507618 - DNA, 22 bp, Homo sapiens
ctgcaactctctccagaggctg

SEQ ID NO: 9507619 - DNA, 22 bp, Homo sapiens
ctgcaatatgatgtctgagaaa

SEQ ID NO: 9507620 - DNA, 22 bp, Homo sapiens
ctgcaatatgatgtctgagaaa

SEQ ID NO: 9507621 - DNA, 22 bp, Homo sapiens
ctgcaatgcatgaattataaat

SEQ ID NO: 9507622 - DNA, 22 bp, Homo sapiens
ctgcaatctccatgcttgattt

SEQ ID NO: 9507623 - DNA, 19 bp, Homo sapiens
agttattgatctattcagg

SEQ ID NO: 9507624 - DNA, 22 bp, Homo sapiens
agttattgagtatctataatgt

SEQ ID NO: 9507625 - DNA, 22 bp, Homo sapiens
agttattcatttattctgtaca

SEQ ID NO: 9507626 - DNA, 22 bp, Homo sapiens
agttatgtcctcagcaaatcaa

SEQ ID NO: 9507627 - DNA, 22 bp, Homo sapiens
agttatcatcccttacactttg

SEQ ID NO: 9507628 - DNA, 22 bp, Homo sapiens
agttatattccatagattcaga

SEQ ID NO: 9507629 - DNA, 22 bp, Homo sapiens
agttatattccatagattcaga

SEQ ID NO: 9507630 - DNA, 22 bp, Homo sapiens
ctgaggagatccccccagaagt

SEQ ID NO: 9507631 - DNA, 22 bp, Homo sapiens
ctgaggagatccccccagaagt

SEQ ID NO: 9507632 - DNA, 22 bp, Homo sapiens
ctgaggagatgataatgtcatt

SEQ ID NO: 9507633 - DNA, 22 bp, Homo sapiens
ctgaggagatgataatgtcatt

SEQ ID NO: 9507634 - DNA, 22 bp, Homo sapiens
ctgaggagcaaccccgtgccct

SEQ ID NO: 9507635 - DNA, 22 bp, Homo sapiens
ctgaggagcaaccccgtgccct

SEQ ID NO: 9507636 - DNA, 22 bp, Homo sapiens
ctgaggagcagctggcccgcta

SEQ ID NO: 9507637 - DNA, 22 bp, Homo sapiens
ctgaggagcagctggcccgcta

SEQ ID NO: 9507638 - DNA, 22 bp, Homo sapiens
ctgaggagccccctctcagcat

SEQ ID NO: 9507639 - DNA, 22 bp, Homo sapiens
ctgaggagccccctctcagcat

SEQ ID NO: 9507640 - DNA, 22 bp, Homo sapiens
ctgaggagccccctctcagcat

SEQ ID NO: 9507641 - DNA, 22 bp, Homo sapiens
ctgaggagcgttggtcacgtgt

SEQ ID NO: 9507642 - DNA, 22 bp, Homo sapiens
agttatataactatctagatgc

SEQ ID NO: 9507643 - DNA, 22 bp, Homo sapiens
ctgaggagctgaaggccctcca

SEQ ID NO: 9507644 - DNA, 22 bp, Homo sapiens
ctgaggagctgaaggccctcca

SEQ ID NO: 9507645 - DNA, 22 bp, Homo sapiens
agttatatgtgaaaacacgtat

SEQ ID NO: 9507646 - DNA, 22 bp, Homo sapiens
agttatattccatagattcaga

SEQ ID NO: 9507647 - DNA, 22 bp, Homo sapiens
agtcttatggccatctctgatt

SEQ ID NO: 9507648 - DNA, 22 bp, Homo sapiens
agtcttatgtgatttatctttc

SEQ ID NO: 9507649 - DNA, 22 bp, Homo sapiens
agtcttatggttaaatagatgc

SEQ ID NO: 9507650 - DNA, 22 bp, Homo sapiens
agtcttagaactacagtgccta

SEQ ID NO: 9507651 - DNA, 22 bp, Homo sapiens
ctcattgcccagatccccacag

SEQ ID NO: 9507652 - DNA, 21 bp, Homo sapiens
agtcttaggcacagctgtgtc

SEQ ID NO: 9507653 - DNA, 22 bp, Homo sapiens
agtcttcagcagggttaaaccc

SEQ ID NO: 9507654 - DNA, 22 bp, Homo sapiens
agtcttcagcagccttctcagg

SEQ ID NO: 9507655 - DNA, 22 bp, Homo sapiens
agtcttcagcagccttctcagg

SEQ ID NO: 9507656 - DNA, 22 bp, Homo sapiens
agtcttcagcagccttctcagg

SEQ ID NO: 9507657 - DNA, 19 bp, Homo sapiens
agtcttcatctgccaggcc

SEQ ID NO: 9507658 - DNA, 23 bp, Homo sapiens
agtcttcattgtatttccagacc

SEQ ID NO: 9507659 - DNA, 23 bp, Homo sapiens
agtcttcattgtatttccagacc

SEQ ID NO: 9507660 - DNA, 22 bp, Homo sapiens
agtcttcatttagttgatccag

SEQ ID NO: 9507661 - DNA, 22 bp, Homo sapiens
agtcttcactcttcactactat

SEQ ID NO: 9507662 - DNA, 22 bp, Homo sapiens
agtcttcacatcagtctaaaga

SEQ ID NO: 9507663 - DNA, 22 bp, Homo sapiens
agtcttcagagaaattaactct

SEQ ID NO: 9507664 - DNA, 22 bp, Homo sapiens
agtcttcagcagccttctcagg

SEQ ID NO: 9507665 - DNA, 22 bp, Homo sapiens
agtcttctcatttcacatgctt

SEQ ID NO: 9507666 - DNA, 22 bp, Homo sapiens
agtcttctcatttcacatgctt

SEQ ID NO: 9507667 - DNA, 21 bp, Homo sapiens
agtcttctccagaggctgggg

SEQ ID NO: 9507668 - DNA, 22 bp, Homo sapiens
ctccagagagtccagctctggg

SEQ ID NO: 9507669 - DNA, 22 bp, Homo sapiens
ctccagagagtccagctctggg

SEQ ID NO: 9507670 - DNA, 22 bp, Homo sapiens
agtcttctgaataagaatcact

SEQ ID NO: 9507671 - DNA, 22 bp, Homo sapiens
agtcttctcatttcacatgctt

SEQ ID NO: 9507672 - DNA, 22 bp, Homo sapiens
agtcttcatttgtgttcaagac

SEQ ID NO: 9507673 - DNA, 22 bp, Homo sapiens
ctccagctcttaactgcggaag

SEQ ID NO: 9507674 - DNA, 22 bp, Homo sapiens
ctccagctcttaactgcggaag

SEQ ID NO: 9507675 - DNA, 22 bp, Homo sapiens
ctccagctgccaccagatgttt

SEQ ID NO: 9507676 - DNA, 22 bp, Homo sapiens
ctccagcctcatctcctggctg

SEQ ID NO: 9507677 - DNA, 22 bp, Homo sapiens
ctccaggctggatccaagtcaa

SEQ ID NO: 9507678 - DNA, 22 bp, Homo sapiens
ctccaggctcgtccaagatcga

SEQ ID NO: 9507679 - DNA, 22 bp, Homo sapiens
ctccaggctcgtccaagatcga

SEQ ID NO: 9507680 - DNA, 22 bp, Homo sapiens
ctccaggcgggaggcggttcca

SEQ ID NO: 9507681 - DNA, 22 bp, Homo sapiens
ctccaggaaagcctgaggcccg

SEQ ID NO: 9507682 - DNA, 22 bp, Homo sapiens
ctccagggaaaggggcgtccgc

SEQ ID NO: 9507683 - DNA, 22 bp, Homo sapiens
ctccaggcttcaagggccggcc

SEQ ID NO: 9507684 - DNA, 22 bp, Homo sapiens
ctccaggctggggtgcaggttg

SEQ ID NO: 9507685 - DNA, 22 bp, Homo sapiens
ctccaggctggatccaagtcaa

SEQ ID NO: 9507686 - DNA, 22 bp, Homo sapiens
ctccaggctggatccaagtcaa

SEQ ID NO: 9507687 - DNA, 22 bp, Homo sapiens
ctccagctgccaccagatgttt

SEQ ID NO: 9507688 - DNA, 22 bp, Homo sapiens
ctccagcttccctcagctgtgg

SEQ ID NO: 9507689 - DNA, 22 bp, Homo sapiens
ctccagcttccctcagctgtgg

SEQ ID NO: 9507690 - DNA, 22 bp, Homo sapiens
ctccagcttccctcagctgtgg

SEQ ID NO: 9507691 - DNA, 22 bp, Homo sapiens
ctccagcttccctcagctgtgg

SEQ ID NO: 9507692 - DNA, 22 bp, Homo sapiens
ctccaggaaaatagggaatgag

SEQ ID NO: 9507693 - DNA, 22 bp, Homo sapiens
ctccagctttagctctccaggg

SEQ ID NO: 9507694 - DNA, 22 bp, Homo sapiens
ctcatgtcaggggtgtcaatgt

SEQ ID NO: 9507695 - DNA, 22 bp, Homo sapiens
ctcatgtcttcacccattctaa

SEQ ID NO: 9507696 - DNA, 22 bp, Homo sapiens
ctcatgtcccagacttaatcag

SEQ ID NO: 9507697 - DNA, 22 bp, Homo sapiens
ctcatggcagagtcacctgtcc

SEQ ID NO: 9507698 - DNA, 22 bp, Homo sapiens
ctcattagacaggtatacttta

SEQ ID NO: 9507699 - DNA, 22 bp, Homo sapiens
ctcattagacaggtatacttta

SEQ ID NO: 9507700 - DNA, 18 bp, Homo sapiens
ctcatgtgtggtcccagc

SEQ ID NO: 9507701 - DNA, 22 bp, Homo sapiens
ctcattaaaggaaatcacctgc

SEQ ID NO: 9507702 - DNA, 22 bp, Homo sapiens
ctcatgtgtctggtaggagctt

SEQ ID NO: 9507703 - DNA, 22 bp, Homo sapiens
ctcattgcaacctccgcctccc

SEQ ID NO: 9507704 - DNA, 22 bp, Homo sapiens
ctcattgcaacctccgcctccc

SEQ ID NO: 9507705 - DNA, 22 bp, Homo sapiens
ctcattcattcccgcagccacc

SEQ ID NO: 9507706 - DNA, 22 bp, Homo sapiens
ctcattgcagctgcattactgt

SEQ ID NO: 9507707 - DNA, 22 bp, Homo sapiens
ctcattgcaacctccgcctccc

SEQ ID NO: 9507708 - DNA, 22 bp, Homo sapiens
ctcattgcaacctccgcctccc

SEQ ID NO: 9507709 - DNA, 22 bp, Homo sapiens
agtcctggctctacgggcttca

SEQ ID NO: 9507710 - DNA, 22 bp, Homo sapiens
agtcctggctctacgggcttca

SEQ ID NO: 9507711 - DNA, 18 bp, Homo sapiens
agtcctggctctaccacc

SEQ ID NO: 9507712 - DNA, 19 bp, Homo sapiens
agtcctggcctgggggacc

SEQ ID NO: 9507713 - DNA, 22 bp, Homo sapiens
agtcctggccccaaggaaggat

SEQ ID NO: 9507714 - DNA, 22 bp, Homo sapiens
agtcctggccccaaggaaggat

SEQ ID NO: 9507715 - DNA, 22 bp, Homo sapiens
ctcatctgtctgggctggtttt

SEQ ID NO: 9507716 - DNA, 22 bp, Homo sapiens
ctcatgatttgagtagtaaact

SEQ ID NO: 9507717 - DNA, 22 bp, Homo sapiens
agtcctgggtccagcaggtcct

SEQ ID NO: 9507718 - DNA, 22 bp, Homo sapiens
ctcagtgttaaatataaggtat

SEQ ID NO: 9507719 - DNA, 22 bp, Homo sapiens
ctcagtgttggagaccttcagg

SEQ ID NO: 9507720 - DNA, 18 bp, Homo sapiens
ctcagtgtttgctgaaaa

SEQ ID NO: 9507721 - DNA, 18 bp, Homo sapiens
ctcagtgtttgctgaaaa

SEQ ID NO: 9507722 - DNA, 22 bp, Homo sapiens
agtcctgggtccagcaggtcct

SEQ ID NO: 9507723 - DNA, 22 bp, Homo sapiens
agtcctgggtccagcaggtcct

SEQ ID NO: 9507724 - DNA, 23 bp, Homo sapiens
agtcccctacatagttcctgggg

SEQ ID NO: 9507725 - DNA, 22 bp, Homo sapiens
agtccccctctgagcccaggga

SEQ ID NO: 9507726 - DNA, 22 bp, Homo sapiens
agtccctggattgtctctgtca

SEQ ID NO: 9507727 - DNA, 17 bp, Homo sapiens
agtccctaggtcctggg

SEQ ID NO: 9507728 - DNA, 22 bp, Homo sapiens
agtccctccaacacagtattag

SEQ ID NO: 9507729 - DNA, 22 bp, Homo sapiens
agtccctctgggagcaggactg

SEQ ID NO: 9507730 - DNA, 21 bp, Homo sapiens
agtcccctgtccttacttcta

SEQ ID NO: 9507731 - DNA, 22 bp, Homo sapiens
agtccctgtactttccactgcc

SEQ ID NO: 9507732 - DNA, 22 bp, Homo sapiens
agtccctgtactttccactgcc

SEQ ID NO: 9507733 - DNA, 22 bp, Homo sapiens
agtccctgtactttccactgcc

SEQ ID NO: 9507734 - DNA, 22 bp, Homo sapiens
agtccggtcagggggctgctgt

SEQ ID NO: 9507735 - DNA, 22 bp, Homo sapiens
agtccgcctgctgccgtggcag

SEQ ID NO: 9507736 - DNA, 22 bp, Homo sapiens
agtcctggcatggaattgtccc

SEQ ID NO: 9507737 - DNA, 22 bp, Homo sapiens
agtcctggcatataggtcctca

SEQ ID NO: 9507738 - DNA, 22 bp, Homo sapiens
agtcctggcatataggtcctca

SEQ ID NO: 9507739 - DNA, 22 bp, Homo sapiens
agtcctggcatataggtcctca

SEQ ID NO: 9507740 - DNA, 18 bp, Homo sapiens
agtcctggagatcaccaa

SEQ ID NO: 9507741 - DNA, 22 bp, Homo sapiens
agtcctggacttggagtcaggg

SEQ ID NO: 9507742 - DNA, 22 bp, Homo sapiens
agtcctgatgctctggcaggag

SEQ ID NO: 9507743 - DNA, 22 bp, Homo sapiens
agtcctgatgctctggcaggag

SEQ ID NO: 9507744 - DNA, 22 bp, Homo sapiens
agtcctgatgctctggcaggag

SEQ ID NO: 9507745 - DNA, 22 bp, Homo sapiens
agtcctggacttggagtcaggg

SEQ ID NO: 9507746 - DNA, 22 bp, Homo sapiens
ctcctggctttcccagaccagg

SEQ ID NO: 9507747 - DNA, 22 bp, Homo sapiens
ctcctgggaaaggctggacaca

SEQ ID NO: 9507748 - DNA, 22 bp, Homo sapiens
ctcctgggaaaggctggacaca

SEQ ID NO: 9507749 - DNA, 22 bp, Homo sapiens
ctcctgggaaaggctggacaca

SEQ ID NO: 9507750 - DNA, 22 bp, Homo sapiens
ctcctgggaaatgaaggggcag

SEQ ID NO: 9507751 - DNA, 22 bp, Homo sapiens
ctcctgggaaatgaaggggcag

SEQ ID NO: 9507752 - DNA, 22 bp, Homo sapiens
ctcctgggaaaggctggacaca

SEQ ID NO: 9507753 - DNA, 22 bp, Homo sapiens
ctcctgggaaaggctggacaca

SEQ ID NO: 9507754 - DNA, 22 bp, Homo sapiens
ctcctgggaaatgaaggggcag

SEQ ID NO: 9507755 - DNA, 22 bp, Homo sapiens
ctcctgggaatttagttgtgag

SEQ ID NO: 9507756 - DNA, 22 bp, Homo sapiens
ctcctgggaatttagttgtgag

SEQ ID NO: 9507757 - DNA, 20 bp, Homo sapiens
ctcctgggactgctggttat

SEQ ID NO: 9507758 - DNA, 22 bp, Homo sapiens
ctcctgggcttcgaaggctccc

SEQ ID NO: 9507759 - DNA, 20 bp, Homo sapiens
ctcctgggactgctggttat

SEQ ID NO: 9507760 - DNA, 22 bp, Homo sapiens
ctcctggggcacttagaagcaa

SEQ ID NO: 9507761 - DNA, 22 bp, Homo sapiens
ctcctgggcttcgaaggctccc

SEQ ID NO: 9507762 - DNA, 22 bp, Homo sapiens
ctcctggggccatggaaggaac

SEQ ID NO: 9507763 - DNA, 22 bp, Homo sapiens
ctcctggggccatggaaggaac

SEQ ID NO: 9507764 - DNA, 22 bp, Homo sapiens
ctcctggggcacttagaagcaa

SEQ ID NO: 9507765 - DNA, 22 bp, Homo sapiens
ctcctgggggacagcggcaggg

SEQ ID NO: 9507766 - DNA, 22 bp, Homo sapiens
ctcctgggggacagcggcaggg

SEQ ID NO: 9507767 - DNA, 22 bp, Homo sapiens
ctcctgggggacagcggcaggg

SEQ ID NO: 9507768 - DNA, 22 bp, Homo sapiens
ctcctgggtcattgccagcaaa

SEQ ID NO: 9507769 - DNA, 22 bp, Homo sapiens
ctcctgggtcattgccagcaaa

SEQ ID NO: 9507770 - DNA, 22 bp, Homo sapiens
ctcctgggtcattgccagcaaa

SEQ ID NO: 9507771 - DNA, 22 bp, Homo sapiens
ctcctgggtcattgccagcaaa

SEQ ID NO: 9507772 - DNA, 22 bp, Homo sapiens
agtggcagaggttgactgcagt

SEQ ID NO: 9507773 - DNA, 22 bp, Homo sapiens
agtggcagaggttgactgcagt

SEQ ID NO: 9507774 - DNA, 22 bp, Homo sapiens
agtggcagagtgcactcaggca

SEQ ID NO: 9507775 - DNA, 22 bp, Homo sapiens
agtggcagagtgcactcaggca

SEQ ID NO: 9507776 - DNA, 22 bp, Homo sapiens
agtggcagagtgcactcaggca

SEQ ID NO: 9507777 - DNA, 22 bp, Homo sapiens
ctcctgggtcattgccagcaaa

SEQ ID NO: 9507778 - DNA, 22 bp, Homo sapiens
ctcctggtgctggggctgccgc

SEQ ID NO: 9507779 - DNA, 22 bp, Homo sapiens
agtggcagaggttgactgcagt

SEQ ID NO: 9507780 - DNA, 22 bp, Homo sapiens
agtggcagaagccaagtctgca

SEQ ID NO: 9507781 - DNA, 22 bp, Homo sapiens
agtggcagatctctggtctgga

SEQ ID NO: 9507782 - DNA, 19 bp, Homo sapiens
agtggcagatctggaagta

SEQ ID NO: 9507783 - DNA, 22 bp, Homo sapiens
agtggcagatctctggtctgga

SEQ ID NO: 9507784 - DNA, 22 bp, Homo sapiens
ctctcagcaggaaagcatgcaa

SEQ ID NO: 9507785 - DNA, 22 bp, Homo sapiens
ctctcagcaggaaagcatgcaa

SEQ ID NO: 9507786 - DNA, 22 bp, Homo sapiens
ctctcagaagtttatgtcagaa

SEQ ID NO: 9507787 - DNA, 19 bp, Homo sapiens
agtggcagatctggaagta

SEQ ID NO: 9507788 - DNA, 22 bp, Homo sapiens
ctctcagaagtagcacgtgggc

SEQ ID NO: 9507789 - DNA, 22 bp, Homo sapiens
ctctcagaagtttatgtcagaa

SEQ ID NO: 9507790 - DNA, 19 bp, Homo sapiens
ctcctggctctgtcatttt

SEQ ID NO: 9507791 - DNA, 22 bp, Homo sapiens
ctcctggctcgcccccagctga

SEQ ID NO: 9507792 - DNA, 22 bp, Homo sapiens
ctcctgcctgtgggactgagga

SEQ ID NO: 9507793 - DNA, 22 bp, Homo sapiens
ctcctgcctgtgggactgagga

SEQ ID NO: 9507794 - DNA, 22 bp, Homo sapiens
ctcctcagaacagccttggctg

SEQ ID NO: 9507795 - DNA, 22 bp, Homo sapiens
ctcctcagaagagggtaacaca

SEQ ID NO: 9507796 - DNA, 22 bp, Homo sapiens
ctcctcagaagagggtaacaca

SEQ ID NO: 9507797 - DNA, 22 bp, Homo sapiens
ctcctcagactttccttgtccg

SEQ ID NO: 9507798 - DNA, 22 bp, Homo sapiens
ctcctgccaccgcggtgtcctg

SEQ ID NO: 9507799 - DNA, 22 bp, Homo sapiens
ctcctgccaccgcggtgtcctg

SEQ ID NO: 9507800 - DNA, 22 bp, Homo sapiens
ctccctctgtccgaggccggct

SEQ ID NO: 9507801 - DNA, 22 bp, Homo sapiens
ctccctctctaaggcaaagaga

SEQ ID NO: 9507802 - DNA, 22 bp, Homo sapiens
ctccgtgctattttagtatcgc

SEQ ID NO: 9507803 - DNA, 22 bp, Homo sapiens
ctcctacagtgtttgagtccag

SEQ ID NO: 9507804 - DNA, 22 bp, Homo sapiens
ctcctagtgcacacctgtccac

SEQ ID NO: 9507805 - DNA, 22 bp, Homo sapiens
ctcctagtgcacacctgtccac

SEQ ID NO: 9507806 - DNA, 22 bp, Homo sapiens
ctcctaggtgctcactggggtc

SEQ ID NO: 9507807 - DNA, 22 bp, Homo sapiens
ctccctcaggccttagccctgc

SEQ ID NO: 9507808 - DNA, 22 bp, Homo sapiens
ctccctcaggccttagccctgc

SEQ ID NO: 9507809 - DNA, 22 bp, Homo sapiens
ctccctcatatacccagcgaga

SEQ ID NO: 9507810 - DNA, 22 bp, Homo sapiens
ctccctccaaataagactcggg

SEQ ID NO: 9507811 - DNA, 22 bp, Homo sapiens
ctccctccctacgtgagctcac

SEQ ID NO: 9507812 - DNA, 22 bp, Homo sapiens
ctccctccaaataagactcggg

SEQ ID NO: 9507813 - DNA, 22 bp, Homo sapiens
ctccctcatatacccagcgaga

SEQ ID NO: 9507814 - DNA, 22 bp, Homo sapiens
ctccctcatatacccagcgaga

SEQ ID NO: 9507815 - DNA, 22 bp, Homo sapiens
ctccctcctcaaatatctttgt

SEQ ID NO: 9507816 - DNA, 22 bp, Homo sapiens
ctccctccctacgtgagctcac

SEQ ID NO: 9507817 - DNA, 22 bp, Homo sapiens
ctccctccctacgtgagctcac

SEQ ID NO: 9507818 - DNA, 20 bp, Homo sapiens
ctccagggaacagactggag

SEQ ID NO: 9507819 - DNA, 20 bp, Homo sapiens
ctccagggaacagactggag

SEQ ID NO: 9507820 - DNA, 18 bp, Homo sapiens
ctccagggaactcagtca

SEQ ID NO: 9507821 - DNA, 18 bp, Homo sapiens
ctccagggaactcagtca

SEQ ID NO: 9507822 - DNA, 22 bp, Homo sapiens
ctccagggaaaggggcgtccgc

SEQ ID NO: 9507823 - DNA, 22 bp, Homo sapiens
ctcccaggttgattctttccct

SEQ ID NO: 9507824 - DNA, 22 bp, Homo sapiens
ctccctcacacccttgcccaga

SEQ ID NO: 9507825 - DNA, 22 bp, Homo sapiens
ctccctcacacccttgcccaga

SEQ ID NO: 9507826 - DNA, 22 bp, Homo sapiens
ctccctcaccatgacccgctgt

SEQ ID NO: 9507827 - DNA, 22 bp, Homo sapiens
ctccctcaccatgacccgctgt

SEQ ID NO: 9507828 - DNA, 22 bp, Homo sapiens
ctccctcaccatgacccgctgt

SEQ ID NO: 9507829 - DNA, 22 bp, Homo sapiens
ctccctcaccatgacccgctgt

SEQ ID NO: 9507830 - DNA, 22 bp, Homo sapiens
ctccctcagaggagcacctgtt

SEQ ID NO: 9507831 - DNA, 22 bp, Homo sapiens
ctccctcagaggagcacctgtt

SEQ ID NO: 9507832 - DNA, 22 bp, Homo sapiens
ctccctcagaggagcacctgtt

SEQ ID NO: 9507833 - DNA, 22 bp, Homo sapiens
ctccctcagaggagcacctgtt

SEQ ID NO: 9507834 - DNA, 22 bp, Homo sapiens
ctccctcagaggagcacctgtt

SEQ ID NO: 9507835 - DNA, 22 bp, Homo sapiens
ctctgcaggccttgagtgtggt

SEQ ID NO: 9507836 - DNA, 22 bp, Homo sapiens
ctctgcaggggaggcatgcact

SEQ ID NO: 9507837 - DNA, 22 bp, Homo sapiens
ctctgcagtgtaacagcgcttg

SEQ ID NO: 9507838 - DNA, 17 bp, Homo sapiens
ctctgcagtgcatggct

SEQ ID NO: 9507839 - DNA, 17 bp, Homo sapiens
ctctgcagtgcatggct

SEQ ID NO: 9507840 - DNA, 21 bp, Homo sapiens
ctctgcagccctgcttccagg

SEQ ID NO: 9507841 - DNA, 21 bp, Homo sapiens
ctctgcagccctgcttccagg

SEQ ID NO: 9507842 - DNA, 22 bp, Homo sapiens
ctctgcaggcacccagggtggg

SEQ ID NO: 9507843 - DNA, 22 bp, Homo sapiens
ctctgcaggcctgtgaagggtg

SEQ ID NO: 9507844 - DNA, 22 bp, Homo sapiens
ctctgagcagaggccgtggcta

SEQ ID NO: 9507845 - DNA, 22 bp, Homo sapiens
ctctccaagttatcaagatgaa

SEQ ID NO: 9507846 - DNA, 21 bp, Homo sapiens
ctctgcagccctgcttccagg

SEQ ID NO: 9507847 - DNA, 22 bp, Homo sapiens
ctctgagcccgctgcagcccca

SEQ ID NO: 9507848 - DNA, 22 bp, Homo sapiens
ctctcagtttcctcaactgtaa

SEQ ID NO: 9507849 - DNA, 22 bp, Homo sapiens
ctctcagtttcctcaactgtaa

SEQ ID NO: 9507850 - DNA, 22 bp, Homo sapiens
ctctcatgtagtatctgtatgg

SEQ ID NO: 9507851 - DNA, 22 bp, Homo sapiens
ctctcagtgccacacagccatt

SEQ ID NO: 9507852 - DNA, 22 bp, Homo sapiens
ctctcagtcctgcgcgcctctg

SEQ ID NO: 9507853 - DNA, 19 bp, Homo sapiens
ctctcagcctgtctccttg

SEQ ID NO: 9507854 - DNA, 15 bp, Homo sapiens
ctctcaggcaggcag

SEQ ID NO: 9507855 - DNA, 22 bp, Homo sapiens
ctctcagggcaggtggcctttc

SEQ ID NO: 9507856 - DNA, 22 bp, Homo sapiens
ctctcagggcaggtggcctttc

SEQ ID NO: 9507857 - DNA, 22 bp, Homo sapiens
ctctcagtgccacacagccatt

SEQ ID NO: 9507858 - DNA, 22 bp, Homo sapiens
ctctcagtaaatttctgcccca

SEQ ID NO: 9507859 - DNA, 22 bp, Homo sapiens
ctctcaggtagagcccaagaat

SEQ ID NO: 9507860 - DNA, 22 bp, Homo sapiens
ctctgctgatctcagctgggct

SEQ ID NO: 9507861 - DNA, 22 bp, Homo sapiens
ctctgctgatctcagctgggct

SEQ ID NO: 9507862 - DNA, 22 bp, Homo sapiens
ctctggatgaggtcctgtctgt

SEQ ID NO: 9507863 - DNA, 22 bp, Homo sapiens
ctctggatctgccctgacgcca

SEQ ID NO: 9507864 - DNA, 23 bp, Homo sapiens
ctctggatcctgtagctcctggc

SEQ ID NO: 9507865 - DNA, 23 bp, Homo sapiens
ctctggatcctgtagctcctggc

SEQ ID NO: 9507866 - DNA, 22 bp, Homo sapiens
ctctggatctgccctgacgcca

SEQ ID NO: 9507867 - DNA, 22 bp, Homo sapiens
ctctggatggttctgcacattc

SEQ ID NO: 9507868 - DNA, 22 bp, Homo sapiens
ctctggattgctgtgagatgct

SEQ ID NO: 9507869 - DNA, 22 bp, Homo sapiens
ctctgcgtggctgggcccaggg

SEQ ID NO: 9507870 - DNA, 22 bp, Homo sapiens
ctctgctcaccagccatgtgat

SEQ ID NO: 9507871 - DNA, 22 bp, Homo sapiens
ctctgctcaccagccatgtgat

SEQ ID NO: 9507872 - DNA, 22 bp, Homo sapiens
ctctgctcagatgatttatcaa

SEQ ID NO: 9507873 - DNA, 22 bp, Homo sapiens
ctctgctgagccagagtcccca

SEQ ID NO: 9507874 - DNA, 22 bp, Homo sapiens
ctctgctcaccagccatgtgat

SEQ ID NO: 9507875 - DNA, 22 bp, Homo sapiens
ctctgcctgtgtcgccaccaca

SEQ ID NO: 9507876 - DNA, 22 bp, Homo sapiens
ctctgcctgtctcatcctgcaa

SEQ ID NO: 9507877 - DNA, 22 bp, Homo sapiens
ctctgcattttaacagatgatt

SEQ ID NO: 9507878 - DNA, 22 bp, Homo sapiens
ctctgcattttaacagatgatt

SEQ ID NO: 9507879 - DNA, 22 bp, Homo sapiens
ctctgcctgccactgttcaggc

SEQ ID NO: 9507880 - DNA, 22 bp, Homo sapiens
ctctgcatcaggcattatggat

SEQ ID NO: 9507881 - DNA, 22 bp, Homo sapiens
ctctgcatcagcttcattctgt

SEQ ID NO: 9507882 - DNA, 22 bp, Homo sapiens
ctctgcatgccacatgagtgac

SEQ ID NO: 9507883 - DNA, 22 bp, Homo sapiens
ctctgcatgccacatgagtgac

SEQ ID NO: 9507884 - DNA, 22 bp, Homo sapiens
ctctgcatgccacatgagtgac

SEQ ID NO: 9507885 - DNA, 22 bp, Homo sapiens
ctctgcagtgtaacagcgcttg

SEQ ID NO: 9507886 - DNA, 22 bp, Homo sapiens
ctctggctttcccagggaggag

SEQ ID NO: 9507887 - DNA, 22 bp, Homo sapiens
ctctggctttgctcatgcatcc

SEQ ID NO: 9507888 - DNA, 22 bp, Homo sapiens
ctctggctttgctcatgcatcc

SEQ ID NO: 9507889 - DNA, 22 bp, Homo sapiens
ctctggctttgctcatgcatcc

SEQ ID NO: 9507890 - DNA, 22 bp, Homo sapiens
ctctggcttgttaatgcatatt

SEQ ID NO: 9507891 - DNA, 22 bp, Homo sapiens
ctctggcttgttaatgcatatt

SEQ ID NO: 9507892 - DNA, 22 bp, Homo sapiens
ctctggcttggtaaaaacttct

SEQ ID NO: 9507893 - DNA, 22 bp, Homo sapiens
ctctggcttgttaatgcatatt

SEQ ID NO: 9507894 - DNA, 22 bp, Homo sapiens
ctctggctttaaggatgccaca

SEQ ID NO: 9507895 - DNA, 22 bp, Homo sapiens
ctctggctttaaggatgccaca

SEQ ID NO: 9507896 - DNA, 22 bp, Homo sapiens
ctctgggaattctgagcaagca

SEQ ID NO: 9507897 - DNA, 22 bp, Homo sapiens
ctctgggaattctgagcaagca

SEQ ID NO: 9507898 - DNA, 22 bp, Homo sapiens
ctctgggaagggctgagcactg

SEQ ID NO: 9507899 - DNA, 22 bp, Homo sapiens
ctctgggaagggctgagcactg

SEQ ID NO: 9507900 - DNA, 22 bp, Homo sapiens
ctctgggaagggctgagcactg

SEQ ID NO: 9507901 - DNA, 22 bp, Homo sapiens
ctctgggaaagattgtgcaggc

SEQ ID NO: 9507902 - DNA, 22 bp, Homo sapiens
ctctggctttgctcatgcatcc

SEQ ID NO: 9507903 - DNA, 22 bp, Homo sapiens
ctctgggagaggacacttggag

SEQ ID NO: 9507904 - DNA, 22 bp, Homo sapiens
ctctgggactagaaccccaggg

SEQ ID NO: 9507905 - DNA, 22 bp, Homo sapiens
ctctgggagaggacacttggag

SEQ ID NO: 9507906 - DNA, 22 bp, Homo sapiens
ctctgggagaggacacttggag

SEQ ID NO: 9507907 - DNA, 22 bp, Homo sapiens
ctctgggaccatggcaagtgcg

SEQ ID NO: 9507908 - DNA, 22 bp, Homo sapiens
ctctgggaccatggcaagtgcg

SEQ ID NO: 9507909 - DNA, 22 bp, Homo sapiens
ctctgggacatcccttggccta

SEQ ID NO: 9507910 - DNA, 22 bp, Homo sapiens
ctctgggacatcccttggccta

SEQ ID NO: 9507911 - DNA, 22 bp, Homo sapiens
ctctgggaccacgtgactctgc

SEQ ID NO: 9507912 - DNA, 22 bp, Homo sapiens
ctctgggaccacgtgactctgc

SEQ ID NO: 9507913 - DNA, 22 bp, Homo sapiens
ctctgggaccacgtgactctgc

SEQ ID NO: 9507914 - DNA, 22 bp, Homo sapiens
ctctgggcttacctgcttcctg

SEQ ID NO: 9507915 - DNA, 22 bp, Homo sapiens
ctctgggcttacctgcttcctg

SEQ ID NO: 9507916 - DNA, 20 bp, Homo sapiens
ctctgggctgcgttgcaaac

SEQ ID NO: 9507917 - DNA, 19 bp, Homo sapiens
ctctgggctgcatcttggt

SEQ ID NO: 9507918 - DNA, 19 bp, Homo sapiens
ctctgggctgcatcttggt

SEQ ID NO: 9507919 - DNA, 20 bp, Homo sapiens
ctctgggctgcgttgcaaac

SEQ ID NO: 9507920 - DNA, 22 bp, Homo sapiens
ctctgggctgccttttagctct

SEQ ID NO: 9507921 - DNA, 22 bp, Homo sapiens
ctctgggcttcctttgtgggtt

SEQ ID NO: 9507922 - DNA, 22 bp, Homo sapiens
ctctgggcttcaagtcagattt

SEQ ID NO: 9507923 - DNA, 22 bp, Homo sapiens
ctctgggcttcaagtcagattt

SEQ ID NO: 9507924 - DNA, 22 bp, Homo sapiens
ctctgggcttacctgcttcctg

SEQ ID NO: 9507925 - DNA, 23 bp, Homo sapiens
ctgaaataccagaaaatcagtgt

SEQ ID NO: 9507926 - DNA, 17 bp, Homo sapiens
ctgaaatattatgataa

SEQ ID NO: 9507927 - DNA, 17 bp, Homo sapiens
ctgaaatattatgataa

SEQ ID NO: 9507928 - DNA, 17 bp, Homo sapiens
ctgaaatattatgataa

SEQ ID NO: 9507929 - DNA, 22 bp, Homo sapiens
ctgaaatgacggtttggggcaa

SEQ ID NO: 9507930 - DNA, 22 bp, Homo sapiens
ctgaaatcaattttgattatct

SEQ ID NO: 9507931 - DNA, 22 bp, Homo sapiens
ctctttggttaatcacacagat

SEQ ID NO: 9507932 - DNA, 22 bp, Homo sapiens
ctgaaaggcagtgggtagtgtg

SEQ ID NO: 9507933 - DNA, 23 bp, Homo sapiens
ctgaaataccagaaaatcagtgt

SEQ ID NO: 9507934 - DNA, 23 bp, Homo sapiens
ctgaaataccagaaaatcagtgt

SEQ ID NO: 9507935 - DNA, 23 bp, Homo sapiens
ctgaaataccagaaaatcagtgt

SEQ ID NO: 9507936 - DNA, 22 bp, Homo sapiens
ctgaaataaagttgctaaaatt

SEQ ID NO: 9507937 - DNA, 22 bp, Homo sapiens
ctctggggtggaggaggctgac

SEQ ID NO: 9507938 - DNA, 22 bp, Homo sapiens
ctctggggtggaggaggctgac

SEQ ID NO: 9507939 - DNA, 22 bp, Homo sapiens
ctctggggttaagcttccatgg

SEQ ID NO: 9507940 - DNA, 22 bp, Homo sapiens
ctctttggtgcaccttgcagtc

SEQ ID NO: 9507941 - DNA, 22 bp, Homo sapiens
ctctggggaagcagccagctgg

SEQ ID NO: 9507942 - DNA, 22 bp, Homo sapiens
ctctggggaaatggatatgtac

SEQ ID NO: 9507943 - DNA, 22 bp, Homo sapiens
ctctgggcttgttgacctgcac

SEQ ID NO: 9507944 - DNA, 22 bp, Homo sapiens
ctctgggcttgttgacctgcac

SEQ ID NO: 9507945 - DNA, 22 bp, Homo sapiens
ctctgggcttgttgacctgcac

SEQ ID NO: 9507946 - DNA, 22 bp, Homo sapiens
ctctggggaagcagccagctgg

SEQ ID NO: 9507947 - DNA, 17 bp, Homo sapiens
ctctggggacagttcta

SEQ ID NO: 9507948 - DNA, 17 bp, Homo sapiens
ctctggggacagttcta

SEQ ID NO: 9507949 - DNA, 22 bp, Homo sapiens
ctctggggtgcttcgacacttc

SEQ ID NO: 9507950 - DNA, 22 bp, Homo sapiens
ctgagaaaagctttcttataca

SEQ ID NO: 9507951 - DNA, 22 bp, Homo sapiens
ctgagaaaagctttcttataca

SEQ ID NO: 9507952 - DNA, 22 bp, Homo sapiens
ctgagaaaagacatttctagat

SEQ ID NO: 9507953 - DNA, 22 bp, Homo sapiens
ctgagaaaagtatgagctctgg

SEQ ID NO: 9507954 - DNA, 22 bp, Homo sapiens
ctgagaaaatttcaggaagtgt

SEQ ID NO: 9507955 - DNA, 22 bp, Homo sapiens
ctgagaaaagtatgagctctgg

SEQ ID NO: 9507956 - DNA, 22 bp, Homo sapiens
ctgagaaaagtatgagctctgg

SEQ ID NO: 9507957 - DNA, 22 bp, Homo sapiens
ctgagaaaagtatgagctctgg

SEQ ID NO: 9507958 - DNA, 22 bp, Homo sapiens
ctgagaaaagctttcttataca

SEQ ID NO: 9507959 - DNA, 20 bp, Homo sapiens
ctgacagaaaatatttcatc

SEQ ID NO: 9507960 - DNA, 22 bp, Homo sapiens
ctgacacccagcagaactggga

SEQ ID NO: 9507961 - DNA, 22 bp, Homo sapiens
ctgacttttccaaataatactt

SEQ ID NO: 9507962 - DNA, 22 bp, Homo sapiens
ctgaattaatacacagaatggc

SEQ ID NO: 9507963 - DNA, 22 bp, Homo sapiens
ctgaattactgaaggtcaactt

SEQ ID NO: 9507964 - DNA, 22 bp, Homo sapiens
ctgaattacttattagtgggga

SEQ ID NO: 9507965 - DNA, 22 bp, Homo sapiens
ctgaattaatacacagaatggc

SEQ ID NO: 9507966 - DNA, 21 bp, Homo sapiens
ctgaattatgtgcttaccttt

SEQ ID NO: 9507967 - DNA, 18 bp, Homo sapiens
ctgaattatctcatcatt

SEQ ID NO: 9507968 - DNA, 22 bp, Homo sapiens
ctgaattagatgaaaaaggctc

SEQ ID NO: 9507969 - DNA, 22 bp, Homo sapiens
ctgaatgatataagatctttct

SEQ ID NO: 9507970 - DNA, 22 bp, Homo sapiens
ctgaattaagcattacatacat

SEQ ID NO: 9507971 - DNA, 22 bp, Homo sapiens
ctgacaaaccactgctccagct

SEQ ID NO: 9507972 - DNA, 22 bp, Homo sapiens
ctgaattatttaaggtgaaggg

SEQ ID NO: 9507973 - DNA, 22 bp, Homo sapiens
ctgaattctgccttgaggcctt

SEQ ID NO: 9507974 - DNA, 22 bp, Homo sapiens
ctgacaaacttaattttctgaa

SEQ ID NO: 9507975 - DNA, 22 bp, Homo sapiens
ctgacaaaccactgctccagct

SEQ ID NO: 9507976 - DNA, 22 bp, Homo sapiens
ctgacaaaggcaaggcaggggg

SEQ ID NO: 9507977 - DNA, 22 bp, Homo sapiens
ctgacaaaggcaaggcaggggg

SEQ ID NO: 9507978 - DNA, 22 bp, Homo sapiens
ctgacacccagcagaactggga

SEQ ID NO: 9507979 - DNA, 22 bp, Homo sapiens
agtgtctgctaggttcatcaac

SEQ ID NO: 9507980 - DNA, 22 bp, Homo sapiens
agtgtctgctcagacagctaca

SEQ ID NO: 9507981 - DNA, 22 bp, Homo sapiens
agtgtctgctcagacagctaca

SEQ ID NO: 9507982 - DNA, 22 bp, Homo sapiens
agtgtctgcttatcagttcttg

SEQ ID NO: 9507983 - DNA, 22 bp, Homo sapiens
agtgtctgcgggcagaggagcg

SEQ ID NO: 9507984 - DNA, 22 bp, Homo sapiens
agtgtctgcgggcagaggagcg

SEQ ID NO: 9507985 - DNA, 22 bp, Homo sapiens
agtgtctgctaggttcatcaac

SEQ ID NO: 9507986 - DNA, 22 bp, Homo sapiens
agtgtctgcgggcagaggagcg

SEQ ID NO: 9507987 - DNA, 22 bp, Homo sapiens
agtgtctgcggcggggaggcgg

SEQ ID NO: 9507988 - DNA, 22 bp, Homo sapiens
agtgtctgcctgggaggagcat

SEQ ID NO: 9507989 - DNA, 22 bp, Homo sapiens
agtgtctgcctgggaggagcat

SEQ ID NO: 9507990 - DNA, 23 bp, Homo sapiens
ctgaaattcagatgctaaagata

SEQ ID NO: 9507991 - DNA, 22 bp, Homo sapiens
ctgaaatggttgcctggagaat

SEQ ID NO: 9507992 - DNA, 22 bp, Homo sapiens
ctgaaatggttgcctggagaat

SEQ ID NO: 9507993 - DNA, 22 bp, Homo sapiens
ctgaaatgttaaatacttggct

SEQ ID NO: 9507994 - DNA, 22 bp, Homo sapiens
agtgtctgctttgagtcaggtg

SEQ ID NO: 9507995 - DNA, 22 bp, Homo sapiens
agtgtctgctttgagtcaggtg

SEQ ID NO: 9507996 - DNA, 22 bp, Homo sapiens
agtgtctgctttgagtcaggtg

SEQ ID NO: 9507997 - DNA, 22 bp, Homo sapiens
agtgtctgctttgagtcaggtg

SEQ ID NO: 9507998 - DNA, 18 bp, Homo sapiens
agtgtctggatatttggg

SEQ ID NO: 9507999 - DNA, 22 bp, Homo sapiens
agtgtctggaggcattcttggt

SEQ ID NO: 9508000 - DNA, 18 bp, Homo sapiens
agtgtctggatatttggg

SEQ ID NO: 9508001 - DNA, 20 bp, Homo sapiens
agtgtctggattttgtaacc

SEQ ID NO: 9508002 - DNA, 20 bp, Homo sapiens
agtgtctgggcctcaggccc

SEQ ID NO: 9508003 - DNA, 22 bp, Homo sapiens
ctgaagctttacttcaaataca

SEQ ID NO: 9508004 - DNA, 22 bp, Homo sapiens
ctgaagctttacttcaaataca

SEQ ID NO: 9508005 - DNA, 22 bp, Homo sapiens
ctgaagctttacttcaaataca

SEQ ID NO: 9508006 - DNA, 22 bp, Homo sapiens
ctgaatccacacaaggtgatgg

SEQ ID NO: 9508007 - DNA, 22 bp, Homo sapiens
ctgaatgagggattctgagggc

SEQ ID NO: 9508008 - DNA, 22 bp, Homo sapiens
ctgagcagatgaccagccccag

SEQ ID NO: 9508009 - DNA, 22 bp, Homo sapiens
ctgagcagaggtcaagatactt

SEQ ID NO: 9508010 - DNA, 22 bp, Homo sapiens
agttatataactatctagatgc

SEQ ID NO: 9508011 - DNA, 22 bp, Homo sapiens
ctgagcagcaacccagagcctc

SEQ ID NO: 9508012 - DNA, 22 bp, Homo sapiens
ctgagcagcaacccagagcctc

SEQ ID NO: 9508013 - DNA, 22 bp, Homo sapiens
ctgagcagcaacccagagcctc

SEQ ID NO: 9508014 - DNA, 22 bp, Homo sapiens
ctgagcagatgttgcccagaag

SEQ ID NO: 9508015 - DNA, 22 bp, Homo sapiens
ctgagcagcaacccagagcctc

SEQ ID NO: 9508016 - DNA, 22 bp, Homo sapiens
ctgagcagcacagggcgccagg

SEQ ID NO: 9508017 - DNA, 22 bp, Homo sapiens
ctgagcagcaattgctggccca

SEQ ID NO: 9508018 - DNA, 22 bp, Homo sapiens
ctgagcagcaacccagagcctc

SEQ ID NO: 9508019 - DNA, 22 bp, Homo sapiens
ctgaggagaggtggcctgtgtt

SEQ ID NO: 9508020 - DNA, 22 bp, Homo sapiens
ctgaggagaggtggcctgtgtt

SEQ ID NO: 9508021 - DNA, 22 bp, Homo sapiens
ctgaggagaggtggcctgtgtt

SEQ ID NO: 9508022 - DNA, 22 bp, Homo sapiens
ctgaggagaggtggcctgtgtt

SEQ ID NO: 9508023 - DNA, 22 bp, Homo sapiens
ctgaggagaccatcaactaatt

SEQ ID NO: 9508024 - DNA, 22 bp, Homo sapiens
ctgaggagaccatcaactaatt

SEQ ID NO: 9508025 - DNA, 22 bp, Homo sapiens
ctgaggagacagaagccaaata

SEQ ID NO: 9508026 - DNA, 22 bp, Homo sapiens
ctgaggagacagaagccaaata

SEQ ID NO: 9508027 - DNA, 17 bp, Homo sapiens
ctgaggagaacagaaag

SEQ ID NO: 9508028 - DNA, 22 bp, Homo sapiens
ctgagcagcagggagactggtg

SEQ ID NO: 9508029 - DNA, 22 bp, Homo sapiens
ctgagcagcagggagactggtg

SEQ ID NO: 9508030 - DNA, 22 bp, Homo sapiens
ctgagcagccccaccagccatt

SEQ ID NO: 9508031 - DNA, 22 bp, Homo sapiens
ctgagcagcagggagactggtg

SEQ ID NO: 9508032 - DNA, 22 bp, Homo sapiens
ctgagctgggactcagtagcaa

SEQ ID NO: 9508033 - DNA, 22 bp, Homo sapiens
ctgagctgggactcagtagcaa

SEQ ID NO: 9508034 - DNA, 22 bp, Homo sapiens
ctgagctgggactcagtagcaa

SEQ ID NO: 9508035 - DNA, 22 bp, Homo sapiens
agttataaaaggagcactgatt

SEQ ID NO: 9508036 - DNA, 22 bp, Homo sapiens
agttataatctgctactgatat

SEQ ID NO: 9508037 - DNA, 20 bp, Homo sapiens
agttagtgagtaattgagct

SEQ ID NO: 9508038 - DNA, 22 bp, Homo sapiens
agttatataactatctagatgc

SEQ ID NO: 9508039 - DNA, 22 bp, Homo sapiens
agttataccttatacacatatg

SEQ ID NO: 9508040 - DNA, 22 bp, Homo sapiens
agttataatctgctactgatat

SEQ ID NO: 9508041 - DNA, 22 bp, Homo sapiens
agttagtatacaaagtaacagc

SEQ ID NO: 9508042 - DNA, 22 bp, Homo sapiens
agttagaatataattatgttaa

SEQ ID NO: 9508043 - DNA, 22 bp, Homo sapiens
agttagagacacatgcacatgc

SEQ ID NO: 9508044 - DNA, 22 bp, Homo sapiens
agttagaaagtaaatcatttga

SEQ ID NO: 9508045 - DNA, 22 bp, Homo sapiens
agttactcactgagggtttatt

SEQ ID NO: 9508046 - DNA, 22 bp, Homo sapiens
agttactcaaggctgatataag

SEQ ID NO: 9508047 - DNA, 22 bp, Homo sapiens
agttaagagtgtgaaaatgtta

SEQ ID NO: 9508048 - DNA, 22 bp, Homo sapiens
agttacttgagacgtttatgaa

SEQ ID NO: 9508049 - DNA, 22 bp, Homo sapiens
agttactttctgatcagtgtgt

SEQ ID NO: 9508050 - DNA, 22 bp, Homo sapiens
agttacttgagacgtttatgaa

SEQ ID NO: 9508051 - DNA, 22 bp, Homo sapiens
agttacttgagacgtttatgaa

SEQ ID NO: 9508052 - DNA, 22 bp, Homo sapiens
ctgagaaacatatttccatcta

SEQ ID NO: 9508053 - DNA, 22 bp, Homo sapiens
ctgagaaaatttcaggaagtgt

SEQ ID NO: 9508054 - DNA, 22 bp, Homo sapiens
ctgagaaacaatgaattgtgat

SEQ ID NO: 9508055 - DNA, 22 bp, Homo sapiens
ctgagaaaccaggtgctctgat

SEQ ID NO: 9508056 - DNA, 22 bp, Homo sapiens
ctgagaaacatatttccatcta

SEQ ID NO: 9508057 - DNA, 22 bp, Homo sapiens
ctgagaaaccaggtgctctgat

SEQ ID NO: 9508058 - DNA, 22 bp, Homo sapiens
ctgagaaaccaggtgctctgat

SEQ ID NO: 9508059 - DNA, 22 bp, Homo sapiens
ctgagaaaccaggtgctctgat

SEQ ID NO: 9508060 - DNA, 22 bp, Homo sapiens
ctgagaaaccaggtgctctgat

SEQ ID NO: 9508061 - DNA, 22 bp, Homo sapiens
agttaactcattttataatgcc

SEQ ID NO: 9508062 - DNA, 22 bp, Homo sapiens
agttaagagtgtgaaaatgtta

SEQ ID NO: 9508063 - DNA, 22 bp, Homo sapiens
agttaactcattttataatgcc

SEQ ID NO: 9508064 - DNA, 22 bp, Homo sapiens
ctgagaaaccaggtgctctgat

SEQ ID NO: 9508065 - DNA, 22 bp, Homo sapiens
ctgagaaagatttgcctccgtg

SEQ ID NO: 9508066 - DNA, 22 bp, Homo sapiens
ctgagaaaggacctcaaacagg

SEQ ID NO: 9508067 - DNA, 22 bp, Homo sapiens
aggtggggccaaatgctacagt

SEQ ID NO: 9508068 - DNA, 22 bp, Homo sapiens
aggtggggagtatatgtaattg

SEQ ID NO: 9508069 - DNA, 22 bp, Homo sapiens
aggtggggccaaatgctacagt

SEQ ID NO: 9508070 - DNA, 22 bp, Homo sapiens
aggtggggccaaatgctacagt

SEQ ID NO: 9508071 - DNA, 22 bp, Homo sapiens
aggtggggagtatatgtaattg

SEQ ID NO: 9508072 - DNA, 22 bp, Homo sapiens
aggtggggaggagtgtctcttt

SEQ ID NO: 9508073 - DNA, 22 bp, Homo sapiens
aggtggggcccaccaatttgca

SEQ ID NO: 9508074 - DNA, 21 bp, Homo sapiens
aggtggggctgcacctctgct

SEQ ID NO: 9508075 - DNA, 21 bp, Homo sapiens
aggtggggctgcacctctgct

SEQ ID NO: 9508076 - DNA, 22 bp, Homo sapiens
cctgtgccagccccttctgctg

SEQ ID NO: 9508077 - DNA, 21 bp, Homo sapiens
cctgtgccaaagtgtgttagg

SEQ ID NO: 9508078 - DNA, 22 bp, Homo sapiens
aggtgggcaatgaggcctgagt

SEQ ID NO: 9508079 - DNA, 22 bp, Homo sapiens
cctgtgccaaaatctaggcagt

SEQ ID NO: 9508080 - DNA, 22 bp, Homo sapiens
cctgtgccaaaatctaggcagt

SEQ ID NO: 9508081 - DNA, 22 bp, Homo sapiens
cctgtgcatgccagggtacacc

SEQ ID NO: 9508082 - DNA, 22 bp, Homo sapiens
cctgtgccaaaaggctgcttat

SEQ ID NO: 9508083 - DNA, 22 bp, Homo sapiens
aggtggggaggagtgtctcttt

SEQ ID NO: 9508084 - DNA, 22 bp, Homo sapiens
aggtggggaggagtgtctcttt

SEQ ID NO: 9508085 - DNA, 22 bp, Homo sapiens
aggtggggaggagtgtctcttt

SEQ ID NO: 9508086 - DNA, 22 bp, Homo sapiens
aggtggggaggagtgtctcttt

SEQ ID NO: 9508087 - DNA, 22 bp, Homo sapiens
aggtggggaggagtgtctcttt

SEQ ID NO: 9508088 - DNA, 22 bp, Homo sapiens
aggtggggaggagtgtctcttt

SEQ ID NO: 9508089 - DNA, 22 bp, Homo sapiens
cctgtcctccggagcgggctgt

SEQ ID NO: 9508090 - DNA, 22 bp, Homo sapiens
cctgtctaccagtcacttagcg

SEQ ID NO: 9508091 - DNA, 22 bp, Homo sapiens
cctgtctatcaagacatcttca

SEQ ID NO: 9508092 - DNA, 20 bp, Homo sapiens
cctgtctcacgttccgcccc

SEQ ID NO: 9508093 - DNA, 22 bp, Homo sapiens
cctgtcctccaagagcacatct

SEQ ID NO: 9508094 - DNA, 22 bp, Homo sapiens
cctgtcctccaagagcacatct

SEQ ID NO: 9508095 - DNA, 22 bp, Homo sapiens
cctgtcctccggagcgggctgt

SEQ ID NO: 9508096 - DNA, 22 bp, Homo sapiens
cctgtctccctggcatggctca

SEQ ID NO: 9508097 - DNA, 22 bp, Homo sapiens
cctgtctccctggcatggctca

SEQ ID NO: 9508098 - DNA, 22 bp, Homo sapiens
cctgtctccctggcatggctca

SEQ ID NO: 9508099 - DNA, 22 bp, Homo sapiens
cctgtcataatgtccgatgtca

SEQ ID NO: 9508100 - DNA, 22 bp, Homo sapiens
cctgtcattttctcctgtcagc

SEQ ID NO: 9508101 - DNA, 22 bp, Homo sapiens
cctgtcccccaggcctgtacca

SEQ ID NO: 9508102 - DNA, 22 bp, Homo sapiens
cctgtcccaagcagggctggcc

SEQ ID NO: 9508103 - DNA, 22 bp, Homo sapiens
cctgtcccaagcagggctggcc

SEQ ID NO: 9508104 - DNA, 22 bp, Homo sapiens
cctgtcccaagcagggctggcc

SEQ ID NO: 9508105 - DNA, 22 bp, Homo sapiens
cctgtcccctcacaatgccact

SEQ ID NO: 9508106 - DNA, 22 bp, Homo sapiens
cctgtcccctcacaatgccact

SEQ ID NO: 9508107 - DNA, 22 bp, Homo sapiens
cctgtgacttggcaaacctcca

SEQ ID NO: 9508108 - DNA, 22 bp, Homo sapiens
cctgtgactctgtctgatggtc

SEQ ID NO: 9508109 - DNA, 22 bp, Homo sapiens
cctgtgaggtcatctgtggtaa

SEQ ID NO: 9508110 - DNA, 22 bp, Homo sapiens
cctgtgacgtgtctcctggcac

SEQ ID NO: 9508111 - DNA, 22 bp, Homo sapiens
cctgtgacgtgtctcctggcac

SEQ ID NO: 9508112 - DNA, 22 bp, Homo sapiens
cctgtgatggtgttacactgtt

SEQ ID NO: 9508113 - DNA, 19 bp, Homo sapiens
cctgtgcacatgtgtcctt

SEQ ID NO: 9508114 - DNA, 22 bp, Homo sapiens
cctgggctcgcgcacttcaccc

SEQ ID NO: 9508115 - DNA, 22 bp, Homo sapiens
cctgggcttctgtctagatgtt

SEQ ID NO: 9508116 - DNA, 22 bp, Homo sapiens
cctgggcttctgtctagatgtt

SEQ ID NO: 9508117 - DNA, 20 bp, Homo sapiens
cctgggctccaggagccccg

SEQ ID NO: 9508118 - DNA, 20 bp, Homo sapiens
cctgggctccaggagccccg

SEQ ID NO: 9508119 - DNA, 22 bp, Homo sapiens
cctgggcttctgtctagatgtt

SEQ ID NO: 9508120 - DNA, 22 bp, Homo sapiens
cctgggcttgcatctgtgctgg

SEQ ID NO: 9508121 - DNA, 22 bp, Homo sapiens
cctgggcttgcatctgtgctgg

SEQ ID NO: 9508122 - DNA, 22 bp, Homo sapiens
cctgggcttggttgttgagaac

SEQ ID NO: 9508123 - DNA, 22 bp, Homo sapiens
cctgggcttggttgttgagaac

SEQ ID NO: 9508124 - DNA, 22 bp, Homo sapiens
cctgtcagttgctgtcagggat

SEQ ID NO: 9508125 - DNA, 22 bp, Homo sapiens
cctgtcagttgctgtcagggat

SEQ ID NO: 9508126 - DNA, 22 bp, Homo sapiens
cctgtcagttgctgtcagggat

SEQ ID NO: 9508127 - DNA, 22 bp, Homo sapiens
cctggtgccggtagacgcgcag

SEQ ID NO: 9508128 - DNA, 22 bp, Homo sapiens
cctgtcagggtttgcctcagaa

SEQ ID NO: 9508129 - DNA, 22 bp, Homo sapiens
cctgtcagctgatggctatgta

SEQ ID NO: 9508130 - DNA, 22 bp, Homo sapiens
cctgggctttcaaaaccagcct

SEQ ID NO: 9508131 - DNA, 22 bp, Homo sapiens
cctgggctttcaaaaccagcct

SEQ ID NO: 9508132 - DNA, 22 bp, Homo sapiens
cctgggctttcaaaaccagcct

SEQ ID NO: 9508133 - DNA, 22 bp, Homo sapiens
cctggtgcccccaagccagctg

SEQ ID NO: 9508134 - DNA, 22 bp, Homo sapiens
cctgggctttcggcggcttcct

SEQ ID NO: 9508135 - DNA, 22 bp, Homo sapiens
cctgggctttcggcggcttcct

SEQ ID NO: 9508136 - DNA, 22 bp, Homo sapiens
cctggctctggttccctcagct

SEQ ID NO: 9508137 - DNA, 22 bp, Homo sapiens
cctggctctggttccctcagct

SEQ ID NO: 9508138 - DNA, 22 bp, Homo sapiens
cctggctctgtcctcgcgcaaa

SEQ ID NO: 9508139 - DNA, 22 bp, Homo sapiens
cctggctctgtcctcgcgcaaa

SEQ ID NO: 9508140 - DNA, 22 bp, Homo sapiens
cctggctctgtcctcgcgcaaa

SEQ ID NO: 9508141 - DNA, 22 bp, Homo sapiens
cctggctctggttccctcagct

SEQ ID NO: 9508142 - DNA, 22 bp, Homo sapiens
cctgggctcaagtgatcctcct

SEQ ID NO: 9508143 - DNA, 22 bp, Homo sapiens
cctgggctcaagtgatcctcct

SEQ ID NO: 9508144 - DNA, 22 bp, Homo sapiens
cctgggcataaatcactccaag

SEQ ID NO: 9508145 - DNA, 22 bp, Homo sapiens
cctggctctgggatcttcgctt

SEQ ID NO: 9508146 - DNA, 22 bp, Homo sapiens
cctggctctgggatcttcgctt

SEQ ID NO: 9508147 - DNA, 22 bp, Homo sapiens
cctggctctgcgtgcagctccg

SEQ ID NO: 9508148 - DNA, 22 bp, Homo sapiens
cctggctctgcgtgcagctccg

SEQ ID NO: 9508149 - DNA, 22 bp, Homo sapiens
cctggctctgcgtgcagctccg

SEQ ID NO: 9508150 - DNA, 22 bp, Homo sapiens
cctggctctgcgtgcagctccg

SEQ ID NO: 9508151 - DNA, 22 bp, Homo sapiens
cctggctctggttccctcagct

SEQ ID NO: 9508152 - DNA, 22 bp, Homo sapiens
cctggctctggttccctcagct

SEQ ID NO: 9508153 - DNA, 22 bp, Homo sapiens
cctggctctgggatcttcgctt

SEQ ID NO: 9508154 - DNA, 22 bp, Homo sapiens
cctgggctccactccaagagca

SEQ ID NO: 9508155 - DNA, 22 bp, Homo sapiens
cctgggctcaggcttgggcagc

SEQ ID NO: 9508156 - DNA, 22 bp, Homo sapiens
cctgggctccactccaagagca

SEQ ID NO: 9508157 - DNA, 22 bp, Homo sapiens
cctgggctccactccaagagca

SEQ ID NO: 9508158 - DNA, 22 bp, Homo sapiens
cctgggctcaggcttgggcagc

SEQ ID NO: 9508159 - DNA, 22 bp, Homo sapiens
cctgggctcaccatgccttgga

SEQ ID NO: 9508160 - DNA, 22 bp, Homo sapiens
cctgggctcaggcttgggcagc

SEQ ID NO: 9508161 - DNA, 22 bp, Homo sapiens
cctgggctcaggcttgggcagc

SEQ ID NO: 9508162 - DNA, 22 bp, Homo sapiens
cctgggctcaccatgccttgga

SEQ ID NO: 9508163 - DNA, 22 bp, Homo sapiens
cctgggctcacagccaaggctc

SEQ ID NO: 9508164 - DNA, 22 bp, Homo sapiens
cctgggctcacagccaaggctc

SEQ ID NO: 9508165 - DNA, 22 bp, Homo sapiens
cctgggctcaagtgatggtccc

SEQ ID NO: 9508166 - DNA, 22 bp, Homo sapiens
cctgggctcaagtgatggtccc

SEQ ID NO: 9508167 - DNA, 22 bp, Homo sapiens
cctgggctcaagtgatggtccc

SEQ ID NO: 9508168 - DNA, 22 bp, Homo sapiens
cctggatagctactggccaggc

SEQ ID NO: 9508169 - DNA, 22 bp, Homo sapiens
cctggagttgaaggaaggtggg

SEQ ID NO: 9508170 - DNA, 22 bp, Homo sapiens
cctggatgatccatgtcatgga

SEQ ID NO: 9508171 - DNA, 22 bp, Homo sapiens
cctggagtgacaggtgtagcct

SEQ ID NO: 9508172 - DNA, 22 bp, Homo sapiens
cctggagttgaaggaaggtggg

SEQ ID NO: 9508173 - DNA, 23 bp, Homo sapiens
cctggagtactaaggggatggaa

SEQ ID NO: 9508174 - DNA, 19 bp, Homo sapiens
cctggagtcgcgctgcctc

SEQ ID NO: 9508175 - DNA, 23 bp, Homo sapiens
aggtaggttattgctgctacctg

SEQ ID NO: 9508176 - DNA, 22 bp, Homo sapiens
cctggaggtggaggttgcagtg

SEQ ID NO: 9508177 - DNA, 22 bp, Homo sapiens
cctggaggtggaggttgcagtg

SEQ ID NO: 9508178 - DNA, 23 bp, Homo sapiens
cctggcacacaaggggtgctgca

SEQ ID NO: 9508179 - DNA, 22 bp, Homo sapiens
cctggcacaagagcagcattgg

SEQ ID NO: 9508180 - DNA, 22 bp, Homo sapiens
cctggcacaagagcagcattgg

SEQ ID NO: 9508181 - DNA, 22 bp, Homo sapiens
cctggattggctgcccatgctc

SEQ ID NO: 9508182 - DNA, 22 bp, Homo sapiens
aggtcatgatccattggtgagt

SEQ ID NO: 9508183 - DNA, 18 bp, Homo sapiens
aggtcatggtcatgggcg

SEQ ID NO: 9508184 - DNA, 22 bp, Homo sapiens
cctggcacacggtggcattcaa

SEQ ID NO: 9508185 - DNA, 22 bp, Homo sapiens
aggtccagttttctgacaaggg

SEQ ID NO: 9508186 - DNA, 22 bp, Homo sapiens
aggtccatggcagcgggtactt

SEQ ID NO: 9508187 - DNA, 22 bp, Homo sapiens
aggtccagttttctgacaaggg

SEQ ID NO: 9508188 - DNA, 22 bp, Homo sapiens
aggtccagttttctgacaaggg

SEQ ID NO: 9508189 - DNA, 22 bp, Homo sapiens
aggtcccagtgttagggtgaca

SEQ ID NO: 9508190 - DNA, 21 bp, Homo sapiens
aggtcccaggtttgggcagca

SEQ ID NO: 9508191 - DNA, 22 bp, Homo sapiens
aggtccctaggagagtaggaag

SEQ ID NO: 9508192 - DNA, 21 bp, Homo sapiens
aggtccctaattaattgacct

SEQ ID NO: 9508193 - DNA, 22 bp, Homo sapiens
aggtccctaatcatttcacttt

SEQ ID NO: 9508194 - DNA, 22 bp, Homo sapiens
aggtccctaatcatttcacttt

SEQ ID NO: 9508195 - DNA, 22 bp, Homo sapiens
aggtccctgagtcagcggcgct

SEQ ID NO: 9508196 - DNA, 22 bp, Homo sapiens
aggtccctcgcacatgcagggt

SEQ ID NO: 9508197 - DNA, 22 bp, Homo sapiens
aggtccctcgcacatgcagggt

SEQ ID NO: 9508198 - DNA, 19 bp, Homo sapiens
aggtccctccctcgaggct

SEQ ID NO: 9508199 - DNA, 22 bp, Homo sapiens
aggtccctgggacagggcgatt

SEQ ID NO: 9508200 - DNA, 22 bp, Homo sapiens
aggtccctggtaattgacacac

SEQ ID NO: 9508201 - DNA, 22 bp, Homo sapiens
aggtccctggctagcactggaa

SEQ ID NO: 9508202 - DNA, 22 bp, Homo sapiens
aggtccctggctagcactggaa

SEQ ID NO: 9508203 - DNA, 22 bp, Homo sapiens
aggtccctgcagcagactgcca

SEQ ID NO: 9508204 - DNA, 22 bp, Homo sapiens
cctggctctgaggtatgcctgg

SEQ ID NO: 9508205 - DNA, 22 bp, Homo sapiens
aggtcctgagggttcgtctgca

SEQ ID NO: 9508206 - DNA, 22 bp, Homo sapiens
aggtcctgaagattttactaga

SEQ ID NO: 9508207 - DNA, 22 bp, Homo sapiens
aggtcctgacgccctttgaaat

SEQ ID NO: 9508208 - DNA, 22 bp, Homo sapiens
aggtcctgactccacgttctag

SEQ ID NO: 9508209 - DNA, 22 bp, Homo sapiens
aggtcctctgtgcctgctggcg

SEQ ID NO: 9508210 - DNA, 19 bp, Homo sapiens
aggtccctgtcacctctca

SEQ ID NO: 9508211 - DNA, 22 bp, Homo sapiens
cctggctctgcagccactccag

SEQ ID NO: 9508212 - DNA, 22 bp, Homo sapiens
cctggctctgcagccactccag

SEQ ID NO: 9508213 - DNA, 22 bp, Homo sapiens
cctggctctgaggtatgcctgg

SEQ ID NO: 9508214 - DNA, 22 bp, Homo sapiens
cctggctctgcagccactccag

SEQ ID NO: 9508215 - DNA, 22 bp, Homo sapiens
cctggctctgcagccactccag

SEQ ID NO: 9508216 - DNA, 22 bp, Homo sapiens
cctggctctgccacttactgcc

SEQ ID NO: 9508217 - DNA, 22 bp, Homo sapiens
cctggctctgcagccactccag

SEQ ID NO: 9508218 - DNA, 22 bp, Homo sapiens
cctggctctgcagccactccag

SEQ ID NO: 9508219 - DNA, 22 bp, Homo sapiens
cctggctctgcgtgcagctccg

SEQ ID NO: 9508220 - DNA, 22 bp, Homo sapiens
cctggctctgccgtaaccacca

SEQ ID NO: 9508221 - DNA, 22 bp, Homo sapiens
cctggctctgccgtaaccacca

SEQ ID NO: 9508222 - DNA, 22 bp, Homo sapiens
aggtagggggtttgggaactgc

SEQ ID NO: 9508223 - DNA, 22 bp, Homo sapiens
aggtagggggtttgggaactgc

SEQ ID NO: 9508224 - DNA, 22 bp, Homo sapiens
aggtagggttaatggagatata

SEQ ID NO: 9508225 - DNA, 22 bp, Homo sapiens
aggtagggttaatggagatata

SEQ ID NO: 9508226 - DNA, 23 bp, Homo sapiens
aggtaggttattgctgctacctg

SEQ ID NO: 9508227 - DNA, 22 bp, Homo sapiens
aggtagggaagaaggcatgaaa

SEQ ID NO: 9508228 - DNA, 22 bp, Homo sapiens
aggtagggaagaaggcatgaaa

SEQ ID NO: 9508229 - DNA, 22 bp, Homo sapiens
aggtagggaagaaggcatgaaa

SEQ ID NO: 9508230 - DNA, 22 bp, Homo sapiens
aggtacagcaatataagaggtc

SEQ ID NO: 9508231 - DNA, 22 bp, Homo sapiens
aggtaggatagataggaagacc

SEQ ID NO: 9508232 - DNA, 22 bp, Homo sapiens
aggtaggatgggtggagatgat

SEQ ID NO: 9508233 - DNA, 22 bp, Homo sapiens
cctgccagcgcttatctctcgg

SEQ ID NO: 9508234 - DNA, 22 bp, Homo sapiens
cctgcagatgtgggacagctgt

SEQ ID NO: 9508235 - DNA, 22 bp, Homo sapiens
cctgcagaggtcaggccagaaa

SEQ ID NO: 9508236 - DNA, 21 bp, Homo sapiens
cctgcagcaccagaaggagat

SEQ ID NO: 9508237 - DNA, 21 bp, Homo sapiens
cctgcagcaccagaaggagat

SEQ ID NO: 9508238 - DNA, 18 bp, Homo sapiens
cctgcagcccaggaggcc

SEQ ID NO: 9508239 - DNA, 18 bp, Homo sapiens
cctgcagcccaggaggcc

SEQ ID NO: 9508240 - DNA, 22 bp, Homo sapiens
cctgcagagggactggcaggaa

SEQ ID NO: 9508241 - DNA, 22 bp, Homo sapiens
cctgcagagccacgtgccagcg

SEQ ID NO: 9508242 - DNA, 22 bp, Homo sapiens
cctgcagagccacgtgccagcg

SEQ ID NO: 9508243 - DNA, 22 bp, Homo sapiens
cctgcagagggactggcaggaa

SEQ ID NO: 9508244 - DNA, 22 bp, Homo sapiens
cctgcagagcaggagaggcatc

SEQ ID NO: 9508245 - DNA, 22 bp, Homo sapiens
cctgcagaccacactcagtcct

SEQ ID NO: 9508246 - DNA, 22 bp, Homo sapiens
cctgccagcccgcgttcatgcc

SEQ ID NO: 9508247 - DNA, 22 bp, Homo sapiens
cctgccagcatcttcagcccct

SEQ ID NO: 9508248 - DNA, 22 bp, Homo sapiens
cctgcagctccggatttctggg

SEQ ID NO: 9508249 - DNA, 22 bp, Homo sapiens
cctgcagccgtcctgtttgtct

SEQ ID NO: 9508250 - DNA, 19 bp, Homo sapiens
agtccatgaatggaggatg

SEQ ID NO: 9508251 - DNA, 22 bp, Homo sapiens
agtccattaactgtgttaacag

SEQ ID NO: 9508252 - DNA, 22 bp, Homo sapiens
ctagggtggatttgtgcagagt

SEQ ID NO: 9508253 - DNA, 22 bp, Homo sapiens
ctagggtgtgcagattttgcct

SEQ ID NO: 9508254 - DNA, 22 bp, Homo sapiens
ctaggtgatccactgctctctt

SEQ ID NO: 9508255 - DNA, 22 bp, Homo sapiens
ctagggtcaggggcctgcgtcg

SEQ ID NO: 9508256 - DNA, 22 bp, Homo sapiens
ctagggtcaggggcctgcgtcg

SEQ ID NO: 9508257 - DNA, 22 bp, Homo sapiens
ctaggggcatgaaatagagaat

SEQ ID NO: 9508258 - DNA, 22 bp, Homo sapiens
agtcccagctactcaagaggct

SEQ ID NO: 9508259 - DNA, 22 bp, Homo sapiens
agtcccagctactcaagaggct

SEQ ID NO: 9508260 - DNA, 22 bp, Homo sapiens
agtcccatgtcattatttctgc

SEQ ID NO: 9508261 - DNA, 22 bp, Homo sapiens
agtcccatttgtgaccttggga

SEQ ID NO: 9508262 - DNA, 22 bp, Homo sapiens
agtcccattgcaagttatgcga

SEQ ID NO: 9508263 - DNA, 16 bp, Homo sapiens
agtcccatgtttgagt

SEQ ID NO: 9508264 - DNA, 20 bp, Homo sapiens
ctagtctcacatccctggca

SEQ ID NO: 9508265 - DNA, 22 bp, Homo sapiens
ctagtaaagctatgattctgcc

SEQ ID NO: 9508266 - DNA, 22 bp, Homo sapiens
ctagtaaagtactcaaatagcc

SEQ ID NO: 9508267 - DNA, 22 bp, Homo sapiens
ctaggtggtggtgggttgacat

SEQ ID NO: 9508268 - DNA, 22 bp, Homo sapiens
ctagtattacatttttgtgtgt

SEQ ID NO: 9508269 - DNA, 22 bp, Homo sapiens
agtccaggtctctgagtcacaa

SEQ ID NO: 9508270 - DNA, 22 bp, Homo sapiens
agtccaggtggaccttggccag

SEQ ID NO: 9508271 - DNA, 22 bp, Homo sapiens
agtccagtcttgttggcacggt

SEQ ID NO: 9508272 - DNA, 22 bp, Homo sapiens
agtccagtctcactcttggcag

SEQ ID NO: 9508273 - DNA, 22 bp, Homo sapiens
agtccagtgtgttctggcagca

SEQ ID NO: 9508274 - DNA, 22 bp, Homo sapiens
agtccagtgtcaaggtgccatt

SEQ ID NO: 9508275 - DNA, 22 bp, Homo sapiens
agtccagtgtcaaggtgccatt

SEQ ID NO: 9508276 - DNA, 22 bp, Homo sapiens
agtccagggcttagtcagcggg

SEQ ID NO: 9508277 - DNA, 22 bp, Homo sapiens
agtccagggctctctgtgggat

SEQ ID NO: 9508278 - DNA, 22 bp, Homo sapiens
agtccagggctctctgtgggat

SEQ ID NO: 9508279 - DNA, 22 bp, Homo sapiens
agtccagggagcccaggctttg

SEQ ID NO: 9508280 - DNA, 22 bp, Homo sapiens
agtccagggagcccaggctttg

SEQ ID NO: 9508281 - DNA, 22 bp, Homo sapiens
agtccagaacttcagctagttt

SEQ ID NO: 9508282 - DNA, 22 bp, Homo sapiens
agtccaccggcagagatgctga

SEQ ID NO: 9508283 - DNA, 22 bp, Homo sapiens
agtccacagagtctctcctgaa

SEQ ID NO: 9508284 - DNA, 22 bp, Homo sapiens
agtccaccacccatgctcctct

SEQ ID NO: 9508285 - DNA, 20 bp, Homo sapiens
ctagaagcagaattgctgat

SEQ ID NO: 9508286 - DNA, 20 bp, Homo sapiens
ctagaactgagaaatttaaa

SEQ ID NO: 9508287 - DNA, 22 bp, Homo sapiens
ctagaactacatcttttaatag

SEQ ID NO: 9508288 - DNA, 22 bp, Homo sapiens
ctagaacagtcaaagtgagctc

SEQ ID NO: 9508289 - DNA, 22 bp, Homo sapiens
agtatgtaattttcaatgtgtt

SEQ ID NO: 9508290 - DNA, 22 bp, Homo sapiens
agtatgtcagagtgaaaatggt

SEQ ID NO: 9508291 - DNA, 22 bp, Homo sapiens
agtatgtcagagtgaaaatggt

SEQ ID NO: 9508292 - DNA, 22 bp, Homo sapiens
ctaaggaacagatgtcagcaga

SEQ ID NO: 9508293 - DNA, 22 bp, Homo sapiens
ctaaggaatcctaaaacagctg

SEQ ID NO: 9508294 - DNA, 22 bp, Homo sapiens
ctaaggaaaaggatatatatgt

SEQ ID NO: 9508295 - DNA, 22 bp, Homo sapiens
agtatttagagacacaagacgg

SEQ ID NO: 9508296 - DNA, 22 bp, Homo sapiens
agtatttagagacacaagatgg

SEQ ID NO: 9508297 - DNA, 23 bp, Homo sapiens
agtattcaaaaggcaagctatat

SEQ ID NO: 9508298 - DNA, 23 bp, Homo sapiens
agtattcaaaaggcaagctatat

SEQ ID NO: 9508299 - DNA, 22 bp, Homo sapiens
agtatgtgtccccccaggagcc

SEQ ID NO: 9508300 - DNA, 22 bp, Homo sapiens
agtattacatggccaatctcct

SEQ ID NO: 9508301 - DNA, 22 bp, Homo sapiens
agtatttagagacacaagatgg

SEQ ID NO: 9508302 - DNA, 22 bp, Homo sapiens
agtatttagagacacaagatgg

SEQ ID NO: 9508303 - DNA, 22 bp, Homo sapiens
agtatttagctgactcgctaca

SEQ ID NO: 9508304 - DNA, 22 bp, Homo sapiens
agtatttagcatagtggttagt

SEQ ID NO: 9508305 - DNA, 22 bp, Homo sapiens
agtatttagcatagtggttagt

SEQ ID NO: 9508306 - DNA, 22 bp, Homo sapiens
ctacatttttcaccgagcctct

SEQ ID NO: 9508307 - DNA, 22 bp, Homo sapiens
ctacatttttcaccgagcctct

SEQ ID NO: 9508308 - DNA, 22 bp, Homo sapiens
ctacatttttcaccgagcctct

SEQ ID NO: 9508309 - DNA, 22 bp, Homo sapiens
ctagaaatattttacagtcaag

SEQ ID NO: 9508310 - DNA, 22 bp, Homo sapiens
ctagaaatattttacagtcaag

SEQ ID NO: 9508311 - DNA, 22 bp, Homo sapiens
ctacccagatccaggatggcta

SEQ ID NO: 9508312 - DNA, 22 bp, Homo sapiens
ctagaaatctctgtttacatca

SEQ ID NO: 9508313 - DNA, 22 bp, Homo sapiens
ctagaaatgctcaagagaaagt

SEQ ID NO: 9508314 - DNA, 22 bp, Homo sapiens
ctagaaatgctcaagagaaagt

SEQ ID NO: 9508315 - DNA, 22 bp, Homo sapiens
ctagaacagaaagtacaggaaa

SEQ ID NO: 9508316 - DNA, 22 bp, Homo sapiens
ctagaaattctgattcagtagg

SEQ ID NO: 9508317 - DNA, 22 bp, Homo sapiens
ctagaaattctgattcagtagg

SEQ ID NO: 9508318 - DNA, 22 bp, Homo sapiens
ctagaaatgtagattcttagtg

SEQ ID NO: 9508319 - DNA, 22 bp, Homo sapiens
ctagaaatgtagattcttagtg

SEQ ID NO: 9508320 - DNA, 22 bp, Homo sapiens
ctagaaatgtagattcttagtg

SEQ ID NO: 9508321 - DNA, 22 bp, Homo sapiens
ctagaaattctgattcagtagg

SEQ ID NO: 9508322 - DNA, 22 bp, Homo sapiens
ctagaaattctgattcagtagg

SEQ ID NO: 9508323 - DNA, 22 bp, Homo sapiens
ctacatttggagagtataggaa

SEQ ID NO: 9508324 - DNA, 22 bp, Homo sapiens
ctacatttgttcaaataagctg

SEQ ID NO: 9508325 - DNA, 22 bp, Homo sapiens
ctacatttgttcaaataagctg

SEQ ID NO: 9508326 - DNA, 22 bp, Homo sapiens
ctacatttgttcaaataagctg

SEQ ID NO: 9508327 - DNA, 22 bp, Homo sapiens
ctacatttcccagctgccttcc

SEQ ID NO: 9508328 - DNA, 22 bp, Homo sapiens
ctacatttcccagctgccttcc

SEQ ID NO: 9508329 - DNA, 22 bp, Homo sapiens
ctacatttggagagtataggaa

SEQ ID NO: 9508330 - DNA, 22 bp, Homo sapiens
ctacattttaataagctgctta

SEQ ID NO: 9508331 - DNA, 22 bp, Homo sapiens
ctacatttgttctatagctttt

SEQ ID NO: 9508332 - DNA, 22 bp, Homo sapiens
ctacatttgttctatagctttt

SEQ ID NO: 9508333 - DNA, 22 bp, Homo sapiens
ctacatttgttctatagctttt

SEQ ID NO: 9508334 - DNA, 22 bp, Homo sapiens
ctacattttgtgattatgaaat

SEQ ID NO: 9508335 - DNA, 22 bp, Homo sapiens
ctacattttaataagctgctta

SEQ ID NO: 9508336 - DNA, 22 bp, Homo sapiens
ctacattttgtgattatgaaat

SEQ ID NO: 9508337 - DNA, 22 bp, Homo sapiens
ctacattttaataagctgctta

SEQ ID NO: 9508338 - DNA, 22 bp, Homo sapiens
agtaaaaatatgcttgtggcta

SEQ ID NO: 9508339 - DNA, 22 bp, Homo sapiens
agtaaaaagttcagaatggttg

SEQ ID NO: 9508340 - DNA, 22 bp, Homo sapiens
agtaaaaagttcagaatggttg

SEQ ID NO: 9508341 - DNA, 22 bp, Homo sapiens
agtaaaaagttcagaatggttg

SEQ ID NO: 9508342 - DNA, 22 bp, Homo sapiens
agtaaaaagttcagaatggttg

SEQ ID NO: 9508343 - DNA, 22 bp, Homo sapiens
aggtttgtttatgtatcattgg

SEQ ID NO: 9508344 - DNA, 22 bp, Homo sapiens
aggtttcttcttaggaatatgt

SEQ ID NO: 9508345 - DNA, 22 bp, Homo sapiens
aggtttctttatgctgctagaa

SEQ ID NO: 9508346 - DNA, 22 bp, Homo sapiens
aggtttcttcttaggaatatgt

SEQ ID NO: 9508347 - DNA, 22 bp, Homo sapiens
aggtttctggaaaggttttgct

SEQ ID NO: 9508348 - DNA, 22 bp, Homo sapiens
aggtttctggatttattatggc

SEQ ID NO: 9508349 - DNA, 22 bp, Homo sapiens
aggtttctggatttattatggc

SEQ ID NO: 9508350 - DNA, 19 bp, Homo sapiens
cgcaggcttcgggtcgctc

SEQ ID NO: 9508351 - DNA, 22 bp, Homo sapiens
cgcaggctcggttcacagagca

SEQ ID NO: 9508352 - DNA, 22 bp, Homo sapiens
cgcaggctcggttcacagagca

SEQ ID NO: 9508353 - DNA, 22 bp, Homo sapiens
cgcaggctgcagccaagaagag

SEQ ID NO: 9508354 - DNA, 22 bp, Homo sapiens
cgcaggctgcagccaagaagag

SEQ ID NO: 9508355 - DNA, 22 bp, Homo sapiens
cgcaggctggcgcggagtggca

SEQ ID NO: 9508356 - DNA, 22 bp, Homo sapiens
cgcaggctggcgcggagtggca

SEQ ID NO: 9508357 - DNA, 22 bp, Homo sapiens
aggtttctgcaatgtgtgtaca

SEQ ID NO: 9508358 - DNA, 22 bp, Homo sapiens
aggtttctgctgtcctccttct

SEQ ID NO: 9508359 - DNA, 22 bp, Homo sapiens
aggtttctgcagcatagtggca

SEQ ID NO: 9508360 - DNA, 22 bp, Homo sapiens
cgcagggccgcgagcgggacca

SEQ ID NO: 9508361 - DNA, 22 bp, Homo sapiens
cgcaggggaggaaggtacacct

SEQ ID NO: 9508362 - DNA, 22 bp, Homo sapiens
cgcaggggaggaaggtacacct

SEQ ID NO: 9508363 - DNA, 22 bp, Homo sapiens
cgaggccagctctaagccctac

SEQ ID NO: 9508364 - DNA, 22 bp, Homo sapiens
cgaggccatgcatgctgaggac

SEQ ID NO: 9508365 - DNA, 22 bp, Homo sapiens
cctgttgctctgcatgagttta

SEQ ID NO: 9508366 - DNA, 22 bp, Homo sapiens
cctgttggaaggtgtaggcccc

SEQ ID NO: 9508367 - DNA, 22 bp, Homo sapiens
cctgttcttgtctcattggcta

SEQ ID NO: 9508368 - DNA, 22 bp, Homo sapiens
cctgttgagagagctcactgag

SEQ ID NO: 9508369 - DNA, 22 bp, Homo sapiens
cctgttgtggaaaaagcctgat

SEQ ID NO: 9508370 - DNA, 20 bp, Homo sapiens
cctgttggatgaggtccaga

SEQ ID NO: 9508371 - DNA, 22 bp, Homo sapiens
cgcagctgtccatgtgtggggg

SEQ ID NO: 9508372 - DNA, 22 bp, Homo sapiens
cgcaggcaagagagtacagtta

SEQ ID NO: 9508373 - DNA, 19 bp, Homo sapiens
cgcaggagccgaggtgacc

SEQ ID NO: 9508374 - DNA, 22 bp, Homo sapiens
cgcaggcacagagtggacagcg

SEQ ID NO: 9508375 - DNA, 22 bp, Homo sapiens
cgcaggctcggttcacagagca

SEQ ID NO: 9508376 - DNA, 22 bp, Homo sapiens
cctgttctaatcttggggcaga

SEQ ID NO: 9508377 - DNA, 22 bp, Homo sapiens
cctgttctgtagtgagtttgag

SEQ ID NO: 9508378 - DNA, 19 bp, Homo sapiens
cctgttcttggctgaggct

SEQ ID NO: 9508379 - DNA, 22 bp, Homo sapiens
cctgttctgtggctctcaaagg

SEQ ID NO: 9508380 - DNA, 22 bp, Homo sapiens
cctgttctgttaattaaacttt

SEQ ID NO: 9508381 - DNA, 22 bp, Homo sapiens
cctgttcaagttgcagggctgg

SEQ ID NO: 9508382 - DNA, 18 bp, Homo sapiens
cctgttacacactggggt

SEQ ID NO: 9508383 - DNA, 22 bp, Homo sapiens
cctgttcaccctccatgcacag

SEQ ID NO: 9508384 - DNA, 18 bp, Homo sapiens
cctgtgtgtgttgcaggc

SEQ ID NO: 9508385 - DNA, 22 bp, Homo sapiens
cctgtgttagttatgggtctct

SEQ ID NO: 9508386 - DNA, 22 bp, Homo sapiens
cctgtgttagttatgggtctct

SEQ ID NO: 9508387 - DNA, 22 bp, Homo sapiens
cctgtgtttagatatgatgctg

SEQ ID NO: 9508388 - DNA, 19 bp, Homo sapiens
cctgtgttgggagtgtgag

SEQ ID NO: 9508389 - DNA, 22 bp, Homo sapiens
cctgtgttctaatccatctcag

SEQ ID NO: 9508390 - DNA, 22 bp, Homo sapiens
ctaaacttcttggcaattttat

SEQ ID NO: 9508391 - DNA, 22 bp, Homo sapiens
ctaaacttcatatgttgcttta

SEQ ID NO: 9508392 - DNA, 22 bp, Homo sapiens
ctaagaaggaggaaaagtgcca

SEQ ID NO: 9508393 - DNA, 22 bp, Homo sapiens
ctaagaaggaggaaaagtgcca

SEQ ID NO: 9508394 - DNA, 22 bp, Homo sapiens
ctaagactctgcaaatcagctt

SEQ ID NO: 9508395 - DNA, 21 bp, Homo sapiens
ctaagcaaggagcaggggtag

SEQ ID NO: 9508396 - DNA, 22 bp, Homo sapiens
ctaagcaagaatgagtgcaaca

SEQ ID NO: 9508397 - DNA, 22 bp, Homo sapiens
ctaagactctgcaaatcagctt

SEQ ID NO: 9508398 - DNA, 22 bp, Homo sapiens
ctaagataaatgctttgatgaa

SEQ ID NO: 9508399 - DNA, 22 bp, Homo sapiens
ctaagatagattttttcacttt

SEQ ID NO: 9508400 - DNA, 22 bp, Homo sapiens
ctaagataatggctgggtaaag

SEQ ID NO: 9508401 - DNA, 22 bp, Homo sapiens
agtacagggagtttgttgtgtt

SEQ ID NO: 9508402 - DNA, 22 bp, Homo sapiens
agtacagtagggtgctgttagt

SEQ ID NO: 9508403 - DNA, 19 bp, Homo sapiens
agtacagaaaagagccctg

SEQ ID NO: 9508404 - DNA, 22 bp, Homo sapiens
agtacacagaattctacttgtt

SEQ ID NO: 9508405 - DNA, 22 bp, Homo sapiens
agtacacacagtagaatagagt

SEQ ID NO: 9508406 - DNA, 22 bp, Homo sapiens
cgggccctactcaaagcttgca

SEQ ID NO: 9508407 - DNA, 22 bp, Homo sapiens
cgggccctttaaggatgtgtcg

SEQ ID NO: 9508408 - DNA, 17 bp, Homo sapiens
cgggcccgcggccgctc

SEQ ID NO: 9508409 - DNA, 17 bp, Homo sapiens
cgggcatggagggcagg

SEQ ID NO: 9508410 - DNA, 17 bp, Homo sapiens
cgggcatggagggcagg

SEQ ID NO: 9508411 - DNA, 22 bp, Homo sapiens
cgggcagcggcgtggccatggt

SEQ ID NO: 9508412 - DNA, 22 bp, Homo sapiens
cgggcagattgggaaggttcat

SEQ ID NO: 9508413 - DNA, 22 bp, Homo sapiens
cgggcagatcacacagggcttg

SEQ ID NO: 9508414 - DNA, 22 bp, Homo sapiens
cgggcagatcacacagggcttg

SEQ ID NO: 9508415 - DNA, 22 bp, Homo sapiens
cgggcagattgggaaggttcat

SEQ ID NO: 9508416 - DNA, 22 bp, Homo sapiens
cgggcagatcacacagggcttg

SEQ ID NO: 9508417 - DNA, 22 bp, Homo sapiens
cgggcaaggcgagactaggccc

SEQ ID NO: 9508418 - DNA, 20 bp, Homo sapiens
cggctcagcctctccctccc

SEQ ID NO: 9508419 - DNA, 22 bp, Homo sapiens
cgggcgcactccgggcagctgt

SEQ ID NO: 9508420 - DNA, 22 bp, Homo sapiens
cgggcgcactccgggcagctgt

SEQ ID NO: 9508421 - DNA, 22 bp, Homo sapiens
cgggcgcactccgggcagctgt

SEQ ID NO: 9508422 - DNA, 21 bp, Homo sapiens
cgggctggccgggccctcacc

SEQ ID NO: 9508423 - DNA, 22 bp, Homo sapiens
agtacaaattatagcgcttgga

SEQ ID NO: 9508424 - DNA, 21 bp, Homo sapiens
cgggctggccgggccctcacc

SEQ ID NO: 9508425 - DNA, 22 bp, Homo sapiens
agtacaactagaaataggtgta

SEQ ID NO: 9508426 - DNA, 22 bp, Homo sapiens
agtacaagtagaatgctacaag

SEQ ID NO: 9508427 - DNA, 22 bp, Homo sapiens
agtacaaattatagcgcttgga

SEQ ID NO: 9508428 - DNA, 20 bp, Homo sapiens
agtacaatgtatgattcaga

SEQ ID NO: 9508429 - DNA, 23 bp, Homo sapiens
agtacaataagtataattctttc

SEQ ID NO: 9508430 - DNA, 22 bp, Homo sapiens
agggacagttacatcatcagac

SEQ ID NO: 9508431 - DNA, 22 bp, Homo sapiens
agggacagttacatcatcagac

SEQ ID NO: 9508432 - DNA, 22 bp, Homo sapiens
agggacagtctactgttcactg

SEQ ID NO: 9508433 - DNA, 22 bp, Homo sapiens
agggacagtctactgttcactg

SEQ ID NO: 9508434 - DNA, 22 bp, Homo sapiens
agggacagtctactgttcactg

SEQ ID NO: 9508435 - DNA, 22 bp, Homo sapiens
agggacagtctactgttcactg

SEQ ID NO: 9508436 - DNA, 22 bp, Homo sapiens
agggacagtctactgttcactg

SEQ ID NO: 9508437 - DNA, 22 bp, Homo sapiens
agggacagtctactgttcactg

SEQ ID NO: 9508438 - DNA, 22 bp, Homo sapiens
agggacagtctactgttcactg

SEQ ID NO: 9508439 - DNA, 22 bp, Homo sapiens
agggaccaatcaccgacaggct

SEQ ID NO: 9508440 - DNA, 22 bp, Homo sapiens
agggaccaatcaccgacaggct

SEQ ID NO: 9508441 - DNA, 22 bp, Homo sapiens
agggacagttacatcatcagac

SEQ ID NO: 9508442 - DNA, 22 bp, Homo sapiens
agggacagttacatcatcagac

SEQ ID NO: 9508443 - DNA, 22 bp, Homo sapiens
agggacatctcacaaacaactt

SEQ ID NO: 9508444 - DNA, 22 bp, Homo sapiens
agggacagttacatcatcagac

SEQ ID NO: 9508445 - DNA, 22 bp, Homo sapiens
agggacagttacatcatcagac

SEQ ID NO: 9508446 - DNA, 22 bp, Homo sapiens
agggacagttacatcatcagac

SEQ ID NO: 9508447 - DNA, 22 bp, Homo sapiens
agggacagttacatcatcagac

SEQ ID NO: 9508448 - DNA, 22 bp, Homo sapiens
agggacccatagagagaccagt

SEQ ID NO: 9508449 - DNA, 22 bp, Homo sapiens
agggacccatagagagaccagt

SEQ ID NO: 9508450 - DNA, 22 bp, Homo sapiens
agggacccatagagagaccagt

SEQ ID NO: 9508451 - DNA, 22 bp, Homo sapiens
agggaccctgatgactgaggag

SEQ ID NO: 9508452 - DNA, 22 bp, Homo sapiens
agggaccctgatgactgaggag

SEQ ID NO: 9508453 - DNA, 22 bp, Homo sapiens
agggacccatagagagaccagt

SEQ ID NO: 9508454 - DNA, 22 bp, Homo sapiens
agggactatttacccatctcac

SEQ ID NO: 9508455 - DNA, 22 bp, Homo sapiens
cccaggccagaacttggttgct

SEQ ID NO: 9508456 - DNA, 17 bp, Homo sapiens
cccaggccgccgggagc

SEQ ID NO: 9508457 - DNA, 17 bp, Homo sapiens
cccaggccgccgggagc

SEQ ID NO: 9508458 - DNA, 22 bp, Homo sapiens
cccaggccctggcagagcttgt

SEQ ID NO: 9508459 - DNA, 22 bp, Homo sapiens
cccaggccccagggcttgtcag

SEQ ID NO: 9508460 - DNA, 22 bp, Homo sapiens
agggagctgagagctactattt

SEQ ID NO: 9508461 - DNA, 22 bp, Homo sapiens
agggagctgagagctactattt

SEQ ID NO: 9508462 - DNA, 22 bp, Homo sapiens
agggagctgactggctgccatt

SEQ ID NO: 9508463 - DNA, 22 bp, Homo sapiens
agggagccttcctggctgtggt

SEQ ID NO: 9508464 - DNA, 22 bp, Homo sapiens
agggagccctgaaccagagggt

SEQ ID NO: 9508465 - DNA, 22 bp, Homo sapiens
cccaggcctggtctgggccagt

SEQ ID NO: 9508466 - DNA, 22 bp, Homo sapiens
cccaggcctggtctgggccagt

SEQ ID NO: 9508467 - DNA, 22 bp, Homo sapiens
cccaggcctggtctgggccagt

SEQ ID NO: 9508468 - DNA, 22 bp, Homo sapiens
cccaggcctggtctgggccagt

SEQ ID NO: 9508469 - DNA, 22 bp, Homo sapiens
agggagctgggccacactgatc

SEQ ID NO: 9508470 - DNA, 22 bp, Homo sapiens
agggagctggtatttataatga

SEQ ID NO: 9508471 - DNA, 21 bp, Homo sapiens
agggagctggccacacagcct

SEQ ID NO: 9508472 - DNA, 21 bp, Homo sapiens
agggagctggccacacagcct

SEQ ID NO: 9508473 - DNA, 21 bp, Homo sapiens
agggagctggccacacagcct

SEQ ID NO: 9508474 - DNA, 21 bp, Homo sapiens
agggagctggccacacagcct

SEQ ID NO: 9508475 - DNA, 22 bp, Homo sapiens
agggagctgctctgcttccgtg

SEQ ID NO: 9508476 - DNA, 22 bp, Homo sapiens
agggagctgctctgcttccgtg

SEQ ID NO: 9508477 - DNA, 22 bp, Homo sapiens
agggagctgagctgtgagcagc

SEQ ID NO: 9508478 - DNA, 21 bp, Homo sapiens
agggagctgcgtcttgaaaga

SEQ ID NO: 9508479 - DNA, 22 bp, Homo sapiens
agggagctgagctgtgagcagc

SEQ ID NO: 9508480 - DNA, 22 bp, Homo sapiens
agggagctgagctgtgagcagc

SEQ ID NO: 9508481 - DNA, 22 bp, Homo sapiens
agggagctgagctgtgagcagc

SEQ ID NO: 9508482 - DNA, 22 bp, Homo sapiens
agggagctgagctgtgagcagc

SEQ ID NO: 9508483 - DNA, 22 bp, Homo sapiens
agggagcttctggcctcagcct

SEQ ID NO: 9508484 - DNA, 22 bp, Homo sapiens
agggagcttctacttcaaggca

SEQ ID NO: 9508485 - DNA, 22 bp, Homo sapiens
agggagcttccgaactacagct

SEQ ID NO: 9508486 - DNA, 22 bp, Homo sapiens
agggagctgtggtcagctcagt

SEQ ID NO: 9508487 - DNA, 22 bp, Homo sapiens
agggagctgtggtcagctcagt

SEQ ID NO: 9508488 - DNA, 22 bp, Homo sapiens
cccagagttcaaaccctgcgtc

SEQ ID NO: 9508489 - DNA, 22 bp, Homo sapiens
cccagagttggtcaggggaccc

SEQ ID NO: 9508490 - DNA, 22 bp, Homo sapiens
cccagagtggagggtgcagaat

SEQ ID NO: 9508491 - DNA, 22 bp, Homo sapiens
cccagagtggagggtgcagaat

SEQ ID NO: 9508492 - DNA, 22 bp, Homo sapiens
cccagagtggacggtggcccct

SEQ ID NO: 9508493 - DNA, 22 bp, Homo sapiens
cccagagtcaagcttaccatta

SEQ ID NO: 9508494 - DNA, 22 bp, Homo sapiens
cccagagtatttgtgatgttag

SEQ ID NO: 9508495 - DNA, 20 bp, Homo sapiens
cccagaggttgcggcaggag

SEQ ID NO: 9508496 - DNA, 22 bp, Homo sapiens
cccagagtctctgctcttgcct

SEQ ID NO: 9508497 - DNA, 23 bp, Homo sapiens
cccagagtcatctgtagctgtgg

SEQ ID NO: 9508498 - DNA, 22 bp, Homo sapiens
cccagagtcacatggggtgttc

SEQ ID NO: 9508499 - DNA, 22 bp, Homo sapiens
aggctttcctgtcactcatgct

SEQ ID NO: 9508500 - DNA, 22 bp, Homo sapiens
aggctttgcaaaaaagctcata

SEQ ID NO: 9508501 - DNA, 22 bp, Homo sapiens
aggcttggctggcagccctggg

SEQ ID NO: 9508502 - DNA, 22 bp, Homo sapiens
aggcttggctctcctatgagaa

SEQ ID NO: 9508503 - DNA, 22 bp, Homo sapiens
aggcttggctctcctatgagaa

SEQ ID NO: 9508504 - DNA, 22 bp, Homo sapiens
cccagatgcaggttcaagagta

SEQ ID NO: 9508505 - DNA, 22 bp, Homo sapiens
cccagatgcaggttcaagagta

SEQ ID NO: 9508506 - DNA, 22 bp, Homo sapiens
agggaaaggctgatgctgtggg

SEQ ID NO: 9508507 - DNA, 21 bp, Homo sapiens
agggaaagaaaatgagctaat

SEQ ID NO: 9508508 - DNA, 21 bp, Homo sapiens
agggaaagaaaatgagctaat

SEQ ID NO: 9508509 - DNA, 22 bp, Homo sapiens
agggaaaggtagtgaggtcaca

SEQ ID NO: 9508510 - DNA, 22 bp, Homo sapiens
agggaaaggtagtgaggtcaca

SEQ ID NO: 9508511 - DNA, 22 bp, Homo sapiens
agggaaaggtagtgaggtcaca

SEQ ID NO: 9508512 - DNA, 22 bp, Homo sapiens
agggaaaggtagtgaggtcaca

SEQ ID NO: 9508513 - DNA, 22 bp, Homo sapiens
agggaaaggctgatgctgtggg

SEQ ID NO: 9508514 - DNA, 21 bp, Homo sapiens
agggaaagaaaatgagctaat

SEQ ID NO: 9508515 - DNA, 21 bp, Homo sapiens
agggaaaaggctgagtgaggg

SEQ ID NO: 9508516 - DNA, 22 bp, Homo sapiens
aggcttttatacattgctgacc

SEQ ID NO: 9508517 - DNA, 23 bp, Homo sapiens
agggaaagtagtaatggcctttg

SEQ ID NO: 9508518 - DNA, 23 bp, Homo sapiens
agggaaagtagtaatggcctttg

SEQ ID NO: 9508519 - DNA, 22 bp, Homo sapiens
agggaaataatctattctgagg

SEQ ID NO: 9508520 - DNA, 22 bp, Homo sapiens
cccaggaaatcaggctttctag

SEQ ID NO: 9508521 - DNA, 22 bp, Homo sapiens
agggaaagtaagcatttcatta

SEQ ID NO: 9508522 - DNA, 22 bp, Homo sapiens
agggaaagtaagcatttcatta

SEQ ID NO: 9508523 - DNA, 23 bp, Homo sapiens
agggaaagtagtaatggcctttg

SEQ ID NO: 9508524 - DNA, 22 bp, Homo sapiens
agggaaagtaagcatttcatta

SEQ ID NO: 9508525 - DNA, 22 bp, Homo sapiens
cccaggaactccagagctcctc

SEQ ID NO: 9508526 - DNA, 22 bp, Homo sapiens
cccaggaaatgggctcttgcct

SEQ ID NO: 9508527 - DNA, 22 bp, Homo sapiens
cccaggaaatgaacttctgatt

SEQ ID NO: 9508528 - DNA, 22 bp, Homo sapiens
cccaggaacagcacagaacagc

SEQ ID NO: 9508529 - DNA, 22 bp, Homo sapiens
cccaggaagaggggtcaggtgt

SEQ ID NO: 9508530 - DNA, 22 bp, Homo sapiens
cccaggaagagtgagtggcatt

SEQ ID NO: 9508531 - DNA, 22 bp, Homo sapiens
cccaggaagcccagaattctgg

SEQ ID NO: 9508532 - DNA, 22 bp, Homo sapiens
cccaggaagttgagactgcagt

SEQ ID NO: 9508533 - DNA, 22 bp, Homo sapiens
cccaggaagttgatgcagagga

SEQ ID NO: 9508534 - DNA, 22 bp, Homo sapiens
cccaggaagggatgccaaggaa

SEQ ID NO: 9508535 - DNA, 22 bp, Homo sapiens
cccaggaagggatgccaaggaa

SEQ ID NO: 9508536 - DNA, 22 bp, Homo sapiens
cccaggaagttgagactgcagt

SEQ ID NO: 9508537 - DNA, 22 bp, Homo sapiens
cccaggtctgtgccagctctga

SEQ ID NO: 9508538 - DNA, 22 bp, Homo sapiens
cccaggtctgtgccagctctga

SEQ ID NO: 9508539 - DNA, 22 bp, Homo sapiens
cccaggtctgtgccagctctga

SEQ ID NO: 9508540 - DNA, 22 bp, Homo sapiens
agggagctttcaggtagcttaa

SEQ ID NO: 9508541 - DNA, 22 bp, Homo sapiens
agggagctttcaggtagcttaa

SEQ ID NO: 9508542 - DNA, 21 bp, Homo sapiens
agggagctttaggtagaagtt

SEQ ID NO: 9508543 - DNA, 21 bp, Homo sapiens
agggagctttaggtagaagtt

SEQ ID NO: 9508544 - DNA, 21 bp, Homo sapiens
agggagctttaggtagaagtt

SEQ ID NO: 9508545 - DNA, 22 bp, Homo sapiens
agggagcttgtgtttcttttag

SEQ ID NO: 9508546 - DNA, 22 bp, Homo sapiens
agggagctttaccccagatcac

SEQ ID NO: 9508547 - DNA, 22 bp, Homo sapiens
cccaggtggcagaagctgcagt

SEQ ID NO: 9508548 - DNA, 21 bp, Homo sapiens
cccaggtgggatggttgcctc

SEQ ID NO: 9508549 - DNA, 22 bp, Homo sapiens
cccaggtggcagaagctgcagt

SEQ ID NO: 9508550 - DNA, 22 bp, Homo sapiens
cccaggtgctgcgtgaagcctc

SEQ ID NO: 9508551 - DNA, 22 bp, Homo sapiens
agggcagaaaccaccttgatgg

SEQ ID NO: 9508552 - DNA, 22 bp, Homo sapiens
agggcagaaaccaccttgatgg

SEQ ID NO: 9508553 - DNA, 22 bp, Homo sapiens
agggcagaaaccaccttgatgg

SEQ ID NO: 9508554 - DNA, 20 bp, Homo sapiens
agggcacttttgctggagca

SEQ ID NO: 9508555 - DNA, 22 bp, Homo sapiens
agggatgggtctaacccagaac

SEQ ID NO: 9508556 - DNA, 22 bp, Homo sapiens
agggatggtggaggttgcaagt

SEQ ID NO: 9508557 - DNA, 22 bp, Homo sapiens
agggatggtggaggttgcaagt

SEQ ID NO: 9508558 - DNA, 22 bp, Homo sapiens
agggcactttacccatagcttg

SEQ ID NO: 9508559 - DNA, 19 bp, Homo sapiens
cccaggtgtttgaggctgc

SEQ ID NO: 9508560 - DNA, 23 bp, Homo sapiens
cccaggtgtggaggcggtggcag

SEQ ID NO: 9508561 - DNA, 23 bp, Homo sapiens
cccaggtgtggaggcggtggcag

SEQ ID NO: 9508562 - DNA, 20 bp, Homo sapiens
cccaggtgtctgaagctctg

SEQ ID NO: 9508563 - DNA, 20 bp, Homo sapiens
cccaggtgtctgaagctctg

SEQ ID NO: 9508564 - DNA, 22 bp, Homo sapiens
agggcagactaggatggaagtg

SEQ ID NO: 9508565 - DNA, 22 bp, Homo sapiens
agggcagactaggatggaagtg

SEQ ID NO: 9508566 - DNA, 22 bp, Homo sapiens
agggcagaccacgtgcaaggat

SEQ ID NO: 9508567 - DNA, 22 bp, Homo sapiens
agggcagaccacgtgcaaggat

SEQ ID NO: 9508568 - DNA, 22 bp, Homo sapiens
agggcagactaggatggaagtg

SEQ ID NO: 9508569 - DNA, 22 bp, Homo sapiens
agggcagactaggatggaagtg

SEQ ID NO: 9508570 - DNA, 22 bp, Homo sapiens
agggcagaccacgtgcaaggat

SEQ ID NO: 9508571 - DNA, 22 bp, Homo sapiens
agggcagaagtacagacactta

SEQ ID NO: 9508572 - DNA, 22 bp, Homo sapiens
agggcagaaatcgattacacct

SEQ ID NO: 9508573 - DNA, 22 bp, Homo sapiens
agggcagaaatcgattacacct

SEQ ID NO: 9508574 - DNA, 22 bp, Homo sapiens
agggcagaaatattgatactgt

SEQ ID NO: 9508575 - DNA, 22 bp, Homo sapiens
agggcagaaatattgatactgt

SEQ ID NO: 9508576 - DNA, 20 bp, Homo sapiens
agggcacttttgctggagca

SEQ ID NO: 9508577 - DNA, 22 bp, Homo sapiens
agggcagaccacgtgcaaggat

SEQ ID NO: 9508578 - DNA, 22 bp, Homo sapiens
agggcagaccacgtgcaaggat

SEQ ID NO: 9508579 - DNA, 22 bp, Homo sapiens
agggcagaagtacagacactta

SEQ ID NO: 9508580 - DNA, 22 bp, Homo sapiens
agggcagaagtacagacactta

SEQ ID NO: 9508581 - DNA, 22 bp, Homo sapiens
cccctcttgtgggctcaggtca

SEQ ID NO: 9508582 - DNA, 22 bp, Homo sapiens
agggcagagaaatgtagttgag

SEQ ID NO: 9508583 - DNA, 22 bp, Homo sapiens
agggcagagaaatgtagttgag

SEQ ID NO: 9508584 - DNA, 22 bp, Homo sapiens
agggcagagaaatgtagttgag

SEQ ID NO: 9508585 - DNA, 22 bp, Homo sapiens
cccctgccagctatccctgaac

SEQ ID NO: 9508586 - DNA, 22 bp, Homo sapiens
cccctgccagctatccctgaac

SEQ ID NO: 9508587 - DNA, 22 bp, Homo sapiens
cccctgagattctggcttggga

SEQ ID NO: 9508588 - DNA, 22 bp, Homo sapiens
cccctgagattctggcttggga

SEQ ID NO: 9508589 - DNA, 22 bp, Homo sapiens
cccctgccagctatccctgaac

SEQ ID NO: 9508590 - DNA, 21 bp, Homo sapiens
cccctgggagccctgtcagta

SEQ ID NO: 9508591 - DNA, 22 bp, Homo sapiens
ccctgaggggagtggtgaggtg

SEQ ID NO: 9508592 - DNA, 22 bp, Homo sapiens
ccctgaggctgaggataggtgg

SEQ ID NO: 9508593 - DNA, 22 bp, Homo sapiens
ccctgaggggagtggtgaggtg

SEQ ID NO: 9508594 - DNA, 18 bp, Homo sapiens
ccctgaggctagcatgct

SEQ ID NO: 9508595 - DNA, 22 bp, Homo sapiens
ccctgaggctgaggataggtgg

SEQ ID NO: 9508596 - DNA, 18 bp, Homo sapiens
ccctgaggctagcatgct

SEQ ID NO: 9508597 - DNA, 22 bp, Homo sapiens
ccctgagttagtacagttgagt

SEQ ID NO: 9508598 - DNA, 22 bp, Homo sapiens
ccctgagttagtacagttgagt

SEQ ID NO: 9508599 - DNA, 22 bp, Homo sapiens
ccctgatagcccctatcatcag

SEQ ID NO: 9508600 - DNA, 22 bp, Homo sapiens
ccctgagtcatcattgcggaag

SEQ ID NO: 9508601 - DNA, 22 bp, Homo sapiens
ccctgagtcatcattgcggaag

SEQ ID NO: 9508602 - DNA, 22 bp, Homo sapiens
ccctgaggggagtggtgaggtg

SEQ ID NO: 9508603 - DNA, 22 bp, Homo sapiens
ccctgaggggcttactttgccc

SEQ ID NO: 9508604 - DNA, 22 bp, Homo sapiens
ccctgaggggcttactttgccc

SEQ ID NO: 9508605 - DNA, 22 bp, Homo sapiens
ccctgaggcaaaggctagagtt

SEQ ID NO: 9508606 - DNA, 22 bp, Homo sapiens
ccctgaggcaaaggctagagtt

SEQ ID NO: 9508607 - DNA, 22 bp, Homo sapiens
ccctgaggcaaaggctagagtt

SEQ ID NO: 9508608 - DNA, 22 bp, Homo sapiens
ccctgaggcacaggccacgtat

SEQ ID NO: 9508609 - DNA, 22 bp, Homo sapiens
ccctgaggcacaggccacgtat

SEQ ID NO: 9508610 - DNA, 19 bp, Homo sapiens
ccctgaggcaaaagccttt

SEQ ID NO: 9508611 - DNA, 22 bp, Homo sapiens
ccctgaggcaaaggctagagtt

SEQ ID NO: 9508612 - DNA, 22 bp, Homo sapiens
ccctgaggatgtctccttcctg

SEQ ID NO: 9508613 - DNA, 22 bp, Homo sapiens
ccctgaggcaaaggctagagtt

SEQ ID NO: 9508614 - DNA, 18 bp, Homo sapiens
ccctgaggctagcatgct

SEQ ID NO: 9508615 - DNA, 22 bp, Homo sapiens
ccctgaggccctcctggggtct

SEQ ID NO: 9508616 - DNA, 22 bp, Homo sapiens
ccctgaggccctcctggggtct

SEQ ID NO: 9508617 - DNA, 22 bp, Homo sapiens
ccctgaggccctcctggggtct

SEQ ID NO: 9508618 - DNA, 22 bp, Homo sapiens
ccctgaggcagtaggagctttt

SEQ ID NO: 9508619 - DNA, 22 bp, Homo sapiens
ccctgaggcagtaggagctttt

SEQ ID NO: 9508620 - DNA, 22 bp, Homo sapiens
ccctgaggcagtaggagctttt

SEQ ID NO: 9508621 - DNA, 22 bp, Homo sapiens
ccctgaggcacaggccacgtat

SEQ ID NO: 9508622 - DNA, 22 bp, Homo sapiens
agggcccaggacagcatcaggg

SEQ ID NO: 9508623 - DNA, 22 bp, Homo sapiens
agggcccaggacagcatcaggg

SEQ ID NO: 9508624 - DNA, 20 bp, Homo sapiens
agggcccaggaagagagtta

SEQ ID NO: 9508625 - DNA, 20 bp, Homo sapiens
agggcccaggaagagagtta

SEQ ID NO: 9508626 - DNA, 22 bp, Homo sapiens
agggcccagcccttgctggtct

SEQ ID NO: 9508627 - DNA, 22 bp, Homo sapiens
agggcccaccttggtgctgagg

SEQ ID NO: 9508628 - DNA, 22 bp, Homo sapiens
agggcccaccttggtgctgagg

SEQ ID NO: 9508629 - DNA, 22 bp, Homo sapiens
agggcccacagttcctatggcc

SEQ ID NO: 9508630 - DNA, 22 bp, Homo sapiens
agggcccacagttcctatggcc

SEQ ID NO: 9508631 - DNA, 23 bp, Homo sapiens
agggcccaagcctggacagcagg

SEQ ID NO: 9508632 - DNA, 23 bp, Homo sapiens
agggcccaagcctggacagcagg

SEQ ID NO: 9508633 - DNA, 23 bp, Homo sapiens
agggcccaagcctggacagcagg

SEQ ID NO: 9508634 - DNA, 23 bp, Homo sapiens
agggcccaagcctggacagcagg

SEQ ID NO: 9508635 - DNA, 22 bp, Homo sapiens
agggccagggaagctgtatttt

SEQ ID NO: 9508636 - DNA, 22 bp, Homo sapiens
ccctgatgacacgggcatcagg

SEQ ID NO: 9508637 - DNA, 23 bp, Homo sapiens
agggccaggtgcggaaacagctc

SEQ ID NO: 9508638 - DNA, 22 bp, Homo sapiens
agggcatgtgggagaggagcct

SEQ ID NO: 9508639 - DNA, 22 bp, Homo sapiens
agggcatgtgggagaggagcct

SEQ ID NO: 9508640 - DNA, 22 bp, Homo sapiens
agggcatggggttaacctggga

SEQ ID NO: 9508641 - DNA, 22 bp, Homo sapiens
agggcagctgtgagccactgtg

SEQ ID NO: 9508642 - DNA, 22 bp, Homo sapiens
agggcagctgtgagccactgtg

SEQ ID NO: 9508643 - DNA, 20 bp, Homo sapiens
ccccttcatctacagcctga

SEQ ID NO: 9508644 - DNA, 20 bp, Homo sapiens
ccccttcatctacagcctga

SEQ ID NO: 9508645 - DNA, 19 bp, Homo sapiens
ccccttaggggttaagcct

SEQ ID NO: 9508646 - DNA, 22 bp, Homo sapiens
cccctgtgttgttcaagggtca

SEQ ID NO: 9508647 - DNA, 22 bp, Homo sapiens
agggccaccagagcagggcagt

SEQ ID NO: 9508648 - DNA, 22 bp, Homo sapiens
agggccacagtggggcctgaga

SEQ ID NO: 9508649 - DNA, 22 bp, Homo sapiens
agggccacagtggggcctgaga

SEQ ID NO: 9508650 - DNA, 22 bp, Homo sapiens
agggccacctctctgggttccc

SEQ ID NO: 9508651 - DNA, 22 bp, Homo sapiens
ccctgaggatagggcaggaccc

SEQ ID NO: 9508652 - DNA, 22 bp, Homo sapiens
ccctgaggatagggcaggaccc

SEQ ID NO: 9508653 - DNA, 22 bp, Homo sapiens
ccctgaggatagggcaggaccc

SEQ ID NO: 9508654 - DNA, 22 bp, Homo sapiens
ccctgaggagagcgcttcccga

SEQ ID NO: 9508655 - DNA, 22 bp, Homo sapiens
ccctgaggatagggcaggaccc

SEQ ID NO: 9508656 - DNA, 22 bp, Homo sapiens
ccctgaggatagggcaggaccc

SEQ ID NO: 9508657 - DNA, 22 bp, Homo sapiens
agggggtgcccagatgaaggat

SEQ ID NO: 9508658 - DNA, 22 bp, Homo sapiens
agggggtgcccagatgaaggat

SEQ ID NO: 9508659 - DNA, 22 bp, Homo sapiens
agggggtgcatttgtgaatgaa

SEQ ID NO: 9508660 - DNA, 22 bp, Homo sapiens
agggggtgcatttgtgaatgaa

SEQ ID NO: 9508661 - DNA, 22 bp, Homo sapiens
agggggtgatcaaggtgcggcg

SEQ ID NO: 9508662 - DNA, 22 bp, Homo sapiens
agggggtgatcaaggtgcggcg

SEQ ID NO: 9508663 - DNA, 22 bp, Homo sapiens
agggggtgtctctgattgggtt

SEQ ID NO: 9508664 - DNA, 22 bp, Homo sapiens
agggggtgtctctgattgggtt

SEQ ID NO: 9508665 - DNA, 22 bp, Homo sapiens
agggggtgggaagtctagaatc

SEQ ID NO: 9508666 - DNA, 22 bp, Homo sapiens
agggggtgctacttccagagtt

SEQ ID NO: 9508667 - DNA, 22 bp, Homo sapiens
agggggtgcatttgtgaatgaa

SEQ ID NO: 9508668 - DNA, 22 bp, Homo sapiens
aggggtcttgaggactccagca

SEQ ID NO: 9508669 - DNA, 22 bp, Homo sapiens
cctgcagaccacactcagtcct

SEQ ID NO: 9508670 - DNA, 22 bp, Homo sapiens
cctgagtctgtgttttcctaag

SEQ ID NO: 9508671 - DNA, 22 bp, Homo sapiens
aggggtgaaggcccgataggag

SEQ ID NO: 9508672 - DNA, 22 bp, Homo sapiens
aggggtcagtgaccattgagga

SEQ ID NO: 9508673 - DNA, 22 bp, Homo sapiens
aggggtagagattgctggtgta

SEQ ID NO: 9508674 - DNA, 20 bp, Homo sapiens
aggggtctagcagcagtgct

SEQ ID NO: 9508675 - DNA, 22 bp, Homo sapiens
aggggtctatcctgagatggtc

SEQ ID NO: 9508676 - DNA, 22 bp, Homo sapiens
aggggtctatcctgagatggtc

SEQ ID NO: 9508677 - DNA, 22 bp, Homo sapiens
cctctgtgtcctggtcattgaa

SEQ ID NO: 9508678 - DNA, 22 bp, Homo sapiens
cctctgtgtcagggaagagact

SEQ ID NO: 9508679 - DNA, 22 bp, Homo sapiens
cctctgtgggccgggcctgctg

SEQ ID NO: 9508680 - DNA, 22 bp, Homo sapiens
cctctgtgtgtgcatgcatgcg

SEQ ID NO: 9508681 - DNA, 22 bp, Homo sapiens
cctctgtgtgtgcatgcatgcg

SEQ ID NO: 9508682 - DNA, 22 bp, Homo sapiens
cctctgtgtgatgcgcaaagta

SEQ ID NO: 9508683 - DNA, 22 bp, Homo sapiens
cctctgtgtctccaagaggcct

SEQ ID NO: 9508684 - DNA, 22 bp, Homo sapiens
cctctgtgtctccaagaggcct

SEQ ID NO: 9508685 - DNA, 22 bp, Homo sapiens
agggggctccttggtgtgcaga

SEQ ID NO: 9508686 - DNA, 22 bp, Homo sapiens
agggggctccttggtgtgcaga

SEQ ID NO: 9508687 - DNA, 22 bp, Homo sapiens
agggggctcctccggtgcttcc

SEQ ID NO: 9508688 - DNA, 22 bp, Homo sapiens
agggggctgccaaggaatgtaa

SEQ ID NO: 9508689 - DNA, 22 bp, Homo sapiens
agggggctgccaaggaatgtaa

SEQ ID NO: 9508690 - DNA, 22 bp, Homo sapiens
agggggctgccaaggaatgtaa

SEQ ID NO: 9508691 - DNA, 22 bp, Homo sapiens
agggggagacatgtgtgtgttt

SEQ ID NO: 9508692 - DNA, 22 bp, Homo sapiens
agggggtgaatgtctgtctaca

SEQ ID NO: 9508693 - DNA, 22 bp, Homo sapiens
agggggtgatcaaggtgcggcg

SEQ ID NO: 9508694 - DNA, 22 bp, Homo sapiens
agggggtgaatgtctgtctaca

SEQ ID NO: 9508695 - DNA, 22 bp, Homo sapiens
agggggtgaatgtctgtctaca

SEQ ID NO: 9508696 - DNA, 22 bp, Homo sapiens
agggggtgaatgtctgtctaca

SEQ ID NO: 9508697 - DNA, 22 bp, Homo sapiens
aggggggtggatcacctgaggt

SEQ ID NO: 9508698 - DNA, 22 bp, Homo sapiens
aggggggtggatcacctgaggt

SEQ ID NO: 9508699 - DNA, 22 bp, Homo sapiens
agggggtctcctatcatggaag

SEQ ID NO: 9508700 - DNA, 22 bp, Homo sapiens
agggggtcgtccggaagacctg

SEQ ID NO: 9508701 - DNA, 22 bp, Homo sapiens
agggggtcgtccggaagacctg

SEQ ID NO: 9508702 - DNA, 22 bp, Homo sapiens
aggggctcctctctgagagtag

SEQ ID NO: 9508703 - DNA, 22 bp, Homo sapiens
aggggctctaaagatcatggaa

SEQ ID NO: 9508704 - DNA, 22 bp, Homo sapiens
aggggctctgagtgggccagga

SEQ ID NO: 9508705 - DNA, 22 bp, Homo sapiens
aggggctgactggaaagtgcca

SEQ ID NO: 9508706 - DNA, 22 bp, Homo sapiens
aggggctcagttactttggcag

SEQ ID NO: 9508707 - DNA, 22 bp, Homo sapiens
aggggcgtctgtaggcagtggg

SEQ ID NO: 9508708 - DNA, 22 bp, Homo sapiens
aggggcgtgctcttccccgacg

SEQ ID NO: 9508709 - DNA, 22 bp, Homo sapiens
aggggcaggtgctgcacttaga

SEQ ID NO: 9508710 - DNA, 18 bp, Homo sapiens
aggggcagcttgtgtgga

SEQ ID NO: 9508711 - DNA, 18 bp, Homo sapiens
aggggcagcttgtgtgga

SEQ ID NO: 9508712 - DNA, 22 bp, Homo sapiens
aggggcggcctgcctgaagcag

SEQ ID NO: 9508713 - DNA, 22 bp, Homo sapiens
aggggcctggttggcctctgtt

SEQ ID NO: 9508714 - DNA, 22 bp, Homo sapiens
aggggcgctgcggtcctcagcc

SEQ ID NO: 9508715 - DNA, 22 bp, Homo sapiens
cctcctggttgcaatgaaatgg

SEQ ID NO: 9508716 - DNA, 22 bp, Homo sapiens
cctcctggtgggcgcttctggc

SEQ ID NO: 9508717 - DNA, 19 bp, Homo sapiens
cctcctgtggcgggtgggg

SEQ ID NO: 9508718 - DNA, 19 bp, Homo sapiens
cctcctgtggcgggtgggg

SEQ ID NO: 9508719 - DNA, 22 bp, Homo sapiens
cctcctgttgtcaccaggcgtg

SEQ ID NO: 9508720 - DNA, 22 bp, Homo sapiens
cctcctggtgggcgcttctggc

SEQ ID NO: 9508721 - DNA, 22 bp, Homo sapiens
cctcctggtgggcgcttctggc

SEQ ID NO: 9508722 - DNA, 22 bp, Homo sapiens
cctcctggtgggcgcttctggc

SEQ ID NO: 9508723 - DNA, 22 bp, Homo sapiens
cctcctggtgggcgcttctggc

SEQ ID NO: 9508724 - DNA, 22 bp, Homo sapiens
cctcctggtgggcgcttctggc

SEQ ID NO: 9508725 - DNA, 22 bp, Homo sapiens
cctcctgttgtcctgctggggc

SEQ ID NO: 9508726 - DNA, 22 bp, Homo sapiens
cctccttcctgggacagagctg

SEQ ID NO: 9508727 - DNA, 22 bp, Homo sapiens
cctccttcctgggacagagctg

SEQ ID NO: 9508728 - DNA, 22 bp, Homo sapiens
cctccttctggggccttctgct

SEQ ID NO: 9508729 - DNA, 22 bp, Homo sapiens
cctcctggtgacaaggcaaagc

SEQ ID NO: 9508730 - DNA, 22 bp, Homo sapiens
cctcctggtgacaaggcaaagc

SEQ ID NO: 9508731 - DNA, 22 bp, Homo sapiens
aggggaatgggtagactgttga

SEQ ID NO: 9508732 - DNA, 22 bp, Homo sapiens
aggggaatgggtagactgttga

SEQ ID NO: 9508733 - DNA, 21 bp, Homo sapiens
aggggaagtagagttttgatt

SEQ ID NO: 9508734 - DNA, 22 bp, Homo sapiens
aggggaaatgccttggtggtac

SEQ ID NO: 9508735 - DNA, 22 bp, Homo sapiens
aggggaagattatacttttgaa

SEQ ID NO: 9508736 - DNA, 22 bp, Homo sapiens
aggggaagagccctttacatgg

SEQ ID NO: 9508737 - DNA, 22 bp, Homo sapiens
aggggaaggccagcctgtagag

SEQ ID NO: 9508738 - DNA, 22 bp, Homo sapiens
aggggaagattatacttttgaa

SEQ ID NO: 9508739 - DNA, 22 bp, Homo sapiens
aggggaaggccagcctgtagag

SEQ ID NO: 9508740 - DNA, 22 bp, Homo sapiens
aggggaaggccagcctgtagag

SEQ ID NO: 9508741 - DNA, 22 bp, Homo sapiens
ccctggccagggcacagggagg

SEQ ID NO: 9508742 - DNA, 22 bp, Homo sapiens
ccctggccagggcacagggagg

SEQ ID NO: 9508743 - DNA, 22 bp, Homo sapiens
agggcctggcttcactttctca

SEQ ID NO: 9508744 - DNA, 22 bp, Homo sapiens
agggcctggcttcactttctca

SEQ ID NO: 9508745 - DNA, 22 bp, Homo sapiens
ccctggcataaaacttctccag

SEQ ID NO: 9508746 - DNA, 22 bp, Homo sapiens
ccctggccagctcatgtctgag

SEQ ID NO: 9508747 - DNA, 22 bp, Homo sapiens
ccctggcagcaatcactggtgt

SEQ ID NO: 9508748 - DNA, 22 bp, Homo sapiens
ccctggcagtgctcctttagac

SEQ ID NO: 9508749 - DNA, 22 bp, Homo sapiens
ccctggcagagggggcaggtgc

SEQ ID NO: 9508750 - DNA, 22 bp, Homo sapiens
agggcccatgtgggagcacttg

SEQ ID NO: 9508751 - DNA, 22 bp, Homo sapiens
agggcccatagatcgtcagctt

SEQ ID NO: 9508752 - DNA, 22 bp, Homo sapiens
agggcccatagatcgtcagctt

SEQ ID NO: 9508753 - DNA, 22 bp, Homo sapiens
agggcccatagatcgtcagctt

SEQ ID NO: 9508754 - DNA, 22 bp, Homo sapiens
agggcccaggacagcatcaggg

SEQ ID NO: 9508755 - DNA, 22 bp, Homo sapiens
agggcccagtggagagctgagc

SEQ ID NO: 9508756 - DNA, 22 bp, Homo sapiens
agggcccatgtgggagcacttg

SEQ ID NO: 9508757 - DNA, 22 bp, Homo sapiens
ccctggcactagcgacggccat

SEQ ID NO: 9508758 - DNA, 21 bp, Homo sapiens
agggcctgtgctctccaggtc

SEQ ID NO: 9508759 - DNA, 22 bp, Homo sapiens
agggcctgtgctgagtagacga

SEQ ID NO: 9508760 - DNA, 22 bp, Homo sapiens
agggcctgtgctgagtagacga

SEQ ID NO: 9508761 - DNA, 22 bp, Homo sapiens
agggcctgtgctgagtagacga

SEQ ID NO: 9508762 - DNA, 22 bp, Homo sapiens
agggcctgtgctgagtagacga

SEQ ID NO: 9508763 - DNA, 22 bp, Homo sapiens
agggcctgtgcttcctgagata

SEQ ID NO: 9508764 - DNA, 22 bp, Homo sapiens
agggcctgtgcttcctgagata

SEQ ID NO: 9508765 - DNA, 22 bp, Homo sapiens
cctaagtaagttgactttcaga

SEQ ID NO: 9508766 - DNA, 22 bp, Homo sapiens
cctaaggaccagggcttccagc

SEQ ID NO: 9508767 - DNA, 22 bp, Homo sapiens
cctaaggaaagccaaagaggcc

SEQ ID NO: 9508768 - DNA, 22 bp, Homo sapiens
cctacagacaaaccagtgacta

SEQ ID NO: 9508769 - DNA, 22 bp, Homo sapiens
cctacaggaaattgtatcaaaa

SEQ ID NO: 9508770 - DNA, 22 bp, Homo sapiens
cctacagttatattcttgattg

SEQ ID NO: 9508771 - DNA, 22 bp, Homo sapiens
cctaagtattttcagtgttaac

SEQ ID NO: 9508772 - DNA, 22 bp, Homo sapiens
cctaattatctcccaaagatcc

SEQ ID NO: 9508773 - DNA, 22 bp, Homo sapiens
cctaatttgattttaaatagcc

SEQ ID NO: 9508774 - DNA, 22 bp, Homo sapiens
agggcctgtccgctcccgcccg

SEQ ID NO: 9508775 - DNA, 22 bp, Homo sapiens
agggcctgtccgctcccgcccg

SEQ ID NO: 9508776 - DNA, 22 bp, Homo sapiens
agggcctgtccgctcccgcccg

SEQ ID NO: 9508777 - DNA, 22 bp, Homo sapiens
agggcctgtcagcggtgtcctg

SEQ ID NO: 9508778 - DNA, 21 bp, Homo sapiens
agggcctgtgctctccaggtc

SEQ ID NO: 9508779 - DNA, 21 bp, Homo sapiens
agggcctgtgctctccaggtc

SEQ ID NO: 9508780 - DNA, 22 bp, Homo sapiens
agggcctgtgaattctccctgc

SEQ ID NO: 9508781 - DNA, 22 bp, Homo sapiens
agggcctgtgaattctccctgc

SEQ ID NO: 9508782 - DNA, 22 bp, Homo sapiens
agggcctgtgaattctccctgc

SEQ ID NO: 9508783 - DNA, 22 bp, Homo sapiens
cctcagggtctgaggagaccgt

SEQ ID NO: 9508784 - DNA, 22 bp, Homo sapiens
cctcagggtctgaggagaccgt

SEQ ID NO: 9508785 - DNA, 22 bp, Homo sapiens
cctcaggggtgcccacagctgc

SEQ ID NO: 9508786 - DNA, 22 bp, Homo sapiens
cctcagtcattggcctacactt

SEQ ID NO: 9508787 - DNA, 22 bp, Homo sapiens
cctcagtctatttccagcaggt

SEQ ID NO: 9508788 - DNA, 22 bp, Homo sapiens
cctcaggtgtgggccagctgtc

SEQ ID NO: 9508789 - DNA, 22 bp, Homo sapiens
cctcagtctatttccagcaggt

SEQ ID NO: 9508790 - DNA, 22 bp, Homo sapiens
cctcagtctatttccagcaggt

SEQ ID NO: 9508791 - DNA, 22 bp, Homo sapiens
cctcagtcattggcctacactt

SEQ ID NO: 9508792 - DNA, 22 bp, Homo sapiens
agggctgggctgcttgttgtca

SEQ ID NO: 9508793 - DNA, 22 bp, Homo sapiens
agggctgggctgcttgttgtca

SEQ ID NO: 9508794 - DNA, 22 bp, Homo sapiens
agggctgggctgcttgttgtca

SEQ ID NO: 9508795 - DNA, 22 bp, Homo sapiens
agggctgggctgcttgttgtca

SEQ ID NO: 9508796 - DNA, 20 bp, Homo sapiens
agggctgagaagggactagc

SEQ ID NO: 9508797 - DNA, 22 bp, Homo sapiens
agggctgagactaaggccagat

SEQ ID NO: 9508798 - DNA, 22 bp, Homo sapiens
agggctgagaatgacagggccg

SEQ ID NO: 9508799 - DNA, 22 bp, Homo sapiens
agggctgagactaaggccagat

SEQ ID NO: 9508800 - DNA, 22 bp, Homo sapiens
agggctgagcccaggcatgtag

SEQ ID NO: 9508801 - DNA, 18 bp, Homo sapiens
cctcagggagatccagtg

SEQ ID NO: 9508802 - DNA, 22 bp, Homo sapiens
cctacatacttgggctttacct

SEQ ID NO: 9508803 - DNA, 22 bp, Homo sapiens
cctacataacactgccaaactg

SEQ ID NO: 9508804 - DNA, 22 bp, Homo sapiens
cctacatatctaagacaagcca

SEQ ID NO: 9508805 - DNA, 22 bp, Homo sapiens
cctacatatagggctttgctgt

SEQ ID NO: 9508806 - DNA, 22 bp, Homo sapiens
cctacctggggcaggcctcggg

SEQ ID NO: 9508807 - DNA, 22 bp, Homo sapiens
cctactccctttctagagtatg

SEQ ID NO: 9508808 - DNA, 22 bp, Homo sapiens
cctactctgagcgcctccgcat

SEQ ID NO: 9508809 - DNA, 22 bp, Homo sapiens
agggctgacctaagctccactt

SEQ ID NO: 9508810 - DNA, 22 bp, Homo sapiens
agggctgacagtggcgtggcgt

SEQ ID NO: 9508811 - DNA, 22 bp, Homo sapiens
cctagaatgtacttaatagatg

SEQ ID NO: 9508812 - DNA, 22 bp, Homo sapiens
cctactctgagcgcctccgcat

SEQ ID NO: 9508813 - DNA, 22 bp, Homo sapiens
cctactctgagcgcctccgcat

SEQ ID NO: 9508814 - DNA, 22 bp, Homo sapiens
aggccctgctttccagagctca

SEQ ID NO: 9508815 - DNA, 22 bp, Homo sapiens
aggccctgctttccagagctca

SEQ ID NO: 9508816 - DNA, 22 bp, Homo sapiens
aggccctgctttccagagctca

SEQ ID NO: 9508817 - DNA, 22 bp, Homo sapiens
aggccctgctgaggcctccctc

SEQ ID NO: 9508818 - DNA, 22 bp, Homo sapiens
aggccctgctgaggcctccctc

SEQ ID NO: 9508819 - DNA, 22 bp, Homo sapiens
aggccctggacactcaagccgg

SEQ ID NO: 9508820 - DNA, 22 bp, Homo sapiens
aggccctgctttccagagctca

SEQ ID NO: 9508821 - DNA, 22 bp, Homo sapiens
ccagctccaggactgggagctg

SEQ ID NO: 9508822 - DNA, 21 bp, Homo sapiens
aggccctggaggtcagagaaa

SEQ ID NO: 9508823 - DNA, 21 bp, Homo sapiens
aggccctggaggtcagagaaa

SEQ ID NO: 9508824 - DNA, 21 bp, Homo sapiens
aggccctggaggtcagagaaa

SEQ ID NO: 9508825 - DNA, 22 bp, Homo sapiens
ccagctccaggtagatgggcag

SEQ ID NO: 9508826 - DNA, 22 bp, Homo sapiens
ccagctccaggtagatgggcag

SEQ ID NO: 9508827 - DNA, 22 bp, Homo sapiens
ccagctcccgcaggctgcacag

SEQ ID NO: 9508828 - DNA, 22 bp, Homo sapiens
ccagctcccctcagcaggtaat

SEQ ID NO: 9508829 - DNA, 23 bp, Homo sapiens
ccagctcccaggtctgaggactg

SEQ ID NO: 9508830 - DNA, 23 bp, Homo sapiens
ccagctcccaggtctgaggactg

SEQ ID NO: 9508831 - DNA, 23 bp, Homo sapiens
ccagctcccaggtctgaggactg

SEQ ID NO: 9508832 - DNA, 22 bp, Homo sapiens
ccagctcccgcaggctgcacag

SEQ ID NO: 9508833 - DNA, 22 bp, Homo sapiens
ccagctcccgcaggctgcacag

SEQ ID NO: 9508834 - DNA, 22 bp, Homo sapiens
ccagctccctgaagcctggtct

SEQ ID NO: 9508835 - DNA, 22 bp, Homo sapiens
ccagctccctgaagcctggtct

SEQ ID NO: 9508836 - DNA, 22 bp, Homo sapiens
ccagctccctgaagcctggtct

SEQ ID NO: 9508837 - DNA, 22 bp, Homo sapiens
ccaggaggtgaaacttcaccag

SEQ ID NO: 9508838 - DNA, 22 bp, Homo sapiens
ccaggaggggtctctgtctccc

SEQ ID NO: 9508839 - DNA, 22 bp, Homo sapiens
ccaggaggtctgagtgtggaca

SEQ ID NO: 9508840 - DNA, 22 bp, Homo sapiens
ccaggagggtggttactcaatc

SEQ ID NO: 9508841 - DNA, 22 bp, Homo sapiens
ccagctccgggagttgctgctg

SEQ ID NO: 9508842 - DNA, 22 bp, Homo sapiens
ccaggaggatgaggggcataga

SEQ ID NO: 9508843 - DNA, 22 bp, Homo sapiens
ccaggaggggtctctgtctccc

SEQ ID NO: 9508844 - DNA, 22 bp, Homo sapiens
ccaggaggggtctctgtctccc

SEQ ID NO: 9508845 - DNA, 22 bp, Homo sapiens
ccaggaggtggagattgcagtg

SEQ ID NO: 9508846 - DNA, 22 bp, Homo sapiens
ccaggaggtggcaggacttgcc

SEQ ID NO: 9508847 - DNA, 22 bp, Homo sapiens
ccaggaggtggaggttgcggtg

SEQ ID NO: 9508848 - DNA, 22 bp, Homo sapiens
ccaggaggttgaggctgcagtg

SEQ ID NO: 9508849 - DNA, 22 bp, Homo sapiens
ccaggaggtggcaggacttgcc

SEQ ID NO: 9508850 - DNA, 22 bp, Homo sapiens
ccaggaggtggcaggacttgcc

SEQ ID NO: 9508851 - DNA, 22 bp, Homo sapiens
aggcctgggacgggagccgtga

SEQ ID NO: 9508852 - DNA, 22 bp, Homo sapiens
aggctcagaggtgagcatctgc

SEQ ID NO: 9508853 - DNA, 16 bp, Homo sapiens
aggctcagaggctgga

SEQ ID NO: 9508854 - DNA, 16 bp, Homo sapiens
aggctcagaggctgga

SEQ ID NO: 9508855 - DNA, 16 bp, Homo sapiens
aggctcagaggctgga

SEQ ID NO: 9508856 - DNA, 20 bp, Homo sapiens
aggctcagagcagtagtaca

SEQ ID NO: 9508857 - DNA, 22 bp, Homo sapiens
ccaggcaccaaagtatgcttta

SEQ ID NO: 9508858 - DNA, 20 bp, Homo sapiens
aggctcagatacccagggaa

SEQ ID NO: 9508859 - DNA, 22 bp, Homo sapiens
aggctcagaggtgagcatctgc

SEQ ID NO: 9508860 - DNA, 22 bp, Homo sapiens
aggctcagaggtgagcatctgc

SEQ ID NO: 9508861 - DNA, 22 bp, Homo sapiens
aggctcagaggtgagcatctgc

SEQ ID NO: 9508862 - DNA, 22 bp, Homo sapiens
ccaggcactggctgggttcttt

SEQ ID NO: 9508863 - DNA, 20 bp, Homo sapiens
ccaggcactgtcccatgcag

SEQ ID NO: 9508864 - DNA, 20 bp, Homo sapiens
ccaggcactgtcccatgcag

SEQ ID NO: 9508865 - DNA, 22 bp, Homo sapiens
ccaggcactgctcgaggtgcta

SEQ ID NO: 9508866 - DNA, 22 bp, Homo sapiens
ccaggcactcagagactgggac

SEQ ID NO: 9508867 - DNA, 22 bp, Homo sapiens
ccaggcaccatgttcttaggac

SEQ ID NO: 9508868 - DNA, 22 bp, Homo sapiens
ccaggcaccatgttcttaggac

SEQ ID NO: 9508869 - DNA, 22 bp, Homo sapiens
ccaggcaccatgttcttaggac

SEQ ID NO: 9508870 - DNA, 22 bp, Homo sapiens
ccaggcacggtggctcatgcct

SEQ ID NO: 9508871 - DNA, 22 bp, Homo sapiens
ccaggcacggtggctcatgcct

SEQ ID NO: 9508872 - DNA, 22 bp, Homo sapiens
ccaggcacggtggctcatgcct

SEQ ID NO: 9508873 - DNA, 22 bp, Homo sapiens
ccaggcacggtggctcatgcct

SEQ ID NO: 9508874 - DNA, 21 bp, Homo sapiens
aggctcagagatcaaacagta

SEQ ID NO: 9508875 - DNA, 21 bp, Homo sapiens
aggctcagagatcaaacagta

SEQ ID NO: 9508876 - DNA, 22 bp, Homo sapiens
aggctcagagagctgtgtccat

SEQ ID NO: 9508877 - DNA, 22 bp, Homo sapiens
aggctcagagagctgtgtccat

SEQ ID NO: 9508878 - DNA, 21 bp, Homo sapiens
aggctcagagatcaaacagta

SEQ ID NO: 9508879 - DNA, 22 bp, Homo sapiens
aggctcagagatgagtaagcac

SEQ ID NO: 9508880 - DNA, 22 bp, Homo sapiens
aggctcagagatgagtaagcac

SEQ ID NO: 9508881 - DNA, 22 bp, Homo sapiens
aggctcagagatgagtaagcac

SEQ ID NO: 9508882 - DNA, 22 bp, Homo sapiens
aggcctggtgaatgaagtatct

SEQ ID NO: 9508883 - DNA, 21 bp, Homo sapiens
aggctcagagagaaactcttg

SEQ ID NO: 9508884 - DNA, 22 bp, Homo sapiens
aggcctgggtgttcaccagaag

SEQ ID NO: 9508885 - DNA, 22 bp, Homo sapiens
aggcctgggtgttcaccagaag

SEQ ID NO: 9508886 - DNA, 22 bp, Homo sapiens
aggcctgggtctcgtgcctacc

SEQ ID NO: 9508887 - DNA, 22 bp, Homo sapiens
aggcctgggtctcgtgcctacc

SEQ ID NO: 9508888 - DNA, 22 bp, Homo sapiens
aggcctgggtctcgtgcctacc

SEQ ID NO: 9508889 - DNA, 22 bp, Homo sapiens
aggcctgggtgttcaccagaag

SEQ ID NO: 9508890 - DNA, 22 bp, Homo sapiens
aggcctggtgaatgaagtatct

SEQ ID NO: 9508891 - DNA, 22 bp, Homo sapiens
aggcctgggcaagaaggggcgt

SEQ ID NO: 9508892 - DNA, 22 bp, Homo sapiens
aggcctgggcaagaaggggcgt

SEQ ID NO: 9508893 - DNA, 19 bp, Homo sapiens
aggcctggggttttgcact

SEQ ID NO: 9508894 - DNA, 22 bp, Homo sapiens
aggcctgggtctcgtgcctacc

SEQ ID NO: 9508895 - DNA, 22 bp, Homo sapiens
aggcctgggtctcgtgcctacc

SEQ ID NO: 9508896 - DNA, 23 bp, Homo sapiens
aggccctgcctgtccctcttttt

SEQ ID NO: 9508897 - DNA, 22 bp, Homo sapiens
aggccctgctgaggcctccctc

SEQ ID NO: 9508898 - DNA, 22 bp, Homo sapiens
aggccctgcggaaatgatcatt

SEQ ID NO: 9508899 - DNA, 22 bp, Homo sapiens
aggccctgcggaaatgatcatt

SEQ ID NO: 9508900 - DNA, 22 bp, Homo sapiens
aggccctgcccagtgccacaag

SEQ ID NO: 9508901 - DNA, 22 bp, Homo sapiens
aggccctgcccagtgccacaag

SEQ ID NO: 9508902 - DNA, 22 bp, Homo sapiens
aggccctgcccagtgccacaag

SEQ ID NO: 9508903 - DNA, 22 bp, Homo sapiens
aggccctgcccagtgccacaag

SEQ ID NO: 9508904 - DNA, 18 bp, Homo sapiens
ccagccctgcagcacctg

SEQ ID NO: 9508905 - DNA, 18 bp, Homo sapiens
ccagccctgcagcacctg

SEQ ID NO: 9508906 - DNA, 18 bp, Homo sapiens
ccagccctgcagcacctg

SEQ ID NO: 9508907 - DNA, 18 bp, Homo sapiens
ccagccctgcagcacctg

SEQ ID NO: 9508908 - DNA, 22 bp, Homo sapiens
aggccctgacctgggagatcta

SEQ ID NO: 9508909 - DNA, 22 bp, Homo sapiens
aggccctgacctgggagatcta

SEQ ID NO: 9508910 - DNA, 22 bp, Homo sapiens
aggccctgcccagagctcctcg

SEQ ID NO: 9508911 - DNA, 22 bp, Homo sapiens
ccagccctcggtagtcccatag

SEQ ID NO: 9508912 - DNA, 22 bp, Homo sapiens
ccagccctcggtagtcccatag

SEQ ID NO: 9508913 - DNA, 22 bp, Homo sapiens
ccagccctcggtagtcccatag

SEQ ID NO: 9508914 - DNA, 22 bp, Homo sapiens
ccagccctcggtagtcccatag

SEQ ID NO: 9508915 - DNA, 22 bp, Homo sapiens
ccagccctgaaccctgctgcat

SEQ ID NO: 9508916 - DNA, 22 bp, Homo sapiens
ccagccctgattagagaatgtc

SEQ ID NO: 9508917 - DNA, 22 bp, Homo sapiens
ccagccctgattagagaatgtc

SEQ ID NO: 9508918 - DNA, 22 bp, Homo sapiens
ccagccctgaaccctgctgcat

SEQ ID NO: 9508919 - DNA, 22 bp, Homo sapiens
ccagccctgaaccctgctgcat

SEQ ID NO: 9508920 - DNA, 22 bp, Homo sapiens
ccagccagtatattccaaagcc

SEQ ID NO: 9508921 - DNA, 23 bp, Homo sapiens
ccagccctccaccagctctaggc

SEQ ID NO: 9508922 - DNA, 23 bp, Homo sapiens
ccagccctccaccagctctaggc

SEQ ID NO: 9508923 - DNA, 22 bp, Homo sapiens
ccagccctcctccatcagagga

SEQ ID NO: 9508924 - DNA, 22 bp, Homo sapiens
ccagccctcctccatcagagga

SEQ ID NO: 9508925 - DNA, 22 bp, Homo sapiens
ccagccctcctccatcagagga

SEQ ID NO: 9508926 - DNA, 22 bp, Homo sapiens
ccagccagccttgatctgagta

SEQ ID NO: 9508927 - DNA, 22 bp, Homo sapiens
ccagccagccttgatctgagta

SEQ ID NO: 9508928 - DNA, 22 bp, Homo sapiens
ccagccagcaagctcccagttc

SEQ ID NO: 9508929 - DNA, 22 bp, Homo sapiens
ccagccagctggttggacgcct

SEQ ID NO: 9508930 - DNA, 22 bp, Homo sapiens
ccagccagctggttggacgcct

SEQ ID NO: 9508931 - DNA, 22 bp, Homo sapiens
ccagccagctggttggacgcct

SEQ ID NO: 9508932 - DNA, 22 bp, Homo sapiens
ccagccaggctggctgtggagg

SEQ ID NO: 9508933 - DNA, 22 bp, Homo sapiens
ccagccaggcattgcaaactga

SEQ ID NO: 9508934 - DNA, 22 bp, Homo sapiens
ccagccagcaagctcccagttc

SEQ ID NO: 9508935 - DNA, 22 bp, Homo sapiens
ccagccagcaagctcccagttc

SEQ ID NO: 9508936 - DNA, 22 bp, Homo sapiens
ccagccagatgataagctctat

SEQ ID NO: 9508937 - DNA, 22 bp, Homo sapiens
ccagccagatgataagctctat

SEQ ID NO: 9508938 - DNA, 22 bp, Homo sapiens
ccagccagaagtccgggcttct

SEQ ID NO: 9508939 - DNA, 22 bp, Homo sapiens
ccagccagatgataagctctat

SEQ ID NO: 9508940 - DNA, 22 bp, Homo sapiens
ccagcagggaaaaacccaccaa

SEQ ID NO: 9508941 - DNA, 22 bp, Homo sapiens
ccagccactgggccactgccag

SEQ ID NO: 9508942 - DNA, 22 bp, Homo sapiens
ccagagtccctgttctcggcct

SEQ ID NO: 9508943 - DNA, 22 bp, Homo sapiens
ccagagtcccttgcagctcagt

SEQ ID NO: 9508944 - DNA, 22 bp, Homo sapiens
ccagagtcccttgcagctcagt

SEQ ID NO: 9508945 - DNA, 22 bp, Homo sapiens
ccagagtcccttgcagctcagt

SEQ ID NO: 9508946 - DNA, 22 bp, Homo sapiens
ccagagtctatgagtcctcatt

SEQ ID NO: 9508947 - DNA, 22 bp, Homo sapiens
ccagagtctatgagtcctcatt

SEQ ID NO: 9508948 - DNA, 22 bp, Homo sapiens
ccagcaggcagtcatatccttt

SEQ ID NO: 9508949 - DNA, 22 bp, Homo sapiens
ccagcaggcagtcatatccttt

SEQ ID NO: 9508950 - DNA, 22 bp, Homo sapiens
ccagcagggaaaaacccaccaa

SEQ ID NO: 9508951 - DNA, 22 bp, Homo sapiens
ccagcagggaaaaacccaccaa

SEQ ID NO: 9508952 - DNA, 19 bp, Homo sapiens
aggcaggtgcagaggtccc

SEQ ID NO: 9508953 - DNA, 20 bp, Homo sapiens
ccagagctgatggctgcccg

SEQ ID NO: 9508954 - DNA, 20 bp, Homo sapiens
ccagagctgatggctgcccg

SEQ ID NO: 9508955 - DNA, 22 bp, Homo sapiens
ccagaggatgctggtcagcctc

SEQ ID NO: 9508956 - DNA, 22 bp, Homo sapiens
ccagaggatgctggtcagcctc

SEQ ID NO: 9508957 - DNA, 22 bp, Homo sapiens
ccagaggatgctggtcagcctc

SEQ ID NO: 9508958 - DNA, 22 bp, Homo sapiens
ccagaggcagacttacactcca

SEQ ID NO: 9508959 - DNA, 22 bp, Homo sapiens
ccagaggatgctggtcagcctc

SEQ ID NO: 9508960 - DNA, 22 bp, Homo sapiens
ccagaggcagacttacactcca

SEQ ID NO: 9508961 - DNA, 22 bp, Homo sapiens
ccagaggcatgttcaaagcaat

SEQ ID NO: 9508962 - DNA, 20 bp, Homo sapiens
ccactccaggtgattctgat

SEQ ID NO: 9508963 - DNA, 21 bp, Homo sapiens
ccactcatgactccactcacc

SEQ ID NO: 9508964 - DNA, 20 bp, Homo sapiens
ccactccaggtgattctgat

SEQ ID NO: 9508965 - DNA, 22 bp, Homo sapiens
ccactcccttccggtccagggc

SEQ ID NO: 9508966 - DNA, 22 bp, Homo sapiens
ccactcccttccggtccagggc

SEQ ID NO: 9508967 - DNA, 22 bp, Homo sapiens
aggcaggtagaaggatctttat

SEQ ID NO: 9508968 - DNA, 22 bp, Homo sapiens
aggcaggtcccctggaaggcac

SEQ ID NO: 9508969 - DNA, 22 bp, Homo sapiens
aggcaggtcccctggaaggcac

SEQ ID NO: 9508970 - DNA, 22 bp, Homo sapiens
aggcaggtgagtcaaaacagac

SEQ ID NO: 9508971 - DNA, 22 bp, Homo sapiens
aggcaggtcccctggaaggcac

SEQ ID NO: 9508972 - DNA, 22 bp, Homo sapiens
aggcaggtcccctggaaggcac

SEQ ID NO: 9508973 - DNA, 21 bp, Homo sapiens
ccagaggcctctcttggccac

SEQ ID NO: 9508974 - DNA, 21 bp, Homo sapiens
ccagaggcctctcttggccac

SEQ ID NO: 9508975 - DNA, 18 bp, Homo sapiens
ccagaggcccgggcaggc

SEQ ID NO: 9508976 - DNA, 18 bp, Homo sapiens
ccagaggcccgggcaggc

SEQ ID NO: 9508977 - DNA, 18 bp, Homo sapiens
ccagaggcccgggcaggc

SEQ ID NO: 9508978 - DNA, 20 bp, Homo sapiens
ccagaggctgacagactttg

SEQ ID NO: 9508979 - DNA, 20 bp, Homo sapiens
ccagaggctgacagactttg

SEQ ID NO: 9508980 - DNA, 20 bp, Homo sapiens
ccagaggctgacagactttg

SEQ ID NO: 9508981 - DNA, 22 bp, Homo sapiens
ccagaggctggcaagggctcct

SEQ ID NO: 9508982 - DNA, 22 bp, Homo sapiens
ccagaggctggcaagggctcct

SEQ ID NO: 9508983 - DNA, 22 bp, Homo sapiens
ccagagtcaggagctcatgtga

SEQ ID NO: 9508984 - DNA, 22 bp, Homo sapiens
ccagagtcaggagctcatgtga

SEQ ID NO: 9508985 - DNA, 19 bp, Homo sapiens
ccagagtcatgtctccccc

SEQ ID NO: 9508986 - DNA, 19 bp, Homo sapiens
ccagagtcatgtctccccc

SEQ ID NO: 9508987 - DNA, 21 bp, Homo sapiens
ccagaggttctgggcctccct

SEQ ID NO: 9508988 - DNA, 19 bp, Homo sapiens
ccagaggtttgctgggcct

SEQ ID NO: 9508989 - DNA, 22 bp, Homo sapiens
ccagaggtggtggtgtctagaa

SEQ ID NO: 9508990 - DNA, 22 bp, Homo sapiens
ccagaggttacaccctcagccc

SEQ ID NO: 9508991 - DNA, 22 bp, Homo sapiens
ccagaggtggtgggtgctacag

SEQ ID NO: 9508992 - DNA, 22 bp, Homo sapiens
cccacactctgagaaatgctga

SEQ ID NO: 9508993 - DNA, 18 bp, Homo sapiens
cccaccctggctcttagt

SEQ ID NO: 9508994 - DNA, 18 bp, Homo sapiens
cccaccctggctcttagt

SEQ ID NO: 9508995 - DNA, 22 bp, Homo sapiens
cccaccctgggaagctaggcag

SEQ ID NO: 9508996 - DNA, 22 bp, Homo sapiens
cccaccctgggaagctaggcag

SEQ ID NO: 9508997 - DNA, 22 bp, Homo sapiens
cccaccctgggctacacatcca

SEQ ID NO: 9508998 - DNA, 22 bp, Homo sapiens
cccaccctgggctacacatcca

SEQ ID NO: 9508999 - DNA, 22 bp, Homo sapiens
cccacctctcagagagccttgc

SEQ ID NO: 9509000 - DNA, 22 bp, Homo sapiens
cccacgtcgaacttgctccaga

SEQ ID NO: 9509001 - DNA, 22 bp, Homo sapiens
cccactccctacgacacgctcc

SEQ ID NO: 9509002 - DNA, 22 bp, Homo sapiens
cccactccctacgacacgctcc

SEQ ID NO: 9509003 - DNA, 22 bp, Homo sapiens
aggctgtgacagggtcatggag

SEQ ID NO: 9509004 - DNA, 22 bp, Homo sapiens
aggctgtgacagggtcatggag

SEQ ID NO: 9509005 - DNA, 22 bp, Homo sapiens
aggctgtgacagggtcatggag

SEQ ID NO: 9509006 - DNA, 22 bp, Homo sapiens
cccactccctgcacgcctgccg

SEQ ID NO: 9509007 - DNA, 22 bp, Homo sapiens
cccactccctgcacgcctgccg

SEQ ID NO: 9509008 - DNA, 22 bp, Homo sapiens
cccactctggctcccttctagt

SEQ ID NO: 9509009 - DNA, 22 bp, Homo sapiens
cccactcctggagctagggctc

SEQ ID NO: 9509010 - DNA, 22 bp, Homo sapiens
aggctgtgcacagggcacctgc

SEQ ID NO: 9509011 - DNA, 22 bp, Homo sapiens
aggctgtgactacgcagggaag

SEQ ID NO: 9509012 - DNA, 22 bp, Homo sapiens
aggctgtgactacgcagggaag

SEQ ID NO: 9509013 - DNA, 22 bp, Homo sapiens
aggctgtgactacgcagggaag

SEQ ID NO: 9509014 - DNA, 22 bp, Homo sapiens
aggctgtgcattttggagggcc

SEQ ID NO: 9509015 - DNA, 22 bp, Homo sapiens
aggctgtgcattttggagggcc

SEQ ID NO: 9509016 - DNA, 22 bp, Homo sapiens
cccagaggtgcttcagaggtgc

SEQ ID NO: 9509017 - DNA, 22 bp, Homo sapiens
cccagaggtgcttcagaggtgc

SEQ ID NO: 9509018 - DNA, 22 bp, Homo sapiens
cccagaggttccttagggacca

SEQ ID NO: 9509019 - DNA, 20 bp, Homo sapiens
cccagaggttgcggcaggag

SEQ ID NO: 9509020 - DNA, 20 bp, Homo sapiens
cccagaggttgcggcaggag

SEQ ID NO: 9509021 - DNA, 22 bp, Homo sapiens
cccagaggttccttagggacca

SEQ ID NO: 9509022 - DNA, 22 bp, Homo sapiens
cccagaggttccttagggacca

SEQ ID NO: 9509023 - DNA, 22 bp, Homo sapiens
cccagaggttccttagggacca

SEQ ID NO: 9509024 - DNA, 22 bp, Homo sapiens
cccagaggttccttagggacca

SEQ ID NO: 9509025 - DNA, 22 bp, Homo sapiens
cccagaggtgaaggaggtggga

SEQ ID NO: 9509026 - DNA, 22 bp, Homo sapiens
aggctgtggtgctgaaggaggg

SEQ ID NO: 9509027 - DNA, 22 bp, Homo sapiens
cccagaggtgaaggaggtggga

SEQ ID NO: 9509028 - DNA, 22 bp, Homo sapiens
cccagaggtgcttcagaggtgc

SEQ ID NO: 9509029 - DNA, 22 bp, Homo sapiens
cccagaggtgacatcccattct

SEQ ID NO: 9509030 - DNA, 22 bp, Homo sapiens
cccagaggtgacatcccattct

SEQ ID NO: 9509031 - DNA, 22 bp, Homo sapiens
cccagaggtgacatcccattct

SEQ ID NO: 9509032 - DNA, 22 bp, Homo sapiens
aggctgtggtgctgaaggaggg

SEQ ID NO: 9509033 - DNA, 22 bp, Homo sapiens
aggctgtggtgctgaaggaggg

SEQ ID NO: 9509034 - DNA, 22 bp, Homo sapiens
aggctgtggtgctgaaggaggg

SEQ ID NO: 9509035 - DNA, 22 bp, Homo sapiens
aggctgtggtgatgattgggtc

SEQ ID NO: 9509036 - DNA, 22 bp, Homo sapiens
aggctgtgggagttgagagtct

SEQ ID NO: 9509037 - DNA, 22 bp, Homo sapiens
aggctgtgggacagttaggaga

SEQ ID NO: 9509038 - DNA, 22 bp, Homo sapiens
aggctgtgggaatggctgcttg

SEQ ID NO: 9509039 - DNA, 22 bp, Homo sapiens
aggctgtgggaatggctgcttg

SEQ ID NO: 9509040 - DNA, 22 bp, Homo sapiens
aggctgtggccctggtctagca

SEQ ID NO: 9509041 - DNA, 22 bp, Homo sapiens
aggctgtgggaatggctgcttg

SEQ ID NO: 9509042 - DNA, 22 bp, Homo sapiens
aggctgtggccctggtctagca

SEQ ID NO: 9509043 - DNA, 22 bp, Homo sapiens
ccagtgggtaggccatggtgag

SEQ ID NO: 9509044 - DNA, 22 bp, Homo sapiens
ccagtgtattatttgagaaatt

SEQ ID NO: 9509045 - DNA, 19 bp, Homo sapiens
aggctgcccagtctctgcc

SEQ ID NO: 9509046 - DNA, 20 bp, Homo sapiens
aggctgccaggtctcacatc

SEQ ID NO: 9509047 - DNA, 22 bp, Homo sapiens
aggctgccctgccgccagtggg

SEQ ID NO: 9509048 - DNA, 19 bp, Homo sapiens
aggctgcccagtctctgcc

SEQ ID NO: 9509049 - DNA, 20 bp, Homo sapiens
aggctgccaggtctcacatc

SEQ ID NO: 9509050 - DNA, 22 bp, Homo sapiens
aggctgccagaagccttcagga

SEQ ID NO: 9509051 - DNA, 22 bp, Homo sapiens
aggctgcagtgcaggtaggatt

SEQ ID NO: 9509052 - DNA, 23 bp, Homo sapiens
aggctgcagaagaatagggtcat

SEQ ID NO: 9509053 - DNA, 22 bp, Homo sapiens
aggctgagtcgggaggatcact

SEQ ID NO: 9509054 - DNA, 22 bp, Homo sapiens
ccattttgtctgacttcttgct

SEQ ID NO: 9509055 - DNA, 22 bp, Homo sapiens
ccattttgtctgacttcttgct

SEQ ID NO: 9509056 - DNA, 22 bp, Homo sapiens
ccattttgtctcctgaaatcta

SEQ ID NO: 9509057 - DNA, 22 bp, Homo sapiens
cccaagttaaaattcagtgctc

SEQ ID NO: 9509058 - DNA, 22 bp, Homo sapiens
cccaagttaatttgtagctgaa

SEQ ID NO: 9509059 - DNA, 22 bp, Homo sapiens
cccaagttgcttgttccaagac

SEQ ID NO: 9509060 - DNA, 22 bp, Homo sapiens
ccattttattagtgacatttag

SEQ ID NO: 9509061 - DNA, 22 bp, Homo sapiens
ccagtgtgaacctcaccaccct

SEQ ID NO: 9509062 - DNA, 22 bp, Homo sapiens
ccagtgtgaccatctgttagct

SEQ ID NO: 9509063 - DNA, 22 bp, Homo sapiens
ccagtgtcttcagagtaaatct

SEQ ID NO: 9509064 - DNA, 22 bp, Homo sapiens
ccagtgtctagtcacaggtact

SEQ ID NO: 9509065 - DNA, 19 bp, Homo sapiens
ccagtgtctagcgcacagc

SEQ ID NO: 9509066 - DNA, 22 bp, Homo sapiens
ccagtgtctgtggtatagaaag

SEQ ID NO: 9509067 - DNA, 22 bp, Homo sapiens
ccagtgtcagaaagattatcct

SEQ ID NO: 9509068 - DNA, 22 bp, Homo sapiens
ccagtgtccttcctttccatgg

SEQ ID NO: 9509069 - DNA, 22 bp, Homo sapiens
ccagtgtctactgtggcatatc

SEQ ID NO: 9509070 - DNA, 22 bp, Homo sapiens
ccagtgtctagcagatgacagg

SEQ ID NO: 9509071 - DNA, 22 bp, Homo sapiens
cccacacatttttcacttaccg

SEQ ID NO: 9509072 - DNA, 22 bp, Homo sapiens
cccacacatttttcacttaccg

SEQ ID NO: 9509073 - DNA, 20 bp, Homo sapiens
cccacacccttcccacttgg

SEQ ID NO: 9509074 - DNA, 18 bp, Homo sapiens
cccacacagcagtagctc

SEQ ID NO: 9509075 - DNA, 18 bp, Homo sapiens
cccacacagcagtagctc

SEQ ID NO: 9509076 - DNA, 22 bp, Homo sapiens
cccaataaaattcattttcatt

SEQ ID NO: 9509077 - DNA, 22 bp, Homo sapiens
cccacacaaatcatggggagaa

SEQ ID NO: 9509078 - DNA, 22 bp, Homo sapiens
cccacacactggctgctgccaa

SEQ ID NO: 9509079 - DNA, 22 bp, Homo sapiens
cccacacacatttatgatagga

SEQ ID NO: 9509080 - DNA, 22 bp, Homo sapiens
cccacacacatttatgatagga

SEQ ID NO: 9509081 - DNA, 22 bp, Homo sapiens
aggctctggtgcagctgtaact

SEQ ID NO: 9509082 - DNA, 22 bp, Homo sapiens
aggctctggttcatcatgatgg

SEQ ID NO: 9509083 - DNA, 22 bp, Homo sapiens
aggctctggttggcaagtaaag

SEQ ID NO: 9509084 - DNA, 22 bp, Homo sapiens
aggctctgcttttctggatata

SEQ ID NO: 9509085 - DNA, 20 bp, Homo sapiens
aggctctgcctgcaggccca

SEQ ID NO: 9509086 - DNA, 22 bp, Homo sapiens
aggctctgggaagcagtgagtt

SEQ ID NO: 9509087 - DNA, 22 bp, Homo sapiens
aggctctgggaagcagtgagtt

SEQ ID NO: 9509088 - DNA, 22 bp, Homo sapiens
aggctctgggaagcagtgagtt

SEQ ID NO: 9509089 - DNA, 22 bp, Homo sapiens
aggctctgggaagcagtgagtt

SEQ ID NO: 9509090 - DNA, 22 bp, Homo sapiens
aggctcagcatctgattcatat

SEQ ID NO: 9509091 - DNA, 22 bp, Homo sapiens
aggctcagcccaaggtggagag

SEQ ID NO: 9509092 - DNA, 22 bp, Homo sapiens
aggctcagcccaaggtggagag

SEQ ID NO: 9509093 - DNA, 21 bp, Homo sapiens
aggctcagcaggtgtataaag

SEQ ID NO: 9509094 - DNA, 22 bp, Homo sapiens
aggctcagcccctgggaggaga

SEQ ID NO: 9509095 - DNA, 20 bp, Homo sapiens
aggctctgcctgcaggccca

SEQ ID NO: 9509096 - DNA, 20 bp, Homo sapiens
aggctctgcctgcaggccca

SEQ ID NO: 9509097 - DNA, 22 bp, Homo sapiens
aggctcagcccctgggaggaga

SEQ ID NO: 9509098 - DNA, 21 bp, Homo sapiens
ccaggcgagtttggactctcc

SEQ ID NO: 9509099 - DNA, 22 bp, Homo sapiens
ccaggcgtggcttcagcagccc

SEQ ID NO: 9509100 - DNA, 22 bp, Homo sapiens
aggctcagatccttgtgtcctg

SEQ ID NO: 9509101 - DNA, 22 bp, Homo sapiens
aggctcagatccttgtgtcctg

SEQ ID NO: 9509102 - DNA, 22 bp, Homo sapiens
ccaggccttctgaggacactct

SEQ ID NO: 9509103 - DNA, 22 bp, Homo sapiens
ccaggccttctgaggacactct

SEQ ID NO: 9509104 - DNA, 22 bp, Homo sapiens
ccaggcctttcttcttggtctg

SEQ ID NO: 9509105 - DNA, 22 bp, Homo sapiens
ccaggccttctgaggacactct

SEQ ID NO: 9509106 - DNA, 22 bp, Homo sapiens
ccaggccttccagtacgcagaa

SEQ ID NO: 9509107 - DNA, 22 bp, Homo sapiens
ccaggcctgtgttgtgtggagg

SEQ ID NO: 9509108 - DNA, 22 bp, Homo sapiens
ccaggcctgtgcaaggagggag

SEQ ID NO: 9509109 - DNA, 22 bp, Homo sapiens
ccaggcctgtgcaaggagggag

SEQ ID NO: 9509110 - DNA, 22 bp, Homo sapiens
ccaggcctcccttttccagcca

SEQ ID NO: 9509111 - DNA, 22 bp, Homo sapiens
ccaggcctcccttttccagcca

SEQ ID NO: 9509112 - DNA, 20 bp, Homo sapiens
ccaggcctgggcctgctcta

SEQ ID NO: 9509113 - DNA, 20 bp, Homo sapiens
ccaggcctgggcctgctcta

SEQ ID NO: 9509114 - DNA, 20 bp, Homo sapiens
ccaggcctgggcctgctcta

SEQ ID NO: 9509115 - DNA, 20 bp, Homo sapiens
ccaggcctgggcctgctcta

SEQ ID NO: 9509116 - DNA, 19 bp, Homo sapiens
aggctctgtaggagagggc

SEQ ID NO: 9509117 - DNA, 19 bp, Homo sapiens
aggctctgtaggagagggc

SEQ ID NO: 9509118 - DNA, 19 bp, Homo sapiens
aggctctgtaggagagggc

SEQ ID NO: 9509119 - DNA, 22 bp, Homo sapiens
ccagggcacttaggcccagccc

SEQ ID NO: 9509120 - DNA, 22 bp, Homo sapiens
ccagggcacttaggcccagccc

SEQ ID NO: 9509121 - DNA, 22 bp, Homo sapiens
ccagggcagaaaaagagggaat

SEQ ID NO: 9509122 - DNA, 22 bp, Homo sapiens
ccagggcagaaaaagagggaat

SEQ ID NO: 9509123 - DNA, 22 bp, Homo sapiens
ccagggcagaaaaagagggaat

SEQ ID NO: 9509124 - DNA, 22 bp, Homo sapiens
ccagggcagaaaaagagggaat

SEQ ID NO: 9509125 - DNA, 22 bp, Homo sapiens
ccagggcagaaaaagagggaat

SEQ ID NO: 9509126 - DNA, 22 bp, Homo sapiens
ccagggcagcagaattggggca

SEQ ID NO: 9509127 - DNA, 16 bp, Homo sapiens
ccaggtggggctgtga

SEQ ID NO: 9509128 - DNA, 22 bp, Homo sapiens
ccaggtgcaaactcccagcagg

SEQ ID NO: 9509129 - DNA, 22 bp, Homo sapiens
ccaggtgcactcaagacctgct

SEQ ID NO: 9509130 - DNA, 22 bp, Homo sapiens
ccagggcagccaacccagatgc

SEQ ID NO: 9509131 - DNA, 22 bp, Homo sapiens
ccagggcagccaacccagatgc

SEQ ID NO: 9509132 - DNA, 22 bp, Homo sapiens
ccagggcagaaaaagagggaat

SEQ ID NO: 9509133 - DNA, 20 bp, Homo sapiens
ccaggtggtgcctggagagg

SEQ ID NO: 9509134 - DNA, 22 bp, Homo sapiens
ccaggtggtgaaagtgggccct

SEQ ID NO: 9509135 - DNA, 18 bp, Homo sapiens
ccaggtggtgacagagat

SEQ ID NO: 9509136 - DNA, 22 bp, Homo sapiens
ccaggttggagttcagtggcgc

SEQ ID NO: 9509137 - DNA, 22 bp, Homo sapiens
ccaggttcaaatagctgtgtga

SEQ ID NO: 9509138 - DNA, 22 bp, Homo sapiens
ccaggttggagttcagtggcgc

SEQ ID NO: 9509139 - DNA, 22 bp, Homo sapiens
ccagtaatggaaatagcagttc

SEQ ID NO: 9509140 - DNA, 22 bp, Homo sapiens
ccagtactgtctccaatattcc

SEQ ID NO: 9509141 - DNA, 18 bp, Homo sapiens
ccagtacctcctcctctc

SEQ ID NO: 9509142 - DNA, 19 bp, Homo sapiens
ccagtagtatagcacagtc

SEQ ID NO: 9509143 - DNA, 22 bp, Homo sapiens
ccagtagttggacaaatagatt

SEQ ID NO: 9509144 - DNA, 22 bp, Homo sapiens
aggctgagtgctcccctagatg

SEQ ID NO: 9509145 - DNA, 22 bp, Homo sapiens
aggctgagtcgggaggatcact

SEQ ID NO: 9509146 - DNA, 21 bp, Homo sapiens
ccagtattatttctctatgta

SEQ ID NO: 9509147 - DNA, 17 bp, Homo sapiens
ccagtcacaccaccctt

SEQ ID NO: 9509148 - DNA, 22 bp, Homo sapiens
ccagtattgtgaaattgatgtc

SEQ ID NO: 9509149 - DNA, 22 bp, Homo sapiens
agctgtctccagatacaggatt

SEQ ID NO: 9509150 - DNA, 22 bp, Homo sapiens
agctggttgcttaacctctctg

SEQ ID NO: 9509151 - DNA, 22 bp, Homo sapiens
agctggttgtcattcagaattg

SEQ ID NO: 9509152 - DNA, 22 bp, Homo sapiens
agctggtttggggtagaggaca

SEQ ID NO: 9509153 - DNA, 22 bp, Homo sapiens
agctggtttggggtagaggaca

SEQ ID NO: 9509154 - DNA, 22 bp, Homo sapiens
agctgtatgcccaagatgctat

SEQ ID NO: 9509155 - DNA, 22 bp, Homo sapiens
agctgtaatataagcaatgaaa

SEQ ID NO: 9509156 - DNA, 22 bp, Homo sapiens
agctgtcaggcagaactgagct

SEQ ID NO: 9509157 - DNA, 22 bp, Homo sapiens
agctggttcagtttctgggcct

SEQ ID NO: 9509158 - DNA, 22 bp, Homo sapiens
agctggtgctgaagctcttgag

SEQ ID NO: 9509159 - DNA, 22 bp, Homo sapiens
agctggtggaagggagcccaaa

SEQ ID NO: 9509160 - DNA, 22 bp, Homo sapiens
caggcagtgtgacgctagggtt

SEQ ID NO: 9509161 - DNA, 22 bp, Homo sapiens
caggcagtggctcacagcaacc

SEQ ID NO: 9509162 - DNA, 22 bp, Homo sapiens
caggcaggtgcagattcctctt

SEQ ID NO: 9509163 - DNA, 22 bp, Homo sapiens
caggcaggtgcagattcctctt

SEQ ID NO: 9509164 - DNA, 22 bp, Homo sapiens
caggcaggtcagtgaagaagga

SEQ ID NO: 9509165 - DNA, 22 bp, Homo sapiens
caggcaggtcagtgaagaagga

SEQ ID NO: 9509166 - DNA, 22 bp, Homo sapiens
caggcaggtgcagattcctctt

SEQ ID NO: 9509167 - DNA, 22 bp, Homo sapiens
caggcagggagctggaaaggat

SEQ ID NO: 9509168 - DNA, 22 bp, Homo sapiens
caggcagggagctggaaaggat

SEQ ID NO: 9509169 - DNA, 22 bp, Homo sapiens
caggcagggagctggaaaggat

SEQ ID NO: 9509170 - DNA, 22 bp, Homo sapiens
caggcaggtcagtgaagaagga

SEQ ID NO: 9509171 - DNA, 22 bp, Homo sapiens
caggcaggtcagtgaagaagga

SEQ ID NO: 9509172 - DNA, 22 bp, Homo sapiens
caggcaggtcagtgaagaagga

SEQ ID NO: 9509173 - DNA, 22 bp, Homo sapiens
caggcaggtcagtgaagaagga

SEQ ID NO: 9509174 - DNA, 22 bp, Homo sapiens
caggcagctcaaccttgggagc

SEQ ID NO: 9509175 - DNA, 22 bp, Homo sapiens
caggcagctcaaccttgggagc

SEQ ID NO: 9509176 - DNA, 22 bp, Homo sapiens
caggcagggagctggaaaggat

SEQ ID NO: 9509177 - DNA, 22 bp, Homo sapiens
caggcagggagctggaaaggat

SEQ ID NO: 9509178 - DNA, 22 bp, Homo sapiens
caggcagcgctcgtggcctggc

SEQ ID NO: 9509179 - DNA, 22 bp, Homo sapiens
caggcagccttctcgtctcaca

SEQ ID NO: 9509180 - DNA, 22 bp, Homo sapiens
caggcagcctgcggtctgcaca

SEQ ID NO: 9509181 - DNA, 22 bp, Homo sapiens
caggcagcctgcggtctgcaca

SEQ ID NO: 9509182 - DNA, 22 bp, Homo sapiens
caggcagcctgcggtctgcaca

SEQ ID NO: 9509183 - DNA, 22 bp, Homo sapiens
agctgtctggaagttcctcatg

SEQ ID NO: 9509184 - DNA, 22 bp, Homo sapiens
agctgtctgtctcctgaggaga

SEQ ID NO: 9509185 - DNA, 22 bp, Homo sapiens
agctgtctgtctcctgaggaga

SEQ ID NO: 9509186 - DNA, 22 bp, Homo sapiens
agctgtctgtgaacacagcatt

SEQ ID NO: 9509187 - DNA, 22 bp, Homo sapiens
agctgtctgtgaacacagcatt

SEQ ID NO: 9509188 - DNA, 22 bp, Homo sapiens
agctgtctttcattacctcatt

SEQ ID NO: 9509189 - DNA, 22 bp, Homo sapiens
agctgtctttcattacctcatt

SEQ ID NO: 9509190 - DNA, 22 bp, Homo sapiens
agctgtctttctgcctcctgat

SEQ ID NO: 9509191 - DNA, 22 bp, Homo sapiens
caggcccagtgatcagggctct

SEQ ID NO: 9509192 - DNA, 22 bp, Homo sapiens
caggcccagtgatcagggctct

SEQ ID NO: 9509193 - DNA, 22 bp, Homo sapiens
agcttactgtaattaaaagact

SEQ ID NO: 9509194 - DNA, 22 bp, Homo sapiens
caggcccattctaggcttgcta

SEQ ID NO: 9509195 - DNA, 22 bp, Homo sapiens
caggcccatttgtagccacttt

SEQ ID NO: 9509196 - DNA, 21 bp, Homo sapiens
agcttacattaccattgttgc

SEQ ID NO: 9509197 - DNA, 22 bp, Homo sapiens
caggcccattctaggcttgcta

SEQ ID NO: 9509198 - DNA, 22 bp, Homo sapiens
caggctctgctgctacagctgt

SEQ ID NO: 9509199 - DNA, 22 bp, Homo sapiens
caggctctgctgctacagctgt

SEQ ID NO: 9509200 - DNA, 22 bp, Homo sapiens
caggctctgctgctacagctgt

SEQ ID NO: 9509201 - DNA, 21 bp, Homo sapiens
caggctctgctagaggagcct

SEQ ID NO: 9509202 - DNA, 22 bp, Homo sapiens
caggctctgctgctacagctgt

SEQ ID NO: 9509203 - DNA, 22 bp, Homo sapiens
caggctcttccatcctgctgag

SEQ ID NO: 9509204 - DNA, 22 bp, Homo sapiens
caggctctgctgctacagctgt

SEQ ID NO: 9509205 - DNA, 22 bp, Homo sapiens
agcttctagcccatccagcagg

SEQ ID NO: 9509206 - DNA, 22 bp, Homo sapiens
agcttccttggcgctgaggcct

SEQ ID NO: 9509207 - DNA, 22 bp, Homo sapiens
agcttccttggcgctgaggcct

SEQ ID NO: 9509208 - DNA, 22 bp, Homo sapiens
agcttctcagaagagtcctgta

SEQ ID NO: 9509209 - DNA, 21 bp, Homo sapiens
caggctctgctagaggagcct

SEQ ID NO: 9509210 - DNA, 21 bp, Homo sapiens
caggctctgctagaggagcct

SEQ ID NO: 9509211 - DNA, 22 bp, Homo sapiens
agcttctcagcttcagaactgt

SEQ ID NO: 9509212 - DNA, 21 bp, Homo sapiens
caggctctgctagaggagcct

SEQ ID NO: 9509213 - DNA, 22 bp, Homo sapiens
agcttcctgtcttctgcacaaa

SEQ ID NO: 9509214 - DNA, 21 bp, Homo sapiens
agcttcctgcagtgggaggtc

SEQ ID NO: 9509215 - DNA, 22 bp, Homo sapiens
agcttcctgtcttctgcacaaa

SEQ ID NO: 9509216 - DNA, 22 bp, Homo sapiens
agcttccttggcgctgaggcct

SEQ ID NO: 9509217 - DNA, 18 bp, Homo sapiens
agcttccctctgagaggg

SEQ ID NO: 9509218 - DNA, 22 bp, Homo sapiens
agcttcctacaaccatctcaga

SEQ ID NO: 9509219 - DNA, 23 bp, Homo sapiens
agcttcctagtgacctggagtct

SEQ ID NO: 9509220 - DNA, 22 bp, Homo sapiens
agcttcctcacctcagaggtct

SEQ ID NO: 9509221 - DNA, 22 bp, Homo sapiens
cagctgtgtatgagagcatgct

SEQ ID NO: 9509222 - DNA, 22 bp, Homo sapiens
cagctgtgtatgagagcatgct

SEQ ID NO: 9509223 - DNA, 22 bp, Homo sapiens
cagctgtgtatgagagcatgct

SEQ ID NO: 9509224 - DNA, 22 bp, Homo sapiens
cagctgtgtatgagagcatgct

SEQ ID NO: 9509225 - DNA, 22 bp, Homo sapiens
cagctgtgtctaattatggctg

SEQ ID NO: 9509226 - DNA, 22 bp, Homo sapiens
cagctgtccaaacacattaact

SEQ ID NO: 9509227 - DNA, 22 bp, Homo sapiens
cagctgttatgaggtgtacatg

SEQ ID NO: 9509228 - DNA, 22 bp, Homo sapiens
cagctgttcacatttccaaaac

SEQ ID NO: 9509229 - DNA, 22 bp, Homo sapiens
cagctgttactgaagtaaaatg

SEQ ID NO: 9509230 - DNA, 22 bp, Homo sapiens
cagctgttactctgagtaaatg

SEQ ID NO: 9509231 - DNA, 22 bp, Homo sapiens
cagctgtgtctaattatggctg

SEQ ID NO: 9509232 - DNA, 22 bp, Homo sapiens
cagctgttcctggaaggagacc

SEQ ID NO: 9509233 - DNA, 22 bp, Homo sapiens
cagctgttcagcaactcgcaga

SEQ ID NO: 9509234 - DNA, 22 bp, Homo sapiens
cagctgttcattgttgccaccc

SEQ ID NO: 9509235 - DNA, 22 bp, Homo sapiens
cagctggtgtcaggcactgcag

SEQ ID NO: 9509236 - DNA, 22 bp, Homo sapiens
cagctggtgtcaggcactgcag

SEQ ID NO: 9509237 - DNA, 22 bp, Homo sapiens
cagctggttatcagagaggcct

SEQ ID NO: 9509238 - DNA, 22 bp, Homo sapiens
cagctggttgaagaggagctgg

SEQ ID NO: 9509239 - DNA, 22 bp, Homo sapiens
cagctggttgaagaggagctgg

SEQ ID NO: 9509240 - DNA, 22 bp, Homo sapiens
cagctggttgaagaggagctgg

SEQ ID NO: 9509241 - DNA, 22 bp, Homo sapiens
cagctggttggaagggagctga

SEQ ID NO: 9509242 - DNA, 22 bp, Homo sapiens
cagctggtactcagttcttgtc

SEQ ID NO: 9509243 - DNA, 22 bp, Homo sapiens
cagctggtcaactgaatgaaca

SEQ ID NO: 9509244 - DNA, 22 bp, Homo sapiens
cagctggtgagcttagtagggt

SEQ ID NO: 9509245 - DNA, 22 bp, Homo sapiens
cagctggtactcagttcttgtc

SEQ ID NO: 9509246 - DNA, 22 bp, Homo sapiens
cagctgggtttagtggggtgtg

SEQ ID NO: 9509247 - DNA, 22 bp, Homo sapiens
caggactggaagtctcaagaga

SEQ ID NO: 9509248 - DNA, 22 bp, Homo sapiens
caggactggctcgcagtgggtg

SEQ ID NO: 9509249 - DNA, 22 bp, Homo sapiens
caggactggctcgcagtgggtg

SEQ ID NO: 9509250 - DNA, 22 bp, Homo sapiens
caggactgatgttcctccagcc

SEQ ID NO: 9509251 - DNA, 22 bp, Homo sapiens
caggactgaagggcacagggaa

SEQ ID NO: 9509252 - DNA, 22 bp, Homo sapiens
caggagcaaggagcagtgggat

SEQ ID NO: 9509253 - DNA, 22 bp, Homo sapiens
caggagcaaggagcagtgggat

SEQ ID NO: 9509254 - DNA, 22 bp, Homo sapiens
caggactggctcgcagtgggtg

SEQ ID NO: 9509255 - DNA, 22 bp, Homo sapiens
caggactggctcgcagtgggtg

SEQ ID NO: 9509256 - DNA, 22 bp, Homo sapiens
caggagaaacataattttctgg

SEQ ID NO: 9509257 - DNA, 22 bp, Homo sapiens
caggacagagcccagactgtgt

SEQ ID NO: 9509258 - DNA, 22 bp, Homo sapiens
cagctgttgatctcttaagcct

SEQ ID NO: 9509259 - DNA, 22 bp, Homo sapiens
cagctgttgcagcactgagaga

SEQ ID NO: 9509260 - DNA, 22 bp, Homo sapiens
cagctgttcttgggacagacag

SEQ ID NO: 9509261 - DNA, 22 bp, Homo sapiens
cagctgttcttgggacagacag

SEQ ID NO: 9509262 - DNA, 22 bp, Homo sapiens
cagctgttgactggtacatgaa

SEQ ID NO: 9509263 - DNA, 22 bp, Homo sapiens
caggacagagcccagactgtgt

SEQ ID NO: 9509264 - DNA, 22 bp, Homo sapiens
caggacctaactcacctgtctc

SEQ ID NO: 9509265 - DNA, 22 bp, Homo sapiens
caggacctgaagacaggcaggt

SEQ ID NO: 9509266 - DNA, 20 bp, Homo sapiens
caggacagcgcaatcggagg

SEQ ID NO: 9509267 - DNA, 20 bp, Homo sapiens
caggacagcgcaatcggagg

SEQ ID NO: 9509268 - DNA, 22 bp, Homo sapiens
caggaccccatattcactgaac

SEQ ID NO: 9509269 - DNA, 22 bp, Homo sapiens
caggaccccatattcactgaac

SEQ ID NO: 9509270 - DNA, 22 bp, Homo sapiens
caggatgggatgtagtgggccc

SEQ ID NO: 9509271 - DNA, 22 bp, Homo sapiens
caggatgggtgtcggccagcac

SEQ ID NO: 9509272 - DNA, 22 bp, Homo sapiens
caggatgggtgtcggccagcac

SEQ ID NO: 9509273 - DNA, 22 bp, Homo sapiens
caggatgggatgtagtgggccc

SEQ ID NO: 9509274 - DNA, 22 bp, Homo sapiens
caggatggtctcgatctcctga

SEQ ID NO: 9509275 - DNA, 22 bp, Homo sapiens
caggatgggtgtcggccagcac

SEQ ID NO: 9509276 - DNA, 22 bp, Homo sapiens
caggcacacagcacatggcctg

SEQ ID NO: 9509277 - DNA, 22 bp, Homo sapiens
caggcacacagcacatggcctg

SEQ ID NO: 9509278 - DNA, 22 bp, Homo sapiens
caggcacacatccgtgagagat

SEQ ID NO: 9509279 - DNA, 22 bp, Homo sapiens
caggcacacatccgtgagagat

SEQ ID NO: 9509280 - DNA, 22 bp, Homo sapiens
caggcacacatccgtgagagat

SEQ ID NO: 9509281 - DNA, 22 bp, Homo sapiens
caggcacacatccgtgagagat

SEQ ID NO: 9509282 - DNA, 22 bp, Homo sapiens
caggcacacaggctccctgggc

SEQ ID NO: 9509283 - DNA, 22 bp, Homo sapiens
caggcacacaggctccctgggc

SEQ ID NO: 9509284 - DNA, 22 bp, Homo sapiens
caggcacacaggctccctgggc

SEQ ID NO: 9509285 - DNA, 22 bp, Homo sapiens
caggcagagtgaggtggtctaa

SEQ ID NO: 9509286 - DNA, 22 bp, Homo sapiens
caggcagcctgcggtctgcaca

SEQ ID NO: 9509287 - DNA, 22 bp, Homo sapiens
caggcagagtgaggtggtctaa

SEQ ID NO: 9509288 - DNA, 22 bp, Homo sapiens
caggcagagtgaggtggtctaa

SEQ ID NO: 9509289 - DNA, 22 bp, Homo sapiens
caggcacacccactggtgcaga

SEQ ID NO: 9509290 - DNA, 22 bp, Homo sapiens
caggagcatgctgatgccagaa

SEQ ID NO: 9509291 - DNA, 22 bp, Homo sapiens
caggagccacattccaccttga

SEQ ID NO: 9509292 - DNA, 22 bp, Homo sapiens
caggagcaggcccaaggacaca

SEQ ID NO: 9509293 - DNA, 22 bp, Homo sapiens
caggagcaggcccaaggacaca

SEQ ID NO: 9509294 - DNA, 22 bp, Homo sapiens
caggagcatgctgatgccagaa

SEQ ID NO: 9509295 - DNA, 18 bp, Homo sapiens
caggagcaggagttgaac

SEQ ID NO: 9509296 - DNA, 18 bp, Homo sapiens
caggagcaggagttgaac

SEQ ID NO: 9509297 - DNA, 22 bp, Homo sapiens
caggagcagagggtggtcagca

SEQ ID NO: 9509298 - DNA, 22 bp, Homo sapiens
caggagcagagggtggtcagca

SEQ ID NO: 9509299 - DNA, 22 bp, Homo sapiens
caggagcagagggtggtcagca

SEQ ID NO: 9509300 - DNA, 22 bp, Homo sapiens
caggagcaaggagcagtgggat

SEQ ID NO: 9509301 - DNA, 22 bp, Homo sapiens
caggagcaaggagcagtgggat

SEQ ID NO: 9509302 - DNA, 22 bp, Homo sapiens
caggagcagagggtggtcagca

SEQ ID NO: 9509303 - DNA, 22 bp, Homo sapiens
caggagcagagggtggtcagca

SEQ ID NO: 9509304 - DNA, 22 bp, Homo sapiens
caggagtgaaatgaggcccagg

SEQ ID NO: 9509305 - DNA, 22 bp, Homo sapiens
caggagtctgttcctcatttgt

SEQ ID NO: 9509306 - DNA, 22 bp, Homo sapiens
agctttgaatgagtgcattgca

SEQ ID NO: 9509307 - DNA, 23 bp, Homo sapiens
agctttgaggactttaaaagata

SEQ ID NO: 9509308 - DNA, 19 bp, Homo sapiens
agctttgccaaaaacttag

SEQ ID NO: 9509309 - DNA, 19 bp, Homo sapiens
agctttggacttgcatttc

SEQ ID NO: 9509310 - DNA, 19 bp, Homo sapiens
agctttggacttgcatttc

SEQ ID NO: 9509311 - DNA, 22 bp, Homo sapiens
agctttgcttcttttccatagc

SEQ ID NO: 9509312 - DNA, 21 bp, Homo sapiens
agctttgctttgtactcattt

SEQ ID NO: 9509313 - DNA, 19 bp, Homo sapiens
agctttgccaaaaacttag

SEQ ID NO: 9509314 - DNA, 22 bp, Homo sapiens
agctttgaagtatttggtctcc

SEQ ID NO: 9509315 - DNA, 22 bp, Homo sapiens
agctttgaatctggtgtttgca

SEQ ID NO: 9509316 - DNA, 22 bp, Homo sapiens
agctttgaaaatccaaattaca

SEQ ID NO: 9509317 - DNA, 22 bp, Homo sapiens
agctttcttctagttgtacagt

SEQ ID NO: 9509318 - DNA, 22 bp, Homo sapiens
cagggcagtaacgggaacatct

SEQ ID NO: 9509319 - DNA, 22 bp, Homo sapiens
agctttctggttacagtcttca

SEQ ID NO: 9509320 - DNA, 22 bp, Homo sapiens
agctttctgtcacctgtgcttg

SEQ ID NO: 9509321 - DNA, 22 bp, Homo sapiens
agctttcttctagttgtacagt

SEQ ID NO: 9509322 - DNA, 22 bp, Homo sapiens
agctttcttctagttgtacagt

SEQ ID NO: 9509323 - DNA, 22 bp, Homo sapiens
agctttcttctagttgtacagt

SEQ ID NO: 9509324 - DNA, 22 bp, Homo sapiens
agctttggccctggaggttact

SEQ ID NO: 9509325 - DNA, 22 bp, Homo sapiens
agctttggctgtgttgctctgt

SEQ ID NO: 9509326 - DNA, 22 bp, Homo sapiens
agctttggatgatctttgatac

SEQ ID NO: 9509327 - DNA, 22 bp, Homo sapiens
agctttggatttcttatagccc

SEQ ID NO: 9509328 - DNA, 22 bp, Homo sapiens
agctttgggattcaggcaggaa

SEQ ID NO: 9509329 - DNA, 22 bp, Homo sapiens
agctttggcttctgttgaacct

SEQ ID NO: 9509330 - DNA, 22 bp, Homo sapiens
agctttggctgtgttgctctgt

SEQ ID NO: 9509331 - DNA, 22 bp, Homo sapiens
cagggctctgccttgagggatg

SEQ ID NO: 9509332 - DNA, 22 bp, Homo sapiens
cagggctctgccttgagggatg

SEQ ID NO: 9509333 - DNA, 20 bp, Homo sapiens
cagggctctgggcctggcct

SEQ ID NO: 9509334 - DNA, 22 bp, Homo sapiens
agctttgggcaaaggcttgtga

SEQ ID NO: 9509335 - DNA, 22 bp, Homo sapiens
cagggctggctcatgaaaagtt

SEQ ID NO: 9509336 - DNA, 22 bp, Homo sapiens
cagggctggctcatgaaaagtt

SEQ ID NO: 9509337 - DNA, 22 bp, Homo sapiens
cagggctggctgtggcaatctc

SEQ ID NO: 9509338 - DNA, 22 bp, Homo sapiens
cagggctggctgtggcaatctc

SEQ ID NO: 9509339 - DNA, 22 bp, Homo sapiens
cagggctggctgtggcaatctc

SEQ ID NO: 9509340 - DNA, 22 bp, Homo sapiens
cagggatgtgatgagctgagcc

SEQ ID NO: 9509341 - DNA, 22 bp, Homo sapiens
cagggatgtgatgagctgagcc

SEQ ID NO: 9509342 - DNA, 22 bp, Homo sapiens
cagggatgtgatgagctgagcc

SEQ ID NO: 9509343 - DNA, 22 bp, Homo sapiens
cagggatgtgatgagctgagcc

SEQ ID NO: 9509344 - DNA, 22 bp, Homo sapiens
cagggcaggatgctgtgattat

SEQ ID NO: 9509345 - DNA, 22 bp, Homo sapiens
cagggcaggatgctgtgattat

SEQ ID NO: 9509346 - DNA, 22 bp, Homo sapiens
caggctcttttggtggcaagga

SEQ ID NO: 9509347 - DNA, 22 bp, Homo sapiens
caggctcttttggtggcaagga

SEQ ID NO: 9509348 - DNA, 22 bp, Homo sapiens
caggctgaagtgcagtggtgtg

SEQ ID NO: 9509349 - DNA, 22 bp, Homo sapiens
caggctgaagtgcagtggtgtg

SEQ ID NO: 9509350 - DNA, 22 bp, Homo sapiens
caggctgacaactgagcatttt

SEQ ID NO: 9509351 - DNA, 22 bp, Homo sapiens
caggctcttccatcctgctgag

SEQ ID NO: 9509352 - DNA, 22 bp, Homo sapiens
caggctcttccatcctgctgag

SEQ ID NO: 9509353 - DNA, 22 bp, Homo sapiens
caggctcttccatcctgctgag

SEQ ID NO: 9509354 - DNA, 22 bp, Homo sapiens
caggctcttttggtggcaagga

SEQ ID NO: 9509355 - DNA, 22 bp, Homo sapiens
caggctcttttggtggcaagga

SEQ ID NO: 9509356 - DNA, 22 bp, Homo sapiens
cagggcagtaacgggaacatct

SEQ ID NO: 9509357 - DNA, 22 bp, Homo sapiens
cagggcagtaacgggaacatct

SEQ ID NO: 9509358 - DNA, 22 bp, Homo sapiens
cagggcagtaacgggaacatct

SEQ ID NO: 9509359 - DNA, 22 bp, Homo sapiens
cagggcagtaacgggaacatct

SEQ ID NO: 9509360 - DNA, 22 bp, Homo sapiens
cagggcagggccacaccccctg

SEQ ID NO: 9509361 - DNA, 22 bp, Homo sapiens
cagggcagggccacaccccctg

SEQ ID NO: 9509362 - DNA, 22 bp, Homo sapiens
cagggcagggccacaccccctg

SEQ ID NO: 9509363 - DNA, 22 bp, Homo sapiens
cagggcagggccacaccccctg

SEQ ID NO: 9509364 - DNA, 22 bp, Homo sapiens
cagggcaggatgctgtgattat

SEQ ID NO: 9509365 - DNA, 22 bp, Homo sapiens
cagggcagggagcttagaatga

SEQ ID NO: 9509366 - DNA, 22 bp, Homo sapiens
cagggcagggagcttagaatga

SEQ ID NO: 9509367 - DNA, 22 bp, Homo sapiens
cagggcagggatgttgcggcag

SEQ ID NO: 9509368 - DNA, 22 bp, Homo sapiens
cagggcagggatgttgcggcag

SEQ ID NO: 9509369 - DNA, 22 bp, Homo sapiens
cagggcagggatgttgcggcag

SEQ ID NO: 9509370 - DNA, 22 bp, Homo sapiens
cagggcagggatgttgcggcag

SEQ ID NO: 9509371 - DNA, 22 bp, Homo sapiens
cagggcagggatgttgcggcag

SEQ ID NO: 9509372 - DNA, 22 bp, Homo sapiens
aggaaaggcctttgcatttggt

SEQ ID NO: 9509373 - DNA, 22 bp, Homo sapiens
aggaaaggcctttgcatttggt

SEQ ID NO: 9509374 - DNA, 22 bp, Homo sapiens
aggaagaaaactaattagatgg

SEQ ID NO: 9509375 - DNA, 22 bp, Homo sapiens
aggaagaaaactaattagatgg

SEQ ID NO: 9509376 - DNA, 22 bp, Homo sapiens
aggaagaaaactaattagatgg

SEQ ID NO: 9509377 - DNA, 22 bp, Homo sapiens
aggaagaaaactaattagatgg

SEQ ID NO: 9509378 - DNA, 22 bp, Homo sapiens
aggaaaggattggcttctctgt

SEQ ID NO: 9509379 - DNA, 21 bp, Homo sapiens
aggaaaggccagcacgtaggg

SEQ ID NO: 9509380 - DNA, 21 bp, Homo sapiens
aggaaaggccagcacgtaggg

SEQ ID NO: 9509381 - DNA, 22 bp, Homo sapiens
aggaaaggcctcagcagaaacc

SEQ ID NO: 9509382 - DNA, 22 bp, Homo sapiens
aggaaaggcctcagcagaaacc

SEQ ID NO: 9509383 - DNA, 22 bp, Homo sapiens
aggaaaggcctcagcagaaacc

SEQ ID NO: 9509384 - DNA, 22 bp, Homo sapiens
aggaaaggcctcagcagaaacc

SEQ ID NO: 9509385 - DNA, 22 bp, Homo sapiens
aggaaaggcctcagcagaaacc

SEQ ID NO: 9509386 - DNA, 19 bp, Homo sapiens
aggaaaggatcaaaatagc

SEQ ID NO: 9509387 - DNA, 19 bp, Homo sapiens
aggaaaggatcaaaatagc

SEQ ID NO: 9509388 - DNA, 19 bp, Homo sapiens
aggaaaggatcaaaatagc

SEQ ID NO: 9509389 - DNA, 22 bp, Homo sapiens
aggaaaggattggcttctctgt

SEQ ID NO: 9509390 - DNA, 22 bp, Homo sapiens
aggaaaggattggcttctctgt

SEQ ID NO: 9509391 - DNA, 21 bp, Homo sapiens
aggaaaggaagtccccagggt

SEQ ID NO: 9509392 - DNA, 21 bp, Homo sapiens
aggaaaggaagtccccagggt

SEQ ID NO: 9509393 - DNA, 23 bp, Homo sapiens
cagggctgggcttggtgttaggc

SEQ ID NO: 9509394 - DNA, 22 bp, Homo sapiens
cagggctgggttaaaagcaggg

SEQ ID NO: 9509395 - DNA, 22 bp, Homo sapiens
cagggctggctgtggcaatctc

SEQ ID NO: 9509396 - DNA, 22 bp, Homo sapiens
cagggctggcttccaagttgtt

SEQ ID NO: 9509397 - DNA, 22 bp, Homo sapiens
cagggctggctgtggcaatctc

SEQ ID NO: 9509398 - DNA, 22 bp, Homo sapiens
cagggctggctgtggcaatctc

SEQ ID NO: 9509399 - DNA, 22 bp, Homo sapiens
cagggctgggttaaaagcaggg

SEQ ID NO: 9509400 - DNA, 23 bp, Homo sapiens
cagggctgggcttggtgttaggc

SEQ ID NO: 9509401 - DNA, 18 bp, Homo sapiens
cagggctgtggggtcact

SEQ ID NO: 9509402 - DNA, 22 bp, Homo sapiens
cagggctgttagctgctgctct

SEQ ID NO: 9509403 - DNA, 22 bp, Homo sapiens
cagggctgttagctgctgctct

SEQ ID NO: 9509404 - DNA, 22 bp, Homo sapiens
cagggctgttagctgctgctct

SEQ ID NO: 9509405 - DNA, 18 bp, Homo sapiens
cagggctgtggggtcact

SEQ ID NO: 9509406 - DNA, 18 bp, Homo sapiens
cagggctgtggggtcact

SEQ ID NO: 9509407 - DNA, 18 bp, Homo sapiens
cagggctgtggggtcact

SEQ ID NO: 9509408 - DNA, 18 bp, Homo sapiens
cagggctgtggggtcact

SEQ ID NO: 9509409 - DNA, 18 bp, Homo sapiens
cagggctgtggggtcact

SEQ ID NO: 9509410 - DNA, 22 bp, Homo sapiens
aggaagagctggaccagaggac

SEQ ID NO: 9509411 - DNA, 23 bp, Homo sapiens
aggaagaggcaatttctcttaga

SEQ ID NO: 9509412 - DNA, 22 bp, Homo sapiens
aggaagagctggaccagaggac

SEQ ID NO: 9509413 - DNA, 22 bp, Homo sapiens
aggaagagctggaccagaggac

SEQ ID NO: 9509414 - DNA, 23 bp, Homo sapiens
aggaagaggcaatttctcttaga

SEQ ID NO: 9509415 - DNA, 18 bp, Homo sapiens
cagggctgtggggtcact

SEQ ID NO: 9509416 - DNA, 22 bp, Homo sapiens
aggaagagcccgggtgacataa

SEQ ID NO: 9509417 - DNA, 22 bp, Homo sapiens
aggaagagcccgggtgacataa

SEQ ID NO: 9509418 - DNA, 22 bp, Homo sapiens
aggaagagcccgggtgacataa

SEQ ID NO: 9509419 - DNA, 22 bp, Homo sapiens
aggaagagcccgggtgacataa

SEQ ID NO: 9509420 - DNA, 22 bp, Homo sapiens
aggaagagcccgggtgacataa

SEQ ID NO: 9509421 - DNA, 22 bp, Homo sapiens
aggaagagctggaccagaggac

SEQ ID NO: 9509422 - DNA, 22 bp, Homo sapiens
aggaagagctggaccagaggac

SEQ ID NO: 9509423 - DNA, 22 bp, Homo sapiens
aggaagagctggaccagaggac

SEQ ID NO: 9509424 - DNA, 22 bp, Homo sapiens
aggaagagctggaccagaggac

SEQ ID NO: 9509425 - DNA, 22 bp, Homo sapiens
aggaagagctggaccagaggac

SEQ ID NO: 9509426 - DNA, 22 bp, Homo sapiens
aggaagagctggaccagaggac

SEQ ID NO: 9509427 - DNA, 22 bp, Homo sapiens
aggaagagctggaccagaggac

SEQ ID NO: 9509428 - DNA, 22 bp, Homo sapiens
caggtgtcaaaatactaagtgg

SEQ ID NO: 9509429 - DNA, 22 bp, Homo sapiens
caggtgtcaaaatactaagtgg

SEQ ID NO: 9509430 - DNA, 22 bp, Homo sapiens
caggtgtcaaaatactaagtgg

SEQ ID NO: 9509431 - DNA, 22 bp, Homo sapiens
caggtggttgtttggattctaa

SEQ ID NO: 9509432 - DNA, 22 bp, Homo sapiens
caggtggttatgaggaaggtga

SEQ ID NO: 9509433 - DNA, 22 bp, Homo sapiens
caggtggttgagagctgtaggc

SEQ ID NO: 9509434 - DNA, 22 bp, Homo sapiens
caggtgtctaattctcaccccc

SEQ ID NO: 9509435 - DNA, 21 bp, Homo sapiens
aggaagtggccagattgggaa

SEQ ID NO: 9509436 - DNA, 22 bp, Homo sapiens
aggaagtgctaagagaacatca

SEQ ID NO: 9509437 - DNA, 22 bp, Homo sapiens
caggtggtgcctccaggctggt

SEQ ID NO: 9509438 - DNA, 22 bp, Homo sapiens
caggtggtgcctcctcccttcc

SEQ ID NO: 9509439 - DNA, 22 bp, Homo sapiens
caggtgggattttgctgcttga

SEQ ID NO: 9509440 - DNA, 22 bp, Homo sapiens
cagggcttcgatggatggatgg

SEQ ID NO: 9509441 - DNA, 22 bp, Homo sapiens
cagggctgttagctgctgctct

SEQ ID NO: 9509442 - DNA, 22 bp, Homo sapiens
cagggctgttagctgctgctct

SEQ ID NO: 9509443 - DNA, 22 bp, Homo sapiens
aggacacagtggtggggaaaag

SEQ ID NO: 9509444 - DNA, 22 bp, Homo sapiens
aggacactgctgaggatcagat

SEQ ID NO: 9509445 - DNA, 22 bp, Homo sapiens
aggacacttaggttattcaact

SEQ ID NO: 9509446 - DNA, 22 bp, Homo sapiens
aggacacttgagagtccagtca

SEQ ID NO: 9509447 - DNA, 22 bp, Homo sapiens
aggacacttggctattgttcca

SEQ ID NO: 9509448 - DNA, 22 bp, Homo sapiens
aggacagacctaggactggagc

SEQ ID NO: 9509449 - DNA, 22 bp, Homo sapiens
aggacagacctaggactggagc

SEQ ID NO: 9509450 - DNA, 22 bp, Homo sapiens
aggacagacctaggactggagc

SEQ ID NO: 9509451 - DNA, 22 bp, Homo sapiens
aggacagagccctagtttcata

SEQ ID NO: 9509452 - DNA, 22 bp, Homo sapiens
aggacagacctaggactggagc

SEQ ID NO: 9509453 - DNA, 22 bp, Homo sapiens
aggacagagcctgtgcagaccg

SEQ ID NO: 9509454 - DNA, 22 bp, Homo sapiens
aggacagagcctgtgcagaccg

SEQ ID NO: 9509455 - DNA, 22 bp, Homo sapiens
aggaatgaactcgagtgatctg

SEQ ID NO: 9509456 - DNA, 22 bp, Homo sapiens
aggacaagacaaggaccagaga

SEQ ID NO: 9509457 - DNA, 22 bp, Homo sapiens
aggaatcccgcaccagctgctg

SEQ ID NO: 9509458 - DNA, 22 bp, Homo sapiens
aggaatattactttgcttttat

SEQ ID NO: 9509459 - DNA, 22 bp, Homo sapiens
aggaatatgagctgctgcagtg

SEQ ID NO: 9509460 - DNA, 22 bp, Homo sapiens
cagtaataaagctaagtatttc

SEQ ID NO: 9509461 - DNA, 22 bp, Homo sapiens
cagtaatagagtgccagggatg

SEQ ID NO: 9509462 - DNA, 22 bp, Homo sapiens
cagtaatagatttgagagtggt

SEQ ID NO: 9509463 - DNA, 22 bp, Homo sapiens
cagtaataacacagaaagtttg

SEQ ID NO: 9509464 - DNA, 22 bp, Homo sapiens
cagtaataacacagaaagtttg

SEQ ID NO: 9509465 - DNA, 22 bp, Homo sapiens
cagtaataacacagaaagtttg

SEQ ID NO: 9509466 - DNA, 22 bp, Homo sapiens
cagtaataagctggagggtgtg

SEQ ID NO: 9509467 - DNA, 22 bp, Homo sapiens
cagtaatagaggctttgagtct

SEQ ID NO: 9509468 - DNA, 22 bp, Homo sapiens
cagtaatacccctggctcaggt

SEQ ID NO: 9509469 - DNA, 22 bp, Homo sapiens
cagtatgttcttccaggacaga

SEQ ID NO: 9509470 - DNA, 22 bp, Homo sapiens
cagtatgtctactggacaaagt

SEQ ID NO: 9509471 - DNA, 22 bp, Homo sapiens
cagtatgtactcttatcatgta

SEQ ID NO: 9509472 - DNA, 22 bp, Homo sapiens
cagtatgtactcttatcatgta

SEQ ID NO: 9509473 - DNA, 22 bp, Homo sapiens
cagtatttcattcagaattgtt

SEQ ID NO: 9509474 - DNA, 22 bp, Homo sapiens
cagtatttcattcagaattgtt

SEQ ID NO: 9509475 - DNA, 22 bp, Homo sapiens
cagtatttcattcagaattgtt

SEQ ID NO: 9509476 - DNA, 22 bp, Homo sapiens
cagtatttcattcagaattgtt

SEQ ID NO: 9509477 - DNA, 22 bp, Homo sapiens
cagtatttatggcttgagtatt

SEQ ID NO: 9509478 - DNA, 22 bp, Homo sapiens
cagtatttatggcttgagtatt

SEQ ID NO: 9509479 - DNA, 22 bp, Homo sapiens
cagtatttatggcttgagtatt

SEQ ID NO: 9509480 - DNA, 22 bp, Homo sapiens
cagtatgtttgggagacatgac

SEQ ID NO: 9509481 - DNA, 22 bp, Homo sapiens
cagtatgtttattagaactgca

SEQ ID NO: 9509482 - DNA, 22 bp, Homo sapiens
cagtatgtttgggagacatgac

SEQ ID NO: 9509483 - DNA, 22 bp, Homo sapiens
cagtatttaggattaggagaga

SEQ ID NO: 9509484 - DNA, 22 bp, Homo sapiens
cagtatttaggattaggagaga

SEQ ID NO: 9509485 - DNA, 22 bp, Homo sapiens
cagtatttgttacagcattagc

SEQ ID NO: 9509486 - DNA, 22 bp, Homo sapiens
cagtatttgttacagcattagc

SEQ ID NO: 9509487 - DNA, 22 bp, Homo sapiens
cagtatttgttacagcattagc

SEQ ID NO: 9509488 - DNA, 22 bp, Homo sapiens
cagtatttggtaattggctacc

SEQ ID NO: 9509489 - DNA, 22 bp, Homo sapiens
cagtatttgttacagcattagc

SEQ ID NO: 9509490 - DNA, 22 bp, Homo sapiens
cagtatttgttacagcattagc

SEQ ID NO: 9509491 - DNA, 22 bp, Homo sapiens
cagtatttggaatatagctaag

SEQ ID NO: 9509492 - DNA, 22 bp, Homo sapiens
cagtatttggaatatagctaag

SEQ ID NO: 9509493 - DNA, 22 bp, Homo sapiens
cagtatttcctcttcttaactt

SEQ ID NO: 9509494 - DNA, 22 bp, Homo sapiens
cagtatttggaatatagctaag

SEQ ID NO: 9509495 - DNA, 21 bp, Homo sapiens
aggacagatgtaggaataaag

SEQ ID NO: 9509496 - DNA, 22 bp, Homo sapiens
aggacagagggaccagagccca

SEQ ID NO: 9509497 - DNA, 22 bp, Homo sapiens
aggacagagggaccagagccca

SEQ ID NO: 9509498 - DNA, 22 bp, Homo sapiens
aggacagagggaccagagccca

SEQ ID NO: 9509499 - DNA, 22 bp, Homo sapiens
aggacagagggaccagagccca

SEQ ID NO: 9509500 - DNA, 22 bp, Homo sapiens
aggacagagggaccagagccca

SEQ ID NO: 9509501 - DNA, 22 bp, Homo sapiens
aggacagagggaccagagccca

SEQ ID NO: 9509502 - DNA, 22 bp, Homo sapiens
aggacagagggaccagagccca

SEQ ID NO: 9509503 - DNA, 22 bp, Homo sapiens
cagtaaacagttactaagaaga

SEQ ID NO: 9509504 - DNA, 22 bp, Homo sapiens
cagtaaacactagcattcttgg

SEQ ID NO: 9509505 - DNA, 22 bp, Homo sapiens
aggacagcaaccgttattcaca

SEQ ID NO: 9509506 - DNA, 22 bp, Homo sapiens
cagtaaagcatgtatgtcttca

SEQ ID NO: 9509507 - DNA, 22 bp, Homo sapiens
cagtaacatgaagagacatgga

SEQ ID NO: 9509508 - DNA, 22 bp, Homo sapiens
cagtaacagtgatcacctgtgg

SEQ ID NO: 9509509 - DNA, 22 bp, Homo sapiens
cagtaacatgaagagacatgga

SEQ ID NO: 9509510 - DNA, 22 bp, Homo sapiens
cagtaacagtgatcacctgtgg

SEQ ID NO: 9509511 - DNA, 22 bp, Homo sapiens
cagtaacaggctctgtggtata

SEQ ID NO: 9509512 - DNA, 22 bp, Homo sapiens
cagtaacaggctctgtggtata

SEQ ID NO: 9509513 - DNA, 22 bp, Homo sapiens
cagtaacatgtctgttaagaaa

SEQ ID NO: 9509514 - DNA, 22 bp, Homo sapiens
cagtaacatgtctgttaagaaa

SEQ ID NO: 9509515 - DNA, 22 bp, Homo sapiens
cagtaacatttcaaggtagagg

SEQ ID NO: 9509516 - DNA, 22 bp, Homo sapiens
cagtaaattatctcatctctgt

SEQ ID NO: 9509517 - DNA, 22 bp, Homo sapiens
cagtaaatgtgatttttcttgt

SEQ ID NO: 9509518 - DNA, 22 bp, Homo sapiens
cagtaaatgtgatttttcttgt

SEQ ID NO: 9509519 - DNA, 22 bp, Homo sapiens
cagtaaatggtacgtatatttt

SEQ ID NO: 9509520 - DNA, 22 bp, Homo sapiens
catacaatcaagttctttatta

SEQ ID NO: 9509521 - DNA, 22 bp, Homo sapiens
catacaatcaagttctttatta

SEQ ID NO: 9509522 - DNA, 20 bp, Homo sapiens
catacactattctgtatagt

SEQ ID NO: 9509523 - DNA, 22 bp, Homo sapiens
catacaatcaagttctttatta

SEQ ID NO: 9509524 - DNA, 22 bp, Homo sapiens
catacaagcgttcaatagatgt

SEQ ID NO: 9509525 - DNA, 22 bp, Homo sapiens
catacaagcgttcaatagatgt

SEQ ID NO: 9509526 - DNA, 22 bp, Homo sapiens
catacaagcgttcaatagatgt

SEQ ID NO: 9509527 - DNA, 22 bp, Homo sapiens
catacaagcgtgcatgtgcttg

SEQ ID NO: 9509528 - DNA, 22 bp, Homo sapiens
catacatactgagtggactgat

SEQ ID NO: 9509529 - DNA, 22 bp, Homo sapiens
catacatactgagtggactgat

SEQ ID NO: 9509530 - DNA, 22 bp, Homo sapiens
catacagttttccctagatgtg

SEQ ID NO: 9509531 - DNA, 22 bp, Homo sapiens
catacataccactgctgtcttt

SEQ ID NO: 9509532 - DNA, 22 bp, Homo sapiens
catacagttttccctagatgtg

SEQ ID NO: 9509533 - DNA, 22 bp, Homo sapiens
catacagtgtggcatgtagtct

SEQ ID NO: 9509534 - DNA, 22 bp, Homo sapiens
catacagagaaggataataaag

SEQ ID NO: 9509535 - DNA, 22 bp, Homo sapiens
aggaggcctgttttctcctgga

SEQ ID NO: 9509536 - DNA, 22 bp, Homo sapiens
aggaggcctgtgtttgtctgta

SEQ ID NO: 9509537 - DNA, 22 bp, Homo sapiens
aggaggctctcaggtcctcccc

SEQ ID NO: 9509538 - DNA, 22 bp, Homo sapiens
aggaggcctggctggggagatc

SEQ ID NO: 9509539 - DNA, 22 bp, Homo sapiens
aggaggcctgcagctgccattc

SEQ ID NO: 9509540 - DNA, 22 bp, Homo sapiens
aggaggctgaactagggtctgg

SEQ ID NO: 9509541 - DNA, 22 bp, Homo sapiens
aggaggctctcaggtcctcccc

SEQ ID NO: 9509542 - DNA, 22 bp, Homo sapiens
aggaggctgaactagggtctgg

SEQ ID NO: 9509543 - DNA, 22 bp, Homo sapiens
aggaggctgaactagggtctgg

SEQ ID NO: 9509544 - DNA, 22 bp, Homo sapiens
aggaggctgaactagggtctgg

SEQ ID NO: 9509545 - DNA, 22 bp, Homo sapiens
cataatttttttaagtcagaac

SEQ ID NO: 9509546 - DNA, 22 bp, Homo sapiens
catacaaatgtgtccaggctct

SEQ ID NO: 9509547 - DNA, 22 bp, Homo sapiens
catacaaatgtgtccaggctct

SEQ ID NO: 9509548 - DNA, 22 bp, Homo sapiens
catacaaatgtgtccaggctct

SEQ ID NO: 9509549 - DNA, 22 bp, Homo sapiens
catcttcacatatttccaatga

SEQ ID NO: 9509550 - DNA, 22 bp, Homo sapiens
catcttcaggggctacatctgt

SEQ ID NO: 9509551 - DNA, 22 bp, Homo sapiens
catcttcaggggctacatctgt

SEQ ID NO: 9509552 - DNA, 22 bp, Homo sapiens
catcttcaccagagacaagcaa

SEQ ID NO: 9509553 - DNA, 22 bp, Homo sapiens
catcttcaccagagacaagcaa

SEQ ID NO: 9509554 - DNA, 22 bp, Homo sapiens
catctcttcattagcattattg

SEQ ID NO: 9509555 - DNA, 21 bp, Homo sapiens
catcttaattgaaagcagaga

SEQ ID NO: 9509556 - DNA, 21 bp, Homo sapiens
catcttaggttgtacatatat

SEQ ID NO: 9509557 - DNA, 22 bp, Homo sapiens
catcttaatttctaacaggcac

SEQ ID NO: 9509558 - DNA, 22 bp, Homo sapiens
catcttaatttctaacaggcac

SEQ ID NO: 9509559 - DNA, 22 bp, Homo sapiens
catctctggttcagtctctgtg

SEQ ID NO: 9509560 - DNA, 22 bp, Homo sapiens
catctctggttcagtctctgtg

SEQ ID NO: 9509561 - DNA, 22 bp, Homo sapiens
catctctgagacctcagctggg

SEQ ID NO: 9509562 - DNA, 19 bp, Homo sapiens
catctctgcaaggagctgc

SEQ ID NO: 9509563 - DNA, 19 bp, Homo sapiens
catctctgcaaggagctgc

SEQ ID NO: 9509564 - DNA, 22 bp, Homo sapiens
catctctgagacctcagctggg

SEQ ID NO: 9509565 - DNA, 19 bp, Homo sapiens
catctctgcaaggagctgc

SEQ ID NO: 9509566 - DNA, 19 bp, Homo sapiens
catctctgcaaggagctgc

SEQ ID NO: 9509567 - DNA, 22 bp, Homo sapiens
catccaaactctcattatctgt

SEQ ID NO: 9509568 - DNA, 22 bp, Homo sapiens
catacatatgtggatgtcatat

SEQ ID NO: 9509569 - DNA, 22 bp, Homo sapiens
catacatatgtggatgtcatat

SEQ ID NO: 9509570 - DNA, 22 bp, Homo sapiens
catctcatcctgccctaaaaca

SEQ ID NO: 9509571 - DNA, 22 bp, Homo sapiens
catctcatcagtgagagtcagc

SEQ ID NO: 9509572 - DNA, 22 bp, Homo sapiens
catctcatcagtgagagtcagc

SEQ ID NO: 9509573 - DNA, 22 bp, Homo sapiens
catctcatagtgcagtgctgta

SEQ ID NO: 9509574 - DNA, 22 bp, Homo sapiens
catctcagtgtacagggagtct

SEQ ID NO: 9509575 - DNA, 22 bp, Homo sapiens
catctcctggcagctgttagga

SEQ ID NO: 9509576 - DNA, 22 bp, Homo sapiens
catctccaggtttagggagcac

SEQ ID NO: 9509577 - DNA, 22 bp, Homo sapiens
catctcatgggcatgccaagct

SEQ ID NO: 9509578 - DNA, 22 bp, Homo sapiens
catgagcataaatcagtcacga

SEQ ID NO: 9509579 - DNA, 22 bp, Homo sapiens
catgagatttgggaggggccag

SEQ ID NO: 9509580 - DNA, 22 bp, Homo sapiens
catgagatttgggaggggccag

SEQ ID NO: 9509581 - DNA, 22 bp, Homo sapiens
catgagatttgggaggggccag

SEQ ID NO: 9509582 - DNA, 18 bp, Homo sapiens
catgagctgcccctagac

SEQ ID NO: 9509583 - DNA, 19 bp, Homo sapiens
catgaggcagctgcacccc

SEQ ID NO: 9509584 - DNA, 22 bp, Homo sapiens
catgaggtcagggggagccggt

SEQ ID NO: 9509585 - DNA, 22 bp, Homo sapiens
aggatttgttgagttttagtgg

SEQ ID NO: 9509586 - DNA, 22 bp, Homo sapiens
aggatttgttgagttttagtgg

SEQ ID NO: 9509587 - DNA, 22 bp, Homo sapiens
aggatttgtatagctttctttt

SEQ ID NO: 9509588 - DNA, 17 bp, Homo sapiens
aggatgtggagaaaatt

SEQ ID NO: 9509589 - DNA, 22 bp, Homo sapiens
catgagaatgaagaagacttaa

SEQ ID NO: 9509590 - DNA, 22 bp, Homo sapiens
catgagatttgggaggggccag

SEQ ID NO: 9509591 - DNA, 22 bp, Homo sapiens
catgagataatttttctccagt

SEQ ID NO: 9509592 - DNA, 22 bp, Homo sapiens
aggatgtgagtggacacagtcc

SEQ ID NO: 9509593 - DNA, 23 bp, Homo sapiens
aggatgtaggatgtatggcagag

SEQ ID NO: 9509594 - DNA, 23 bp, Homo sapiens
aggatgtaggatgtatggcagag

SEQ ID NO: 9509595 - DNA, 22 bp, Homo sapiens
aggatgggtcagctagagtcca

SEQ ID NO: 9509596 - DNA, 22 bp, Homo sapiens
aggatggggtctgcagcctggt

SEQ ID NO: 9509597 - DNA, 22 bp, Homo sapiens
aggatgggtcagctagagtcca

SEQ ID NO: 9509598 - DNA, 23 bp, Homo sapiens
aggatgtaggatgtatggcagag

SEQ ID NO: 9509599 - DNA, 23 bp, Homo sapiens
aggatgggtggcaatagaaagac

SEQ ID NO: 9509600 - DNA, 23 bp, Homo sapiens
aggatgggtggcaatagaaagac

SEQ ID NO: 9509601 - DNA, 22 bp, Homo sapiens
aggatggcttgcaggaggctgt

SEQ ID NO: 9509602 - DNA, 22 bp, Homo sapiens
aggatggcttgcaggaggctgt

SEQ ID NO: 9509603 - DNA, 22 bp, Homo sapiens
aggatgagagatacatggagca

SEQ ID NO: 9509604 - DNA, 22 bp, Homo sapiens
aggatgagagatacatggagca

SEQ ID NO: 9509605 - DNA, 22 bp, Homo sapiens
aggatgagagatacatggagca

SEQ ID NO: 9509606 - DNA, 22 bp, Homo sapiens
catcttctgggacttctcagtt

SEQ ID NO: 9509607 - DNA, 22 bp, Homo sapiens
catcttctgggacttctcagtt

SEQ ID NO: 9509608 - DNA, 22 bp, Homo sapiens
catcttcaggtgttttccatca

SEQ ID NO: 9509609 - DNA, 22 bp, Homo sapiens
catcttcaggttcatggtcata

SEQ ID NO: 9509610 - DNA, 22 bp, Homo sapiens
catcttcaggttcatggtcata

SEQ ID NO: 9509611 - DNA, 22 bp, Homo sapiens
catcttcagtgattacctaaaa

SEQ ID NO: 9509612 - DNA, 22 bp, Homo sapiens
catcttcataaaggaactgcat

SEQ ID NO: 9509613 - DNA, 22 bp, Homo sapiens
catcttcagtgattacctaaaa

SEQ ID NO: 9509614 - DNA, 22 bp, Homo sapiens
catcttcattttgtccagtact

SEQ ID NO: 9509615 - DNA, 22 bp, Homo sapiens
catcttgtgaatttctgattct

SEQ ID NO: 9509616 - DNA, 22 bp, Homo sapiens
catcttgggtaagcagttgctt

SEQ ID NO: 9509617 - DNA, 19 bp, Homo sapiens
catcttggagtactccttt

SEQ ID NO: 9509618 - DNA, 22 bp, Homo sapiens
catcttgcttcatctgctgtgt

SEQ ID NO: 9509619 - DNA, 22 bp, Homo sapiens
catcttgcttcatctgctgtgt

SEQ ID NO: 9509620 - DNA, 22 bp, Homo sapiens
catcttgcctgctattctgttg

SEQ ID NO: 9509621 - DNA, 22 bp, Homo sapiens
aggaggccgggattctggagat

SEQ ID NO: 9509622 - DNA, 22 bp, Homo sapiens
aggaggccgctgatgggctccc

SEQ ID NO: 9509623 - DNA, 22 bp, Homo sapiens
aggaggcctacgcacatgtcta

SEQ ID NO: 9509624 - DNA, 22 bp, Homo sapiens
aggaggcctacgcacatgtcta

SEQ ID NO: 9509625 - DNA, 22 bp, Homo sapiens
aggaggcctctatccagagaga

SEQ ID NO: 9509626 - DNA, 23 bp, Homo sapiens
aggaggcctgaaactgaggctga

SEQ ID NO: 9509627 - DNA, 22 bp, Homo sapiens
aggagctgtgaatgggaggggt

SEQ ID NO: 9509628 - DNA, 22 bp, Homo sapiens
aggagctgtgaatgggaggggt

SEQ ID NO: 9509629 - DNA, 22 bp, Homo sapiens
aggagctgtgaatgggaggggt

SEQ ID NO: 9509630 - DNA, 22 bp, Homo sapiens
aggaggcagatgcttggctgta

SEQ ID NO: 9509631 - DNA, 22 bp, Homo sapiens
aggaggccgctgatgggctccc

SEQ ID NO: 9509632 - DNA, 22 bp, Homo sapiens
aggaggccgctgatgggctccc

SEQ ID NO: 9509633 - DNA, 16 bp, Homo sapiens
aggagctgggtaggag

SEQ ID NO: 9509634 - DNA, 17 bp, Homo sapiens
aggagctgggggtggtg

SEQ ID NO: 9509635 - DNA, 17 bp, Homo sapiens
aggagctgggggtggtg

SEQ ID NO: 9509636 - DNA, 22 bp, Homo sapiens
aggagctggtagtctcattggg

SEQ ID NO: 9509637 - DNA, 22 bp, Homo sapiens
aggagctgggttcctttggtgg

SEQ ID NO: 9509638 - DNA, 22 bp, Homo sapiens
aggagctgtcatttgattcaca

SEQ ID NO: 9509639 - DNA, 22 bp, Homo sapiens
aggagctgtcagagtgccagag

SEQ ID NO: 9509640 - DNA, 22 bp, Homo sapiens
aggagctgtcagagtgccagag

SEQ ID NO: 9509641 - DNA, 22 bp, Homo sapiens
aggagctggtagtctcattggg

SEQ ID NO: 9509642 - DNA, 22 bp, Homo sapiens
aggagctgggttcctttggtgg

SEQ ID NO: 9509643 - DNA, 22 bp, Homo sapiens
aggagctgtcagagtgccagag

SEQ ID NO: 9509644 - DNA, 22 bp, Homo sapiens
aggagctgtcagagtgccagag

SEQ ID NO: 9509645 - DNA, 22 bp, Homo sapiens
cataactagagtgaaatgttga

SEQ ID NO: 9509646 - DNA, 22 bp, Homo sapiens
cataactggggacacttctcta

SEQ ID NO: 9509647 - DNA, 22 bp, Homo sapiens
cataactggggacacttctcta

SEQ ID NO: 9509648 - DNA, 22 bp, Homo sapiens
cataactagagtgaaatgttga

SEQ ID NO: 9509649 - DNA, 22 bp, Homo sapiens
cataactgggagatccaagggt

SEQ ID NO: 9509650 - DNA, 22 bp, Homo sapiens
cataacattgagcagcattcct

SEQ ID NO: 9509651 - DNA, 22 bp, Homo sapiens
cataagaaataatgatgatgac

SEQ ID NO: 9509652 - DNA, 22 bp, Homo sapiens
cataagaaataatgatgatgac

SEQ ID NO: 9509653 - DNA, 22 bp, Homo sapiens
cataagaaatttaacagaactt

SEQ ID NO: 9509654 - DNA, 22 bp, Homo sapiens
cataagaaatttaacagaactt

SEQ ID NO: 9509655 - DNA, 22 bp, Homo sapiens
cataagaatcttccagggcatg

SEQ ID NO: 9509656 - DNA, 19 bp, Homo sapiens
cataatacagtggatctga

SEQ ID NO: 9509657 - DNA, 22 bp, Homo sapiens
cataagaatatttagtggcagc

SEQ ID NO: 9509658 - DNA, 22 bp, Homo sapiens
cataagaatatttagtggcagc

SEQ ID NO: 9509659 - DNA, 22 bp, Homo sapiens
cataatatactacattgatgaa

SEQ ID NO: 9509660 - DNA, 22 bp, Homo sapiens
cataatatactacattgatgaa

SEQ ID NO: 9509661 - DNA, 22 bp, Homo sapiens
cataacatccttgctactttga

SEQ ID NO: 9509662 - DNA, 22 bp, Homo sapiens
cataacatccttgctactttga

SEQ ID NO: 9509663 - DNA, 22 bp, Homo sapiens
cataacatccttgctactttga

SEQ ID NO: 9509664 - DNA, 22 bp, Homo sapiens
cataacatccttgctactttga

SEQ ID NO: 9509665 - DNA, 22 bp, Homo sapiens
cataacatgtacatataaatgc

SEQ ID NO: 9509666 - DNA, 22 bp, Homo sapiens
cataacatgtacatataaatgc

SEQ ID NO: 9509667 - DNA, 22 bp, Homo sapiens
cataacattaagcctctatttc

SEQ ID NO: 9509668 - DNA, 22 bp, Homo sapiens
cataacattattttctgaagat

SEQ ID NO: 9509669 - DNA, 22 bp, Homo sapiens
cataacattaagcctctatttc

SEQ ID NO: 9509670 - DNA, 22 bp, Homo sapiens
cataacatgtacatataaatgc

SEQ ID NO: 9509671 - DNA, 22 bp, Homo sapiens
cataacatgtacatataaatgc

SEQ ID NO: 9509672 - DNA, 22 bp, Homo sapiens
cataacattaagcctctatttc

SEQ ID NO: 9509673 - DNA, 22 bp, Homo sapiens
cataacatgtacatataaatgc

SEQ ID NO: 9509674 - DNA, 22 bp, Homo sapiens
aggagccatccccatgagaggt

SEQ ID NO: 9509675 - DNA, 22 bp, Homo sapiens
aggagccagttccaccccagga

SEQ ID NO: 9509676 - DNA, 22 bp, Homo sapiens
aggagccagtggagttcctgcc

SEQ ID NO: 9509677 - DNA, 22 bp, Homo sapiens
cagttttatgtcgaatgtatac

SEQ ID NO: 9509678 - DNA, 22 bp, Homo sapiens
cagttttatgtcgaatgtatac

SEQ ID NO: 9509679 - DNA, 22 bp, Homo sapiens
cagttttatgtcgaatgtatac

SEQ ID NO: 9509680 - DNA, 22 bp, Homo sapiens
cagttttattggttgaaatctg

SEQ ID NO: 9509681 - DNA, 22 bp, Homo sapiens
cagttttatgtcgaatgtatac

SEQ ID NO: 9509682 - DNA, 22 bp, Homo sapiens
aggagccatccccatgagaggt

SEQ ID NO: 9509683 - DNA, 22 bp, Homo sapiens
aggagccatgagcaggaggcaa

SEQ ID NO: 9509684 - DNA, 20 bp, Homo sapiens
cagtccaggctgcagcatct

SEQ ID NO: 9509685 - DNA, 22 bp, Homo sapiens
cagtccagtccaatcctcaatg

SEQ ID NO: 9509686 - DNA, 22 bp, Homo sapiens
cagtgtgctatctggaagtctc

SEQ ID NO: 9509687 - DNA, 22 bp, Homo sapiens
cagtggttctcaatcaggaatg

SEQ ID NO: 9509688 - DNA, 22 bp, Homo sapiens
cagtggttcctgttcttctggg

SEQ ID NO: 9509689 - DNA, 22 bp, Homo sapiens
cagtgtgggtttgggaggagta

SEQ ID NO: 9509690 - DNA, 22 bp, Homo sapiens
cagtgtggcttagggaataggc

SEQ ID NO: 9509691 - DNA, 22 bp, Homo sapiens
cagtgtggagggagagagcctg

SEQ ID NO: 9509692 - DNA, 22 bp, Homo sapiens
cagtgtggagggagagagcctg

SEQ ID NO: 9509693 - DNA, 22 bp, Homo sapiens
cagtgtggctgagacagaggct

SEQ ID NO: 9509694 - DNA, 22 bp, Homo sapiens
cagtgtggctgagacagaggct

SEQ ID NO: 9509695 - DNA, 22 bp, Homo sapiens
cagtccagagcccaccagagga

SEQ ID NO: 9509696 - DNA, 22 bp, Homo sapiens
cagtccagagcccaccagagga

SEQ ID NO: 9509697 - DNA, 22 bp, Homo sapiens
cagtccagagtaccccaagaag

SEQ ID NO: 9509698 - DNA, 22 bp, Homo sapiens
cagtccagccagtagggtgtgg

SEQ ID NO: 9509699 - DNA, 22 bp, Homo sapiens
cagtccagccagtagggtgtgg

SEQ ID NO: 9509700 - DNA, 22 bp, Homo sapiens
cagtccagccccctgctaaaag

SEQ ID NO: 9509701 - DNA, 22 bp, Homo sapiens
cagtccagccccctgctaaaag

SEQ ID NO: 9509702 - DNA, 22 bp, Homo sapiens
cagtccagagtatatccgcttt

SEQ ID NO: 9509703 - DNA, 22 bp, Homo sapiens
cagtccaggcctggaggagcca

SEQ ID NO: 9509704 - DNA, 22 bp, Homo sapiens
cagtccaggcctggaggagcca

SEQ ID NO: 9509705 - DNA, 22 bp, Homo sapiens
cagtccaggcctggaggagcca

SEQ ID NO: 9509706 - DNA, 22 bp, Homo sapiens
cagtccagctcatcagtggcac

SEQ ID NO: 9509707 - DNA, 22 bp, Homo sapiens
cagtccaggcctggaggagcca

SEQ ID NO: 9509708 - DNA, 22 bp, Homo sapiens
cagtccagctcatcagtggcac

SEQ ID NO: 9509709 - DNA, 22 bp, Homo sapiens
cagtccagctcatcagtggcac

SEQ ID NO: 9509710 - DNA, 21 bp, Homo sapiens
cagtgtggtgaccagggtctc

SEQ ID NO: 9509711 - DNA, 22 bp, Homo sapiens
cagtgtggtgagattccaggtg

SEQ ID NO: 9509712 - DNA, 21 bp, Homo sapiens
cagtgtggtgaccagggtctc

SEQ ID NO: 9509713 - DNA, 21 bp, Homo sapiens
cagtgtggtgaccagggtctc

SEQ ID NO: 9509714 - DNA, 22 bp, Homo sapiens
cagtgtggtgagattccaggtg

SEQ ID NO: 9509715 - DNA, 22 bp, Homo sapiens
cagtgtgtctcttgtcctggct

SEQ ID NO: 9509716 - DNA, 22 bp, Homo sapiens
cagtgtgtgactctgggggtac

SEQ ID NO: 9509717 - DNA, 22 bp, Homo sapiens
cagtgtgtgactctgggggtac

SEQ ID NO: 9509718 - DNA, 22 bp, Homo sapiens
cagtgtgtttcatgtaggtcct

SEQ ID NO: 9509719 - DNA, 22 bp, Homo sapiens
cagtgttccctgaacatatgtt

SEQ ID NO: 9509720 - DNA, 21 bp, Homo sapiens
cagtgttgatatttaatacat

SEQ ID NO: 9509721 - DNA, 22 bp, Homo sapiens
cagtgttgctaagttctgaact

SEQ ID NO: 9509722 - DNA, 22 bp, Homo sapiens
aggagccacctaggagctgttt

SEQ ID NO: 9509723 - DNA, 22 bp, Homo sapiens
aggagccacttaggtgagataa

SEQ ID NO: 9509724 - DNA, 22 bp, Homo sapiens
cagtgtttaatcattgtgaatt

SEQ ID NO: 9509725 - DNA, 23 bp, Homo sapiens
aggagccaggaaccagcttcccc

SEQ ID NO: 9509726 - DNA, 22 bp, Homo sapiens
aggagccaggccccatggggct

SEQ ID NO: 9509727 - DNA, 22 bp, Homo sapiens
aggagccaggaaacctgctctg

SEQ ID NO: 9509728 - DNA, 22 bp, Homo sapiens
aggagccaggaaacctgctctg

SEQ ID NO: 9509729 - DNA, 23 bp, Homo sapiens
aggagccaggtgcagcccttgtg

SEQ ID NO: 9509730 - DNA, 23 bp, Homo sapiens
aggagccaggtgcagcccttgtg

SEQ ID NO: 9509731 - DNA, 22 bp, Homo sapiens
aggagccagggaagctgctttc

SEQ ID NO: 9509732 - DNA, 22 bp, Homo sapiens
aggagccaggccccatggggct

SEQ ID NO: 9509733 - DNA, 22 bp, Homo sapiens
aggagccaggccccatggggct

SEQ ID NO: 9509734 - DNA, 22 bp, Homo sapiens
aggagccagggaagctgctttc

SEQ ID NO: 9509735 - DNA, 22 bp, Homo sapiens
aggagccagcgttcctcaggat

SEQ ID NO: 9509736 - DNA, 21 bp, Homo sapiens
aggagccagcctgtcagtcta

SEQ ID NO: 9509737 - DNA, 22 bp, Homo sapiens
aggagccagcgttcctcaggat

SEQ ID NO: 9509738 - DNA, 22 bp, Homo sapiens
aggagccagaatccagactcgg

SEQ ID NO: 9509739 - DNA, 22 bp, Homo sapiens
aggagccagaatccagactcgg

SEQ ID NO: 9509740 - DNA, 22 bp, Homo sapiens
aggagccacttaggtgagataa

SEQ ID NO: 9509741 - DNA, 22 bp, Homo sapiens
aggcaggaggatcatggatgca

SEQ ID NO: 9509742 - DNA, 22 bp, Homo sapiens
aggcaggaggatcatggatgca

SEQ ID NO: 9509743 - DNA, 22 bp, Homo sapiens
aggcaggaggatcatggatgca

SEQ ID NO: 9509744 - DNA, 22 bp, Homo sapiens
aggcaggagtgaccctgacagg

SEQ ID NO: 9509745 - DNA, 22 bp, Homo sapiens
aggcaggagtgaccctgacagg

SEQ ID NO: 9509746 - DNA, 22 bp, Homo sapiens
aggcaggagtgaccctgacagg

SEQ ID NO: 9509747 - DNA, 22 bp, Homo sapiens
aggcaggagtgaccctgacagg

SEQ ID NO: 9509748 - DNA, 18 bp, Homo sapiens
aggcaggatcctggcctc

SEQ ID NO: 9509749 - DNA, 18 bp, Homo sapiens
aggcaggatcctggcctc

SEQ ID NO: 9509750 - DNA, 18 bp, Homo sapiens
aggcaggatcctggcctc

SEQ ID NO: 9509751 - DNA, 18 bp, Homo sapiens
aggcaggatcctggcctc

SEQ ID NO: 9509752 - DNA, 18 bp, Homo sapiens
aggcaggatcctggcctc

SEQ ID NO: 9509753 - DNA, 22 bp, Homo sapiens
ccacagtgcctggaattctgca

SEQ ID NO: 9509754 - DNA, 22 bp, Homo sapiens
ccacagtgcctggaattctgca

SEQ ID NO: 9509755 - DNA, 23 bp, Homo sapiens
ccacaggcacagaggcttgcatc

SEQ ID NO: 9509756 - DNA, 23 bp, Homo sapiens
ccacaggcacagaggcttgcatc

SEQ ID NO: 9509757 - DNA, 22 bp, Homo sapiens
aggcaggagcaagccctacaag

SEQ ID NO: 9509758 - DNA, 22 bp, Homo sapiens
aggcaggagcaagccctacaag

SEQ ID NO: 9509759 - DNA, 17 bp, Homo sapiens
aggcaggagattggaga

SEQ ID NO: 9509760 - DNA, 17 bp, Homo sapiens
aggcaggagattggaga

SEQ ID NO: 9509761 - DNA, 17 bp, Homo sapiens
aggcaggagattggaga

SEQ ID NO: 9509762 - DNA, 22 bp, Homo sapiens
aggcaggaaccctgtgtgcgcc

SEQ ID NO: 9509763 - DNA, 22 bp, Homo sapiens
aggcaggaaccctgtgtgcgcc

SEQ ID NO: 9509764 - DNA, 19 bp, Homo sapiens
ccacagagcatgctgaggc

SEQ ID NO: 9509765 - DNA, 19 bp, Homo sapiens
ccacagagcatgctgaggc

SEQ ID NO: 9509766 - DNA, 22 bp, Homo sapiens
ccacagagcattagatttcaga

SEQ ID NO: 9509767 - DNA, 22 bp, Homo sapiens
aggcaggaaaatcgcttgaacc

SEQ ID NO: 9509768 - DNA, 22 bp, Homo sapiens
aggcaggaaaatcgcttgaacc

SEQ ID NO: 9509769 - DNA, 22 bp, Homo sapiens
ccacagaccttggcttccacct

SEQ ID NO: 9509770 - DNA, 22 bp, Homo sapiens
ccacagaattctgtctccagga

SEQ ID NO: 9509771 - DNA, 22 bp, Homo sapiens
ccacagaatgatgacacttcag

SEQ ID NO: 9509772 - DNA, 22 bp, Homo sapiens
ccacagagactctgcaggactg

SEQ ID NO: 9509773 - DNA, 22 bp, Homo sapiens
ccacagagactctgcaggactg

SEQ ID NO: 9509774 - DNA, 22 bp, Homo sapiens
ccacagagactctgcaggactg

SEQ ID NO: 9509775 - DNA, 19 bp, Homo sapiens
ccacagagcatgctgaggc

SEQ ID NO: 9509776 - DNA, 19 bp, Homo sapiens
ccacagagactagaagaca

SEQ ID NO: 9509777 - DNA, 22 bp, Homo sapiens
catttctgggagacatgctaga

SEQ ID NO: 9509778 - DNA, 22 bp, Homo sapiens
catttctgttctcttcctgtac

SEQ ID NO: 9509779 - DNA, 22 bp, Homo sapiens
catttctgtgacacttccatct

SEQ ID NO: 9509780 - DNA, 22 bp, Homo sapiens
catttctgtcacgttcttttat

SEQ ID NO: 9509781 - DNA, 22 bp, Homo sapiens
catttgaaacctggaatctacc

SEQ ID NO: 9509782 - DNA, 22 bp, Homo sapiens
catttgaaaatactcttttcca

SEQ ID NO: 9509783 - DNA, 20 bp, Homo sapiens
ccacagtggagactggagac

SEQ ID NO: 9509784 - DNA, 20 bp, Homo sapiens
ccacagtggagactggagac

SEQ ID NO: 9509785 - DNA, 20 bp, Homo sapiens
ccacagtggagactggagac

SEQ ID NO: 9509786 - DNA, 22 bp, Homo sapiens
ccacagtgggcacagcaggact

SEQ ID NO: 9509787 - DNA, 22 bp, Homo sapiens
ccacagtggttctcaaccaggg

SEQ ID NO: 9509788 - DNA, 22 bp, Homo sapiens
ccacagtgtggcataaactgta

SEQ ID NO: 9509789 - DNA, 22 bp, Homo sapiens
ccacagtggttgtggcatgtgg

SEQ ID NO: 9509790 - DNA, 22 bp, Homo sapiens
ccacagtgttctttttaaaatt

SEQ ID NO: 9509791 - DNA, 22 bp, Homo sapiens
ccacagtgtggcataaactgta

SEQ ID NO: 9509792 - DNA, 22 bp, Homo sapiens
ccacagtgttttgtcacattag

SEQ ID NO: 9509793 - DNA, 22 bp, Homo sapiens
ccacagtggttgtggcatgtgg

SEQ ID NO: 9509794 - DNA, 23 bp, Homo sapiens
ccacagttcatcgttcactcacc

SEQ ID NO: 9509795 - DNA, 22 bp, Homo sapiens
ccacagtttcttcatctataaa

SEQ ID NO: 9509796 - DNA, 21 bp, Homo sapiens
ccaccaggtcttctgctcggg

SEQ ID NO: 9509797 - DNA, 21 bp, Homo sapiens
ccaccaggtcttctgctcggg

SEQ ID NO: 9509798 - DNA, 22 bp, Homo sapiens
ccaccatgggaagagagactaa

SEQ ID NO: 9509799 - DNA, 22 bp, Homo sapiens
ccaccattcaaggtcttcacag

SEQ ID NO: 9509800 - DNA, 22 bp, Homo sapiens
ccaccattatatctcccatgcc

SEQ ID NO: 9509801 - DNA, 22 bp, Homo sapiens
ccaccattatatctcccatgcc

SEQ ID NO: 9509802 - DNA, 22 bp, Homo sapiens
ccaccaggcactcacagggaag

SEQ ID NO: 9509803 - DNA, 21 bp, Homo sapiens
ccaccaggtcttctgctcggg

SEQ ID NO: 9509804 - DNA, 22 bp, Homo sapiens
ccaccaggctctgtccgagcgg

SEQ ID NO: 9509805 - DNA, 22 bp, Homo sapiens
ccacatcagaaatgtttactca

SEQ ID NO: 9509806 - DNA, 22 bp, Homo sapiens
ccacatctatctttagtatgaa

SEQ ID NO: 9509807 - DNA, 22 bp, Homo sapiens
ccacatctccctattgctcttt

SEQ ID NO: 9509808 - DNA, 22 bp, Homo sapiens
ccacatctaagccttcatgata

SEQ ID NO: 9509809 - DNA, 22 bp, Homo sapiens
ccacccagaccagggatctggg

SEQ ID NO: 9509810 - DNA, 22 bp, Homo sapiens
ccacccagaccagggatctggg

SEQ ID NO: 9509811 - DNA, 22 bp, Homo sapiens
ccacccagaccagggatctggg

SEQ ID NO: 9509812 - DNA, 22 bp, Homo sapiens
ccacccagaccagggatctggg

SEQ ID NO: 9509813 - DNA, 22 bp, Homo sapiens
ccacccagcagaggaggcaaga

SEQ ID NO: 9509814 - DNA, 22 bp, Homo sapiens
ccacccagcagaggaggcaaga

SEQ ID NO: 9509815 - DNA, 22 bp, Homo sapiens
ccacccagccagatgcaggaag

SEQ ID NO: 9509816 - DNA, 18 bp, Homo sapiens
ccacccagggggagagga

SEQ ID NO: 9509817 - DNA, 22 bp, Homo sapiens
ccacccagccagatgcaggaag

SEQ ID NO: 9509818 - DNA, 22 bp, Homo sapiens
ccacccagccagatgcaggaag

SEQ ID NO: 9509819 - DNA, 22 bp, Homo sapiens
ccacgaggctatcctgctaggg

SEQ ID NO: 9509820 - DNA, 22 bp, Homo sapiens
ccacgagggaaccaggtggggt

SEQ ID NO: 9509821 - DNA, 22 bp, Homo sapiens
ccacgagggaaccaggtggggt

SEQ ID NO: 9509822 - DNA, 22 bp, Homo sapiens
ccacgcatccctccacagagag

SEQ ID NO: 9509823 - DNA, 22 bp, Homo sapiens
ccacgtccagctaattttcgta

SEQ ID NO: 9509824 - DNA, 22 bp, Homo sapiens
ccactattactgtgtggcagtc

SEQ ID NO: 9509825 - DNA, 22 bp, Homo sapiens
aggcaagaacagacatgggagt

SEQ ID NO: 9509826 - DNA, 22 bp, Homo sapiens
aggcaagaaactttctgggaga

SEQ ID NO: 9509827 - DNA, 22 bp, Homo sapiens
aggcaagaaactttctgggaga

SEQ ID NO: 9509828 - DNA, 22 bp, Homo sapiens
aggcaagaacagacatgggagt

SEQ ID NO: 9509829 - DNA, 22 bp, Homo sapiens
aggcaagaacagacatgggagt

SEQ ID NO: 9509830 - DNA, 22 bp, Homo sapiens
aggcaagaacagacatgggagt

SEQ ID NO: 9509831 - DNA, 22 bp, Homo sapiens
aggcaagaacagacatgggagt

SEQ ID NO: 9509832 - DNA, 22 bp, Homo sapiens
aggcaagaccagaaagggctga

SEQ ID NO: 9509833 - DNA, 22 bp, Homo sapiens
aggcaagaccagaaagggctga

SEQ ID NO: 9509834 - DNA, 22 bp, Homo sapiens
aggcaacttttggggatgatgg

SEQ ID NO: 9509835 - DNA, 22 bp, Homo sapiens
aggcaactgtttgataatgttg

SEQ ID NO: 9509836 - DNA, 22 bp, Homo sapiens
aggcaactgacagtttctgctt

SEQ ID NO: 9509837 - DNA, 22 bp, Homo sapiens
aggcaactgacagcatatcctg

SEQ ID NO: 9509838 - DNA, 22 bp, Homo sapiens
aggcaactcatcatgaaagact

SEQ ID NO: 9509839 - DNA, 22 bp, Homo sapiens
aggcaagcagtcagtctatgag

SEQ ID NO: 9509840 - DNA, 23 bp, Homo sapiens
aggcaagggtgtaaaggaaatga

SEQ ID NO: 9509841 - DNA, 20 bp, Homo sapiens
aggcaaggtagatgtctgct

SEQ ID NO: 9509842 - DNA, 23 bp, Homo sapiens
aggcaagggtgtaaaggaaatga

SEQ ID NO: 9509843 - DNA, 23 bp, Homo sapiens
aggcaagggtgtaaaggaaatga

SEQ ID NO: 9509844 - DNA, 19 bp, Homo sapiens
cattcctttgtctgccaaa

SEQ ID NO: 9509845 - DNA, 22 bp, Homo sapiens
cattccttaacgtggggagtct

SEQ ID NO: 9509846 - DNA, 22 bp, Homo sapiens
cattgcctcggagcctgttatg

SEQ ID NO: 9509847 - DNA, 22 bp, Homo sapiens
cattgctgaatgagatcaaatc

SEQ ID NO: 9509848 - DNA, 22 bp, Homo sapiens
cattgctgacagatgaagagaa

SEQ ID NO: 9509849 - DNA, 22 bp, Homo sapiens
cattgcagtaatctggtgaaat

SEQ ID NO: 9509850 - DNA, 22 bp, Homo sapiens
cattgcttatttcagctaaagt

SEQ ID NO: 9509851 - DNA, 22 bp, Homo sapiens
cattgctgttatgcataattcc

SEQ ID NO: 9509852 - DNA, 22 bp, Homo sapiens
cattgcttatctagttcacata

SEQ ID NO: 9509853 - DNA, 22 bp, Homo sapiens
cattgctgtagtccagatgagg

SEQ ID NO: 9509854 - DNA, 22 bp, Homo sapiens
cattgctgcttccaggcacagg

SEQ ID NO: 9509855 - DNA, 22 bp, Homo sapiens
cattgctgccactggatatttc

SEQ ID NO: 9509856 - DNA, 22 bp, Homo sapiens
cattgcttgatagctgaaaatt

SEQ ID NO: 9509857 - DNA, 22 bp, Homo sapiens
cattgcttgatagctgaaaatt

SEQ ID NO: 9509858 - DNA, 22 bp, Homo sapiens
aggcaatgcagatagatgaatg

SEQ ID NO: 9509859 - DNA, 17 bp, Homo sapiens
aggcaatgactgtggtt

SEQ ID NO: 9509860 - DNA, 22 bp, Homo sapiens
aggcaataggttcctcatcttt

SEQ ID NO: 9509861 - DNA, 22 bp, Homo sapiens
aggcaataagcctcaactgtct

SEQ ID NO: 9509862 - DNA, 22 bp, Homo sapiens
aggcaatacacagcatttcaca

SEQ ID NO: 9509863 - DNA, 23 bp, Homo sapiens
aggcaatacaaggcatctctgga

SEQ ID NO: 9509864 - DNA, 22 bp, Homo sapiens
aggcaaggtgctacagacagtg

SEQ ID NO: 9509865 - DNA, 22 bp, Homo sapiens
aggcaaggtgctacagacagtg

SEQ ID NO: 9509866 - DNA, 22 bp, Homo sapiens
aggcaaggtgctacagacagtg

SEQ ID NO: 9509867 - DNA, 22 bp, Homo sapiens
aggcaaggtgctacagacagtg

SEQ ID NO: 9509868 - DNA, 22 bp, Homo sapiens
aggcaaggtgctacagacagtg

SEQ ID NO: 9509869 - DNA, 22 bp, Homo sapiens
aggcaaggtgctcttgctctat

SEQ ID NO: 9509870 - DNA, 22 bp, Homo sapiens
aggcaaggtgctcttgctctat

SEQ ID NO: 9509871 - DNA, 22 bp, Homo sapiens
aggcaagtgcattagaagagca

SEQ ID NO: 9509872 - DNA, 22 bp, Homo sapiens
catttcaatgccttcaacatag

SEQ ID NO: 9509873 - DNA, 22 bp, Homo sapiens
catttcaatgccttcaacatag

SEQ ID NO: 9509874 - DNA, 22 bp, Homo sapiens
catttcaatgccttcaacatag

SEQ ID NO: 9509875 - DNA, 22 bp, Homo sapiens
catttctcctgggtgataaatt

SEQ ID NO: 9509876 - DNA, 22 bp, Homo sapiens
catttctgattacagaatacta

SEQ ID NO: 9509877 - DNA, 22 bp, Homo sapiens
catttctcataatattagcact

SEQ ID NO: 9509878 - DNA, 22 bp, Homo sapiens
catttctcataatattagcact

SEQ ID NO: 9509879 - DNA, 22 bp, Homo sapiens
catttctcataatattagcact

SEQ ID NO: 9509880 - DNA, 22 bp, Homo sapiens
catttctccgccgagatcactg

SEQ ID NO: 9509881 - DNA, 22 bp, Homo sapiens
catttcacacataaacttgggt

SEQ ID NO: 9509882 - DNA, 22 bp, Homo sapiens
catttcaagtaacagattgctt

SEQ ID NO: 9509883 - DNA, 22 bp, Homo sapiens
catttcaagcattgacttctat

SEQ ID NO: 9509884 - DNA, 22 bp, Homo sapiens
catttcaagcattgacttctat

SEQ ID NO: 9509885 - DNA, 21 bp, Homo sapiens
catttcaaagagctggaaatc

SEQ ID NO: 9509886 - DNA, 22 bp, Homo sapiens
catttattggttaggccagcag

SEQ ID NO: 9509887 - DNA, 22 bp, Homo sapiens
aggcacttcatgggttcaagga

SEQ ID NO: 9509888 - DNA, 22 bp, Homo sapiens
aggcacttaataaggattcaat

SEQ ID NO: 9509889 - DNA, 22 bp, Homo sapiens
aggcacttgattaatgtgaatt

SEQ ID NO: 9509890 - DNA, 22 bp, Homo sapiens
aggcacttgcattgatgaggtc

SEQ ID NO: 9509891 - DNA, 22 bp, Homo sapiens
aggcacttggagttctttgccc

SEQ ID NO: 9509892 - DNA, 22 bp, Homo sapiens
aggcacttggaggtctctgccc

SEQ ID NO: 9509893 - DNA, 22 bp, Homo sapiens
aggcacttgtaattgcagtcat

SEQ ID NO: 9509894 - DNA, 22 bp, Homo sapiens
aggcacttgtaattgcagtcat

SEQ ID NO: 9509895 - DNA, 22 bp, Homo sapiens
aggcacttgtgactgtctgcat

SEQ ID NO: 9509896 - DNA, 22 bp, Homo sapiens
catttactgttgaatccctagc

SEQ ID NO: 9509897 - DNA, 22 bp, Homo sapiens
catttactgttgaatccctagc

SEQ ID NO: 9509898 - DNA, 22 bp, Homo sapiens
catttactgtaaaagattctct

SEQ ID NO: 9509899 - DNA, 22 bp, Homo sapiens
catttactgtaaaagattctct

SEQ ID NO: 9509900 - DNA, 22 bp, Homo sapiens
catttactgtaaaagattctct

SEQ ID NO: 9509901 - DNA, 21 bp, Homo sapiens
aggcactgtttgtggtttggg

SEQ ID NO: 9509902 - DNA, 21 bp, Homo sapiens
aggcactgtttgtggtttggg

SEQ ID NO: 9509903 - DNA, 21 bp, Homo sapiens
aggcactgtttgtggtttggg

SEQ ID NO: 9509904 - DNA, 20 bp, Homo sapiens
aggcactgttgtctgtatcc

SEQ ID NO: 9509905 - DNA, 22 bp, Homo sapiens
aggcactgtgggtgtggccgga

SEQ ID NO: 9509906 - DNA, 22 bp, Homo sapiens
aggcactgttcccagttatcct

SEQ ID NO: 9509907 - DNA, 22 bp, Homo sapiens
cattgtaagctgttgaatcctc

SEQ ID NO: 9509908 - DNA, 22 bp, Homo sapiens
cattgtaagctgttgaatcctc

SEQ ID NO: 9509909 - DNA, 22 bp, Homo sapiens
cattgtaagaggctttgcagca

SEQ ID NO: 9509910 - DNA, 22 bp, Homo sapiens
cattggtttgatattgccatgg

SEQ ID NO: 9509911 - DNA, 22 bp, Homo sapiens
cattggcacaagtagcttcatc

SEQ ID NO: 9509912 - DNA, 22 bp, Homo sapiens
cattggcacctcacaggataga

SEQ ID NO: 9509913 - DNA, 20 bp, Homo sapiens
cattggcattcacagaagct

SEQ ID NO: 9509914 - DNA, 22 bp, Homo sapiens
cattggccttttatcctagagg

SEQ ID NO: 9509915 - DNA, 22 bp, Homo sapiens
tgggcccaagagagtctccaac

SEQ ID NO: 9509916 - DNA, 22 bp, Homo sapiens
tgggcccaagtgcaatgcagtg

SEQ ID NO: 9509917 - DNA, 21 bp, Homo sapiens
tgggcccagctctgtctgttt

SEQ ID NO: 9509918 - DNA, 22 bp, Homo sapiens
tgggcccaggtcctgggagaag

SEQ ID NO: 9509919 - DNA, 21 bp, Homo sapiens
tgggcccagttcccgctgggc

SEQ ID NO: 9509920 - DNA, 18 bp, Homo sapiens
tgggctgcctggcctctg

SEQ ID NO: 9509921 - DNA, 18 bp, Homo sapiens
tgggctgcctggcctctg

SEQ ID NO: 9509922 - DNA, 18 bp, Homo sapiens
tgggctgcctggcctctg

SEQ ID NO: 9509923 - DNA, 22 bp, Homo sapiens
tgggctgcggataggcctcgga

SEQ ID NO: 9509924 - DNA, 22 bp, Homo sapiens
tgggctcctcgtcactcgctgt

SEQ ID NO: 9509925 - DNA, 22 bp, Homo sapiens
tgggctgctgtctgcacatgct

SEQ ID NO: 9509926 - DNA, 22 bp, Homo sapiens
tgggctgctgtctgcacatgct

SEQ ID NO: 9509927 - DNA, 22 bp, Homo sapiens
tgggctgctgcggtgctcttgg

SEQ ID NO: 9509928 - DNA, 22 bp, Homo sapiens
tgggctgctgagaatgagagag

SEQ ID NO: 9509929 - DNA, 22 bp, Homo sapiens
tgggctgctgcggtgctcttgg

SEQ ID NO: 9509930 - DNA, 22 bp, Homo sapiens
cctgagctgactctcctttcag

SEQ ID NO: 9509931 - DNA, 22 bp, Homo sapiens
cctgagctgactctcctttcag

SEQ ID NO: 9509932 - DNA, 22 bp, Homo sapiens
tggggaggaagtcagatttcag

SEQ ID NO: 9509933 - DNA, 22 bp, Homo sapiens
tggggagcccactcacctcccc

SEQ ID NO: 9509934 - DNA, 22 bp, Homo sapiens
cctgagctccagtagcagccag

SEQ ID NO: 9509935 - DNA, 22 bp, Homo sapiens
cctgagctctgcactttttaga

SEQ ID NO: 9509936 - DNA, 22 bp, Homo sapiens
cctgagctccagtagcagccag

SEQ ID NO: 9509937 - DNA, 22 bp, Homo sapiens
cctgagctcaagaaggtgacca

SEQ ID NO: 9509938 - DNA, 22 bp, Homo sapiens
cctgagctcaaagggtgcctgg

SEQ ID NO: 9509939 - DNA, 22 bp, Homo sapiens
cctgagctagggaaggaagacc

SEQ ID NO: 9509940 - DNA, 22 bp, Homo sapiens
cctgagctcaaagggtgcctgg

SEQ ID NO: 9509941 - DNA, 22 bp, Homo sapiens
tgggctggagcttgttgcttcc

SEQ ID NO: 9509942 - DNA, 22 bp, Homo sapiens
tgggctgcttctcaaatgtctc

SEQ ID NO: 9509943 - DNA, 22 bp, Homo sapiens
tgggctggagcttgttgcttcc

SEQ ID NO: 9509944 - DNA, 22 bp, Homo sapiens
tgggctggagcttgttgcttcc

SEQ ID NO: 9509945 - DNA, 22 bp, Homo sapiens
tgggctggagcttgttgcttcc

SEQ ID NO: 9509946 - DNA, 22 bp, Homo sapiens
tgggctgcttcctcagctgaga

SEQ ID NO: 9509947 - DNA, 22 bp, Homo sapiens
tgggctgcttcctcagctgaga

SEQ ID NO: 9509948 - DNA, 22 bp, Homo sapiens
tgggctggcccaccacacctcg

SEQ ID NO: 9509949 - DNA, 22 bp, Homo sapiens
cctgagcctggctcatgcactc

SEQ ID NO: 9509950 - DNA, 22 bp, Homo sapiens
tgggctggcccaccacacctcg

SEQ ID NO: 9509951 - DNA, 22 bp, Homo sapiens
tgggctggcccaccacacctcg

SEQ ID NO: 9509952 - DNA, 22 bp, Homo sapiens
tgggctggcccaccacacctcg

SEQ ID NO: 9509953 - DNA, 22 bp, Homo sapiens
tgggctggcccaccacacctcg

SEQ ID NO: 9509954 - DNA, 22 bp, Homo sapiens
cctgagcctggctcatgcactc

SEQ ID NO: 9509955 - DNA, 22 bp, Homo sapiens
cctgagcctggctcatgcactc

SEQ ID NO: 9509956 - DNA, 22 bp, Homo sapiens
cctgagcctggctcatgcactc

SEQ ID NO: 9509957 - DNA, 19 bp, Homo sapiens
cctcttcctctgacactat

SEQ ID NO: 9509958 - DNA, 17 bp, Homo sapiens
cctcttcctctcagctg

SEQ ID NO: 9509959 - DNA, 17 bp, Homo sapiens
cctcttcctctcagctg

SEQ ID NO: 9509960 - DNA, 22 bp, Homo sapiens
cctcttctaccatttacatttt

SEQ ID NO: 9509961 - DNA, 22 bp, Homo sapiens
cctcttctaggacgtccttgtg

SEQ ID NO: 9509962 - DNA, 22 bp, Homo sapiens
cctcttctaggacgtccttgtg

SEQ ID NO: 9509963 - DNA, 22 bp, Homo sapiens
cctcttctaggtttcagcctgc

SEQ ID NO: 9509964 - DNA, 22 bp, Homo sapiens
cctcttctaggtttcagcctgc

SEQ ID NO: 9509965 - DNA, 22 bp, Homo sapiens
tgggagtggggcatagaaggta

SEQ ID NO: 9509966 - DNA, 22 bp, Homo sapiens
tgggagtggggcatagaaggta

SEQ ID NO: 9509967 - DNA, 22 bp, Homo sapiens
tgggagtgttcttggcttgctt

SEQ ID NO: 9509968 - DNA, 22 bp, Homo sapiens
tgggagtgttcttggcttgctt

SEQ ID NO: 9509969 - DNA, 19 bp, Homo sapiens
tgggagtggggaaggtcct

SEQ ID NO: 9509970 - DNA, 19 bp, Homo sapiens
tgggagtggggaaggtcct

SEQ ID NO: 9509971 - DNA, 22 bp, Homo sapiens
tgggagtggggcatagaaggta

SEQ ID NO: 9509972 - DNA, 22 bp, Homo sapiens
tgggagtggggcatagaaggta

SEQ ID NO: 9509973 - DNA, 19 bp, Homo sapiens
tgggagtggggaaggtcct

SEQ ID NO: 9509974 - DNA, 19 bp, Homo sapiens
tgggagtggggaaggtcct

SEQ ID NO: 9509975 - DNA, 18 bp, Homo sapiens
tgggagtgggagtggata

SEQ ID NO: 9509976 - DNA, 18 bp, Homo sapiens
tgggagtgggagtggata

SEQ ID NO: 9509977 - DNA, 18 bp, Homo sapiens
tgggagtgggagtggata

SEQ ID NO: 9509978 - DNA, 18 bp, Homo sapiens
tgggagtgggagtggata

SEQ ID NO: 9509979 - DNA, 18 bp, Homo sapiens
tgggagtgggagtggata

SEQ ID NO: 9509980 - DNA, 19 bp, Homo sapiens
cctcttctctggcagcaga

SEQ ID NO: 9509981 - DNA, 22 bp, Homo sapiens
cctcttctcaactccagccaga

SEQ ID NO: 9509982 - DNA, 22 bp, Homo sapiens
tgggagtgttcttggcttgctt

SEQ ID NO: 9509983 - DNA, 23 bp, Homo sapiens
tgggagtgttgggatctctgctc

SEQ ID NO: 9509984 - DNA, 22 bp, Homo sapiens
cctgagatcagtgcatttggtg

SEQ ID NO: 9509985 - DNA, 21 bp, Homo sapiens
cctgagatctggagtggcttt

SEQ ID NO: 9509986 - DNA, 22 bp, Homo sapiens
cctgagagagaagcgacctggt

SEQ ID NO: 9509987 - DNA, 22 bp, Homo sapiens
cctgagaccaagttgcagccat

SEQ ID NO: 9509988 - DNA, 22 bp, Homo sapiens
tgggagtttgttagaaatgcag

SEQ ID NO: 9509989 - DNA, 22 bp, Homo sapiens
cctgagatggccagtgctggga

SEQ ID NO: 9509990 - DNA, 22 bp, Homo sapiens
cctgagcaaaggcccagaggga

SEQ ID NO: 9509991 - DNA, 22 bp, Homo sapiens
cctgagcaaaggaaggatgact

SEQ ID NO: 9509992 - DNA, 22 bp, Homo sapiens
cctgagcacacatcagaatcac

SEQ ID NO: 9509993 - DNA, 18 bp, Homo sapiens
cctgagccctgcttactt

SEQ ID NO: 9509994 - DNA, 22 bp, Homo sapiens
cctgagccgagcgctctttctc

SEQ ID NO: 9509995 - DNA, 22 bp, Homo sapiens
cctgagcctcttgcacgctcag

SEQ ID NO: 9509996 - DNA, 22 bp, Homo sapiens
cctgagccgagcgctctttctc

SEQ ID NO: 9509997 - DNA, 22 bp, Homo sapiens
cctgagcattagacatccatca

SEQ ID NO: 9509998 - DNA, 22 bp, Homo sapiens
cctgagccaagagtcagaatct

SEQ ID NO: 9509999 - DNA, 22 bp, Homo sapiens
cctgagcagggctctgcagggc

SEQ ID NO: 9510000 - DNA, 22 bp, Homo sapiens
cctgagcagggctctgcagggc

SEQ ID NO: 9510001 - DNA, 22 bp, Homo sapiens
cctgagcagggctctgcagggc

SEQ ID NO: 9510002 - DNA, 22 bp, Homo sapiens
cctgagcatcagcgcctcctta

SEQ ID NO: 9510003 - DNA, 22 bp, Homo sapiens
cctgagcatcagcgcctcctta

SEQ ID NO: 9510004 - DNA, 22 bp, Homo sapiens
cctgagcattagacatccatca

SEQ ID NO: 9510005 - DNA, 22 bp, Homo sapiens
cctgagcctgcagccgagcaga

SEQ ID NO: 9510006 - DNA, 22 bp, Homo sapiens
tgggccatttttggaagactgg

SEQ ID NO: 9510007 - DNA, 22 bp, Homo sapiens
tgggcccaagagagtctccaac

SEQ ID NO: 9510008 - DNA, 22 bp, Homo sapiens
cctgagcctgagtggtgcaggg

SEQ ID NO: 9510009 - DNA, 22 bp, Homo sapiens
cctgagcctgagtggtgcaggg

SEQ ID NO: 9510010 - DNA, 22 bp, Homo sapiens
cctgagcctgagtggtgcaggg

SEQ ID NO: 9510011 - DNA, 22 bp, Homo sapiens
cctgagcctgagtggtgcaggg

SEQ ID NO: 9510012 - DNA, 22 bp, Homo sapiens
cctgagcctcttgcacgctcag

SEQ ID NO: 9510013 - DNA, 22 bp, Homo sapiens
tggctgagagaagacggggaag

SEQ ID NO: 9510014 - DNA, 22 bp, Homo sapiens
tggctgagagaagacggggaag

SEQ ID NO: 9510015 - DNA, 22 bp, Homo sapiens
tggctgagaccatcagggtgta

SEQ ID NO: 9510016 - DNA, 22 bp, Homo sapiens
tggctgagaccttcccaaattc

SEQ ID NO: 9510017 - DNA, 22 bp, Homo sapiens
tggctgagaccatcagggtgta

SEQ ID NO: 9510018 - DNA, 16 bp, Homo sapiens
tggctgagagagggtt

SEQ ID NO: 9510019 - DNA, 16 bp, Homo sapiens
tggctgagagagggtt

SEQ ID NO: 9510020 - DNA, 22 bp, Homo sapiens
tggctgctagccagagcttcag

SEQ ID NO: 9510021 - DNA, 16 bp, Homo sapiens
tggctgagagagggtt

SEQ ID NO: 9510022 - DNA, 22 bp, Homo sapiens
tggctgctcaagggaggaggct

SEQ ID NO: 9510023 - DNA, 22 bp, Homo sapiens
tggctggctagtgggcaggatt

SEQ ID NO: 9510024 - DNA, 22 bp, Homo sapiens
tggctggctggaccacacctgc

SEQ ID NO: 9510025 - DNA, 18 bp, Homo sapiens
tggctggctctgtcatct

SEQ ID NO: 9510026 - DNA, 22 bp, Homo sapiens
tggctggctggaccacacctgc

SEQ ID NO: 9510027 - DNA, 18 bp, Homo sapiens
tggctggctctgtcatct

SEQ ID NO: 9510028 - DNA, 18 bp, Homo sapiens
tggctggctctgtcatct

SEQ ID NO: 9510029 - DNA, 22 bp, Homo sapiens
tggctggctagtgggcaggatt

SEQ ID NO: 9510030 - DNA, 22 bp, Homo sapiens
tggctgagaccatcagggtgta

SEQ ID NO: 9510031 - DNA, 22 bp, Homo sapiens
tggctgagaccatcagggtgta

SEQ ID NO: 9510032 - DNA, 22 bp, Homo sapiens
tggctgagaagttctggtggga

SEQ ID NO: 9510033 - DNA, 22 bp, Homo sapiens
tggctgagaatgggatgatgcc

SEQ ID NO: 9510034 - DNA, 22 bp, Homo sapiens
tggctgagaagttctggtggga

SEQ ID NO: 9510035 - DNA, 19 bp, Homo sapiens
tggctctgtcgaaggcaca

SEQ ID NO: 9510036 - DNA, 17 bp, Homo sapiens
tggctctgtcctcagct

SEQ ID NO: 9510037 - DNA, 17 bp, Homo sapiens
tggctctgtcctcagct

SEQ ID NO: 9510038 - DNA, 17 bp, Homo sapiens
tggctctgtcctcagct

SEQ ID NO: 9510039 - DNA, 17 bp, Homo sapiens
tggctctgtcctcagct

SEQ ID NO: 9510040 - DNA, 17 bp, Homo sapiens
tggctctgtcctcagct

SEQ ID NO: 9510041 - DNA, 17 bp, Homo sapiens
tggcttcaggctgagca

SEQ ID NO: 9510042 - DNA, 22 bp, Homo sapiens
tggcttcatggcaagtcttagt

SEQ ID NO: 9510043 - DNA, 20 bp, Homo sapiens
tggcttcataatggtttctg

SEQ ID NO: 9510044 - DNA, 22 bp, Homo sapiens
tggcttcattattgtttttcct

SEQ ID NO: 9510045 - DNA, 22 bp, Homo sapiens
tggcttcattctgtagttaaaa

SEQ ID NO: 9510046 - DNA, 22 bp, Homo sapiens
tggctggctttcttgtatttac

SEQ ID NO: 9510047 - DNA, 22 bp, Homo sapiens
tggctgggagctggaactgggc

SEQ ID NO: 9510048 - DNA, 22 bp, Homo sapiens
tggctgggagctggaactgggc

SEQ ID NO: 9510049 - DNA, 22 bp, Homo sapiens
tggctggcttgttcactgactg

SEQ ID NO: 9510050 - DNA, 22 bp, Homo sapiens
tggctggcttgttcactgactg

SEQ ID NO: 9510051 - DNA, 22 bp, Homo sapiens
tggctggcttgttcactgactg

SEQ ID NO: 9510052 - DNA, 20 bp, Homo sapiens
tggctggcttgtatttcctt

SEQ ID NO: 9510053 - DNA, 22 bp, Homo sapiens
tggctggctggaccacacctgc

SEQ ID NO: 9510054 - DNA, 22 bp, Homo sapiens
tggctggctgtcaaggaaagcc

SEQ ID NO: 9510055 - DNA, 22 bp, Homo sapiens
tggctggctgtcaaggaaagcc

SEQ ID NO: 9510056 - DNA, 22 bp, Homo sapiens
tggctggctgtcaaggaaagcc

SEQ ID NO: 9510057 - DNA, 22 bp, Homo sapiens
tggctggctgtcagtaggctgt

SEQ ID NO: 9510058 - DNA, 22 bp, Homo sapiens
tggctggctgtccagctgggca

SEQ ID NO: 9510059 - DNA, 22 bp, Homo sapiens
tggctggctgtccagctgggca

SEQ ID NO: 9510060 - DNA, 22 bp, Homo sapiens
tggctggctgtccagctgggca

SEQ ID NO: 9510061 - DNA, 22 bp, Homo sapiens
cctctggaggctctaagagaga

SEQ ID NO: 9510062 - DNA, 22 bp, Homo sapiens
cctctggaggctctaagagaga

SEQ ID NO: 9510063 - DNA, 22 bp, Homo sapiens
tgggaagctactcatgcaggca

SEQ ID NO: 9510064 - DNA, 22 bp, Homo sapiens
cctctggacttgggacagtgag

SEQ ID NO: 9510065 - DNA, 22 bp, Homo sapiens
cctctggacttgggacagtgag

SEQ ID NO: 9510066 - DNA, 22 bp, Homo sapiens
tgggaagctgcattttaacaag

SEQ ID NO: 9510067 - DNA, 22 bp, Homo sapiens
tgggaagctactcatgcaggca

SEQ ID NO: 9510068 - DNA, 22 bp, Homo sapiens
tgggaagctgcattttaacaag

SEQ ID NO: 9510069 - DNA, 22 bp, Homo sapiens
tgggaaggaatggtgattaata

SEQ ID NO: 9510070 - DNA, 22 bp, Homo sapiens
tgggaaggacagaacataattg

SEQ ID NO: 9510071 - DNA, 22 bp, Homo sapiens
tgggaaggacagaacataattg

SEQ ID NO: 9510072 - DNA, 22 bp, Homo sapiens
tgggaaggaactgcctttagct

SEQ ID NO: 9510073 - DNA, 22 bp, Homo sapiens
tgggaaggaatggtgattaata

SEQ ID NO: 9510074 - DNA, 22 bp, Homo sapiens
tgggaaggaactgcctttagct

SEQ ID NO: 9510075 - DNA, 22 bp, Homo sapiens
tgggaaggaactgcctttagct

SEQ ID NO: 9510076 - DNA, 22 bp, Homo sapiens
tgggaaggcagtcactgtccta

SEQ ID NO: 9510077 - DNA, 22 bp, Homo sapiens
tgggaaggcagtcactgtccta

SEQ ID NO: 9510078 - DNA, 22 bp, Homo sapiens
tgggaaggcagtcactgtccta

SEQ ID NO: 9510079 - DNA, 22 bp, Homo sapiens
cctctgtggccttggaccagct

SEQ ID NO: 9510080 - DNA, 22 bp, Homo sapiens
cctctgtggccttggaccagct

SEQ ID NO: 9510081 - DNA, 19 bp, Homo sapiens
cctctgtgggagtcagtga

SEQ ID NO: 9510082 - DNA, 22 bp, Homo sapiens
cctcttccagctgttgcttcca

SEQ ID NO: 9510083 - DNA, 22 bp, Homo sapiens
tgggaaggataccttggaacat

SEQ ID NO: 9510084 - DNA, 22 bp, Homo sapiens
tgggaaggataccttggaacat

SEQ ID NO: 9510085 - DNA, 22 bp, Homo sapiens
tgggaaggatacgttacaagat

SEQ ID NO: 9510086 - DNA, 22 bp, Homo sapiens
tgggaaggatacgttacaagat

SEQ ID NO: 9510087 - DNA, 22 bp, Homo sapiens
tgggaaggacgtgtcagtggca

SEQ ID NO: 9510088 - DNA, 22 bp, Homo sapiens
tgggaaggacgtgtcagtggca

SEQ ID NO: 9510089 - DNA, 22 bp, Homo sapiens
tgggaaggacgtgtcagtggca

SEQ ID NO: 9510090 - DNA, 22 bp, Homo sapiens
cctctgcccttttcctgtatca

SEQ ID NO: 9510091 - DNA, 22 bp, Homo sapiens
cctctgagtcctccctggttgc

SEQ ID NO: 9510092 - DNA, 22 bp, Homo sapiens
cctctgagtcatgcgcatagga

SEQ ID NO: 9510093 - DNA, 20 bp, Homo sapiens
cctctgccccggggctgcta

SEQ ID NO: 9510094 - DNA, 20 bp, Homo sapiens
cctctgccccggggctgcta

SEQ ID NO: 9510095 - DNA, 22 bp, Homo sapiens
tggcttccagagctgctccacc

SEQ ID NO: 9510096 - DNA, 22 bp, Homo sapiens
tggcttccagagctgctccacc

SEQ ID NO: 9510097 - DNA, 22 bp, Homo sapiens
tggcttccagaactgagcaaca

SEQ ID NO: 9510098 - DNA, 22 bp, Homo sapiens
tggcttccagtaatcaggattt

SEQ ID NO: 9510099 - DNA, 22 bp, Homo sapiens
cctctgagtacagtgatggatt

SEQ ID NO: 9510100 - DNA, 22 bp, Homo sapiens
cctctgagtacagtgatggatt

SEQ ID NO: 9510101 - DNA, 22 bp, Homo sapiens
cctctgagtcatgcgcatagga

SEQ ID NO: 9510102 - DNA, 22 bp, Homo sapiens
cctctgagtagactggacatga

SEQ ID NO: 9510103 - DNA, 22 bp, Homo sapiens
cctctgctctggtccatgtgct

SEQ ID NO: 9510104 - DNA, 22 bp, Homo sapiens
cctctgctctggtccatgtgct

SEQ ID NO: 9510105 - DNA, 19 bp, Homo sapiens
cctctgctccagtttcctt

SEQ ID NO: 9510106 - DNA, 20 bp, Homo sapiens
cctctgcctttctagtctga

SEQ ID NO: 9510107 - DNA, 20 bp, Homo sapiens
cctctgcctttctagtctga

SEQ ID NO: 9510108 - DNA, 20 bp, Homo sapiens
cctctgcctttctagtctga

SEQ ID NO: 9510109 - DNA, 22 bp, Homo sapiens
cctctgcgcccttgatcagcca

SEQ ID NO: 9510110 - DNA, 22 bp, Homo sapiens
cctcagaggttttcattctgta

SEQ ID NO: 9510111 - DNA, 22 bp, Homo sapiens
cctcagaggttttcattctgta

SEQ ID NO: 9510112 - DNA, 22 bp, Homo sapiens
cctcagagttatttgaagtgaa

SEQ ID NO: 9510113 - DNA, 22 bp, Homo sapiens
cctcagagttggaatcacattt

SEQ ID NO: 9510114 - DNA, 22 bp, Homo sapiens
cctcagagttggaatcacattt

SEQ ID NO: 9510115 - DNA, 22 bp, Homo sapiens
tggcccagagcactgctgggca

SEQ ID NO: 9510116 - DNA, 22 bp, Homo sapiens
tggcccagagcactgctgggca

SEQ ID NO: 9510117 - DNA, 22 bp, Homo sapiens
tggcccagagcactgctgggca

SEQ ID NO: 9510118 - DNA, 22 bp, Homo sapiens
tggcccagagcactgctgggca

SEQ ID NO: 9510119 - DNA, 22 bp, Homo sapiens
cctcagcagacacgcttctcac

SEQ ID NO: 9510120 - DNA, 22 bp, Homo sapiens
cctcagcagacacgcttctcac

SEQ ID NO: 9510121 - DNA, 22 bp, Homo sapiens
cctcagagtttaagatgtcaga

SEQ ID NO: 9510122 - DNA, 19 bp, Homo sapiens
tggcccagatggtcctggg

SEQ ID NO: 9510123 - DNA, 19 bp, Homo sapiens
tggcccagatggtcctggg

SEQ ID NO: 9510124 - DNA, 19 bp, Homo sapiens
tggcccagatggtcctggg

SEQ ID NO: 9510125 - DNA, 19 bp, Homo sapiens
tggcccagatggtcctggg

SEQ ID NO: 9510126 - DNA, 22 bp, Homo sapiens
tggcccagagcactgctgggca

SEQ ID NO: 9510127 - DNA, 22 bp, Homo sapiens
tggcccagatctctgaccttga

SEQ ID NO: 9510128 - DNA, 22 bp, Homo sapiens
tggcccagatctctgaccttga

SEQ ID NO: 9510129 - DNA, 22 bp, Homo sapiens
tggcccagatctctgaccttga

SEQ ID NO: 9510130 - DNA, 22 bp, Homo sapiens
tggcccagatctctgaccttga

SEQ ID NO: 9510131 - DNA, 20 bp, Homo sapiens
tggcccagcacgacgaggac

SEQ ID NO: 9510132 - DNA, 20 bp, Homo sapiens
tggcccagcacgacgaggac

SEQ ID NO: 9510133 - DNA, 20 bp, Homo sapiens
tggcccagcacgacgaggac

SEQ ID NO: 9510134 - DNA, 22 bp, Homo sapiens
tggcccagcactccaagtaggg

SEQ ID NO: 9510135 - DNA, 22 bp, Homo sapiens
tggcccagcactccaagtaggg

SEQ ID NO: 9510136 - DNA, 17 bp, Homo sapiens
cctcagcttctttcctc

SEQ ID NO: 9510137 - DNA, 17 bp, Homo sapiens
cctcagcttctttcctc

SEQ ID NO: 9510138 - DNA, 22 bp, Homo sapiens
tggcccagcactccaagtaggg

SEQ ID NO: 9510139 - DNA, 22 bp, Homo sapiens
tggcccagcactccaagtaggg

SEQ ID NO: 9510140 - DNA, 22 bp, Homo sapiens
tggcccagcagttctgccccag

SEQ ID NO: 9510141 - DNA, 22 bp, Homo sapiens
tggcccagcagttctgccccag

SEQ ID NO: 9510142 - DNA, 22 bp, Homo sapiens
cctcaggcttctagttcagtga

SEQ ID NO: 9510143 - DNA, 22 bp, Homo sapiens
cctcaggcttctagttcagtga

SEQ ID NO: 9510144 - DNA, 22 bp, Homo sapiens
cctcaggcttgtgagccttcag

SEQ ID NO: 9510145 - DNA, 22 bp, Homo sapiens
cctcagggaatgggaggctggg

SEQ ID NO: 9510146 - DNA, 22 bp, Homo sapiens
cctcagggaatgggaggctggg

SEQ ID NO: 9510147 - DNA, 22 bp, Homo sapiens
cctcaggcttacgggcaatgga

SEQ ID NO: 9510148 - DNA, 22 bp, Homo sapiens
cctcaggcttacgggcaatgga

SEQ ID NO: 9510149 - DNA, 22 bp, Homo sapiens
cctcaggcttcgtcttccaccc

SEQ ID NO: 9510150 - DNA, 22 bp, Homo sapiens
cctcaggcttcgtcttccaccc

SEQ ID NO: 9510151 - DNA, 22 bp, Homo sapiens
cctcaggcttcgtcttccaccc

SEQ ID NO: 9510152 - DNA, 22 bp, Homo sapiens
cctcaggcttcgtcttccaccc

SEQ ID NO: 9510153 - DNA, 22 bp, Homo sapiens
cctcaggctgtcttccttctgg

SEQ ID NO: 9510154 - DNA, 22 bp, Homo sapiens
cctcaggcttaacttgtcttga

SEQ ID NO: 9510155 - DNA, 22 bp, Homo sapiens
cctcaggctgtcttccttctgg

SEQ ID NO: 9510156 - DNA, 22 bp, Homo sapiens
cctcaggcttacgggcaatgga

SEQ ID NO: 9510157 - DNA, 22 bp, Homo sapiens
cctcaggcttacgggcaatgga

SEQ ID NO: 9510158 - DNA, 22 bp, Homo sapiens
cctcaggcttacgggcaatgga

SEQ ID NO: 9510159 - DNA, 22 bp, Homo sapiens
cctcaggctgggctgcccctgg

SEQ ID NO: 9510160 - DNA, 22 bp, Homo sapiens
cctcaggctgggctgcccctgg

SEQ ID NO: 9510161 - DNA, 22 bp, Homo sapiens
cctcaggctctgggtgcctacc

SEQ ID NO: 9510162 - DNA, 22 bp, Homo sapiens
cctcaggctctgggtgcctacc

SEQ ID NO: 9510163 - DNA, 22 bp, Homo sapiens
cctcaggctctgggtgcctacc

SEQ ID NO: 9510164 - DNA, 22 bp, Homo sapiens
cctcaggctctgggtgcctacc

SEQ ID NO: 9510165 - DNA, 22 bp, Homo sapiens
cctcaggctgctcacacttgtc

SEQ ID NO: 9510166 - DNA, 22 bp, Homo sapiens
cctcaggctgctcacacttgtc

SEQ ID NO: 9510167 - DNA, 22 bp, Homo sapiens
cctcaggctgctcacacttgtc

SEQ ID NO: 9510168 - DNA, 22 bp, Homo sapiens
cctcaggcctgccagagcccca

SEQ ID NO: 9510169 - DNA, 22 bp, Homo sapiens
cctcaggcctgccagagcccca

SEQ ID NO: 9510170 - DNA, 22 bp, Homo sapiens
cctcaggcctgccagagcccca

SEQ ID NO: 9510171 - DNA, 22 bp, Homo sapiens
cctcaggcctctgcctcattgg

SEQ ID NO: 9510172 - DNA, 22 bp, Homo sapiens
cctcagcttgatttctgcagag

SEQ ID NO: 9510173 - DNA, 22 bp, Homo sapiens
cctcaggctagctactgtccct

SEQ ID NO: 9510174 - DNA, 22 bp, Homo sapiens
cctcaggctagctactgtccct

SEQ ID NO: 9510175 - DNA, 22 bp, Homo sapiens
cctcaggctagctactgtccct

SEQ ID NO: 9510176 - DNA, 22 bp, Homo sapiens
cctcaggctctgggtgcctacc

SEQ ID NO: 9510177 - DNA, 22 bp, Homo sapiens
cctcaggctagctactgtccct

SEQ ID NO: 9510178 - DNA, 22 bp, Homo sapiens
tggctctggtgcgggctcctgc

SEQ ID NO: 9510179 - DNA, 22 bp, Homo sapiens
tggctctgtcaaactgcacaca

SEQ ID NO: 9510180 - DNA, 22 bp, Homo sapiens
tggctctgtcactgtgagctat

SEQ ID NO: 9510181 - DNA, 22 bp, Homo sapiens
tggctctgtcaaactgcacaca

SEQ ID NO: 9510182 - DNA, 21 bp, Homo sapiens
tggctctgggtaggagagtgc

SEQ ID NO: 9510183 - DNA, 21 bp, Homo sapiens
tggctctgggtaggagagtgc

SEQ ID NO: 9510184 - DNA, 22 bp, Homo sapiens
tggctctggtaacattgggtag

SEQ ID NO: 9510185 - DNA, 21 bp, Homo sapiens
tggctctgggtaggagagtgc

SEQ ID NO: 9510186 - DNA, 22 bp, Homo sapiens
tggctctggggacagtaagtcc

SEQ ID NO: 9510187 - DNA, 22 bp, Homo sapiens
tggctctgaccaggtagaggag

SEQ ID NO: 9510188 - DNA, 22 bp, Homo sapiens
tggctctgaccaggtagaggag

SEQ ID NO: 9510189 - DNA, 22 bp, Homo sapiens
tggcctgggcatgaagcatcgt

SEQ ID NO: 9510190 - DNA, 22 bp, Homo sapiens
tggcctgggccggcagatatac

SEQ ID NO: 9510191 - DNA, 22 bp, Homo sapiens
tggcctggggacctgtgagacc

SEQ ID NO: 9510192 - DNA, 22 bp, Homo sapiens
tggcctggggaagaccatgggc

SEQ ID NO: 9510193 - DNA, 22 bp, Homo sapiens
cctcagtgtgcagcagcatctg

SEQ ID NO: 9510194 - DNA, 22 bp, Homo sapiens
cctcagtgtgtggatgttagag

SEQ ID NO: 9510195 - DNA, 20 bp, Homo sapiens
cctcagtgtcctggactggg

SEQ ID NO: 9510196 - DNA, 22 bp, Homo sapiens
cctcagtgtgcagcagcatctg

SEQ ID NO: 9510197 - DNA, 22 bp, Homo sapiens
cctcagtgtgtggatgttagag

SEQ ID NO: 9510198 - DNA, 22 bp, Homo sapiens
cctcatcgtttccagaatgtgg

SEQ ID NO: 9510199 - DNA, 20 bp, Homo sapiens
cctcatctcaagggcagtcc

SEQ ID NO: 9510200 - DNA, 20 bp, Homo sapiens
cctcatctcaagggcagtcc

SEQ ID NO: 9510201 - DNA, 22 bp, Homo sapiens
cctcagggactccatgctgcag

SEQ ID NO: 9510202 - DNA, 22 bp, Homo sapiens
cctcagggactccatgctgcag

SEQ ID NO: 9510203 - DNA, 18 bp, Homo sapiens
cctcagggagagagacgc

SEQ ID NO: 9510204 - DNA, 18 bp, Homo sapiens
cctcagggagagagacgc

SEQ ID NO: 9510205 - DNA, 18 bp, Homo sapiens
cctcagggagagagacgc

SEQ ID NO: 9510206 - DNA, 22 bp, Homo sapiens
cctcagtgagtgtttccttctt

SEQ ID NO: 9510207 - DNA, 20 bp, Homo sapiens
cctcagtgtcctggactggg

SEQ ID NO: 9510208 - DNA, 22 bp, Homo sapiens
cctcagtgcgtactgaacagtg

SEQ ID NO: 9510209 - DNA, 22 bp, Homo sapiens
cctcagtgcgtactgaacagtg

SEQ ID NO: 9510210 - DNA, 22 bp, Homo sapiens
tggcctggctgccctgtctgga

SEQ ID NO: 9510211 - DNA, 22 bp, Homo sapiens
tggcctggctcacagtgagatt

SEQ ID NO: 9510212 - DNA, 22 bp, Homo sapiens
cctccaaggtgagagaggatgg

SEQ ID NO: 9510213 - DNA, 22 bp, Homo sapiens
cctcatggccttgagctgaggg

SEQ ID NO: 9510214 - DNA, 22 bp, Homo sapiens
cctcatggacctcagactgtcc

SEQ ID NO: 9510215 - DNA, 23 bp, Homo sapiens
cctcatgaaggtctgcttcctgg

SEQ ID NO: 9510216 - DNA, 22 bp, Homo sapiens
cctcatggccttgagctgaggg

SEQ ID NO: 9510217 - DNA, 22 bp, Homo sapiens
cctcatggtacttactgtagct

SEQ ID NO: 9510218 - DNA, 22 bp, Homo sapiens
cctccaagctggtcctctgtgt

SEQ ID NO: 9510219 - DNA, 22 bp, Homo sapiens
tggcagggtgggcttcagcccc

SEQ ID NO: 9510220 - DNA, 22 bp, Homo sapiens
tggcagggtgggcttcagcccc

SEQ ID NO: 9510221 - DNA, 22 bp, Homo sapiens
tggcagggttggccaccttacc

SEQ ID NO: 9510222 - DNA, 22 bp, Homo sapiens
cctaggagttgaggtggccaga

SEQ ID NO: 9510223 - DNA, 22 bp, Homo sapiens
cctaggagttcgaagctgcagt

SEQ ID NO: 9510224 - DNA, 22 bp, Homo sapiens
cctaggagaggtaatgaagttc

SEQ ID NO: 9510225 - DNA, 22 bp, Homo sapiens
cctaggagaggtaatgaagttc

SEQ ID NO: 9510226 - DNA, 22 bp, Homo sapiens
cctaggaaggagtatagtaaat

SEQ ID NO: 9510227 - DNA, 22 bp, Homo sapiens
cctaggaagctgagattgcagt

SEQ ID NO: 9510228 - DNA, 20 bp, Homo sapiens
cctaggcatgctgagtctcc

SEQ ID NO: 9510229 - DNA, 22 bp, Homo sapiens
cctaggagttcgaagctgcagt

SEQ ID NO: 9510230 - DNA, 22 bp, Homo sapiens
cctaggagttgaggtggccaga

SEQ ID NO: 9510231 - DNA, 22 bp, Homo sapiens
tggcagggtggcaacttttggt

SEQ ID NO: 9510232 - DNA, 22 bp, Homo sapiens
cctcagaaggacaagagacaaa

SEQ ID NO: 9510233 - DNA, 22 bp, Homo sapiens
tggcaggtagagttctgagatg

SEQ ID NO: 9510234 - DNA, 18 bp, Homo sapiens
tggcaggtagactcaggt

SEQ ID NO: 9510235 - DNA, 18 bp, Homo sapiens
cctcagaggcaaattgtt

SEQ ID NO: 9510236 - DNA, 22 bp, Homo sapiens
cctcagaaggacaagagacaaa

SEQ ID NO: 9510237 - DNA, 22 bp, Homo sapiens
cctcagaggtgtggcatctctg

SEQ ID NO: 9510238 - DNA, 22 bp, Homo sapiens
cctcagaggtgtggcatctctg

SEQ ID NO: 9510239 - DNA, 22 bp, Homo sapiens
cctcagaggtgaacatcagtgc

SEQ ID NO: 9510240 - DNA, 22 bp, Homo sapiens
cctcagaggtgtggcatctctg

SEQ ID NO: 9510241 - DNA, 22 bp, Homo sapiens
tggcagaggtaattcaaatccc

SEQ ID NO: 9510242 - DNA, 22 bp, Homo sapiens
cctaagaattaatgaatacacc

SEQ ID NO: 9510243 - DNA, 22 bp, Homo sapiens
cctaagaattaatgaatacacc

SEQ ID NO: 9510244 - DNA, 22 bp, Homo sapiens
tggcagaggctctgtgatgttg

SEQ ID NO: 9510245 - DNA, 22 bp, Homo sapiens
tggcagaggtaattcaaatccc

SEQ ID NO: 9510246 - DNA, 22 bp, Homo sapiens
tggcagaggagaattaagatta

SEQ ID NO: 9510247 - DNA, 22 bp, Homo sapiens
cctagaggctgcaaggagaggc

SEQ ID NO: 9510248 - DNA, 22 bp, Homo sapiens
cctagaggctgcaaggagaggc

SEQ ID NO: 9510249 - DNA, 19 bp, Homo sapiens
cctagagcagtacctggta

SEQ ID NO: 9510250 - DNA, 18 bp, Homo sapiens
cctagagcagatgggagt

SEQ ID NO: 9510251 - DNA, 22 bp, Homo sapiens
cctagagccgcacctcctccac

SEQ ID NO: 9510252 - DNA, 22 bp, Homo sapiens
cctagccttcggcctacccatc

SEQ ID NO: 9510253 - DNA, 18 bp, Homo sapiens
cctagcctccaagctcat

SEQ ID NO: 9510254 - DNA, 22 bp, Homo sapiens
cctagccccagatatctcacac

SEQ ID NO: 9510255 - DNA, 21 bp, Homo sapiens
cctagcctcttacccagcttt

SEQ ID NO: 9510256 - DNA, 19 bp, Homo sapiens
cctagagggaaggcaggac

SEQ ID NO: 9510257 - DNA, 22 bp, Homo sapiens
ccctgcagccggccagctcatt

SEQ ID NO: 9510258 - DNA, 18 bp, Homo sapiens
tggagcaggtaggcatga

SEQ ID NO: 9510259 - DNA, 19 bp, Homo sapiens
tggagcagggcccttgttt

SEQ ID NO: 9510260 - DNA, 19 bp, Homo sapiens
tggagcagggcccttgttt

SEQ ID NO: 9510261 - DNA, 18 bp, Homo sapiens
tggagcaggtaggcatga

SEQ ID NO: 9510262 - DNA, 22 bp, Homo sapiens
tggagcaggcatctttctctct

SEQ ID NO: 9510263 - DNA, 22 bp, Homo sapiens
tggagcaggccggaagtggctt

SEQ ID NO: 9510264 - DNA, 22 bp, Homo sapiens
tggagcaggccggaagtggctt

SEQ ID NO: 9510265 - DNA, 22 bp, Homo sapiens
tggagcagggcatcactgtgcg

SEQ ID NO: 9510266 - DNA, 22 bp, Homo sapiens
tggagcagggcatcactgtgcg

SEQ ID NO: 9510267 - DNA, 22 bp, Homo sapiens
tggagcaggccggaagtggctt

SEQ ID NO: 9510268 - DNA, 22 bp, Homo sapiens
tggagcaggccggaagtggctt

SEQ ID NO: 9510269 - DNA, 22 bp, Homo sapiens
ccctgcagcttttgcatagtca

SEQ ID NO: 9510270 - DNA, 22 bp, Homo sapiens
ccctgcagccttgcatgccttc

SEQ ID NO: 9510271 - DNA, 22 bp, Homo sapiens
ccctgcagccttgcatgccttc

SEQ ID NO: 9510272 - DNA, 22 bp, Homo sapiens
ccctgcaggctcagactggagt

SEQ ID NO: 9510273 - DNA, 22 bp, Homo sapiens
ccctgcaggctcagactggagt

SEQ ID NO: 9510274 - DNA, 23 bp, Homo sapiens
ccctgcagtcagggtgagatggt

SEQ ID NO: 9510275 - DNA, 22 bp, Homo sapiens
ccctgcaggggacctgcagcct

SEQ ID NO: 9510276 - DNA, 22 bp, Homo sapiens
ccctgtgggaactcctgagttg

SEQ ID NO: 9510277 - DNA, 22 bp, Homo sapiens
cccttcccttctgggagatcca

SEQ ID NO: 9510278 - DNA, 22 bp, Homo sapiens
cccttcctcaaggagctgtgtt

SEQ ID NO: 9510279 - DNA, 22 bp, Homo sapiens
cccttcctcaaggagctgtgtt

SEQ ID NO: 9510280 - DNA, 22 bp, Homo sapiens
ccctgtggtgacaggcctgtct

SEQ ID NO: 9510281 - DNA, 22 bp, Homo sapiens
ccctgtggggtccgcctgtccg

SEQ ID NO: 9510282 - DNA, 22 bp, Homo sapiens
cccttcctgggtgtcccggagt

SEQ ID NO: 9510283 - DNA, 22 bp, Homo sapiens
tggcagaggaaaaagtcactgg

SEQ ID NO: 9510284 - DNA, 22 bp, Homo sapiens
tggcagaggagaattaagatta

SEQ ID NO: 9510285 - DNA, 22 bp, Homo sapiens
cccttctagtccattcttcaca

SEQ ID NO: 9510286 - DNA, 22 bp, Homo sapiens
cccttctctttcactcactatt

SEQ ID NO: 9510287 - DNA, 22 bp, Homo sapiens
cccttctagtccattcttcaca

SEQ ID NO: 9510288 - DNA, 22 bp, Homo sapiens
cccttccttgtgactggtgggg

SEQ ID NO: 9510289 - DNA, 22 bp, Homo sapiens
cccttctctttcactcactatt

SEQ ID NO: 9510290 - DNA, 21 bp, Homo sapiens
cccttctgctccagctttgcc

SEQ ID NO: 9510291 - DNA, 22 bp, Homo sapiens
cccttctgtaaatgctgactgg

SEQ ID NO: 9510292 - DNA, 21 bp, Homo sapiens
cccttctgctccagctttgcc

SEQ ID NO: 9510293 - DNA, 22 bp, Homo sapiens
cccgactagctgggattacagg

SEQ ID NO: 9510294 - DNA, 22 bp, Homo sapiens
cccgagggccgaaagctgcttt

SEQ ID NO: 9510295 - DNA, 22 bp, Homo sapiens
cccgagggccgaaagctgcttt

SEQ ID NO: 9510296 - DNA, 22 bp, Homo sapiens
cccgctccttacctgtccaacc

SEQ ID NO: 9510297 - DNA, 18 bp, Homo sapiens
cccggctaatttttggta

SEQ ID NO: 9510298 - DNA, 22 bp, Homo sapiens
ccccttctgtgtcctgtcagcc

SEQ ID NO: 9510299 - DNA, 22 bp, Homo sapiens
ccccttctctgcaagcctgctc

SEQ ID NO: 9510300 - DNA, 22 bp, Homo sapiens
ccccttccttcctcagacagcc

SEQ ID NO: 9510301 - DNA, 22 bp, Homo sapiens
ccccttccaggaagcagaatcg

SEQ ID NO: 9510302 - DNA, 22 bp, Homo sapiens
cccctcttgtactagacagttt

SEQ ID NO: 9510303 - DNA, 22 bp, Homo sapiens
tgctgggatatagcttctaggg

SEQ ID NO: 9510304 - DNA, 22 bp, Homo sapiens
tgctgggatatagcttctaggg

SEQ ID NO: 9510305 - DNA, 22 bp, Homo sapiens
tgctggctttttggtccttgct

SEQ ID NO: 9510306 - DNA, 22 bp, Homo sapiens
tgctggctttttgtgtcaaaga

SEQ ID NO: 9510307 - DNA, 22 bp, Homo sapiens
tgctggctttttggtccttgct

SEQ ID NO: 9510308 - DNA, 22 bp, Homo sapiens
tgctggcttttccttcaggcag

SEQ ID NO: 9510309 - DNA, 22 bp, Homo sapiens
tgctggcttttccttcaggcag

SEQ ID NO: 9510310 - DNA, 23 bp, Homo sapiens
tgctggcttttatctggtcccta

SEQ ID NO: 9510311 - DNA, 23 bp, Homo sapiens
tgctggcttttatctggtcccta

SEQ ID NO: 9510312 - DNA, 23 bp, Homo sapiens
tgctggcttttatctggtcccta

SEQ ID NO: 9510313 - DNA, 22 bp, Homo sapiens
tgctggctttgcgagatgcatt

SEQ ID NO: 9510314 - DNA, 22 bp, Homo sapiens
tgctggctttgcgagatgcatt

SEQ ID NO: 9510315 - DNA, 22 bp, Homo sapiens
tgctggctttgcgagatgcatt

SEQ ID NO: 9510316 - DNA, 22 bp, Homo sapiens
tgctggctttctgtccctggca

SEQ ID NO: 9510317 - DNA, 22 bp, Homo sapiens
tgctggctttctgtccctggca

SEQ ID NO: 9510318 - DNA, 22 bp, Homo sapiens
tgctggctttctgtccctggca

SEQ ID NO: 9510319 - DNA, 22 bp, Homo sapiens
tgctggctttagtgattggggt

SEQ ID NO: 9510320 - DNA, 22 bp, Homo sapiens
tgctggctttaaggttaaagtg

SEQ ID NO: 9510321 - DNA, 22 bp, Homo sapiens
tgctggcttggaaggaaagcgc

SEQ ID NO: 9510322 - DNA, 22 bp, Homo sapiens
tgctggctaatggaaaccagat

SEQ ID NO: 9510323 - DNA, 22 bp, Homo sapiens
tgctggctacattattgctgtc

SEQ ID NO: 9510324 - DNA, 22 bp, Homo sapiens
tgctggctaatggaaaccagat

SEQ ID NO: 9510325 - DNA, 22 bp, Homo sapiens
tgctggcctgtccacgggctgt

SEQ ID NO: 9510326 - DNA, 23 bp, Homo sapiens
tgctggctaagaatctgcatttt

SEQ ID NO: 9510327 - DNA, 22 bp, Homo sapiens
tgctggcccagtatggactgca

SEQ ID NO: 9510328 - DNA, 22 bp, Homo sapiens
tgctggcccagtatggactgca

SEQ ID NO: 9510329 - DNA, 22 bp, Homo sapiens
tgctggcccatgaagacgcagt

SEQ ID NO: 9510330 - DNA, 22 bp, Homo sapiens
tgctggcccagtatggactgca

SEQ ID NO: 9510331 - DNA, 21 bp, Homo sapiens
tgctggccatgtgctgggcat

SEQ ID NO: 9510332 - DNA, 22 bp, Homo sapiens
tgctggccggccaggtgctgag

SEQ ID NO: 9510333 - DNA, 22 bp, Homo sapiens
tgctggccggccaggtgctgag

SEQ ID NO: 9510334 - DNA, 22 bp, Homo sapiens
tgctggccctggctcagggaac

SEQ ID NO: 9510335 - DNA, 22 bp, Homo sapiens
tgctggccctggctcagggaac

SEQ ID NO: 9510336 - DNA, 22 bp, Homo sapiens
tgctggcctggttagaaagggg

SEQ ID NO: 9510337 - DNA, 22 bp, Homo sapiens
tgctggcctgtccacgggctgt

SEQ ID NO: 9510338 - DNA, 22 bp, Homo sapiens
tgctggcctgggctgcaccttg

SEQ ID NO: 9510339 - DNA, 22 bp, Homo sapiens
tgctggcctgggctgcaccttg

SEQ ID NO: 9510340 - DNA, 22 bp, Homo sapiens
tgctggcctgggctgcaccttg

SEQ ID NO: 9510341 - DNA, 22 bp, Homo sapiens
tgctggcctgggctgcaccttg

SEQ ID NO: 9510342 - DNA, 21 bp, Homo sapiens
tgctggcctcaagggtgactt

SEQ ID NO: 9510343 - DNA, 22 bp, Homo sapiens
tgctggccgtgagctctcggga

SEQ ID NO: 9510344 - DNA, 22 bp, Homo sapiens
tgctggcctcggcgctgggcct

SEQ ID NO: 9510345 - DNA, 22 bp, Homo sapiens
tgctggcctcggcgctgggcct

SEQ ID NO: 9510346 - DNA, 22 bp, Homo sapiens
tgctggcctcggcgctgggcct

SEQ ID NO: 9510347 - DNA, 22 bp, Homo sapiens
ccccacaggtgtctgaggcagg

SEQ ID NO: 9510348 - DNA, 22 bp, Homo sapiens
ccccacagtccgtgaggagcca

SEQ ID NO: 9510349 - DNA, 22 bp, Homo sapiens
ccccacagtccgtgaggagcca

SEQ ID NO: 9510350 - DNA, 22 bp, Homo sapiens
ccccacagtccgtgaggagcca

SEQ ID NO: 9510351 - DNA, 22 bp, Homo sapiens
ccccacagccgccagcagggag

SEQ ID NO: 9510352 - DNA, 22 bp, Homo sapiens
ccccacagccgccagcagggag

SEQ ID NO: 9510353 - DNA, 22 bp, Homo sapiens
ccccacagcttgtggagagaat

SEQ ID NO: 9510354 - DNA, 22 bp, Homo sapiens
ccccacaggtgtctgaggcagg

SEQ ID NO: 9510355 - DNA, 22 bp, Homo sapiens
ccccacacctgccgggcagcag

SEQ ID NO: 9510356 - DNA, 22 bp, Homo sapiens
ccccacaactcatgttgaaact

SEQ ID NO: 9510357 - DNA, 22 bp, Homo sapiens
ccccaaggtgctcactgtctgg

SEQ ID NO: 9510358 - DNA, 22 bp, Homo sapiens
ccccacaactcatgttgaaact

SEQ ID NO: 9510359 - DNA, 22 bp, Homo sapiens
ccccacaactcatgttgaaact

SEQ ID NO: 9510360 - DNA, 22 bp, Homo sapiens
ccccacactctttacattcata

SEQ ID NO: 9510361 - DNA, 22 bp, Homo sapiens
ccccacagccgccagcagggag

SEQ ID NO: 9510362 - DNA, 20 bp, Homo sapiens
ccccacactattgagcactt

SEQ ID NO: 9510363 - DNA, 20 bp, Homo sapiens
ccccacactattgagcactt

SEQ ID NO: 9510364 - DNA, 22 bp, Homo sapiens
tgctggagcccaggcggccttt

SEQ ID NO: 9510365 - DNA, 22 bp, Homo sapiens
tgctggccaatggcagaggcgg

SEQ ID NO: 9510366 - DNA, 21 bp, Homo sapiens
tgctggccatgtgctgggcat

SEQ ID NO: 9510367 - DNA, 21 bp, Homo sapiens
tgctggccatgtgctgggcat

SEQ ID NO: 9510368 - DNA, 22 bp, Homo sapiens
ccccaccctcgctccatttcgg

SEQ ID NO: 9510369 - DNA, 22 bp, Homo sapiens
ccccaccctcgctccatttcgg

SEQ ID NO: 9510370 - DNA, 22 bp, Homo sapiens
ccccaccctcgctccatttcgg

SEQ ID NO: 9510371 - DNA, 22 bp, Homo sapiens
ccccaccctcgctccatttcgg

SEQ ID NO: 9510372 - DNA, 22 bp, Homo sapiens
ccccacccacctaagagaaact

SEQ ID NO: 9510373 - DNA, 22 bp, Homo sapiens
ccccacccacctaagagaaact

SEQ ID NO: 9510374 - DNA, 22 bp, Homo sapiens
ccccacccacctaagagaaact

SEQ ID NO: 9510375 - DNA, 22 bp, Homo sapiens
cccaggtcccgccccagctcta

SEQ ID NO: 9510376 - DNA, 22 bp, Homo sapiens
cccaggtcccggggccagctgc

SEQ ID NO: 9510377 - DNA, 22 bp, Homo sapiens
cccaggtcgtcagcagtgtggt

SEQ ID NO: 9510378 - DNA, 21 bp, Homo sapiens
cccaggtcgtggtcttcccag

SEQ ID NO: 9510379 - DNA, 22 bp, Homo sapiens
cccaggtcgtcagcagtgtggt

SEQ ID NO: 9510380 - DNA, 22 bp, Homo sapiens
cccaggtcgtcagcagtgtggt

SEQ ID NO: 9510381 - DNA, 22 bp, Homo sapiens
cccaggtcgtcagcagtgtggt

SEQ ID NO: 9510382 - DNA, 22 bp, Homo sapiens
cccaggtcccgccccagctcta

SEQ ID NO: 9510383 - DNA, 22 bp, Homo sapiens
cccaggtccccacctgtctgct

SEQ ID NO: 9510384 - DNA, 22 bp, Homo sapiens
cccaggtccccacctgtctgct

SEQ ID NO: 9510385 - DNA, 22 bp, Homo sapiens
cccaggtccccacctgtctgct

SEQ ID NO: 9510386 - DNA, 23 bp, Homo sapiens
cccaggtcaaaattcacaggcct

SEQ ID NO: 9510387 - DNA, 22 bp, Homo sapiens
cccagttgttgccggctctgga

SEQ ID NO: 9510388 - DNA, 22 bp, Homo sapiens
cccaggtctatgccagctctga

SEQ ID NO: 9510389 - DNA, 22 bp, Homo sapiens
cccaggtctatgccagctctga

SEQ ID NO: 9510390 - DNA, 22 bp, Homo sapiens
cccaggtcccggggccagctgc

SEQ ID NO: 9510391 - DNA, 22 bp, Homo sapiens
cccaggtctatgccagctctga

SEQ ID NO: 9510392 - DNA, 22 bp, Homo sapiens
cccagtttcaactttccagtgg

SEQ ID NO: 9510393 - DNA, 22 bp, Homo sapiens
cccattcatcctcgcttccttc

SEQ ID NO: 9510394 - DNA, 22 bp, Homo sapiens
cccagttgttgccggctctgga

SEQ ID NO: 9510395 - DNA, 23 bp, Homo sapiens
cccattttcatgttaactcctgg

SEQ ID NO: 9510396 - DNA, 22 bp, Homo sapiens
cccattttagcaaggggtggcg

SEQ ID NO: 9510397 - DNA, 22 bp, Homo sapiens
cccatttcttgagttcagctct

SEQ ID NO: 9510398 - DNA, 22 bp, Homo sapiens
cccattcttcatacaagtctaa

SEQ ID NO: 9510399 - DNA, 22 bp, Homo sapiens
cccattgtggttgttgaggata

SEQ ID NO: 9510400 - DNA, 22 bp, Homo sapiens
cccattgcccaaatagtaaaca

SEQ ID NO: 9510401 - DNA, 22 bp, Homo sapiens
cccattttggaacgagtagcca

SEQ ID NO: 9510402 - DNA, 22 bp, Homo sapiens
cccattttgcttatgctgctgt

SEQ ID NO: 9510403 - DNA, 22 bp, Homo sapiens
cccatttttgtgtgagtaatga

SEQ ID NO: 9510404 - DNA, 22 bp, Homo sapiens
ccccaaaacttggtgacttcca

SEQ ID NO: 9510405 - DNA, 22 bp, Homo sapiens
ccccaaaacttagtgacttaaa

SEQ ID NO: 9510406 - DNA, 22 bp, Homo sapiens
ccccaaagtgttggataattga

SEQ ID NO: 9510407 - DNA, 19 bp, Homo sapiens
ccccaaagtttagatgttg

SEQ ID NO: 9510408 - DNA, 22 bp, Homo sapiens
ccccaaagctgagttcccgcct

SEQ ID NO: 9510409 - DNA, 22 bp, Homo sapiens
ccccaaagcctcagcctgcctg

SEQ ID NO: 9510410 - DNA, 22 bp, Homo sapiens
ccccaaaattcttaagttgaat

SEQ ID NO: 9510411 - DNA, 18 bp, Homo sapiens
ccccaaaagtcaccctgg

SEQ ID NO: 9510412 - DNA, 22 bp, Homo sapiens
tgctgtgggcagtacataagct

SEQ ID NO: 9510413 - DNA, 22 bp, Homo sapiens
tgctgtgggatatatgttcaaa

SEQ ID NO: 9510414 - DNA, 22 bp, Homo sapiens
tgctgtgtaaaaggtgattgaa

SEQ ID NO: 9510415 - DNA, 22 bp, Homo sapiens
tgctgtgtctttctgtgaaaag

SEQ ID NO: 9510416 - DNA, 22 bp, Homo sapiens
tgctgtgtaaaaggtgattgaa

SEQ ID NO: 9510417 - DNA, 22 bp, Homo sapiens
tgctgtggattcagagatgaaa

SEQ ID NO: 9510418 - DNA, 22 bp, Homo sapiens
tgctgtgctggcggcagaggcc

SEQ ID NO: 9510419 - DNA, 22 bp, Homo sapiens
tgctgtgctggcggcagaggcc

SEQ ID NO: 9510420 - DNA, 22 bp, Homo sapiens
tgctgtgctctttaaggtgctg

SEQ ID NO: 9510421 - DNA, 22 bp, Homo sapiens
tgctgtgctctttaaggtgctg

SEQ ID NO: 9510422 - DNA, 22 bp, Homo sapiens
tgctgtgctccattgtcttcac

SEQ ID NO: 9510423 - DNA, 18 bp, Homo sapiens
cccggctaatttttggta

SEQ ID NO: 9510424 - DNA, 18 bp, Homo sapiens
cccggctaatttttggta

SEQ ID NO: 9510425 - DNA, 18 bp, Homo sapiens
cccggctaatttttggta

SEQ ID NO: 9510426 - DNA, 22 bp, Homo sapiens
tgctgtgtggatgtgaagaatc

SEQ ID NO: 9510427 - DNA, 22 bp, Homo sapiens
tgctgtgttcctcagtttcatg

SEQ ID NO: 9510428 - DNA, 22 bp, Homo sapiens
tgctgtgttaaatacaagcatg

SEQ ID NO: 9510429 - DNA, 22 bp, Homo sapiens
tgctgtgttaaatacaagcatg

SEQ ID NO: 9510430 - DNA, 22 bp, Homo sapiens
tggaatggaaacaaactgagga

SEQ ID NO: 9510431 - DNA, 22 bp, Homo sapiens
tggaatggaaacaaactgagga

SEQ ID NO: 9510432 - DNA, 22 bp, Homo sapiens
tggaatggaaacaaactgagga

SEQ ID NO: 9510433 - DNA, 22 bp, Homo sapiens
tggaagggagctggaatttgga

SEQ ID NO: 9510434 - DNA, 22 bp, Homo sapiens
tggaatgtggtatcagtagaaa

SEQ ID NO: 9510435 - DNA, 20 bp, Homo sapiens
tggaatgggtccttgaaaaa

SEQ ID NO: 9510436 - DNA, 22 bp, Homo sapiens
tggaatggaaacaaactgagga

SEQ ID NO: 9510437 - DNA, 22 bp, Homo sapiens
tggaatggaaacaaactgagga

SEQ ID NO: 9510438 - DNA, 22 bp, Homo sapiens
ccctcctggaggcggatgccca

SEQ ID NO: 9510439 - DNA, 22 bp, Homo sapiens
ccctcctgtgcctgaggccagc

SEQ ID NO: 9510440 - DNA, 22 bp, Homo sapiens
ccctcctgtgcctgaggccagc

SEQ ID NO: 9510441 - DNA, 22 bp, Homo sapiens
ccctcctggaggcggatgccca

SEQ ID NO: 9510442 - DNA, 22 bp, Homo sapiens
ccctcctctccctaagagtcac

SEQ ID NO: 9510443 - DNA, 22 bp, Homo sapiens
ccctcctctccctaagagtcac

SEQ ID NO: 9510444 - DNA, 22 bp, Homo sapiens
ccctcgccgcagctgcttcccg

SEQ ID NO: 9510445 - DNA, 22 bp, Homo sapiens
ccctcgctctaggcagccctgt

SEQ ID NO: 9510446 - DNA, 22 bp, Homo sapiens
ccctctacagggaagcgctttc

SEQ ID NO: 9510447 - DNA, 22 bp, Homo sapiens
ccctcgtgcatccatcatttag

SEQ ID NO: 9510448 - DNA, 22 bp, Homo sapiens
ccctcctgtgcctgaggccagc

SEQ ID NO: 9510449 - DNA, 22 bp, Homo sapiens
ccctcctgtgcctgaggccagc

SEQ ID NO: 9510450 - DNA, 22 bp, Homo sapiens
ccctcctgtgcctgaggccagc

SEQ ID NO: 9510451 - DNA, 22 bp, Homo sapiens
ccctccttaccaccacagctcc

SEQ ID NO: 9510452 - DNA, 22 bp, Homo sapiens
tggagcaggactgctgccctca

SEQ ID NO: 9510453 - DNA, 16 bp, Homo sapiens
tggagcaggcaggatg

SEQ ID NO: 9510454 - DNA, 22 bp, Homo sapiens
tggagcaggcatctttctctct

SEQ ID NO: 9510455 - DNA, 22 bp, Homo sapiens
tggagcaggacggggagtggta

SEQ ID NO: 9510456 - DNA, 22 bp, Homo sapiens
tggagcaggacggggagtggta

SEQ ID NO: 9510457 - DNA, 22 bp, Homo sapiens
tggagcaggacggggagtggta

SEQ ID NO: 9510458 - DNA, 22 bp, Homo sapiens
tggagcaggactgctgccctca

SEQ ID NO: 9510459 - DNA, 22 bp, Homo sapiens
tggagcaaattcaagctcatct

SEQ ID NO: 9510460 - DNA, 22 bp, Homo sapiens
tggagcagaaatggcctcttgt

SEQ ID NO: 9510461 - DNA, 22 bp, Homo sapiens
tggagcagaaatggcctcttgt

SEQ ID NO: 9510462 - DNA, 22 bp, Homo sapiens
ccctgaggaccaggaaggaggg

SEQ ID NO: 9510463 - DNA, 22 bp, Homo sapiens
ccctgaggaccaggaaggaggg

SEQ ID NO: 9510464 - DNA, 23 bp, Homo sapiens
ccctgagctggtccaggctcaac

SEQ ID NO: 9510465 - DNA, 23 bp, Homo sapiens
ccctgagctggtccaggctcaac

SEQ ID NO: 9510466 - DNA, 22 bp, Homo sapiens
ccctgaggaaagggtggagggc

SEQ ID NO: 9510467 - DNA, 22 bp, Homo sapiens
ccctgaggaaagggtggagggc

SEQ ID NO: 9510468 - DNA, 22 bp, Homo sapiens
ccctgaggaaagggtggagggc

SEQ ID NO: 9510469 - DNA, 22 bp, Homo sapiens
ccctgagccgctgctccaacct

SEQ ID NO: 9510470 - DNA, 22 bp, Homo sapiens
ccctgagccgctgctccaacct

SEQ ID NO: 9510471 - DNA, 22 bp, Homo sapiens
ccctgagccgcctgccgtgtcc

SEQ ID NO: 9510472 - DNA, 22 bp, Homo sapiens
ccctgagcgtgaggaggaagta

SEQ ID NO: 9510473 - DNA, 22 bp, Homo sapiens
ccctgagcccatagttgacatt

SEQ ID NO: 9510474 - DNA, 22 bp, Homo sapiens
ccctgagccacacagagcaggt

SEQ ID NO: 9510475 - DNA, 22 bp, Homo sapiens
ccctgagcattcatgtgagctt

SEQ ID NO: 9510476 - DNA, 22 bp, Homo sapiens
ccctgagcattcatgtgagctt

SEQ ID NO: 9510477 - DNA, 22 bp, Homo sapiens
ccctgagatgcctcaccctagt

SEQ ID NO: 9510478 - DNA, 22 bp, Homo sapiens
ccctgagatgcctcaccctagt

SEQ ID NO: 9510479 - DNA, 22 bp, Homo sapiens
ccctgagcagtctgcagagagc

SEQ ID NO: 9510480 - DNA, 22 bp, Homo sapiens
ccctgagcacacctggcagaca

SEQ ID NO: 9510481 - DNA, 18 bp, Homo sapiens
ccctgagatgatgctgtg

SEQ ID NO: 9510482 - DNA, 22 bp, Homo sapiens
ccctgagatgcctcaccctagt

SEQ ID NO: 9510483 - DNA, 18 bp, Homo sapiens
ccctgagatgatgctgtg

SEQ ID NO: 9510484 - DNA, 22 bp, Homo sapiens
ccctgagagtgagtgccacctt

SEQ ID NO: 9510485 - DNA, 22 bp, Homo sapiens
ccctgaaatcctgtgctctgtg

SEQ ID NO: 9510486 - DNA, 22 bp, Homo sapiens
ccctgaaagtacactgggacgg

SEQ ID NO: 9510487 - DNA, 19 bp, Homo sapiens
ccctcttgcacaaagcaaa

SEQ ID NO: 9510488 - DNA, 19 bp, Homo sapiens
ccctcttgcacaaagcaaa

SEQ ID NO: 9510489 - DNA, 22 bp, Homo sapiens
ccctctctcaggctgacagcct

SEQ ID NO: 9510490 - DNA, 22 bp, Homo sapiens
ccctctctcaggctgacagcct

SEQ ID NO: 9510491 - DNA, 19 bp, Homo sapiens
ccctcttgcacaaagcaaa

SEQ ID NO: 9510492 - DNA, 22 bp, Homo sapiens
ccctctcagtcagagccagata

SEQ ID NO: 9510493 - DNA, 22 bp, Homo sapiens
ccctctcctggctgcatggagc

SEQ ID NO: 9510494 - DNA, 22 bp, Homo sapiens
ccctctcctggctgcatggagc

SEQ ID NO: 9510495 - DNA, 18 bp, Homo sapiens
ccctctcctgctagtggg

SEQ ID NO: 9510496 - DNA, 22 bp, Homo sapiens
ccctgaacagtgagagataggg

SEQ ID NO: 9510497 - DNA, 18 bp, Homo sapiens
ccctgaagggcaagataa

SEQ ID NO: 9510498 - DNA, 22 bp, Homo sapiens
ccctgacccaaaactgtcagaa

SEQ ID NO: 9510499 - DNA, 22 bp, Homo sapiens
ccctgagaagatcattgccacg

SEQ ID NO: 9510500 - DNA, 20 bp, Homo sapiens
ccctgagacaaaggaggggc

SEQ ID NO: 9510501 - DNA, 20 bp, Homo sapiens
ccctgagacaaaggaggggc

SEQ ID NO: 9510502 - DNA, 22 bp, Homo sapiens
ccctgacttgatctttgacttg

SEQ ID NO: 9510503 - DNA, 22 bp, Homo sapiens
ccctgaccctatcagagggcca

SEQ ID NO: 9510504 - DNA, 20 bp, Homo sapiens
ccctgagaccagagagcagc

SEQ ID NO: 9510505 - DNA, 20 bp, Homo sapiens
ccctgagaccagagagcagc

SEQ ID NO: 9510506 - DNA, 20 bp, Homo sapiens
ccctgagacaaaggaggggc

SEQ ID NO: 9510507 - DNA, 20 bp, Homo sapiens
ccctgagacgactgagctcc

SEQ ID NO: 9510508 - DNA, 20 bp, Homo sapiens
ccctgagacgactgagctcc

SEQ ID NO: 9510509 - DNA, 20 bp, Homo sapiens
ccctgagacgactgagctcc

SEQ ID NO: 9510510 - DNA, 20 bp, Homo sapiens
ccctgagacgactgagctcc

SEQ ID NO: 9510511 - DNA, 20 bp, Homo sapiens
ccctgagaccagagagcagc

SEQ ID NO: 9510512 - DNA, 22 bp, Homo sapiens
ccctgagagcagggtctttctc

SEQ ID NO: 9510513 - DNA, 22 bp, Homo sapiens
ccctgagaggttgagtgtctgc

SEQ ID NO: 9510514 - DNA, 22 bp, Homo sapiens
ccctgagaggttgagtgtctgc

SEQ ID NO: 9510515 - DNA, 22 bp, Homo sapiens
tgccctggggagcccagccagg

SEQ ID NO: 9510516 - DNA, 22 bp, Homo sapiens
tgccctggggagcccagccagg

SEQ ID NO: 9510517 - DNA, 22 bp, Homo sapiens
tgccctggggagcccagccagg

SEQ ID NO: 9510518 - DNA, 21 bp, Homo sapiens
tgccctggggctcttccctca

SEQ ID NO: 9510519 - DNA, 21 bp, Homo sapiens
tgccctggggctcttccctca

SEQ ID NO: 9510520 - DNA, 21 bp, Homo sapiens
tgccctggggctcttccctca

SEQ ID NO: 9510521 - DNA, 22 bp, Homo sapiens
tgccctggggtctggagcagca

SEQ ID NO: 9510522 - DNA, 22 bp, Homo sapiens
tgccctggggtctggagcagca

SEQ ID NO: 9510523 - DNA, 22 bp, Homo sapiens
tgccctgggagttggagctgct

SEQ ID NO: 9510524 - DNA, 22 bp, Homo sapiens
tgccctgggctttgctatgact

SEQ ID NO: 9510525 - DNA, 22 bp, Homo sapiens
tgccctgggagttggagctgct

SEQ ID NO: 9510526 - DNA, 22 bp, Homo sapiens
tgccctgggagttggagctgct

SEQ ID NO: 9510527 - DNA, 22 bp, Homo sapiens
tgccctgggagttggagctgct

SEQ ID NO: 9510528 - DNA, 22 bp, Homo sapiens
cccaggctcccaggtgggacaa

SEQ ID NO: 9510529 - DNA, 22 bp, Homo sapiens
cccaggctcagactggcttgtt

SEQ ID NO: 9510530 - DNA, 22 bp, Homo sapiens
cccaggctcagactggcttgtt

SEQ ID NO: 9510531 - DNA, 22 bp, Homo sapiens
cccaggctcactgtccgcttcc

SEQ ID NO: 9510532 - DNA, 22 bp, Homo sapiens
cccaggctcagactggcttgtt

SEQ ID NO: 9510533 - DNA, 19 bp, Homo sapiens
cccaggctacatggagagg

SEQ ID NO: 9510534 - DNA, 19 bp, Homo sapiens
cccaggctacatggagagg

SEQ ID NO: 9510535 - DNA, 22 bp, Homo sapiens
cccaggctagaaaggccaacaa

SEQ ID NO: 9510536 - DNA, 22 bp, Homo sapiens
cccaggctagtatgatatcagt

SEQ ID NO: 9510537 - DNA, 22 bp, Homo sapiens
cccaggctagtatgatatcagt

SEQ ID NO: 9510538 - DNA, 22 bp, Homo sapiens
tgcccagccaatttgttatgtt

SEQ ID NO: 9510539 - DNA, 22 bp, Homo sapiens
tgccatagcaatggtaagctga

SEQ ID NO: 9510540 - DNA, 22 bp, Homo sapiens
tgcccagccagtttatggtaat

SEQ ID NO: 9510541 - DNA, 22 bp, Homo sapiens
tgcccagccaatttgttatgtt

SEQ ID NO: 9510542 - DNA, 22 bp, Homo sapiens
tgcccagccagtttatggtaat

SEQ ID NO: 9510543 - DNA, 22 bp, Homo sapiens
tgcccagccaatttgttatgtt

SEQ ID NO: 9510544 - DNA, 22 bp, Homo sapiens
tgccagtgtggaactaggaaga

SEQ ID NO: 9510545 - DNA, 22 bp, Homo sapiens
tgccagtgtagtagctggttta

SEQ ID NO: 9510546 - DNA, 22 bp, Homo sapiens
tgccagttgggaaaacagacat

SEQ ID NO: 9510547 - DNA, 22 bp, Homo sapiens
tgccagtgtgtgccttaagctc

SEQ ID NO: 9510548 - DNA, 22 bp, Homo sapiens
tgccagttgggaaaacagacat

SEQ ID NO: 9510549 - DNA, 22 bp, Homo sapiens
tgccagtgtgagtggagttctt

SEQ ID NO: 9510550 - DNA, 22 bp, Homo sapiens
cccaggcagtgtgtgcatgcgt

SEQ ID NO: 9510551 - DNA, 22 bp, Homo sapiens
tgcccagctgtcaaagtagata

SEQ ID NO: 9510552 - DNA, 22 bp, Homo sapiens
tgcccagctgtcaaagtagata

SEQ ID NO: 9510553 - DNA, 22 bp, Homo sapiens
tgcccagctgtcaaagtagata

SEQ ID NO: 9510554 - DNA, 22 bp, Homo sapiens
cccaggcagtgtgtgcatgcgt

SEQ ID NO: 9510555 - DNA, 22 bp, Homo sapiens
tgcccagcgcccacattctgtc

SEQ ID NO: 9510556 - DNA, 22 bp, Homo sapiens
tgcccagctattcctttcttag

SEQ ID NO: 9510557 - DNA, 22 bp, Homo sapiens
tgcccagctattcctttcttag

SEQ ID NO: 9510558 - DNA, 22 bp, Homo sapiens
tgcccagcgcccacattctgtc

SEQ ID NO: 9510559 - DNA, 22 bp, Homo sapiens
tgcccagcgcccacattctgtc

SEQ ID NO: 9510560 - DNA, 22 bp, Homo sapiens
tgcccagcgcccacattctgtc

SEQ ID NO: 9510561 - DNA, 22 bp, Homo sapiens
tgcccagcctaaacttggcaag

SEQ ID NO: 9510562 - DNA, 22 bp, Homo sapiens
tgcccagcccctatccctggga

SEQ ID NO: 9510563 - DNA, 22 bp, Homo sapiens
tgcccagcccctatccctggga

SEQ ID NO: 9510564 - DNA, 22 bp, Homo sapiens
tgcccagcccctatccctggga

SEQ ID NO: 9510565 - DNA, 22 bp, Homo sapiens
tgcccagcctaaacttggcaag

SEQ ID NO: 9510566 - DNA, 22 bp, Homo sapiens
tgcccagcctaaacttggcaag

SEQ ID NO: 9510567 - DNA, 22 bp, Homo sapiens
tgcccagcctaaacttggcaag

SEQ ID NO: 9510568 - DNA, 22 bp, Homo sapiens
tgcccagcctaaacttggcaag

SEQ ID NO: 9510569 - DNA, 22 bp, Homo sapiens
tgccaggagtcaggccaggcag

SEQ ID NO: 9510570 - DNA, 22 bp, Homo sapiens
tgccaggatataagagtgcgat

SEQ ID NO: 9510571 - DNA, 22 bp, Homo sapiens
cccaggagacctagatctgttt

SEQ ID NO: 9510572 - DNA, 22 bp, Homo sapiens
cccaggagacatatagaaggac

SEQ ID NO: 9510573 - DNA, 22 bp, Homo sapiens
cccaggagacatatagaaggac

SEQ ID NO: 9510574 - DNA, 22 bp, Homo sapiens
cccaggagacatatagaaggac

SEQ ID NO: 9510575 - DNA, 22 bp, Homo sapiens
cccaggagactgagctgtaacc

SEQ ID NO: 9510576 - DNA, 22 bp, Homo sapiens
cccaggagactgagctgtaacc

SEQ ID NO: 9510577 - DNA, 22 bp, Homo sapiens
cccaggagagagacttgaatct

SEQ ID NO: 9510578 - DNA, 22 bp, Homo sapiens
cccaggagagagacttgaatct

SEQ ID NO: 9510579 - DNA, 22 bp, Homo sapiens
cccaggagacctagatctgttt

SEQ ID NO: 9510580 - DNA, 22 bp, Homo sapiens
cccaggagacctgtgaaaggac

SEQ ID NO: 9510581 - DNA, 22 bp, Homo sapiens
cccaggagacctgtgaaaggac

SEQ ID NO: 9510582 - DNA, 22 bp, Homo sapiens
cccaggagagaggccagttggc

SEQ ID NO: 9510583 - DNA, 22 bp, Homo sapiens
cccaggagagaggccagttggc

SEQ ID NO: 9510584 - DNA, 22 bp, Homo sapiens
cccaggagagaggccagttggc

SEQ ID NO: 9510585 - DNA, 22 bp, Homo sapiens
cccaggagagaggggataaagc

SEQ ID NO: 9510586 - DNA, 22 bp, Homo sapiens
cccaggagagaggggataaagc

SEQ ID NO: 9510587 - DNA, 22 bp, Homo sapiens
tgccagtgggtgtgcagagact

SEQ ID NO: 9510588 - DNA, 22 bp, Homo sapiens
tgccagtgcctgctgcccaata

SEQ ID NO: 9510589 - DNA, 22 bp, Homo sapiens
tgccagtgagccctgggatgtg

SEQ ID NO: 9510590 - DNA, 22 bp, Homo sapiens
tgccagtgaaacgtggtctcat

SEQ ID NO: 9510591 - DNA, 22 bp, Homo sapiens
tgccagtgaaacatggaagaat

SEQ ID NO: 9510592 - DNA, 22 bp, Homo sapiens
tgccagtctcaccctgggtcct

SEQ ID NO: 9510593 - DNA, 22 bp, Homo sapiens
tgccaggctaagtggaggactt

SEQ ID NO: 9510594 - DNA, 20 bp, Homo sapiens
tgcacagacaatgagcccag

SEQ ID NO: 9510595 - DNA, 22 bp, Homo sapiens
tgccagctcccttttctcctcc

SEQ ID NO: 9510596 - DNA, 22 bp, Homo sapiens
tgccagctccgaggagctgcag

SEQ ID NO: 9510597 - DNA, 22 bp, Homo sapiens
tgccagctcctgcagctcctgt

SEQ ID NO: 9510598 - DNA, 22 bp, Homo sapiens
tgccagctccgaggagctgcag

SEQ ID NO: 9510599 - DNA, 22 bp, Homo sapiens
tgccagctgttcccacccaaaa

SEQ ID NO: 9510600 - DNA, 21 bp, Homo sapiens
tgccagctgctgcatctgtct

SEQ ID NO: 9510601 - DNA, 22 bp, Homo sapiens
tgccagctgcttgtcccccaca

SEQ ID NO: 9510602 - DNA, 22 bp, Homo sapiens
tgccagctgacagcagagacaa

SEQ ID NO: 9510603 - DNA, 22 bp, Homo sapiens
tgccagcttcttacggctgcct

SEQ ID NO: 9510604 - DNA, 22 bp, Homo sapiens
tgccagcttctaaggacccagg

SEQ ID NO: 9510605 - DNA, 22 bp, Homo sapiens
tgccagcttgtggtcagaggct

SEQ ID NO: 9510606 - DNA, 22 bp, Homo sapiens
tgccagcttttgactatcttag

SEQ ID NO: 9510607 - DNA, 22 bp, Homo sapiens
tgccaggaggaggtgggacaga

SEQ ID NO: 9510608 - DNA, 22 bp, Homo sapiens
tgccaggagagtgcatgcaggg

SEQ ID NO: 9510609 - DNA, 22 bp, Homo sapiens
tgccaggaagtgtgtgggcctg

SEQ ID NO: 9510610 - DNA, 19 bp, Homo sapiens
tgccaggaatactccagaa

SEQ ID NO: 9510611 - DNA, 22 bp, Homo sapiens
tgccaggacaaggaccacatgg

SEQ ID NO: 9510612 - DNA, 22 bp, Homo sapiens
cccagggtggatgcaagcagca

SEQ ID NO: 9510613 - DNA, 22 bp, Homo sapiens
cccagggtggatgcaagcagca

SEQ ID NO: 9510614 - DNA, 23 bp, Homo sapiens
cccaggtagccctctagagcctg

SEQ ID NO: 9510615 - DNA, 22 bp, Homo sapiens
cccaggtagtgagaaatggagg

SEQ ID NO: 9510616 - DNA, 22 bp, Homo sapiens
cccaggtagtgagaaatggagg

SEQ ID NO: 9510617 - DNA, 22 bp, Homo sapiens
cccaggtagttggaagagacaa

SEQ ID NO: 9510618 - DNA, 22 bp, Homo sapiens
cccaggtagttggaagagacaa

SEQ ID NO: 9510619 - DNA, 22 bp, Homo sapiens
cccagggtccctgctctctgtg

SEQ ID NO: 9510620 - DNA, 22 bp, Homo sapiens
cccagggtgcggccctggctgg

SEQ ID NO: 9510621 - DNA, 22 bp, Homo sapiens
cccagggtgcggccctggctgg

SEQ ID NO: 9510622 - DNA, 22 bp, Homo sapiens
cccagggtgcggccctggctgg

SEQ ID NO: 9510623 - DNA, 22 bp, Homo sapiens
cccagggtgctaattaaatatg

SEQ ID NO: 9510624 - DNA, 22 bp, Homo sapiens
cccagggtagctgagctggcag

SEQ ID NO: 9510625 - DNA, 22 bp, Homo sapiens
cccaggggttctagaccagctt

SEQ ID NO: 9510626 - DNA, 22 bp, Homo sapiens
cccaggggttctagaccagctt

SEQ ID NO: 9510627 - DNA, 22 bp, Homo sapiens
cccaggggttcaaggctgcagt

SEQ ID NO: 9510628 - DNA, 22 bp, Homo sapiens
cccaggggttcaaggctgcagt

SEQ ID NO: 9510629 - DNA, 22 bp, Homo sapiens
cccaggggttcaaggctgcagt

SEQ ID NO: 9510630 - DNA, 22 bp, Homo sapiens
cccaggggttcaaggctgcagt

SEQ ID NO: 9510631 - DNA, 22 bp, Homo sapiens
cccaggggttcaaggctgcagt

SEQ ID NO: 9510632 - DNA, 20 bp, Homo sapiens
cccaggggttgtggtgagga

SEQ ID NO: 9510633 - DNA, 22 bp, Homo sapiens
cccaggggttctgagcagcagc

SEQ ID NO: 9510634 - DNA, 22 bp, Homo sapiens
cccaggggttctgagcagcagc

SEQ ID NO: 9510635 - DNA, 20 bp, Homo sapiens
cccaggggttgtggtgagga

SEQ ID NO: 9510636 - DNA, 22 bp, Homo sapiens
cccagggacagatgggcagcta

SEQ ID NO: 9510637 - DNA, 22 bp, Homo sapiens
cccagggacagatgggcagcta

SEQ ID NO: 9510638 - DNA, 22 bp, Homo sapiens
cccagggacagatgggcagcta

SEQ ID NO: 9510639 - DNA, 22 bp, Homo sapiens
cccagggacagatgggcagcta

SEQ ID NO: 9510640 - DNA, 17 bp, Homo sapiens
cccagggaccactgctt

SEQ ID NO: 9510641 - DNA, 17 bp, Homo sapiens
cccagggaccactgctt

SEQ ID NO: 9510642 - DNA, 22 bp, Homo sapiens
tgcctgtgtggggtctgccgcc

SEQ ID NO: 9510643 - DNA, 17 bp, Homo sapiens
cccagggaccactgctt

SEQ ID NO: 9510644 - DNA, 17 bp, Homo sapiens
cccagggaccactgctt

SEQ ID NO: 9510645 - DNA, 22 bp, Homo sapiens
tgcctgtgtggggtctgccgcc

SEQ ID NO: 9510646 - DNA, 22 bp, Homo sapiens
tgcctgttgcccacctgataaa

SEQ ID NO: 9510647 - DNA, 22 bp, Homo sapiens
tgcctgttgcccacctgataaa

SEQ ID NO: 9510648 - DNA, 22 bp, Homo sapiens
tgccttcctggagctgaaggct

SEQ ID NO: 9510649 - DNA, 22 bp, Homo sapiens
tgccttcctggagctgaaggct

SEQ ID NO: 9510650 - DNA, 22 bp, Homo sapiens
cccagggattataaaggtgaaa

SEQ ID NO: 9510651 - DNA, 22 bp, Homo sapiens
tgccttcctaatggtggggttt

SEQ ID NO: 9510652 - DNA, 22 bp, Homo sapiens
tgccttcatccatgttatagtg

SEQ ID NO: 9510653 - DNA, 22 bp, Homo sapiens
tgccttcaccaggccttcagcc

SEQ ID NO: 9510654 - DNA, 22 bp, Homo sapiens
tgccctggtgaagtgctctcct

SEQ ID NO: 9510655 - DNA, 22 bp, Homo sapiens
tgccctggtgaagtgctctcct

SEQ ID NO: 9510656 - DNA, 22 bp, Homo sapiens
tgccctggttacactggagtcc

SEQ ID NO: 9510657 - DNA, 22 bp, Homo sapiens
tgccctggtagacacagactgt

SEQ ID NO: 9510658 - DNA, 22 bp, Homo sapiens
tgccctggtagacacagactgt

SEQ ID NO: 9510659 - DNA, 22 bp, Homo sapiens
tgccctggtgaagtgctctcct

SEQ ID NO: 9510660 - DNA, 22 bp, Homo sapiens
tgccctggtatcatgtggaatt

SEQ ID NO: 9510661 - DNA, 22 bp, Homo sapiens
cccaggctggaattccaggcct

SEQ ID NO: 9510662 - DNA, 22 bp, Homo sapiens
cccaggctggagggcagtgtca

SEQ ID NO: 9510663 - DNA, 22 bp, Homo sapiens
cccaggctggagggcagtgtca

SEQ ID NO: 9510664 - DNA, 22 bp, Homo sapiens
cccaggctggagtgcaatggca

SEQ ID NO: 9510665 - DNA, 22 bp, Homo sapiens
cccaggctggagggcagtgtca

SEQ ID NO: 9510666 - DNA, 22 bp, Homo sapiens
cccaggctggagggcagtgtca

SEQ ID NO: 9510667 - DNA, 22 bp, Homo sapiens
cccaggctggagtgcaatggca

SEQ ID NO: 9510668 - DNA, 22 bp, Homo sapiens
cccaggctggagtgcaatggtg

SEQ ID NO: 9510669 - DNA, 22 bp, Homo sapiens
cccaggctggagtgcaatggtg

SEQ ID NO: 9510670 - DNA, 22 bp, Homo sapiens
cccaggctggagtgcagtggcg

SEQ ID NO: 9510671 - DNA, 22 bp, Homo sapiens
cccaggctggagtgcagtggcg

SEQ ID NO: 9510672 - DNA, 22 bp, Homo sapiens
cccaggctggggctcctccagc

SEQ ID NO: 9510673 - DNA, 22 bp, Homo sapiens
cccaggctggcactgctgaagt

SEQ ID NO: 9510674 - DNA, 22 bp, Homo sapiens
cccaggctggcctccgcagtgc

SEQ ID NO: 9510675 - DNA, 22 bp, Homo sapiens
cccaggctggcctccgcagtgc

SEQ ID NO: 9510676 - DNA, 22 bp, Homo sapiens
cccaggctggagtgtaatggtg

SEQ ID NO: 9510677 - DNA, 22 bp, Homo sapiens
cccaggctggcactgctgaagt

SEQ ID NO: 9510678 - DNA, 22 bp, Homo sapiens
cccaggctggatttcggtggca

SEQ ID NO: 9510679 - DNA, 22 bp, Homo sapiens
cccaggctggatttcggtggca

SEQ ID NO: 9510680 - DNA, 22 bp, Homo sapiens
cccaggctggtcctgaactcct

SEQ ID NO: 9510681 - DNA, 22 bp, Homo sapiens
cccaggctggtcctgaactcct

SEQ ID NO: 9510682 - DNA, 22 bp, Homo sapiens
cccaggctggggctcctccagc

SEQ ID NO: 9510683 - DNA, 21 bp, Homo sapiens
cccagggaagccgcagtcacc

SEQ ID NO: 9510684 - DNA, 21 bp, Homo sapiens
cccagggaagccgcagtcacc

SEQ ID NO: 9510685 - DNA, 22 bp, Homo sapiens
cccagggaaggcagatggagga

SEQ ID NO: 9510686 - DNA, 22 bp, Homo sapiens
cccagggaatgactctggcctt

SEQ ID NO: 9510687 - DNA, 23 bp, Homo sapiens
cccagggacacgatgacacctcc

SEQ ID NO: 9510688 - DNA, 23 bp, Homo sapiens
cccagggacacgatgacacctcc

SEQ ID NO: 9510689 - DNA, 22 bp, Homo sapiens
ccattctttcagtgtctcatgt

SEQ ID NO: 9510690 - DNA, 22 bp, Homo sapiens
ccattctttcagtgtctcatgt

SEQ ID NO: 9510691 - DNA, 22 bp, Homo sapiens
ccattctgtttaatgaatgaaa

SEQ ID NO: 9510692 - DNA, 22 bp, Homo sapiens
ccattctgtgtctctccacagc

SEQ ID NO: 9510693 - DNA, 22 bp, Homo sapiens
ccattctgaagtgcaggctaag

SEQ ID NO: 9510694 - DNA, 22 bp, Homo sapiens
ccattctgaacaattcttgtct

SEQ ID NO: 9510695 - DNA, 19 bp, Homo sapiens
ccattcctctagaatttgg

SEQ ID NO: 9510696 - DNA, 22 bp, Homo sapiens
ccattccttcatcaaaaggcct

SEQ ID NO: 9510697 - DNA, 22 bp, Homo sapiens
ccattccatgtgctacacataa

SEQ ID NO: 9510698 - DNA, 20 bp, Homo sapiens
ccattctgggtgcagtctgg

SEQ ID NO: 9510699 - DNA, 20 bp, Homo sapiens
ccattctgggtgcagtctgg

SEQ ID NO: 9510700 - DNA, 20 bp, Homo sapiens
ccattctgggtgcagtctgg

SEQ ID NO: 9510701 - DNA, 22 bp, Homo sapiens
ccattctgccatgcttcatcta

SEQ ID NO: 9510702 - DNA, 22 bp, Homo sapiens
ccattctgagtcttatgtcttt

SEQ ID NO: 9510703 - DNA, 22 bp, Homo sapiens
ccattctgccatgcttcatcta

SEQ ID NO: 9510704 - DNA, 22 bp, Homo sapiens
ccattctgacacctaattctgt

SEQ ID NO: 9510705 - DNA, 22 bp, Homo sapiens
ccattctgacttcattgcctca

SEQ ID NO: 9510706 - DNA, 22 bp, Homo sapiens
ccattctgacttcattgcctca

SEQ ID NO: 9510707 - DNA, 22 bp, Homo sapiens
ccattctgagtcttatgtcttt

SEQ ID NO: 9510708 - DNA, 22 bp, Homo sapiens
ccattactttccaatatatcag

SEQ ID NO: 9510709 - DNA, 22 bp, Homo sapiens
ccattaaagcaccactgtaata

SEQ ID NO: 9510710 - DNA, 23 bp, Homo sapiens
ccattcatctcagtcattgcttt

SEQ ID NO: 9510711 - DNA, 22 bp, Homo sapiens
ccattatccacgggcttcctga

SEQ ID NO: 9510712 - DNA, 22 bp, Homo sapiens
ccattatccattttgagtctta

SEQ ID NO: 9510713 - DNA, 22 bp, Homo sapiens
ccattattataggaggctcatt

SEQ ID NO: 9510714 - DNA, 22 bp, Homo sapiens
ccatgttgtatctcttatcggc

SEQ ID NO: 9510715 - DNA, 22 bp, Homo sapiens
ccattaaaatggaatgtagtga

SEQ ID NO: 9510716 - DNA, 22 bp, Homo sapiens
ccattaaaattgtgacatagga

SEQ ID NO: 9510717 - DNA, 22 bp, Homo sapiens
ccattgtaaattctgtggaagt

SEQ ID NO: 9510718 - DNA, 22 bp, Homo sapiens
tgattcaagccaccacatactg

SEQ ID NO: 9510719 - DNA, 22 bp, Homo sapiens
tgattcaagccaccacatactg

SEQ ID NO: 9510720 - DNA, 22 bp, Homo sapiens
tgatttctcatattgttcaaaa

SEQ ID NO: 9510721 - DNA, 22 bp, Homo sapiens
tgatttctagtgaggttgaaca

SEQ ID NO: 9510722 - DNA, 22 bp, Homo sapiens
tgatttctagtgaggttgaaca

SEQ ID NO: 9510723 - DNA, 22 bp, Homo sapiens
tgatttctagtgaggttgaaca

SEQ ID NO: 9510724 - DNA, 20 bp, Homo sapiens
tgatttctcttctattcctt

SEQ ID NO: 9510725 - DNA, 22 bp, Homo sapiens
tgatttctcatattgttcaaaa

SEQ ID NO: 9510726 - DNA, 21 bp, Homo sapiens
tgatttctgccaagttcacta

SEQ ID NO: 9510727 - DNA, 22 bp, Homo sapiens
tgatttcttccttgtcattaga

SEQ ID NO: 9510728 - DNA, 22 bp, Homo sapiens
tgatttcttctaatttccatca

SEQ ID NO: 9510729 - DNA, 23 bp, Homo sapiens
tgattttaaaaagtaagttatca

SEQ ID NO: 9510730 - DNA, 22 bp, Homo sapiens
tgattttattgaaacttcactt

SEQ ID NO: 9510731 - DNA, 22 bp, Homo sapiens
tgattttattgaaacttcactt

SEQ ID NO: 9510732 - DNA, 22 bp, Homo sapiens
tgattttacttagcatgatgtt

SEQ ID NO: 9510733 - DNA, 23 bp, Homo sapiens
tgattttaaaaagtaagttatca

SEQ ID NO: 9510734 - DNA, 23 bp, Homo sapiens
tgattttaaaaagtaagttatca

SEQ ID NO: 9510735 - DNA, 23 bp, Homo sapiens
tgattttaaaaagtaagttatca

SEQ ID NO: 9510736 - DNA, 22 bp, Homo sapiens
cccactgtgttgcagtctagtg

SEQ ID NO: 9510737 - DNA, 20 bp, Homo sapiens
cccagaagcttaacagagca

SEQ ID NO: 9510738 - DNA, 22 bp, Homo sapiens
tgcaaatagcctgatgaaagaa

SEQ ID NO: 9510739 - DNA, 22 bp, Homo sapiens
tgcaaataggggacaactcttt

SEQ ID NO: 9510740 - DNA, 22 bp, Homo sapiens
tgcaaataggggacaactcttt

SEQ ID NO: 9510741 - DNA, 22 bp, Homo sapiens
tgcaaataggggacaactcttt

SEQ ID NO: 9510742 - DNA, 22 bp, Homo sapiens
tgcaaataggggacaactcttt

SEQ ID NO: 9510743 - DNA, 22 bp, Homo sapiens
tgcaaatattagcattcgatat

SEQ ID NO: 9510744 - DNA, 22 bp, Homo sapiens
tgcaaatattagcattcgatat

SEQ ID NO: 9510745 - DNA, 22 bp, Homo sapiens
tgcaaatattccatgctgttca

SEQ ID NO: 9510746 - DNA, 22 bp, Homo sapiens
tgcaaaggaggatgggaaagaa

SEQ ID NO: 9510747 - DNA, 21 bp, Homo sapiens
tgcaaaggacctgaggtagga

SEQ ID NO: 9510748 - DNA, 22 bp, Homo sapiens
tgcaaaggaggatgggaaagaa

SEQ ID NO: 9510749 - DNA, 22 bp, Homo sapiens
tgcaaagtcgcaaaattcttct

SEQ ID NO: 9510750 - DNA, 22 bp, Homo sapiens
tgcaaagtcgcaaaattcttct

SEQ ID NO: 9510751 - DNA, 22 bp, Homo sapiens
tgcaaataaatttctgttcatt

SEQ ID NO: 9510752 - DNA, 22 bp, Homo sapiens
tgcaaataaatttctgttcatt

SEQ ID NO: 9510753 - DNA, 22 bp, Homo sapiens
tgcaaagttgcatcaaaaccca

SEQ ID NO: 9510754 - DNA, 23 bp, Homo sapiens
tgcaaataacaaggagtttaagg

SEQ ID NO: 9510755 - DNA, 23 bp, Homo sapiens
tgcaaataacaaggagtttaagg

SEQ ID NO: 9510756 - DNA, 22 bp, Homo sapiens
tgcaaatagcctatatttatag

SEQ ID NO: 9510757 - DNA, 22 bp, Homo sapiens
cccagaaggtcgaggctgcagt

SEQ ID NO: 9510758 - DNA, 22 bp, Homo sapiens
cccagaaggcttgccaggaagc

SEQ ID NO: 9510759 - DNA, 22 bp, Homo sapiens
cccagaaggcttgccaggaagc

SEQ ID NO: 9510760 - DNA, 22 bp, Homo sapiens
cccagaaggctaagcgtggatt

SEQ ID NO: 9510761 - DNA, 20 bp, Homo sapiens
cccagaagcttaacagagca

SEQ ID NO: 9510762 - DNA, 22 bp, Homo sapiens
cccagacattgcagggactggt

SEQ ID NO: 9510763 - DNA, 22 bp, Homo sapiens
cccagacataacagcagagagg

SEQ ID NO: 9510764 - DNA, 22 bp, Homo sapiens
cccagacataacagcagagagg

SEQ ID NO: 9510765 - DNA, 22 bp, Homo sapiens
cccagacagtcaagaggcctgc

SEQ ID NO: 9510766 - DNA, 22 bp, Homo sapiens
cccagacagtcaagaggcctgc

SEQ ID NO: 9510767 - DNA, 22 bp, Homo sapiens
cccagacagtcaagaggcctgc

SEQ ID NO: 9510768 - DNA, 22 bp, Homo sapiens
cccagacagtcaagaggcctgc

SEQ ID NO: 9510769 - DNA, 22 bp, Homo sapiens
cccagactcatccctgggagct

SEQ ID NO: 9510770 - DNA, 22 bp, Homo sapiens
tgcacacatgtatgtatatgtg

SEQ ID NO: 9510771 - DNA, 22 bp, Homo sapiens
tgcacacatgtttacaagcatc

SEQ ID NO: 9510772 - DNA, 22 bp, Homo sapiens
tgcacacatgtttacaagcatc

SEQ ID NO: 9510773 - DNA, 22 bp, Homo sapiens
tgcacacatgtatgtatatgtg

SEQ ID NO: 9510774 - DNA, 22 bp, Homo sapiens
tgcacacatgtttacaagcatc

SEQ ID NO: 9510775 - DNA, 22 bp, Homo sapiens
tgcacacatgtttacaagcatc

SEQ ID NO: 9510776 - DNA, 22 bp, Homo sapiens
tgcacacattaaggatacacag

SEQ ID NO: 9510777 - DNA, 22 bp, Homo sapiens
tgcacacattaaggatacacag

SEQ ID NO: 9510778 - DNA, 22 bp, Homo sapiens
tgcacacattctatggggctga

SEQ ID NO: 9510779 - DNA, 22 bp, Homo sapiens
tgcacacctctccaccactctc

SEQ ID NO: 9510780 - DNA, 22 bp, Homo sapiens
tgcacacattctatggggctga

SEQ ID NO: 9510781 - DNA, 22 bp, Homo sapiens
ccatgtggtgggaaggagaatg

SEQ ID NO: 9510782 - DNA, 22 bp, Homo sapiens
ccatggcctgaaggagtgcatc

SEQ ID NO: 9510783 - DNA, 22 bp, Homo sapiens
ccatggcctgaaggagtgcatc

SEQ ID NO: 9510784 - DNA, 22 bp, Homo sapiens
ccatggcctgaaggagtgcatc

SEQ ID NO: 9510785 - DNA, 22 bp, Homo sapiens
tgaggtcacctggaggcagcct

SEQ ID NO: 9510786 - DNA, 22 bp, Homo sapiens
tgaggtcacagctggggatgga

SEQ ID NO: 9510787 - DNA, 22 bp, Homo sapiens
tgaggtatgctgaactctgttt

SEQ ID NO: 9510788 - DNA, 22 bp, Homo sapiens
tgaggtatggtaaggtaaaatc

SEQ ID NO: 9510789 - DNA, 22 bp, Homo sapiens
ccatgcttaaataagaggcagc

SEQ ID NO: 9510790 - DNA, 22 bp, Homo sapiens
tgaggtaggcttgagatgggag

SEQ ID NO: 9510791 - DNA, 22 bp, Homo sapiens
tgaggtaggcttgagatgggag

SEQ ID NO: 9510792 - DNA, 22 bp, Homo sapiens
tgaggtagggaaggctggtatt

SEQ ID NO: 9510793 - DNA, 21 bp, Homo sapiens
tgaggtagtgtttgtcaagtt

SEQ ID NO: 9510794 - DNA, 22 bp, Homo sapiens
tgaggtagtttgttgtacagta

SEQ ID NO: 9510795 - DNA, 22 bp, Homo sapiens
tgaggtagtgcttgtcatgttt

SEQ ID NO: 9510796 - DNA, 22 bp, Homo sapiens
tgaggtagtaaaggtgttagtt

SEQ ID NO: 9510797 - DNA, 22 bp, Homo sapiens
ccatcctgcattgctattcaga

SEQ ID NO: 9510798 - DNA, 22 bp, Homo sapiens
ccatcctgcattgctattcaga

SEQ ID NO: 9510799 - DNA, 22 bp, Homo sapiens
ccatgccagctgctaggtcaca

SEQ ID NO: 9510800 - DNA, 22 bp, Homo sapiens
ccatgcccacgttgtggctcag

SEQ ID NO: 9510801 - DNA, 22 bp, Homo sapiens
ccatgcccacgttgtggctcag

SEQ ID NO: 9510802 - DNA, 22 bp, Homo sapiens
ccatgccccaccaggacgctgc

SEQ ID NO: 9510803 - DNA, 22 bp, Homo sapiens
ccatgctctggggaggtcaagc

SEQ ID NO: 9510804 - DNA, 22 bp, Homo sapiens
ccatgctgaccctgtgcaggca

SEQ ID NO: 9510805 - DNA, 22 bp, Homo sapiens
ccatgctggagtccctagctgt

SEQ ID NO: 9510806 - DNA, 22 bp, Homo sapiens
ccatgctgaccctgtgcaggca

SEQ ID NO: 9510807 - DNA, 22 bp, Homo sapiens
ccatgctgtgacacagtagtta

SEQ ID NO: 9510808 - DNA, 22 bp, Homo sapiens
ccatgcttaaataagaggcagc

SEQ ID NO: 9510809 - DNA, 22 bp, Homo sapiens
ccatgctgggatgctccaagtg

SEQ ID NO: 9510810 - DNA, 22 bp, Homo sapiens
ccatgcccttgtcatctccagg

SEQ ID NO: 9510811 - DNA, 22 bp, Homo sapiens
ccatgcctcgggaagagtctgt

SEQ ID NO: 9510812 - DNA, 22 bp, Homo sapiens
ccatgcccttgtcatctccagg

SEQ ID NO: 9510813 - DNA, 22 bp, Homo sapiens
ccatgcctcgggaagagtctgt

SEQ ID NO: 9510814 - DNA, 22 bp, Homo sapiens
ccatgcctggactccactctca

SEQ ID NO: 9510815 - DNA, 22 bp, Homo sapiens
ccatgccttcctttccctggaa

SEQ ID NO: 9510816 - DNA, 22 bp, Homo sapiens
ccatgccttcctttccctggaa

SEQ ID NO: 9510817 - DNA, 22 bp, Homo sapiens
tgagggcagagcactggggagc

SEQ ID NO: 9510818 - DNA, 22 bp, Homo sapiens
tgagggcagagcactggggagc

SEQ ID NO: 9510819 - DNA, 22 bp, Homo sapiens
tgagggcagagcactggggagc

SEQ ID NO: 9510820 - DNA, 20 bp, Homo sapiens
tgagggctaaccagactctg

SEQ ID NO: 9510821 - DNA, 22 bp, Homo sapiens
tgagggctaaattgtggcaggt

SEQ ID NO: 9510822 - DNA, 22 bp, Homo sapiens
tgagggctaaattgtggcaggt

SEQ ID NO: 9510823 - DNA, 22 bp, Homo sapiens
tgagggctaaattgtggcaggt

SEQ ID NO: 9510824 - DNA, 22 bp, Homo sapiens
tgagggctaaattgtggcaggt

SEQ ID NO: 9510825 - DNA, 22 bp, Homo sapiens
tgagggctaaattgtggcaggt

SEQ ID NO: 9510826 - DNA, 22 bp, Homo sapiens
tgagggcaaagtggtgctgagg

SEQ ID NO: 9510827 - DNA, 22 bp, Homo sapiens
tgagggcaaagtggtgctgagg

SEQ ID NO: 9510828 - DNA, 23 bp, Homo sapiens
ccagtctctttccaaaatcacat

SEQ ID NO: 9510829 - DNA, 23 bp, Homo sapiens
tgaggctgattgatttttgctca

SEQ ID NO: 9510830 - DNA, 23 bp, Homo sapiens
tgaggctgattgatttttgctca

SEQ ID NO: 9510831 - DNA, 22 bp, Homo sapiens
tgagggatccagaggcagtggt

SEQ ID NO: 9510832 - DNA, 22 bp, Homo sapiens
tgagggctgcttccagagctag

SEQ ID NO: 9510833 - DNA, 22 bp, Homo sapiens
tgagggctgtctgaagcttggg

SEQ ID NO: 9510834 - DNA, 22 bp, Homo sapiens
tgagggctgtggaaggctaacc

SEQ ID NO: 9510835 - DNA, 22 bp, Homo sapiens
tgagggctgcttccagagctag

SEQ ID NO: 9510836 - DNA, 22 bp, Homo sapiens
tgagggctgcttccagagctag

SEQ ID NO: 9510837 - DNA, 22 bp, Homo sapiens
tgagggctgacaggaggacagc

SEQ ID NO: 9510838 - DNA, 22 bp, Homo sapiens
tgagggctgacaggaggacagc

SEQ ID NO: 9510839 - DNA, 22 bp, Homo sapiens
ccagtgtttacagttgaacaaa

SEQ ID NO: 9510840 - DNA, 22 bp, Homo sapiens
tgaggggaactgatgcccattg

SEQ ID NO: 9510841 - DNA, 22 bp, Homo sapiens
ccagtcctcagatggtctgtgc

SEQ ID NO: 9510842 - DNA, 22 bp, Homo sapiens
ccagtcctagaagaggagtcga

SEQ ID NO: 9510843 - DNA, 20 bp, Homo sapiens
ccagtccctgagcaccaggg

SEQ ID NO: 9510844 - DNA, 20 bp, Homo sapiens
ccagtccctgagcaccaggg

SEQ ID NO: 9510845 - DNA, 20 bp, Homo sapiens
ccagtccctgagcaccaggg

SEQ ID NO: 9510846 - DNA, 22 bp, Homo sapiens
ccagtcccgcatggtccagaat

SEQ ID NO: 9510847 - DNA, 22 bp, Homo sapiens
ccagtcccgcatggtccagaat

SEQ ID NO: 9510848 - DNA, 22 bp, Homo sapiens
ccagtcccgcatggtccagaat

SEQ ID NO: 9510849 - DNA, 20 bp, Homo sapiens
ccagtccctgagcaccaggg

SEQ ID NO: 9510850 - DNA, 22 bp, Homo sapiens
ccagtcccatctctgtcgctta

SEQ ID NO: 9510851 - DNA, 22 bp, Homo sapiens
ccagtcccatctctgtcgctta

SEQ ID NO: 9510852 - DNA, 22 bp, Homo sapiens
ccagtcccgcatggtccagaat

SEQ ID NO: 9510853 - DNA, 22 bp, Homo sapiens
ccagtcccgcatggtccagaat

SEQ ID NO: 9510854 - DNA, 22 bp, Homo sapiens
tgaggcagcccactttccttag

SEQ ID NO: 9510855 - DNA, 22 bp, Homo sapiens
ccagtcctgtgtgaccctgcac

SEQ ID NO: 9510856 - DNA, 22 bp, Homo sapiens
ccagtcctttgagccagttctg

SEQ ID NO: 9510857 - DNA, 22 bp, Homo sapiens
ccagtcctgggagcttgcactg

SEQ ID NO: 9510858 - DNA, 22 bp, Homo sapiens
ccagtcctgggagcttgcactg

SEQ ID NO: 9510859 - DNA, 22 bp, Homo sapiens
ccagtcctcagatggtctgtgc

SEQ ID NO: 9510860 - DNA, 22 bp, Homo sapiens
ccagtcctcagatggtctgtgc

SEQ ID NO: 9510861 - DNA, 22 bp, Homo sapiens
ccagtcctgccaccctgtctat

SEQ ID NO: 9510862 - DNA, 23 bp, Homo sapiens
ccagtctcacgtatacaggattt

SEQ ID NO: 9510863 - DNA, 22 bp, Homo sapiens
ccagtctcagttcacgttggta

SEQ ID NO: 9510864 - DNA, 22 bp, Homo sapiens
ccagtctcgttgaggcgcttgt

SEQ ID NO: 9510865 - DNA, 22 bp, Homo sapiens
ccagtctcctaagagcccctga

SEQ ID NO: 9510866 - DNA, 22 bp, Homo sapiens
ccagtctcctaagagcccctga

SEQ ID NO: 9510867 - DNA, 20 bp, Homo sapiens
ccagtctctggccagcatca

SEQ ID NO: 9510868 - DNA, 20 bp, Homo sapiens
ccagtctctggccagcatca

SEQ ID NO: 9510869 - DNA, 20 bp, Homo sapiens
ccagtctctatcagaaataa

SEQ ID NO: 9510870 - DNA, 22 bp, Homo sapiens
ccagtctcttccctcctgccag

SEQ ID NO: 9510871 - DNA, 22 bp, Homo sapiens
ccagtctcttccctcctgccag

SEQ ID NO: 9510872 - DNA, 20 bp, Homo sapiens
tgacagtttcatatggttca

SEQ ID NO: 9510873 - DNA, 22 bp, Homo sapiens
tgacataaaccagtgagcaaaa

SEQ ID NO: 9510874 - DNA, 22 bp, Homo sapiens
tgacagttgagcatgtaagaga

SEQ ID NO: 9510875 - DNA, 22 bp, Homo sapiens
tgacagttgagcatgtaagaga

SEQ ID NO: 9510876 - DNA, 22 bp, Homo sapiens
tgacagttgtattacatgggaa

SEQ ID NO: 9510877 - DNA, 22 bp, Homo sapiens
tgacagttgagcatgtaagaga

SEQ ID NO: 9510878 - DNA, 22 bp, Homo sapiens
tgacagtttattttgcagaatg

SEQ ID NO: 9510879 - DNA, 22 bp, Homo sapiens
tgacagttcaggtcagatttat

SEQ ID NO: 9510880 - DNA, 22 bp, Homo sapiens
tgacagttaaggtatacattca

SEQ ID NO: 9510881 - DNA, 22 bp, Homo sapiens
tgacagttaaggtatacattca

SEQ ID NO: 9510882 - DNA, 23 bp, Homo sapiens
tgacagtgtatttgactatatgg

SEQ ID NO: 9510883 - DNA, 22 bp, Homo sapiens
ccaggggcctgtgaaggtgccc

SEQ ID NO: 9510884 - DNA, 22 bp, Homo sapiens
ccaggggcctgtgaaggtgccc

SEQ ID NO: 9510885 - DNA, 22 bp, Homo sapiens
tgacagtgcgggtacatcatag

SEQ ID NO: 9510886 - DNA, 22 bp, Homo sapiens
ccaggggcctgtgaaggtgccc

SEQ ID NO: 9510887 - DNA, 22 bp, Homo sapiens
tgacataatgctttgaagttgc

SEQ ID NO: 9510888 - DNA, 22 bp, Homo sapiens
tgacataatgctttgaagttgc

SEQ ID NO: 9510889 - DNA, 22 bp, Homo sapiens
tgacataataatccaaacatac

SEQ ID NO: 9510890 - DNA, 22 bp, Homo sapiens
tgagaaaagtacatggagaagc

SEQ ID NO: 9510891 - DNA, 22 bp, Homo sapiens
tgagaaaagtacatggagaagc

SEQ ID NO: 9510892 - DNA, 22 bp, Homo sapiens
tgagaaggaaacaatggctttt

SEQ ID NO: 9510893 - DNA, 22 bp, Homo sapiens
tgagaaaagtacatggagaagc

SEQ ID NO: 9510894 - DNA, 22 bp, Homo sapiens
tgagaaaaggttgagatgataa

SEQ ID NO: 9510895 - DNA, 22 bp, Homo sapiens
tgacatcattagtaacatagct

SEQ ID NO: 9510896 - DNA, 22 bp, Homo sapiens
tgacaagtttcctggtgatttt

SEQ ID NO: 9510897 - DNA, 22 bp, Homo sapiens
tgacaagtagggtgggatttgt

SEQ ID NO: 9510898 - DNA, 22 bp, Homo sapiens
tgacaagtcactgttcttcaat

SEQ ID NO: 9510899 - DNA, 23 bp, Homo sapiens
tgacaagtctcagccaatgcaga

SEQ ID NO: 9510900 - DNA, 22 bp, Homo sapiens
tgacaagtacataatttcatgt

SEQ ID NO: 9510901 - DNA, 22 bp, Homo sapiens
tgacaagaggcagaatcagctg

SEQ ID NO: 9510902 - DNA, 22 bp, Homo sapiens
ccagggcttcagaggttttggc

SEQ ID NO: 9510903 - DNA, 22 bp, Homo sapiens
ccagggctgctgtgggactcca

SEQ ID NO: 9510904 - DNA, 22 bp, Homo sapiens
tgacaatggggcacatggaaag

SEQ ID NO: 9510905 - DNA, 22 bp, Homo sapiens
tgacaatggatattagttgtgg

SEQ ID NO: 9510906 - DNA, 22 bp, Homo sapiens
tgacaatggatattagttgtgg

SEQ ID NO: 9510907 - DNA, 22 bp, Homo sapiens
tgacaatgattaggtagcttct

SEQ ID NO: 9510908 - DNA, 22 bp, Homo sapiens
tgacaatgacatggacagtgat

SEQ ID NO: 9510909 - DNA, 22 bp, Homo sapiens
tgacaatagcgatttatcttgc

SEQ ID NO: 9510910 - DNA, 22 bp, Homo sapiens
ccagggcttcagttagtggtga

SEQ ID NO: 9510911 - DNA, 22 bp, Homo sapiens
ccagggcttcccacgtgccctg

SEQ ID NO: 9510912 - DNA, 22 bp, Homo sapiens
ccagggcttcagttagtggtga

SEQ ID NO: 9510913 - DNA, 22 bp, Homo sapiens
ccagggcttcagttagtggtga

SEQ ID NO: 9510914 - DNA, 22 bp, Homo sapiens
ccagggcttcccacgtgccctg

SEQ ID NO: 9510915 - DNA, 19 bp, Homo sapiens
ccagggctttaagttgagg

SEQ ID NO: 9510916 - DNA, 22 bp, Homo sapiens
ccagggctttatctgcctttga

SEQ ID NO: 9510917 - DNA, 22 bp, Homo sapiens
ccagggctttgccaaagtccag

SEQ ID NO: 9510918 - DNA, 22 bp, Homo sapiens
ccaggggaaacagggagcactc

SEQ ID NO: 9510919 - DNA, 22 bp, Homo sapiens
ccaggggaaacagggagcactc

SEQ ID NO: 9510920 - DNA, 22 bp, Homo sapiens
ccaggggaaacagggagcactc

SEQ ID NO: 9510921 - DNA, 22 bp, Homo sapiens
ccaggggaaacagggagcactc

SEQ ID NO: 9510922 - DNA, 21 bp, Homo sapiens
ccaggggcaaattgtcgtttc

SEQ ID NO: 9510923 - DNA, 22 bp, Homo sapiens
ccaggctggattttgcagttca

SEQ ID NO: 9510924 - DNA, 22 bp, Homo sapiens
ccaggctggattttgcagttca

SEQ ID NO: 9510925 - DNA, 22 bp, Homo sapiens
ccaggctggagtgtagtcgcat

SEQ ID NO: 9510926 - DNA, 22 bp, Homo sapiens
ccaggctggagtgtagtcgcat

SEQ ID NO: 9510927 - DNA, 22 bp, Homo sapiens
ccaggctggagtgtagtcgcat

SEQ ID NO: 9510928 - DNA, 20 bp, Homo sapiens
ccaggctggcaaatgggggc

SEQ ID NO: 9510929 - DNA, 20 bp, Homo sapiens
ccaggctggcaaatgggggc

SEQ ID NO: 9510930 - DNA, 20 bp, Homo sapiens
ccaggctggcaaatgggggc

SEQ ID NO: 9510931 - DNA, 22 bp, Homo sapiens
ccaggctggattttgcagttca

SEQ ID NO: 9510932 - DNA, 22 bp, Homo sapiens
tgaagttcaagggctacatttg

SEQ ID NO: 9510933 - DNA, 23 bp, Homo sapiens
tgaagttcattctcactgatgta

SEQ ID NO: 9510934 - DNA, 22 bp, Homo sapiens
tgaagttcactgagagttcacc

SEQ ID NO: 9510935 - DNA, 20 bp, Homo sapiens
ccaggctggcaaatgggggc

SEQ ID NO: 9510936 - DNA, 22 bp, Homo sapiens
ccaggctggagtgcagtagtgt

SEQ ID NO: 9510937 - DNA, 22 bp, Homo sapiens
ccaggctggagtgcagtagtgt

SEQ ID NO: 9510938 - DNA, 22 bp, Homo sapiens
ccaggctggagtgcagtagtgt

SEQ ID NO: 9510939 - DNA, 22 bp, Homo sapiens
ccaggctggagtgcaatggtgc

SEQ ID NO: 9510940 - DNA, 22 bp, Homo sapiens
ccaggctggagtgcagtagtgt

SEQ ID NO: 9510941 - DNA, 22 bp, Homo sapiens
ccaggctggagtgcaatggtgc

SEQ ID NO: 9510942 - DNA, 22 bp, Homo sapiens
ccaggctggagtgcagtggcac

SEQ ID NO: 9510943 - DNA, 22 bp, Homo sapiens
ccaggctggagtgcagtggcac

SEQ ID NO: 9510944 - DNA, 22 bp, Homo sapiens
ccaggctggagtgcagtggcac

SEQ ID NO: 9510945 - DNA, 22 bp, Homo sapiens
ccaggctggagtgcagtggcac

SEQ ID NO: 9510946 - DNA, 22 bp, Homo sapiens
ccaggctggagtgcagtggcac

SEQ ID NO: 9510947 - DNA, 22 bp, Homo sapiens
ccaggctggagtgcagtggcac

SEQ ID NO: 9510948 - DNA, 23 bp, Homo sapiens
tgacaacagctctcagccatgtc

SEQ ID NO: 9510949 - DNA, 22 bp, Homo sapiens
tgacaactttacaaaattcttc

SEQ ID NO: 9510950 - DNA, 20 bp, Homo sapiens
tgacaactctgagaacgttc

SEQ ID NO: 9510951 - DNA, 22 bp, Homo sapiens
tgaatgcactgctctcctagga

SEQ ID NO: 9510952 - DNA, 22 bp, Homo sapiens
tgaatgcaagaaggaacatgaa

SEQ ID NO: 9510953 - DNA, 22 bp, Homo sapiens
tgaatgcactgctctcctagga

SEQ ID NO: 9510954 - DNA, 20 bp, Homo sapiens
tgacaacaaaatggtaattt

SEQ ID NO: 9510955 - DNA, 22 bp, Homo sapiens
tgaatgatggtgtgttcttgcc

SEQ ID NO: 9510956 - DNA, 22 bp, Homo sapiens
tgaatgatctagttttgtagac

SEQ ID NO: 9510957 - DNA, 22 bp, Homo sapiens
tgaagttgttaaggttgccatt

SEQ ID NO: 9510958 - DNA, 21 bp, Homo sapiens
tgaagttcgcgggcaagatta

SEQ ID NO: 9510959 - DNA, 22 bp, Homo sapiens
tgaagttgttaaggttgccatt

SEQ ID NO: 9510960 - DNA, 22 bp, Homo sapiens
tgaggactttccatgttaatgt

SEQ ID NO: 9510961 - DNA, 22 bp, Homo sapiens
tgaggcagaaaatagcagttca

SEQ ID NO: 9510962 - DNA, 22 bp, Homo sapiens
tgaggcagaaaatagcagttca

SEQ ID NO: 9510963 - DNA, 22 bp, Homo sapiens
tgaggcagaaaatagcagttca

SEQ ID NO: 9510964 - DNA, 22 bp, Homo sapiens
tgaggcagaaattcctgttttc

SEQ ID NO: 9510965 - DNA, 22 bp, Homo sapiens
tgaggcagcaattgattattca

SEQ ID NO: 9510966 - DNA, 22 bp, Homo sapiens
tgaggcagatatttattgggtt

SEQ ID NO: 9510967 - DNA, 22 bp, Homo sapiens
ccaggtgtgccagcagggactg

SEQ ID NO: 9510968 - DNA, 22 bp, Homo sapiens
ccaggtgtgctctgcagtggat

SEQ ID NO: 9510969 - DNA, 22 bp, Homo sapiens
ccaggtgtgatttcatctgagg

SEQ ID NO: 9510970 - DNA, 22 bp, Homo sapiens
ccaggtgtgatttggcagtgtc

SEQ ID NO: 9510971 - DNA, 22 bp, Homo sapiens
ccaggtgtggccacatggctgg

SEQ ID NO: 9510972 - DNA, 22 bp, Homo sapiens
ccaggtgtggggaggactcaca

SEQ ID NO: 9510973 - DNA, 22 bp, Homo sapiens
ccaggtgtggtggcatacacct

SEQ ID NO: 9510974 - DNA, 23 bp, Homo sapiens
tgaggacctctcaggggccaggc

SEQ ID NO: 9510975 - DNA, 22 bp, Homo sapiens
ccaggtgtcatgcgtgtgaccc

SEQ ID NO: 9510976 - DNA, 22 bp, Homo sapiens
ccaggtgtaggacaccaaggga

SEQ ID NO: 9510977 - DNA, 22 bp, Homo sapiens
ccaggtgtcatggataatgggt

SEQ ID NO: 9510978 - DNA, 22 bp, Homo sapiens
ccaggtgtctgtggccagccct

SEQ ID NO: 9510979 - DNA, 22 bp, Homo sapiens
ccaggtgtctgtctctttttca

SEQ ID NO: 9510980 - DNA, 22 bp, Homo sapiens
ccaggtgtccccgtcactgcag

SEQ ID NO: 9510981 - DNA, 22 bp, Homo sapiens
ccaggtggttcaggtcaccata

SEQ ID NO: 9510982 - DNA, 22 bp, Homo sapiens
ccaggtgtagcactgctcacag

SEQ ID NO: 9510983 - DNA, 22 bp, Homo sapiens
tgagacgaagtcttgctctgtt

SEQ ID NO: 9510984 - DNA, 22 bp, Homo sapiens
tgagacgaagtcttgctctgtt

SEQ ID NO: 9510985 - DNA, 17 bp, Homo sapiens
ccaggtgggaggtgggg

SEQ ID NO: 9510986 - DNA, 22 bp, Homo sapiens
tgagacatcatggctgaaagta

SEQ ID NO: 9510987 - DNA, 22 bp, Homo sapiens
tgagacagtttttctatttcca

SEQ ID NO: 9510988 - DNA, 23 bp, Homo sapiens
tgagaccctaatttagcaagtgt

SEQ ID NO: 9510989 - DNA, 20 bp, Homo sapiens
tgagacccgctgacaagttc

SEQ ID NO: 9510990 - DNA, 23 bp, Homo sapiens
tgagaccctaatttagcaagtgt

SEQ ID NO: 9510991 - DNA, 22 bp, Homo sapiens
tgagacctgcctctgcactagg

SEQ ID NO: 9510992 - DNA, 22 bp, Homo sapiens
tgagacgaagtcttgctctgtt

SEQ ID NO: 9510993 - DNA, 22 bp, Homo sapiens
tgagacctgtaatgagaaattg

SEQ ID NO: 9510994 - DNA, 22 bp, Homo sapiens
tgagacctgtagcttcacagag

SEQ ID NO: 9510995 - DNA, 22 bp, Homo sapiens
tgagacagttctgcagctgggt

SEQ ID NO: 9510996 - DNA, 22 bp, Homo sapiens
tgagacagttctgcagctgggt

SEQ ID NO: 9510997 - DNA, 22 bp, Homo sapiens
tgagacagttggtgaaatctaa

SEQ ID NO: 9510998 - DNA, 22 bp, Homo sapiens
tgagacagttggtgaaatctaa

SEQ ID NO: 9510999 - DNA, 22 bp, Homo sapiens
tgagacagttctgcagctgggt

SEQ ID NO: 9511000 - DNA, 22 bp, Homo sapiens
tgagaataactgatttaaatgc

SEQ ID NO: 9511001 - DNA, 22 bp, Homo sapiens
tgagaagtgacattattgaatg

SEQ ID NO: 9511002 - DNA, 22 bp, Homo sapiens
tgagaataacagcctgtgttcc

SEQ ID NO: 9511003 - DNA, 22 bp, Homo sapiens
tgagaaggtgaaagtgtggaga

SEQ ID NO: 9511004 - DNA, 22 bp, Homo sapiens
tgagaaggtgaaagtgtggaga

SEQ ID NO: 9511005 - DNA, 19 bp, Homo sapiens
tgagaaggtttccgtgggt

SEQ ID NO: 9511006 - DNA, 17 bp, Homo sapiens
tgagaagtaggcatcat

SEQ ID NO: 9511007 - DNA, 22 bp, Homo sapiens
tgagaagtactacaagagaggg

SEQ ID NO: 9511008 - DNA, 22 bp, Homo sapiens
tgagaagtactacaagagaggg

SEQ ID NO: 9511009 - DNA, 19 bp, Homo sapiens
tgagaaggcagtggggagc

SEQ ID NO: 9511010 - DNA, 22 bp, Homo sapiens
tgagaaggcctgtgtgacaggg

SEQ ID NO: 9511011 - DNA, 22 bp, Homo sapiens
tgagaagggttggagaaataat

SEQ ID NO: 9511012 - DNA, 22 bp, Homo sapiens
tgagaagggttggagaaataat

SEQ ID NO: 9511013 - DNA, 22 bp, Homo sapiens
tgagaaggctcaggcttagaga

SEQ ID NO: 9511014 - DNA, 20 bp, Homo sapiens
tgagaaggggtcagctgtac

SEQ ID NO: 9511015 - DNA, 20 bp, Homo sapiens
tgagaaggggtcagctgtac

SEQ ID NO: 9511016 - DNA, 22 bp, Homo sapiens
tgagaatattgttttagtgagg

SEQ ID NO: 9511017 - DNA, 22 bp, Homo sapiens
tgagaatagcagactggtaact

SEQ ID NO: 9511018 - DNA, 22 bp, Homo sapiens
tgagaatagcaaaagctgtcag

SEQ ID NO: 9511019 - DNA, 22 bp, Homo sapiens
tgagaatagcaaaagctgtcag

SEQ ID NO: 9511020 - DNA, 22 bp, Homo sapiens
tgagaatagaaagagctgtcat

SEQ ID NO: 9511021 - DNA, 22 bp, Homo sapiens
tgagaatagaaagagctgtcat

SEQ ID NO: 9511022 - DNA, 22 bp, Homo sapiens
tgagaatactgcattgttagga

SEQ ID NO: 9511023 - DNA, 22 bp, Homo sapiens
tgagaatagtaataatttctgg

SEQ ID NO: 9511024 - DNA, 22 bp, Homo sapiens
tgagaatatttgaagatgttag

SEQ ID NO: 9511025 - DNA, 22 bp, Homo sapiens
tgagaatgaatcttttgctttc

SEQ ID NO: 9511026 - DNA, 22 bp, Homo sapiens
ccaggggctctcagggtgtgtg

SEQ ID NO: 9511027 - DNA, 22 bp, Homo sapiens
ccaggggctctcagggtgtgtg

SEQ ID NO: 9511028 - DNA, 22 bp, Homo sapiens
ccaggggctctcagggtgtgtg

SEQ ID NO: 9511029 - DNA, 22 bp, Homo sapiens
ccaggtgctagcaatcactgtc

SEQ ID NO: 9511030 - DNA, 22 bp, Homo sapiens
ccaggtctcgggtctgctcgtg

SEQ ID NO: 9511031 - DNA, 22 bp, Homo sapiens
ccaggtctcgggtctgctcgtg

SEQ ID NO: 9511032 - DNA, 17 bp, Homo sapiens
ccaggtctccttgcttt

SEQ ID NO: 9511033 - DNA, 17 bp, Homo sapiens
ccaggtctccttgcttt

SEQ ID NO: 9511034 - DNA, 22 bp, Homo sapiens
ccagggtaccccaagggcaggt

SEQ ID NO: 9511035 - DNA, 21 bp, Homo sapiens
ccagggtccagctgccatggt

SEQ ID NO: 9511036 - DNA, 22 bp, Homo sapiens
ccaggggttggaggttgcagtg

SEQ ID NO: 9511037 - DNA, 22 bp, Homo sapiens
ccagggtaccccaagggcaggt

SEQ ID NO: 9511038 - DNA, 22 bp, Homo sapiens
ccaggggggcgtagatgctggg

SEQ ID NO: 9511039 - DNA, 22 bp, Homo sapiens
ccaggggctggtgctgagctgg

SEQ ID NO: 9511040 - DNA, 22 bp, Homo sapiens
ccaggggctggtgctgagctgg

SEQ ID NO: 9511041 - DNA, 22 bp, Homo sapiens
ccagggggcttggtgaggccat

SEQ ID NO: 9511042 - DNA, 22 bp, Homo sapiens
ccaggtggaaggtctgtgctct

SEQ ID NO: 9511043 - DNA, 22 bp, Homo sapiens
ccaggtggaaggtctgtgctct

SEQ ID NO: 9511044 - DNA, 17 bp, Homo sapiens
ccaggtggaatcgtgga

SEQ ID NO: 9511045 - DNA, 19 bp, Homo sapiens
ccaggtggaactgaggtag

SEQ ID NO: 9511046 - DNA, 22 bp, Homo sapiens
ccaggtgctcttgccagggctg

SEQ ID NO: 9511047 - DNA, 19 bp, Homo sapiens
ccaggtggaactgaggtag

SEQ ID NO: 9511048 - DNA, 22 bp, Homo sapiens
ccaggtgctgaccggtcagatt

SEQ ID NO: 9511049 - DNA, 22 bp, Homo sapiens
ccaggtgctcttgccagggctg

SEQ ID NO: 9511050 - DNA, 22 bp, Homo sapiens
ccaggtgctgaccggtcagatt

SEQ ID NO: 9511051 - DNA, 22 bp, Homo sapiens
ccaggtgctcttgccagggctg

SEQ ID NO: 9511052 - DNA, 22 bp, Homo sapiens
ccaggtgctcttgccagggctg

SEQ ID NO: 9511053 - DNA, 22 bp, Homo sapiens
ccagagagaaaatggagggcca

SEQ ID NO: 9511054 - DNA, 22 bp, Homo sapiens
ccagagagaaaatggagggcca

SEQ ID NO: 9511055 - DNA, 22 bp, Homo sapiens
ccagagagaaaatggagggcca

SEQ ID NO: 9511056 - DNA, 22 bp, Homo sapiens
ccagagagaaatggatttgagt

SEQ ID NO: 9511057 - DNA, 22 bp, Homo sapiens
ccagagagagaggtcaatggca

SEQ ID NO: 9511058 - DNA, 22 bp, Homo sapiens
tctcagacatgtaatctctacc

SEQ ID NO: 9511059 - DNA, 22 bp, Homo sapiens
tctcagaattgtgtccactggg

SEQ ID NO: 9511060 - DNA, 22 bp, Homo sapiens
tctcagaatccttgcccaggtg

SEQ ID NO: 9511061 - DNA, 22 bp, Homo sapiens
tctcagaatccttgcccaggtg

SEQ ID NO: 9511062 - DNA, 22 bp, Homo sapiens
tctcagaatcaggacctacttc

SEQ ID NO: 9511063 - DNA, 22 bp, Homo sapiens
tctgctattttctatctgtgtg

SEQ ID NO: 9511064 - DNA, 22 bp, Homo sapiens
tctgctattttctatctgtgtg

SEQ ID NO: 9511065 - DNA, 22 bp, Homo sapiens
tctgctaatgtggttatttcta

SEQ ID NO: 9511066 - DNA, 18 bp, Homo sapiens
tctggaacaacttcatgt

SEQ ID NO: 9511067 - DNA, 22 bp, Homo sapiens
tctggaaatttcagttttagag

SEQ ID NO: 9511068 - DNA, 22 bp, Homo sapiens
tctggaacagttacttgctgat

SEQ ID NO: 9511069 - DNA, 21 bp, Homo sapiens
tctggaagaaaaaagtattat

SEQ ID NO: 9511070 - DNA, 22 bp, Homo sapiens
ccagctctcagcgggagactca

SEQ ID NO: 9511071 - DNA, 22 bp, Homo sapiens
tctggaaagatcattaaatcca

SEQ ID NO: 9511072 - DNA, 22 bp, Homo sapiens
tctggaaagatcattaaatcca

SEQ ID NO: 9511073 - DNA, 22 bp, Homo sapiens
tctggaaaagcgataaaccatt

SEQ ID NO: 9511074 - DNA, 22 bp, Homo sapiens
tctgctttttcattgactgaaa

SEQ ID NO: 9511075 - DNA, 22 bp, Homo sapiens
tctgctttgctgcctcctgatc

SEQ ID NO: 9511076 - DNA, 22 bp, Homo sapiens
tctgctttcttgcgcagatgtg

SEQ ID NO: 9511077 - DNA, 22 bp, Homo sapiens
tctgctttcttgcgcagatgtg

SEQ ID NO: 9511078 - DNA, 22 bp, Homo sapiens
tctgctcaatactgctcatgaa

SEQ ID NO: 9511079 - DNA, 22 bp, Homo sapiens
tctgctgtttactgtgtgatat

SEQ ID NO: 9511080 - DNA, 22 bp, Homo sapiens
tctgcttctcctacttcatggg

SEQ ID NO: 9511081 - DNA, 22 bp, Homo sapiens
tctgcttctcctacttcatggg

SEQ ID NO: 9511082 - DNA, 22 bp, Homo sapiens
tctgctttcttactaaaaatga

SEQ ID NO: 9511083 - DNA, 22 bp, Homo sapiens
tctgctttcttactaaaaatga

SEQ ID NO: 9511084 - DNA, 22 bp, Homo sapiens
ccagctgcaggggagcagtgga

SEQ ID NO: 9511085 - DNA, 22 bp, Homo sapiens
ccagctgaggttgaagaaagag

SEQ ID NO: 9511086 - DNA, 22 bp, Homo sapiens
ccagctctgccaagcgtcagct

SEQ ID NO: 9511087 - DNA, 22 bp, Homo sapiens
ccagctctgccaagcgtcagct

SEQ ID NO: 9511088 - DNA, 20 bp, Homo sapiens
ccagctgagccaaggggaga

SEQ ID NO: 9511089 - DNA, 22 bp, Homo sapiens
ccagctgaggcagccacacagg

SEQ ID NO: 9511090 - DNA, 22 bp, Homo sapiens
ccagctgcccaagaggcatcct

SEQ ID NO: 9511091 - DNA, 22 bp, Homo sapiens
ccagctgcatcctattcactgc

SEQ ID NO: 9511092 - DNA, 22 bp, Homo sapiens
ccagctgcaggtgttccagatg

SEQ ID NO: 9511093 - DNA, 22 bp, Homo sapiens
ccagctgcaggtgttccagatg

SEQ ID NO: 9511094 - DNA, 22 bp, Homo sapiens
ccagctctgattttgacctcca

SEQ ID NO: 9511095 - DNA, 22 bp, Homo sapiens
ccagctctgccaagcgtcagct

SEQ ID NO: 9511096 - DNA, 22 bp, Homo sapiens
ccagctctcttcaagcccactc

SEQ ID NO: 9511097 - DNA, 22 bp, Homo sapiens
ccagctctctttgaagcataaa

SEQ ID NO: 9511098 - DNA, 22 bp, Homo sapiens
ccagctctctttgaagcataaa

SEQ ID NO: 9511099 - DNA, 22 bp, Homo sapiens
ccagctctgattttgacctcca

SEQ ID NO: 9511100 - DNA, 22 bp, Homo sapiens
ccagctctctgtcctccccaca

SEQ ID NO: 9511101 - DNA, 22 bp, Homo sapiens
ccagctctctgtcctccccaca

SEQ ID NO: 9511102 - DNA, 22 bp, Homo sapiens
ccagctctctgtcctccccaca

SEQ ID NO: 9511103 - DNA, 18 bp, Homo sapiens
ccagctgcgctgaaccga

SEQ ID NO: 9511104 - DNA, 21 bp, Homo sapiens
ccagctgcctgcactttggac

SEQ ID NO: 9511105 - DNA, 18 bp, Homo sapiens
ccagctgcgctgaaccga

SEQ ID NO: 9511106 - DNA, 22 bp, Homo sapiens
ccagctgcgggcatcgagagtt

SEQ ID NO: 9511107 - DNA, 22 bp, Homo sapiens
ccagctgcccaagaggcatcct

SEQ ID NO: 9511108 - DNA, 22 bp, Homo sapiens
ccagctgcccactatgtgttct

SEQ ID NO: 9511109 - DNA, 22 bp, Homo sapiens
ccagctgcgggcatcgagagtt

SEQ ID NO: 9511110 - DNA, 22 bp, Homo sapiens
ccagctgcggtctcccaaagtt

SEQ ID NO: 9511111 - DNA, 22 bp, Homo sapiens
ccagctgctatcatgccatttc

SEQ ID NO: 9511112 - DNA, 17 bp, Homo sapiens
ccagctgctccctcaga

SEQ ID NO: 9511113 - DNA, 22 bp, Homo sapiens
ccagctgctatcatgccatttc

SEQ ID NO: 9511114 - DNA, 21 bp, Homo sapiens
ccagctgctccttgaggttcc

SEQ ID NO: 9511115 - DNA, 22 bp, Homo sapiens
tctggaggccatagggaaggat

SEQ ID NO: 9511116 - DNA, 22 bp, Homo sapiens
tctggaggccatagggaaggat

SEQ ID NO: 9511117 - DNA, 22 bp, Homo sapiens
tctggcagcaagtctgtttctc

SEQ ID NO: 9511118 - DNA, 22 bp, Homo sapiens
ccagctgctgtgaggaccacag

SEQ ID NO: 9511119 - DNA, 22 bp, Homo sapiens
ccagctgctgcaccgtgcatgg

SEQ ID NO: 9511120 - DNA, 22 bp, Homo sapiens
ccagctgctgacatgggcaggt

SEQ ID NO: 9511121 - DNA, 22 bp, Homo sapiens
ccagctgctgacatgggcaggt

SEQ ID NO: 9511122 - DNA, 22 bp, Homo sapiens
ccagctgctctcttctccgcca

SEQ ID NO: 9511123 - DNA, 22 bp, Homo sapiens
ccagctgctctcttctccgcca

SEQ ID NO: 9511124 - DNA, 22 bp, Homo sapiens
tctggcaggggttctgcacttg

SEQ ID NO: 9511125 - DNA, 22 bp, Homo sapiens
tctggccctgctgctgtgagca

SEQ ID NO: 9511126 - DNA, 22 bp, Homo sapiens
tctggcctactggagtccatga

SEQ ID NO: 9511127 - DNA, 22 bp, Homo sapiens
tctggccctgctgctgtgagca

SEQ ID NO: 9511128 - DNA, 22 bp, Homo sapiens
tctggccctgctgctgtgagca

SEQ ID NO: 9511129 - DNA, 22 bp, Homo sapiens
tctggccctgctgctgtgagca

SEQ ID NO: 9511130 - DNA, 22 bp, Homo sapiens
tctggcctatttctgtcagatc

SEQ ID NO: 9511131 - DNA, 22 bp, Homo sapiens
tctggcctatttctgtcagatc

SEQ ID NO: 9511132 - DNA, 22 bp, Homo sapiens
tctggcctactggagtccatga

SEQ ID NO: 9511133 - DNA, 22 bp, Homo sapiens
tctggcctgaaagtccatgctt

SEQ ID NO: 9511134 - DNA, 22 bp, Homo sapiens
tctggcctcttgggatgctccc

SEQ ID NO: 9511135 - DNA, 22 bp, Homo sapiens
tctggcctcttgggatgctccc

SEQ ID NO: 9511136 - DNA, 22 bp, Homo sapiens
tctggcctcttgggatgctccc

SEQ ID NO: 9511137 - DNA, 22 bp, Homo sapiens
tctggcctgggcctgccggtgc

SEQ ID NO: 9511138 - DNA, 22 bp, Homo sapiens
tctggcctgggcctgccggtgc

SEQ ID NO: 9511139 - DNA, 22 bp, Homo sapiens
tctggcctgtgttggtggcccc

SEQ ID NO: 9511140 - DNA, 22 bp, Homo sapiens
tctggcctgtgttggtggcccc

SEQ ID NO: 9511141 - DNA, 22 bp, Homo sapiens
tctggccttatctgtccaagcc

SEQ ID NO: 9511142 - DNA, 22 bp, Homo sapiens
tctggcagcgaagcgtgtactt

SEQ ID NO: 9511143 - DNA, 21 bp, Homo sapiens
tctggcagcagtttgttgagt

SEQ ID NO: 9511144 - DNA, 21 bp, Homo sapiens
tctggcaggaagacggatggg

SEQ ID NO: 9511145 - DNA, 21 bp, Homo sapiens
tctggcaggaagacggatggg

SEQ ID NO: 9511146 - DNA, 21 bp, Homo sapiens
tctggcaggaagacggatggg

SEQ ID NO: 9511147 - DNA, 22 bp, Homo sapiens
tctggcaggcaatcggctctgg

SEQ ID NO: 9511148 - DNA, 22 bp, Homo sapiens
tctggcaggacatgctgaccat

SEQ ID NO: 9511149 - DNA, 22 bp, Homo sapiens
tctggcaggatatcgaagtgaa

SEQ ID NO: 9511150 - DNA, 18 bp, Homo sapiens
ccaggacaggcaaaaggt

SEQ ID NO: 9511151 - DNA, 18 bp, Homo sapiens
ccaggacaggcaaaaggt

SEQ ID NO: 9511152 - DNA, 22 bp, Homo sapiens
ccaggacagggagacgggagcc

SEQ ID NO: 9511153 - DNA, 22 bp, Homo sapiens
ccaggacagggagacgggagcc

SEQ ID NO: 9511154 - DNA, 22 bp, Homo sapiens
ccaggacaggagttggcttcgc

SEQ ID NO: 9511155 - DNA, 22 bp, Homo sapiens
ccaggacactgcttcacagcag

SEQ ID NO: 9511156 - DNA, 22 bp, Homo sapiens
ccaggacctggagctctatgaa

SEQ ID NO: 9511157 - DNA, 22 bp, Homo sapiens
ccaggacctggagctctatgaa

SEQ ID NO: 9511158 - DNA, 19 bp, Homo sapiens
ccaggacctttccagggtc

SEQ ID NO: 9511159 - DNA, 22 bp, Homo sapiens
ccaggactcaatgaccacaggg

SEQ ID NO: 9511160 - DNA, 19 bp, Homo sapiens
ccaggacctttccagggtc

SEQ ID NO: 9511161 - DNA, 22 bp, Homo sapiens
ccaggaccacacgacaggagag

SEQ ID NO: 9511162 - DNA, 22 bp, Homo sapiens
ccaggacatgttgcaagtttat

SEQ ID NO: 9511163 - DNA, 22 bp, Homo sapiens
ccaggaccctgcaaaccctgtt

SEQ ID NO: 9511164 - DNA, 22 bp, Homo sapiens
ccaggacagtgaacatgtaaga

SEQ ID NO: 9511165 - DNA, 22 bp, Homo sapiens
ccaggacagtgaacatgtaaga

SEQ ID NO: 9511166 - DNA, 22 bp, Homo sapiens
tctggctcaggtcagacaggga

SEQ ID NO: 9511167 - DNA, 21 bp, Homo sapiens
ccaggaaggactgagctccct

SEQ ID NO: 9511168 - DNA, 21 bp, Homo sapiens
ccaggaaggactgagctccct

SEQ ID NO: 9511169 - DNA, 22 bp, Homo sapiens
tctggctcaggtcagacaggga

SEQ ID NO: 9511170 - DNA, 22 bp, Homo sapiens
ccaggacaattcgtcactttct

SEQ ID NO: 9511171 - DNA, 22 bp, Homo sapiens
ccaggacacgatttttagtctg

SEQ ID NO: 9511172 - DNA, 22 bp, Homo sapiens
ccaggacactgcttcacagcag

SEQ ID NO: 9511173 - DNA, 22 bp, Homo sapiens
tctggctcagggctctgaggga

SEQ ID NO: 9511174 - DNA, 22 bp, Homo sapiens
tctggctcaggagctgtgttca

SEQ ID NO: 9511175 - DNA, 18 bp, Homo sapiens
tctggctcaggactgaac

SEQ ID NO: 9511176 - DNA, 22 bp, Homo sapiens
tctggctcacttcaggcttcac

SEQ ID NO: 9511177 - DNA, 17 bp, Homo sapiens
tctggccttcctgaact

SEQ ID NO: 9511178 - DNA, 22 bp, Homo sapiens
tctggctaacattttgtggaga

SEQ ID NO: 9511179 - DNA, 22 bp, Homo sapiens
tctggctatatgctggcttcca

SEQ ID NO: 9511180 - DNA, 22 bp, Homo sapiens
tctggctcaaaatacgtactct

SEQ ID NO: 9511181 - DNA, 22 bp, Homo sapiens
tctggctcacttcaggcttcac

SEQ ID NO: 9511182 - DNA, 22 bp, Homo sapiens
tctgggagcagatgatggtata

SEQ ID NO: 9511183 - DNA, 22 bp, Homo sapiens
tctgggagcacacgcagtgatc

SEQ ID NO: 9511184 - DNA, 22 bp, Homo sapiens
tctgggagcacacgcagtgatc

SEQ ID NO: 9511185 - DNA, 22 bp, Homo sapiens
tctgggagatccaagcagaact

SEQ ID NO: 9511186 - DNA, 19 bp, Homo sapiens
tctgggagagtgaatctga

SEQ ID NO: 9511187 - DNA, 22 bp, Homo sapiens
ccaggactcaattaacctcact

SEQ ID NO: 9511188 - DNA, 21 bp, Homo sapiens
ccaggactccatggggtctct

SEQ ID NO: 9511189 - DNA, 22 bp, Homo sapiens
ccaggactcagtggggaaaggg

SEQ ID NO: 9511190 - DNA, 20 bp, Homo sapiens
tctggggatgaggtctagga

SEQ ID NO: 9511191 - DNA, 20 bp, Homo sapiens
tctggggatgaggtctagga

SEQ ID NO: 9511192 - DNA, 22 bp, Homo sapiens
tctggggatgaggtccagtgat

SEQ ID NO: 9511193 - DNA, 22 bp, Homo sapiens
tctggggatgaggtccagtgat

SEQ ID NO: 9511194 - DNA, 22 bp, Homo sapiens
tctggtaacctttatccctcct

SEQ ID NO: 9511195 - DNA, 22 bp, Homo sapiens
tctggtagaagaagtgaagctg

SEQ ID NO: 9511196 - DNA, 22 bp, Homo sapiens
tctgggagcagctcagcagatt

SEQ ID NO: 9511197 - DNA, 22 bp, Homo sapiens
tctgggagccatgccttggagt

SEQ ID NO: 9511198 - DNA, 22 bp, Homo sapiens
ccaggagaagcatctgagtgta

SEQ ID NO: 9511199 - DNA, 22 bp, Homo sapiens
ccaggagaagcatctgagtgta

SEQ ID NO: 9511200 - DNA, 19 bp, Homo sapiens
ccaggactttgcagacact

SEQ ID NO: 9511201 - DNA, 22 bp, Homo sapiens
ccaggagaagcatctgagtgta

SEQ ID NO: 9511202 - DNA, 22 bp, Homo sapiens
ccaggagaataatggcagatta

SEQ ID NO: 9511203 - DNA, 22 bp, Homo sapiens
ccaggagaataatggcagatta

SEQ ID NO: 9511204 - DNA, 22 bp, Homo sapiens
ccaggagaagcatctgagtgta

SEQ ID NO: 9511205 - DNA, 22 bp, Homo sapiens
tctggttgtcgaccaccaatgc

SEQ ID NO: 9511206 - DNA, 22 bp, Homo sapiens
ccaggactgcagggggcgagga

SEQ ID NO: 9511207 - DNA, 22 bp, Homo sapiens
ccaggacttattacagtataac

SEQ ID NO: 9511208 - DNA, 22 bp, Homo sapiens
ccaggacttcgaggctacagtg

SEQ ID NO: 9511209 - DNA, 22 bp, Homo sapiens
ccaggactttaagtccagcact

SEQ ID NO: 9511210 - DNA, 19 bp, Homo sapiens
tctggttcatttctgctgt

SEQ ID NO: 9511211 - DNA, 22 bp, Homo sapiens
tctggtgtcagtattctttgaa

SEQ ID NO: 9511212 - DNA, 22 bp, Homo sapiens
tctggtggtgggccacaagcat

SEQ ID NO: 9511213 - DNA, 22 bp, Homo sapiens
tctggtcctgaagtcaacttca

SEQ ID NO: 9511214 - DNA, 22 bp, Homo sapiens
tctggtcctctctgtgatgcta

SEQ ID NO: 9511215 - DNA, 22 bp, Homo sapiens
tctggtcctctctgtgatgcta

SEQ ID NO: 9511216 - DNA, 21 bp, Homo sapiens
tctggtctgctgtggacctgg

SEQ ID NO: 9511217 - DNA, 20 bp, Homo sapiens
tctggtgccccttcctgaga

SEQ ID NO: 9511218 - DNA, 20 bp, Homo sapiens
tctggtgccccttcctgaga

SEQ ID NO: 9511219 - DNA, 22 bp, Homo sapiens
tctggtggcacgtgtcttgcat

SEQ ID NO: 9511220 - DNA, 22 bp, Homo sapiens
tctggtggtatacatctaggag

SEQ ID NO: 9511221 - DNA, 22 bp, Homo sapiens
tctggtccccattccaggtggg

SEQ ID NO: 9511222 - DNA, 22 bp, Homo sapiens
tctggtcatcggaaagatcaaa

SEQ ID NO: 9511223 - DNA, 22 bp, Homo sapiens
tctggtccccattccaggtggg

SEQ ID NO: 9511224 - DNA, 22 bp, Homo sapiens
tctggtccccattccaggtggg

SEQ ID NO: 9511225 - DNA, 20 bp, Homo sapiens
tctggtccaggtcttcatgg

SEQ ID NO: 9511226 - DNA, 22 bp, Homo sapiens
tctggtcccttttcctgcagtc

SEQ ID NO: 9511227 - DNA, 22 bp, Homo sapiens
tctggtcctctctgtgatgcta

SEQ ID NO: 9511228 - DNA, 22 bp, Homo sapiens
tctggtcccttttcctgcagtc

SEQ ID NO: 9511229 - DNA, 22 bp, Homo sapiens
tctggtcccttttcctgcagtc

SEQ ID NO: 9511230 - DNA, 22 bp, Homo sapiens
tctggtcccttttcctgcagtc

SEQ ID NO: 9511231 - DNA, 22 bp, Homo sapiens
tctggtccctgctcacttcttg

SEQ ID NO: 9511232 - DNA, 22 bp, Homo sapiens
ccaggccccagggctggctttc

SEQ ID NO: 9511233 - DNA, 22 bp, Homo sapiens
ccaggccccagggctggctttc

SEQ ID NO: 9511234 - DNA, 22 bp, Homo sapiens
ccaggccccagggctggctttc

SEQ ID NO: 9511235 - DNA, 22 bp, Homo sapiens
tctttcaaatgcttgaattgga

SEQ ID NO: 9511236 - DNA, 22 bp, Homo sapiens
tctttcttattagccattgttc

SEQ ID NO: 9511237 - DNA, 22 bp, Homo sapiens
tctttcaatccattcatatgtc

SEQ ID NO: 9511238 - DNA, 22 bp, Homo sapiens
ccaggcccaccttggccactta

SEQ ID NO: 9511239 - DNA, 22 bp, Homo sapiens
ccaggcccagggtactgaccaa

SEQ ID NO: 9511240 - DNA, 22 bp, Homo sapiens
ccaggcccaccttggccactta

SEQ ID NO: 9511241 - DNA, 18 bp, Homo sapiens
ccaggccatgaacctctg

SEQ ID NO: 9511242 - DNA, 18 bp, Homo sapiens
ccaggccatgaacctctg

SEQ ID NO: 9511243 - DNA, 22 bp, Homo sapiens
ccaggccattcccagagttgct

SEQ ID NO: 9511244 - DNA, 22 bp, Homo sapiens
ccaggccattcccagagttgct

SEQ ID NO: 9511245 - DNA, 19 bp, Homo sapiens
ccaggccatcccagttccc

SEQ ID NO: 9511246 - DNA, 22 bp, Homo sapiens
ccaggccagtgtttggtccagg

SEQ ID NO: 9511247 - DNA, 22 bp, Homo sapiens
ccaggccagtgtttggtccagg

SEQ ID NO: 9511248 - DNA, 22 bp, Homo sapiens
ccaggccagtgtttggtccagg

SEQ ID NO: 9511249 - DNA, 22 bp, Homo sapiens
ccaggccaggagagcgaggttt

SEQ ID NO: 9511250 - DNA, 22 bp, Homo sapiens
ccaggccaggagagcgaggttt

SEQ ID NO: 9511251 - DNA, 22 bp, Homo sapiens
ccaggccagggctgcagcgagc

SEQ ID NO: 9511252 - DNA, 22 bp, Homo sapiens
ccaggccagggctgcagcgagc

SEQ ID NO: 9511253 - DNA, 22 bp, Homo sapiens
ccaggccagggctgcagcgagc

SEQ ID NO: 9511254 - DNA, 22 bp, Homo sapiens
ccaggccagtgtttggtccagg

SEQ ID NO: 9511255 - DNA, 22 bp, Homo sapiens
ccaggccagtgtttggtccagg

SEQ ID NO: 9511256 - DNA, 22 bp, Homo sapiens
ccaggcctgcatctgctgcgca

SEQ ID NO: 9511257 - DNA, 22 bp, Homo sapiens
tctttctttatcacctgatatg

SEQ ID NO: 9511258 - DNA, 22 bp, Homo sapiens
tctttctttatcacctgatatg

SEQ ID NO: 9511259 - DNA, 22 bp, Homo sapiens
tctttgaaaagggagatagaaa

SEQ ID NO: 9511260 - DNA, 22 bp, Homo sapiens
tctttgaaaagggagatagaaa

SEQ ID NO: 9511261 - DNA, 22 bp, Homo sapiens
ccaggcctggaccatgccaggg

SEQ ID NO: 9511262 - DNA, 19 bp, Homo sapiens
ccaggcctgcgggcgttgg

SEQ ID NO: 9511263 - DNA, 19 bp, Homo sapiens
ccaggcctgcgggcgttgg

SEQ ID NO: 9511264 - DNA, 22 bp, Homo sapiens
ccaggcctgcattccctctcag

SEQ ID NO: 9511265 - DNA, 22 bp, Homo sapiens
ccaggcctgcattccctctcag

SEQ ID NO: 9511266 - DNA, 22 bp, Homo sapiens
tctttcttctttcatagtgtga

SEQ ID NO: 9511267 - DNA, 22 bp, Homo sapiens
tctttcttggtataaagcaggg

SEQ ID NO: 9511268 - DNA, 22 bp, Homo sapiens
tctttcttggtattctgagcta

SEQ ID NO: 9511269 - DNA, 22 bp, Homo sapiens
tctttcttggtataaagcaggg

SEQ ID NO: 9511270 - DNA, 22 bp, Homo sapiens
tctttcttgtgggtgccctttt

SEQ ID NO: 9511271 - DNA, 22 bp, Homo sapiens
tctttcttattatgctcaatgt

SEQ ID NO: 9511272 - DNA, 22 bp, Homo sapiens
tctttcttattatgctcaatgt

SEQ ID NO: 9511273 - DNA, 22 bp, Homo sapiens
tctttcttcagccctgtaagat

SEQ ID NO: 9511274 - DNA, 22 bp, Homo sapiens
tctttcttctttcatagtgtga

SEQ ID NO: 9511275 - DNA, 22 bp, Homo sapiens
tctttcttctttcatagtgtga

SEQ ID NO: 9511276 - DNA, 22 bp, Homo sapiens
ccaggctgctgttggtgtccgc

SEQ ID NO: 9511277 - DNA, 22 bp, Homo sapiens
ccaggctggagtgcaatggtgc

SEQ ID NO: 9511278 - DNA, 22 bp, Homo sapiens
ccaggctggagtgcaatggtgc

SEQ ID NO: 9511279 - DNA, 22 bp, Homo sapiens
ccaggctggagtgcaatggcgt

SEQ ID NO: 9511280 - DNA, 22 bp, Homo sapiens
ccaggctggagtgcaatggcgt

SEQ ID NO: 9511281 - DNA, 22 bp, Homo sapiens
ccaggctggagtgcaatggcat

SEQ ID NO: 9511282 - DNA, 22 bp, Homo sapiens
ccaggctggagtgcaatggcat

SEQ ID NO: 9511283 - DNA, 22 bp, Homo sapiens
tctttggtattcacttgtgaag

SEQ ID NO: 9511284 - DNA, 22 bp, Homo sapiens
tctttggggcatctgggagatt

SEQ ID NO: 9511285 - DNA, 22 bp, Homo sapiens
tctttggggcatctgggagatt

SEQ ID NO: 9511286 - DNA, 22 bp, Homo sapiens
tctttgggagatgttatttata

SEQ ID NO: 9511287 - DNA, 22 bp, Homo sapiens
tctttgggagaaggggtcccag

SEQ ID NO: 9511288 - DNA, 22 bp, Homo sapiens
tctttggcatttaggagcagga

SEQ ID NO: 9511289 - DNA, 22 bp, Homo sapiens
tctttggccttaggagcccttg

SEQ ID NO: 9511290 - DNA, 22 bp, Homo sapiens
tctttggctatgatttactgtt

SEQ ID NO: 9511291 - DNA, 22 bp, Homo sapiens
ccaggctgaatatgttccaggg

SEQ ID NO: 9511292 - DNA, 19 bp, Homo sapiens
tctttggcttctggatcag

SEQ ID NO: 9511293 - DNA, 22 bp, Homo sapiens
tctttggctgcctgaagcccaa

SEQ ID NO: 9511294 - DNA, 22 bp, Homo sapiens
tctttggctttgccacacccaa

SEQ ID NO: 9511295 - DNA, 22 bp, Homo sapiens
tctttggctttgccacacccaa

SEQ ID NO: 9511296 - DNA, 22 bp, Homo sapiens
tctttggcttgtctcctcagtt

SEQ ID NO: 9511297 - DNA, 22 bp, Homo sapiens
ccaggctgaatatgttccaggg

SEQ ID NO: 9511298 - DNA, 23 bp, Homo sapiens
ccaggctctttcacctgctattc

SEQ ID NO: 9511299 - DNA, 22 bp, Homo sapiens
ccaggctgaatatgttccaggg

SEQ ID NO: 9511300 - DNA, 22 bp, Homo sapiens
ccaggctgaatatgttccaggg

SEQ ID NO: 9511301 - DNA, 23 bp, Homo sapiens
ccaggctctttcacctgctattc

SEQ ID NO: 9511302 - DNA, 23 bp, Homo sapiens
ccaggctctttcacctgctattc

SEQ ID NO: 9511303 - DNA, 22 bp, Homo sapiens
ccaggctctgtgtgggctagag

SEQ ID NO: 9511304 - DNA, 22 bp, Homo sapiens
ccaggctctgttccccgaggag

SEQ ID NO: 9511305 - DNA, 22 bp, Homo sapiens
ccaggctctgttccccgaggag

SEQ ID NO: 9511306 - DNA, 22 bp, Homo sapiens
ccaggctctgtgtgggctagag

SEQ ID NO: 9511307 - DNA, 22 bp, Homo sapiens
ccaggctctgtgtgggctagag

SEQ ID NO: 9511308 - DNA, 22 bp, Homo sapiens
ccaggctctgtgtgggctagag

SEQ ID NO: 9511309 - DNA, 22 bp, Homo sapiens
ccaggctctgtgtgggctagag

SEQ ID NO: 9511310 - DNA, 22 bp, Homo sapiens
ccaggctctgtgtgggctagag

SEQ ID NO: 9511311 - DNA, 22 bp, Homo sapiens
ccaggctctgtgtgggctagag

SEQ ID NO: 9511312 - DNA, 22 bp, Homo sapiens
ccaggctctgtgtgggctagag

SEQ ID NO: 9511313 - DNA, 21 bp, Homo sapiens
ccaggctcctgaggctggtca

SEQ ID NO: 9511314 - DNA, 21 bp, Homo sapiens
ccaggctcctgaggctggtca

SEQ ID NO: 9511315 - DNA, 22 bp, Homo sapiens
ccaggcctggccaggggatgcc

SEQ ID NO: 9511316 - DNA, 22 bp, Homo sapiens
ccaggcctggccaggggatgcc

SEQ ID NO: 9511317 - DNA, 22 bp, Homo sapiens
ccaggctctgtctggtcagaag

SEQ ID NO: 9511318 - DNA, 22 bp, Homo sapiens
ccaggctctgtctggtcagaag

SEQ ID NO: 9511319 - DNA, 22 bp, Homo sapiens
ccaggcctggacgggtggcctg

SEQ ID NO: 9511320 - DNA, 22 bp, Homo sapiens
ccaggcctggccaggggatgcc

SEQ ID NO: 9511321 - DNA, 22 bp, Homo sapiens
ccaggcctggacgggtggcctg

SEQ ID NO: 9511322 - DNA, 22 bp, Homo sapiens
ccaggcctggacgggtggcctg

SEQ ID NO: 9511323 - DNA, 22 bp, Homo sapiens
ccaggaggttgaggctgcagtg

SEQ ID NO: 9511324 - DNA, 22 bp, Homo sapiens
ccaggaggttgaggctgcagtg

SEQ ID NO: 9511325 - DNA, 22 bp, Homo sapiens
ccaggaggttgaggctgcagtg

SEQ ID NO: 9511326 - DNA, 22 bp, Homo sapiens
ccaggaggttgaggctgcagtg

SEQ ID NO: 9511327 - DNA, 22 bp, Homo sapiens
ccaggaggttgaggctgcagtg

SEQ ID NO: 9511328 - DNA, 22 bp, Homo sapiens
ccaggagtgcagggatggtatc

SEQ ID NO: 9511329 - DNA, 22 bp, Homo sapiens
ccaggagtctggatgaggtgtc

SEQ ID NO: 9511330 - DNA, 22 bp, Homo sapiens
ccaggagtctggatgaggtgtc

SEQ ID NO: 9511331 - DNA, 22 bp, Homo sapiens
ccaggagtcaataaaggaagct

SEQ ID NO: 9511332 - DNA, 22 bp, Homo sapiens
ccaggagtggctggtgaccttc

SEQ ID NO: 9511333 - DNA, 22 bp, Homo sapiens
ccaggagtggctggtgaccttc

SEQ ID NO: 9511334 - DNA, 19 bp, Homo sapiens
ccaggagtggtggggtgag

SEQ ID NO: 9511335 - DNA, 19 bp, Homo sapiens
ccaggagtggtggggtgag

SEQ ID NO: 9511336 - DNA, 22 bp, Homo sapiens
ccaggagttggaagctgccatg

SEQ ID NO: 9511337 - DNA, 22 bp, Homo sapiens
ccaggagacccagggaaggagc

SEQ ID NO: 9511338 - DNA, 22 bp, Homo sapiens
ccaggagacaaagatgactgct

SEQ ID NO: 9511339 - DNA, 22 bp, Homo sapiens
ccaggagaatgggattacccta

SEQ ID NO: 9511340 - DNA, 22 bp, Homo sapiens
ccaggagactgtactgatattt

SEQ ID NO: 9511341 - DNA, 22 bp, Homo sapiens
ccaggagacccagggaaggagc

SEQ ID NO: 9511342 - DNA, 17 bp, Homo sapiens
ccaggagagatgcttgt

SEQ ID NO: 9511343 - DNA, 22 bp, Homo sapiens
ccaggagggaccgcggcatccc

SEQ ID NO: 9511344 - DNA, 22 bp, Homo sapiens
ccaggagggaccgcggcatccc

SEQ ID NO: 9511345 - DNA, 22 bp, Homo sapiens
ccaggaggttgaggctgcagtg

SEQ ID NO: 9511346 - DNA, 22 bp, Homo sapiens
ccaggaggttgaggctgcagtg

SEQ ID NO: 9511347 - DNA, 22 bp, Homo sapiens
ccaggaggttgaggctgcagtg

SEQ ID NO: 9511348 - DNA, 22 bp, Homo sapiens
tcttagaatgtcaactgatgtt

SEQ ID NO: 9511349 - DNA, 22 bp, Homo sapiens
tcttagaatgtcaactgatgtt

SEQ ID NO: 9511350 - DNA, 22 bp, Homo sapiens
ccaggcaaggacatgaaactga

SEQ ID NO: 9511351 - DNA, 22 bp, Homo sapiens
ccaggcaaggtctcctagagag

SEQ ID NO: 9511352 - DNA, 22 bp, Homo sapiens
tcttcacattcacgtaacatag

SEQ ID NO: 9511353 - DNA, 22 bp, Homo sapiens
tcttcacattcacgtaacatag

SEQ ID NO: 9511354 - DNA, 22 bp, Homo sapiens
tcttcacatggagaagcaactc

SEQ ID NO: 9511355 - DNA, 22 bp, Homo sapiens
tcttcacattttaagaagttct

SEQ ID NO: 9511356 - DNA, 22 bp, Homo sapiens
tcttcacattttagtggtttgt

SEQ ID NO: 9511357 - DNA, 22 bp, Homo sapiens
tcttcacattttaagaagttct

SEQ ID NO: 9511358 - DNA, 22 bp, Homo sapiens
tcttcaccatcaacagaatgaa

SEQ ID NO: 9511359 - DNA, 22 bp, Homo sapiens
tcttcactgatgtctctcaaat

SEQ ID NO: 9511360 - DNA, 22 bp, Homo sapiens
ccaggatggggagcagatagaa

SEQ ID NO: 9511361 - DNA, 22 bp, Homo sapiens
ccaggatctgatattgggctcc

SEQ ID NO: 9511362 - DNA, 22 bp, Homo sapiens
ccaggagtttgaggctgcagtg

SEQ ID NO: 9511363 - DNA, 22 bp, Homo sapiens
ccaggatctgggtccatgggac

SEQ ID NO: 9511364 - DNA, 22 bp, Homo sapiens
ccaggatctgtacacctctgag

SEQ ID NO: 9511365 - DNA, 22 bp, Homo sapiens
ccaggatgacccccactttcct

SEQ ID NO: 9511366 - DNA, 22 bp, Homo sapiens
ccaggagtttgaggctgcagtg

SEQ ID NO: 9511367 - DNA, 22 bp, Homo sapiens
ccaggagtttgaggctgcagtg

SEQ ID NO: 9511368 - DNA, 22 bp, Homo sapiens
ccaggagttggaggctgcagtg

SEQ ID NO: 9511369 - DNA, 22 bp, Homo sapiens
ccaggagttggaggttgcagtg

SEQ ID NO: 9511370 - DNA, 22 bp, Homo sapiens
ccaggagttggaggctgcagtg

SEQ ID NO: 9511371 - DNA, 22 bp, Homo sapiens
ccaggagttggaagctgccatg

SEQ ID NO: 9511372 - DNA, 22 bp, Homo sapiens
ccaggagttggaagctgccatg

SEQ ID NO: 9511373 - DNA, 22 bp, Homo sapiens
ccaggagttggaggctgcagtg

SEQ ID NO: 9511374 - DNA, 22 bp, Homo sapiens
tcttcagactccaaatgtttta

SEQ ID NO: 9511375 - DNA, 22 bp, Homo sapiens
tcttcactgtgaatttgttctt

SEQ ID NO: 9511376 - DNA, 22 bp, Homo sapiens
tcttcactgatgtctctcaaat

SEQ ID NO: 9511377 - DNA, 22 bp, Homo sapiens
tcttcagacccttagctgtgat

SEQ ID NO: 9511378 - DNA, 22 bp, Homo sapiens
tcttcagagcatttctgaggta

SEQ ID NO: 9511379 - DNA, 22 bp, Homo sapiens
tcttcagagatgtaacatatgg

SEQ ID NO: 9511380 - DNA, 22 bp, Homo sapiens
tcttcagagactctgagcccct

SEQ ID NO: 9511381 - DNA, 22 bp, Homo sapiens
tcttcagagactctgagcccct

SEQ ID NO: 9511382 - DNA, 22 bp, Homo sapiens
tcttccagtgtagacatctgcc

SEQ ID NO: 9511383 - DNA, 22 bp, Homo sapiens
tcttcccagaggaggtgccagc

SEQ ID NO: 9511384 - DNA, 22 bp, Homo sapiens
tcttcccagaggaggtgccagc

SEQ ID NO: 9511385 - DNA, 20 bp, Homo sapiens
tcttccaggtacagtctgca

SEQ ID NO: 9511386 - DNA, 22 bp, Homo sapiens
ccaggccagcaggcacacctgc

SEQ ID NO: 9511387 - DNA, 22 bp, Homo sapiens
ccaggccagcaggcacacctgc

SEQ ID NO: 9511388 - DNA, 22 bp, Homo sapiens
ccaggccagcaggcacacctgc

SEQ ID NO: 9511389 - DNA, 22 bp, Homo sapiens
ccaggccagcaggcacacctgc

SEQ ID NO: 9511390 - DNA, 22 bp, Homo sapiens
ccaggccagcaggcacacctgc

SEQ ID NO: 9511391 - DNA, 22 bp, Homo sapiens
ccaggccagagtgcagtggcac

SEQ ID NO: 9511392 - DNA, 22 bp, Homo sapiens
ccaggccagagtgcagtggcac

SEQ ID NO: 9511393 - DNA, 22 bp, Homo sapiens
ccaggccagagtgcagtggcac

SEQ ID NO: 9511394 - DNA, 22 bp, Homo sapiens
ccaggccagcgctggctggagg

SEQ ID NO: 9511395 - DNA, 22 bp, Homo sapiens
ccaggccagcgctggctggagg

SEQ ID NO: 9511396 - DNA, 22 bp, Homo sapiens
ccaggccagcgctggctggagg

SEQ ID NO: 9511397 - DNA, 22 bp, Homo sapiens
ccaggccagcgctggctggagg

SEQ ID NO: 9511398 - DNA, 22 bp, Homo sapiens
ccaggccaggagagcgaggttt

SEQ ID NO: 9511399 - DNA, 22 bp, Homo sapiens
ccaggccagcgctggctggagg

SEQ ID NO: 9511400 - DNA, 22 bp, Homo sapiens
ccaggccagcgctggctggagg

SEQ ID NO: 9511401 - DNA, 22 bp, Homo sapiens
ccaggccagcctggagcatggc

SEQ ID NO: 9511402 - DNA, 22 bp, Homo sapiens
ccaggccagcctggagcatggc

SEQ ID NO: 9511403 - DNA, 22 bp, Homo sapiens
ccaggccagcctggagcatggc

SEQ ID NO: 9511404 - DNA, 22 bp, Homo sapiens
ccaggccagcctggagcatggc

SEQ ID NO: 9511405 - DNA, 21 bp, Homo sapiens
tcttccctcaggatgtcctgc

SEQ ID NO: 9511406 - DNA, 21 bp, Homo sapiens
tcttcccattatgttccaatt

SEQ ID NO: 9511407 - DNA, 22 bp, Homo sapiens
tcttcccccgtgctccagtgca

SEQ ID NO: 9511408 - DNA, 22 bp, Homo sapiens
ccaggccagagtgcagtggcac

SEQ ID NO: 9511409 - DNA, 22 bp, Homo sapiens
ccaggccagagtgcagtggcac

SEQ ID NO: 9511410 - DNA, 22 bp, Homo sapiens
tcttcctatgccaacattctgt

SEQ ID NO: 9511411 - DNA, 22 bp, Homo sapiens
tcccaccccggtcaagggctga

SEQ ID NO: 9511412 - DNA, 22 bp, Homo sapiens
tcccaccccggtcaagggctga

SEQ ID NO: 9511413 - DNA, 22 bp, Homo sapiens
tcccaccccctccaaggaggaa

SEQ ID NO: 9511414 - DNA, 22 bp, Homo sapiens
tcccaccccctccaaggaggaa

SEQ ID NO: 9511415 - DNA, 22 bp, Homo sapiens
tcccaccccctccaaggaggaa

SEQ ID NO: 9511416 - DNA, 22 bp, Homo sapiens
tcccaccccggtcaagggctga

SEQ ID NO: 9511417 - DNA, 22 bp, Homo sapiens
tcccaccccttgactctttaag

SEQ ID NO: 9511418 - DNA, 22 bp, Homo sapiens
tcccaccccttgactctttaag

SEQ ID NO: 9511419 - DNA, 22 bp, Homo sapiens
tcccacccatcctgcatctctt

SEQ ID NO: 9511420 - DNA, 22 bp, Homo sapiens
tcccaccaggtgaccatttcat

SEQ ID NO: 9511421 - DNA, 22 bp, Homo sapiens
tcccacccatcctgcatctctt

SEQ ID NO: 9511422 - DNA, 22 bp, Homo sapiens
tcccacccatcctgcatctctt

SEQ ID NO: 9511423 - DNA, 22 bp, Homo sapiens
tcccacccatcctgcatctctt

SEQ ID NO: 9511424 - DNA, 22 bp, Homo sapiens
cattcttgcaccgtgatggctt

SEQ ID NO: 9511425 - DNA, 22 bp, Homo sapiens
cattcttctggatagttagttg

SEQ ID NO: 9511426 - DNA, 22 bp, Homo sapiens
cattcttgaaccaggcactgtg

SEQ ID NO: 9511427 - DNA, 22 bp, Homo sapiens
cattcttgcaccgtgatggctt

SEQ ID NO: 9511428 - DNA, 22 bp, Homo sapiens
cattctgggtctggctcaggga

SEQ ID NO: 9511429 - DNA, 17 bp, Homo sapiens
cattctgtaatctttct

SEQ ID NO: 9511430 - DNA, 22 bp, Homo sapiens
cattcttacacaatattttaat

SEQ ID NO: 9511431 - DNA, 22 bp, Homo sapiens
cattcttctggatagttagttg

SEQ ID NO: 9511432 - DNA, 22 bp, Homo sapiens
cattcttatatttactcattca

SEQ ID NO: 9511433 - DNA, 22 bp, Homo sapiens
cattctctgatcttcacatacc

SEQ ID NO: 9511434 - DNA, 22 bp, Homo sapiens
cattctctgatcttcacatacc

SEQ ID NO: 9511435 - DNA, 22 bp, Homo sapiens
cattctctgatcttcacatacc

SEQ ID NO: 9511436 - DNA, 22 bp, Homo sapiens
cattctgaccctatgatttaag

SEQ ID NO: 9511437 - DNA, 22 bp, Homo sapiens
cattctgagtcactctttagca

SEQ ID NO: 9511438 - DNA, 22 bp, Homo sapiens
cattctgggtctggctcaggga

SEQ ID NO: 9511439 - DNA, 22 bp, Homo sapiens
cattctgggtctggctcaggga

SEQ ID NO: 9511440 - DNA, 22 bp, Homo sapiens
cattacatggtccaggatatat

SEQ ID NO: 9511441 - DNA, 22 bp, Homo sapiens
tcccaaagaactgaatagtaat

SEQ ID NO: 9511442 - DNA, 20 bp, Homo sapiens
tcccaaaattctactttatc

SEQ ID NO: 9511443 - DNA, 21 bp, Homo sapiens
cattacatggttttagtgaac

SEQ ID NO: 9511444 - DNA, 22 bp, Homo sapiens
cattacttctcatgcttcatgc

SEQ ID NO: 9511445 - DNA, 22 bp, Homo sapiens
cattacatttcaaaatgtttcc

SEQ ID NO: 9511446 - DNA, 22 bp, Homo sapiens
cattagaacctataaaaagcat

SEQ ID NO: 9511447 - DNA, 22 bp, Homo sapiens
cattcatttgcccagtaagtca

SEQ ID NO: 9511448 - DNA, 22 bp, Homo sapiens
cattcatttatgaaatatctat

SEQ ID NO: 9511449 - DNA, 22 bp, Homo sapiens
cattctaggcctggcttgggcc

SEQ ID NO: 9511450 - DNA, 22 bp, Homo sapiens
cattctatcttggactggatct

SEQ ID NO: 9511451 - DNA, 22 bp, Homo sapiens
cattcatttatgaaatatctat

SEQ ID NO: 9511452 - DNA, 22 bp, Homo sapiens
cattctatcttggactggatct

SEQ ID NO: 9511453 - DNA, 22 bp, Homo sapiens
cattctcaatagtagatgagta

SEQ ID NO: 9511454 - DNA, 22 bp, Homo sapiens
cattagcaggcactaagaaggt

SEQ ID NO: 9511455 - DNA, 18 bp, Homo sapiens
cattagcaccacgtagag

SEQ ID NO: 9511456 - DNA, 22 bp, Homo sapiens
cattaggtatttaagcacacag

SEQ ID NO: 9511457 - DNA, 22 bp, Homo sapiens
tccattttctaagtatcactta

SEQ ID NO: 9511458 - DNA, 22 bp, Homo sapiens
tccattttcatctcatgtataa

SEQ ID NO: 9511459 - DNA, 22 bp, Homo sapiens
tccattttcatctcatgtataa

SEQ ID NO: 9511460 - DNA, 22 bp, Homo sapiens
tccattttagagatgaagaaac

SEQ ID NO: 9511461 - DNA, 22 bp, Homo sapiens
tccattttagagatgaagaaac

SEQ ID NO: 9511462 - DNA, 22 bp, Homo sapiens
tccattttagagatgaagaaac

SEQ ID NO: 9511463 - DNA, 22 bp, Homo sapiens
tccattttcttgctctaggtaa

SEQ ID NO: 9511464 - DNA, 22 bp, Homo sapiens
tccattttcttgctctaggtaa

SEQ ID NO: 9511465 - DNA, 22 bp, Homo sapiens
tccattttctaagtatcactta

SEQ ID NO: 9511466 - DNA, 22 bp, Homo sapiens
tccattttctaagtatcactta

SEQ ID NO: 9511467 - DNA, 22 bp, Homo sapiens
tccattttctcttccggaggtg

SEQ ID NO: 9511468 - DNA, 22 bp, Homo sapiens
tccattttgtaggtatgctaca

SEQ ID NO: 9511469 - DNA, 22 bp, Homo sapiens
tccattttgtaggtatgctaca

SEQ ID NO: 9511470 - DNA, 22 bp, Homo sapiens
tccatttttcatgactcctcaa

SEQ ID NO: 9511471 - DNA, 22 bp, Homo sapiens
tccatttttcatgactcctcaa

SEQ ID NO: 9511472 - DNA, 22 bp, Homo sapiens
tccatttttcatgactcctcaa

SEQ ID NO: 9511473 - DNA, 22 bp, Homo sapiens
tccatttggcactctatttcca

SEQ ID NO: 9511474 - DNA, 22 bp, Homo sapiens
tccatttggcctctgtattgta

SEQ ID NO: 9511475 - DNA, 22 bp, Homo sapiens
tccattttagaagaaaatccac

SEQ ID NO: 9511476 - DNA, 22 bp, Homo sapiens
tccatttggcctctgtattgta

SEQ ID NO: 9511477 - DNA, 22 bp, Homo sapiens
tccattttagaagaaaatccac

SEQ ID NO: 9511478 - DNA, 22 bp, Homo sapiens
tccatcaccacagaggacagag

SEQ ID NO: 9511479 - DNA, 22 bp, Homo sapiens
tccatttaggttccactagtta

SEQ ID NO: 9511480 - DNA, 22 bp, Homo sapiens
catgggctcaaccttgaccaca

SEQ ID NO: 9511481 - DNA, 22 bp, Homo sapiens
catgggcagttggcagggctca

SEQ ID NO: 9511482 - DNA, 22 bp, Homo sapiens
catgggcagttggcagggctca

SEQ ID NO: 9511483 - DNA, 22 bp, Homo sapiens
catgggctacagaagcatgctg

SEQ ID NO: 9511484 - DNA, 22 bp, Homo sapiens
catgggctacagaagcatgctg

SEQ ID NO: 9511485 - DNA, 22 bp, Homo sapiens
catgggctacagaagcatgctg

SEQ ID NO: 9511486 - DNA, 22 bp, Homo sapiens
catgggcccgtgagaggcaggg

SEQ ID NO: 9511487 - DNA, 22 bp, Homo sapiens
catgggaggttggcttggcatg

SEQ ID NO: 9511488 - DNA, 22 bp, Homo sapiens
catgggaggttggcttggcatg

SEQ ID NO: 9511489 - DNA, 22 bp, Homo sapiens
catgggaggcctgctgctggtg

SEQ ID NO: 9511490 - DNA, 22 bp, Homo sapiens
catgggaggttggcttggcatg

SEQ ID NO: 9511491 - DNA, 23 bp, Homo sapiens
catgggagtgagaatgccagctc

SEQ ID NO: 9511492 - DNA, 22 bp, Homo sapiens
catgggcaccttaaaatgaggc

SEQ ID NO: 9511493 - DNA, 21 bp, Homo sapiens
tccaggagcacgggactagga

SEQ ID NO: 9511494 - DNA, 22 bp, Homo sapiens
catgggaggcctgctgctggtg

SEQ ID NO: 9511495 - DNA, 21 bp, Homo sapiens
tccaggagcacgggactagga

SEQ ID NO: 9511496 - DNA, 22 bp, Homo sapiens
tccaggagaccagatgtaggcc

SEQ ID NO: 9511497 - DNA, 17 bp, Homo sapiens
tccaggagaggcaatgg

SEQ ID NO: 9511498 - DNA, 22 bp, Homo sapiens
tccaggagaccagatgtaggcc

SEQ ID NO: 9511499 - DNA, 22 bp, Homo sapiens
tccaggagacacaaggtacata

SEQ ID NO: 9511500 - DNA, 22 bp, Homo sapiens
tccaggagacacccttgtgtgt

SEQ ID NO: 9511501 - DNA, 22 bp, Homo sapiens
tccaggagacacaaggtacata

SEQ ID NO: 9511502 - DNA, 22 bp, Homo sapiens
tccaggagaggcctgaccaggt

SEQ ID NO: 9511503 - DNA, 22 bp, Homo sapiens
tccaggagaggcctgaccaggt

SEQ ID NO: 9511504 - DNA, 22 bp, Homo sapiens
tccaggagaggtagagggttcc

SEQ ID NO: 9511505 - DNA, 22 bp, Homo sapiens
tccaggagaggtgtggggactg

SEQ ID NO: 9511506 - DNA, 22 bp, Homo sapiens
tccaggagatacactgcaccag

SEQ ID NO: 9511507 - DNA, 22 bp, Homo sapiens
tccaggagattcattaggtcat

SEQ ID NO: 9511508 - DNA, 22 bp, Homo sapiens
catttattctcagatccttgtc

SEQ ID NO: 9511509 - DNA, 22 bp, Homo sapiens
catttattctcagatccttgtc

SEQ ID NO: 9511510 - DNA, 22 bp, Homo sapiens
catttattctcagatccttgtc

SEQ ID NO: 9511511 - DNA, 22 bp, Homo sapiens
catttattcatgatctgtagct

SEQ ID NO: 9511512 - DNA, 22 bp, Homo sapiens
catttattcatgatctgtagct

SEQ ID NO: 9511513 - DNA, 22 bp, Homo sapiens
catttattcatgatctgtagct

SEQ ID NO: 9511514 - DNA, 22 bp, Homo sapiens
catttattcatttgctagggct

SEQ ID NO: 9511515 - DNA, 22 bp, Homo sapiens
catttattcatgatctgtagct

SEQ ID NO: 9511516 - DNA, 22 bp, Homo sapiens
catttattagttagttcgatgt

SEQ ID NO: 9511517 - DNA, 22 bp, Homo sapiens
tccctctctagcctgttcagta

SEQ ID NO: 9511518 - DNA, 22 bp, Homo sapiens
tccctctctggctggggtgcgg

SEQ ID NO: 9511519 - DNA, 22 bp, Homo sapiens
tccctctcttgggcgtggctca

SEQ ID NO: 9511520 - DNA, 22 bp, Homo sapiens
tccctctctagcctgttcagta

SEQ ID NO: 9511521 - DNA, 22 bp, Homo sapiens
tccctctccctattgcctggag

SEQ ID NO: 9511522 - DNA, 22 bp, Homo sapiens
tccctcgaagagcttattcttt

SEQ ID NO: 9511523 - DNA, 22 bp, Homo sapiens
tccctggggttcctccagccac

SEQ ID NO: 9511524 - DNA, 22 bp, Homo sapiens
tccctggggtatcgctgaggca

SEQ ID NO: 9511525 - DNA, 22 bp, Homo sapiens
tccctggggttcctccagccac

SEQ ID NO: 9511526 - DNA, 22 bp, Homo sapiens
tccctggggttcctccagccac

SEQ ID NO: 9511527 - DNA, 22 bp, Homo sapiens
tccctggggtatcgctgaggca

SEQ ID NO: 9511528 - DNA, 22 bp, Homo sapiens
tccctggggtatcgctgaggca

SEQ ID NO: 9511529 - DNA, 22 bp, Homo sapiens
tccctggggtatcgctgaggca

SEQ ID NO: 9511530 - DNA, 22 bp, Homo sapiens
tccctggggtaacattagaggg

SEQ ID NO: 9511531 - DNA, 22 bp, Homo sapiens
tccctggggtatcgctgaggca

SEQ ID NO: 9511532 - DNA, 22 bp, Homo sapiens
tccctggaacagagagacaacg

SEQ ID NO: 9511533 - DNA, 18 bp, Homo sapiens
tccctggggctgccaccc

SEQ ID NO: 9511534 - DNA, 18 bp, Homo sapiens
tccctggggctgccaccc

SEQ ID NO: 9511535 - DNA, 20 bp, Homo sapiens
tccctggggccctacttcct

SEQ ID NO: 9511536 - DNA, 22 bp, Homo sapiens
tccctgggtcctgcttgctctc

SEQ ID NO: 9511537 - DNA, 22 bp, Homo sapiens
tccctgggtcctgcttgctctc

SEQ ID NO: 9511538 - DNA, 22 bp, Homo sapiens
tccctgggtcctgcttgctctc

SEQ ID NO: 9511539 - DNA, 22 bp, Homo sapiens
tccctgggtcctgcttgctctc

SEQ ID NO: 9511540 - DNA, 22 bp, Homo sapiens
tccctgggtcattctctggcac

SEQ ID NO: 9511541 - DNA, 22 bp, Homo sapiens
tccctgggtcattctctggcac

SEQ ID NO: 9511542 - DNA, 22 bp, Homo sapiens
tccctgggtcattctctggcac

SEQ ID NO: 9511543 - DNA, 23 bp, Homo sapiens
tcctaactgattctgcagtctct

SEQ ID NO: 9511544 - DNA, 22 bp, Homo sapiens
tcctaactccactagccttggg

SEQ ID NO: 9511545 - DNA, 23 bp, Homo sapiens
tcctaactcaattcaggggtgtc

SEQ ID NO: 9511546 - DNA, 23 bp, Homo sapiens
tcctaactgattctgcagtctct

SEQ ID NO: 9511547 - DNA, 22 bp, Homo sapiens
tccctgggttcccgtggaagtg

SEQ ID NO: 9511548 - DNA, 22 bp, Homo sapiens
catttacaatgtacaggttgtg

SEQ ID NO: 9511549 - DNA, 22 bp, Homo sapiens
catttacaatgtacaggttgtg

SEQ ID NO: 9511550 - DNA, 22 bp, Homo sapiens
catttacacacagaggtgtgct

SEQ ID NO: 9511551 - DNA, 22 bp, Homo sapiens
catttacacttctaaccacaag

SEQ ID NO: 9511552 - DNA, 22 bp, Homo sapiens
catttacacacagaggtgtgct

SEQ ID NO: 9511553 - DNA, 22 bp, Homo sapiens
catttaatgcacggatgtagcc

SEQ ID NO: 9511554 - DNA, 22 bp, Homo sapiens
catttaatgcacggatgtagcc

SEQ ID NO: 9511555 - DNA, 22 bp, Homo sapiens
catttaatctggctcatgagca

SEQ ID NO: 9511556 - DNA, 22 bp, Homo sapiens
catttaatcctcacaagcctat

SEQ ID NO: 9511557 - DNA, 22 bp, Homo sapiens
catttaatagatgctgtttcag

SEQ ID NO: 9511558 - DNA, 22 bp, Homo sapiens
catttaatagatgctgtttcag

SEQ ID NO: 9511559 - DNA, 22 bp, Homo sapiens
catttaagagaaatatttagtt

SEQ ID NO: 9511560 - DNA, 22 bp, Homo sapiens
catttacacttctaaccacaag

SEQ ID NO: 9511561 - DNA, 22 bp, Homo sapiens
catttacacttctaaccacaag

SEQ ID NO: 9511562 - DNA, 22 bp, Homo sapiens
tccctcagaaattctctctgaa

SEQ ID NO: 9511563 - DNA, 22 bp, Homo sapiens
tccctcagaaattctctctgaa

SEQ ID NO: 9511564 - DNA, 22 bp, Homo sapiens
catttacacttctaaccacaag

SEQ ID NO: 9511565 - DNA, 22 bp, Homo sapiens
catttacacttctaaccacaag

SEQ ID NO: 9511566 - DNA, 20 bp, Homo sapiens
tccctcctgcagatagagaa

SEQ ID NO: 9511567 - DNA, 22 bp, Homo sapiens
tccctcagaaattctctctgaa

SEQ ID NO: 9511568 - DNA, 20 bp, Homo sapiens
tccctcctgcagatagagaa

SEQ ID NO: 9511569 - DNA, 22 bp, Homo sapiens
tccctccttaataagaggtctg

SEQ ID NO: 9511570 - DNA, 22 bp, Homo sapiens
tccctcctggccgtcaccgctg

SEQ ID NO: 9511571 - DNA, 22 bp, Homo sapiens
tccctcctggccgtcaccgctg

SEQ ID NO: 9511572 - DNA, 22 bp, Homo sapiens
tcccactcccaggcaggcctct

SEQ ID NO: 9511573 - DNA, 22 bp, Homo sapiens
cattgcactccagcctgggcaa

SEQ ID NO: 9511574 - DNA, 22 bp, Homo sapiens
cattgcactcctgcctgggcaa

SEQ ID NO: 9511575 - DNA, 22 bp, Homo sapiens
cattgcactccagcctgggcca

SEQ ID NO: 9511576 - DNA, 22 bp, Homo sapiens
tcccactcactgtctctgacac

SEQ ID NO: 9511577 - DNA, 22 bp, Homo sapiens
tcccactcccaggcaggcctct

SEQ ID NO: 9511578 - DNA, 18 bp, Homo sapiens
cattgtacaatgctttat

SEQ ID NO: 9511579 - DNA, 22 bp, Homo sapiens
cattgtacagttattttaaaat

SEQ ID NO: 9511580 - DNA, 22 bp, Homo sapiens
cattgtattgaggatacttaag

SEQ ID NO: 9511581 - DNA, 22 bp, Homo sapiens
cattgtcacccaaagctcatag

SEQ ID NO: 9511582 - DNA, 22 bp, Homo sapiens
cattgtcacccaaagctcatag

SEQ ID NO: 9511583 - DNA, 22 bp, Homo sapiens
cattgtctggtaggaagtgggc

SEQ ID NO: 9511584 - DNA, 22 bp, Homo sapiens
cattgtctcttgtcatttagta

SEQ ID NO: 9511585 - DNA, 22 bp, Homo sapiens
cattgtcctgtgggctccctgg

SEQ ID NO: 9511586 - DNA, 22 bp, Homo sapiens
cattgtcacccaaagctcatag

SEQ ID NO: 9511587 - DNA, 22 bp, Homo sapiens
cattgttgctgcttcaagatat

SEQ ID NO: 9511588 - DNA, 22 bp, Homo sapiens
cattgttcaacactgacttgca

SEQ ID NO: 9511589 - DNA, 22 bp, Homo sapiens
cattgttaattggtatcttaca

SEQ ID NO: 9511590 - DNA, 22 bp, Homo sapiens
catttaaaggttgtgggtaaaa

SEQ ID NO: 9511591 - DNA, 22 bp, Homo sapiens
catttaaaggttgtgggtaaaa

SEQ ID NO: 9511592 - DNA, 22 bp, Homo sapiens
catttaaaggttgtgggtaaaa

SEQ ID NO: 9511593 - DNA, 22 bp, Homo sapiens
catttaaaggttgtgggtaaaa

SEQ ID NO: 9511594 - DNA, 22 bp, Homo sapiens
cattgttttgagaacaacctga

SEQ ID NO: 9511595 - DNA, 22 bp, Homo sapiens
cattgttggcagagggacagag

SEQ ID NO: 9511596 - DNA, 22 bp, Homo sapiens
tccttccatggtggggctgctt

SEQ ID NO: 9511597 - DNA, 22 bp, Homo sapiens
tccttccatggtggggctgctt

SEQ ID NO: 9511598 - DNA, 22 bp, Homo sapiens
tccttcccaggtgtcgccgcct

SEQ ID NO: 9511599 - DNA, 22 bp, Homo sapiens
tccttccaggtccagggatgtg

SEQ ID NO: 9511600 - DNA, 19 bp, Homo sapiens
tccttccagttcctggggt

SEQ ID NO: 9511601 - DNA, 21 bp, Homo sapiens
tccttcagtctagatgattgt

SEQ ID NO: 9511602 - DNA, 22 bp, Homo sapiens
tcctgggcttgctcctccagct

SEQ ID NO: 9511603 - DNA, 22 bp, Homo sapiens
tcctgggcttgctcctccagct

SEQ ID NO: 9511604 - DNA, 22 bp, Homo sapiens
tcctgggcttcacagactctgt

SEQ ID NO: 9511605 - DNA, 22 bp, Homo sapiens
tcctgggcttcacagactctgt

SEQ ID NO: 9511606 - DNA, 22 bp, Homo sapiens
tcctgggcttagtggctaggtc

SEQ ID NO: 9511607 - DNA, 22 bp, Homo sapiens
tcctgggcttagtggctaggtc

SEQ ID NO: 9511608 - DNA, 22 bp, Homo sapiens
tcctgggctttgtttctctcct

SEQ ID NO: 9511609 - DNA, 22 bp, Homo sapiens
tcctgggcttgctcctccagct

SEQ ID NO: 9511610 - DNA, 19 bp, Homo sapiens
tcctggggaggggcatggc

SEQ ID NO: 9511611 - DNA, 19 bp, Homo sapiens
tcctggggaggggcatggc

SEQ ID NO: 9511612 - DNA, 19 bp, Homo sapiens
tcctggggaggggcatggc

SEQ ID NO: 9511613 - DNA, 19 bp, Homo sapiens
tcctggggaggggcatggc

SEQ ID NO: 9511614 - DNA, 22 bp, Homo sapiens
tccttgggtcagtgagtgaggt

SEQ ID NO: 9511615 - DNA, 22 bp, Homo sapiens
tccttgggtcagtgagtgaggt

SEQ ID NO: 9511616 - DNA, 22 bp, Homo sapiens
tccttgtaacgttgggctgggg

SEQ ID NO: 9511617 - DNA, 22 bp, Homo sapiens
tccttgtaaaggagctctaaca

SEQ ID NO: 9511618 - DNA, 22 bp, Homo sapiens
tcctttaacttgattattttca

SEQ ID NO: 9511619 - DNA, 22 bp, Homo sapiens
tcctttaacttgattattttca

SEQ ID NO: 9511620 - DNA, 22 bp, Homo sapiens
tcctttaaagaactgtgctttt

SEQ ID NO: 9511621 - DNA, 22 bp, Homo sapiens
tcctttaaagaactgtgctttt

SEQ ID NO: 9511622 - DNA, 22 bp, Homo sapiens
tcctttaaagaactgtgctttt

SEQ ID NO: 9511623 - DNA, 22 bp, Homo sapiens
tcctttaaactcctttcaagtc

SEQ ID NO: 9511624 - DNA, 22 bp, Homo sapiens
tcctttaaactcctttcaagtc

SEQ ID NO: 9511625 - DNA, 22 bp, Homo sapiens
tcctttatctgctcagaaagta

SEQ ID NO: 9511626 - DNA, 23 bp, Homo sapiens
tcctttaatgctggaatggctag

SEQ ID NO: 9511627 - DNA, 23 bp, Homo sapiens
tcctttaagatatcttattcctt

SEQ ID NO: 9511628 - DNA, 22 bp, Homo sapiens
tcctttaacttgattattttca

SEQ ID NO: 9511629 - DNA, 22 bp, Homo sapiens
tcctttatgtgagttgtttccc

SEQ ID NO: 9511630 - DNA, 22 bp, Homo sapiens
tcctttatgtgagttgtttccc

SEQ ID NO: 9511631 - DNA, 21 bp, Homo sapiens
tccttcccccttggcctggga

SEQ ID NO: 9511632 - DNA, 22 bp, Homo sapiens
tccttcctcggggacccagatc

SEQ ID NO: 9511633 - DNA, 22 bp, Homo sapiens
tccttcctgcaggccaagtcct

SEQ ID NO: 9511634 - DNA, 19 bp, Homo sapiens
tccttccccccagcacaga

SEQ ID NO: 9511635 - DNA, 19 bp, Homo sapiens
tccttccccccagcacaga

SEQ ID NO: 9511636 - DNA, 22 bp, Homo sapiens
tccttccccctcaagagaactt

SEQ ID NO: 9511637 - DNA, 23 bp, Homo sapiens
tccttgggcctgcccagagtggt

SEQ ID NO: 9511638 - DNA, 23 bp, Homo sapiens
tccttgggcctgcccagagtggt

SEQ ID NO: 9511639 - DNA, 22 bp, Homo sapiens
tccttggggacgctgacatcgt

SEQ ID NO: 9511640 - DNA, 22 bp, Homo sapiens
tccttggggacgctgacatcgt

SEQ ID NO: 9511641 - DNA, 22 bp, Homo sapiens
tccttggggtaactccagcctg

SEQ ID NO: 9511642 - DNA, 19 bp, Homo sapiens
ccagagacattggcatctt

SEQ ID NO: 9511643 - DNA, 22 bp, Homo sapiens
ccagagaattttagacaaaaat

SEQ ID NO: 9511644 - DNA, 22 bp, Homo sapiens
ccagagacaaggagctggagtc

SEQ ID NO: 9511645 - DNA, 22 bp, Homo sapiens
ccagagaattttagacaaaaat

SEQ ID NO: 9511646 - DNA, 22 bp, Homo sapiens
ccagagaatccggagagtccat

SEQ ID NO: 9511647 - DNA, 22 bp, Homo sapiens
ccagagaaccttgagctgtgag

SEQ ID NO: 9511648 - DNA, 22 bp, Homo sapiens
ccagagaagaaaagcacctttt

SEQ ID NO: 9511649 - DNA, 22 bp, Homo sapiens
ccagacagttccttgaggttca

SEQ ID NO: 9511650 - DNA, 22 bp, Homo sapiens
ccagagaaccatctgcttgagg

SEQ ID NO: 9511651 - DNA, 22 bp, Homo sapiens
ccagagaaccatctgcttgagg

SEQ ID NO: 9511652 - DNA, 22 bp, Homo sapiens
ccagagaaccatctgcttgagg

SEQ ID NO: 9511653 - DNA, 22 bp, Homo sapiens
ccagacaggggctgttcctgct

SEQ ID NO: 9511654 - DNA, 22 bp, Homo sapiens
ccagacaggggctgttcctgct

SEQ ID NO: 9511655 - DNA, 22 bp, Homo sapiens
ccagacaggggctgttcctgct

SEQ ID NO: 9511656 - DNA, 22 bp, Homo sapiens
ccagacaggggctgttcctgct

SEQ ID NO: 9511657 - DNA, 22 bp, Homo sapiens
tctaataaataaatgctctagg

SEQ ID NO: 9511658 - DNA, 22 bp, Homo sapiens
tctaatcctatggtggggaggg

SEQ ID NO: 9511659 - DNA, 21 bp, Homo sapiens
tctaagccttgcagatgggtt

SEQ ID NO: 9511660 - DNA, 22 bp, Homo sapiens
tctaagtaaaatttgtcatttc

SEQ ID NO: 9511661 - DNA, 22 bp, Homo sapiens
tctaagggaaggtgatatgtta

SEQ ID NO: 9511662 - DNA, 22 bp, Homo sapiens
tctaaggccttcatgtcagtat

SEQ ID NO: 9511663 - DNA, 22 bp, Homo sapiens
ccactgtgagcatgaacaggac

SEQ ID NO: 9511664 - DNA, 22 bp, Homo sapiens
ccacttcatcccagctcagata

SEQ ID NO: 9511665 - DNA, 22 bp, Homo sapiens
ccactgttggcccgaaggggtc

SEQ ID NO: 9511666 - DNA, 22 bp, Homo sapiens
ccactgttaccagtcaatcaca

SEQ ID NO: 9511667 - DNA, 21 bp, Homo sapiens
tctaagaacatgattctccct

SEQ ID NO: 9511668 - DNA, 22 bp, Homo sapiens
tctaagaagggttttaaatatt

SEQ ID NO: 9511669 - DNA, 22 bp, Homo sapiens
tctaagaatactcatatcttct

SEQ ID NO: 9511670 - DNA, 22 bp, Homo sapiens
tctaagccaggactgagagacg

SEQ ID NO: 9511671 - DNA, 22 bp, Homo sapiens
ccactgtcttttccaggctgaa

SEQ ID NO: 9511672 - DNA, 22 bp, Homo sapiens
ccactgtctgtgacatcagaaa

SEQ ID NO: 9511673 - DNA, 22 bp, Homo sapiens
ccactgtctgtgacatcagaaa

SEQ ID NO: 9511674 - DNA, 22 bp, Homo sapiens
ccactgtataagcaaaatgaaa

SEQ ID NO: 9511675 - DNA, 22 bp, Homo sapiens
ccactgctaacttgctgcagct

SEQ ID NO: 9511676 - DNA, 22 bp, Homo sapiens
ccactgggggctgctcccaggt

SEQ ID NO: 9511677 - DNA, 21 bp, Homo sapiens
ccactggtggggaacggtggc

SEQ ID NO: 9511678 - DNA, 22 bp, Homo sapiens
ccactgtaagtttgaaaataac

SEQ ID NO: 9511679 - DNA, 22 bp, Homo sapiens
tcctggctccagcagctcttcc

SEQ ID NO: 9511680 - DNA, 22 bp, Homo sapiens
tcctgggactctttatcagaga

SEQ ID NO: 9511681 - DNA, 22 bp, Homo sapiens
tcctgggactctgcctcaggct

SEQ ID NO: 9511682 - DNA, 22 bp, Homo sapiens
ccacagaaagttgtctagagta

SEQ ID NO: 9511683 - DNA, 22 bp, Homo sapiens
tcctggctccagcagctcttcc

SEQ ID NO: 9511684 - DNA, 22 bp, Homo sapiens
ccacagaacctcagctttgagc

SEQ ID NO: 9511685 - DNA, 22 bp, Homo sapiens
tcctgggagacccagctgtgga

SEQ ID NO: 9511686 - DNA, 22 bp, Homo sapiens
tcctgggagacccagctgtgga

SEQ ID NO: 9511687 - DNA, 22 bp, Homo sapiens
tcctgggactttcaaggctagg

SEQ ID NO: 9511688 - DNA, 22 bp, Homo sapiens
tcctgggagagtgggactgtat

SEQ ID NO: 9511689 - DNA, 22 bp, Homo sapiens
tcctgggagacccagctgtgga

SEQ ID NO: 9511690 - DNA, 22 bp, Homo sapiens
tcctgggagacccagctgtgga

SEQ ID NO: 9511691 - DNA, 22 bp, Homo sapiens
tcctgggagagtgggactgtat

SEQ ID NO: 9511692 - DNA, 22 bp, Homo sapiens
tcctgggagcatgaagagggat

SEQ ID NO: 9511693 - DNA, 22 bp, Homo sapiens
tcctgggagcatgaagagggat

SEQ ID NO: 9511694 - DNA, 22 bp, Homo sapiens
tcctgggagcatggtgccgtga

SEQ ID NO: 9511695 - DNA, 22 bp, Homo sapiens
tcctgggagcatggtgccgtga

SEQ ID NO: 9511696 - DNA, 22 bp, Homo sapiens
tcctgggagcatggtgccgtga

SEQ ID NO: 9511697 - DNA, 22 bp, Homo sapiens
tcctgggagcacatggtcctgc

SEQ ID NO: 9511698 - DNA, 22 bp, Homo sapiens
tcctgggagcacatggtcctgc

SEQ ID NO: 9511699 - DNA, 22 bp, Homo sapiens
tcctgggagcacatggtcctgc

SEQ ID NO: 9511700 - DNA, 22 bp, Homo sapiens
tcctgggagagtttgattcatt

SEQ ID NO: 9511701 - DNA, 22 bp, Homo sapiens
tcctgggcttaagtgatcctcc

SEQ ID NO: 9511702 - DNA, 22 bp, Homo sapiens
tcctgggcttaagtgatcctcc

SEQ ID NO: 9511703 - DNA, 22 bp, Homo sapiens
tcctgggagcccttgctccacc

SEQ ID NO: 9511704 - DNA, 22 bp, Homo sapiens
tcctgggctgtgtgccactctg

SEQ ID NO: 9511705 - DNA, 22 bp, Homo sapiens
tcctgggctgtgtgccactctg

SEQ ID NO: 9511706 - DNA, 22 bp, Homo sapiens
tcctgggagcccttgctccacc

SEQ ID NO: 9511707 - DNA, 22 bp, Homo sapiens
tcctgggagcccttgctccacc

SEQ ID NO: 9511708 - DNA, 22 bp, Homo sapiens
tcctggcaggtctgagaggtct

SEQ ID NO: 9511709 - DNA, 22 bp, Homo sapiens
tcctggcaggtcagcaggagca

SEQ ID NO: 9511710 - DNA, 22 bp, Homo sapiens
tcctggcaggtcagcaggagca

SEQ ID NO: 9511711 - DNA, 22 bp, Homo sapiens
tcctggcagcccgcaggtgctg

SEQ ID NO: 9511712 - DNA, 22 bp, Homo sapiens
tcctggcagcccgcaggtgctg

SEQ ID NO: 9511713 - DNA, 22 bp, Homo sapiens
tcctggcagcccgcaggtgctg

SEQ ID NO: 9511714 - DNA, 22 bp, Homo sapiens
tcctggcagggtggcagcgggt

SEQ ID NO: 9511715 - DNA, 22 bp, Homo sapiens
tcctggcagggtggcagcgggt

SEQ ID NO: 9511716 - DNA, 22 bp, Homo sapiens
ccacactgcctgttatctccca

SEQ ID NO: 9511717 - DNA, 22 bp, Homo sapiens
ccacactgtctaacaaggcata

SEQ ID NO: 9511718 - DNA, 22 bp, Homo sapiens
ccacagaaagcctgggaagtgg

SEQ ID NO: 9511719 - DNA, 22 bp, Homo sapiens
ccacagaaaataaagcacgatt

SEQ ID NO: 9511720 - DNA, 22 bp, Homo sapiens
ccacactgaccagctgtgagac

SEQ ID NO: 9511721 - DNA, 22 bp, Homo sapiens
ccacactggcatgggatggagg

SEQ ID NO: 9511722 - DNA, 22 bp, Homo sapiens
ccacactgcctgttatctccca

SEQ ID NO: 9511723 - DNA, 22 bp, Homo sapiens
ccacactgaccagctgtgagac

SEQ ID NO: 9511724 - DNA, 17 bp, Homo sapiens
ccacaccctttccttcc

SEQ ID NO: 9511725 - DNA, 22 bp, Homo sapiens
ccacactccccgcaggcgtagg

SEQ ID NO: 9511726 - DNA, 22 bp, Homo sapiens
tcctggaggacagaggcatctc

SEQ ID NO: 9511727 - DNA, 22 bp, Homo sapiens
tcctggaggacagaggcatctc

SEQ ID NO: 9511728 - DNA, 22 bp, Homo sapiens
tcctggcagagagcatgaggcc

SEQ ID NO: 9511729 - DNA, 22 bp, Homo sapiens
tcctggcagagagcatgaggcc

SEQ ID NO: 9511730 - DNA, 22 bp, Homo sapiens
ccaaggcttcccagagatgctc

SEQ ID NO: 9511731 - DNA, 22 bp, Homo sapiens
ccaaggctggagtgcagtggcg

SEQ ID NO: 9511732 - DNA, 22 bp, Homo sapiens
ccaaggctcctcagctggtctt

SEQ ID NO: 9511733 - DNA, 22 bp, Homo sapiens
ccaaggccatcaggtaggtcct

SEQ ID NO: 9511734 - DNA, 22 bp, Homo sapiens
ccaaggcccctgtggtctagcc

SEQ ID NO: 9511735 - DNA, 18 bp, Homo sapiens
ccaaggcccctgctgggg

SEQ ID NO: 9511736 - DNA, 22 bp, Homo sapiens
ccaaggcacactctgcaaggtt

SEQ ID NO: 9511737 - DNA, 22 bp, Homo sapiens
ccaaggcagaagatggctcttg

SEQ ID NO: 9511738 - DNA, 22 bp, Homo sapiens
ccaaggcagaagatggctcttg

SEQ ID NO: 9511739 - DNA, 22 bp, Homo sapiens
ccaaggcagaagatggctcttg

SEQ ID NO: 9511740 - DNA, 22 bp, Homo sapiens
ccaaggcacactctgcaaggtt

SEQ ID NO: 9511741 - DNA, 22 bp, Homo sapiens
ccaaggccacaaacagcctggc

SEQ ID NO: 9511742 - DNA, 22 bp, Homo sapiens
ccaaggcatatggctgaaacca

SEQ ID NO: 9511743 - DNA, 22 bp, Homo sapiens
ccaaggcatatggctgaaacca

SEQ ID NO: 9511744 - DNA, 22 bp, Homo sapiens
ccaaggcagaagatggctcttg

SEQ ID NO: 9511745 - DNA, 22 bp, Homo sapiens
ccaaggcaatgtgcagctggtg

SEQ ID NO: 9511746 - DNA, 22 bp, Homo sapiens
ccaaggcaacgttggtgtcagg

SEQ ID NO: 9511747 - DNA, 22 bp, Homo sapiens
ccaaggcaacgttggtgtcagg

SEQ ID NO: 9511748 - DNA, 22 bp, Homo sapiens
ccaaggcaacgttggtgtcagg

SEQ ID NO: 9511749 - DNA, 22 bp, Homo sapiens
ccaaggcaacgttggtgtcagg

SEQ ID NO: 9511750 - DNA, 22 bp, Homo sapiens
ccaaggaggccccaggtcagct

SEQ ID NO: 9511751 - DNA, 22 bp, Homo sapiens
ccaaggagtagagcaggaagct

SEQ ID NO: 9511752 - DNA, 22 bp, Homo sapiens
ccaagaggttgaggctgcagtg

SEQ ID NO: 9511753 - DNA, 22 bp, Homo sapiens
ccaagaggttgaggctgcagtg

SEQ ID NO: 9511754 - DNA, 22 bp, Homo sapiens
ccaagaggttgtgaggcaggca

SEQ ID NO: 9511755 - DNA, 22 bp, Homo sapiens
ccaagagtaaattcatgatgcc

SEQ ID NO: 9511756 - DNA, 22 bp, Homo sapiens
ccaagaggttgtgaggcaggca

SEQ ID NO: 9511757 - DNA, 22 bp, Homo sapiens
ccaaggagcaagtttacacctg

SEQ ID NO: 9511758 - DNA, 22 bp, Homo sapiens
ccaaggagctgcaggcacttgt

SEQ ID NO: 9511759 - DNA, 22 bp, Homo sapiens
ccaaggagaatgacaccatgga

SEQ ID NO: 9511760 - DNA, 22 bp, Homo sapiens
ccaaggagcaaggctcaacaag

SEQ ID NO: 9511761 - DNA, 22 bp, Homo sapiens
tcctacatcagctctcagtagc

SEQ ID NO: 9511762 - DNA, 22 bp, Homo sapiens
tcctacagatactaaggagatc

SEQ ID NO: 9511763 - DNA, 20 bp, Homo sapiens
tcctactcttttaatatgtg

SEQ ID NO: 9511764 - DNA, 22 bp, Homo sapiens
tcctagaacagcccacctggaa

SEQ ID NO: 9511765 - DNA, 22 bp, Homo sapiens
tcctagaactccaggacagtcc

SEQ ID NO: 9511766 - DNA, 22 bp, Homo sapiens
tcctaattgcttcatgtgttgt

SEQ ID NO: 9511767 - DNA, 20 bp, Homo sapiens
tcctaataacctgaagaaat

SEQ ID NO: 9511768 - DNA, 18 bp, Homo sapiens
tcctaacttagatactcc

SEQ ID NO: 9511769 - DNA, 22 bp, Homo sapiens
catctgtaggtgacacatgagt

SEQ ID NO: 9511770 - DNA, 22 bp, Homo sapiens
catctgtaggtgacacatgagt

SEQ ID NO: 9511771 - DNA, 22 bp, Homo sapiens
catctgtagctccatgacaatt

SEQ ID NO: 9511772 - DNA, 22 bp, Homo sapiens
catctgtagctccatgacaatt

SEQ ID NO: 9511773 - DNA, 19 bp, Homo sapiens
catctgtaaggacagaaac

SEQ ID NO: 9511774 - DNA, 22 bp, Homo sapiens
catctgtagctccatgacaatt

SEQ ID NO: 9511775 - DNA, 22 bp, Homo sapiens
catctggtttaaaagaagaaag

SEQ ID NO: 9511776 - DNA, 22 bp, Homo sapiens
catctggttagttgatgaaact

SEQ ID NO: 9511777 - DNA, 22 bp, Homo sapiens
catctggttagttgatgaaact

SEQ ID NO: 9511778 - DNA, 22 bp, Homo sapiens
catctggtttaaaagaagaaag

SEQ ID NO: 9511779 - DNA, 22 bp, Homo sapiens
catctgtaaagtaggaatattg

SEQ ID NO: 9511780 - DNA, 22 bp, Homo sapiens
catctgggttctcagatggata

SEQ ID NO: 9511781 - DNA, 22 bp, Homo sapiens
catctggacaaaactctgaagg

SEQ ID NO: 9511782 - DNA, 22 bp, Homo sapiens
catctgctgttccttggactca

SEQ ID NO: 9511783 - DNA, 22 bp, Homo sapiens
catctgctgttccttggactca

SEQ ID NO: 9511784 - DNA, 22 bp, Homo sapiens
catctgctgttccttggactca

SEQ ID NO: 9511785 - DNA, 19 bp, Homo sapiens
catctggatgattctcctg

SEQ ID NO: 9511786 - DNA, 22 bp, Homo sapiens
catctggcagaccctgcctccg

SEQ ID NO: 9511787 - DNA, 22 bp, Homo sapiens
catctggcagaccctgcctccg

SEQ ID NO: 9511788 - DNA, 22 bp, Homo sapiens
catctggctagctatcattgtg

SEQ ID NO: 9511789 - DNA, 22 bp, Homo sapiens
catctgcaggggaagccagttt

SEQ ID NO: 9511790 - DNA, 20 bp, Homo sapiens
catctgagcccacagaagtc

SEQ ID NO: 9511791 - DNA, 20 bp, Homo sapiens
catctgagcccacagaagtc

SEQ ID NO: 9511792 - DNA, 20 bp, Homo sapiens
catctgagcccacagaagtc

SEQ ID NO: 9511793 - DNA, 22 bp, Homo sapiens
catctgaaatctgcctacaagc

SEQ ID NO: 9511794 - DNA, 22 bp, Homo sapiens
catctgaaatctgcctacaagc

SEQ ID NO: 9511795 - DNA, 22 bp, Homo sapiens
catctgaaatctgcctacaagc

SEQ ID NO: 9511796 - DNA, 22 bp, Homo sapiens
catctgaatatcccaggcatat

SEQ ID NO: 9511797 - DNA, 22 bp, Homo sapiens
catctgaataaagacttgcaga

SEQ ID NO: 9511798 - DNA, 22 bp, Homo sapiens
catctgctgtaattaacaagcc

SEQ ID NO: 9511799 - DNA, 22 bp, Homo sapiens
catctgctgctgaagccagcat

SEQ ID NO: 9511800 - DNA, 22 bp, Homo sapiens
catctgctgttccttggactca

SEQ ID NO: 9511801 - DNA, 22 bp, Homo sapiens
catctgctgttccttggactca

SEQ ID NO: 9511802 - DNA, 22 bp, Homo sapiens
catctgctgacttgacaagtac

SEQ ID NO: 9511803 - DNA, 22 bp, Homo sapiens
catctgctgacttgacaagtac

SEQ ID NO: 9511804 - DNA, 17 bp, Homo sapiens
catctgctctgcccctt

SEQ ID NO: 9511805 - DNA, 17 bp, Homo sapiens
catctgctctgcccctt

SEQ ID NO: 9511806 - DNA, 22 bp, Homo sapiens
catctgccactctctcccacca

SEQ ID NO: 9511807 - DNA, 22 bp, Homo sapiens
catctgagggaaaacatgtagt

SEQ ID NO: 9511808 - DNA, 22 bp, Homo sapiens
catctgcctaagtggccctgtt

SEQ ID NO: 9511809 - DNA, 22 bp, Homo sapiens
catctgcctaagtggccctgtt

SEQ ID NO: 9511810 - DNA, 22 bp, Homo sapiens
catgaagcatgttttgtcatga

SEQ ID NO: 9511811 - DNA, 22 bp, Homo sapiens
catgaagcacagctctcttttt

SEQ ID NO: 9511812 - DNA, 22 bp, Homo sapiens
catgaagatcctgtatgttttt

SEQ ID NO: 9511813 - DNA, 22 bp, Homo sapiens
catgaagcatgttttgtcatga

SEQ ID NO: 9511814 - DNA, 22 bp, Homo sapiens
catgaagccctcatcagtctga

SEQ ID NO: 9511815 - DNA, 22 bp, Homo sapiens
catgaagccctcatcagtctga

SEQ ID NO: 9511816 - DNA, 22 bp, Homo sapiens
catgaagctcttgcacctctag

SEQ ID NO: 9511817 - DNA, 21 bp, Homo sapiens
catgaagccggttccctgttt

SEQ ID NO: 9511818 - DNA, 22 bp, Homo sapiens
catgaagcttgaagcagtccac

SEQ ID NO: 9511819 - DNA, 22 bp, Homo sapiens
catgaacattcagaaatacagc

SEQ ID NO: 9511820 - DNA, 22 bp, Homo sapiens
catgaacattcagaaatacagc

SEQ ID NO: 9511821 - DNA, 22 bp, Homo sapiens
catgaacatttgtttacatctg

SEQ ID NO: 9511822 - DNA, 22 bp, Homo sapiens
catgaacaccaggcatgaacaa

SEQ ID NO: 9511823 - DNA, 22 bp, Homo sapiens
catgaacaccaggcatgaacaa

SEQ ID NO: 9511824 - DNA, 22 bp, Homo sapiens
catgaacaatttgctcactgat

SEQ ID NO: 9511825 - DNA, 22 bp, Homo sapiens
catgaacaccaggcatgaacaa

SEQ ID NO: 9511826 - DNA, 22 bp, Homo sapiens
catgaacaatttgctcactgat

SEQ ID NO: 9511827 - DNA, 22 bp, Homo sapiens
catgaacaaattctgtttgagg

SEQ ID NO: 9511828 - DNA, 22 bp, Homo sapiens
catgaacattcagaaatacagc

SEQ ID NO: 9511829 - DNA, 21 bp, Homo sapiens
catgaacatgcttatcctcag

SEQ ID NO: 9511830 - DNA, 22 bp, Homo sapiens
catgaaatttgaagtacagcaa

SEQ ID NO: 9511831 - DNA, 22 bp, Homo sapiens
catgaaattgctcctttggtgc

SEQ ID NO: 9511832 - DNA, 22 bp, Homo sapiens
catgaaaataacattgttgtga

SEQ ID NO: 9511833 - DNA, 22 bp, Homo sapiens
catgaaaataacattgttgtga

SEQ ID NO: 9511834 - DNA, 22 bp, Homo sapiens
catctgtttcctaatctgtagc

SEQ ID NO: 9511835 - DNA, 22 bp, Homo sapiens
catcttaaaatgtgtcataact

SEQ ID NO: 9511836 - DNA, 22 bp, Homo sapiens
catcttaaattaaagcttaagg

SEQ ID NO: 9511837 - DNA, 22 bp, Homo sapiens
catcttaaattaaagcttaagg

SEQ ID NO: 9511838 - DNA, 22 bp, Homo sapiens
catctgtgtatctgtgcttaga

SEQ ID NO: 9511839 - DNA, 22 bp, Homo sapiens
catctgttaaagtctaatgaaa

SEQ ID NO: 9511840 - DNA, 22 bp, Homo sapiens
catctgtcatcaaccctggcta

SEQ ID NO: 9511841 - DNA, 22 bp, Homo sapiens
catctgtcatcaaccctggcta

SEQ ID NO: 9511842 - DNA, 22 bp, Homo sapiens
catctgtctgcatgctctgggt

SEQ ID NO: 9511843 - DNA, 22 bp, Homo sapiens
tcagggagatttggggactcaa

SEQ ID NO: 9511844 - DNA, 22 bp, Homo sapiens
tcagggagatttggggactcaa

SEQ ID NO: 9511845 - DNA, 22 bp, Homo sapiens
tcagggagatttggggactcaa

SEQ ID NO: 9511846 - DNA, 22 bp, Homo sapiens
tcagggagggacctgaggctgg

SEQ ID NO: 9511847 - DNA, 22 bp, Homo sapiens
tcagggagggacctgaggctgg

SEQ ID NO: 9511848 - DNA, 22 bp, Homo sapiens
tcagggagggacctgaggctgg

SEQ ID NO: 9511849 - DNA, 22 bp, Homo sapiens
tcagggagcctggacttcaagg

SEQ ID NO: 9511850 - DNA, 22 bp, Homo sapiens
tcagggaggtgtctgccagaga

SEQ ID NO: 9511851 - DNA, 22 bp, Homo sapiens
tcagggagtagtttgtgctatg

SEQ ID NO: 9511852 - DNA, 22 bp, Homo sapiens
tcagggagtgttggcaggatca

SEQ ID NO: 9511853 - DNA, 22 bp, Homo sapiens
tcagggagtgttggcaggatca

SEQ ID NO: 9511854 - DNA, 19 bp, Homo sapiens
tcagggagtttacagcatg

SEQ ID NO: 9511855 - DNA, 22 bp, Homo sapiens
tcagtcacactcactgaggtag

SEQ ID NO: 9511856 - DNA, 22 bp, Homo sapiens
tcagtatttctaaacattggct

SEQ ID NO: 9511857 - DNA, 22 bp, Homo sapiens
tcagggattgcaaaattcatcc

SEQ ID NO: 9511858 - DNA, 22 bp, Homo sapiens
tcaggtgtatcatggagttgaa

SEQ ID NO: 9511859 - DNA, 22 bp, Homo sapiens
tcagtattgctagagttcactg

SEQ ID NO: 9511860 - DNA, 22 bp, Homo sapiens
tcaggtgtaggttgttcagttt

SEQ ID NO: 9511861 - DNA, 22 bp, Homo sapiens
tcagtcacttttgcctgctaca

SEQ ID NO: 9511862 - DNA, 22 bp, Homo sapiens
tcagtcaggagatgccagagat

SEQ ID NO: 9511863 - DNA, 22 bp, Homo sapiens
tcagtcagaatcaccagacttt

SEQ ID NO: 9511864 - DNA, 19 bp, Homo sapiens
tcagtcatatatctgcacc

SEQ ID NO: 9511865 - DNA, 22 bp, Homo sapiens
tcagtcaggttctgatttctgg

SEQ ID NO: 9511866 - DNA, 22 bp, Homo sapiens
tcagtccactaagacccttgtt

SEQ ID NO: 9511867 - DNA, 22 bp, Homo sapiens
tcagtgctcctaaagtgaatgc

SEQ ID NO: 9511868 - DNA, 22 bp, Homo sapiens
tcagtgctcctaaagtgaatgc

SEQ ID NO: 9511869 - DNA, 22 bp, Homo sapiens
tcagtgctcctaaagtgaatgc

SEQ ID NO: 9511870 - DNA, 22 bp, Homo sapiens
tcagtgctcaggggagccgagg

SEQ ID NO: 9511871 - DNA, 22 bp, Homo sapiens
tcagtgctcctaaagtgaatgc

SEQ ID NO: 9511872 - DNA, 22 bp, Homo sapiens
tcagtgctcctaaagtgaatgc

SEQ ID NO: 9511873 - DNA, 22 bp, Homo sapiens
tcagtgctcctaaagtgaatgc

SEQ ID NO: 9511874 - DNA, 20 bp, Homo sapiens
tcagtgctcaggcaccaggt

SEQ ID NO: 9511875 - DNA, 22 bp, Homo sapiens
tcagtgcctactttgatcaatt

SEQ ID NO: 9511876 - DNA, 22 bp, Homo sapiens
catctcactgaggggtttacaa

SEQ ID NO: 9511877 - DNA, 22 bp, Homo sapiens
catctcacagcaaactgctgaa

SEQ ID NO: 9511878 - DNA, 22 bp, Homo sapiens
tcagtccataggtgggcctgag

SEQ ID NO: 9511879 - DNA, 22 bp, Homo sapiens
tcagtccaggggctgtgatgtc

SEQ ID NO: 9511880 - DNA, 23 bp, Homo sapiens
tcagtcccaacagcttctcctgg

SEQ ID NO: 9511881 - DNA, 22 bp, Homo sapiens
tcagtccccagatgtgtgctgt

SEQ ID NO: 9511882 - DNA, 22 bp, Homo sapiens
tcagtcccaaggtcctgaggtg

SEQ ID NO: 9511883 - DNA, 22 bp, Homo sapiens
tcagtcccttctccaggtcagc

SEQ ID NO: 9511884 - DNA, 21 bp, Homo sapiens
tcagtccctgggtgtgtccca

SEQ ID NO: 9511885 - DNA, 22 bp, Homo sapiens
tcagtccctcgcaccctgccat

SEQ ID NO: 9511886 - DNA, 22 bp, Homo sapiens
tcagtgcattgttcattgtagg

SEQ ID NO: 9511887 - DNA, 22 bp, Homo sapiens
tcagtgcattctaccaaaaggc

SEQ ID NO: 9511888 - DNA, 22 bp, Homo sapiens
tcagtgcattctaccaaaaggc

SEQ ID NO: 9511889 - DNA, 22 bp, Homo sapiens
tcagtgccatgggcagacaggc

SEQ ID NO: 9511890 - DNA, 22 bp, Homo sapiens
tcagtgccaattctgccatggg

SEQ ID NO: 9511891 - DNA, 22 bp, Homo sapiens
tcagtgccaattctgccatggg

SEQ ID NO: 9511892 - DNA, 22 bp, Homo sapiens
catgcattcctcctctgcctta

SEQ ID NO: 9511893 - DNA, 22 bp, Homo sapiens
catgcattcagaatctctcaca

SEQ ID NO: 9511894 - DNA, 22 bp, Homo sapiens
catgcatgtttactacagtgac

SEQ ID NO: 9511895 - DNA, 22 bp, Homo sapiens
catgcatggtcatgctgggact

SEQ ID NO: 9511896 - DNA, 22 bp, Homo sapiens
catgcatgtcagggatcctgga

SEQ ID NO: 9511897 - DNA, 22 bp, Homo sapiens
catgcatgtttactacagtgac

SEQ ID NO: 9511898 - DNA, 22 bp, Homo sapiens
catggaactgtataaaggcact

SEQ ID NO: 9511899 - DNA, 22 bp, Homo sapiens
catgcattgtaatttttagtct

SEQ ID NO: 9511900 - DNA, 22 bp, Homo sapiens
catggcagagaaggggaactgg

SEQ ID NO: 9511901 - DNA, 22 bp, Homo sapiens
catggaaggcaaaagacacaga

SEQ ID NO: 9511902 - DNA, 22 bp, Homo sapiens
catggcagctttgggaggagga

SEQ ID NO: 9511903 - DNA, 22 bp, Homo sapiens
catggcagctttgggaggagga

SEQ ID NO: 9511904 - DNA, 22 bp, Homo sapiens
catggcaggaaaatgaacaggc

SEQ ID NO: 9511905 - DNA, 22 bp, Homo sapiens
catggcaggaaggacatgcact

SEQ ID NO: 9511906 - DNA, 22 bp, Homo sapiens
catggcaggaaggacatgcact

SEQ ID NO: 9511907 - DNA, 23 bp, Homo sapiens
catggcagcaagagctcatggcc

SEQ ID NO: 9511908 - DNA, 22 bp, Homo sapiens
catggcagagcctgcaggtggg

SEQ ID NO: 9511909 - DNA, 23 bp, Homo sapiens
catggcagcaagagctcatggcc

SEQ ID NO: 9511910 - DNA, 22 bp, Homo sapiens
catggcagctcctccagtgtga

SEQ ID NO: 9511911 - DNA, 22 bp, Homo sapiens
catggccacatctagctgcaag

SEQ ID NO: 9511912 - DNA, 22 bp, Homo sapiens
catggccacatctagctgcaag

SEQ ID NO: 9511913 - DNA, 22 bp, Homo sapiens
catggccaaggatgctcaacca

SEQ ID NO: 9511914 - DNA, 22 bp, Homo sapiens
catggcattttttcatggagac

SEQ ID NO: 9511915 - DNA, 20 bp, Homo sapiens
tccagctgggaacagctgat

SEQ ID NO: 9511916 - DNA, 22 bp, Homo sapiens
tccaggagaaggccatccagcg

SEQ ID NO: 9511917 - DNA, 23 bp, Homo sapiens
tccaggagaattccagggcccgg

SEQ ID NO: 9511918 - DNA, 22 bp, Homo sapiens
tccaggagaaggccatccagcg

SEQ ID NO: 9511919 - DNA, 22 bp, Homo sapiens
catggcagtgattcagcctttg

SEQ ID NO: 9511920 - DNA, 22 bp, Homo sapiens
catggcattgcataacggggct

SEQ ID NO: 9511921 - DNA, 22 bp, Homo sapiens
catggcaggtgcagattctgtg

SEQ ID NO: 9511922 - DNA, 22 bp, Homo sapiens
catggcagggctgtgggcaggt

SEQ ID NO: 9511923 - DNA, 22 bp, Homo sapiens
catggcagggctgtgggcaggt

SEQ ID NO: 9511924 - DNA, 22 bp, Homo sapiens
catggcagggctgtgggcaggt

SEQ ID NO: 9511925 - DNA, 22 bp, Homo sapiens
catggcaggcttcttcagcctt

SEQ ID NO: 9511926 - DNA, 22 bp, Homo sapiens
catggcaggaaggacatgcact

SEQ ID NO: 9511927 - DNA, 22 bp, Homo sapiens
catggcaggaggctgctggcag

SEQ ID NO: 9511928 - DNA, 22 bp, Homo sapiens
catgcatattactagcacagca

SEQ ID NO: 9511929 - DNA, 22 bp, Homo sapiens
catgcagtgactcagacacagg

SEQ ID NO: 9511930 - DNA, 22 bp, Homo sapiens
catgcaggtgaccaggtgtggg

SEQ ID NO: 9511931 - DNA, 22 bp, Homo sapiens
catgaattatttttcacaagat

SEQ ID NO: 9511932 - DNA, 22 bp, Homo sapiens
catgaatttatattattagtga

SEQ ID NO: 9511933 - DNA, 22 bp, Homo sapiens
catgaattatttttcacaagat

SEQ ID NO: 9511934 - DNA, 22 bp, Homo sapiens
catgaatttttctgtgggttaa

SEQ ID NO: 9511935 - DNA, 22 bp, Homo sapiens
catgaatttatattattagtga

SEQ ID NO: 9511936 - DNA, 22 bp, Homo sapiens
catgaattttaagactgttttt

SEQ ID NO: 9511937 - DNA, 22 bp, Homo sapiens
catgacacctaccatattaagt

SEQ ID NO: 9511938 - DNA, 22 bp, Homo sapiens
catgacacccaggcatagcacc

SEQ ID NO: 9511939 - DNA, 22 bp, Homo sapiens
catgaaggaattaaggtaagga

SEQ ID NO: 9511940 - DNA, 22 bp, Homo sapiens
catgaagtcaggatttccatga

SEQ ID NO: 9511941 - DNA, 22 bp, Homo sapiens
catgaattagcaatggtgtgca

SEQ ID NO: 9511942 - DNA, 22 bp, Homo sapiens
catgaatgctgggttcatgtaa

SEQ ID NO: 9511943 - DNA, 20 bp, Homo sapiens
catgacactgttcctctgcc

SEQ ID NO: 9511944 - DNA, 22 bp, Homo sapiens
catgacagatgcaaaggattgg

SEQ ID NO: 9511945 - DNA, 22 bp, Homo sapiens
catgacagatgcaaaggattgg

SEQ ID NO: 9511946 - DNA, 22 bp, Homo sapiens
catgaccaaaatcattacactg

SEQ ID NO: 9511947 - DNA, 22 bp, Homo sapiens
catgagaaccaggtctgtgttt

SEQ ID NO: 9511948 - DNA, 22 bp, Homo sapiens
catgactctccctctgtttatt

SEQ ID NO: 9511949 - DNA, 22 bp, Homo sapiens
catgcacacacgtgcatgtacg

SEQ ID NO: 9511950 - DNA, 22 bp, Homo sapiens
catgcacacacgtgcatgtacg

SEQ ID NO: 9511951 - DNA, 22 bp, Homo sapiens
catgcacacacagttctaatta

SEQ ID NO: 9511952 - DNA, 20 bp, Homo sapiens
catgagaagggcagtgtgag

SEQ ID NO: 9511953 - DNA, 22 bp, Homo sapiens
tcaggcagagtggaagctgcaa

SEQ ID NO: 9511954 - DNA, 22 bp, Homo sapiens
tcaggccaggagatcagattga

SEQ ID NO: 9511955 - DNA, 22 bp, Homo sapiens
tcaggcagagttaatttgctcc

SEQ ID NO: 9511956 - DNA, 22 bp, Homo sapiens
tcaggccaggagatcagattga

SEQ ID NO: 9511957 - DNA, 22 bp, Homo sapiens
tcaggcccagagtcacggatcc

SEQ ID NO: 9511958 - DNA, 22 bp, Homo sapiens
tcaggcccagagtcacggatcc

SEQ ID NO: 9511959 - DNA, 18 bp, Homo sapiens
cataattttctttcttta

SEQ ID NO: 9511960 - DNA, 22 bp, Homo sapiens
cataatttgatatgcttgatgg

SEQ ID NO: 9511961 - DNA, 22 bp, Homo sapiens
cataatttgatatgcttgatgg

SEQ ID NO: 9511962 - DNA, 22 bp, Homo sapiens
cataatttctgtatcagcacca

SEQ ID NO: 9511963 - DNA, 22 bp, Homo sapiens
cataattttccatggtttgcta

SEQ ID NO: 9511964 - DNA, 22 bp, Homo sapiens
cataattactgatatgctgatt

SEQ ID NO: 9511965 - DNA, 22 bp, Homo sapiens
cataattactgatatgctgatt

SEQ ID NO: 9511966 - DNA, 22 bp, Homo sapiens
cataattactgatatgctgatt

SEQ ID NO: 9511967 - DNA, 22 bp, Homo sapiens
cataattagagaattcatgtta

SEQ ID NO: 9511968 - DNA, 22 bp, Homo sapiens
cataattaggcagttgatcatt

SEQ ID NO: 9511969 - DNA, 22 bp, Homo sapiens
cataattaaattctgggcaaga

SEQ ID NO: 9511970 - DNA, 22 bp, Homo sapiens
cataattaaattctgggcaaga

SEQ ID NO: 9511971 - DNA, 22 bp, Homo sapiens
cataatttcactgtcgtatggc

SEQ ID NO: 9511972 - DNA, 22 bp, Homo sapiens
cataattagtcatgttatgcat

SEQ ID NO: 9511973 - DNA, 22 bp, Homo sapiens
cataattaggcagttgatcatt

SEQ ID NO: 9511974 - DNA, 22 bp, Homo sapiens
cataattaggcagttgatcatt

SEQ ID NO: 9511975 - DNA, 22 bp, Homo sapiens
cataattataaacgcaagttca

SEQ ID NO: 9511976 - DNA, 22 bp, Homo sapiens
cataattataaacgcaagttca

SEQ ID NO: 9511977 - DNA, 22 bp, Homo sapiens
cataattagtcatgttatgcat

SEQ ID NO: 9511978 - DNA, 22 bp, Homo sapiens
cataattataaacgcaagttca

SEQ ID NO: 9511979 - DNA, 22 bp, Homo sapiens
cataatccttgattcaaataat

SEQ ID NO: 9511980 - DNA, 22 bp, Homo sapiens
cataatgtctgacacagtaaga

SEQ ID NO: 9511981 - DNA, 22 bp, Homo sapiens
cataatgtgtgtcatacagact

SEQ ID NO: 9511982 - DNA, 22 bp, Homo sapiens
cataatcagatgtgtacataag

SEQ ID NO: 9511983 - DNA, 22 bp, Homo sapiens
cataatcagatgtgtacataag

SEQ ID NO: 9511984 - DNA, 22 bp, Homo sapiens
cataatcagatgtgtacataag

SEQ ID NO: 9511985 - DNA, 22 bp, Homo sapiens
cataatcccaggcttgcattca

SEQ ID NO: 9511986 - DNA, 22 bp, Homo sapiens
cataatcctggtgtagccctct

SEQ ID NO: 9511987 - DNA, 22 bp, Homo sapiens
cataatatctccgattacttgc

SEQ ID NO: 9511988 - DNA, 22 bp, Homo sapiens
cataacagtggcttcagcaagt

SEQ ID NO: 9511989 - DNA, 22 bp, Homo sapiens
cataatatctccgattacttgc

SEQ ID NO: 9511990 - DNA, 22 bp, Homo sapiens
cataatatctccgattacttgc

SEQ ID NO: 9511991 - DNA, 22 bp, Homo sapiens
tcagcagtcctccaggatcaag

SEQ ID NO: 9511992 - DNA, 22 bp, Homo sapiens
cataacatccttgctactttga

SEQ ID NO: 9511993 - DNA, 22 bp, Homo sapiens
tcagcagtcctccaggatcaag

SEQ ID NO: 9511994 - DNA, 17 bp, Homo sapiens
tcagcagtaatggtggg

SEQ ID NO: 9511995 - DNA, 22 bp, Homo sapiens
tcagcaggtgctttgtttactc

SEQ ID NO: 9511996 - DNA, 22 bp, Homo sapiens
tcagcaggtggtgggcaggtga

SEQ ID NO: 9511997 - DNA, 22 bp, Homo sapiens
tcagcagtagagggggcacagt

SEQ ID NO: 9511998 - DNA, 22 bp, Homo sapiens
tcagcagtagagggggcacagt

SEQ ID NO: 9511999 - DNA, 22 bp, Homo sapiens
tcagcaggtggtgggcaggtga

SEQ ID NO: 9512000 - DNA, 22 bp, Homo sapiens
tcagcaggtgcctcagattctt

SEQ ID NO: 9512001 - DNA, 22 bp, Homo sapiens
tcagcaggtgcctcagattctt

SEQ ID NO: 9512002 - DNA, 22 bp, Homo sapiens
tcagcaggtctgaggcggggcc

SEQ ID NO: 9512003 - DNA, 22 bp, Homo sapiens
tcagcaggtgaacatcatgcca

SEQ ID NO: 9512004 - DNA, 22 bp, Homo sapiens
tcagcagggtttgacttctaat

SEQ ID NO: 9512005 - DNA, 22 bp, Homo sapiens
tcagcaggtctgaggcggggcc

SEQ ID NO: 9512006 - DNA, 22 bp, Homo sapiens
tcagcagggtttgacttctaat

SEQ ID NO: 9512007 - DNA, 22 bp, Homo sapiens
catagaaaagagtaggtaatgt

SEQ ID NO: 9512008 - DNA, 22 bp, Homo sapiens
tcaggcctgagaaaaatccttt

SEQ ID NO: 9512009 - DNA, 22 bp, Homo sapiens
catagaaagtattatggaattt

SEQ ID NO: 9512010 - DNA, 22 bp, Homo sapiens
catagaaatcaggtgagaatct

SEQ ID NO: 9512011 - DNA, 22 bp, Homo sapiens
catagaaatcaggtgagaatct

SEQ ID NO: 9512012 - DNA, 22 bp, Homo sapiens
catagaaatcaggtgagaatct

SEQ ID NO: 9512013 - DNA, 22 bp, Homo sapiens
tcaggccccttgtcagctctgt

SEQ ID NO: 9512014 - DNA, 22 bp, Homo sapiens
tcaggcccagagtcacggatcc

SEQ ID NO: 9512015 - DNA, 22 bp, Homo sapiens
tcaggccccatcccagacttat

SEQ ID NO: 9512016 - DNA, 22 bp, Homo sapiens
tcaggccccatcccagacttat

SEQ ID NO: 9512017 - DNA, 22 bp, Homo sapiens
tcaggcccttctcccaggactc

SEQ ID NO: 9512018 - DNA, 22 bp, Homo sapiens
tcaggcccttctcccaggactc

SEQ ID NO: 9512019 - DNA, 22 bp, Homo sapiens
tcaggccctttgctgctgcccc

SEQ ID NO: 9512020 - DNA, 22 bp, Homo sapiens
tcaggcccttctcccaggactc

SEQ ID NO: 9512021 - DNA, 22 bp, Homo sapiens
tcaggcctagggagccacacca

SEQ ID NO: 9512022 - DNA, 22 bp, Homo sapiens
tcaggcctagggagaaaattca

SEQ ID NO: 9512023 - DNA, 22 bp, Homo sapiens
tcaggcctagaacacagcagat

SEQ ID NO: 9512024 - DNA, 22 bp, Homo sapiens
tcaggccctttgctgctgcccc

SEQ ID NO: 9512025 - DNA, 22 bp, Homo sapiens
tcaggcctcaagctgctttaag

SEQ ID NO: 9512026 - DNA, 22 bp, Homo sapiens
tcaggcctcagaaattgcactg

SEQ ID NO: 9512027 - DNA, 22 bp, Homo sapiens
tcaggcctccaggttaccattt

SEQ ID NO: 9512028 - DNA, 22 bp, Homo sapiens
tcaggcctccaggttaccattt

SEQ ID NO: 9512029 - DNA, 22 bp, Homo sapiens
tcaggcctcagcagcccacagg

SEQ ID NO: 9512030 - DNA, 22 bp, Homo sapiens
tcagggagagtgacccatccac

SEQ ID NO: 9512031 - DNA, 22 bp, Homo sapiens
tcagggagagtgacccatccac

SEQ ID NO: 9512032 - DNA, 22 bp, Homo sapiens
tcagggagaggtgagagcctgt

SEQ ID NO: 9512033 - DNA, 17 bp, Homo sapiens
tcaggctgtgcctggta

SEQ ID NO: 9512034 - DNA, 22 bp, Homo sapiens
tcagggagaggtgagagcctgt

SEQ ID NO: 9512035 - DNA, 22 bp, Homo sapiens
tcaggctgtgtctttaaacaat

SEQ ID NO: 9512036 - DNA, 17 bp, Homo sapiens
tcaggctgtgcctggta

SEQ ID NO: 9512037 - DNA, 17 bp, Homo sapiens
tcaggctgtgcctggta

SEQ ID NO: 9512038 - DNA, 21 bp, Homo sapiens
tcaggctgtctgctggttcca

SEQ ID NO: 9512039 - DNA, 22 bp, Homo sapiens
tcaggctgtatatcttgcactc

SEQ ID NO: 9512040 - DNA, 21 bp, Homo sapiens
tcaggctgtctgctggttcca

SEQ ID NO: 9512041 - DNA, 22 bp, Homo sapiens
tcaggctgcctatcagactgtg

SEQ ID NO: 9512042 - DNA, 22 bp, Homo sapiens
tcaggctgcctatcagactgtg

SEQ ID NO: 9512043 - DNA, 22 bp, Homo sapiens
tcaggctgcctatcagactgtg

SEQ ID NO: 9512044 - DNA, 22 bp, Homo sapiens
catagaatatgtgtgattgtta

SEQ ID NO: 9512045 - DNA, 22 bp, Homo sapiens
tcagatatgaattcatatctct

SEQ ID NO: 9512046 - DNA, 22 bp, Homo sapiens
tcagatattcaattaagttaaa

SEQ ID NO: 9512047 - DNA, 22 bp, Homo sapiens
tcagatatagtcatttaaataa

SEQ ID NO: 9512048 - DNA, 22 bp, Homo sapiens
tcagatagtgataatagcatgt

SEQ ID NO: 9512049 - DNA, 22 bp, Homo sapiens
tcagataagtgaagcaaagttt

SEQ ID NO: 9512050 - DNA, 22 bp, Homo sapiens
tcagataattaatcatgaaatt

SEQ ID NO: 9512051 - DNA, 22 bp, Homo sapiens
tcagataaaggagagcttagca

SEQ ID NO: 9512052 - DNA, 22 bp, Homo sapiens
tcagagtttgtactgacaggag

SEQ ID NO: 9512053 - DNA, 22 bp, Homo sapiens
tcagagtttcaggatacaaata

SEQ ID NO: 9512054 - DNA, 22 bp, Homo sapiens
tcagagttctctgtccagatga

SEQ ID NO: 9512055 - DNA, 22 bp, Homo sapiens
tcagagttggcagtaaaacaca

SEQ ID NO: 9512056 - DNA, 22 bp, Homo sapiens
tcagagttggcagtaaaacaca

SEQ ID NO: 9512057 - DNA, 22 bp, Homo sapiens
tcagaggagctgcagaacgctg

SEQ ID NO: 9512058 - DNA, 22 bp, Homo sapiens
tcagaggaggcatttaaacaga

SEQ ID NO: 9512059 - DNA, 22 bp, Homo sapiens
tcagaggagggactcagaccca

SEQ ID NO: 9512060 - DNA, 22 bp, Homo sapiens
tcagaggatcatgtccctactc

SEQ ID NO: 9512061 - DNA, 22 bp, Homo sapiens
tcagaggagccaaagttctgag

SEQ ID NO: 9512062 - DNA, 23 bp, Homo sapiens
tcagagcaagatgatgtatgagc

SEQ ID NO: 9512063 - DNA, 22 bp, Homo sapiens
tcagaggagcaaaagaggggat

SEQ ID NO: 9512064 - DNA, 22 bp, Homo sapiens
tcagatattctctaagaacaat

SEQ ID NO: 9512065 - DNA, 22 bp, Homo sapiens
tcagatcaggatgcagcaacat

SEQ ID NO: 9512066 - DNA, 22 bp, Homo sapiens
tcagatcatttgtggattcact

SEQ ID NO: 9512067 - DNA, 22 bp, Homo sapiens
tcagatcatcagctgctttata

SEQ ID NO: 9512068 - DNA, 22 bp, Homo sapiens
cagtttgtcttgattcagaaca

SEQ ID NO: 9512069 - DNA, 22 bp, Homo sapiens
cagtttttagattagttggtgg

SEQ ID NO: 9512070 - DNA, 22 bp, Homo sapiens
cagttttggtcctttctaggta

SEQ ID NO: 9512071 - DNA, 22 bp, Homo sapiens
cagttttctatggtagaagcat

SEQ ID NO: 9512072 - DNA, 22 bp, Homo sapiens
cagttttctaaagtctctttaa

SEQ ID NO: 9512073 - DNA, 22 bp, Homo sapiens
cagtttgtgctaggcactattt

SEQ ID NO: 9512074 - DNA, 22 bp, Homo sapiens
cagtttgtgctaggcactattt

SEQ ID NO: 9512075 - DNA, 22 bp, Homo sapiens
cagtttttcaaaattacatgat

SEQ ID NO: 9512076 - DNA, 22 bp, Homo sapiens
cagtttttgccattaagagtaa

SEQ ID NO: 9512077 - DNA, 17 bp, Homo sapiens
cataaaacagttctatt

SEQ ID NO: 9512078 - DNA, 17 bp, Homo sapiens
cataaaacagttctatt

SEQ ID NO: 9512079 - DNA, 22 bp, Homo sapiens
cataaaagccacctatttaaag

SEQ ID NO: 9512080 - DNA, 22 bp, Homo sapiens
cataaaagccacctatttaaag

SEQ ID NO: 9512081 - DNA, 17 bp, Homo sapiens
cataaaacagttctatt

SEQ ID NO: 9512082 - DNA, 22 bp, Homo sapiens
cagtttttgccattaagagtaa

SEQ ID NO: 9512083 - DNA, 22 bp, Homo sapiens
cagtttttgccattaagagtaa

SEQ ID NO: 9512084 - DNA, 22 bp, Homo sapiens
cataaaagccacctatttaaag

SEQ ID NO: 9512085 - DNA, 22 bp, Homo sapiens
cataaaagccacctatttaaag

SEQ ID NO: 9512086 - DNA, 23 bp, Homo sapiens
cataaaatattagtatggtagca

SEQ ID NO: 9512087 - DNA, 22 bp, Homo sapiens
cataaaatggcttgttctttaa

SEQ ID NO: 9512088 - DNA, 22 bp, Homo sapiens
tcagagagttagtgtcttagct

SEQ ID NO: 9512089 - DNA, 22 bp, Homo sapiens
tcagagagttttcactagggtg

SEQ ID NO: 9512090 - DNA, 22 bp, Homo sapiens
tcagagcaaattcctgtgagcc

SEQ ID NO: 9512091 - DNA, 18 bp, Homo sapiens
tcagagcaaacagaagcc

SEQ ID NO: 9512092 - DNA, 22 bp, Homo sapiens
tcagagattcacgtcagtccca

SEQ ID NO: 9512093 - DNA, 22 bp, Homo sapiens
cagttggaggaatgaggctgta

SEQ ID NO: 9512094 - DNA, 22 bp, Homo sapiens
cagttgcagaggcagagtgcta

SEQ ID NO: 9512095 - DNA, 22 bp, Homo sapiens
cagttggttttgaggctgtact

SEQ ID NO: 9512096 - DNA, 22 bp, Homo sapiens
cagttggtgatgaggctagtag

SEQ ID NO: 9512097 - DNA, 22 bp, Homo sapiens
tcagagaggttggtgataagaa

SEQ ID NO: 9512098 - DNA, 22 bp, Homo sapiens
cagttgtccccaaaatatacgg

SEQ ID NO: 9512099 - DNA, 22 bp, Homo sapiens
cagttgtccccaaaatatacgg

SEQ ID NO: 9512100 - DNA, 22 bp, Homo sapiens
tcagagaggttggtgataagaa

SEQ ID NO: 9512101 - DNA, 21 bp, Homo sapiens
tcagagagtcacagtgaactg

SEQ ID NO: 9512102 - DNA, 22 bp, Homo sapiens
tcagagagtgcaaaatatagct

SEQ ID NO: 9512103 - DNA, 22 bp, Homo sapiens
tcagagagtcctggtcatttgc

SEQ ID NO: 9512104 - DNA, 22 bp, Homo sapiens
tcaatcataatgaagtgaagaa

SEQ ID NO: 9512105 - DNA, 22 bp, Homo sapiens
tcaatgaaagagcatgcatttt

SEQ ID NO: 9512106 - DNA, 22 bp, Homo sapiens
tcaatgaaagagcatgcatttt

SEQ ID NO: 9512107 - DNA, 22 bp, Homo sapiens
tcaatcaatgtgtcagttccca

SEQ ID NO: 9512108 - DNA, 22 bp, Homo sapiens
tcaatatttttatgagcataga

SEQ ID NO: 9512109 - DNA, 22 bp, Homo sapiens
tcaatcaatggtttccaaattt

SEQ ID NO: 9512110 - DNA, 22 bp, Homo sapiens
tcaatcaaagcactgggctttg

SEQ ID NO: 9512111 - DNA, 22 bp, Homo sapiens
tcaatcaaagccagatgtcctt

SEQ ID NO: 9512112 - DNA, 22 bp, Homo sapiens
tcaatagattaggtattagatt

SEQ ID NO: 9512113 - DNA, 22 bp, Homo sapiens
tcaatagattaggtattagatt

SEQ ID NO: 9512114 - DNA, 22 bp, Homo sapiens
tcaatagcatagcaattaatgt

SEQ ID NO: 9512115 - DNA, 22 bp, Homo sapiens
tcaatatattccatgttttctc

SEQ ID NO: 9512116 - DNA, 22 bp, Homo sapiens
tcaatattcttctttagtagga

SEQ ID NO: 9512117 - DNA, 22 bp, Homo sapiens
tcaatatattccatgttttctc

SEQ ID NO: 9512118 - DNA, 22 bp, Homo sapiens
cagttctttgtggggagttctc

SEQ ID NO: 9512119 - DNA, 22 bp, Homo sapiens
cagttcttggacactctggagt

SEQ ID NO: 9512120 - DNA, 22 bp, Homo sapiens
cagttctggagtttcattcttt

SEQ ID NO: 9512121 - DNA, 22 bp, Homo sapiens
cagttctggaggctccacatct

SEQ ID NO: 9512122 - DNA, 22 bp, Homo sapiens
cagttctggaggctccacatct

SEQ ID NO: 9512123 - DNA, 22 bp, Homo sapiens
cagttctggtttgcagatatat

SEQ ID NO: 9512124 - DNA, 22 bp, Homo sapiens
cagttctggtttgcagatatat

SEQ ID NO: 9512125 - DNA, 22 bp, Homo sapiens
tcaatgaaagagcatgcatttt

SEQ ID NO: 9512126 - DNA, 22 bp, Homo sapiens
cagttactgtatgtcaaagact

SEQ ID NO: 9512127 - DNA, 22 bp, Homo sapiens
cagggagcctccaaagctttca

SEQ ID NO: 9512128 - DNA, 22 bp, Homo sapiens
cagggccactgcatgaggttca

SEQ ID NO: 9512129 - DNA, 22 bp, Homo sapiens
cagggccactgcatgaggttca

SEQ ID NO: 9512130 - DNA, 22 bp, Homo sapiens
cagggccaggctgatggcctgg

SEQ ID NO: 9512131 - DNA, 22 bp, Homo sapiens
cagggagcaggctctgtccatc

SEQ ID NO: 9512132 - DNA, 22 bp, Homo sapiens
cagggagcctccaaagctttca

SEQ ID NO: 9512133 - DNA, 22 bp, Homo sapiens
cagggccagttctcgcagcagt

SEQ ID NO: 9512134 - DNA, 22 bp, Homo sapiens
cagggccagggctatggtgaag

SEQ ID NO: 9512135 - DNA, 22 bp, Homo sapiens
cagggccagggctatggtgaag

SEQ ID NO: 9512136 - DNA, 22 bp, Homo sapiens
cagggccagggctatggtgaag

SEQ ID NO: 9512137 - DNA, 22 bp, Homo sapiens
cagggccatatcttgtgcacca

SEQ ID NO: 9512138 - DNA, 22 bp, Homo sapiens
cagggccagttctcgcagcagt

SEQ ID NO: 9512139 - DNA, 22 bp, Homo sapiens
cagggccagttctcgcagcagt

SEQ ID NO: 9512140 - DNA, 22 bp, Homo sapiens
cagggccatgaggcacagggtc

SEQ ID NO: 9512141 - DNA, 22 bp, Homo sapiens
cagggccatgaggcacagggtc

SEQ ID NO: 9512142 - DNA, 22 bp, Homo sapiens
tagcttaatatgaaacacataa

SEQ ID NO: 9512143 - DNA, 22 bp, Homo sapiens
tagcttaaggcaggcccttgtc

SEQ ID NO: 9512144 - DNA, 22 bp, Homo sapiens
tagcttaaggagtaccagatca

SEQ ID NO: 9512145 - DNA, 22 bp, Homo sapiens
tagcttaaggagtaccagatca

SEQ ID NO: 9512146 - DNA, 22 bp, Homo sapiens
cagggccatgaggcacagggtc

SEQ ID NO: 9512147 - DNA, 22 bp, Homo sapiens
cagggccatgaggcacagggtc

SEQ ID NO: 9512148 - DNA, 22 bp, Homo sapiens
cagggccattggaacaaagagg

SEQ ID NO: 9512149 - DNA, 22 bp, Homo sapiens
cagggccattggaacaaagagg

SEQ ID NO: 9512150 - DNA, 22 bp, Homo sapiens
tagatttgaatgatgtaaagag

SEQ ID NO: 9512151 - DNA, 22 bp, Homo sapiens
cagggagatcttggctcctggt

SEQ ID NO: 9512152 - DNA, 22 bp, Homo sapiens
tagatttcgctgcatctcaatc

SEQ ID NO: 9512153 - DNA, 22 bp, Homo sapiens
tagatttcaggagacaaaatgg

SEQ ID NO: 9512154 - DNA, 22 bp, Homo sapiens
tagattctttgctagatcattg

SEQ ID NO: 9512155 - DNA, 22 bp, Homo sapiens
tagattgtagatcatgagactt

SEQ ID NO: 9512156 - DNA, 22 bp, Homo sapiens
tagattgtagatcatgagactt

SEQ ID NO: 9512157 - DNA, 22 bp, Homo sapiens
tagatttaagaccctgaatttg

SEQ ID NO: 9512158 - DNA, 22 bp, Homo sapiens
cagggagcagcccctagaagta

SEQ ID NO: 9512159 - DNA, 22 bp, Homo sapiens
cagggagcagcccctagaagta

SEQ ID NO: 9512160 - DNA, 22 bp, Homo sapiens
cagggagcagcgctggggcctc

SEQ ID NO: 9512161 - DNA, 22 bp, Homo sapiens
cagggagcaggctctgtccatc

SEQ ID NO: 9512162 - DNA, 22 bp, Homo sapiens
cagggagcaggctctgtccatc

SEQ ID NO: 9512163 - DNA, 22 bp, Homo sapiens
cagggagatcttggctcctggt

SEQ ID NO: 9512164 - DNA, 22 bp, Homo sapiens
cagggagatcttggctcctggt

SEQ ID NO: 9512165 - DNA, 22 bp, Homo sapiens
cagggagcactgcgagcggcag

SEQ ID NO: 9512166 - DNA, 22 bp, Homo sapiens
cagggagcactgcgagcggcag

SEQ ID NO: 9512167 - DNA, 22 bp, Homo sapiens
cagggagcactgcgagcggcag

SEQ ID NO: 9512168 - DNA, 22 bp, Homo sapiens
taggcatgcaaataaatgtgca

SEQ ID NO: 9512169 - DNA, 22 bp, Homo sapiens
taggcatgcaaataaatgtgca

SEQ ID NO: 9512170 - DNA, 22 bp, Homo sapiens
taggcatgtgtttgccatagcc

SEQ ID NO: 9512171 - DNA, 22 bp, Homo sapiens
taggccaaatgacttgatgttt

SEQ ID NO: 9512172 - DNA, 22 bp, Homo sapiens
taggccaaggacagtaaggaca

SEQ ID NO: 9512173 - DNA, 22 bp, Homo sapiens
taggccaacgtggaagggtcca

SEQ ID NO: 9512174 - DNA, 22 bp, Homo sapiens
taggccaaatgacttgatgttt

SEQ ID NO: 9512175 - DNA, 22 bp, Homo sapiens
taggcagggattagggttgatt

SEQ ID NO: 9512176 - DNA, 22 bp, Homo sapiens
taggcaggtgtgcactgcccac

SEQ ID NO: 9512177 - DNA, 22 bp, Homo sapiens
taggcaggtgtgcactgcccac

SEQ ID NO: 9512178 - DNA, 22 bp, Homo sapiens
tagctttaagacatggtgaatg

SEQ ID NO: 9512179 - DNA, 22 bp, Homo sapiens
tagctttaaaaatcatcaaagc

SEQ ID NO: 9512180 - DNA, 22 bp, Homo sapiens
tagcttggaataaaatgagaat

SEQ ID NO: 9512181 - DNA, 22 bp, Homo sapiens
tagctttaaaaatcatcaaagc

SEQ ID NO: 9512182 - DNA, 22 bp, Homo sapiens
tagcttgactattctatgatgt

SEQ ID NO: 9512183 - DNA, 22 bp, Homo sapiens
tagcttcttgagaaagggtgcc

SEQ ID NO: 9512184 - DNA, 22 bp, Homo sapiens
tagcttctgggagtgtttacta

SEQ ID NO: 9512185 - DNA, 22 bp, Homo sapiens
tagcttctgggagtgtttacta

SEQ ID NO: 9512186 - DNA, 22 bp, Homo sapiens
tagcttctggagtgtttgaaaa

SEQ ID NO: 9512187 - DNA, 22 bp, Homo sapiens
tagcttctcttttcaacatctt

SEQ ID NO: 9512188 - DNA, 22 bp, Homo sapiens
tagcttctcttttcaacatctt

SEQ ID NO: 9512189 - DNA, 22 bp, Homo sapiens
tagcttcagggaaaccactgct

SEQ ID NO: 9512190 - DNA, 22 bp, Homo sapiens
tagcttctcataatttatgctg

SEQ ID NO: 9512191 - DNA, 22 bp, Homo sapiens
tagcttctatacaacttcagca

SEQ ID NO: 9512192 - DNA, 22 bp, Homo sapiens
tagcttctaatacttaccaatt

SEQ ID NO: 9512193 - DNA, 22 bp, Homo sapiens
tagcttctaatacttaccaatt

SEQ ID NO: 9512194 - DNA, 22 bp, Homo sapiens
taggccaagttgatcagacatc

SEQ ID NO: 9512195 - DNA, 22 bp, Homo sapiens
taggccaaggacagtaaggaca

SEQ ID NO: 9512196 - DNA, 22 bp, Homo sapiens
taggccacagagaggagatttc

SEQ ID NO: 9512197 - DNA, 22 bp, Homo sapiens
taggccacaaataagatcctgt

SEQ ID NO: 9512198 - DNA, 22 bp, Homo sapiens
taggccacagatgagacataag

SEQ ID NO: 9512199 - DNA, 22 bp, Homo sapiens
taggccaccagggttccattta

SEQ ID NO: 9512200 - DNA, 21 bp, Homo sapiens
taggccacatgggttggagat

SEQ ID NO: 9512201 - DNA, 22 bp, Homo sapiens
taggccactctcctttgtctca

SEQ ID NO: 9512202 - DNA, 22 bp, Homo sapiens
taggccacgaaggagatgatag

SEQ ID NO: 9512203 - DNA, 22 bp, Homo sapiens
taggccacggaaagcaggttgc

SEQ ID NO: 9512204 - DNA, 22 bp, Homo sapiens
cagggcccagtccctgctgtca

SEQ ID NO: 9512205 - DNA, 22 bp, Homo sapiens
cagggcccaggccactgggttg

SEQ ID NO: 9512206 - DNA, 22 bp, Homo sapiens
cagggcccaggccactgggttg

SEQ ID NO: 9512207 - DNA, 22 bp, Homo sapiens
cagggcccagtccctgctgtca

SEQ ID NO: 9512208 - DNA, 22 bp, Homo sapiens
cagggcccaagacacaatgagg

SEQ ID NO: 9512209 - DNA, 22 bp, Homo sapiens
cagggccattggcgtggctgtc

SEQ ID NO: 9512210 - DNA, 22 bp, Homo sapiens
cagggcccaagacacaatgagg

SEQ ID NO: 9512211 - DNA, 22 bp, Homo sapiens
cagggccccagggatgtctgct

SEQ ID NO: 9512212 - DNA, 22 bp, Homo sapiens
cagggccccagggatgtctgct

SEQ ID NO: 9512213 - DNA, 20 bp, Homo sapiens
cagggcctatgattgagctt

SEQ ID NO: 9512214 - DNA, 20 bp, Homo sapiens
cagggcctaagagctgaaaa

SEQ ID NO: 9512215 - DNA, 20 bp, Homo sapiens
cagggcctaagagctgaaaa

SEQ ID NO: 9512216 - DNA, 23 bp, Homo sapiens
cagggccctgctcaatttctcca

SEQ ID NO: 9512217 - DNA, 22 bp, Homo sapiens
cagggccctaagatacacatca

SEQ ID NO: 9512218 - DNA, 22 bp, Homo sapiens
cagggcctcatcctcagagatt

SEQ ID NO: 9512219 - DNA, 22 bp, Homo sapiens
cagggcctcatcctcagagatt

SEQ ID NO: 9512220 - DNA, 22 bp, Homo sapiens
cagggctccatgcagggactcc

SEQ ID NO: 9512221 - DNA, 22 bp, Homo sapiens
cagggctccatgcagggactcc

SEQ ID NO: 9512222 - DNA, 22 bp, Homo sapiens
cagggtagacagtaggtgtctg

SEQ ID NO: 9512223 - DNA, 22 bp, Homo sapiens
cagggtagacagtaggtgtctg

SEQ ID NO: 9512224 - DNA, 22 bp, Homo sapiens
cagggtagggcaagggaacctg

SEQ ID NO: 9512225 - DNA, 22 bp, Homo sapiens
cagggtagggcaagggaacctg

SEQ ID NO: 9512226 - DNA, 22 bp, Homo sapiens
cagggtacagagttttctaaac

SEQ ID NO: 9512227 - DNA, 22 bp, Homo sapiens
caggggtgtttttggccaggag

SEQ ID NO: 9512228 - DNA, 22 bp, Homo sapiens
caggggtgtttttggccaggag

SEQ ID NO: 9512229 - DNA, 22 bp, Homo sapiens
caggggtgtttttggccaggag

SEQ ID NO: 9512230 - DNA, 22 bp, Homo sapiens
cagggggtggtccaggctgcgc

SEQ ID NO: 9512231 - DNA, 22 bp, Homo sapiens
cagggggtggtccaggctgcgc

SEQ ID NO: 9512232 - DNA, 22 bp, Homo sapiens
cagggggtggtccaggctgcgc

SEQ ID NO: 9512233 - DNA, 22 bp, Homo sapiens
caggggtggctgcagcagaggt

SEQ ID NO: 9512234 - DNA, 22 bp, Homo sapiens
caggggtggctgcagcagaggt

SEQ ID NO: 9512235 - DNA, 22 bp, Homo sapiens
cagggtcaggctgctagaagct

SEQ ID NO: 9512236 - DNA, 22 bp, Homo sapiens
cagggtcatggcacctgcacgg

SEQ ID NO: 9512237 - DNA, 22 bp, Homo sapiens
cagggtcaggctgctagaagct

SEQ ID NO: 9512238 - DNA, 22 bp, Homo sapiens
cagggtccatctttcatcactg

SEQ ID NO: 9512239 - DNA, 22 bp, Homo sapiens
cagggtccatctttcatcactg

SEQ ID NO: 9512240 - DNA, 22 bp, Homo sapiens
cagggtcaggaggatctggctt

SEQ ID NO: 9512241 - DNA, 22 bp, Homo sapiens
cagggtcaggaggatctggctt

SEQ ID NO: 9512242 - DNA, 22 bp, Homo sapiens
cagggtagtaatttaatacaag

SEQ ID NO: 9512243 - DNA, 22 bp, Homo sapiens
cagggtcaagagactccagcag

SEQ ID NO: 9512244 - DNA, 22 bp, Homo sapiens
cagggtccccgggtctcctgtg

SEQ ID NO: 9512245 - DNA, 22 bp, Homo sapiens
cagggtcccaggagctgctttc

SEQ ID NO: 9512246 - DNA, 22 bp, Homo sapiens
cagggtccggctgcctggctgt

SEQ ID NO: 9512247 - DNA, 22 bp, Homo sapiens
cagggtggggctggctatcaaa

SEQ ID NO: 9512248 - DNA, 22 bp, Homo sapiens
cagggtctgatggtcctcactt

SEQ ID NO: 9512249 - DNA, 22 bp, Homo sapiens
cagggtctgatggtcctcactt

SEQ ID NO: 9512250 - DNA, 22 bp, Homo sapiens
caggggggcaggagtcattgat

SEQ ID NO: 9512251 - DNA, 22 bp, Homo sapiens
cagggggctgtggctgtccagt

SEQ ID NO: 9512252 - DNA, 22 bp, Homo sapiens
cagggggctgtggctgtccagt

SEQ ID NO: 9512253 - DNA, 22 bp, Homo sapiens
cagggggctgtggctgtccagt

SEQ ID NO: 9512254 - DNA, 22 bp, Homo sapiens
cagggggctcaaaggagagtgc

SEQ ID NO: 9512255 - DNA, 22 bp, Homo sapiens
cagggggcagcgtagaaaatga

SEQ ID NO: 9512256 - DNA, 22 bp, Homo sapiens
cagggggctcaaaggagagtgc

SEQ ID NO: 9512257 - DNA, 22 bp, Homo sapiens
caggggcttaagtgacagaagg

SEQ ID NO: 9512258 - DNA, 22 bp, Homo sapiens
caggggcctgtcctggcttctg

SEQ ID NO: 9512259 - DNA, 22 bp, Homo sapiens
caggggcgggtaaaaggcctcc

SEQ ID NO: 9512260 - DNA, 17 bp, Homo sapiens
cagggctgtctgcctag

SEQ ID NO: 9512261 - DNA, 22 bp, Homo sapiens
cagggctgtgcccatcttcccc

SEQ ID NO: 9512262 - DNA, 22 bp, Homo sapiens
cagggctgtgcccatcttcccc

SEQ ID NO: 9512263 - DNA, 17 bp, Homo sapiens
cagggctgtctgcctag

SEQ ID NO: 9512264 - DNA, 17 bp, Homo sapiens
cagggctgtctgcctag

SEQ ID NO: 9512265 - DNA, 22 bp, Homo sapiens
cagggctgtggaaaactggtgc

SEQ ID NO: 9512266 - DNA, 22 bp, Homo sapiens
cagggctgtggctttgtgctgt

SEQ ID NO: 9512267 - DNA, 22 bp, Homo sapiens
caggggcctgtcctggcttctg

SEQ ID NO: 9512268 - DNA, 22 bp, Homo sapiens
cagggctgtggctttgtgctgt

SEQ ID NO: 9512269 - DNA, 20 bp, Homo sapiens
cagggctctgggcctggcct

SEQ ID NO: 9512270 - DNA, 20 bp, Homo sapiens
cagggctctgggcctggcct

SEQ ID NO: 9512271 - DNA, 22 bp, Homo sapiens
cagggctcttcatcacacagta

SEQ ID NO: 9512272 - DNA, 22 bp, Homo sapiens
cagggctcttccggagcaggga

SEQ ID NO: 9512273 - DNA, 22 bp, Homo sapiens
cagggctcttccggagcaggga

SEQ ID NO: 9512274 - DNA, 22 bp, Homo sapiens
cagggctgaaatcaaggtgtag

SEQ ID NO: 9512275 - DNA, 22 bp, Homo sapiens
cagggctgaactgagcttgtga

SEQ ID NO: 9512276 - DNA, 22 bp, Homo sapiens
cagggctgaactgagcttgtga

SEQ ID NO: 9512277 - DNA, 22 bp, Homo sapiens
cagggctgaactgagcttgtga

SEQ ID NO: 9512278 - DNA, 18 bp, Homo sapiens
taggctgggggctgtagt

SEQ ID NO: 9512279 - DNA, 22 bp, Homo sapiens
taggctgggggtaggaattgag

SEQ ID NO: 9512280 - DNA, 22 bp, Homo sapiens
taggctgtaagagagggcagag

SEQ ID NO: 9512281 - DNA, 22 bp, Homo sapiens
taggctgtaagagagggcagag

SEQ ID NO: 9512282 - DNA, 22 bp, Homo sapiens
taggctgggctgagctggacgg

SEQ ID NO: 9512283 - DNA, 22 bp, Homo sapiens
taggctgggctgagctggacgg

SEQ ID NO: 9512284 - DNA, 22 bp, Homo sapiens
taggctgggctgagctggacgg

SEQ ID NO: 9512285 - DNA, 22 bp, Homo sapiens
cagggctgaagaaattcaaaag

SEQ ID NO: 9512286 - DNA, 22 bp, Homo sapiens
cagggctgagaatttagagaca

SEQ ID NO: 9512287 - DNA, 22 bp, Homo sapiens
cagggctgaagaaattcaaaag

SEQ ID NO: 9512288 - DNA, 22 bp, Homo sapiens
taggctgggcctgccttccagg

SEQ ID NO: 9512289 - DNA, 22 bp, Homo sapiens
taggctgggcctgccttccagg

SEQ ID NO: 9512290 - DNA, 22 bp, Homo sapiens
cagggctgtaaattagtgctga

SEQ ID NO: 9512291 - DNA, 22 bp, Homo sapiens
cagggctgtaaattagtgctga

SEQ ID NO: 9512292 - DNA, 22 bp, Homo sapiens
cagggctgtctccaaaggcccc

SEQ ID NO: 9512293 - DNA, 22 bp, Homo sapiens
cagggctgtaaattagtgctga

SEQ ID NO: 9512294 - DNA, 22 bp, Homo sapiens
cagggctggtttgtcgaagaaa

SEQ ID NO: 9512295 - DNA, 23 bp, Homo sapiens
cagggctggtagggaagagcgtg

SEQ ID NO: 9512296 - DNA, 23 bp, Homo sapiens
cagggctggtagggaagagcgtg

SEQ ID NO: 9512297 - DNA, 22 bp, Homo sapiens
cagggctggatttcatttctag

SEQ ID NO: 9512298 - DNA, 22 bp, Homo sapiens
cagggctggatttcatttctag

SEQ ID NO: 9512299 - DNA, 22 bp, Homo sapiens
tagggaagagcattcaaccttt

SEQ ID NO: 9512300 - DNA, 22 bp, Homo sapiens
tagggaaatatagatttagggc

SEQ ID NO: 9512301 - DNA, 22 bp, Homo sapiens
tagggaaaagacttcactgttt

SEQ ID NO: 9512302 - DNA, 22 bp, Homo sapiens
tagggaaatatagatttagggc

SEQ ID NO: 9512303 - DNA, 23 bp, Homo sapiens
cagggctggtagggaagagcgtg

SEQ ID NO: 9512304 - DNA, 22 bp, Homo sapiens
cagggctgggttaaaagcaggg

SEQ ID NO: 9512305 - DNA, 22 bp, Homo sapiens
cagggctgggttaaaagcaggg

SEQ ID NO: 9512306 - DNA, 22 bp, Homo sapiens
taggctttgtgcaggatacagg

SEQ ID NO: 9512307 - DNA, 22 bp, Homo sapiens
taggcttcccgctcacatgccc

SEQ ID NO: 9512308 - DNA, 17 bp, Homo sapiens
taggctgtgcaatacca

SEQ ID NO: 9512309 - DNA, 23 bp, Homo sapiens
taggcttctgctgtccccgacgc

SEQ ID NO: 9512310 - DNA, 22 bp, Homo sapiens
taggcttccgagtcttggtatc

SEQ ID NO: 9512311 - DNA, 22 bp, Homo sapiens
caggtggggggcttccgagcct

SEQ ID NO: 9512312 - DNA, 22 bp, Homo sapiens
tattattaaatggcagaatttt

SEQ ID NO: 9512313 - DNA, 22 bp, Homo sapiens
tattatggcagcattcagtatg

SEQ ID NO: 9512314 - DNA, 22 bp, Homo sapiens
tattatggggggaacatcactc

SEQ ID NO: 9512315 - DNA, 22 bp, Homo sapiens
tattatggttgtaggttaacaa

SEQ ID NO: 9512316 - DNA, 18 bp, Homo sapiens
caggtgggtctcctgccc

SEQ ID NO: 9512317 - DNA, 18 bp, Homo sapiens
caggtgggtctcctgccc

SEQ ID NO: 9512318 - DNA, 18 bp, Homo sapiens
caggtgggtctcctgccc

SEQ ID NO: 9512319 - DNA, 18 bp, Homo sapiens
caggtgggtctcctgccc

SEQ ID NO: 9512320 - DNA, 22 bp, Homo sapiens
caggtgggtacatcacagagac

SEQ ID NO: 9512321 - DNA, 22 bp, Homo sapiens
caggtgggtacatcacagagac

SEQ ID NO: 9512322 - DNA, 22 bp, Homo sapiens
caggtgggtacatcacagagac

SEQ ID NO: 9512323 - DNA, 22 bp, Homo sapiens
tattatcagagctatttggaat

SEQ ID NO: 9512324 - DNA, 22 bp, Homo sapiens
tattataatttagggcttggat

SEQ ID NO: 9512325 - DNA, 22 bp, Homo sapiens
tattagtgaaagaattagtttg

SEQ ID NO: 9512326 - DNA, 22 bp, Homo sapiens
tattatcattaactgttgaatt

SEQ ID NO: 9512327 - DNA, 22 bp, Homo sapiens
tattatcattggtaatatggtc

SEQ ID NO: 9512328 - DNA, 22 bp, Homo sapiens
tattatgaggactggtgtaagg

SEQ ID NO: 9512329 - DNA, 22 bp, Homo sapiens
tattatgaggggcagagggcat

SEQ ID NO: 9512330 - DNA, 22 bp, Homo sapiens
tattatgaggcttagggatgac

SEQ ID NO: 9512331 - DNA, 22 bp, Homo sapiens
tattatgagccaggtgctgtct

SEQ ID NO: 9512332 - DNA, 20 bp, Homo sapiens
tattatgacctgtgttctgg

SEQ ID NO: 9512333 - DNA, 20 bp, Homo sapiens
tattatgacctgtgttctgg

SEQ ID NO: 9512334 - DNA, 22 bp, Homo sapiens
tattatgattcggacgtggcag

SEQ ID NO: 9512335 - DNA, 22 bp, Homo sapiens
tattatgaggtatttggacttt

SEQ ID NO: 9512336 - DNA, 22 bp, Homo sapiens
tattatgatcgtgactcaagga

SEQ ID NO: 9512337 - DNA, 22 bp, Homo sapiens
tattatgatcccagccctggag

SEQ ID NO: 9512338 - DNA, 22 bp, Homo sapiens
caggtggccttgccatctcctg

SEQ ID NO: 9512339 - DNA, 22 bp, Homo sapiens
caggtggccagtactcaaggat

SEQ ID NO: 9512340 - DNA, 22 bp, Homo sapiens
caggtggcatgactgcctacaa

SEQ ID NO: 9512341 - DNA, 22 bp, Homo sapiens
caggtggatctctaaggactga

SEQ ID NO: 9512342 - DNA, 22 bp, Homo sapiens
caggtggcaaatgagtagcatt

SEQ ID NO: 9512343 - DNA, 22 bp, Homo sapiens
caggtggcaaatgagtagcatt

SEQ ID NO: 9512344 - DNA, 22 bp, Homo sapiens
tattaaatgttatttgggttgt

SEQ ID NO: 9512345 - DNA, 22 bp, Homo sapiens
tattaaatgttatttgggttgt

SEQ ID NO: 9512346 - DNA, 22 bp, Homo sapiens
tattaaattatggatttaggag

SEQ ID NO: 9512347 - DNA, 22 bp, Homo sapiens
tattaaatatatctgttagttg

SEQ ID NO: 9512348 - DNA, 22 bp, Homo sapiens
tattaaatgttatttgggttgt

SEQ ID NO: 9512349 - DNA, 22 bp, Homo sapiens
tattagtaatacctgtctcata

SEQ ID NO: 9512350 - DNA, 19 bp, Homo sapiens
caggtggcgctctacaggg

SEQ ID NO: 9512351 - DNA, 23 bp, Homo sapiens
caggtggctccacgaggggtggg

SEQ ID NO: 9512352 - DNA, 23 bp, Homo sapiens
caggtggctccacgaggggtggg

SEQ ID NO: 9512353 - DNA, 22 bp, Homo sapiens
caggtccaccatgcctcaagcc

SEQ ID NO: 9512354 - DNA, 22 bp, Homo sapiens
caggtgaagaggataaaaagtt

SEQ ID NO: 9512355 - DNA, 22 bp, Homo sapiens
caggtgaagaggataaaaagtt

SEQ ID NO: 9512356 - DNA, 22 bp, Homo sapiens
caggtgaatcacttgagtccag

SEQ ID NO: 9512357 - DNA, 22 bp, Homo sapiens
caggtccaattgcgctaaaatc

SEQ ID NO: 9512358 - DNA, 22 bp, Homo sapiens
caggtccaattgcgctaaaatc

SEQ ID NO: 9512359 - DNA, 22 bp, Homo sapiens
caggtccaagagatcctcctac

SEQ ID NO: 9512360 - DNA, 22 bp, Homo sapiens
caggtccacagcccatcactgc

SEQ ID NO: 9512361 - DNA, 22 bp, Homo sapiens
caggtccaattgcgctaaaatc

SEQ ID NO: 9512362 - DNA, 22 bp, Homo sapiens
caggtccacagcccatcactgc

SEQ ID NO: 9512363 - DNA, 22 bp, Homo sapiens
caggtccacagcccatcactgc

SEQ ID NO: 9512364 - DNA, 22 bp, Homo sapiens
caggtcagcacttggaggtgca

SEQ ID NO: 9512365 - DNA, 22 bp, Homo sapiens
caggtcagcacttggaggtgca

SEQ ID NO: 9512366 - DNA, 22 bp, Homo sapiens
caggtcagcacttggaggtgca

SEQ ID NO: 9512367 - DNA, 18 bp, Homo sapiens
caggtcagcctggcctca

SEQ ID NO: 9512368 - DNA, 22 bp, Homo sapiens
caggtccaactatttatctgtg

SEQ ID NO: 9512369 - DNA, 22 bp, Homo sapiens
caggtccaagagatcctcctac

SEQ ID NO: 9512370 - DNA, 22 bp, Homo sapiens
caggtccaactatttatctgtg

SEQ ID NO: 9512371 - DNA, 22 bp, Homo sapiens
caggtcagctggtgccccaggt

SEQ ID NO: 9512372 - DNA, 22 bp, Homo sapiens
caggtgctgcagggctggcgtc

SEQ ID NO: 9512373 - DNA, 22 bp, Homo sapiens
caggtgctgcgtggcggagctg

SEQ ID NO: 9512374 - DNA, 22 bp, Homo sapiens
caggtgctgcagggctggcgtc

SEQ ID NO: 9512375 - DNA, 22 bp, Homo sapiens
caggtgctgcagggctggcgtc

SEQ ID NO: 9512376 - DNA, 22 bp, Homo sapiens
caggtgctgtcctgcacatgtc

SEQ ID NO: 9512377 - DNA, 22 bp, Homo sapiens
caggtgctgtcctgcacatgtc

SEQ ID NO: 9512378 - DNA, 22 bp, Homo sapiens
caggtgctgtgaatcttcataa

SEQ ID NO: 9512379 - DNA, 22 bp, Homo sapiens
caggtgccgggaatgcagcaat

SEQ ID NO: 9512380 - DNA, 22 bp, Homo sapiens
caggtgcccagctcctgctgtg

SEQ ID NO: 9512381 - DNA, 22 bp, Homo sapiens
caggtgcctcaggatgagacaa

SEQ ID NO: 9512382 - DNA, 22 bp, Homo sapiens
caggtgctcccagagaagtgct

SEQ ID NO: 9512383 - DNA, 22 bp, Homo sapiens
caggtgctcccagagaagtgct

SEQ ID NO: 9512384 - DNA, 22 bp, Homo sapiens
caggtgcctcaggatgagacaa

SEQ ID NO: 9512385 - DNA, 22 bp, Homo sapiens
caggtaggtatggtgcagtctt

SEQ ID NO: 9512386 - DNA, 22 bp, Homo sapiens
caggtaggtatggtgcagtctt

SEQ ID NO: 9512387 - DNA, 22 bp, Homo sapiens
caggtcaaaggttagttatgtt

SEQ ID NO: 9512388 - DNA, 22 bp, Homo sapiens
caggtcagaggcgcagccccca

SEQ ID NO: 9512389 - DNA, 22 bp, Homo sapiens
caggtcagaggtagatgagatg

SEQ ID NO: 9512390 - DNA, 22 bp, Homo sapiens
caggtcagaggtagatgagatg

SEQ ID NO: 9512391 - DNA, 22 bp, Homo sapiens
caggtcagaggtagatgagatg

SEQ ID NO: 9512392 - DNA, 22 bp, Homo sapiens
cagggtttcaccatgttagcag

SEQ ID NO: 9512393 - DNA, 22 bp, Homo sapiens
cagggtttctgttgagaagtcc

SEQ ID NO: 9512394 - DNA, 22 bp, Homo sapiens
cagggtttctgttgagaagtcc

SEQ ID NO: 9512395 - DNA, 22 bp, Homo sapiens
caggtaaaaataaatttgtgag

SEQ ID NO: 9512396 - DNA, 22 bp, Homo sapiens
caggtaaggtcacattctgaag

SEQ ID NO: 9512397 - DNA, 22 bp, Homo sapiens
caggtaggatggaagggctcaa

SEQ ID NO: 9512398 - DNA, 22 bp, Homo sapiens
caggtagctgcagagactattt

SEQ ID NO: 9512399 - DNA, 22 bp, Homo sapiens
caggtagctgctggccatgtac

SEQ ID NO: 9512400 - DNA, 22 bp, Homo sapiens
caggtagcttttgatattaggg

SEQ ID NO: 9512401 - DNA, 22 bp, Homo sapiens
caggtagaggctgccatcagct

SEQ ID NO: 9512402 - DNA, 17 bp, Homo sapiens
caggtacattgctactg

SEQ ID NO: 9512403 - DNA, 22 bp, Homo sapiens
cagtcagggacaccagctagga

SEQ ID NO: 9512404 - DNA, 22 bp, Homo sapiens
cagtcaggggtgggatcaaggc

SEQ ID NO: 9512405 - DNA, 22 bp, Homo sapiens
cagtcagggacaccagctagga

SEQ ID NO: 9512406 - DNA, 22 bp, Homo sapiens
cagtcaggctgcgcttctctga

SEQ ID NO: 9512407 - DNA, 22 bp, Homo sapiens
cagtcaggggtgggatcaaggc

SEQ ID NO: 9512408 - DNA, 22 bp, Homo sapiens
cagtcattggctaaagctccct

SEQ ID NO: 9512409 - DNA, 22 bp, Homo sapiens
cagtcattcctaaccaagaaca

SEQ ID NO: 9512410 - DNA, 22 bp, Homo sapiens
cagtccaacctgccccttgggc

SEQ ID NO: 9512411 - DNA, 22 bp, Homo sapiens
cagtcaggctgcgcttctctga

SEQ ID NO: 9512412 - DNA, 22 bp, Homo sapiens
cagtcaggctgcgcttctctga

SEQ ID NO: 9512413 - DNA, 22 bp, Homo sapiens
cagtcaggaatgcctccttcct

SEQ ID NO: 9512414 - DNA, 22 bp, Homo sapiens
cagtcaggaatgcctccttcct

SEQ ID NO: 9512415 - DNA, 22 bp, Homo sapiens
cagtcaggaatgcctccttcct

SEQ ID NO: 9512416 - DNA, 22 bp, Homo sapiens
cagtcacttacaaaaatataat

SEQ ID NO: 9512417 - DNA, 22 bp, Homo sapiens
cagtcactggaatagctgagga

SEQ ID NO: 9512418 - DNA, 22 bp, Homo sapiens
cagtcactccagcctgcctcag

SEQ ID NO: 9512419 - DNA, 22 bp, Homo sapiens
cagtcactggaatagctgagga

SEQ ID NO: 9512420 - DNA, 22 bp, Homo sapiens
cagtcactggttctataggccc

SEQ ID NO: 9512421 - DNA, 22 bp, Homo sapiens
tattttaaagtgaagggtcttg

SEQ ID NO: 9512422 - DNA, 22 bp, Homo sapiens
tattttaaagtgaagggtcttg

SEQ ID NO: 9512423 - DNA, 22 bp, Homo sapiens
tattttaaagtgaagggtcttg

SEQ ID NO: 9512424 - DNA, 20 bp, Homo sapiens
cagtccaatcagaggccacc

SEQ ID NO: 9512425 - DNA, 20 bp, Homo sapiens
tatttgaaatggccaagtgt

SEQ ID NO: 9512426 - DNA, 22 bp, Homo sapiens
tattttaaagactgccagccta

SEQ ID NO: 9512427 - DNA, 22 bp, Homo sapiens
tattttaaagactgccagccta

SEQ ID NO: 9512428 - DNA, 22 bp, Homo sapiens
cagtcacaggtggagaaccgag

SEQ ID NO: 9512429 - DNA, 22 bp, Homo sapiens
cagtcacagtgacaggatgtgg

SEQ ID NO: 9512430 - DNA, 22 bp, Homo sapiens
cagtcacataggtatacacata

SEQ ID NO: 9512431 - DNA, 22 bp, Homo sapiens
cagtcaaacttataggcacatt

SEQ ID NO: 9512432 - DNA, 17 bp, Homo sapiens
cagtcacaggtcttttc

SEQ ID NO: 9512433 - DNA, 22 bp, Homo sapiens
cagtcacaagcgtacctaattt

SEQ ID NO: 9512434 - DNA, 22 bp, Homo sapiens
cagtcacaagcgtacctaattt

SEQ ID NO: 9512435 - DNA, 22 bp, Homo sapiens
cagtcacacaagtggacttggg

SEQ ID NO: 9512436 - DNA, 22 bp, Homo sapiens
cagtcacctagacagaacttac

SEQ ID NO: 9512437 - DNA, 22 bp, Homo sapiens
cagtcaccttgaggactcagac

SEQ ID NO: 9512438 - DNA, 22 bp, Homo sapiens
cagtcactggaatagctgagga

SEQ ID NO: 9512439 - DNA, 22 bp, Homo sapiens
cagtcaccaccaggtggcagta

SEQ ID NO: 9512440 - DNA, 22 bp, Homo sapiens
cagtcacatttcgacataacta

SEQ ID NO: 9512441 - DNA, 22 bp, Homo sapiens
cagtcacatttcgacataacta

SEQ ID NO: 9512442 - DNA, 22 bp, Homo sapiens
cagtcacattgccctgcattta

SEQ ID NO: 9512443 - DNA, 21 bp, Homo sapiens
cagtattttaagcagtgagtt

SEQ ID NO: 9512444 - DNA, 21 bp, Homo sapiens
cagtattttaagcagtgagtt

SEQ ID NO: 9512445 - DNA, 19 bp, Homo sapiens
cagtatcattgcacatagt

SEQ ID NO: 9512446 - DNA, 22 bp, Homo sapiens
cagtatctccacatgtaaagtg

SEQ ID NO: 9512447 - DNA, 22 bp, Homo sapiens
cagtatattttagagaagtccc

SEQ ID NO: 9512448 - DNA, 22 bp, Homo sapiens
cagtatattctgcagagcctta

SEQ ID NO: 9512449 - DNA, 21 bp, Homo sapiens
cagtattttaagcagtgagtt

SEQ ID NO: 9512450 - DNA, 22 bp, Homo sapiens
cagtattttcaggatttggaag

SEQ ID NO: 9512451 - DNA, 22 bp, Homo sapiens
cagtattttcaggatttggaag

SEQ ID NO: 9512452 - DNA, 22 bp, Homo sapiens
cagtatatgctctttcatcaaa

SEQ ID NO: 9512453 - DNA, 22 bp, Homo sapiens
caggtggtacttaaagtcagaa

SEQ ID NO: 9512454 - DNA, 22 bp, Homo sapiens
caggtgggtgtatgaatgcaaa

SEQ ID NO: 9512455 - DNA, 22 bp, Homo sapiens
tattttaggtaatatccattgt

SEQ ID NO: 9512456 - DNA, 22 bp, Homo sapiens
tcaaaaatgttttatattggta

SEQ ID NO: 9512457 - DNA, 22 bp, Homo sapiens
tcaaaaatgttttatattggta

SEQ ID NO: 9512458 - DNA, 22 bp, Homo sapiens
tcaaaaatgttttatattggta

SEQ ID NO: 9512459 - DNA, 22 bp, Homo sapiens
tcaaaaatgttttatattggta

SEQ ID NO: 9512460 - DNA, 22 bp, Homo sapiens
tattttatctgccagagtggag

SEQ ID NO: 9512461 - DNA, 22 bp, Homo sapiens
tattttatctgccagagtggag

SEQ ID NO: 9512462 - DNA, 22 bp, Homo sapiens
tattttatctgccagagtggag

SEQ ID NO: 9512463 - DNA, 22 bp, Homo sapiens
tcaaaaattttctgaggatgag

SEQ ID NO: 9512464 - DNA, 22 bp, Homo sapiens
tcaaaacaacactcaggtgtaa

SEQ ID NO: 9512465 - DNA, 22 bp, Homo sapiens
tcaaaacaacactcaggtgtaa

SEQ ID NO: 9512466 - DNA, 22 bp, Homo sapiens
tcaaaacaacactcaggtgtaa

SEQ ID NO: 9512467 - DNA, 22 bp, Homo sapiens
tcaaaacaatcattggatgtgc

SEQ ID NO: 9512468 - DNA, 22 bp, Homo sapiens
tcaaaacaacactcaggtgtaa

SEQ ID NO: 9512469 - DNA, 22 bp, Homo sapiens
tcaaaacaatcattggatgtgc

SEQ ID NO: 9512470 - DNA, 22 bp, Homo sapiens
tcaaaacaatcattggatgtgc

SEQ ID NO: 9512471 - DNA, 22 bp, Homo sapiens
tcaaaacactattacctttaat

SEQ ID NO: 9512472 - DNA, 19 bp, Homo sapiens
tcaaaacacaaatggttga

SEQ ID NO: 9512473 - DNA, 19 bp, Homo sapiens
tcaaaacacaaatggttga

SEQ ID NO: 9512474 - DNA, 19 bp, Homo sapiens
tcaaaacacaaatggttga

SEQ ID NO: 9512475 - DNA, 19 bp, Homo sapiens
tcaaaacacaaatggttga

SEQ ID NO: 9512476 - DNA, 19 bp, Homo sapiens
tcaaaacacaaatggttga

SEQ ID NO: 9512477 - DNA, 19 bp, Homo sapiens
tcaaaacacaaatggttga

SEQ ID NO: 9512478 - DNA, 22 bp, Homo sapiens
tcaagccactggcagaagatta

SEQ ID NO: 9512479 - DNA, 22 bp, Homo sapiens
tcaatagagccttctttcaggt

SEQ ID NO: 9512480 - DNA, 22 bp, Homo sapiens
tcaatagataaagctacataaa

SEQ ID NO: 9512481 - DNA, 22 bp, Homo sapiens
tcaatagataaagctacataaa

SEQ ID NO: 9512482 - DNA, 22 bp, Homo sapiens
tcaatagaaatgcagagtctca

SEQ ID NO: 9512483 - DNA, 22 bp, Homo sapiens
tcaatagagccttctttcaggt

SEQ ID NO: 9512484 - DNA, 23 bp, Homo sapiens
tcaagcaattctcctgcctcggc

SEQ ID NO: 9512485 - DNA, 22 bp, Homo sapiens
tcaagcagagtcaaaagtacca

SEQ ID NO: 9512486 - DNA, 22 bp, Homo sapiens
tcaagcaatctctgtgtccctg

SEQ ID NO: 9512487 - DNA, 22 bp, Homo sapiens
tcaagcaattctcctgcctcag

SEQ ID NO: 9512488 - DNA, 23 bp, Homo sapiens
tcaagcaataattggtaatagtg

SEQ ID NO: 9512489 - DNA, 22 bp, Homo sapiens
tcaagcagcttttacagaagag

SEQ ID NO: 9512490 - DNA, 22 bp, Homo sapiens
tcaagcagcttttacagaagag

SEQ ID NO: 9512491 - DNA, 22 bp, Homo sapiens
tcaagcagggtagcaagctggt

SEQ ID NO: 9512492 - DNA, 19 bp, Homo sapiens
tcaagcagtctgatttagg

SEQ ID NO: 9512493 - DNA, 22 bp, Homo sapiens
tcaagcaagtgtttggtgtaaa

SEQ ID NO: 9512494 - DNA, 22 bp, Homo sapiens
tcaagcaagttgcatattgcta

SEQ ID NO: 9512495 - DNA, 22 bp, Homo sapiens
tcaagcaacagaactgtgagac

SEQ ID NO: 9512496 - DNA, 22 bp, Homo sapiens
tcaagcaactgaattctaaaag

SEQ ID NO: 9512497 - DNA, 22 bp, Homo sapiens
tcaagcaaactctgagaaataa

SEQ ID NO: 9512498 - DNA, 22 bp, Homo sapiens
tcaagcaaatgtccttttgttc

SEQ ID NO: 9512499 - DNA, 22 bp, Homo sapiens
tcaagcaaagatacaaatggaa

SEQ ID NO: 9512500 - DNA, 22 bp, Homo sapiens
tcaagcaaagatacaaatggaa

SEQ ID NO: 9512501 - DNA, 22 bp, Homo sapiens
tcaagcaaagtttagctggtta

SEQ ID NO: 9512502 - DNA, 22 bp, Homo sapiens
tcaaaacactattacctttaat

SEQ ID NO: 9512503 - DNA, 22 bp, Homo sapiens
tcaaaacactattacctttaat

SEQ ID NO: 9512504 - DNA, 22 bp, Homo sapiens
tcaacaaatacttaaagcagag

SEQ ID NO: 9512505 - DNA, 22 bp, Homo sapiens
tcaaaacactattacctttaat

SEQ ID NO: 9512506 - DNA, 22 bp, Homo sapiens
tcaacaaatacttaaagcagag

SEQ ID NO: 9512507 - DNA, 22 bp, Homo sapiens
tactttaaaaactgataattca

SEQ ID NO: 9512508 - DNA, 22 bp, Homo sapiens
tactttaaaaactgataattca

SEQ ID NO: 9512509 - DNA, 22 bp, Homo sapiens
tactttaaaaactgataattca

SEQ ID NO: 9512510 - DNA, 22 bp, Homo sapiens
tacttgttatcatcttttcctt

SEQ ID NO: 9512511 - DNA, 22 bp, Homo sapiens
tacttgttaggaatttctacta

SEQ ID NO: 9512512 - DNA, 22 bp, Homo sapiens
tacttgttatcccttactcttg

SEQ ID NO: 9512513 - DNA, 22 bp, Homo sapiens
tacttgttatcatcttttcctt

SEQ ID NO: 9512514 - DNA, 22 bp, Homo sapiens
caggctacatttgctctgagaa

SEQ ID NO: 9512515 - DNA, 22 bp, Homo sapiens
caggctactggggcttggatgg

SEQ ID NO: 9512516 - DNA, 22 bp, Homo sapiens
caggctcaaggctgacttccat

SEQ ID NO: 9512517 - DNA, 22 bp, Homo sapiens
caggctcaagccctgcttatat

SEQ ID NO: 9512518 - DNA, 22 bp, Homo sapiens
caggctcaagccctgcttatat

SEQ ID NO: 9512519 - DNA, 22 bp, Homo sapiens
caggctagcagggcccagggca

SEQ ID NO: 9512520 - DNA, 22 bp, Homo sapiens
tactttaatatatgtgaagttc

SEQ ID NO: 9512521 - DNA, 22 bp, Homo sapiens
tactttaaaaactgataattca

SEQ ID NO: 9512522 - DNA, 22 bp, Homo sapiens
tactttacagtattagataatt

SEQ ID NO: 9512523 - DNA, 22 bp, Homo sapiens
tactttatcagcgtcaaaggta

SEQ ID NO: 9512524 - DNA, 22 bp, Homo sapiens
tacatttataaggcttctctgt

SEQ ID NO: 9512525 - DNA, 22 bp, Homo sapiens
tacatttcagagctcctctctg

SEQ ID NO: 9512526 - DNA, 22 bp, Homo sapiens
tacatttataaggcttctctgt

SEQ ID NO: 9512527 - DNA, 22 bp, Homo sapiens
tacatttataaggcttctctgt

SEQ ID NO: 9512528 - DNA, 22 bp, Homo sapiens
tacatttataaggcttctctgt

SEQ ID NO: 9512529 - DNA, 22 bp, Homo sapiens
tacatttacagagccttctctg

SEQ ID NO: 9512530 - DNA, 22 bp, Homo sapiens
tacatttacagagccttctctg

SEQ ID NO: 9512531 - DNA, 22 bp, Homo sapiens
tacattgttttttcttgccatc

SEQ ID NO: 9512532 - DNA, 22 bp, Homo sapiens
tacattgttttttcttgccatc

SEQ ID NO: 9512533 - DNA, 22 bp, Homo sapiens
tacattgtgatgtttcaataca

SEQ ID NO: 9512534 - DNA, 22 bp, Homo sapiens
tacattgttcatgcatgagaaa

SEQ ID NO: 9512535 - DNA, 22 bp, Homo sapiens
tacattgttcatgcatgagaaa

SEQ ID NO: 9512536 - DNA, 22 bp, Homo sapiens
tacattgtgttaaaacagaaga

SEQ ID NO: 9512537 - DNA, 23 bp, Homo sapiens
tacattgtggatggagtcctggg

SEQ ID NO: 9512538 - DNA, 22 bp, Homo sapiens
caggcgagtgaacagactctca

SEQ ID NO: 9512539 - DNA, 22 bp, Homo sapiens
caggccttttttcctgcagtgt

SEQ ID NO: 9512540 - DNA, 22 bp, Homo sapiens
caggccttttttcctgcagtgt

SEQ ID NO: 9512541 - DNA, 22 bp, Homo sapiens
caggctaaagctttgagcatgt

SEQ ID NO: 9512542 - DNA, 18 bp, Homo sapiens
caggcctttgagacagaa

SEQ ID NO: 9512543 - DNA, 22 bp, Homo sapiens
caggcctttctggggaagtgag

SEQ ID NO: 9512544 - DNA, 22 bp, Homo sapiens
caggcctttctggggaagtgag

SEQ ID NO: 9512545 - DNA, 22 bp, Homo sapiens
caggcctttcttggggcttaga

SEQ ID NO: 9512546 - DNA, 22 bp, Homo sapiens
tacatttcctgtcagagatata

SEQ ID NO: 9512547 - DNA, 22 bp, Homo sapiens
tacatttcctgtcagagatata

SEQ ID NO: 9512548 - DNA, 22 bp, Homo sapiens
tacatttcctgtcagagatata

SEQ ID NO: 9512549 - DNA, 19 bp, Homo sapiens
caggcctctggtctgctgt

SEQ ID NO: 9512550 - DNA, 20 bp, Homo sapiens
caggcctctgggggccctgg

SEQ ID NO: 9512551 - DNA, 19 bp, Homo sapiens
caggcctctggtctgctgt

SEQ ID NO: 9512552 - DNA, 22 bp, Homo sapiens
caggcctctccttagtctggca

SEQ ID NO: 9512553 - DNA, 20 bp, Homo sapiens
caggcctctgggggccctgg

SEQ ID NO: 9512554 - DNA, 20 bp, Homo sapiens
caggcctctgggggccctgg

SEQ ID NO: 9512555 - DNA, 22 bp, Homo sapiens
caggcctctccttagtctggca

SEQ ID NO: 9512556 - DNA, 22 bp, Homo sapiens
caggcctctatggtcagctgag

SEQ ID NO: 9512557 - DNA, 22 bp, Homo sapiens
caggcctctatggtcagctgag

SEQ ID NO: 9512558 - DNA, 22 bp, Homo sapiens
caggcctcgaggagacagctac

SEQ ID NO: 9512559 - DNA, 22 bp, Homo sapiens
caggcctcgaggagacagctac

SEQ ID NO: 9512560 - DNA, 22 bp, Homo sapiens
caggcctctatggtcagctgag

SEQ ID NO: 9512561 - DNA, 22 bp, Homo sapiens
caggcctctatggtcagctgag

SEQ ID NO: 9512562 - DNA, 22 bp, Homo sapiens
caggccggggcggcgccatctt

SEQ ID NO: 9512563 - DNA, 22 bp, Homo sapiens
caggccgggcactgcgctaggt

SEQ ID NO: 9512564 - DNA, 22 bp, Homo sapiens
caggcctcgaggagacagctac

SEQ ID NO: 9512565 - DNA, 22 bp, Homo sapiens
caggcctcctatgagcactagc

SEQ ID NO: 9512566 - DNA, 22 bp, Homo sapiens
caggcctcctatgagcactagc

SEQ ID NO: 9512567 - DNA, 22 bp, Homo sapiens
caggcccagcccagcccttcga

SEQ ID NO: 9512568 - DNA, 22 bp, Homo sapiens
caggcccagcccttagccaggt

SEQ ID NO: 9512569 - DNA, 22 bp, Homo sapiens
tacattgattcaggatataggc

SEQ ID NO: 9512570 - DNA, 22 bp, Homo sapiens
tacattgctttctaatacatct

SEQ ID NO: 9512571 - DNA, 22 bp, Homo sapiens
caggcctgcaggaaaggctccc

SEQ ID NO: 9512572 - DNA, 22 bp, Homo sapiens
tacatgttcaaatttgtctttc

SEQ ID NO: 9512573 - DNA, 22 bp, Homo sapiens
caggcctgatacactgaactct

SEQ ID NO: 9512574 - DNA, 22 bp, Homo sapiens
caggcctgagacatctgagata

SEQ ID NO: 9512575 - DNA, 22 bp, Homo sapiens
caggcctgagacatctgagata

SEQ ID NO: 9512576 - DNA, 22 bp, Homo sapiens
caggcctgagacatctgagata

SEQ ID NO: 9512577 - DNA, 22 bp, Homo sapiens
caggcctgaccctgagcttcac

SEQ ID NO: 9512578 - DNA, 22 bp, Homo sapiens
caggcctcttccatgcagcagc

SEQ ID NO: 9512579 - DNA, 18 bp, Homo sapiens
caggcctcttgatcttcc

SEQ ID NO: 9512580 - DNA, 18 bp, Homo sapiens
caggcctcttgatcttcc

SEQ ID NO: 9512581 - DNA, 22 bp, Homo sapiens
caggcctgaccctgagcttcac

SEQ ID NO: 9512582 - DNA, 19 bp, Homo sapiens
caggcctcttaccctctct

SEQ ID NO: 9512583 - DNA, 19 bp, Homo sapiens
caggcctcttaccctctct

SEQ ID NO: 9512584 - DNA, 22 bp, Homo sapiens
tagattcagatatttaggacaa

SEQ ID NO: 9512585 - DNA, 22 bp, Homo sapiens
tagatacaggcaagattatgaa

SEQ ID NO: 9512586 - DNA, 22 bp, Homo sapiens
tagatacacacacagtcatgtg

SEQ ID NO: 9512587 - DNA, 22 bp, Homo sapiens
tagatacaggctctctgagcct

SEQ ID NO: 9512588 - DNA, 22 bp, Homo sapiens
tagattctgtgagagtcaaagt

SEQ ID NO: 9512589 - DNA, 22 bp, Homo sapiens
tagattctgtaaataatcaagg

SEQ ID NO: 9512590 - DNA, 22 bp, Homo sapiens
tagattctcccatcatgagatg

SEQ ID NO: 9512591 - DNA, 22 bp, Homo sapiens
cagggacagacagatatatttg

SEQ ID NO: 9512592 - DNA, 22 bp, Homo sapiens
cagggacagagactgcaccttg

SEQ ID NO: 9512593 - DNA, 22 bp, Homo sapiens
cagggacagagactgcaccttg

SEQ ID NO: 9512594 - DNA, 22 bp, Homo sapiens
cagggacagcactaaactcttg

SEQ ID NO: 9512595 - DNA, 22 bp, Homo sapiens
cagggacagcactaaactcttg

SEQ ID NO: 9512596 - DNA, 20 bp, Homo sapiens
cagggacagcagtgggtttt

SEQ ID NO: 9512597 - DNA, 22 bp, Homo sapiens
cagggacaaggaataagattag

SEQ ID NO: 9512598 - DNA, 22 bp, Homo sapiens
cagggacaatggcagagcctga

SEQ ID NO: 9512599 - DNA, 22 bp, Homo sapiens
cagggacaatggcagagcctga

SEQ ID NO: 9512600 - DNA, 22 bp, Homo sapiens
cagggacaatggcagagcctga

SEQ ID NO: 9512601 - DNA, 22 bp, Homo sapiens
cagggacaatggcagagcctga

SEQ ID NO: 9512602 - DNA, 22 bp, Homo sapiens
cagggaatccatggtcataagg

SEQ ID NO: 9512603 - DNA, 22 bp, Homo sapiens
cagggaaggctgcaaatgttaa

SEQ ID NO: 9512604 - DNA, 22 bp, Homo sapiens
cagggacaaagtgagaaaggaa

SEQ ID NO: 9512605 - DNA, 22 bp, Homo sapiens
cagggaagagccgatgctgcag

SEQ ID NO: 9512606 - DNA, 22 bp, Homo sapiens
cagggaaggctgcaaatgttaa

SEQ ID NO: 9512607 - DNA, 22 bp, Homo sapiens
cagggaagagccgatgctgcag

SEQ ID NO: 9512608 - DNA, 22 bp, Homo sapiens
cagggaagagccgatgctgcag

SEQ ID NO: 9512609 - DNA, 22 bp, Homo sapiens
cagggaagaatagttagcaaag

SEQ ID NO: 9512610 - DNA, 22 bp, Homo sapiens
cagggaagaatagttagcaaag

SEQ ID NO: 9512611 - DNA, 22 bp, Homo sapiens
cagggaaagttcttgtccactc

SEQ ID NO: 9512612 - DNA, 22 bp, Homo sapiens
cagggaaagttcttgtccactc

SEQ ID NO: 9512613 - DNA, 22 bp, Homo sapiens
cagggaaagtcccaccccacac

SEQ ID NO: 9512614 - DNA, 22 bp, Homo sapiens
caggctttactttctctctgaa

SEQ ID NO: 9512615 - DNA, 22 bp, Homo sapiens
caggcttgtgtctcagctgcag

SEQ ID NO: 9512616 - DNA, 22 bp, Homo sapiens
caggcttgggttctctgagtta

SEQ ID NO: 9512617 - DNA, 22 bp, Homo sapiens
caggcttgggagcagagccact

SEQ ID NO: 9512618 - DNA, 22 bp, Homo sapiens
caggcttggcagggaggctggt

SEQ ID NO: 9512619 - DNA, 22 bp, Homo sapiens
tagaaacaagggagaggattct

SEQ ID NO: 9512620 - DNA, 22 bp, Homo sapiens
caggctgtccaggctcctttgg

SEQ ID NO: 9512621 - DNA, 22 bp, Homo sapiens
tagaaacaagggagaggattct

SEQ ID NO: 9512622 - DNA, 22 bp, Homo sapiens
caggctgtctgaatggaggccc

SEQ ID NO: 9512623 - DNA, 22 bp, Homo sapiens
caggcttggagggcagtggcat

SEQ ID NO: 9512624 - DNA, 22 bp, Homo sapiens
caggctgtctgaatggaggccc

SEQ ID NO: 9512625 - DNA, 22 bp, Homo sapiens
caggcttgctgctagagcactt

SEQ ID NO: 9512626 - DNA, 22 bp, Homo sapiens
caggcttggcagggaggctggt

SEQ ID NO: 9512627 - DNA, 22 bp, Homo sapiens
caggctgggaacgccacccgct

SEQ ID NO: 9512628 - DNA, 22 bp, Homo sapiens
caggctggcaatgcgtcaagca

SEQ ID NO: 9512629 - DNA, 22 bp, Homo sapiens
caggctggcaatgcgtcaagca

SEQ ID NO: 9512630 - DNA, 22 bp, Homo sapiens
tagaaaagtatgggactgacat

SEQ ID NO: 9512631 - DNA, 22 bp, Homo sapiens
caggctgggactgacccctgct

SEQ ID NO: 9512632 - DNA, 22 bp, Homo sapiens
caggctgggactgacccctgct

SEQ ID NO: 9512633 - DNA, 22 bp, Homo sapiens
tagaaacaaaatctgatgactc

SEQ ID NO: 9512634 - DNA, 22 bp, Homo sapiens
tagaaacaaagacctgggtgct

SEQ ID NO: 9512635 - DNA, 22 bp, Homo sapiens
tagaaacaaagacctgggtgct

SEQ ID NO: 9512636 - DNA, 22 bp, Homo sapiens
tagaaacaaagacctgggtgct

SEQ ID NO: 9512637 - DNA, 22 bp, Homo sapiens
tagaaacaaaatctgatgactc

SEQ ID NO: 9512638 - DNA, 22 bp, Homo sapiens
tagaaaatgttccactgccatt

SEQ ID NO: 9512639 - DNA, 22 bp, Homo sapiens
tagaaaatgttccactgccatt

SEQ ID NO: 9512640 - DNA, 22 bp, Homo sapiens
tagaaaatgttccactgccatt

SEQ ID NO: 9512641 - DNA, 22 bp, Homo sapiens
tagaaaatgttccactgccatt

SEQ ID NO: 9512642 - DNA, 22 bp, Homo sapiens
tagaaaatgttccactgccatt

SEQ ID NO: 9512643 - DNA, 22 bp, Homo sapiens
tagaaaatagggcctgtggagc

SEQ ID NO: 9512644 - DNA, 22 bp, Homo sapiens
tagaaaatccagtgtggggaga

SEQ ID NO: 9512645 - DNA, 22 bp, Homo sapiens
tagaaaatggccaagcaggact

SEQ ID NO: 9512646 - DNA, 22 bp, Homo sapiens
tagaaaatggccaagcaggact

SEQ ID NO: 9512647 - DNA, 22 bp, Homo sapiens
tagaaaatggccaagcaggact

SEQ ID NO: 9512648 - DNA, 22 bp, Homo sapiens
tagaaaatggccaagcaggact

SEQ ID NO: 9512649 - DNA, 22 bp, Homo sapiens
caggctgccgtgaagcaggcct

SEQ ID NO: 9512650 - DNA, 22 bp, Homo sapiens
caggctgccgaggctgcagaat

SEQ ID NO: 9512651 - DNA, 22 bp, Homo sapiens
caggctgccgaggctgcagaat

SEQ ID NO: 9512652 - DNA, 22 bp, Homo sapiens
caggctgccgaggctgcagaat

SEQ ID NO: 9512653 - DNA, 22 bp, Homo sapiens
caggctgcccggcaagttgcgc

SEQ ID NO: 9512654 - DNA, 22 bp, Homo sapiens
caggctgcagtgcagtggctat

SEQ ID NO: 9512655 - DNA, 22 bp, Homo sapiens
caggctgccaaggctggggagg

SEQ ID NO: 9512656 - DNA, 22 bp, Homo sapiens
caggctgccaaggctggggagg

SEQ ID NO: 9512657 - DNA, 22 bp, Homo sapiens
caggctggagttcagtggtgtg

SEQ ID NO: 9512658 - DNA, 22 bp, Homo sapiens
caggctggagttcagtggtgtg

SEQ ID NO: 9512659 - DNA, 22 bp, Homo sapiens
caggctggagttcagtggtgtg

SEQ ID NO: 9512660 - DNA, 22 bp, Homo sapiens
caggctggagttcagtggtgtg

SEQ ID NO: 9512661 - DNA, 22 bp, Homo sapiens
caggctggagtgcagtggtgcc

SEQ ID NO: 9512662 - DNA, 22 bp, Homo sapiens
caggctggagtgcagtggtgcc

SEQ ID NO: 9512663 - DNA, 22 bp, Homo sapiens
caggctgccgtgaagcaggcct

SEQ ID NO: 9512664 - DNA, 22 bp, Homo sapiens
caggcaccccaggtgagcactg

SEQ ID NO: 9512665 - DNA, 22 bp, Homo sapiens
caggcaccccaggtgagcactg

SEQ ID NO: 9512666 - DNA, 22 bp, Homo sapiens
caggcacccagcccagtcgcac

SEQ ID NO: 9512667 - DNA, 22 bp, Homo sapiens
caggcacccagcccagtcgcac

SEQ ID NO: 9512668 - DNA, 22 bp, Homo sapiens
caggcaccacactaggggctga

SEQ ID NO: 9512669 - DNA, 22 bp, Homo sapiens
caggcacctttgtgcatgggca

SEQ ID NO: 9512670 - DNA, 22 bp, Homo sapiens
caggcacctgtgtgtctcaggg

SEQ ID NO: 9512671 - DNA, 22 bp, Homo sapiens
caggcaccctctgaggggaagc

SEQ ID NO: 9512672 - DNA, 22 bp, Homo sapiens
caggcacctcacgtgggtccca

SEQ ID NO: 9512673 - DNA, 22 bp, Homo sapiens
caggcagagttagagcaactgg

SEQ ID NO: 9512674 - DNA, 22 bp, Homo sapiens
caggcagagttagagcaactgg

SEQ ID NO: 9512675 - DNA, 22 bp, Homo sapiens
caggcagagttagagcaactgg

SEQ ID NO: 9512676 - DNA, 22 bp, Homo sapiens
caggcagagccaatcgtggggt

SEQ ID NO: 9512677 - DNA, 22 bp, Homo sapiens
caggcagagccaatcgtggggt

SEQ ID NO: 9512678 - DNA, 22 bp, Homo sapiens
caggcagagctgaagatagatg

SEQ ID NO: 9512679 - DNA, 22 bp, Homo sapiens
caggcagatgctgacaagagtt

SEQ ID NO: 9512680 - DNA, 22 bp, Homo sapiens
caggcagatgctgacaagagtt

SEQ ID NO: 9512681 - DNA, 22 bp, Homo sapiens
caggcagatgctgacaagagtt

SEQ ID NO: 9512682 - DNA, 22 bp, Homo sapiens
caggcagagttagtgatttagg

SEQ ID NO: 9512683 - DNA, 22 bp, Homo sapiens
caggcagatatgttcgctttaa

SEQ ID NO: 9512684 - DNA, 22 bp, Homo sapiens
caggcagatatgttcgctttaa

SEQ ID NO: 9512685 - DNA, 22 bp, Homo sapiens
taataattttaaagaaggctag

SEQ ID NO: 9512686 - DNA, 22 bp, Homo sapiens
taatacaaggcaggaagcagta

SEQ ID NO: 9512687 - DNA, 22 bp, Homo sapiens
taatacaatggagttgggcccc

SEQ ID NO: 9512688 - DNA, 22 bp, Homo sapiens
taatacactgctttttgtaact

SEQ ID NO: 9512689 - DNA, 22 bp, Homo sapiens
taataattggcaatgttgagca

SEQ ID NO: 9512690 - DNA, 22 bp, Homo sapiens
taataattggcaatgttgagca

SEQ ID NO: 9512691 - DNA, 21 bp, Homo sapiens
taataattccactacagagta

SEQ ID NO: 9512692 - DNA, 22 bp, Homo sapiens
taataattggcaatgttgagca

SEQ ID NO: 9512693 - DNA, 22 bp, Homo sapiens
taataattggctaaccctggga

SEQ ID NO: 9512694 - DNA, 22 bp, Homo sapiens
taataattttaaagaaggctag

SEQ ID NO: 9512695 - DNA, 22 bp, Homo sapiens
taataattggctaaccctggga

SEQ ID NO: 9512696 - DNA, 22 bp, Homo sapiens
caggcagatttgctgccctcca

SEQ ID NO: 9512697 - DNA, 22 bp, Homo sapiens
caggcagatgctgacaagagtt

SEQ ID NO: 9512698 - DNA, 22 bp, Homo sapiens
caggcagatttgctgccctcca

SEQ ID NO: 9512699 - DNA, 22 bp, Homo sapiens
caggcagatttgctgccctcca

SEQ ID NO: 9512700 - DNA, 21 bp, Homo sapiens
taataattccactacagagta

SEQ ID NO: 9512701 - DNA, 21 bp, Homo sapiens
taataattccactacagagta

SEQ ID NO: 9512702 - DNA, 22 bp, Homo sapiens
taataattagttattgatcgtg

SEQ ID NO: 9512703 - DNA, 21 bp, Homo sapiens
taataattccactacagagta

SEQ ID NO: 9512704 - DNA, 21 bp, Homo sapiens
taataattccactacagagta

SEQ ID NO: 9512705 - DNA, 22 bp, Homo sapiens
taataattaacagtgatgggtc

SEQ ID NO: 9512706 - DNA, 22 bp, Homo sapiens
taataattagttattgatcgtg

SEQ ID NO: 9512707 - DNA, 22 bp, Homo sapiens
taataattagttattgatcgtg

SEQ ID NO: 9512708 - DNA, 22 bp, Homo sapiens
caggcagcagaggagtgtggga

SEQ ID NO: 9512709 - DNA, 22 bp, Homo sapiens
caggcagcagaggagtgtggga

SEQ ID NO: 9512710 - DNA, 22 bp, Homo sapiens
gtgcttcactgacctgttttca

SEQ ID NO: 9512711 - DNA, 22 bp, Homo sapiens
gtgcttcactgacctgttttca

SEQ ID NO: 9512712 - DNA, 22 bp, Homo sapiens
gtgcttatccccattctggagg

SEQ ID NO: 9512713 - DNA, 22 bp, Homo sapiens
gtgcttatgtgggagggagagg

SEQ ID NO: 9512714 - DNA, 20 bp, Homo sapiens
gtgcttcagaagccattgct

SEQ ID NO: 9512715 - DNA, 20 bp, Homo sapiens
gtgcttcagaagccattgct

SEQ ID NO: 9512716 - DNA, 20 bp, Homo sapiens
gtgcttcagaagccattgct

SEQ ID NO: 9512717 - DNA, 22 bp, Homo sapiens
gtgcttaaaacagaaaacattg

SEQ ID NO: 9512718 - DNA, 22 bp, Homo sapiens
gtgcttaacctagtttctagta

SEQ ID NO: 9512719 - DNA, 22 bp, Homo sapiens
gtgcttaaggcagtctgtcaaa

SEQ ID NO: 9512720 - DNA, 22 bp, Homo sapiens
gtgcttaaggcagtctgtcaaa

SEQ ID NO: 9512721 - DNA, 22 bp, Homo sapiens
gtgcttaatacatgtcaataac

SEQ ID NO: 9512722 - DNA, 22 bp, Homo sapiens
gtgcttatccccattctggagg

SEQ ID NO: 9512723 - DNA, 22 bp, Homo sapiens
gtgcttctccgttctgcagcac

SEQ ID NO: 9512724 - DNA, 22 bp, Homo sapiens
gtgcttctccgttctgcagcac

SEQ ID NO: 9512725 - DNA, 22 bp, Homo sapiens
cagctcaagtttcccaggtcag

SEQ ID NO: 9512726 - DNA, 22 bp, Homo sapiens
cagctcaatagcctaccttaat

SEQ ID NO: 9512727 - DNA, 22 bp, Homo sapiens
cagctcacccatcacgtctgct

SEQ ID NO: 9512728 - DNA, 22 bp, Homo sapiens
cagctcacagccacgccattcc

SEQ ID NO: 9512729 - DNA, 22 bp, Homo sapiens
cagctcagacgcaggtcgagca

SEQ ID NO: 9512730 - DNA, 22 bp, Homo sapiens
cagctattggtccacaggtatg

SEQ ID NO: 9512731 - DNA, 22 bp, Homo sapiens
cagctattgataaatgttgggg

SEQ ID NO: 9512732 - DNA, 22 bp, Homo sapiens
cagctattggcaagaagtggtg

SEQ ID NO: 9512733 - DNA, 22 bp, Homo sapiens
gtgcttctgccaactaattaac

SEQ ID NO: 9512734 - DNA, 22 bp, Homo sapiens
cagctattttctcattaaggat

SEQ ID NO: 9512735 - DNA, 22 bp, Homo sapiens
cagctatttgtaggaaaactgt

SEQ ID NO: 9512736 - DNA, 22 bp, Homo sapiens
cagctattggtccacaggtatg

SEQ ID NO: 9512737 - DNA, 22 bp, Homo sapiens
cagctatttatctttcatgata

SEQ ID NO: 9512738 - DNA, 22 bp, Homo sapiens
taagtcatcccataacagtgct

SEQ ID NO: 9512739 - DNA, 22 bp, Homo sapiens
taagtcacttaagtttgcatgt

SEQ ID NO: 9512740 - DNA, 22 bp, Homo sapiens
taagtcacttattccacaagat

SEQ ID NO: 9512741 - DNA, 22 bp, Homo sapiens
taagtattggcctatagctaga

SEQ ID NO: 9512742 - DNA, 22 bp, Homo sapiens
taagtattggcctatagctaga

SEQ ID NO: 9512743 - DNA, 22 bp, Homo sapiens
taaggcagctgagcttctaaca

SEQ ID NO: 9512744 - DNA, 22 bp, Homo sapiens
taaggcagcctcagggtagggt

SEQ ID NO: 9512745 - DNA, 19 bp, Homo sapiens
taagtagtcaaatagtaac

SEQ ID NO: 9512746 - DNA, 22 bp, Homo sapiens
taagtagtcagacataccccat

SEQ ID NO: 9512747 - DNA, 19 bp, Homo sapiens
taagtagtcaaatagtaac

SEQ ID NO: 9512748 - DNA, 19 bp, Homo sapiens
taagtagtcaaatagtaac

SEQ ID NO: 9512749 - DNA, 22 bp, Homo sapiens
taagtagttccatccaaacagc

SEQ ID NO: 9512750 - DNA, 22 bp, Homo sapiens
taagtagtttgtagccccatag

SEQ ID NO: 9512751 - DNA, 22 bp, Homo sapiens
taagtagtcctgatttaacctt

SEQ ID NO: 9512752 - DNA, 22 bp, Homo sapiens
taagtattggcctatagctaga

SEQ ID NO: 9512753 - DNA, 22 bp, Homo sapiens
taagtcttgaaatatttcctat

SEQ ID NO: 9512754 - DNA, 22 bp, Homo sapiens
taagtgaaaatggtttcccagc

SEQ ID NO: 9512755 - DNA, 22 bp, Homo sapiens
taagtgaaatggtgcatcaaat

SEQ ID NO: 9512756 - DNA, 22 bp, Homo sapiens
taagtcgtggatgattcttcgg

SEQ ID NO: 9512757 - DNA, 22 bp, Homo sapiens
taagtcctattccaggtctctc

SEQ ID NO: 9512758 - DNA, 22 bp, Homo sapiens
taagtccataatggcagtaaat

SEQ ID NO: 9512759 - DNA, 22 bp, Homo sapiens
taagtccagtgttctctctgtg

SEQ ID NO: 9512760 - DNA, 22 bp, Homo sapiens
taagtccagtgttctctctgtg

SEQ ID NO: 9512761 - DNA, 22 bp, Homo sapiens
taagtccactatatccttctct

SEQ ID NO: 9512762 - DNA, 22 bp, Homo sapiens
taagtccactatatccttctct

SEQ ID NO: 9512763 - DNA, 22 bp, Homo sapiens
taagtccacctcattcttcagc

SEQ ID NO: 9512764 - DNA, 22 bp, Homo sapiens
taagtccacaggctgacagcgg

SEQ ID NO: 9512765 - DNA, 22 bp, Homo sapiens
taagtccacaggagttgtgttc

SEQ ID NO: 9512766 - DNA, 22 bp, Homo sapiens
taagtccaagggtatgagttgg

SEQ ID NO: 9512767 - DNA, 22 bp, Homo sapiens
caggccaggtggcaggcaaaac

SEQ ID NO: 9512768 - DNA, 19 bp, Homo sapiens
caggccagtgtcagggggc

SEQ ID NO: 9512769 - DNA, 22 bp, Homo sapiens
caggccagtgggaaatagggat

SEQ ID NO: 9512770 - DNA, 22 bp, Homo sapiens
caggccagtgggaaatagggat

SEQ ID NO: 9512771 - DNA, 22 bp, Homo sapiens
caggccagggttgagaagagaa

SEQ ID NO: 9512772 - DNA, 22 bp, Homo sapiens
caggccagggttgagaagagaa

SEQ ID NO: 9512773 - DNA, 22 bp, Homo sapiens
caggccagggttgagaagagaa

SEQ ID NO: 9512774 - DNA, 22 bp, Homo sapiens
caggccagggttgagaagagaa

SEQ ID NO: 9512775 - DNA, 22 bp, Homo sapiens
caggccagggttgagaagagaa

SEQ ID NO: 9512776 - DNA, 22 bp, Homo sapiens
caggccaggtgctctagaatca

SEQ ID NO: 9512777 - DNA, 22 bp, Homo sapiens
caggccagggttgagaagagaa

SEQ ID NO: 9512778 - DNA, 22 bp, Homo sapiens
caggccaggtgctctagaatca

SEQ ID NO: 9512779 - DNA, 19 bp, Homo sapiens
caggccagtgtcagggggc

SEQ ID NO: 9512780 - DNA, 19 bp, Homo sapiens
caggccagtgtcagggggc

SEQ ID NO: 9512781 - DNA, 22 bp, Homo sapiens
caggccagtgtgcttcccaggc

SEQ ID NO: 9512782 - DNA, 22 bp, Homo sapiens
caggccattaccgctgagaccc

SEQ ID NO: 9512783 - DNA, 22 bp, Homo sapiens
caggccagtgtgcttcccaggc

SEQ ID NO: 9512784 - DNA, 22 bp, Homo sapiens
caggccagtgtgcttcccaggc

SEQ ID NO: 9512785 - DNA, 22 bp, Homo sapiens
caggccagtgtgcttcccaggc

SEQ ID NO: 9512786 - DNA, 22 bp, Homo sapiens
caggcccaaatgcaaccttctt

SEQ ID NO: 9512787 - DNA, 22 bp, Homo sapiens
caggcccactgcttgtctagtc

SEQ ID NO: 9512788 - DNA, 22 bp, Homo sapiens
tacaaaccagcagaataggtcc

SEQ ID NO: 9512789 - DNA, 22 bp, Homo sapiens
caggccagagcgcgtggttggg

SEQ ID NO: 9512790 - DNA, 22 bp, Homo sapiens
caggccagagcgcgtggttggg

SEQ ID NO: 9512791 - DNA, 22 bp, Homo sapiens
tacaaaagtaattacggttttt

SEQ ID NO: 9512792 - DNA, 22 bp, Homo sapiens
tacaaaagtaattacggttttt

SEQ ID NO: 9512793 - DNA, 22 bp, Homo sapiens
tacaaaagtaattacggttttt

SEQ ID NO: 9512794 - DNA, 20 bp, Homo sapiens
tacaaacctccacactggtg

SEQ ID NO: 9512795 - DNA, 22 bp, Homo sapiens
tacaaaacagtgctctggtcct

SEQ ID NO: 9512796 - DNA, 22 bp, Homo sapiens
tacaaaaaattgatactgacga

SEQ ID NO: 9512797 - DNA, 22 bp, Homo sapiens
tacaaaacagtgctctggtcct

SEQ ID NO: 9512798 - DNA, 22 bp, Homo sapiens
tacaaaaggaagagggatctta

SEQ ID NO: 9512799 - DNA, 22 bp, Homo sapiens
tacaaaaggaagagggatctta

SEQ ID NO: 9512800 - DNA, 22 bp, Homo sapiens
caggcatgtggcccaggggtga

SEQ ID NO: 9512801 - DNA, 22 bp, Homo sapiens
caggcatggtgagaactcagcc

SEQ ID NO: 9512802 - DNA, 22 bp, Homo sapiens
caggcatgggccatgggaagtg

SEQ ID NO: 9512803 - DNA, 22 bp, Homo sapiens
caggcatgggccatgggaagtg

SEQ ID NO: 9512804 - DNA, 22 bp, Homo sapiens
caggcatggatctggaatcatt

SEQ ID NO: 9512805 - DNA, 22 bp, Homo sapiens
caggcatgggccatgggaagtg

SEQ ID NO: 9512806 - DNA, 22 bp, Homo sapiens
caggcattcctctatgaatatt

SEQ ID NO: 9512807 - DNA, 22 bp, Homo sapiens
caggcatttcgcaaaggctgag

SEQ ID NO: 9512808 - DNA, 22 bp, Homo sapiens
tacaaaaaattgatactgacga

SEQ ID NO: 9512809 - DNA, 21 bp, Homo sapiens
caggccaaaaggttcaacatt

SEQ ID NO: 9512810 - DNA, 22 bp, Homo sapiens
tacaaaaaattgatactgacga

SEQ ID NO: 9512811 - DNA, 22 bp, Homo sapiens
tacaaaaaattgatactgacga

SEQ ID NO: 9512812 - DNA, 22 bp, Homo sapiens
tacaaaaaattgatactgacga

SEQ ID NO: 9512813 - DNA, 22 bp, Homo sapiens
tacaaaaaattgatactgacga

SEQ ID NO: 9512814 - DNA, 22 bp, Homo sapiens
tacaaaaaattgatactgacga

SEQ ID NO: 9512815 - DNA, 22 bp, Homo sapiens
taatgtctttaagagcattggg

SEQ ID NO: 9512816 - DNA, 22 bp, Homo sapiens
taatgtgtgtcatcagtagagt

SEQ ID NO: 9512817 - DNA, 22 bp, Homo sapiens
taatgtgatattcctgtccttt

SEQ ID NO: 9512818 - DNA, 22 bp, Homo sapiens
taatgttacactgcatggttca

SEQ ID NO: 9512819 - DNA, 22 bp, Homo sapiens
caggcagggagctggaaaggat

SEQ ID NO: 9512820 - DNA, 22 bp, Homo sapiens
taatgtgttgaatatttgtaca

SEQ ID NO: 9512821 - DNA, 22 bp, Homo sapiens
taatgtctagatcagacctcga

SEQ ID NO: 9512822 - DNA, 22 bp, Homo sapiens
taatgtctgtgtttcagtgcag

SEQ ID NO: 9512823 - DNA, 22 bp, Homo sapiens
taatgtctatgggccagataat

SEQ ID NO: 9512824 - DNA, 22 bp, Homo sapiens
taatgtcttagtaccttaattt

SEQ ID NO: 9512825 - DNA, 22 bp, Homo sapiens
caggcatggatctggaatcatt

SEQ ID NO: 9512826 - DNA, 22 bp, Homo sapiens
caggcatggagaggcagagact

SEQ ID NO: 9512827 - DNA, 22 bp, Homo sapiens
caggcatggagaggcagagact

SEQ ID NO: 9512828 - DNA, 22 bp, Homo sapiens
caggcatggagaggcagagact

SEQ ID NO: 9512829 - DNA, 22 bp, Homo sapiens
caggcatggaaaagcccagagg

SEQ ID NO: 9512830 - DNA, 22 bp, Homo sapiens
caggcatgcttctgtctgggca

SEQ ID NO: 9512831 - DNA, 22 bp, Homo sapiens
caggcatgagccaggcccctcc

SEQ ID NO: 9512832 - DNA, 22 bp, Homo sapiens
caggcatgagccaggcccctcc

SEQ ID NO: 9512833 - DNA, 22 bp, Homo sapiens
caggcatgatcataggagttta

SEQ ID NO: 9512834 - DNA, 22 bp, Homo sapiens
taatatgtgttactgacttttt

SEQ ID NO: 9512835 - DNA, 22 bp, Homo sapiens
taatatctacttcatagagttt

SEQ ID NO: 9512836 - DNA, 22 bp, Homo sapiens
taatacagacaacttgccaaat

SEQ ID NO: 9512837 - DNA, 22 bp, Homo sapiens
taatatctggcattcaaacatg

SEQ ID NO: 9512838 - DNA, 22 bp, Homo sapiens
taatatctggcattcaaacatg

SEQ ID NO: 9512839 - DNA, 22 bp, Homo sapiens
taatatctggcattcaaacatg

SEQ ID NO: 9512840 - DNA, 22 bp, Homo sapiens
taatcacaattcagatgtctta

SEQ ID NO: 9512841 - DNA, 22 bp, Homo sapiens
taatcacaattcagatgtctta

SEQ ID NO: 9512842 - DNA, 22 bp, Homo sapiens
taatatttctaccctgctgcct

SEQ ID NO: 9512843 - DNA, 22 bp, Homo sapiens
taatatttctaccctgctgcct

SEQ ID NO: 9512844 - DNA, 22 bp, Homo sapiens
taatcacaattcagatgtctta

SEQ ID NO: 9512845 - DNA, 22 bp, Homo sapiens
taatcacagaaacagactgttt

SEQ ID NO: 9512846 - DNA, 22 bp, Homo sapiens
taatcacagaaacagactgttt

SEQ ID NO: 9512847 - DNA, 22 bp, Homo sapiens
taatcacagaaacagactgttt

SEQ ID NO: 9512848 - DNA, 22 bp, Homo sapiens
taatcatatgggtaatccaatg

SEQ ID NO: 9512849 - DNA, 22 bp, Homo sapiens
taatcatatgggtaatccaatg

SEQ ID NO: 9512850 - DNA, 20 bp, Homo sapiens
taatcacttataagacaatg

SEQ ID NO: 9512851 - DNA, 22 bp, Homo sapiens
taatcatatgggtaatccaatg

SEQ ID NO: 9512852 - DNA, 22 bp, Homo sapiens
taatgtaaacacagagacagaa

SEQ ID NO: 9512853 - DNA, 22 bp, Homo sapiens
taatgtaaagaagatgtaggaa

SEQ ID NO: 9512854 - DNA, 22 bp, Homo sapiens
taatgtaaacacagagacagaa

SEQ ID NO: 9512855 - DNA, 22 bp, Homo sapiens
taatgtatttgttcagaagagt

SEQ ID NO: 9512856 - DNA, 22 bp, Homo sapiens
taatgtatttgttcagaagagt

SEQ ID NO: 9512857 - DNA, 22 bp, Homo sapiens
taatgtataacaaatactcatc

SEQ ID NO: 9512858 - DNA, 22 bp, Homo sapiens
taatgtataacaaatactcatc

SEQ ID NO: 9512859 - DNA, 20 bp, Homo sapiens
taatgtcaaagtcacaaggt

SEQ ID NO: 9512860 - DNA, 22 bp, Homo sapiens
taatgtcaaggtcattctagag

SEQ ID NO: 9512861 - DNA, 22 bp, Homo sapiens
cctgtggcttccacgacctaat

SEQ ID NO: 9512862 - DNA, 22 bp, Homo sapiens
cctgtggctggtcaggccagca

SEQ ID NO: 9512863 - DNA, 22 bp, Homo sapiens
cctgtggctggtcaggccagca

SEQ ID NO: 9512864 - DNA, 22 bp, Homo sapiens
ttaaatagctcttgtagaagaa

SEQ ID NO: 9512865 - DNA, 22 bp, Homo sapiens
ttaaagtttcagaaacttggtc

SEQ ID NO: 9512866 - DNA, 22 bp, Homo sapiens
ttaaagttcattaaatgagcca

SEQ ID NO: 9512867 - DNA, 22 bp, Homo sapiens
ttaaagttcattaaatgagcca

SEQ ID NO: 9512868 - DNA, 22 bp, Homo sapiens
ttaaagtaatctgtgtgaattt

SEQ ID NO: 9512869 - DNA, 22 bp, Homo sapiens
ttaaaggctgatcttaatatta

SEQ ID NO: 9512870 - DNA, 19 bp, Homo sapiens
ttaaagtgcgagaagtctt

SEQ ID NO: 9512871 - DNA, 22 bp, Homo sapiens
ttaaagtctatgtactacactt

SEQ ID NO: 9512872 - DNA, 22 bp, Homo sapiens
cctgtgtcatcagctgtggcta

SEQ ID NO: 9512873 - DNA, 22 bp, Homo sapiens
cctgtgtcctaatccatcaggc

SEQ ID NO: 9512874 - DNA, 22 bp, Homo sapiens
cctgtgtcctaatccatcaggc

SEQ ID NO: 9512875 - DNA, 22 bp, Homo sapiens
cctgtgtcagcccctgcctcca

SEQ ID NO: 9512876 - DNA, 22 bp, Homo sapiens
cctgtgtcagcccctgcctcca

SEQ ID NO: 9512877 - DNA, 21 bp, Homo sapiens
cctgtggtctggagggagcac

SEQ ID NO: 9512878 - DNA, 21 bp, Homo sapiens
cctgtgtatatggcttgcatg

SEQ ID NO: 9512879 - DNA, 22 bp, Homo sapiens
cctgtgggtcacatgggtgact

SEQ ID NO: 9512880 - DNA, 22 bp, Homo sapiens
cctgtgcttcactcaacaagcc

SEQ ID NO: 9512881 - DNA, 22 bp, Homo sapiens
cctgtgcttcagctggaggagg

SEQ ID NO: 9512882 - DNA, 20 bp, Homo sapiens
cctgtgcttatcacttgctg

SEQ ID NO: 9512883 - DNA, 22 bp, Homo sapiens
cctgtgctgggtgtgagggaca

SEQ ID NO: 9512884 - DNA, 22 bp, Homo sapiens
cctgtgctgggtgtgagggaca

SEQ ID NO: 9512885 - DNA, 21 bp, Homo sapiens
ttaaagctatggtagtgggct

SEQ ID NO: 9512886 - DNA, 22 bp, Homo sapiens
cctgtgctgggtgtgagggaca

SEQ ID NO: 9512887 - DNA, 20 bp, Homo sapiens
cctgtgctgccctcggggcc

SEQ ID NO: 9512888 - DNA, 22 bp, Homo sapiens
cctgtgctccctatgtatctgg

SEQ ID NO: 9512889 - DNA, 22 bp, Homo sapiens
ttaaaggcatggttagacatgg

SEQ ID NO: 9512890 - DNA, 22 bp, Homo sapiens
ttaaaggaattgagtttcttgt

SEQ ID NO: 9512891 - DNA, 22 bp, Homo sapiens
ttaaagctgagccctcagaagc

SEQ ID NO: 9512892 - DNA, 22 bp, Homo sapiens
ttaaagctggcgttacagtttg

SEQ ID NO: 9512893 - DNA, 22 bp, Homo sapiens
cctgtgccctcagcctggctct

SEQ ID NO: 9512894 - DNA, 22 bp, Homo sapiens
cctgtgccctctgcatagcagc

SEQ ID NO: 9512895 - DNA, 22 bp, Homo sapiens
cctgtgccatcctgagcatccc

SEQ ID NO: 9512896 - DNA, 22 bp, Homo sapiens
cctgtgccatcctgagcatccc

SEQ ID NO: 9512897 - DNA, 22 bp, Homo sapiens
cctgtgccctacacctttccag

SEQ ID NO: 9512898 - DNA, 22 bp, Homo sapiens
cctgtgccttaaccctttaggc

SEQ ID NO: 9512899 - DNA, 22 bp, Homo sapiens
cctgtgcctgcctgtgagttct

SEQ ID NO: 9512900 - DNA, 22 bp, Homo sapiens
cctgtgccctggaaggagagag

SEQ ID NO: 9512901 - DNA, 22 bp, Homo sapiens
cctgtgccctgccaggctggtg

SEQ ID NO: 9512902 - DNA, 22 bp, Homo sapiens
cctgtgccttccttaggcacct

SEQ ID NO: 9512903 - DNA, 19 bp, Homo sapiens
cctgtgctaggagctgacc

SEQ ID NO: 9512904 - DNA, 19 bp, Homo sapiens
cctgtgctaggagctgacc

SEQ ID NO: 9512905 - DNA, 22 bp, Homo sapiens
cctgtgctcccatagcttctgt

SEQ ID NO: 9512906 - DNA, 22 bp, Homo sapiens
cctgtgctcccatagcttctgt

SEQ ID NO: 9512907 - DNA, 22 bp, Homo sapiens
cctgtgctccctatgtatctgg

SEQ ID NO: 9512908 - DNA, 22 bp, Homo sapiens
cctgtgctcccatagcttctgt

SEQ ID NO: 9512909 - DNA, 18 bp, Homo sapiens
cctgtgctccagcatctg

SEQ ID NO: 9512910 - DNA, 22 bp, Homo sapiens
cctgtctgtttgcccattcttg

SEQ ID NO: 9512911 - DNA, 22 bp, Homo sapiens
cctgtctgtttgcccattcttg

SEQ ID NO: 9512912 - DNA, 22 bp, Homo sapiens
cctgtctgttctgactggtcag

SEQ ID NO: 9512913 - DNA, 23 bp, Homo sapiens
cctgtctgtgctgggtggacaca

SEQ ID NO: 9512914 - DNA, 23 bp, Homo sapiens
cctgtctgtgctgggtggacaca

SEQ ID NO: 9512915 - DNA, 23 bp, Homo sapiens
cctgtctgtgctgggtggacaca

SEQ ID NO: 9512916 - DNA, 22 bp, Homo sapiens
cctgtctgtttcattccttgtt

SEQ ID NO: 9512917 - DNA, 22 bp, Homo sapiens
cctgtctgttctgactggtcag

SEQ ID NO: 9512918 - DNA, 22 bp, Homo sapiens
cctgtctgttctgactggtcag

SEQ ID NO: 9512919 - DNA, 22 bp, Homo sapiens
cctgtctgtcctttgcattctt

SEQ ID NO: 9512920 - DNA, 22 bp, Homo sapiens
cctgtctgtcctttgcattctt

SEQ ID NO: 9512921 - DNA, 19 bp, Homo sapiens
cctgtctgtcttcagctag

SEQ ID NO: 9512922 - DNA, 19 bp, Homo sapiens
cctgtctgtcttcagctag

SEQ ID NO: 9512923 - DNA, 23 bp, Homo sapiens
cctgtctgtgctgggtggacaca

SEQ ID NO: 9512924 - DNA, 22 bp, Homo sapiens
cctgtctggaacatggcctgtt

SEQ ID NO: 9512925 - DNA, 22 bp, Homo sapiens
cctgtctggaacatggcctgtt

SEQ ID NO: 9512926 - DNA, 22 bp, Homo sapiens
cctgtctggaacatggcctgtt

SEQ ID NO: 9512927 - DNA, 22 bp, Homo sapiens
cctgtctggaacatggcctgtt

SEQ ID NO: 9512928 - DNA, 22 bp, Homo sapiens
cctgtctggccaccagggcgat

SEQ ID NO: 9512929 - DNA, 22 bp, Homo sapiens
cctgtctggccaccagggcgat

SEQ ID NO: 9512930 - DNA, 22 bp, Homo sapiens
cctgtctggccttccacggggg

SEQ ID NO: 9512931 - DNA, 22 bp, Homo sapiens
cctgtctggccttccacggggg

SEQ ID NO: 9512932 - DNA, 22 bp, Homo sapiens
cctgtctgggcttgagtattta

SEQ ID NO: 9512933 - DNA, 22 bp, Homo sapiens
cctgtctgtcctctcatgagcc

SEQ ID NO: 9512934 - DNA, 22 bp, Homo sapiens
cctgtctgtcctctcatgagcc

SEQ ID NO: 9512935 - DNA, 22 bp, Homo sapiens
cctgtctgtcctctcatgagcc

SEQ ID NO: 9512936 - DNA, 22 bp, Homo sapiens
cctgtctgtcctctcatgagcc

SEQ ID NO: 9512937 - DNA, 22 bp, Homo sapiens
cctgtctgtattggtttgctat

SEQ ID NO: 9512938 - DNA, 22 bp, Homo sapiens
cctgtctgtattggtttgctat

SEQ ID NO: 9512939 - DNA, 22 bp, Homo sapiens
cctgtctgtatcggttcagagt

SEQ ID NO: 9512940 - DNA, 22 bp, Homo sapiens
cctgtctgtattattcaccact

SEQ ID NO: 9512941 - DNA, 22 bp, Homo sapiens
cctgtctgtatcggttcagagt

SEQ ID NO: 9512942 - DNA, 22 bp, Homo sapiens
cctgtctggggactccctgggt

SEQ ID NO: 9512943 - DNA, 22 bp, Homo sapiens
cctgtctggggactccctgggt

SEQ ID NO: 9512944 - DNA, 18 bp, Homo sapiens
cctgtctggggtccccac

SEQ ID NO: 9512945 - DNA, 18 bp, Homo sapiens
cctgtctggggtccccac

SEQ ID NO: 9512946 - DNA, 22 bp, Homo sapiens
cctgtctgcatgatccctgcca

SEQ ID NO: 9512947 - DNA, 22 bp, Homo sapiens
cctgtctgcatgagtgagcata

SEQ ID NO: 9512948 - DNA, 22 bp, Homo sapiens
cctgtctgcatgagtgagcata

SEQ ID NO: 9512949 - DNA, 22 bp, Homo sapiens
cctgtctgcaggaaattaccag

SEQ ID NO: 9512950 - DNA, 22 bp, Homo sapiens
cctgtctgcagatatctcaggt

SEQ ID NO: 9512951 - DNA, 22 bp, Homo sapiens
cctgtctgcagatatctcaggt

SEQ ID NO: 9512952 - DNA, 22 bp, Homo sapiens
cctgtctgaatcatgatttcct

SEQ ID NO: 9512953 - DNA, 22 bp, Homo sapiens
cctgtctctttcaatctgagag

SEQ ID NO: 9512954 - DNA, 22 bp, Homo sapiens
cctgtctgaggaggtgctcttt

SEQ ID NO: 9512955 - DNA, 22 bp, Homo sapiens
cctgtctgaggaggtgctcttt

SEQ ID NO: 9512956 - DNA, 20 bp, Homo sapiens
cctgtctgcaatggaggtca

SEQ ID NO: 9512957 - DNA, 22 bp, Homo sapiens
tgtttactttccttctcacagg

SEQ ID NO: 9512958 - DNA, 22 bp, Homo sapiens
tgtttactggctcctgtggttc

SEQ ID NO: 9512959 - DNA, 22 bp, Homo sapiens
tgtttacttttaattacctgtc

SEQ ID NO: 9512960 - DNA, 22 bp, Homo sapiens
tgtttacttttaattacctgtc

SEQ ID NO: 9512961 - DNA, 22 bp, Homo sapiens
tgtttacttcatcgagtacttc

SEQ ID NO: 9512962 - DNA, 22 bp, Homo sapiens
tgtttagacaaggatcaggtta

SEQ ID NO: 9512963 - DNA, 22 bp, Homo sapiens
tgtttagaatcattcaaaagtt

SEQ ID NO: 9512964 - DNA, 22 bp, Homo sapiens
tgtttagcataaagattttcca

SEQ ID NO: 9512965 - DNA, 22 bp, Homo sapiens
tgtttagatgcaaagtctcaca

SEQ ID NO: 9512966 - DNA, 22 bp, Homo sapiens
tgtttagatgcaaagtctcaca

SEQ ID NO: 9512967 - DNA, 22 bp, Homo sapiens
tgtttagactcaaaattgaaag

SEQ ID NO: 9512968 - DNA, 22 bp, Homo sapiens
tgtttagaggaactggaatcag

SEQ ID NO: 9512969 - DNA, 22 bp, Homo sapiens
tgtttagtaggagtttaatact

SEQ ID NO: 9512970 - DNA, 22 bp, Homo sapiens
cctgtcactctgagccgctccg

SEQ ID NO: 9512971 - DNA, 22 bp, Homo sapiens
cctgtcactctgagccgctccg

SEQ ID NO: 9512972 - DNA, 22 bp, Homo sapiens
cctgtcactgttgcagccagct

SEQ ID NO: 9512973 - DNA, 20 bp, Homo sapiens
cctgtctcctcttacctggc

SEQ ID NO: 9512974 - DNA, 22 bp, Homo sapiens
cctgtctctgcagggccctgcc

SEQ ID NO: 9512975 - DNA, 22 bp, Homo sapiens
ccttcctggctgtccgcctgat

SEQ ID NO: 9512976 - DNA, 22 bp, Homo sapiens
ccttcctggctgtccgcctgat

SEQ ID NO: 9512977 - DNA, 22 bp, Homo sapiens
ccttccctaaagcgtcgcttag

SEQ ID NO: 9512978 - DNA, 19 bp, Homo sapiens
ccttccccttcagcctctg

SEQ ID NO: 9512979 - DNA, 19 bp, Homo sapiens
ccttccccttcagcctctg

SEQ ID NO: 9512980 - DNA, 17 bp, Homo sapiens
ccttcctcatctccttc

SEQ ID NO: 9512981 - DNA, 22 bp, Homo sapiens
ccttccagtgactaaggaggaa

SEQ ID NO: 9512982 - DNA, 22 bp, Homo sapiens
ccttcaggtcatatatgtcaga

SEQ ID NO: 9512983 - DNA, 22 bp, Homo sapiens
ccttcatgtcattggacacctt

SEQ ID NO: 9512984 - DNA, 22 bp, Homo sapiens
ccttccccagtgattctctcag

SEQ ID NO: 9512985 - DNA, 19 bp, Homo sapiens
ccttccccttcagcctctg

SEQ ID NO: 9512986 - DNA, 19 bp, Homo sapiens
ccttccccttcagcctctg

SEQ ID NO: 9512987 - DNA, 19 bp, Homo sapiens
ccttccccttcagcctctg

SEQ ID NO: 9512988 - DNA, 22 bp, Homo sapiens
ccttccccaggtgctcactgtc

SEQ ID NO: 9512989 - DNA, 22 bp, Homo sapiens
ccttccccagtgattctctcag

SEQ ID NO: 9512990 - DNA, 22 bp, Homo sapiens
ccttccccagtgattctctcag

SEQ ID NO: 9512991 - DNA, 20 bp, Homo sapiens
ccttccccacccgctgaggt

SEQ ID NO: 9512992 - DNA, 20 bp, Homo sapiens
ccttccccacccgctgaggt

SEQ ID NO: 9512993 - DNA, 20 bp, Homo sapiens
ccttccccacccgctgaggt

SEQ ID NO: 9512994 - DNA, 22 bp, Homo sapiens
ccttccccaggtgctcactgtc

SEQ ID NO: 9512995 - DNA, 22 bp, Homo sapiens
ccttccccaggtgctcactgtc

SEQ ID NO: 9512996 - DNA, 22 bp, Homo sapiens
ccttccccaggtgctcactgtc

SEQ ID NO: 9512997 - DNA, 22 bp, Homo sapiens
ccttccccaggtgctcactgtc

SEQ ID NO: 9512998 - DNA, 22 bp, Homo sapiens
cctgtgtcctaatccatcaggc

SEQ ID NO: 9512999 - DNA, 22 bp, Homo sapiens
cctgtgtcctcccactcagtcc

SEQ ID NO: 9513000 - DNA, 22 bp, Homo sapiens
cctgtgtctgaccatgcacatg

SEQ ID NO: 9513001 - DNA, 22 bp, Homo sapiens
cctgtgtcttccccactggtgt

SEQ ID NO: 9513002 - DNA, 22 bp, Homo sapiens
cctgtgtctttgcctcagggtc

SEQ ID NO: 9513003 - DNA, 22 bp, Homo sapiens
cctgtgtctgaccatgcacatg

SEQ ID NO: 9513004 - DNA, 22 bp, Homo sapiens
cctgtgtgaaggttaggcaggt

SEQ ID NO: 9513005 - DNA, 22 bp, Homo sapiens
cctgtgtgcacacgaggccatg

SEQ ID NO: 9513006 - DNA, 22 bp, Homo sapiens
cctgtgtgctgatgacgacaga

SEQ ID NO: 9513007 - DNA, 22 bp, Homo sapiens
cctgtgtgcacacgaggccatg

SEQ ID NO: 9513008 - DNA, 22 bp, Homo sapiens
cctgtgtgctgatgacgacaga

SEQ ID NO: 9513009 - DNA, 22 bp, Homo sapiens
cctgtgtgtaggccaggggagt

SEQ ID NO: 9513010 - DNA, 20 bp, Homo sapiens
cctgtgtggtttgcactaca

SEQ ID NO: 9513011 - DNA, 20 bp, Homo sapiens
cctgtgtggtttgcactaca

SEQ ID NO: 9513012 - DNA, 22 bp, Homo sapiens
cctgtgtggtagccagcggtgc

SEQ ID NO: 9513013 - DNA, 22 bp, Homo sapiens
cctgtgtgtaggccaggggagt

SEQ ID NO: 9513014 - DNA, 22 bp, Homo sapiens
ccttcaggtcatatatgtcaga

SEQ ID NO: 9513015 - DNA, 20 bp, Homo sapiens
cctgtgtggccagctgaggc

SEQ ID NO: 9513016 - DNA, 22 bp, Homo sapiens
cctgtgtggccaggctggagtc

SEQ ID NO: 9513017 - DNA, 22 bp, Homo sapiens
cctgtgtggccaggctggagtc

SEQ ID NO: 9513018 - DNA, 20 bp, Homo sapiens
cctgtgtggccagctgaggc

SEQ ID NO: 9513019 - DNA, 20 bp, Homo sapiens
cctgtgtggccagctgaggc

SEQ ID NO: 9513020 - DNA, 22 bp, Homo sapiens
cctgtgtggccgcactgctccc

SEQ ID NO: 9513021 - DNA, 19 bp, Homo sapiens
cctgtgtggggtagagatc

SEQ ID NO: 9513022 - DNA, 19 bp, Homo sapiens
cctgtgtggggtagagatc

SEQ ID NO: 9513023 - DNA, 22 bp, Homo sapiens
cctgtgtggccgcactgctccc

SEQ ID NO: 9513024 - DNA, 22 bp, Homo sapiens
ttagaagtgaaatgctgcagag

SEQ ID NO: 9513025 - DNA, 22 bp, Homo sapiens
ttagaagtcatctagtctaaaa

SEQ ID NO: 9513026 - DNA, 22 bp, Homo sapiens
ttagaaaaatgttcagtagttt

SEQ ID NO: 9513027 - DNA, 22 bp, Homo sapiens
ttagaaaaatgttcagtagttt

SEQ ID NO: 9513028 - DNA, 22 bp, Homo sapiens
ttagaaaaatgttcagtagttt

SEQ ID NO: 9513029 - DNA, 22 bp, Homo sapiens
ttagaaaaatgttcagtagttt

SEQ ID NO: 9513030 - DNA, 22 bp, Homo sapiens
ttagaatcagaagagaggtatt

SEQ ID NO: 9513031 - DNA, 22 bp, Homo sapiens
ttagaatcaggtgttataatca

SEQ ID NO: 9513032 - DNA, 22 bp, Homo sapiens
ttagaatctaacattcttatct

SEQ ID NO: 9513033 - DNA, 22 bp, Homo sapiens
ttagaatctttagagtctcact

SEQ ID NO: 9513034 - DNA, 22 bp, Homo sapiens
ttagacaagggctccttaaaag

SEQ ID NO: 9513035 - DNA, 22 bp, Homo sapiens
cctttacagtatggttgtatca

SEQ ID NO: 9513036 - DNA, 22 bp, Homo sapiens
cctttacatctgacttctttca

SEQ ID NO: 9513037 - DNA, 22 bp, Homo sapiens
ttagaaaaaggctgtggtctta

SEQ ID NO: 9513038 - DNA, 22 bp, Homo sapiens
ttagaaaaaacgtcttctagtg

SEQ ID NO: 9513039 - DNA, 23 bp, Homo sapiens
ttacttttgcaccaacctaatat

SEQ ID NO: 9513040 - DNA, 23 bp, Homo sapiens
ttacttttgcaccaacctaatat

SEQ ID NO: 9513041 - DNA, 21 bp, Homo sapiens
ttacttttgcagcaacctaat

SEQ ID NO: 9513042 - DNA, 21 bp, Homo sapiens
ttacttttgcagcaacctaat

SEQ ID NO: 9513043 - DNA, 22 bp, Homo sapiens
ttacttttgcaccaaactaata

SEQ ID NO: 9513044 - DNA, 22 bp, Homo sapiens
ttacttttgcaccaaactaata

SEQ ID NO: 9513045 - DNA, 22 bp, Homo sapiens
ttacttttgcaccaaactaata

SEQ ID NO: 9513046 - DNA, 21 bp, Homo sapiens
ttacttttgcaccaacctaat

SEQ ID NO: 9513047 - DNA, 21 bp, Homo sapiens
ttacttttgcaccaacctaat

SEQ ID NO: 9513048 - DNA, 22 bp, Homo sapiens
ttactaaggactctaagttcta

SEQ ID NO: 9513049 - DNA, 22 bp, Homo sapiens
ttactaagagaagtaaatattt

SEQ ID NO: 9513050 - DNA, 21 bp, Homo sapiens
ttactaaacaaaacatgcagg

SEQ ID NO: 9513051 - DNA, 22 bp, Homo sapiens
ccttcctttcagggctatgcct

SEQ ID NO: 9513052 - DNA, 22 bp, Homo sapiens
ccttcctttgcaggtcaggtca

SEQ ID NO: 9513053 - DNA, 22 bp, Homo sapiens
ccttccttgagaagcaattcct

SEQ ID NO: 9513054 - DNA, 22 bp, Homo sapiens
ccttccttgtctacaaaagctc

SEQ ID NO: 9513055 - DNA, 22 bp, Homo sapiens
ccttccttgtctacaaaagctc

SEQ ID NO: 9513056 - DNA, 22 bp, Homo sapiens
ccttctagcaaatcaacataaa

SEQ ID NO: 9513057 - DNA, 21 bp, Homo sapiens
ttactaaacaaaacatgcagg

SEQ ID NO: 9513058 - DNA, 21 bp, Homo sapiens
ttactaaacaaaacatgcagg

SEQ ID NO: 9513059 - DNA, 21 bp, Homo sapiens
ccttctccacagggtctccgg

SEQ ID NO: 9513060 - DNA, 22 bp, Homo sapiens
cctggttgagggaggtgtggac

SEQ ID NO: 9513061 - DNA, 21 bp, Homo sapiens
cctggttggcgtagctcagtc

SEQ ID NO: 9513062 - DNA, 22 bp, Homo sapiens
cctggtgtggctgtcacagagg

SEQ ID NO: 9513063 - DNA, 22 bp, Homo sapiens
tgtttacttatgtgggtcacat

SEQ ID NO: 9513064 - DNA, 22 bp, Homo sapiens
tgtttacttatgtgggtcacat

SEQ ID NO: 9513065 - DNA, 22 bp, Homo sapiens
tgtttacttcatcgagtacttc

SEQ ID NO: 9513066 - DNA, 22 bp, Homo sapiens
tgtttacttctttccatggctt

SEQ ID NO: 9513067 - DNA, 22 bp, Homo sapiens
tgtttacttgaggtggaaacaa

SEQ ID NO: 9513068 - DNA, 22 bp, Homo sapiens
tgtttactggctcctgtggttc

SEQ ID NO: 9513069 - DNA, 22 bp, Homo sapiens
tgtttacttaaatgttttcata

SEQ ID NO: 9513070 - DNA, 22 bp, Homo sapiens
tgtttacttaaatgttttcata

SEQ ID NO: 9513071 - DNA, 22 bp, Homo sapiens
tgtttactggaccagggagggg

SEQ ID NO: 9513072 - DNA, 22 bp, Homo sapiens
cctgggtgtcatgggcagctgg

SEQ ID NO: 9513073 - DNA, 22 bp, Homo sapiens
cctggtgcttaccagagctttt

SEQ ID NO: 9513074 - DNA, 22 bp, Homo sapiens
cctgggtgtcatgggcagctgg

SEQ ID NO: 9513075 - DNA, 22 bp, Homo sapiens
cctggtggagaggggcggagcg

SEQ ID NO: 9513076 - DNA, 22 bp, Homo sapiens
cctggtgggcaggagtgagacc

SEQ ID NO: 9513077 - DNA, 22 bp, Homo sapiens
cctggtggcttctgggtggacg

SEQ ID NO: 9513078 - DNA, 22 bp, Homo sapiens
cctggtggcttctgggtggacg

SEQ ID NO: 9513079 - DNA, 22 bp, Homo sapiens
cctggtggagaggggcggagcg

SEQ ID NO: 9513080 - DNA, 22 bp, Homo sapiens
cctggtggcttctgggtggacg

SEQ ID NO: 9513081 - DNA, 22 bp, Homo sapiens
tgttccagggcgcgaaggtggt

SEQ ID NO: 9513082 - DNA, 22 bp, Homo sapiens
tgttccagaggcagagatagga

SEQ ID NO: 9513083 - DNA, 23 bp, Homo sapiens
tgttccagatacgccttttcctc

SEQ ID NO: 9513084 - DNA, 23 bp, Homo sapiens
tgttccagatacgccttttcctc

SEQ ID NO: 9513085 - DNA, 22 bp, Homo sapiens
tgttccagaggcagagatagga

SEQ ID NO: 9513086 - DNA, 22 bp, Homo sapiens
tgttcattagtggaagtaagtt

SEQ ID NO: 9513087 - DNA, 22 bp, Homo sapiens
tgttcattctgtatatgctgta

SEQ ID NO: 9513088 - DNA, 22 bp, Homo sapiens
tgttcatttgcaacaaccaaat

SEQ ID NO: 9513089 - DNA, 22 bp, Homo sapiens
tgttcattttgaagtacttcaa

SEQ ID NO: 9513090 - DNA, 22 bp, Homo sapiens
tgttcattttgaagtacttcaa

SEQ ID NO: 9513091 - DNA, 22 bp, Homo sapiens
tgttacagtactacaattctgc

SEQ ID NO: 9513092 - DNA, 22 bp, Homo sapiens
tgttacaggaaatagaattacc

SEQ ID NO: 9513093 - DNA, 22 bp, Homo sapiens
tgttacaatattatcaactgag

SEQ ID NO: 9513094 - DNA, 22 bp, Homo sapiens
tgttacacagcagaatagcaag

SEQ ID NO: 9513095 - DNA, 22 bp, Homo sapiens
tgttacaatattatcaactgag

SEQ ID NO: 9513096 - DNA, 22 bp, Homo sapiens
tgttcatattcctgtccgctga

SEQ ID NO: 9513097 - DNA, 22 bp, Homo sapiens
tgttcagttaacacagacacca

SEQ ID NO: 9513098 - DNA, 22 bp, Homo sapiens
tgttcagaacaaaggtaaatga

SEQ ID NO: 9513099 - DNA, 22 bp, Homo sapiens
tgttcagaacaaaggtaaatga

SEQ ID NO: 9513100 - DNA, 22 bp, Homo sapiens
tgttacaaggaagaatgtaggt

SEQ ID NO: 9513101 - DNA, 22 bp, Homo sapiens
tgttacaactatagatcccaag

SEQ ID NO: 9513102 - DNA, 22 bp, Homo sapiens
tgttaatggctgaagacatcct

SEQ ID NO: 9513103 - DNA, 17 bp, Homo sapiens
tgttaattccaatgata

SEQ ID NO: 9513104 - DNA, 17 bp, Homo sapiens
tgttaattccaatgata

SEQ ID NO: 9513105 - DNA, 22 bp, Homo sapiens
tgttacaaactgttgtttctat

SEQ ID NO: 9513106 - DNA, 22 bp, Homo sapiens
tgttacaaactgttgtttctat

SEQ ID NO: 9513107 - DNA, 22 bp, Homo sapiens
tgttaatatactaaaatccact

SEQ ID NO: 9513108 - DNA, 22 bp, Homo sapiens
tgttaatatactaaaatccact

SEQ ID NO: 9513109 - DNA, 22 bp, Homo sapiens
tgttaatatactaaaatccact

SEQ ID NO: 9513110 - DNA, 22 bp, Homo sapiens
tgttaatatactaaaatccact

SEQ ID NO: 9513111 - DNA, 23 bp, Homo sapiens
tgttaatacatctgccactcatt

SEQ ID NO: 9513112 - DNA, 22 bp, Homo sapiens
tgttaatatactaaaatccact

SEQ ID NO: 9513113 - DNA, 18 bp, Homo sapiens
tgttaaggatccagtagt

SEQ ID NO: 9513114 - DNA, 22 bp, Homo sapiens
tgttaaggagacacatgaaaaa

SEQ ID NO: 9513115 - DNA, 22 bp, Homo sapiens
tgttaagggtaaacagcagtaa

SEQ ID NO: 9513116 - DNA, 22 bp, Homo sapiens
tgttaaggtcctgacttctgca

SEQ ID NO: 9513117 - DNA, 22 bp, Homo sapiens
tgttaaggggatatagcagggc

SEQ ID NO: 9513118 - DNA, 22 bp, Homo sapiens
cctgggctgtacctgtgcgcgg

SEQ ID NO: 9513119 - DNA, 21 bp, Homo sapiens
cctgggctgtggtttggagac

SEQ ID NO: 9513120 - DNA, 22 bp, Homo sapiens
cctgggctgggcgtctcatggg

SEQ ID NO: 9513121 - DNA, 22 bp, Homo sapiens
cctgggctgttgcatcatcctt

SEQ ID NO: 9513122 - DNA, 22 bp, Homo sapiens
cctgggctgttgcatcatcctt

SEQ ID NO: 9513123 - DNA, 22 bp, Homo sapiens
cctgggctgttgcatcatcctt

SEQ ID NO: 9513124 - DNA, 22 bp, Homo sapiens
cctgggcttacgacctctgact

SEQ ID NO: 9513125 - DNA, 22 bp, Homo sapiens
cctgggcttacgacctctgact

SEQ ID NO: 9513126 - DNA, 22 bp, Homo sapiens
cctgggctgctcatggggatga

SEQ ID NO: 9513127 - DNA, 22 bp, Homo sapiens
cctgggctgctcatggggatga

SEQ ID NO: 9513128 - DNA, 22 bp, Homo sapiens
cctgggctgctcatggggatga

SEQ ID NO: 9513129 - DNA, 22 bp, Homo sapiens
cctgggctgcatgatggcattt

SEQ ID NO: 9513130 - DNA, 22 bp, Homo sapiens
cctgggctgctcatggggatga

SEQ ID NO: 9513131 - DNA, 22 bp, Homo sapiens
cctgggctggagtacagcagtg

SEQ ID NO: 9513132 - DNA, 22 bp, Homo sapiens
cctgggctggagtacagcagtg

SEQ ID NO: 9513133 - DNA, 16 bp, Homo sapiens
cctgggctctgttgga

SEQ ID NO: 9513134 - DNA, 16 bp, Homo sapiens
cctgggctctgttgga

SEQ ID NO: 9513135 - DNA, 16 bp, Homo sapiens
cctgggctctgttgga

SEQ ID NO: 9513136 - DNA, 22 bp, Homo sapiens
cctgggctctgtcagaattggg

SEQ ID NO: 9513137 - DNA, 22 bp, Homo sapiens
cctgggctctgtcagaattggg

SEQ ID NO: 9513138 - DNA, 22 bp, Homo sapiens
cctgggctgaagtcaagtgtgg

SEQ ID NO: 9513139 - DNA, 22 bp, Homo sapiens
cctgggctgaagtcaagtgtgg

SEQ ID NO: 9513140 - DNA, 22 bp, Homo sapiens
cctgggctgcatgatggcattt

SEQ ID NO: 9513141 - DNA, 22 bp, Homo sapiens
cctgggctgcatgatggcattt

SEQ ID NO: 9513142 - DNA, 22 bp, Homo sapiens
tgtgtctggataggtaatggat

SEQ ID NO: 9513143 - DNA, 22 bp, Homo sapiens
tgtgtctggaccggggaggagc

SEQ ID NO: 9513144 - DNA, 22 bp, Homo sapiens
cctgggctctatcctgacccag

SEQ ID NO: 9513145 - DNA, 22 bp, Homo sapiens
cctgggctcaagtgatcctcct

SEQ ID NO: 9513146 - DNA, 22 bp, Homo sapiens
cctgggctctatcctgacccag

SEQ ID NO: 9513147 - DNA, 22 bp, Homo sapiens
cctgggctctatcctgacccag

SEQ ID NO: 9513148 - DNA, 22 bp, Homo sapiens
cctgggctctgaggagggagtc

SEQ ID NO: 9513149 - DNA, 22 bp, Homo sapiens
cctgggctctgaggagggagtc

SEQ ID NO: 9513150 - DNA, 22 bp, Homo sapiens
cctgggctctgaggagggagtc

SEQ ID NO: 9513151 - DNA, 22 bp, Homo sapiens
cctgggctctgaggagggagtc

SEQ ID NO: 9513152 - DNA, 22 bp, Homo sapiens
cctgggctctgaggagggagtc

SEQ ID NO: 9513153 - DNA, 22 bp, Homo sapiens
tgtgtagctttcttctgtgggg

SEQ ID NO: 9513154 - DNA, 22 bp, Homo sapiens
tgtgggtgatgaatttgttctt

SEQ ID NO: 9513155 - DNA, 20 bp, Homo sapiens
tgtgtataaatatatgtttc

SEQ ID NO: 9513156 - DNA, 22 bp, Homo sapiens
tgtgggtgatgaatttgttctt

SEQ ID NO: 9513157 - DNA, 22 bp, Homo sapiens
tgtgggtcctcctgtgtgcccg

SEQ ID NO: 9513158 - DNA, 22 bp, Homo sapiens
cctgggcaatatagtgaggccc

SEQ ID NO: 9513159 - DNA, 22 bp, Homo sapiens
cctgggcaacatagtgagacct

SEQ ID NO: 9513160 - DNA, 22 bp, Homo sapiens
cctgggcaacatagggagaccc

SEQ ID NO: 9513161 - DNA, 22 bp, Homo sapiens
cctgggcaaatgccagagacaa

SEQ ID NO: 9513162 - DNA, 22 bp, Homo sapiens
cctgggcaacatagtgagaccc

SEQ ID NO: 9513163 - DNA, 22 bp, Homo sapiens
cctgggcaacatagggagaccc

SEQ ID NO: 9513164 - DNA, 22 bp, Homo sapiens
cctgggcaacatagtgagacct

SEQ ID NO: 9513165 - DNA, 22 bp, Homo sapiens
cctgggcaacatagtgagaccc

SEQ ID NO: 9513166 - DNA, 22 bp, Homo sapiens
tgtgtctctttgtcctagagct

SEQ ID NO: 9513167 - DNA, 22 bp, Homo sapiens
tgtgtctgaacatgctttgtaa

SEQ ID NO: 9513168 - DNA, 22 bp, Homo sapiens
tgtgtctgaacatgctttgtaa

SEQ ID NO: 9513169 - DNA, 22 bp, Homo sapiens
tgtgtctgaactagttgctctc

SEQ ID NO: 9513170 - DNA, 19 bp, Homo sapiens
tgtgtctctgtgtagcctg

SEQ ID NO: 9513171 - DNA, 22 bp, Homo sapiens
tgtgtctctcctggaagcacgt

SEQ ID NO: 9513172 - DNA, 22 bp, Homo sapiens
tgtgtctgcactgagtcctcac

SEQ ID NO: 9513173 - DNA, 23 bp, Homo sapiens
tgtgtctgaggatatatgtgcat

SEQ ID NO: 9513174 - DNA, 22 bp, Homo sapiens
tgtgtctgcactgagtcctcac

SEQ ID NO: 9513175 - DNA, 22 bp, Homo sapiens
tgtgtctgcccttagtacatct

SEQ ID NO: 9513176 - DNA, 22 bp, Homo sapiens
tgtgtctgcactgagtcctcac

SEQ ID NO: 9513177 - DNA, 22 bp, Homo sapiens
tgtgtctgaactagttgctctc

SEQ ID NO: 9513178 - DNA, 22 bp, Homo sapiens
tgtgtctgaactagttgctctc

SEQ ID NO: 9513179 - DNA, 23 bp, Homo sapiens
tgtgtctgaggatatatgtgcat

SEQ ID NO: 9513180 - DNA, 23 bp, Homo sapiens
tgtgtctgaggatatatgtgcat

SEQ ID NO: 9513181 - DNA, 22 bp, Homo sapiens
tgtgtatattaggacacattct

SEQ ID NO: 9513182 - DNA, 23 bp, Homo sapiens
tgtgtatgtatctatgcataggt

SEQ ID NO: 9513183 - DNA, 23 bp, Homo sapiens
tgtgtatgtatctatgcataggt

SEQ ID NO: 9513184 - DNA, 20 bp, Homo sapiens
tgtgtatgtgcacatgcgaa

SEQ ID NO: 9513185 - DNA, 22 bp, Homo sapiens
tgtgtctcaagtcagagcatca

SEQ ID NO: 9513186 - DNA, 22 bp, Homo sapiens
tgtgtattaatgtttgtatatg

SEQ ID NO: 9513187 - DNA, 22 bp, Homo sapiens
tgtgtattaatgtttgtatatg

SEQ ID NO: 9513188 - DNA, 22 bp, Homo sapiens
tggggcagggatgggaaactat

SEQ ID NO: 9513189 - DNA, 22 bp, Homo sapiens
tggggcagggatgggaaactat

SEQ ID NO: 9513190 - DNA, 22 bp, Homo sapiens
tggggcagtggcttttcaccct

SEQ ID NO: 9513191 - DNA, 22 bp, Homo sapiens
tggggcagtggcttttcaccct

SEQ ID NO: 9513192 - DNA, 22 bp, Homo sapiens
tggggcagccacatagacaaca

SEQ ID NO: 9513193 - DNA, 22 bp, Homo sapiens
tggggcagccacatagacaaca

SEQ ID NO: 9513194 - DNA, 22 bp, Homo sapiens
tggggcagctccatctattcca

SEQ ID NO: 9513195 - DNA, 22 bp, Homo sapiens
tggggcagctccatctattcca

SEQ ID NO: 9513196 - DNA, 22 bp, Homo sapiens
tggggcagctccatctattcca

SEQ ID NO: 9513197 - DNA, 22 bp, Homo sapiens
tggggccaagaaggtctcatgt

SEQ ID NO: 9513198 - DNA, 22 bp, Homo sapiens
tggggcatgtgaacctggatgt

SEQ ID NO: 9513199 - DNA, 22 bp, Homo sapiens
tggggctgtccttagtctgaga

SEQ ID NO: 9513200 - DNA, 23 bp, Homo sapiens
tggggccaagtgaggaagggtct

SEQ ID NO: 9513201 - DNA, 23 bp, Homo sapiens
tggggccaagtgaggaagggtct

SEQ ID NO: 9513202 - DNA, 22 bp, Homo sapiens
tggggctgtgagactacaggat

SEQ ID NO: 9513203 - DNA, 22 bp, Homo sapiens
tggggctgtgagactacaggat

SEQ ID NO: 9513204 - DNA, 22 bp, Homo sapiens
tggggctgtgagactacaggat

SEQ ID NO: 9513205 - DNA, 22 bp, Homo sapiens
tggggctgtgagactacaggat

SEQ ID NO: 9513206 - DNA, 22 bp, Homo sapiens
tggggctgtgagactacaggat

SEQ ID NO: 9513207 - DNA, 22 bp, Homo sapiens
tggggctgtggattctcacgaa

SEQ ID NO: 9513208 - DNA, 22 bp, Homo sapiens
tggggctgtggattctcacgaa

SEQ ID NO: 9513209 - DNA, 22 bp, Homo sapiens
tgggggaagagcttgttaaagt

SEQ ID NO: 9513210 - DNA, 22 bp, Homo sapiens
tgggggaagagcttgttaaagt

SEQ ID NO: 9513211 - DNA, 21 bp, Homo sapiens
tgggggagaattggttgcttt

SEQ ID NO: 9513212 - DNA, 21 bp, Homo sapiens
tgggggagaattggttgcttt

SEQ ID NO: 9513213 - DNA, 21 bp, Homo sapiens
tgggggagaattggttgcttt

SEQ ID NO: 9513214 - DNA, 21 bp, Homo sapiens
tgggggagaattggttgcttt

SEQ ID NO: 9513215 - DNA, 22 bp, Homo sapiens
cctgggaggctgaggctgcagt

SEQ ID NO: 9513216 - DNA, 22 bp, Homo sapiens
cctgggaggtggatgttgcggt

SEQ ID NO: 9513217 - DNA, 19 bp, Homo sapiens
cctgggagtcagctgaagg

SEQ ID NO: 9513218 - DNA, 19 bp, Homo sapiens
cctgggagtcagctgaagg

SEQ ID NO: 9513219 - DNA, 22 bp, Homo sapiens
cctgggagtggcactcacagca

SEQ ID NO: 9513220 - DNA, 22 bp, Homo sapiens
cctgggagtggcactcacagca

SEQ ID NO: 9513221 - DNA, 22 bp, Homo sapiens
cctgggagtggcactcacagca

SEQ ID NO: 9513222 - DNA, 22 bp, Homo sapiens
cctgggagtggcactcacagca

SEQ ID NO: 9513223 - DNA, 22 bp, Homo sapiens
cctgggagtgtgccatctctgt

SEQ ID NO: 9513224 - DNA, 22 bp, Homo sapiens
cctgggagtgtgccatctctgt

SEQ ID NO: 9513225 - DNA, 22 bp, Homo sapiens
cctgggagtgtcagacttgctt

SEQ ID NO: 9513226 - DNA, 22 bp, Homo sapiens
cctgggagtgtcagacttgctt

SEQ ID NO: 9513227 - DNA, 22 bp, Homo sapiens
ttcaagttttatattgaagcaa

SEQ ID NO: 9513228 - DNA, 22 bp, Homo sapiens
ttcaagttttcagaatagccac

SEQ ID NO: 9513229 - DNA, 22 bp, Homo sapiens
ttcaagtttgtatttctgtatt

SEQ ID NO: 9513230 - DNA, 22 bp, Homo sapiens
ttcaagttgtgttttccgggct

SEQ ID NO: 9513231 - DNA, 22 bp, Homo sapiens
ttcaagtttactttgaagttta

SEQ ID NO: 9513232 - DNA, 20 bp, Homo sapiens
ttcaagttgggtctctggct

SEQ ID NO: 9513233 - DNA, 20 bp, Homo sapiens
ttcaagttgggtctctggct

SEQ ID NO: 9513234 - DNA, 20 bp, Homo sapiens
ttcaagttgggtctctggct

SEQ ID NO: 9513235 - DNA, 22 bp, Homo sapiens
ttcaagttctagtgttcacttc

SEQ ID NO: 9513236 - DNA, 22 bp, Homo sapiens
ttcaagttctgtggagagctgt

SEQ ID NO: 9513237 - DNA, 22 bp, Homo sapiens
ttcaagttagagatatatttag

SEQ ID NO: 9513238 - DNA, 22 bp, Homo sapiens
ttcaagttacctttaaacagct

SEQ ID NO: 9513239 - DNA, 22 bp, Homo sapiens
ttcaagttaatgattctggttt

SEQ ID NO: 9513240 - DNA, 22 bp, Homo sapiens
ttcaataggatgcatgatataa

SEQ ID NO: 9513241 - DNA, 22 bp, Homo sapiens
ttcaatatcattgtttagtctc

SEQ ID NO: 9513242 - DNA, 22 bp, Homo sapiens
ttcacaatttcccttcatcagg

SEQ ID NO: 9513243 - DNA, 19 bp, Homo sapiens
ttcacaattatgaaattag

SEQ ID NO: 9513244 - DNA, 22 bp, Homo sapiens
ttcaatacaaagaaaggaattt

SEQ ID NO: 9513245 - DNA, 22 bp, Homo sapiens
ttcaatacaccataggaatagt

SEQ ID NO: 9513246 - DNA, 21 bp, Homo sapiens
ttcaatactatttcaatagtc

SEQ ID NO: 9513247 - DNA, 22 bp, Homo sapiens
ttcaatagaaagtccctagtta

SEQ ID NO: 9513248 - DNA, 22 bp, Homo sapiens
ttcaatagcatacttttgctct

SEQ ID NO: 9513249 - DNA, 22 bp, Homo sapiens
ttcaatagaaatgacattcttt

SEQ ID NO: 9513250 - DNA, 22 bp, Homo sapiens
ttcacacagcaactgtatgaat

SEQ ID NO: 9513251 - DNA, 22 bp, Homo sapiens
ttcacacagaatctgaggagct

SEQ ID NO: 9513252 - DNA, 22 bp, Homo sapiens
ttcacacagaatctgaggagct

SEQ ID NO: 9513253 - DNA, 22 bp, Homo sapiens
ttcacaatttcccttcatcagg

SEQ ID NO: 9513254 - DNA, 19 bp, Homo sapiens
ttcacaattatgaaattag

SEQ ID NO: 9513255 - DNA, 22 bp, Homo sapiens
ttcacaatttcccttcatcagg

SEQ ID NO: 9513256 - DNA, 22 bp, Homo sapiens
ttcacaatttcccttcatcagg

SEQ ID NO: 9513257 - DNA, 22 bp, Homo sapiens
ttcacacacagcttcctattgt

SEQ ID NO: 9513258 - DNA, 22 bp, Homo sapiens
cgcccagggcaggaggccgctc

SEQ ID NO: 9513259 - DNA, 22 bp, Homo sapiens
cgcccagggcaggaggccgctc

SEQ ID NO: 9513260 - DNA, 22 bp, Homo sapiens
cgcccagggcaggaggccgctc

SEQ ID NO: 9513261 - DNA, 22 bp, Homo sapiens
cgcccaggctggagtgcagtgg

SEQ ID NO: 9513262 - DNA, 22 bp, Homo sapiens
cgcccaggctggagtgcagtgg

SEQ ID NO: 9513263 - DNA, 22 bp, Homo sapiens
cgccccagatgcaagacaaaga

SEQ ID NO: 9513264 - DNA, 22 bp, Homo sapiens
cgccccagtctgtaggtgcccc

SEQ ID NO: 9513265 - DNA, 22 bp, Homo sapiens
cgcccagggcaggaggccgctc

SEQ ID NO: 9513266 - DNA, 20 bp, Homo sapiens
cgcccagtgcggttctgacc

SEQ ID NO: 9513267 - DNA, 20 bp, Homo sapiens
cgcccaggagggcccatgtg

SEQ ID NO: 9513268 - DNA, 22 bp, Homo sapiens
cgcccaggctggagagcagtgg

SEQ ID NO: 9513269 - DNA, 22 bp, Homo sapiens
cgcccaggctggagagcagtgg

SEQ ID NO: 9513270 - DNA, 20 bp, Homo sapiens
cgcccaggagggcccatgtg

SEQ ID NO: 9513271 - DNA, 22 bp, Homo sapiens
cgcccagctgaaatctccaggc

SEQ ID NO: 9513272 - DNA, 22 bp, Homo sapiens
cgcccagctgaaatctccaggc

SEQ ID NO: 9513273 - DNA, 22 bp, Homo sapiens
cgcccagctgaaatctccaggc

SEQ ID NO: 9513274 - DNA, 22 bp, Homo sapiens
cgcccaggctggagagcagtgg

SEQ ID NO: 9513275 - DNA, 22 bp, Homo sapiens
cgcccaggctggagagcagtgg

SEQ ID NO: 9513276 - DNA, 22 bp, Homo sapiens
cgcccaggctggagtgcagtga

SEQ ID NO: 9513277 - DNA, 22 bp, Homo sapiens
cgcccaggctggagtgcagtga

SEQ ID NO: 9513278 - DNA, 22 bp, Homo sapiens
ttcaagtctggagatctggaac

SEQ ID NO: 9513279 - DNA, 22 bp, Homo sapiens
ttcaagttaactctccttgtac

SEQ ID NO: 9513280 - DNA, 22 bp, Homo sapiens
ttcaagtgaggctgtctttaga

SEQ ID NO: 9513281 - DNA, 22 bp, Homo sapiens
ttcaaatttggtatgcaagcca

SEQ ID NO: 9513282 - DNA, 22 bp, Homo sapiens
ttcaaattaccacatttgctta

SEQ ID NO: 9513283 - DNA, 22 bp, Homo sapiens
cgccgcctgctgcagcagctgt

SEQ ID NO: 9513284 - DNA, 22 bp, Homo sapiens
cgccctccacacagcccctggc

SEQ ID NO: 9513285 - DNA, 22 bp, Homo sapiens
cgccccagtctgtaggtgcccc

SEQ ID NO: 9513286 - DNA, 22 bp, Homo sapiens
cgccccagtctgtaggtgcccc

SEQ ID NO: 9513287 - DNA, 22 bp, Homo sapiens
cgccccggacgtctgaccaaac

SEQ ID NO: 9513288 - DNA, 20 bp, Homo sapiens
cgcccagtgcggttctgacc

SEQ ID NO: 9513289 - DNA, 22 bp, Homo sapiens
cgccaggcttggtagctcatgc

SEQ ID NO: 9513290 - DNA, 22 bp, Homo sapiens
cgccaggcttggtagctcatgc

SEQ ID NO: 9513291 - DNA, 23 bp, Homo sapiens
cgcccagcctcagtgacctgggc

SEQ ID NO: 9513292 - DNA, 22 bp, Homo sapiens
cgcatccagggcgcaggatctg

SEQ ID NO: 9513293 - DNA, 22 bp, Homo sapiens
cgcatccagggcgcaggatctg

SEQ ID NO: 9513294 - DNA, 22 bp, Homo sapiens
cgccaggcttggtagctcatgc

SEQ ID NO: 9513295 - DNA, 22 bp, Homo sapiens
cgcatgagacctgccggccatc

SEQ ID NO: 9513296 - DNA, 22 bp, Homo sapiens
cgcatgtgcgttgattgcagtg

SEQ ID NO: 9513297 - DNA, 22 bp, Homo sapiens
cgcagtgagtctgtaaaaggct

SEQ ID NO: 9513298 - DNA, 22 bp, Homo sapiens
cgcagctggatatcatgtgcct

SEQ ID NO: 9513299 - DNA, 22 bp, Homo sapiens
cgcagctgctgctctgaaacag

SEQ ID NO: 9513300 - DNA, 22 bp, Homo sapiens
ttaggcaattttgtcattgtgt

SEQ ID NO: 9513301 - DNA, 22 bp, Homo sapiens
ttaggcaatttgatttttcaag

SEQ ID NO: 9513302 - DNA, 22 bp, Homo sapiens
ttaggcaatgaattattccaag

SEQ ID NO: 9513303 - DNA, 22 bp, Homo sapiens
ttaggcaaataaaatgtttcca

SEQ ID NO: 9513304 - DNA, 22 bp, Homo sapiens
ttaggcaatgaattattccaag

SEQ ID NO: 9513305 - DNA, 22 bp, Homo sapiens
ttaggcaaagatattacgtagt

SEQ ID NO: 9513306 - DNA, 22 bp, Homo sapiens
ttaggatttgaaaaggggcaga

SEQ ID NO: 9513307 - DNA, 22 bp, Homo sapiens
ttaggctctctgcaactaagta

SEQ ID NO: 9513308 - DNA, 22 bp, Homo sapiens
ttaggctcacatgctagatttg

SEQ ID NO: 9513309 - DNA, 22 bp, Homo sapiens
ttaggctgttcttgtgttgtta

SEQ ID NO: 9513310 - DNA, 22 bp, Homo sapiens
cgcagctgcacggggctgagcc

SEQ ID NO: 9513311 - DNA, 22 bp, Homo sapiens
cgcagctgccttgtcagccgtt

SEQ ID NO: 9513312 - DNA, 20 bp, Homo sapiens
ttaggaagtcacaatttcag

SEQ ID NO: 9513313 - DNA, 22 bp, Homo sapiens
ttaggaatatgtattttaaagt

SEQ ID NO: 9513314 - DNA, 22 bp, Homo sapiens
ttaggaatatagactaagtaga

SEQ ID NO: 9513315 - DNA, 22 bp, Homo sapiens
ttaggaatgagatttctagtga

SEQ ID NO: 9513316 - DNA, 22 bp, Homo sapiens
ttaggaatgagatttctagtga

SEQ ID NO: 9513317 - DNA, 22 bp, Homo sapiens
cctttctctttgctgatcatgt

SEQ ID NO: 9513318 - DNA, 17 bp, Homo sapiens
cctttctctttcatctc

SEQ ID NO: 9513319 - DNA, 22 bp, Homo sapiens
cctttctctggcagcaggacag

SEQ ID NO: 9513320 - DNA, 22 bp, Homo sapiens
cctttctctatcgacccatcgc

SEQ ID NO: 9513321 - DNA, 22 bp, Homo sapiens
cctttcctgcctcaggaagtag

SEQ ID NO: 9513322 - DNA, 16 bp, Homo sapiens
cctttctctgccttcc

SEQ ID NO: 9513323 - DNA, 22 bp, Homo sapiens
cctttctctatcgacccatcgc

SEQ ID NO: 9513324 - DNA, 18 bp, Homo sapiens
cctttcctcccctcagct

SEQ ID NO: 9513325 - DNA, 22 bp, Homo sapiens
cctttcctgcctcaggaagtag

SEQ ID NO: 9513326 - DNA, 18 bp, Homo sapiens
cctttcctcccctcagct

SEQ ID NO: 9513327 - DNA, 22 bp, Homo sapiens
cctttccccgcgggaggtgcca

SEQ ID NO: 9513328 - DNA, 22 bp, Homo sapiens
cctttcccgctttgagggcaag

SEQ ID NO: 9513329 - DNA, 22 bp, Homo sapiens
cgtcacttcttagtctattttc

SEQ ID NO: 9513330 - DNA, 22 bp, Homo sapiens
cgtatttagaaggctgctgaaa

SEQ ID NO: 9513331 - DNA, 22 bp, Homo sapiens
cgtattcactcaggacacatag

SEQ ID NO: 9513332 - DNA, 22 bp, Homo sapiens
cgtatttagaaggctgctgaaa

SEQ ID NO: 9513333 - DNA, 22 bp, Homo sapiens
cgtcacttcttagtctattttc

SEQ ID NO: 9513334 - DNA, 22 bp, Homo sapiens
cgtcacttcttagtctattttc

SEQ ID NO: 9513335 - DNA, 21 bp, Homo sapiens
ttcatcattggtaaaaagtgg

SEQ ID NO: 9513336 - DNA, 22 bp, Homo sapiens
ttcatccatatgcagagagctt

SEQ ID NO: 9513337 - DNA, 22 bp, Homo sapiens
ttcatccatatgcagagagctt

SEQ ID NO: 9513338 - DNA, 22 bp, Homo sapiens
ttcatctgcttcttgattttgc

SEQ ID NO: 9513339 - DNA, 22 bp, Homo sapiens
ttcatctgcttcttcctattcc

SEQ ID NO: 9513340 - DNA, 22 bp, Homo sapiens
ttcatctggaagttcccaaggc

SEQ ID NO: 9513341 - DNA, 22 bp, Homo sapiens
ttcatctggaagttcccaaggc

SEQ ID NO: 9513342 - DNA, 21 bp, Homo sapiens
ttcatctggccgtattccagg

SEQ ID NO: 9513343 - DNA, 22 bp, Homo sapiens
ttcatctggaatttatgttata

SEQ ID NO: 9513344 - DNA, 21 bp, Homo sapiens
ttcatctggccgtattccagg

SEQ ID NO: 9513345 - DNA, 22 bp, Homo sapiens
ttcatctgtacgccaagtactc

SEQ ID NO: 9513346 - DNA, 22 bp, Homo sapiens
ttcatctgtagcatcttccaat

SEQ ID NO: 9513347 - DNA, 22 bp, Homo sapiens
ttcatgaaacttaactgttggg

SEQ ID NO: 9513348 - DNA, 22 bp, Homo sapiens
ttcatgaaacttaactgttggg

SEQ ID NO: 9513349 - DNA, 22 bp, Homo sapiens
ttcatgaaagacagcaactgtg

SEQ ID NO: 9513350 - DNA, 22 bp, Homo sapiens
cggtgcccggtgccaggcgcgg

SEQ ID NO: 9513351 - DNA, 22 bp, Homo sapiens
cggtctcccgtgtgtgtgcgct

SEQ ID NO: 9513352 - DNA, 22 bp, Homo sapiens
cggtctcccgtgtgtgtgcgct

SEQ ID NO: 9513353 - DNA, 22 bp, Homo sapiens
cggtctcccgtgtgtgtgcgct

SEQ ID NO: 9513354 - DNA, 22 bp, Homo sapiens
cggtctcccgtgtgtgtgcgct

SEQ ID NO: 9513355 - DNA, 22 bp, Homo sapiens
cggtcctggcacttgcggctcc

SEQ ID NO: 9513356 - DNA, 22 bp, Homo sapiens
cggtcctgtacttgatgagata

SEQ ID NO: 9513357 - DNA, 22 bp, Homo sapiens
cggtggctcaggcccccagcag

SEQ ID NO: 9513358 - DNA, 22 bp, Homo sapiens
ctaaagataaggaaagtatcct

SEQ ID NO: 9513359 - DNA, 22 bp, Homo sapiens
ctaaagaagctagcaatctata

SEQ ID NO: 9513360 - DNA, 22 bp, Homo sapiens
ctaaatactagccttcagattt

SEQ ID NO: 9513361 - DNA, 22 bp, Homo sapiens
ctaaatcaggccttacagcttc

SEQ ID NO: 9513362 - DNA, 17 bp, Homo sapiens
ctaaatacttgcgtttc

SEQ ID NO: 9513363 - DNA, 22 bp, Homo sapiens
ctaaataatccctctggtctta

SEQ ID NO: 9513364 - DNA, 22 bp, Homo sapiens
ctaaataatccctctggtctta

SEQ ID NO: 9513365 - DNA, 22 bp, Homo sapiens
ctaaataatccctctggtctta

SEQ ID NO: 9513366 - DNA, 22 bp, Homo sapiens
ctaaataatccctctggtctta

SEQ ID NO: 9513367 - DNA, 22 bp, Homo sapiens
ctaaataatccctctggtctta

SEQ ID NO: 9513368 - DNA, 22 bp, Homo sapiens
ctaaaaatccacactaggtgaa

SEQ ID NO: 9513369 - DNA, 22 bp, Homo sapiens
ctaaaaatccacactaggtgaa

SEQ ID NO: 9513370 - DNA, 22 bp, Homo sapiens
ttcatgaatgttccatgtgagt

SEQ ID NO: 9513371 - DNA, 22 bp, Homo sapiens
ttcatgaatgttccatgtgagt

SEQ ID NO: 9513372 - DNA, 22 bp, Homo sapiens
ttcatgaatgttccatgtgagt

SEQ ID NO: 9513373 - DNA, 22 bp, Homo sapiens
ttcatgaatggaatcaatgctc

SEQ ID NO: 9513374 - DNA, 22 bp, Homo sapiens
ctaaaattacctaccagtttag

SEQ ID NO: 9513375 - DNA, 22 bp, Homo sapiens
ctaaaattacctaccagtttag

SEQ ID NO: 9513376 - DNA, 22 bp, Homo sapiens
ttcatgaacgaacatatgtata

SEQ ID NO: 9513377 - DNA, 22 bp, Homo sapiens
ttcatgaacgaacatatgtata

SEQ ID NO: 9513378 - DNA, 22 bp, Homo sapiens
ttcatgaacgaacatatgtata

SEQ ID NO: 9513379 - DNA, 22 bp, Homo sapiens
ttcatgaagggtgaatatagtc

SEQ ID NO: 9513380 - DNA, 22 bp, Homo sapiens
ttcatgaaagtgtatcttgtgg

SEQ ID NO: 9513381 - DNA, 22 bp, Homo sapiens
ttcatgaacgaacatatgtata

SEQ ID NO: 9513382 - DNA, 22 bp, Homo sapiens
ttcatgaacgaacatatgtata

SEQ ID NO: 9513383 - DNA, 22 bp, Homo sapiens
ttcatgaatatattgaattagc

SEQ ID NO: 9513384 - DNA, 22 bp, Homo sapiens
ttcatgaatatattgaattagc

SEQ ID NO: 9513385 - DNA, 22 bp, Homo sapiens
ttcatgaagggtgaatatagtc

SEQ ID NO: 9513386 - DNA, 22 bp, Homo sapiens
ttcagggactttgatgtatcag

SEQ ID NO: 9513387 - DNA, 22 bp, Homo sapiens
ttcagggacttagtgtcagttt

SEQ ID NO: 9513388 - DNA, 22 bp, Homo sapiens
ttcaggcccagcacagcgcgtg

SEQ ID NO: 9513389 - DNA, 22 bp, Homo sapiens
ttcaggcccaacgcacagcttc

SEQ ID NO: 9513390 - DNA, 22 bp, Homo sapiens
ttcaggcctaatttctagcccc

SEQ ID NO: 9513391 - DNA, 22 bp, Homo sapiens
ttcaggcctaatttctagcccc

SEQ ID NO: 9513392 - DNA, 22 bp, Homo sapiens
ttcaggcctctaaagggaaagc

SEQ ID NO: 9513393 - DNA, 22 bp, Homo sapiens
cggtcaggtgcagcgttggcac

SEQ ID NO: 9513394 - DNA, 22 bp, Homo sapiens
cggggctgtagcacagctgagc

SEQ ID NO: 9513395 - DNA, 22 bp, Homo sapiens
ttcagatatcattaatttagta

SEQ ID NO: 9513396 - DNA, 22 bp, Homo sapiens
ttcagattttttaataggtaat

SEQ ID NO: 9513397 - DNA, 22 bp, Homo sapiens
ttcagattttttaataggtaat

SEQ ID NO: 9513398 - DNA, 22 bp, Homo sapiens
ttcagcaaacacgatgcttgtt

SEQ ID NO: 9513399 - DNA, 22 bp, Homo sapiens
ttcaggagtgtcaggagtgcct

SEQ ID NO: 9513400 - DNA, 22 bp, Homo sapiens
ttcaggcatggaaactggatta

SEQ ID NO: 9513401 - DNA, 22 bp, Homo sapiens
ttcaggcccaacgcacagcttc

SEQ ID NO: 9513402 - DNA, 22 bp, Homo sapiens
ttcaggcatggaaactggatta

SEQ ID NO: 9513403 - DNA, 22 bp, Homo sapiens
ttcaggcagctgaggagaaagt

SEQ ID NO: 9513404 - DNA, 22 bp, Homo sapiens
ttcaggcatccctacagttagg

SEQ ID NO: 9513405 - DNA, 22 bp, Homo sapiens
ttcaggatatgtgatatctgaa

SEQ ID NO: 9513406 - DNA, 22 bp, Homo sapiens
ttcaggattatactctcttccc

SEQ ID NO: 9513407 - DNA, 22 bp, Homo sapiens
ttcacagacattgcagactgaa

SEQ ID NO: 9513408 - DNA, 22 bp, Homo sapiens
ttcagaaagtgaatcttgttat

SEQ ID NO: 9513409 - DNA, 22 bp, Homo sapiens
ttcacagaattgtcttgactgg

SEQ ID NO: 9513410 - DNA, 22 bp, Homo sapiens
ttcacagaattgtcttgactgg

SEQ ID NO: 9513411 - DNA, 22 bp, Homo sapiens
ttcagagggacattcaagggaa

SEQ ID NO: 9513412 - DNA, 22 bp, Homo sapiens
ttcacactgtttttcatagtgg

SEQ ID NO: 9513413 - DNA, 22 bp, Homo sapiens
ttcacactgtttttcatagtgg

SEQ ID NO: 9513414 - DNA, 22 bp, Homo sapiens
ttcacactgaatgggactttat

SEQ ID NO: 9513415 - DNA, 22 bp, Homo sapiens
ttcacactctcactccctgacc

SEQ ID NO: 9513416 - DNA, 22 bp, Homo sapiens
ttcacagaatggcaagttatgg

SEQ ID NO: 9513417 - DNA, 22 bp, Homo sapiens
ttcacagaatggcaagttatgg

SEQ ID NO: 9513418 - DNA, 22 bp, Homo sapiens
ttcacagaagaggtcacatttc

SEQ ID NO: 9513419 - DNA, 22 bp, Homo sapiens
ttcacagaagaggtcacatttc

SEQ ID NO: 9513420 - DNA, 22 bp, Homo sapiens
ttcagataaactacaaataatt

SEQ ID NO: 9513421 - DNA, 22 bp, Homo sapiens
ttcagagtggtatgaagtgatg

SEQ ID NO: 9513422 - DNA, 22 bp, Homo sapiens
ttcagagggttttagggtcaga

SEQ ID NO: 9513423 - DNA, 22 bp, Homo sapiens
ttcagagtacacagagatcttc

SEQ ID NO: 9513424 - DNA, 21 bp, Homo sapiens
ttctctggataggccagtcct

SEQ ID NO: 9513425 - DNA, 20 bp, Homo sapiens
ttctctggatagccagatgt

SEQ ID NO: 9513426 - DNA, 22 bp, Homo sapiens
ttctctggactatttgcactcc

SEQ ID NO: 9513427 - DNA, 22 bp, Homo sapiens
ttctctggagagtatcttctta

SEQ ID NO: 9513428 - DNA, 22 bp, Homo sapiens
ttctctggagggctgcccggcc

SEQ ID NO: 9513429 - DNA, 22 bp, Homo sapiens
ttctctggagggctgcccggcc

SEQ ID NO: 9513430 - DNA, 22 bp, Homo sapiens
ttctctaaagagttaggccaag

SEQ ID NO: 9513431 - DNA, 22 bp, Homo sapiens
ttctctggactatttgcactcc

SEQ ID NO: 9513432 - DNA, 19 bp, Homo sapiens
ttctctggactagatgctg

SEQ ID NO: 9513433 - DNA, 22 bp, Homo sapiens
ctacttctgtgatgaaactaca

SEQ ID NO: 9513434 - DNA, 21 bp, Homo sapiens
ctacttaagtaggggattagg

SEQ ID NO: 9513435 - DNA, 21 bp, Homo sapiens
ctacttaagtaggggattagg

SEQ ID NO: 9513436 - DNA, 22 bp, Homo sapiens
ctacttgttcactgtaggtcgc

SEQ ID NO: 9513437 - DNA, 22 bp, Homo sapiens
ctagaaaaatactttattgtga

SEQ ID NO: 9513438 - DNA, 22 bp, Homo sapiens
ctactgtctcatcagtgttatt

SEQ ID NO: 9513439 - DNA, 22 bp, Homo sapiens
ctactgccattgtctctgccat

SEQ ID NO: 9513440 - DNA, 22 bp, Homo sapiens
ctactgtaatagatgaatttga

SEQ ID NO: 9513441 - DNA, 22 bp, Homo sapiens
ctactgccattgtctctgccat

SEQ ID NO: 9513442 - DNA, 22 bp, Homo sapiens
ctactggccatctgatctacaa

SEQ ID NO: 9513443 - DNA, 22 bp, Homo sapiens
ctactctcccatgattctctgt

SEQ ID NO: 9513444 - DNA, 22 bp, Homo sapiens
ctactagatcagtatgcctcaa

SEQ ID NO: 9513445 - DNA, 22 bp, Homo sapiens
ctaccttcaagttcctccctct

SEQ ID NO: 9513446 - DNA, 22 bp, Homo sapiens
ctactgaagataactggctctt

SEQ ID NO: 9513447 - DNA, 22 bp, Homo sapiens
ctactgaaactcagaaattcaa

SEQ ID NO: 9513448 - DNA, 22 bp, Homo sapiens
ctactcttttgagtcttcagat

SEQ ID NO: 9513449 - DNA, 22 bp, Homo sapiens
ctactgaattagactgcatttt

SEQ ID NO: 9513450 - DNA, 22 bp, Homo sapiens
ctacccttaagtttctgtgggg

SEQ ID NO: 9513451 - DNA, 22 bp, Homo sapiens
ctacctgaaaaggttgtggtga

SEQ ID NO: 9513452 - DNA, 22 bp, Homo sapiens
ctacccaggcttagagggctgg

SEQ ID NO: 9513453 - DNA, 22 bp, Homo sapiens
ctacccaggcttagagggctgg

SEQ ID NO: 9513454 - DNA, 22 bp, Homo sapiens
ctacccaggctggagtgcagta

SEQ ID NO: 9513455 - DNA, 21 bp, Homo sapiens
ctaccctcactcccattcctc

SEQ ID NO: 9513456 - DNA, 21 bp, Homo sapiens
ctaccctctcctgctcatatc

SEQ ID NO: 9513457 - DNA, 22 bp, Homo sapiens
ttcctgggctgcagagagcacc

SEQ ID NO: 9513458 - DNA, 22 bp, Homo sapiens
ttcctgggctgcagagagcacc

SEQ ID NO: 9513459 - DNA, 22 bp, Homo sapiens
ttcctgggctgcagagagcacc

SEQ ID NO: 9513460 - DNA, 22 bp, Homo sapiens
ttcctgggctttcccctctggt

SEQ ID NO: 9513461 - DNA, 22 bp, Homo sapiens
ctacatttcatccagggagagc

SEQ ID NO: 9513462 - DNA, 22 bp, Homo sapiens
ctacatttcccagctgccttcc

SEQ ID NO: 9513463 - DNA, 22 bp, Homo sapiens
ctacatttcccagctgccttcc

SEQ ID NO: 9513464 - DNA, 22 bp, Homo sapiens
ctaaatgatattttggtttcct

SEQ ID NO: 9513465 - DNA, 22 bp, Homo sapiens
ttccaggacaagatgtttcagg

SEQ ID NO: 9513466 - DNA, 22 bp, Homo sapiens
ctaaatctagtctttactgatt

SEQ ID NO: 9513467 - DNA, 22 bp, Homo sapiens
ctaaatgacaggtaccatagtg

SEQ ID NO: 9513468 - DNA, 22 bp, Homo sapiens
ctaaatgacttccagtggttat

SEQ ID NO: 9513469 - DNA, 22 bp, Homo sapiens
ttccaggactcgttctggctca

SEQ ID NO: 9513470 - DNA, 22 bp, Homo sapiens
ttccaggactcgttctggctca

SEQ ID NO: 9513471 - DNA, 22 bp, Homo sapiens
ttccaggactgggtgtttgaag

SEQ ID NO: 9513472 - DNA, 22 bp, Homo sapiens
ttccaggactgggtgtttgaag

SEQ ID NO: 9513473 - DNA, 22 bp, Homo sapiens
ttccaggagacttccagaaata

SEQ ID NO: 9513474 - DNA, 22 bp, Homo sapiens
ttccaggagccacacaggggcg

SEQ ID NO: 9513475 - DNA, 22 bp, Homo sapiens
ctacaacatagtcttctacaga

SEQ ID NO: 9513476 - DNA, 22 bp, Homo sapiens
ctacaacatagtcttctacaga

SEQ ID NO: 9513477 - DNA, 22 bp, Homo sapiens
ttccaggatggcaataatgaat

SEQ ID NO: 9513478 - DNA, 22 bp, Homo sapiens
ctacagaggacacaaagatctt

SEQ ID NO: 9513479 - DNA, 22 bp, Homo sapiens
ctacagagaattgtgtgatttt

SEQ ID NO: 9513480 - DNA, 22 bp, Homo sapiens
ttccaggatgctgctgcttttt

SEQ ID NO: 9513481 - DNA, 22 bp, Homo sapiens
ttccaggatgctgctgcttttt

SEQ ID NO: 9513482 - DNA, 22 bp, Homo sapiens
ttccaggaggaggtactagagg

SEQ ID NO: 9513483 - DNA, 22 bp, Homo sapiens
ttccaggaggcattcttagttt

SEQ ID NO: 9513484 - DNA, 22 bp, Homo sapiens
ttccaggaggcactgacagagg

SEQ ID NO: 9513485 - DNA, 22 bp, Homo sapiens
ttccaggaggcattcttagttt

SEQ ID NO: 9513486 - DNA, 22 bp, Homo sapiens
ttcctggctcacagcagtgggg

SEQ ID NO: 9513487 - DNA, 22 bp, Homo sapiens
ctacagtctggcaggaatgtta

SEQ ID NO: 9513488 - DNA, 20 bp, Homo sapiens
ttcctggctctaggaccttg

SEQ ID NO: 9513489 - DNA, 22 bp, Homo sapiens
ttcctggctgaactgaactcct

SEQ ID NO: 9513490 - DNA, 22 bp, Homo sapiens
ttcctggctgtcatgccctagt

SEQ ID NO: 9513491 - DNA, 22 bp, Homo sapiens
ttcctgggactggagcagccca

SEQ ID NO: 9513492 - DNA, 22 bp, Homo sapiens
ttcctgggactggagcagccca

SEQ ID NO: 9513493 - DNA, 22 bp, Homo sapiens
ttcctgggactggagcagccca

SEQ ID NO: 9513494 - DNA, 22 bp, Homo sapiens
ttcctgggagctagccacatct

SEQ ID NO: 9513495 - DNA, 22 bp, Homo sapiens
ttcctgggaggctgtgtacttg

SEQ ID NO: 9513496 - DNA, 22 bp, Homo sapiens
ttcctgggaggctgtgtacttg

SEQ ID NO: 9513497 - DNA, 22 bp, Homo sapiens
ttcctgggattattgtcaagca

SEQ ID NO: 9513498 - DNA, 22 bp, Homo sapiens
ttcctgggaggctgtgtacttg

SEQ ID NO: 9513499 - DNA, 22 bp, Homo sapiens
ttcctgggagctagccacatct

SEQ ID NO: 9513500 - DNA, 22 bp, Homo sapiens
ttcctgggccttaaatcttttg

SEQ ID NO: 9513501 - DNA, 22 bp, Homo sapiens
ttcctgggctctggctggccta

SEQ ID NO: 9513502 - DNA, 22 bp, Homo sapiens
ttcctgggctgcagagagcacc

SEQ ID NO: 9513503 - DNA, 22 bp, Homo sapiens
ttcctgggattattgtcaagca

SEQ ID NO: 9513504 - DNA, 22 bp, Homo sapiens
ttcctgggccttaaatcttttg

SEQ ID NO: 9513505 - DNA, 22 bp, Homo sapiens
ttcctgggcaggacgagagtct

SEQ ID NO: 9513506 - DNA, 22 bp, Homo sapiens
ttcctgggcaggacgagagtct

SEQ ID NO: 9513507 - DNA, 22 bp, Homo sapiens
ctacaggaaggatcttgctcaa

SEQ ID NO: 9513508 - DNA, 22 bp, Homo sapiens
ctacagctgtgtgtttatgtgc

SEQ ID NO: 9513509 - DNA, 22 bp, Homo sapiens
ctacagctgtgtgtttatgtgc

SEQ ID NO: 9513510 - DNA, 22 bp, Homo sapiens
ctacagctggccttggaaaact

SEQ ID NO: 9513511 - DNA, 22 bp, Homo sapiens
ctacagcagagctacactaact

SEQ ID NO: 9513512 - DNA, 22 bp, Homo sapiens
ctacagcagagctacactaact

SEQ ID NO: 9513513 - DNA, 22 bp, Homo sapiens
ctacagcagagaccagccacat

SEQ ID NO: 9513514 - DNA, 23 bp, Homo sapiens
ctacaggttaattttcagtggaa

SEQ ID NO: 9513515 - DNA, 22 bp, Homo sapiens
ctacagtagagaggatgtagaa

SEQ ID NO: 9513516 - DNA, 22 bp, Homo sapiens
ctacaggctcagggagccctct

SEQ ID NO: 9513517 - DNA, 23 bp, Homo sapiens
ctatggaataccaatgattctca

SEQ ID NO: 9513518 - DNA, 23 bp, Homo sapiens
ctatggaataccaatgattctca

SEQ ID NO: 9513519 - DNA, 22 bp, Homo sapiens
ctatggaagggatgcaaagaaa

SEQ ID NO: 9513520 - DNA, 22 bp, Homo sapiens
ctatggaaacctaatcaggaga

SEQ ID NO: 9513521 - DNA, 22 bp, Homo sapiens
ctatggaaactcaacatttgtt

SEQ ID NO: 9513522 - DNA, 22 bp, Homo sapiens
ctatggaaacctaatcaggaga

SEQ ID NO: 9513523 - DNA, 22 bp, Homo sapiens
ctatggaaactcaacatttgtt

SEQ ID NO: 9513524 - DNA, 22 bp, Homo sapiens
ctatgagaagaaaacaagatta

SEQ ID NO: 9513525 - DNA, 17 bp, Homo sapiens
ctatgcattggactgaa

SEQ ID NO: 9513526 - DNA, 22 bp, Homo sapiens
ctatggtctggaccgaggtcct

SEQ ID NO: 9513527 - DNA, 22 bp, Homo sapiens
ctatggctcaattctagtggtt

SEQ ID NO: 9513528 - DNA, 22 bp, Homo sapiens
ctattaaatactcttcaaattg

SEQ ID NO: 9513529 - DNA, 22 bp, Homo sapiens
ctattaaatactcttcaaattg

SEQ ID NO: 9513530 - DNA, 22 bp, Homo sapiens
ctattaaatactcttcaaattg

SEQ ID NO: 9513531 - DNA, 22 bp, Homo sapiens
ctattaaatactcttcaaattg

SEQ ID NO: 9513532 - DNA, 22 bp, Homo sapiens
ctattaaacactactgtgcact

SEQ ID NO: 9513533 - DNA, 22 bp, Homo sapiens
ctattaaacactactgtgcact

SEQ ID NO: 9513534 - DNA, 22 bp, Homo sapiens
ctattaaatactcttcaaattg

SEQ ID NO: 9513535 - DNA, 22 bp, Homo sapiens
ctattaaatactcttcaaattg

SEQ ID NO: 9513536 - DNA, 22 bp, Homo sapiens
ctattaaatactcttcaaattg

SEQ ID NO: 9513537 - DNA, 22 bp, Homo sapiens
ctattacaatctgctactatga

SEQ ID NO: 9513538 - DNA, 18 bp, Homo sapiens
ctattacaatgcagtggt

SEQ ID NO: 9513539 - DNA, 22 bp, Homo sapiens
ctagcagcattcttctagttag

SEQ ID NO: 9513540 - DNA, 22 bp, Homo sapiens
ctagcagctctgatatttacaa

SEQ ID NO: 9513541 - DNA, 22 bp, Homo sapiens
ctagcagcattcttctagttag

SEQ ID NO: 9513542 - DNA, 22 bp, Homo sapiens
ctagcagcatcacaggaagact

SEQ ID NO: 9513543 - DNA, 22 bp, Homo sapiens
ctagcagcatcacaggaagact

SEQ ID NO: 9513544 - DNA, 22 bp, Homo sapiens
ctagccagatttaaagagagac

SEQ ID NO: 9513545 - DNA, 22 bp, Homo sapiens
ctagccagatttaaagagagac

SEQ ID NO: 9513546 - DNA, 22 bp, Homo sapiens
ctagccagatgattcccaaata

SEQ ID NO: 9513547 - DNA, 22 bp, Homo sapiens
ctagccagactcaagggccacc

SEQ ID NO: 9513548 - DNA, 22 bp, Homo sapiens
ttctctggcctgaggcgaggcc

SEQ ID NO: 9513549 - DNA, 22 bp, Homo sapiens
ttctctggcctgaggcgaggcc

SEQ ID NO: 9513550 - DNA, 22 bp, Homo sapiens
ttctctggcggtgtgttttcct

SEQ ID NO: 9513551 - DNA, 22 bp, Homo sapiens
ttctctggcgcgctgtgctatg

SEQ ID NO: 9513552 - DNA, 22 bp, Homo sapiens
ttctctggccatagctggctag

SEQ ID NO: 9513553 - DNA, 22 bp, Homo sapiens
ttctctggccatagctggctag

SEQ ID NO: 9513554 - DNA, 22 bp, Homo sapiens
ttctctggatgtttctcagtca

SEQ ID NO: 9513555 - DNA, 22 bp, Homo sapiens
ttctctggatgtttctcagtca

SEQ ID NO: 9513556 - DNA, 21 bp, Homo sapiens
ttctctggcttctgtagctgg

SEQ ID NO: 9513557 - DNA, 22 bp, Homo sapiens
ttctctggcggtgtgttttcct

SEQ ID NO: 9513558 - DNA, 21 bp, Homo sapiens
ttctctggcttctgtagctgg

SEQ ID NO: 9513559 - DNA, 22 bp, Homo sapiens
ctagatttgcatgcctacacca

SEQ ID NO: 9513560 - DNA, 22 bp, Homo sapiens
ctagcacagtatggtatcagat

SEQ ID NO: 9513561 - DNA, 22 bp, Homo sapiens
ctattagaaagcatcttctata

SEQ ID NO: 9513562 - DNA, 22 bp, Homo sapiens
ctattactgacttctgtattta

SEQ ID NO: 9513563 - DNA, 22 bp, Homo sapiens
ctcaaaatccataaaatcaggt

SEQ ID NO: 9513564 - DNA, 22 bp, Homo sapiens
ctattatttcctcatctataaa

SEQ ID NO: 9513565 - DNA, 22 bp, Homo sapiens
ctattattatgttaactggact

SEQ ID NO: 9513566 - DNA, 22 bp, Homo sapiens
ctcaagatattccagctctcaa

SEQ ID NO: 9513567 - DNA, 22 bp, Homo sapiens
ctcaagcctgctgagttttgga

SEQ ID NO: 9513568 - DNA, 22 bp, Homo sapiens
ctcaaggaaagtctggagaaga

SEQ ID NO: 9513569 - DNA, 22 bp, Homo sapiens
ctcaaggaaagtctggagaaga

SEQ ID NO: 9513570 - DNA, 22 bp, Homo sapiens
ctcaaaatccataaaatcaggt

SEQ ID NO: 9513571 - DNA, 22 bp, Homo sapiens
ctcaagtaagaaacagaattgg

SEQ ID NO: 9513572 - DNA, 22 bp, Homo sapiens
ctcaagttggcatgaacaaatt

SEQ ID NO: 9513573 - DNA, 22 bp, Homo sapiens
ctcaagtttcatatttgtctag

SEQ ID NO: 9513574 - DNA, 22 bp, Homo sapiens
ctcaatatgccagaggggaaag

SEQ ID NO: 9513575 - DNA, 22 bp, Homo sapiens
ctcacaggagaaagtcatggtc

SEQ ID NO: 9513576 - DNA, 22 bp, Homo sapiens
ctcacagctgcttcaggatcca

SEQ ID NO: 9513577 - DNA, 22 bp, Homo sapiens
ctcacagcatggaattttctgg

SEQ ID NO: 9513578 - DNA, 22 bp, Homo sapiens
ctcacagcaaggaggtaaggta

SEQ ID NO: 9513579 - DNA, 22 bp, Homo sapiens
ctcacagcacttgtgtcattgg

SEQ ID NO: 9513580 - DNA, 22 bp, Homo sapiens
ctcacagcagccagtctgcctt

SEQ ID NO: 9513581 - DNA, 22 bp, Homo sapiens
ctcacagcagctctgcgagata

SEQ ID NO: 9513582 - DNA, 22 bp, Homo sapiens
ctcacagcagctctgcgagata

SEQ ID NO: 9513583 - DNA, 22 bp, Homo sapiens
ctcacaggtcatgtggtggctt

SEQ ID NO: 9513584 - DNA, 22 bp, Homo sapiens
ctcacaggttagttgtgtggat

SEQ ID NO: 9513585 - DNA, 22 bp, Homo sapiens
ctcacaggtaccagcaccctcc

SEQ ID NO: 9513586 - DNA, 22 bp, Homo sapiens
ctcacaggcatctcatcaggct

SEQ ID NO: 9513587 - DNA, 22 bp, Homo sapiens
ctcacaggcatctcatcaggct

SEQ ID NO: 9513588 - DNA, 22 bp, Homo sapiens
ctcacaccagcttacaagactt

SEQ ID NO: 9513589 - DNA, 22 bp, Homo sapiens
ctcacacacgaagcccttggcc

SEQ ID NO: 9513590 - DNA, 22 bp, Homo sapiens
ctcaatgtagacctcaacatat

SEQ ID NO: 9513591 - DNA, 22 bp, Homo sapiens
ctcaatacccagggactctaga

SEQ ID NO: 9513592 - DNA, 22 bp, Homo sapiens
ctcaatatgccagaggggaaag

SEQ ID NO: 9513593 - DNA, 22 bp, Homo sapiens
ctcacagagctcatactgggag

SEQ ID NO: 9513594 - DNA, 22 bp, Homo sapiens
ctcacagatacggctattcctg

SEQ ID NO: 9513595 - DNA, 22 bp, Homo sapiens
ctcacagatgttctcctttagg

SEQ ID NO: 9513596 - DNA, 22 bp, Homo sapiens
ctcacagatgctgtgggtcagg

SEQ ID NO: 9513597 - DNA, 22 bp, Homo sapiens
ctcacagatgctgtgggtcagg

SEQ ID NO: 9513598 - DNA, 22 bp, Homo sapiens
ctcacagatgctgtgggtcagg

SEQ ID NO: 9513599 - DNA, 22 bp, Homo sapiens
ctcacagatgatgtctatgtgg

SEQ ID NO: 9513600 - DNA, 22 bp, Homo sapiens
ctcacagatctgtgcctgaacc

SEQ ID NO: 9513601 - DNA, 23 bp, Homo sapiens
ttttagtgactcctttatctgcc

SEQ ID NO: 9513602 - DNA, 22 bp, Homo sapiens
ttttagttactgcagtagcaaa

SEQ ID NO: 9513603 - DNA, 22 bp, Homo sapiens
ctcttagtttgtaaaaataatt

SEQ ID NO: 9513604 - DNA, 22 bp, Homo sapiens
ctcttagtttatctttgacaaa

SEQ ID NO: 9513605 - DNA, 18 bp, Homo sapiens
ctctgtgttggtgtgaag

SEQ ID NO: 9513606 - DNA, 22 bp, Homo sapiens
ctcttattcctacagtaacagg

SEQ ID NO: 9513607 - DNA, 22 bp, Homo sapiens
ctcttattcctacagtaacagg

SEQ ID NO: 9513608 - DNA, 22 bp, Homo sapiens
ctcttattcctacagtaacagg

SEQ ID NO: 9513609 - DNA, 22 bp, Homo sapiens
ctcttattcctacagtaacagg

SEQ ID NO: 9513610 - DNA, 22 bp, Homo sapiens
ctcttattttatggcatttgtg

SEQ ID NO: 9513611 - DNA, 22 bp, Homo sapiens
ctcttattttatggcatttgtg

SEQ ID NO: 9513612 - DNA, 20 bp, Homo sapiens
ctcttattgcattagtttct

SEQ ID NO: 9513613 - DNA, 20 bp, Homo sapiens
ctcttcaaatattttattct

SEQ ID NO: 9513614 - DNA, 20 bp, Homo sapiens
ctcttcaaatattttattct

SEQ ID NO: 9513615 - DNA, 20 bp, Homo sapiens
ctcttcaaatattttattct

SEQ ID NO: 9513616 - DNA, 22 bp, Homo sapiens
ctcttcatgtgtttaattttta

SEQ ID NO: 9513617 - DNA, 22 bp, Homo sapiens
ctcttccacctccttcaggaga

SEQ ID NO: 9513618 - DNA, 22 bp, Homo sapiens
ctcttccatttctacttcacag

SEQ ID NO: 9513619 - DNA, 22 bp, Homo sapiens
ctcttcagttgttgcatattct

SEQ ID NO: 9513620 - DNA, 22 bp, Homo sapiens
ctcttcagttggtcactattct

SEQ ID NO: 9513621 - DNA, 22 bp, Homo sapiens
ctcttcagtaaatgacactgtt

SEQ ID NO: 9513622 - DNA, 22 bp, Homo sapiens
ctcttcaggaatatgtcagtca

SEQ ID NO: 9513623 - DNA, 22 bp, Homo sapiens
ctcttcagatatacagtactct

SEQ ID NO: 9513624 - DNA, 22 bp, Homo sapiens
ctcttcactgagataatcctag

SEQ ID NO: 9513625 - DNA, 22 bp, Homo sapiens
ctcttcaaatgatttccttagg

SEQ ID NO: 9513626 - DNA, 22 bp, Homo sapiens
ctcttcaggtttctgctctgga

SEQ ID NO: 9513627 - DNA, 22 bp, Homo sapiens
ctcttcagtaaatgacactgtt

SEQ ID NO: 9513628 - DNA, 22 bp, Homo sapiens
ctcttcaggatggcttgtgatg

SEQ ID NO: 9513629 - DNA, 22 bp, Homo sapiens
ctcttgtttcctttctgcagtc

SEQ ID NO: 9513630 - DNA, 22 bp, Homo sapiens
ctctttaagctcctaacagcca

SEQ ID NO: 9513631 - DNA, 22 bp, Homo sapiens
ctctttaagctcctaacagcca

SEQ ID NO: 9513632 - DNA, 20 bp, Homo sapiens
ctctttacatgtctcttcct

SEQ ID NO: 9513633 - DNA, 22 bp, Homo sapiens
ctctttagtcacagggcttcat

SEQ ID NO: 9513634 - DNA, 22 bp, Homo sapiens
ctctttagtctgtgtggagaag

SEQ ID NO: 9513635 - DNA, 22 bp, Homo sapiens
ctcttcttgaaagaggaattca

SEQ ID NO: 9513636 - DNA, 22 bp, Homo sapiens
ttttcagttactgtttatgtga

SEQ ID NO: 9513637 - DNA, 22 bp, Homo sapiens
ttttcagttactgtttatgtga

SEQ ID NO: 9513638 - DNA, 22 bp, Homo sapiens
ttttcagtaatgtctacataat

SEQ ID NO: 9513639 - DNA, 22 bp, Homo sapiens
ttttcagtaatgtctacataat

SEQ ID NO: 9513640 - DNA, 22 bp, Homo sapiens
ttttcagtggtatctttgtaaa

SEQ ID NO: 9513641 - DNA, 22 bp, Homo sapiens
ttttcaggccagaagatagacc

SEQ ID NO: 9513642 - DNA, 22 bp, Homo sapiens
ttttcagaattagcataccatt

SEQ ID NO: 9513643 - DNA, 22 bp, Homo sapiens
ttttcaccagcttgctacaatt

SEQ ID NO: 9513644 - DNA, 22 bp, Homo sapiens
ttttcacattgtcccagcacta

SEQ ID NO: 9513645 - DNA, 22 bp, Homo sapiens
ttttcacattgtcccagcacta

SEQ ID NO: 9513646 - DNA, 22 bp, Homo sapiens
ttttcacttaaggaatttcatg

SEQ ID NO: 9513647 - DNA, 22 bp, Homo sapiens
ttttagaatcaggttgtctggg

SEQ ID NO: 9513648 - DNA, 22 bp, Homo sapiens
ttttagaatcaggttgtctggg

SEQ ID NO: 9513649 - DNA, 22 bp, Homo sapiens
ttttagaatcaggttgtctggg

SEQ ID NO: 9513650 - DNA, 22 bp, Homo sapiens
ttttagattataagtctaattc

SEQ ID NO: 9513651 - DNA, 22 bp, Homo sapiens
ttttagatagtttaactgcact

SEQ ID NO: 9513652 - DNA, 22 bp, Homo sapiens
ttttagattataagtctaattc

SEQ ID NO: 9513653 - DNA, 22 bp, Homo sapiens
ttttagattgggaaatgtaaag

SEQ ID NO: 9513654 - DNA, 22 bp, Homo sapiens
ttttagcacactttctttagcg

SEQ ID NO: 9513655 - DNA, 22 bp, Homo sapiens
ttttagattataagtctaattc

SEQ ID NO: 9513656 - DNA, 22 bp, Homo sapiens
ttttagcactaagtgatatgct

SEQ ID NO: 9513657 - DNA, 22 bp, Homo sapiens
ttttagcactaagtgatatgct

SEQ ID NO: 9513658 - DNA, 22 bp, Homo sapiens
ttttagcactaagtgatatgct

SEQ ID NO: 9513659 - DNA, 22 bp, Homo sapiens
ttttagcactaagtgatatgct

SEQ ID NO: 9513660 - DNA, 20 bp, Homo sapiens
ttttagcacttgttatggtg

SEQ ID NO: 9513661 - DNA, 22 bp, Homo sapiens
ttttaagatgctagtatttcag

SEQ ID NO: 9513662 - DNA, 22 bp, Homo sapiens
ttttaagatgctagtatttcag

SEQ ID NO: 9513663 - DNA, 19 bp, Homo sapiens
ttttaagtgccctttcttc

SEQ ID NO: 9513664 - DNA, 19 bp, Homo sapiens
ttttaagtgccctttcttc

SEQ ID NO: 9513665 - DNA, 22 bp, Homo sapiens
ttttaagttaatataattgagg

SEQ ID NO: 9513666 - DNA, 22 bp, Homo sapiens
ttttaagttaatataattgagg

SEQ ID NO: 9513667 - DNA, 22 bp, Homo sapiens
ttttaagttggattgctaagta

SEQ ID NO: 9513668 - DNA, 22 bp, Homo sapiens
ttttaatactgctattgtagga

SEQ ID NO: 9513669 - DNA, 22 bp, Homo sapiens
tttgtacacaggatgttataat

SEQ ID NO: 9513670 - DNA, 22 bp, Homo sapiens
tttgtacacaggtcattcaggg

SEQ ID NO: 9513671 - DNA, 22 bp, Homo sapiens
tttgtacacctacctaatacag

SEQ ID NO: 9513672 - DNA, 22 bp, Homo sapiens
tttgtacacctacctaatacag

SEQ ID NO: 9513673 - DNA, 22 bp, Homo sapiens
tttgtacactgtctactatgaa

SEQ ID NO: 9513674 - DNA, 22 bp, Homo sapiens
tttgggcaattcagtgggacct

SEQ ID NO: 9513675 - DNA, 22 bp, Homo sapiens
tttgtacagtgaaagcgaggtt

SEQ ID NO: 9513676 - DNA, 22 bp, Homo sapiens
tttgtacagtgatgttgtatgc

SEQ ID NO: 9513677 - DNA, 22 bp, Homo sapiens
tttgtacactgtctactatgaa

SEQ ID NO: 9513678 - DNA, 22 bp, Homo sapiens
tttgtacactgtctactatgaa

SEQ ID NO: 9513679 - DNA, 22 bp, Homo sapiens
tttgtacactgtctactatgaa

SEQ ID NO: 9513680 - DNA, 22 bp, Homo sapiens
tttgtacactgtctactatgaa

SEQ ID NO: 9513681 - DNA, 22 bp, Homo sapiens
ttttaagaactgttctgtgctt

SEQ ID NO: 9513682 - DNA, 22 bp, Homo sapiens
tttgttctgaaaactcaagtcc

SEQ ID NO: 9513683 - DNA, 22 bp, Homo sapiens
tttgtacatatataaaatctgt

SEQ ID NO: 9513684 - DNA, 22 bp, Homo sapiens
tttgtacatataaatcttgtat

SEQ ID NO: 9513685 - DNA, 22 bp, Homo sapiens
tttgtacatcctaattctgagt

SEQ ID NO: 9513686 - DNA, 22 bp, Homo sapiens
tttgttctgaaaactcaagtcc

SEQ ID NO: 9513687 - DNA, 22 bp, Homo sapiens
ctctggaatgtttacatgccct

SEQ ID NO: 9513688 - DNA, 22 bp, Homo sapiens
ctctggaattaaggaagcctgt

SEQ ID NO: 9513689 - DNA, 22 bp, Homo sapiens
ctctggaatgtttacatgccct

SEQ ID NO: 9513690 - DNA, 22 bp, Homo sapiens
ctctggaatgggtgtttctaac

SEQ ID NO: 9513691 - DNA, 22 bp, Homo sapiens
ctctggaattaaggaagcctgt

SEQ ID NO: 9513692 - DNA, 22 bp, Homo sapiens
tttggaattggcattctattct

SEQ ID NO: 9513693 - DNA, 22 bp, Homo sapiens
tttggacaaacagaatagagct

SEQ ID NO: 9513694 - DNA, 22 bp, Homo sapiens
tttgggaacaatgaggatctga

SEQ ID NO: 9513695 - DNA, 20 bp, Homo sapiens
tttgggaaatgcaggtttca

SEQ ID NO: 9513696 - DNA, 22 bp, Homo sapiens
tttgggaaataaacctagagga

SEQ ID NO: 9513697 - DNA, 22 bp, Homo sapiens
tttgggaaccagaagttcaaaa

SEQ ID NO: 9513698 - DNA, 22 bp, Homo sapiens
tttgggaacttggttcagggaa

SEQ ID NO: 9513699 - DNA, 22 bp, Homo sapiens
tttgggaaggcagacatcccac

SEQ ID NO: 9513700 - DNA, 19 bp, Homo sapiens
tttgggaagcccagagtgt

SEQ ID NO: 9513701 - DNA, 22 bp, Homo sapiens
tttgggaatagcagggactgag

SEQ ID NO: 9513702 - DNA, 22 bp, Homo sapiens
tttgggaattgtagctgtcttg

SEQ ID NO: 9513703 - DNA, 22 bp, Homo sapiens
ctctggaaaaccactagcagga

SEQ ID NO: 9513704 - DNA, 22 bp, Homo sapiens
ctctggaaatggccatagtcat

SEQ ID NO: 9513705 - DNA, 22 bp, Homo sapiens
ctctggaagaatacacttagaa

SEQ ID NO: 9513706 - DNA, 22 bp, Homo sapiens
ctctggaaaaccactagcagga

SEQ ID NO: 9513707 - DNA, 22 bp, Homo sapiens
tttgctcagttctctgtatttt

SEQ ID NO: 9513708 - DNA, 22 bp, Homo sapiens
tttgctatttttctgtgcagct

SEQ ID NO: 9513709 - DNA, 22 bp, Homo sapiens
tttgctctgacagtgccagaga

SEQ ID NO: 9513710 - DNA, 22 bp, Homo sapiens
tttgctctgctgttgccaggtg

SEQ ID NO: 9513711 - DNA, 22 bp, Homo sapiens
tttgctctgctgttgccaggtg

SEQ ID NO: 9513712 - DNA, 20 bp, Homo sapiens
ctctgctttaggagagtcag

SEQ ID NO: 9513713 - DNA, 22 bp, Homo sapiens
tttgccaggtaagtactatgct

SEQ ID NO: 9513714 - DNA, 22 bp, Homo sapiens
tttgcctctcagagtctacaca

SEQ ID NO: 9513715 - DNA, 22 bp, Homo sapiens
tttgcctgattctaagagctca

SEQ ID NO: 9513716 - DNA, 22 bp, Homo sapiens
tttgccttctctgaacctattt

SEQ ID NO: 9513717 - DNA, 21 bp, Homo sapiens
tttgccttcacgaagcatcct

SEQ ID NO: 9513718 - DNA, 22 bp, Homo sapiens
tttgcctgggaattctagtgta

SEQ ID NO: 9513719 - DNA, 21 bp, Homo sapiens
tttgccttcacgaagcatcct

SEQ ID NO: 9513720 - DNA, 22 bp, Homo sapiens
tttgcctgggaattctagtgta

SEQ ID NO: 9513721 - DNA, 22 bp, Homo sapiens
tttgctattgtgaatagtgcca

SEQ ID NO: 9513722 - DNA, 22 bp, Homo sapiens
tttgctattgtgaatagtgcca

SEQ ID NO: 9513723 - DNA, 22 bp, Homo sapiens
tttgctatttttctgtgcagct

SEQ ID NO: 9513724 - DNA, 22 bp, Homo sapiens
tttgctattgtgaatagtgcca

SEQ ID NO: 9513725 - DNA, 22 bp, Homo sapiens
tttgctataaaagggtcacacg

SEQ ID NO: 9513726 - DNA, 20 bp, Homo sapiens
tttgctatgcatatctgacc

SEQ ID NO: 9513727 - DNA, 20 bp, Homo sapiens
tttgcgaggccaaggcgggc

SEQ ID NO: 9513728 - DNA, 22 bp, Homo sapiens
tttgctaaaaggccattgattt

SEQ ID NO: 9513729 - DNA, 22 bp, Homo sapiens
tttgctaaaatgtattgggatt

SEQ ID NO: 9513730 - DNA, 22 bp, Homo sapiens
tttgctaaaagtgatgaagaca

SEQ ID NO: 9513731 - DNA, 22 bp, Homo sapiens
tttgctaaataagtgattaagt

SEQ ID NO: 9513732 - DNA, 22 bp, Homo sapiens
tttgctaatgcctctgaaatca

SEQ ID NO: 9513733 - DNA, 22 bp, Homo sapiens
ctctgccctcgcacatctgcca

SEQ ID NO: 9513734 - DNA, 22 bp, Homo sapiens
ctctgccctcgcacatctgcca

SEQ ID NO: 9513735 - DNA, 22 bp, Homo sapiens
ctctgccctcgcacatctgcca

SEQ ID NO: 9513736 - DNA, 19 bp, Homo sapiens
ctctgcctccctcctgggt

SEQ ID NO: 9513737 - DNA, 19 bp, Homo sapiens
ctctgcctccctcctgggt

SEQ ID NO: 9513738 - DNA, 22 bp, Homo sapiens
tttgcattttgataagatcact

SEQ ID NO: 9513739 - DNA, 22 bp, Homo sapiens
tttgcaaagtgcttgcagagta

SEQ ID NO: 9513740 - DNA, 22 bp, Homo sapiens
tttgcaaagtgcttgcagagta

SEQ ID NO: 9513741 - DNA, 22 bp, Homo sapiens
tttgcaaagttatttagactca

SEQ ID NO: 9513742 - DNA, 22 bp, Homo sapiens
tttgcaaagtgcttgcagagta

SEQ ID NO: 9513743 - DNA, 20 bp, Homo sapiens
ctctgcccccagactgacag

SEQ ID NO: 9513744 - DNA, 22 bp, Homo sapiens
ctctgcccccagctggtgcttg

SEQ ID NO: 9513745 - DNA, 22 bp, Homo sapiens
ctctgcccccagctggtgcttg

SEQ ID NO: 9513746 - DNA, 22 bp, Homo sapiens
ctctgcccccagctggtgcttg

SEQ ID NO: 9513747 - DNA, 22 bp, Homo sapiens
ctctgcccagtgcccacaggag

SEQ ID NO: 9513748 - DNA, 22 bp, Homo sapiens
ctctgcccagtgcccacaggag

SEQ ID NO: 9513749 - DNA, 22 bp, Homo sapiens
ctctgcccgcggatgccacgtc

SEQ ID NO: 9513750 - DNA, 22 bp, Homo sapiens
ctctgcccgcggatgccacgtc

SEQ ID NO: 9513751 - DNA, 22 bp, Homo sapiens
ctctgcccgcggatgccacgtc

SEQ ID NO: 9513752 - DNA, 22 bp, Homo sapiens
ctctgcccgcggatgccacgtc

SEQ ID NO: 9513753 - DNA, 22 bp, Homo sapiens
ctctgccctcacttggggcctg

SEQ ID NO: 9513754 - DNA, 22 bp, Homo sapiens
ctctgccctcacttggggcctg

SEQ ID NO: 9513755 - DNA, 22 bp, Homo sapiens
ctctgccctcgcacatctgcca

SEQ ID NO: 9513756 - DNA, 22 bp, Homo sapiens
ctctgcccgtgcctttcccagt

SEQ ID NO: 9513757 - DNA, 22 bp, Homo sapiens
ctctgcccgtgcctttcccagt

SEQ ID NO: 9513758 - DNA, 19 bp, Homo sapiens
ctctgccctacagaaagct

SEQ ID NO: 9513759 - DNA, 22 bp, Homo sapiens
tttcctttatgacatcaccact

SEQ ID NO: 9513760 - DNA, 20 bp, Homo sapiens
tttcctttcattttagtacc

SEQ ID NO: 9513761 - DNA, 20 bp, Homo sapiens
tttcctttcattttagtacc

SEQ ID NO: 9513762 - DNA, 22 bp, Homo sapiens
tttccttgttattatttgtcct

SEQ ID NO: 9513763 - DNA, 22 bp, Homo sapiens
tttccttgttattatttgtcct

SEQ ID NO: 9513764 - DNA, 22 bp, Homo sapiens
tttccttgttcatttgccctat

SEQ ID NO: 9513765 - DNA, 22 bp, Homo sapiens
tttcctttccaaaattctgcct

SEQ ID NO: 9513766 - DNA, 22 bp, Homo sapiens
tttcctttccaaaattctgcct

SEQ ID NO: 9513767 - DNA, 22 bp, Homo sapiens
ctctgccaagatgacaggtaag

SEQ ID NO: 9513768 - DNA, 22 bp, Homo sapiens
ctctgccaccatgcttcctgac

SEQ ID NO: 9513769 - DNA, 22 bp, Homo sapiens
ctctgccatcttggagctcaag

SEQ ID NO: 9513770 - DNA, 22 bp, Homo sapiens
ctctgcccacgtcttgcccaga

SEQ ID NO: 9513771 - DNA, 21 bp, Homo sapiens
ctctgcccagggcctcctgcc

SEQ ID NO: 9513772 - DNA, 21 bp, Homo sapiens
ctctgcccagggcctcctgcc

SEQ ID NO: 9513773 - DNA, 21 bp, Homo sapiens
ctctgcccagggcctcctgcc

SEQ ID NO: 9513774 - DNA, 21 bp, Homo sapiens
ctctgcccagggcctcctgcc

SEQ ID NO: 9513775 - DNA, 22 bp, Homo sapiens
ctctgcccacgtcttgcccaga

SEQ ID NO: 9513776 - DNA, 22 bp, Homo sapiens
ctctgcccacgtcttgcccaga

SEQ ID NO: 9513777 - DNA, 21 bp, Homo sapiens
ctctgcccagggcctcctgcc

SEQ ID NO: 9513778 - DNA, 22 bp, Homo sapiens
ctctgccagtttctggcctcag

SEQ ID NO: 9513779 - DNA, 22 bp, Homo sapiens
ctctgccatcttggagctcaag

SEQ ID NO: 9513780 - DNA, 22 bp, Homo sapiens
ctgacagctgaattgcttgcat

SEQ ID NO: 9513781 - DNA, 22 bp, Homo sapiens
ctgacagggtagacagagggca

SEQ ID NO: 9513782 - DNA, 22 bp, Homo sapiens
ctgacagggtagacagagggca

SEQ ID NO: 9513783 - DNA, 22 bp, Homo sapiens
ctgacagattagatgtgcatat

SEQ ID NO: 9513784 - DNA, 22 bp, Homo sapiens
ctgacagcaaaggccagtggct

SEQ ID NO: 9513785 - DNA, 22 bp, Homo sapiens
ctgacagcaaaggccagtggct

SEQ ID NO: 9513786 - DNA, 22 bp, Homo sapiens
ctgacagctcctagtgctcact

SEQ ID NO: 9513787 - DNA, 22 bp, Homo sapiens
ctgacagctcctagtgctcact

SEQ ID NO: 9513788 - DNA, 22 bp, Homo sapiens
ctgacagctgaagggtcccaga

SEQ ID NO: 9513789 - DNA, 22 bp, Homo sapiens
ctgaatattagtcatgtctgat

SEQ ID NO: 9513790 - DNA, 22 bp, Homo sapiens
ctgaatatcatttatcattggc

SEQ ID NO: 9513791 - DNA, 22 bp, Homo sapiens
ctgaatcatggtcattagttta

SEQ ID NO: 9513792 - DNA, 19 bp, Homo sapiens
ctgacccaggacaccacgg

SEQ ID NO: 9513793 - DNA, 22 bp, Homo sapiens
ctgaccctagcatctctgtgca

SEQ ID NO: 9513794 - DNA, 22 bp, Homo sapiens
ctgacccatataagagtggagg

SEQ ID NO: 9513795 - DNA, 22 bp, Homo sapiens
ctgacccttaatgagcaagtaa

SEQ ID NO: 9513796 - DNA, 22 bp, Homo sapiens
ctgaccctggtcaagttgcctc

SEQ ID NO: 9513797 - DNA, 18 bp, Homo sapiens
ctgaccctggctctgggt

SEQ ID NO: 9513798 - DNA, 22 bp, Homo sapiens
ctgacagggtagacagagggca

SEQ ID NO: 9513799 - DNA, 22 bp, Homo sapiens
ctgacaggttggtagctttgga

SEQ ID NO: 9513800 - DNA, 22 bp, Homo sapiens
ctgacaggttggtagctttgga

SEQ ID NO: 9513801 - DNA, 22 bp, Homo sapiens
ctgacagtttttgctgtattgt

SEQ ID NO: 9513802 - DNA, 22 bp, Homo sapiens
ctgacagtgtacactgacagct

SEQ ID NO: 9513803 - DNA, 22 bp, Homo sapiens
ctgacagtcttgccaagtttct

SEQ ID NO: 9513804 - DNA, 22 bp, Homo sapiens
ctgacatttactgagcacttac

SEQ ID NO: 9513805 - DNA, 22 bp, Homo sapiens
ctgacatttactgagcacttac

SEQ ID NO: 9513806 - DNA, 22 bp, Homo sapiens
ctctttcagttctgatagtctc

SEQ ID NO: 9513807 - DNA, 22 bp, Homo sapiens
ctctttagtggtgatgatgcta

SEQ ID NO: 9513808 - DNA, 22 bp, Homo sapiens
ctctttagtttgaaatccacat

SEQ ID NO: 9513809 - DNA, 22 bp, Homo sapiens
ctctttctgattcgctgggacc

SEQ ID NO: 9513810 - DNA, 22 bp, Homo sapiens
ctctttcctcagccacagtcta

SEQ ID NO: 9513811 - DNA, 22 bp, Homo sapiens
ctctttcctcgatgggctcctg

SEQ ID NO: 9513812 - DNA, 22 bp, Homo sapiens
ctctttcctcgatgggctcctg

SEQ ID NO: 9513813 - DNA, 22 bp, Homo sapiens
ctctttggatgtttatgataag

SEQ ID NO: 9513814 - DNA, 22 bp, Homo sapiens
ctctttggatgtttatgataag

SEQ ID NO: 9513815 - DNA, 22 bp, Homo sapiens
ctctttggatagaattacaaag

SEQ ID NO: 9513816 - DNA, 22 bp, Homo sapiens
ctctttggatagaattacaaag

SEQ ID NO: 9513817 - DNA, 22 bp, Homo sapiens
ctctttggatagaattacaaag

SEQ ID NO: 9513818 - DNA, 19 bp, Homo sapiens
ctctttggagatccttgga

SEQ ID NO: 9513819 - DNA, 22 bp, Homo sapiens
ctctttctgattcgctgggacc

SEQ ID NO: 9513820 - DNA, 22 bp, Homo sapiens
ctctttctggaaggcagagtgg

SEQ ID NO: 9513821 - DNA, 22 bp, Homo sapiens
ctctttgaaatccatcactgct

SEQ ID NO: 9513822 - DNA, 18 bp, Homo sapiens
ctctttctttggcacaaa

SEQ ID NO: 9513823 - DNA, 22 bp, Homo sapiens
ctctttggagaagcacgtatta

SEQ ID NO: 9513824 - DNA, 22 bp, Homo sapiens
ctctttggagaagcacgtatta

SEQ ID NO: 9513825 - DNA, 20 bp, Homo sapiens
ctgagcccccagcctgcagg

SEQ ID NO: 9513826 - DNA, 20 bp, Homo sapiens
ctgagcccccagcctgcagg

SEQ ID NO: 9513827 - DNA, 17 bp, Homo sapiens
ctgagccccgggcagct

SEQ ID NO: 9513828 - DNA, 22 bp, Homo sapiens
ctgagcccgggtgctctacccc

SEQ ID NO: 9513829 - DNA, 22 bp, Homo sapiens
ctgagcccctctgacctcagag

SEQ ID NO: 9513830 - DNA, 20 bp, Homo sapiens
ctgagcccagatcccaggtc

SEQ ID NO: 9513831 - DNA, 20 bp, Homo sapiens
ctgagcccagatcccaggtc

SEQ ID NO: 9513832 - DNA, 22 bp, Homo sapiens
ctgagcccaggcgggagctgag

SEQ ID NO: 9513833 - DNA, 22 bp, Homo sapiens
ctgagcccaggcgggagctgag

SEQ ID NO: 9513834 - DNA, 22 bp, Homo sapiens
ctgagccccatctgaggtgccc

SEQ ID NO: 9513835 - DNA, 22 bp, Homo sapiens
ctgagcccattgggtgctgtta

SEQ ID NO: 9513836 - DNA, 22 bp, Homo sapiens
ctgagccctgcctcttgtcact

SEQ ID NO: 9513837 - DNA, 22 bp, Homo sapiens
ctgagccctgcctcttgtcact

SEQ ID NO: 9513838 - DNA, 22 bp, Homo sapiens
ctgagccctggctcgcctggag

SEQ ID NO: 9513839 - DNA, 22 bp, Homo sapiens
ctgagccctggctcgcctggag

SEQ ID NO: 9513840 - DNA, 20 bp, Homo sapiens
ctgagcccttcctgtgaacc

SEQ ID NO: 9513841 - DNA, 22 bp, Homo sapiens
ctgagcctccaggaggggggtg

SEQ ID NO: 9513842 - DNA, 22 bp, Homo sapiens
ctgagcctccatttcatcaggt

SEQ ID NO: 9513843 - DNA, 22 bp, Homo sapiens
ctgagcccttgaacccaagtcc

SEQ ID NO: 9513844 - DNA, 22 bp, Homo sapiens
ctgaggcagagggcagaccaga

SEQ ID NO: 9513845 - DNA, 22 bp, Homo sapiens
ctgaggcagagagaacccgggc

SEQ ID NO: 9513846 - DNA, 22 bp, Homo sapiens
ctgaggcagagggcagaccaga

SEQ ID NO: 9513847 - DNA, 22 bp, Homo sapiens
ctgaggcagagggcagaccaga

SEQ ID NO: 9513848 - DNA, 22 bp, Homo sapiens
ctgaggcagagggcagaccaga

SEQ ID NO: 9513849 - DNA, 22 bp, Homo sapiens
ctgaggcagagggcagaccaga

SEQ ID NO: 9513850 - DNA, 22 bp, Homo sapiens
ctgaggcagagggcagaccaga

SEQ ID NO: 9513851 - DNA, 22 bp, Homo sapiens
ctgaggcagagggcagaccaga

SEQ ID NO: 9513852 - DNA, 21 bp, Homo sapiens
ctgaggcatgcaggcctgggc

SEQ ID NO: 9513853 - DNA, 22 bp, Homo sapiens
ctgacctgcggggaggagggcc

SEQ ID NO: 9513854 - DNA, 22 bp, Homo sapiens
ctgacctgagtggtacaaggca

SEQ ID NO: 9513855 - DNA, 22 bp, Homo sapiens
ctgacctgtaactgtaagagac

SEQ ID NO: 9513856 - DNA, 22 bp, Homo sapiens
ctgaccctttagggtatgttta

SEQ ID NO: 9513857 - DNA, 18 bp, Homo sapiens
ctgacctctgagcccctc

SEQ ID NO: 9513858 - DNA, 23 bp, Homo sapiens
ctgacctgacccataagcaagga

SEQ ID NO: 9513859 - DNA, 18 bp, Homo sapiens
ctgacctctgagcccctc

SEQ ID NO: 9513860 - DNA, 23 bp, Homo sapiens
ctgactcatcccaccacctcctc

SEQ ID NO: 9513861 - DNA, 22 bp, Homo sapiens
ctgactcactgtggctcttaat

SEQ ID NO: 9513862 - DNA, 22 bp, Homo sapiens
ctgagccaaccacagcaggagc

SEQ ID NO: 9513863 - DNA, 22 bp, Homo sapiens
ctgagccaaccacagcaggagc

SEQ ID NO: 9513864 - DNA, 22 bp, Homo sapiens
ctgactgtaattctgttcttaa

SEQ ID NO: 9513865 - DNA, 20 bp, Homo sapiens
ctgactctccttggcttgga

SEQ ID NO: 9513866 - DNA, 22 bp, Homo sapiens
ctgactctctgagctcaaggtt

SEQ ID NO: 9513867 - DNA, 22 bp, Homo sapiens
ctgactcctatcacagtgttct

SEQ ID NO: 9513868 - DNA, 22 bp, Homo sapiens
ctgactccttaccatatgcttt

SEQ ID NO: 9513869 - DNA, 22 bp, Homo sapiens
ctgactcctatgccccatgggc

SEQ ID NO: 9513870 - DNA, 18 bp, Homo sapiens
ctgactcctttgctgcca

SEQ ID NO: 9513871 - DNA, 22 bp, Homo sapiens
ctgactctcctgagatggggag

SEQ ID NO: 9513872 - DNA, 20 bp, Homo sapiens
ctgagccaactctcttcttg

SEQ ID NO: 9513873 - DNA, 20 bp, Homo sapiens
ctgagccaactctcttcttg

SEQ ID NO: 9513874 - DNA, 22 bp, Homo sapiens
ctgagccagtagtcagggacaa

SEQ ID NO: 9513875 - DNA, 22 bp, Homo sapiens
ctgagccataagggaggctggg

SEQ ID NO: 9513876 - DNA, 22 bp, Homo sapiens
ctgagccataagggaggctggg

SEQ ID NO: 9513877 - DNA, 22 bp, Homo sapiens
ctgagccatgagcctgcgccca

SEQ ID NO: 9513878 - DNA, 22 bp, Homo sapiens
ctgagccatgagcctgcgccca

SEQ ID NO: 9513879 - DNA, 22 bp, Homo sapiens
ctgagccatgggtctaagcact

SEQ ID NO: 9513880 - DNA, 22 bp, Homo sapiens
ctgagccatccataccagctta

SEQ ID NO: 9513881 - DNA, 22 bp, Homo sapiens
ctgagccatgagcctgcgccca

SEQ ID NO: 9513882 - DNA, 22 bp, Homo sapiens
ctgagccataagggaggctggg

SEQ ID NO: 9513883 - DNA, 22 bp, Homo sapiens
ctgagccataagggaggctggg

SEQ ID NO: 9513884 - DNA, 22 bp, Homo sapiens
ctgagccatccataccagctta

SEQ ID NO: 9513885 - DNA, 22 bp, Homo sapiens
ctgaggcccctcttgtgagcat

SEQ ID NO: 9513886 - DNA, 22 bp, Homo sapiens
ctgaggcccctcttgtgagcat

SEQ ID NO: 9513887 - DNA, 22 bp, Homo sapiens
ctgaggcccctcttgtgagcat

SEQ ID NO: 9513888 - DNA, 22 bp, Homo sapiens
ctgaggcccctcttgtgagcat

SEQ ID NO: 9513889 - DNA, 22 bp, Homo sapiens
ctgaggccggagcactgaagag

SEQ ID NO: 9513890 - DNA, 22 bp, Homo sapiens
ctgaggcccctctcttgagctt

SEQ ID NO: 9513891 - DNA, 22 bp, Homo sapiens
ctgaggcccctctcttgagctt

SEQ ID NO: 9513892 - DNA, 22 bp, Homo sapiens
ctgaggcccctctcttgagctt

SEQ ID NO: 9513893 - DNA, 19 bp, Homo sapiens
ctgaggcccatgtaccatg

SEQ ID NO: 9513894 - DNA, 19 bp, Homo sapiens
ctgaggcccatgtaccatg

SEQ ID NO: 9513895 - DNA, 19 bp, Homo sapiens
ctgaggcccatgtaccatg

SEQ ID NO: 9513896 - DNA, 18 bp, Homo sapiens
ctgaggcccagagagggc

SEQ ID NO: 9513897 - DNA, 18 bp, Homo sapiens
ctgaggcccagagagggc

SEQ ID NO: 9513898 - DNA, 18 bp, Homo sapiens
ctgaggcccagagagggc

SEQ ID NO: 9513899 - DNA, 22 bp, Homo sapiens
ctgaggccagctgcagagctct

SEQ ID NO: 9513900 - DNA, 17 bp, Homo sapiens
ctgaggcccagggccca

SEQ ID NO: 9513901 - DNA, 17 bp, Homo sapiens
ctgaggcccagggccca

SEQ ID NO: 9513902 - DNA, 17 bp, Homo sapiens
ctgaggcccagggccca

SEQ ID NO: 9513903 - DNA, 18 bp, Homo sapiens
ctgaggcccagagagggc

SEQ ID NO: 9513904 - DNA, 22 bp, Homo sapiens
ctgaggccagaacccgaccctg

SEQ ID NO: 9513905 - DNA, 22 bp, Homo sapiens
ctgaggccagagtgggcctctt

SEQ ID NO: 9513906 - DNA, 22 bp, Homo sapiens
ctgaggccagagtgggcctctt

SEQ ID NO: 9513907 - DNA, 22 bp, Homo sapiens
ctgaggccagagtgggcctctt

SEQ ID NO: 9513908 - DNA, 18 bp, Homo sapiens
ctgaggccaactacactg

SEQ ID NO: 9513909 - DNA, 22 bp, Homo sapiens
ctgaggccagaacccgaccctg

SEQ ID NO: 9513910 - DNA, 22 bp, Homo sapiens
ctgaggccagaacccgaccctg

SEQ ID NO: 9513911 - DNA, 22 bp, Homo sapiens
ctgaggccagagtgggcctctt

SEQ ID NO: 9513912 - DNA, 22 bp, Homo sapiens
ctgaggccagctgcagagctct

SEQ ID NO: 9513913 - DNA, 22 bp, Homo sapiens
ctgaggccagctgcagagctct

SEQ ID NO: 9513914 - DNA, 22 bp, Homo sapiens
ctgaggcatgttacaggacata

SEQ ID NO: 9513915 - DNA, 18 bp, Homo sapiens
ctgaggccaactacactg

SEQ ID NO: 9513916 - DNA, 22 bp, Homo sapiens
ctgaggcatgttacaggacata

SEQ ID NO: 9513917 - DNA, 22 bp, Homo sapiens
ctgaggcatgttacaggacata

SEQ ID NO: 9513918 - DNA, 22 bp, Homo sapiens
ctgaggcatgttacaggacata

SEQ ID NO: 9513919 - DNA, 22 bp, Homo sapiens
ctgaggcatgttacaggacata

SEQ ID NO: 9513920 - DNA, 22 bp, Homo sapiens
ctgaggcatgttacaggacata

SEQ ID NO: 9513921 - DNA, 22 bp, Homo sapiens
ctgaggcatgggaagttgggtg

SEQ ID NO: 9513922 - DNA, 22 bp, Homo sapiens
ctgaggcatgggaagttgggtg

SEQ ID NO: 9513923 - DNA, 22 bp, Homo sapiens
ctgcacagtggacagtgaagat

SEQ ID NO: 9513924 - DNA, 22 bp, Homo sapiens
ctgcacagtggacagtgaagat

SEQ ID NO: 9513925 - DNA, 22 bp, Homo sapiens
ctgcacagtggacagtgaagat

SEQ ID NO: 9513926 - DNA, 22 bp, Homo sapiens
ctgcacagtgggtggggcgtca

SEQ ID NO: 9513927 - DNA, 22 bp, Homo sapiens
ctgcacaggggatgagggcagt

SEQ ID NO: 9513928 - DNA, 22 bp, Homo sapiens
ctgcacagggatatggggagct

SEQ ID NO: 9513929 - DNA, 22 bp, Homo sapiens
ctgcacagggatatggggagct

SEQ ID NO: 9513930 - DNA, 22 bp, Homo sapiens
ctgcacagggatatggggagct

SEQ ID NO: 9513931 - DNA, 22 bp, Homo sapiens
ctgcacagtaagcttcagagat

SEQ ID NO: 9513932 - DNA, 22 bp, Homo sapiens
ctgcacagctggccagggagag

SEQ ID NO: 9513933 - DNA, 22 bp, Homo sapiens
ctgcacagcctgtctgggggcc

SEQ ID NO: 9513934 - DNA, 22 bp, Homo sapiens
ctgcacagcctgtctgggggcc

SEQ ID NO: 9513935 - DNA, 22 bp, Homo sapiens
ctgcacagcctgtctgggggcc

SEQ ID NO: 9513936 - DNA, 22 bp, Homo sapiens
ctgcacagccctcaagagcctg

SEQ ID NO: 9513937 - DNA, 22 bp, Homo sapiens
ctgcacagccctcaagagcctg

SEQ ID NO: 9513938 - DNA, 22 bp, Homo sapiens
ctgcacagctggccagggagag

SEQ ID NO: 9513939 - DNA, 22 bp, Homo sapiens
ctgcacagctggccagggagag

SEQ ID NO: 9513940 - DNA, 22 bp, Homo sapiens
ctgcacagggatatggggagct

SEQ ID NO: 9513941 - DNA, 22 bp, Homo sapiens
ctgcacagctgggcaagatata

SEQ ID NO: 9513942 - DNA, 22 bp, Homo sapiens
ctgaggccggagcactgaagag

SEQ ID NO: 9513943 - DNA, 22 bp, Homo sapiens
ctgaggccggagcactgaagag

SEQ ID NO: 9513944 - DNA, 22 bp, Homo sapiens
ctgaggccgtctgggtctgcag

SEQ ID NO: 9513945 - DNA, 22 bp, Homo sapiens
ctgcaaaagtcattgtggtttt

SEQ ID NO: 9513946 - DNA, 20 bp, Homo sapiens
ctgcaaaatgacattaggaa

SEQ ID NO: 9513947 - DNA, 22 bp, Homo sapiens
ctgcaaaattgttctttgctcc

SEQ ID NO: 9513948 - DNA, 20 bp, Homo sapiens
ctgcaaaatgacattaggaa

SEQ ID NO: 9513949 - DNA, 22 bp, Homo sapiens
ctgcaaaattgttctttgctcc

SEQ ID NO: 9513950 - DNA, 22 bp, Homo sapiens
ctgcaaaggtgggggaggagct

SEQ ID NO: 9513951 - DNA, 21 bp, Homo sapiens
ctgcaaatacctagttatctg

SEQ ID NO: 9513952 - DNA, 22 bp, Homo sapiens
ctgcacagagcggcagttctta

SEQ ID NO: 9513953 - DNA, 22 bp, Homo sapiens
ctgcacagaggtcggtctgcca

SEQ ID NO: 9513954 - DNA, 22 bp, Homo sapiens
ctgcacagagcggcagttctta

SEQ ID NO: 9513955 - DNA, 22 bp, Homo sapiens
ctgcacagaggtcggtctgcca

SEQ ID NO: 9513956 - DNA, 22 bp, Homo sapiens
ctgcaaataggaaaagggcata

SEQ ID NO: 9513957 - DNA, 22 bp, Homo sapiens
ctgcacacatcgcactgcccgt

SEQ ID NO: 9513958 - DNA, 19 bp, Homo sapiens
ctgcagggatgtgcagagt

SEQ ID NO: 9513959 - DNA, 19 bp, Homo sapiens
ctgcagggatgtgcagagt

SEQ ID NO: 9513960 - DNA, 19 bp, Homo sapiens
ctgcagggatgtgcagagt

SEQ ID NO: 9513961 - DNA, 19 bp, Homo sapiens
ctgcagggatgtgcagagt

SEQ ID NO: 9513962 - DNA, 19 bp, Homo sapiens
ctgcagggatgtgcagagt

SEQ ID NO: 9513963 - DNA, 22 bp, Homo sapiens
ctgcagggatgtgaggcccgtt

SEQ ID NO: 9513964 - DNA, 22 bp, Homo sapiens
ctgcagggatgtgaggcccgtt

SEQ ID NO: 9513965 - DNA, 22 bp, Homo sapiens
ctgcagggattgcttctgtata

SEQ ID NO: 9513966 - DNA, 22 bp, Homo sapiens
ctgcagggcagaagggcataga

SEQ ID NO: 9513967 - DNA, 22 bp, Homo sapiens
ctgcagggcattgtaactcttt

SEQ ID NO: 9513968 - DNA, 22 bp, Homo sapiens
ctgcagggcagggcctcctggc

SEQ ID NO: 9513969 - DNA, 22 bp, Homo sapiens
ctgcagggcagggcctcctggc

SEQ ID NO: 9513970 - DNA, 22 bp, Homo sapiens
ctgcaggggaccaaagtctgac

SEQ ID NO: 9513971 - DNA, 22 bp, Homo sapiens
ctgcaggggcagtccacttcct

SEQ ID NO: 9513972 - DNA, 22 bp, Homo sapiens
ctgcagggcccgcctgagccct

SEQ ID NO: 9513973 - DNA, 22 bp, Homo sapiens
ctgcagggcccgcctgagccct

SEQ ID NO: 9513974 - DNA, 22 bp, Homo sapiens
ctgcagggcccgcctgagccct

SEQ ID NO: 9513975 - DNA, 22 bp, Homo sapiens
ctgcagggcccaaggtcaacgg

SEQ ID NO: 9513976 - DNA, 22 bp, Homo sapiens
ctgcagggcccaaggtcaacgg

SEQ ID NO: 9513977 - DNA, 22 bp, Homo sapiens
ctgcacagtgttggaagctgcc

SEQ ID NO: 9513978 - DNA, 22 bp, Homo sapiens
ctgcacagtgggtggggcgtca

SEQ ID NO: 9513979 - DNA, 22 bp, Homo sapiens
ctgcacagtttgatttcttgct

SEQ ID NO: 9513980 - DNA, 22 bp, Homo sapiens
ctgcaccctcaaactcctgggc

SEQ ID NO: 9513981 - DNA, 22 bp, Homo sapiens
ctgcaccctcaaactcctgggc

SEQ ID NO: 9513982 - DNA, 22 bp, Homo sapiens
ctgcacccatgagctcaaggga

SEQ ID NO: 9513983 - DNA, 22 bp, Homo sapiens
ctgcactgacttccccggctgc

SEQ ID NO: 9513984 - DNA, 20 bp, Homo sapiens
ctgcactgaacatgtctgag

SEQ ID NO: 9513985 - DNA, 20 bp, Homo sapiens
ctgcactgaacatgtctgag

SEQ ID NO: 9513986 - DNA, 22 bp, Homo sapiens
ctgcaccgtgtctcgggctgcc

SEQ ID NO: 9513987 - DNA, 22 bp, Homo sapiens
ctgcacctacagccacatttac

SEQ ID NO: 9513988 - DNA, 22 bp, Homo sapiens
ctgcagggaggttccttgttct

SEQ ID NO: 9513989 - DNA, 22 bp, Homo sapiens
ctgcagggaggttccttgttct

SEQ ID NO: 9513990 - DNA, 22 bp, Homo sapiens
ctgcagggaggttccttgttct

SEQ ID NO: 9513991 - DNA, 22 bp, Homo sapiens
ctgcagggagcagatggcgtgt

SEQ ID NO: 9513992 - DNA, 22 bp, Homo sapiens
ctgcagggagcagatggcgtgt

SEQ ID NO: 9513993 - DNA, 22 bp, Homo sapiens
ctgcagggagaggggacagcct

SEQ ID NO: 9513994 - DNA, 22 bp, Homo sapiens
ctgcaggcccccttcctggagt

SEQ ID NO: 9513995 - DNA, 22 bp, Homo sapiens
ctgcaggcatctaactgtgggc

SEQ ID NO: 9513996 - DNA, 22 bp, Homo sapiens
ctgcaggcatctaactgtgggc

SEQ ID NO: 9513997 - DNA, 22 bp, Homo sapiens
ctgcactgagctctcccagccc

SEQ ID NO: 9513998 - DNA, 22 bp, Homo sapiens
ctgcactgtgtaacagataact

SEQ ID NO: 9513999 - DNA, 22 bp, Homo sapiens
ctgcactgtgtaacagataact

SEQ ID NO: 9514000 - DNA, 22 bp, Homo sapiens
ttgtctttcccagcttctagag

SEQ ID NO: 9514001 - DNA, 22 bp, Homo sapiens
ttgtcttattttatcataagca

SEQ ID NO: 9514002 - DNA, 22 bp, Homo sapiens
ttgtctttcccagcttctagag

SEQ ID NO: 9514003 - DNA, 19 bp, Homo sapiens
ttgtcttagctgcataaga

SEQ ID NO: 9514004 - DNA, 22 bp, Homo sapiens
ttgtcttaaatggatggacaat

SEQ ID NO: 9514005 - DNA, 22 bp, Homo sapiens
ttgtcttaaatggatggacaat

SEQ ID NO: 9514006 - DNA, 23 bp, Homo sapiens
ttgtctgtgcttttccagttgct

SEQ ID NO: 9514007 - DNA, 23 bp, Homo sapiens
ttgtctgtgcttttccagttgct

SEQ ID NO: 9514008 - DNA, 22 bp, Homo sapiens
ttgtctgtgaaatggaaatagt

SEQ ID NO: 9514009 - DNA, 22 bp, Homo sapiens
ctccagcctcatctcctggctg

SEQ ID NO: 9514010 - DNA, 20 bp, Homo sapiens
ctccagcccctgccctggtc

SEQ ID NO: 9514011 - DNA, 22 bp, Homo sapiens
ctccagcctcagatgacggtac

SEQ ID NO: 9514012 - DNA, 22 bp, Homo sapiens
ctccagcctcagatgacggtac

SEQ ID NO: 9514013 - DNA, 22 bp, Homo sapiens
ttgtattttgttatgctactgc

SEQ ID NO: 9514014 - DNA, 22 bp, Homo sapiens
ttgtctgtcccagcttgtgcat

SEQ ID NO: 9514015 - DNA, 22 bp, Homo sapiens
ttgtctgtccaggcaccccaag

SEQ ID NO: 9514016 - DNA, 23 bp, Homo sapiens
ttgtatttttagtagagacaggg

SEQ ID NO: 9514017 - DNA, 22 bp, Homo sapiens
ctccagccagagtgcctctgtt

SEQ ID NO: 9514018 - DNA, 22 bp, Homo sapiens
ctccagccagagtgcctctgtt

SEQ ID NO: 9514019 - DNA, 22 bp, Homo sapiens
ctccagccagagtgcctctgtt

SEQ ID NO: 9514020 - DNA, 22 bp, Homo sapiens
ctccagccagagtgcctctgtt

SEQ ID NO: 9514021 - DNA, 22 bp, Homo sapiens
ctccagcaggtgcgtctcagag

SEQ ID NO: 9514022 - DNA, 22 bp, Homo sapiens
ctccagcagaaagggcgagtgg

SEQ ID NO: 9514023 - DNA, 22 bp, Homo sapiens
ctccagccagagtgcctctgtt

SEQ ID NO: 9514024 - DNA, 20 bp, Homo sapiens
ctccagcccctgccctggtc

SEQ ID NO: 9514025 - DNA, 20 bp, Homo sapiens
ctccagcccctgccctggtc

SEQ ID NO: 9514026 - DNA, 20 bp, Homo sapiens
ctccagcccctgccctggtc

SEQ ID NO: 9514027 - DNA, 20 bp, Homo sapiens
ctccagcccctgccctggtc

SEQ ID NO: 9514028 - DNA, 20 bp, Homo sapiens
ctccagcccctgccctggtc

SEQ ID NO: 9514029 - DNA, 20 bp, Homo sapiens
ttgtgggggcaatggtatgc

SEQ ID NO: 9514030 - DNA, 20 bp, Homo sapiens
ttgtgggggcaatggtatgc

SEQ ID NO: 9514031 - DNA, 22 bp, Homo sapiens
ttgtggggcaacagcaggtgaa

SEQ ID NO: 9514032 - DNA, 22 bp, Homo sapiens
ttgtggggaggatttgatgaga

SEQ ID NO: 9514033 - DNA, 22 bp, Homo sapiens
ttgtggggcaacagcaggtgaa

SEQ ID NO: 9514034 - DNA, 22 bp, Homo sapiens
ttgtggggccccaatgttgctg

SEQ ID NO: 9514035 - DNA, 22 bp, Homo sapiens
ttgtggggaggatttgatgaga

SEQ ID NO: 9514036 - DNA, 22 bp, Homo sapiens
ttgtggggcaacagcaggtgaa

SEQ ID NO: 9514037 - DNA, 22 bp, Homo sapiens
ttgtggggcaacagcaggtgaa

SEQ ID NO: 9514038 - DNA, 22 bp, Homo sapiens
ttgtggggaacccctgtcccac

SEQ ID NO: 9514039 - DNA, 22 bp, Homo sapiens
ttgtggggaacccctgtcccac

SEQ ID NO: 9514040 - DNA, 22 bp, Homo sapiens
ttgtggggaggatttgatgaga

SEQ ID NO: 9514041 - DNA, 22 bp, Homo sapiens
ttgtgggcttgcctggctcttg

SEQ ID NO: 9514042 - DNA, 22 bp, Homo sapiens
ttgtggggaaacactgtttctt

SEQ ID NO: 9514043 - DNA, 22 bp, Homo sapiens
ttgtggggaaacactgtttctt

SEQ ID NO: 9514044 - DNA, 22 bp, Homo sapiens
ttgtgaaaagccgcaagtatag

SEQ ID NO: 9514045 - DNA, 22 bp, Homo sapiens
ttgtgaaacattcatggatttg

SEQ ID NO: 9514046 - DNA, 22 bp, Homo sapiens
ttgtgaaaagccgcaagtatag

SEQ ID NO: 9514047 - DNA, 18 bp, Homo sapiens
ttgtgaaatattggagtc

SEQ ID NO: 9514048 - DNA, 18 bp, Homo sapiens
ttgtgaaatattggagtc

SEQ ID NO: 9514049 - DNA, 21 bp, Homo sapiens
ttgtgaaagtccaggaacaac

SEQ ID NO: 9514050 - DNA, 22 bp, Homo sapiens
ttgtggttaaccgcacattttt

SEQ ID NO: 9514051 - DNA, 22 bp, Homo sapiens
ttgtggggttggcagttcttta

SEQ ID NO: 9514052 - DNA, 22 bp, Homo sapiens
ttgtggggccccaatgttgctg

SEQ ID NO: 9514053 - DNA, 22 bp, Homo sapiens
ttgtggggttggcagttcttta

SEQ ID NO: 9514054 - DNA, 22 bp, Homo sapiens
ttgtgggggctgccctgtacgg

SEQ ID NO: 9514055 - DNA, 22 bp, Homo sapiens
ttgtggggtgatttgccacggg

SEQ ID NO: 9514056 - DNA, 22 bp, Homo sapiens
ttgtgggggctgccctgtacgg

SEQ ID NO: 9514057 - DNA, 22 bp, Homo sapiens
ttgtggggtgatttgccacggg

SEQ ID NO: 9514058 - DNA, 22 bp, Homo sapiens
ttgtggttaaccgcacattttt

SEQ ID NO: 9514059 - DNA, 22 bp, Homo sapiens
ctccagtgcgtcttagtaaacc

SEQ ID NO: 9514060 - DNA, 22 bp, Homo sapiens
ctccagtgcgcaggacagcccc

SEQ ID NO: 9514061 - DNA, 22 bp, Homo sapiens
ttgtgtaacttgagcaaacaca

SEQ ID NO: 9514062 - DNA, 22 bp, Homo sapiens
ctccatggaaaaggctgttgtt

SEQ ID NO: 9514063 - DNA, 22 bp, Homo sapiens
ctccatggctttcgcatctgca

SEQ ID NO: 9514064 - DNA, 22 bp, Homo sapiens
ctccatggaaccggggctgctt

SEQ ID NO: 9514065 - DNA, 22 bp, Homo sapiens
tttaatatccagtggatacaaa

SEQ ID NO: 9514066 - DNA, 22 bp, Homo sapiens
tttaatatccagtggatacaaa

SEQ ID NO: 9514067 - DNA, 22 bp, Homo sapiens
tttaatatccagtggatacaaa

SEQ ID NO: 9514068 - DNA, 22 bp, Homo sapiens
tttaatatccagtggatacaaa

SEQ ID NO: 9514069 - DNA, 22 bp, Homo sapiens
tttaatagggcccaatgagact

SEQ ID NO: 9514070 - DNA, 22 bp, Homo sapiens
tttaatatttctttcctgaagc

SEQ ID NO: 9514071 - DNA, 22 bp, Homo sapiens
tttaatatttctttcctgaagc

SEQ ID NO: 9514072 - DNA, 22 bp, Homo sapiens
tttaatatctcacacttccatg

SEQ ID NO: 9514073 - DNA, 22 bp, Homo sapiens
tttaatattctgcattctcctt

SEQ ID NO: 9514074 - DNA, 22 bp, Homo sapiens
tttaatatttctttcctgaagc

SEQ ID NO: 9514075 - DNA, 22 bp, Homo sapiens
tttaatattctgcattctcctt

SEQ ID NO: 9514076 - DNA, 22 bp, Homo sapiens
tttaacagatgctatgtctacc

SEQ ID NO: 9514077 - DNA, 22 bp, Homo sapiens
ctcccaggccatgctctagcca

SEQ ID NO: 9514078 - DNA, 22 bp, Homo sapiens
ctcccaggccatgctctagcca

SEQ ID NO: 9514079 - DNA, 22 bp, Homo sapiens
tttaacagatgctatgtctacc

SEQ ID NO: 9514080 - DNA, 22 bp, Homo sapiens
tttaagttccttttcaacaact

SEQ ID NO: 9514081 - DNA, 22 bp, Homo sapiens
ctcccaggcacagggaggagcc

SEQ ID NO: 9514082 - DNA, 22 bp, Homo sapiens
ctcccaggccatgctctagcca

SEQ ID NO: 9514083 - DNA, 22 bp, Homo sapiens
ctcccaggcacagggaggagcc

SEQ ID NO: 9514084 - DNA, 22 bp, Homo sapiens
ctcccaggcacagggaggagcc

SEQ ID NO: 9514085 - DNA, 22 bp, Homo sapiens
ctccatgggggctggcctgtgt

SEQ ID NO: 9514086 - DNA, 22 bp, Homo sapiens
ctcccaaggggtaagggagctg

SEQ ID NO: 9514087 - DNA, 22 bp, Homo sapiens
ctcccacatggaatagcaggga

SEQ ID NO: 9514088 - DNA, 22 bp, Homo sapiens
ctcccacatggaatagcaggga

SEQ ID NO: 9514089 - DNA, 22 bp, Homo sapiens
ctcccaaggggtaagggagctg

SEQ ID NO: 9514090 - DNA, 22 bp, Homo sapiens
ctcccagacatgtgcctccttg

SEQ ID NO: 9514091 - DNA, 22 bp, Homo sapiens
ctcccagacatgtgcctccttg

SEQ ID NO: 9514092 - DNA, 22 bp, Homo sapiens
ctcccagaaaattctcagacaa

SEQ ID NO: 9514093 - DNA, 22 bp, Homo sapiens
ctcccagaaaattctcagacaa

SEQ ID NO: 9514094 - DNA, 22 bp, Homo sapiens
ctcccagaaaattctcagacaa

SEQ ID NO: 9514095 - DNA, 22 bp, Homo sapiens
ctcccactcctggctcaccaca

SEQ ID NO: 9514096 - DNA, 22 bp, Homo sapiens
ctcccacatggaatagcaggga

SEQ ID NO: 9514097 - DNA, 22 bp, Homo sapiens
ctcccagagaccaagctgagaa

SEQ ID NO: 9514098 - DNA, 22 bp, Homo sapiens
ctcccagagaccaagctgagaa

SEQ ID NO: 9514099 - DNA, 22 bp, Homo sapiens
ctcccagattcctgctgtggga

SEQ ID NO: 9514100 - DNA, 22 bp, Homo sapiens
ctcccagattcctgctgtggga

SEQ ID NO: 9514101 - DNA, 22 bp, Homo sapiens
ctcccagattcctgctgtggga

SEQ ID NO: 9514102 - DNA, 22 bp, Homo sapiens
ctcccagagagcaggtgggccg

SEQ ID NO: 9514103 - DNA, 22 bp, Homo sapiens
ctcccagagagcaggtgggccg

SEQ ID NO: 9514104 - DNA, 22 bp, Homo sapiens
ctcccagccttcgccagtctga

SEQ ID NO: 9514105 - DNA, 22 bp, Homo sapiens
ctcccagccttcgccagtctga

SEQ ID NO: 9514106 - DNA, 22 bp, Homo sapiens
ctcccagccttcgccagtctga

SEQ ID NO: 9514107 - DNA, 22 bp, Homo sapiens
ctcccaggactcagaggagaag

SEQ ID NO: 9514108 - DNA, 22 bp, Homo sapiens
ttgtaatttgcaaatgtattgt

SEQ ID NO: 9514109 - DNA, 22 bp, Homo sapiens
ttgtacaaagatttcacagctc

SEQ ID NO: 9514110 - DNA, 22 bp, Homo sapiens
ttgtacaaagatttcacagctc

SEQ ID NO: 9514111 - DNA, 22 bp, Homo sapiens
ttgtacaaaggatttggaagag

SEQ ID NO: 9514112 - DNA, 22 bp, Homo sapiens
ttggtcagctaataaggacagg

SEQ ID NO: 9514113 - DNA, 22 bp, Homo sapiens
ctccaccccgtgccggtgctgg

SEQ ID NO: 9514114 - DNA, 22 bp, Homo sapiens
ctccacagttgctgcttttaat

SEQ ID NO: 9514115 - DNA, 22 bp, Homo sapiens
ttggtcagatgtgtctcctcct

SEQ ID NO: 9514116 - DNA, 22 bp, Homo sapiens
ttgtacaaataggaacctctga

SEQ ID NO: 9514117 - DNA, 22 bp, Homo sapiens
ttgtacaaatgcatattcctgg

SEQ ID NO: 9514118 - DNA, 22 bp, Homo sapiens
ttgtacaaatgcatattcctgg

SEQ ID NO: 9514119 - DNA, 22 bp, Homo sapiens
ttgtacaacgttttaaatttga

SEQ ID NO: 9514120 - DNA, 22 bp, Homo sapiens
ttgtacaacacatattctacag

SEQ ID NO: 9514121 - DNA, 22 bp, Homo sapiens
ttgtacaacgttttaaatttga

SEQ ID NO: 9514122 - DNA, 22 bp, Homo sapiens
ctccagatccagctgagctgca

SEQ ID NO: 9514123 - DNA, 22 bp, Homo sapiens
ctccagatccagctgagctgca

SEQ ID NO: 9514124 - DNA, 22 bp, Homo sapiens
ttgtacaagtattatgtgaaca

SEQ ID NO: 9514125 - DNA, 22 bp, Homo sapiens
ttgtacaagtattatgtgaaca

SEQ ID NO: 9514126 - DNA, 22 bp, Homo sapiens
ctccagattcctgctggcagaa

SEQ ID NO: 9514127 - DNA, 22 bp, Homo sapiens
ctccagattccgtttattcagg

SEQ ID NO: 9514128 - DNA, 22 bp, Homo sapiens
ctccagcagaaagggcgagtgg

SEQ ID NO: 9514129 - DNA, 22 bp, Homo sapiens
ctccagattctggatgactggg

SEQ ID NO: 9514130 - DNA, 22 bp, Homo sapiens
ctccagattctggatgactggg

SEQ ID NO: 9514131 - DNA, 22 bp, Homo sapiens
ctccacagcccctccagtggca

SEQ ID NO: 9514132 - DNA, 22 bp, Homo sapiens
ctccacagcccctccagtggca

SEQ ID NO: 9514133 - DNA, 22 bp, Homo sapiens
ctccacagctcaggctcagagt

SEQ ID NO: 9514134 - DNA, 22 bp, Homo sapiens
ctccacagctcaggctcagagt

SEQ ID NO: 9514135 - DNA, 19 bp, Homo sapiens
ctccacagggattgtgatt

SEQ ID NO: 9514136 - DNA, 22 bp, Homo sapiens
ctccacagctcaggctcagagt

SEQ ID NO: 9514137 - DNA, 22 bp, Homo sapiens
ctccacaggtgtactgtacctt

SEQ ID NO: 9514138 - DNA, 22 bp, Homo sapiens
ctccaagtatgttaaaatctaa

SEQ ID NO: 9514139 - DNA, 22 bp, Homo sapiens
ctccaaggtttcagaacaaatg

SEQ ID NO: 9514140 - DNA, 22 bp, Homo sapiens
ctccaaggtttcagaacaaatg

SEQ ID NO: 9514141 - DNA, 22 bp, Homo sapiens
ctccaagtccgagggctctcaa

SEQ ID NO: 9514142 - DNA, 22 bp, Homo sapiens
ctccacagagatgctgattgta

SEQ ID NO: 9514143 - DNA, 22 bp, Homo sapiens
ctccacagcccctccagtggca

SEQ ID NO: 9514144 - DNA, 22 bp, Homo sapiens
ctccacagagatgctgattgta

SEQ ID NO: 9514145 - DNA, 22 bp, Homo sapiens
ctccaaggaagccccaagggat

SEQ ID NO: 9514146 - DNA, 22 bp, Homo sapiens
ctccaactgatctcacagcaga

SEQ ID NO: 9514147 - DNA, 22 bp, Homo sapiens
ctccaactgatctcacagcaga

SEQ ID NO: 9514148 - DNA, 22 bp, Homo sapiens
ctccaagaggctataaaggcag

SEQ ID NO: 9514149 - DNA, 22 bp, Homo sapiens
ctccaacgaggctggggtacaa

SEQ ID NO: 9514150 - DNA, 22 bp, Homo sapiens
ctccaaggagaaatgggcaaca

SEQ ID NO: 9514151 - DNA, 22 bp, Homo sapiens
ctccaaggattctggacccttg

SEQ ID NO: 9514152 - DNA, 22 bp, Homo sapiens
ctccaaggctaggagcatgttc

SEQ ID NO: 9514153 - DNA, 23 bp, Homo sapiens
ctccaaggcccaactgtctaggc

SEQ ID NO: 9514154 - DNA, 20 bp, Homo sapiens
ctccaaggcttgcaggaggc

SEQ ID NO: 9514155 - DNA, 20 bp, Homo sapiens
ctccaaggcttgcaggaggc

SEQ ID NO: 9514156 - DNA, 23 bp, Homo sapiens
ctccaagggagggcaaacaacag

SEQ ID NO: 9514157 - DNA, 22 bp, Homo sapiens
ctccaagggctcccagacgtct

SEQ ID NO: 9514158 - DNA, 22 bp, Homo sapiens
ctccaaggtggttatttgagat

SEQ ID NO: 9514159 - DNA, 21 bp, Homo sapiens
ctcatttatttttgtgtccaa

SEQ ID NO: 9514160 - DNA, 22 bp, Homo sapiens
ctcatttgttctgcagaagatc

SEQ ID NO: 9514161 - DNA, 22 bp, Homo sapiens
ctcatttatgtaatgattaagg

SEQ ID NO: 9514162 - DNA, 22 bp, Homo sapiens
ctcatttacctttgcaatcaag

SEQ ID NO: 9514163 - DNA, 22 bp, Homo sapiens
ctcatttacactatgggaacta

SEQ ID NO: 9514164 - DNA, 22 bp, Homo sapiens
ctcatttagggggcatggtaca

SEQ ID NO: 9514165 - DNA, 22 bp, Homo sapiens
ctcatttactgtagaacagtta

SEQ ID NO: 9514166 - DNA, 22 bp, Homo sapiens
ctcatttactactcatgtgacc

SEQ ID NO: 9514167 - DNA, 22 bp, Homo sapiens
ctcatttactcatctgcaaaac

SEQ ID NO: 9514168 - DNA, 22 bp, Homo sapiens
ctcatttactcatctgcaaaac

SEQ ID NO: 9514169 - DNA, 22 bp, Homo sapiens
ttgaaatactgcattgttcagt

SEQ ID NO: 9514170 - DNA, 22 bp, Homo sapiens
ttgaaatactgcattgttcagt

SEQ ID NO: 9514171 - DNA, 22 bp, Homo sapiens
ctcatctgtatatagtgaatga

SEQ ID NO: 9514172 - DNA, 22 bp, Homo sapiens
ctcatctgtatatagtgaatga

SEQ ID NO: 9514173 - DNA, 22 bp, Homo sapiens
ttgaaatagatgcgtcagagat

SEQ ID NO: 9514174 - DNA, 22 bp, Homo sapiens
ctcatctggcttcagtaacagt

SEQ ID NO: 9514175 - DNA, 22 bp, Homo sapiens
ctcatctggcttcagtaacagt

SEQ ID NO: 9514176 - DNA, 22 bp, Homo sapiens
ttgaaagtgatggggaagatgg

SEQ ID NO: 9514177 - DNA, 22 bp, Homo sapiens
ttgaaagtctaggcttacagta

SEQ ID NO: 9514178 - DNA, 22 bp, Homo sapiens
ttgaaagtctctgcatgtagga

SEQ ID NO: 9514179 - DNA, 22 bp, Homo sapiens
ttgaaagtagcagctgcatatg

SEQ ID NO: 9514180 - DNA, 22 bp, Homo sapiens
ttcttttcccaatattttgctg

SEQ ID NO: 9514181 - DNA, 22 bp, Homo sapiens
ttcttttcccaatattttgctg

SEQ ID NO: 9514182 - DNA, 22 bp, Homo sapiens
ttcttttcccaatattttgctg

SEQ ID NO: 9514183 - DNA, 22 bp, Homo sapiens
ttcttttcccaatattttgctg

SEQ ID NO: 9514184 - DNA, 22 bp, Homo sapiens
ttcttttcctacacagcgattt

SEQ ID NO: 9514185 - DNA, 22 bp, Homo sapiens
ttcttttcctacacagcgattt

SEQ ID NO: 9514186 - DNA, 22 bp, Homo sapiens
ttcttttcctacacagcgattt

SEQ ID NO: 9514187 - DNA, 23 bp, Homo sapiens
ttgaaaggtagctggcagctaga

SEQ ID NO: 9514188 - DNA, 21 bp, Homo sapiens
ttgaaagtaaattcagcagct

SEQ ID NO: 9514189 - DNA, 22 bp, Homo sapiens
ttgaaagtaataactttgttca

SEQ ID NO: 9514190 - DNA, 22 bp, Homo sapiens
ttcttttacattaagatttcag

SEQ ID NO: 9514191 - DNA, 22 bp, Homo sapiens
ttcttttacattaagatttcag

SEQ ID NO: 9514192 - DNA, 22 bp, Homo sapiens
ttcttttagaatttcctaaggt

SEQ ID NO: 9514193 - DNA, 22 bp, Homo sapiens
ctcccgtgatcctggaggagag

SEQ ID NO: 9514194 - DNA, 22 bp, Homo sapiens
tttagacatggcttgctcactt

SEQ ID NO: 9514195 - DNA, 22 bp, Homo sapiens
ctccctcacaaagcattctctt

SEQ ID NO: 9514196 - DNA, 22 bp, Homo sapiens
ctcccgagttcaagctattttc

SEQ ID NO: 9514197 - DNA, 22 bp, Homo sapiens
ctcccgtgatcctggaggagag

SEQ ID NO: 9514198 - DNA, 22 bp, Homo sapiens
ctcccctccttaggtcttctag

SEQ ID NO: 9514199 - DNA, 20 bp, Homo sapiens
ctcccctctacagagggctg

SEQ ID NO: 9514200 - DNA, 18 bp, Homo sapiens
ctcccctgttttccctgc

SEQ ID NO: 9514201 - DNA, 20 bp, Homo sapiens
ctcccctctacagagggctg

SEQ ID NO: 9514202 - DNA, 22 bp, Homo sapiens
ctccccattgtgacctcatcca

SEQ ID NO: 9514203 - DNA, 22 bp, Homo sapiens
ctccccatggcaacagttatgg

SEQ ID NO: 9514204 - DNA, 22 bp, Homo sapiens
ctccccatccaggcagcaggtg

SEQ ID NO: 9514205 - DNA, 22 bp, Homo sapiens
ctcccccttagctcttgtcttt

SEQ ID NO: 9514206 - DNA, 22 bp, Homo sapiens
ctcccccttagctcttgtcttt

SEQ ID NO: 9514207 - DNA, 22 bp, Homo sapiens
tttaatcataagaaggaaaata

SEQ ID NO: 9514208 - DNA, 22 bp, Homo sapiens
tttaatcataagaaggaaaata

SEQ ID NO: 9514209 - DNA, 22 bp, Homo sapiens
tttaatcaggcaaagcataata

SEQ ID NO: 9514210 - DNA, 22 bp, Homo sapiens
tttaatcaggcaaagcataata

SEQ ID NO: 9514211 - DNA, 22 bp, Homo sapiens
tttaatcaggcaaagcataata

SEQ ID NO: 9514212 - DNA, 23 bp, Homo sapiens
ctccccagtgtcctcatgcatct

SEQ ID NO: 9514213 - DNA, 23 bp, Homo sapiens
ctccccagtgtcctcatgcatct

SEQ ID NO: 9514214 - DNA, 22 bp, Homo sapiens
tttaatctattccctaaacacc

SEQ ID NO: 9514215 - DNA, 23 bp, Homo sapiens
ctccccagtgtcctcatgcatct

SEQ ID NO: 9514216 - DNA, 22 bp, Homo sapiens
tttagtaagttcactgcaaagc

SEQ ID NO: 9514217 - DNA, 22 bp, Homo sapiens
tttagtaccatcatttgcctct

SEQ ID NO: 9514218 - DNA, 22 bp, Homo sapiens
tttagtagaatagtatatcaaa

SEQ ID NO: 9514219 - DNA, 22 bp, Homo sapiens
tttagtactgtttaaaaatgga

SEQ ID NO: 9514220 - DNA, 22 bp, Homo sapiens
tttagtatataaaaagagaagt

SEQ ID NO: 9514221 - DNA, 22 bp, Homo sapiens
tttaggttaatcaacaaacatt

SEQ ID NO: 9514222 - DNA, 22 bp, Homo sapiens
tttaggttttttcacgtggcta

SEQ ID NO: 9514223 - DNA, 22 bp, Homo sapiens
tttaggcatgcagttctattta

SEQ ID NO: 9514224 - DNA, 22 bp, Homo sapiens
tttagtgagtgtgaatcaaatg

SEQ ID NO: 9514225 - DNA, 22 bp, Homo sapiens
tttagtgagtgtgaatcaaatg

SEQ ID NO: 9514226 - DNA, 22 bp, Homo sapiens
tttagtgagtgtgaatcaaatg

SEQ ID NO: 9514227 - DNA, 22 bp, Homo sapiens
tttagtgataagaattatgaaa

SEQ ID NO: 9514228 - DNA, 22 bp, Homo sapiens
tttagtgataagaattatgaaa

SEQ ID NO: 9514229 - DNA, 22 bp, Homo sapiens
tttagtgattcatttagaaaaa

SEQ ID NO: 9514230 - DNA, 22 bp, Homo sapiens
tttagtcatttggatttgatct

SEQ ID NO: 9514231 - DNA, 23 bp, Homo sapiens
tttagtcagttgacagccatata

SEQ ID NO: 9514232 - DNA, 22 bp, Homo sapiens
ctcctccacagagtccttgcca

SEQ ID NO: 9514233 - DNA, 22 bp, Homo sapiens
ctcctcagttgtcccatggaga

SEQ ID NO: 9514234 - DNA, 22 bp, Homo sapiens
tttagtgcctggtttccttctt

SEQ ID NO: 9514235 - DNA, 22 bp, Homo sapiens
tttagtgcctgggccagttcca

SEQ ID NO: 9514236 - DNA, 22 bp, Homo sapiens
tttagtgattcatttagaaaaa

SEQ ID NO: 9514237 - DNA, 22 bp, Homo sapiens
ctcctccacagacctactgaat

SEQ ID NO: 9514238 - DNA, 17 bp, Homo sapiens
ctcctggcagcctcagg

SEQ ID NO: 9514239 - DNA, 22 bp, Homo sapiens
ctcctggatgcaggctgtctgc

SEQ ID NO: 9514240 - DNA, 22 bp, Homo sapiens
ctcctggatgcaggctgtctgc

SEQ ID NO: 9514241 - DNA, 22 bp, Homo sapiens
ctcctggatgcaggctgtctgc

SEQ ID NO: 9514242 - DNA, 22 bp, Homo sapiens
ctcctggatgcaggctgtctgc

SEQ ID NO: 9514243 - DNA, 16 bp, Homo sapiens
tttatttactagtgtt

SEQ ID NO: 9514244 - DNA, 22 bp, Homo sapiens
tttatttaaagtcgtgtgttaa

SEQ ID NO: 9514245 - DNA, 22 bp, Homo sapiens
tttatttaccttatgtcctcca

SEQ ID NO: 9514246 - DNA, 22 bp, Homo sapiens
tttatttaccttatgtcctcca

SEQ ID NO: 9514247 - DNA, 22 bp, Homo sapiens
tttattgtgttgaaactgaatt

SEQ ID NO: 9514248 - DNA, 22 bp, Homo sapiens
tttattgttgggtcttaagctg

SEQ ID NO: 9514249 - DNA, 22 bp, Homo sapiens
tttattgttatcatgggtgagt

SEQ ID NO: 9514250 - DNA, 22 bp, Homo sapiens
tttattctaacttgctgctcta

SEQ ID NO: 9514251 - DNA, 22 bp, Homo sapiens
tttattctaacttgctgctcta

SEQ ID NO: 9514252 - DNA, 22 bp, Homo sapiens
tttattgttgttagtcataagt

SEQ ID NO: 9514253 - DNA, 22 bp, Homo sapiens
tttattgttgggtcttaagctg

SEQ ID NO: 9514254 - DNA, 22 bp, Homo sapiens
tttattgttgggtcttaagctg

SEQ ID NO: 9514255 - DNA, 22 bp, Homo sapiens
tttattgttgttagtcataagt

SEQ ID NO: 9514256 - DNA, 22 bp, Homo sapiens
tttattgttgttagtcataagt

SEQ ID NO: 9514257 - DNA, 22 bp, Homo sapiens
tttattgtttagaagggggctg

SEQ ID NO: 9514258 - DNA, 22 bp, Homo sapiens
tttatttaaagtcgtgtgttaa

SEQ ID NO: 9514259 - DNA, 22 bp, Homo sapiens
ctcctccacccgctggggccca

SEQ ID NO: 9514260 - DNA, 22 bp, Homo sapiens
ctcctccagacttactgaatcc

SEQ ID NO: 9514261 - DNA, 18 bp, Homo sapiens
ctcctccacagcccctgc

SEQ ID NO: 9514262 - DNA, 18 bp, Homo sapiens
ctcctccacagcccctgc

SEQ ID NO: 9514263 - DNA, 22 bp, Homo sapiens
ctcctccagctctccctggggg

SEQ ID NO: 9514264 - DNA, 22 bp, Homo sapiens
ctcctccagctctccctggggg

SEQ ID NO: 9514265 - DNA, 22 bp, Homo sapiens
ctcctccagctctccctggggg

SEQ ID NO: 9514266 - DNA, 22 bp, Homo sapiens
ctcctcccaattgccaagtgct

SEQ ID NO: 9514267 - DNA, 22 bp, Homo sapiens
ctcctcccaattgccaagtgct

SEQ ID NO: 9514268 - DNA, 22 bp, Homo sapiens
ctcctccagtgggtccctcagg

SEQ ID NO: 9514269 - DNA, 22 bp, Homo sapiens
ctcctccagtcctccaaggaca

SEQ ID NO: 9514270 - DNA, 22 bp, Homo sapiens
ctcctccagcttccagtggctc

SEQ ID NO: 9514271 - DNA, 22 bp, Homo sapiens
ctcctccagcttccagtggctc

SEQ ID NO: 9514272 - DNA, 22 bp, Homo sapiens
ctcctccagtgggtccctcagg

SEQ ID NO: 9514273 - DNA, 22 bp, Homo sapiens
ctcctccagtgggtccctcagg

SEQ ID NO: 9514274 - DNA, 20 bp, Homo sapiens
ctctctctccattcccaggg

SEQ ID NO: 9514275 - DNA, 20 bp, Homo sapiens
ctctctctccattcccaggg

SEQ ID NO: 9514276 - DNA, 20 bp, Homo sapiens
ctctctctccattcccaggg

SEQ ID NO: 9514277 - DNA, 22 bp, Homo sapiens
ctctctcttgtgttgctgcaga

SEQ ID NO: 9514278 - DNA, 22 bp, Homo sapiens
ctctctcttgtgttgctgcaga

SEQ ID NO: 9514279 - DNA, 22 bp, Homo sapiens
ctctctcttgtgttgctgcaga

SEQ ID NO: 9514280 - DNA, 22 bp, Homo sapiens
ctctctgaggcaggcctgtggg

SEQ ID NO: 9514281 - DNA, 22 bp, Homo sapiens
ctctctgaaactggagagtctc

SEQ ID NO: 9514282 - DNA, 22 bp, Homo sapiens
ctctctctttagaagcgtctgg

SEQ ID NO: 9514283 - DNA, 22 bp, Homo sapiens
ctctctctttagaagcgtctgg

SEQ ID NO: 9514284 - DNA, 22 bp, Homo sapiens
ctctctgctgtatccttaggct

SEQ ID NO: 9514285 - DNA, 22 bp, Homo sapiens
ctctctgctgtatccttaggct

SEQ ID NO: 9514286 - DNA, 22 bp, Homo sapiens
ctctctggaagggggagctgat

SEQ ID NO: 9514287 - DNA, 22 bp, Homo sapiens
ctctctgatgtcaggtcgctga

SEQ ID NO: 9514288 - DNA, 22 bp, Homo sapiens
ctctctgagtggctgtactttc

SEQ ID NO: 9514289 - DNA, 22 bp, Homo sapiens
tttccttgggtctcttagtggc

SEQ ID NO: 9514290 - DNA, 22 bp, Homo sapiens
tttccttgggtctcttagtggc

SEQ ID NO: 9514291 - DNA, 18 bp, Homo sapiens
tttccttgtatgaacata

SEQ ID NO: 9514292 - DNA, 18 bp, Homo sapiens
tttccttgtatgaacata

SEQ ID NO: 9514293 - DNA, 22 bp, Homo sapiens
tttccttgcctcctgtccttct

SEQ ID NO: 9514294 - DNA, 22 bp, Homo sapiens
tttccttgcctcctgtccttct

SEQ ID NO: 9514295 - DNA, 22 bp, Homo sapiens
ctctctggaagggggagctgat

SEQ ID NO: 9514296 - DNA, 22 bp, Homo sapiens
ctctctggaagggggagctgat

SEQ ID NO: 9514297 - DNA, 22 bp, Homo sapiens
ctctctggaagggggagctgat

SEQ ID NO: 9514298 - DNA, 22 bp, Homo sapiens
tttccttgcctcctgtccttct

SEQ ID NO: 9514299 - DNA, 22 bp, Homo sapiens
ctctccaggagagcactttgag

SEQ ID NO: 9514300 - DNA, 22 bp, Homo sapiens
ctctccaggagctcagagtcta

SEQ ID NO: 9514301 - DNA, 22 bp, Homo sapiens
tttcctcaactgtcaaatgggg

SEQ ID NO: 9514302 - DNA, 22 bp, Homo sapiens
ctctccaggcgaggtcctactg

SEQ ID NO: 9514303 - DNA, 22 bp, Homo sapiens
ctctccaggctgggacaggacc

SEQ ID NO: 9514304 - DNA, 22 bp, Homo sapiens
ctctccaggctgggacaggacc

SEQ ID NO: 9514305 - DNA, 22 bp, Homo sapiens
ctctccagggaagcagtgtact

SEQ ID NO: 9514306 - DNA, 22 bp, Homo sapiens
ctctccaggctgggacaggacc

SEQ ID NO: 9514307 - DNA, 22 bp, Homo sapiens
ctctccaggcgaggtcctactg

SEQ ID NO: 9514308 - DNA, 22 bp, Homo sapiens
ctctccagggcatgagttccac

SEQ ID NO: 9514309 - DNA, 22 bp, Homo sapiens
ctctccagggaagcagtgtact

SEQ ID NO: 9514310 - DNA, 22 bp, Homo sapiens
ctctccaggggtagatgccttc

SEQ ID NO: 9514311 - DNA, 22 bp, Homo sapiens
ctctcctggggagcacacacac

SEQ ID NO: 9514312 - DNA, 22 bp, Homo sapiens
ctctccagtcatattctcagtc

SEQ ID NO: 9514313 - DNA, 22 bp, Homo sapiens
ctctccaggttagagcacttat

SEQ ID NO: 9514314 - DNA, 22 bp, Homo sapiens
ctctccagtcatattctcagtc

SEQ ID NO: 9514315 - DNA, 22 bp, Homo sapiens
ctctccagtcatattctcagtc

SEQ ID NO: 9514316 - DNA, 22 bp, Homo sapiens
tttcaattccaccaaagcgccc

SEQ ID NO: 9514317 - DNA, 22 bp, Homo sapiens
tttcaattgactttggaagaaa

SEQ ID NO: 9514318 - DNA, 22 bp, Homo sapiens
tttcaattgactttggaagaaa

SEQ ID NO: 9514319 - DNA, 22 bp, Homo sapiens
tttcaatttccaggctagaatt

SEQ ID NO: 9514320 - DNA, 22 bp, Homo sapiens
tttcaatttccaggctagaatt

SEQ ID NO: 9514321 - DNA, 21 bp, Homo sapiens
tttcaatttgccttgagtcat

SEQ ID NO: 9514322 - DNA, 22 bp, Homo sapiens
tttcaatttccaggctagaatt

SEQ ID NO: 9514323 - DNA, 21 bp, Homo sapiens
tttcaatttgccttgagtcat

SEQ ID NO: 9514324 - DNA, 22 bp, Homo sapiens
tttcaaatggatccctcagcct

SEQ ID NO: 9514325 - DNA, 22 bp, Homo sapiens
tttcaaatggagtcgtgaaatg

SEQ ID NO: 9514326 - DNA, 22 bp, Homo sapiens
tttcaaatggagtcgtgaaatg

SEQ ID NO: 9514327 - DNA, 22 bp, Homo sapiens
tttcaaatggagtcgtgaaatg

SEQ ID NO: 9514328 - DNA, 22 bp, Homo sapiens
tttcaatgtaacatttccaggc

SEQ ID NO: 9514329 - DNA, 21 bp, Homo sapiens
tttcacaaaagtatgtgacaa

SEQ ID NO: 9514330 - DNA, 22 bp, Homo sapiens
tttcacaaactgaggagacaat

SEQ ID NO: 9514331 - DNA, 19 bp, Homo sapiens
tttcacaaagagagcgtga

SEQ ID NO: 9514332 - DNA, 22 bp, Homo sapiens
tttcacaaatgtctttaacttg

SEQ ID NO: 9514333 - DNA, 22 bp, Homo sapiens
tttcacaaagcatagcacttta

SEQ ID NO: 9514334 - DNA, 22 bp, Homo sapiens
tttcacaaagcatagcacttta

SEQ ID NO: 9514335 - DNA, 22 bp, Homo sapiens
tttcacaaagcatagcacttta

SEQ ID NO: 9514336 - DNA, 22 bp, Homo sapiens
tttcctaaggtagtgataattt

SEQ ID NO: 9514337 - DNA, 22 bp, Homo sapiens
tttcctaaggctcattttaaaa

SEQ ID NO: 9514338 - DNA, 20 bp, Homo sapiens
tttcctaagtggtttgctga

SEQ ID NO: 9514339 - DNA, 22 bp, Homo sapiens
tttcctaatcccaatgacattt

SEQ ID NO: 9514340 - DNA, 22 bp, Homo sapiens
tttcctaatcccaatgacattt

SEQ ID NO: 9514341 - DNA, 22 bp, Homo sapiens
tttcctaacacaatgcatgaga

SEQ ID NO: 9514342 - DNA, 22 bp, Homo sapiens
tttcctaacacaatgcatgaga

SEQ ID NO: 9514343 - DNA, 22 bp, Homo sapiens
tttcctaagatagatacttcag

SEQ ID NO: 9514344 - DNA, 22 bp, Homo sapiens
tttcctaactcatcggatgtac

SEQ ID NO: 9514345 - DNA, 22 bp, Homo sapiens
tttcctaaggctcattttaaaa

SEQ ID NO: 9514346 - DNA, 22 bp, Homo sapiens
tttcacatagaaagtgatttac

SEQ ID NO: 9514347 - DNA, 22 bp, Homo sapiens
tttcacatagaaagtgatttac

SEQ ID NO: 9514348 - DNA, 22 bp, Homo sapiens
tttcacatagaaagtgatttac

SEQ ID NO: 9514349 - DNA, 22 bp, Homo sapiens
tttcacatacagtgtatagtag

SEQ ID NO: 9514350 - DNA, 22 bp, Homo sapiens
tttcacatacagtgtatagtag

SEQ ID NO: 9514351 - DNA, 22 bp, Homo sapiens
tttcacataaatattatgccta

SEQ ID NO: 9514352 - DNA, 22 bp, Homo sapiens
tttcacataaatattatgccta

SEQ ID NO: 9514353 - DNA, 22 bp, Homo sapiens
tttcacataaatggagtaaaga

SEQ ID NO: 9514354 - DNA, 22 bp, Homo sapiens
tttcacataaatggagtaaaga

SEQ ID NO: 9514355 - DNA, 22 bp, Homo sapiens
tttcacagttagcatgaggact

SEQ ID NO: 9514356 - DNA, 22 bp, Homo sapiens
tttcacagtgctctgtaagtat

SEQ ID NO: 9514357 - DNA, 22 bp, Homo sapiens
tttcacagtcaatttggagtca

SEQ ID NO: 9514358 - DNA, 22 bp, Homo sapiens
cttcagctgcagttatgtttag

SEQ ID NO: 9514359 - DNA, 22 bp, Homo sapiens
cttcagcctcatctcagcccgt

SEQ ID NO: 9514360 - DNA, 22 bp, Homo sapiens
cttcagcctcgttactcctgcg

SEQ ID NO: 9514361 - DNA, 22 bp, Homo sapiens
cttcaggattaatttggggcct

SEQ ID NO: 9514362 - DNA, 20 bp, Homo sapiens
cttcaggacccatcctcccc

SEQ ID NO: 9514363 - DNA, 22 bp, Homo sapiens
cttcaggagtagttacctagca

SEQ ID NO: 9514364 - DNA, 22 bp, Homo sapiens
cttcaggaaaatctctaaggat

SEQ ID NO: 9514365 - DNA, 22 bp, Homo sapiens
cttcagctgcagttatgtttag

SEQ ID NO: 9514366 - DNA, 22 bp, Homo sapiens
cttcagctgcagttatgtttag

SEQ ID NO: 9514367 - DNA, 22 bp, Homo sapiens
cttcagtgattgcagaaagcct

SEQ ID NO: 9514368 - DNA, 22 bp, Homo sapiens
cttcagtgcatgtttataatca

SEQ ID NO: 9514369 - DNA, 22 bp, Homo sapiens
cttcagtgattgcagaaagcct

SEQ ID NO: 9514370 - DNA, 22 bp, Homo sapiens
cttcaggatttaggaagatgaa

SEQ ID NO: 9514371 - DNA, 22 bp, Homo sapiens
cttcagggtgacgcaggctgca

SEQ ID NO: 9514372 - DNA, 22 bp, Homo sapiens
cttcagtgaatgttgagtaagg

SEQ ID NO: 9514373 - DNA, 18 bp, Homo sapiens
cttcagtcttcccacctc

SEQ ID NO: 9514374 - DNA, 22 bp, Homo sapiens
cttcagtctccaatgctctgtg

SEQ ID NO: 9514375 - DNA, 22 bp, Homo sapiens
cttcagtatcctccacatgtta

SEQ ID NO: 9514376 - DNA, 22 bp, Homo sapiens
cttcagtccttaagccaagcaa

SEQ ID NO: 9514377 - DNA, 22 bp, Homo sapiens
cttcctctgtgtcctgggcttg

SEQ ID NO: 9514378 - DNA, 16 bp, Homo sapiens
cttcctcttcactggc

SEQ ID NO: 9514379 - DNA, 22 bp, Homo sapiens
cttcctctgtgtcctgggcttc

SEQ ID NO: 9514380 - DNA, 22 bp, Homo sapiens
cttcctgaaatgtctcaccagt

SEQ ID NO: 9514381 - DNA, 22 bp, Homo sapiens
cttcctgaaatgtctcaccagt

SEQ ID NO: 9514382 - DNA, 22 bp, Homo sapiens
cttcctgaaagtagtaggttga

SEQ ID NO: 9514383 - DNA, 18 bp, Homo sapiens
cttcctcttctggagaaa

SEQ ID NO: 9514384 - DNA, 22 bp, Homo sapiens
cttcctgaagaggttggtcagg

SEQ ID NO: 9514385 - DNA, 22 bp, Homo sapiens
cttcctgaacaatgccatcaat

SEQ ID NO: 9514386 - DNA, 22 bp, Homo sapiens
cttcctgaaggatggcagcctc

SEQ ID NO: 9514387 - DNA, 22 bp, Homo sapiens
cttcctgaaggatggcagcctc

SEQ ID NO: 9514388 - DNA, 22 bp, Homo sapiens
cttcctgaagaggttggtcagg

SEQ ID NO: 9514389 - DNA, 22 bp, Homo sapiens
cttcctgagcaaggaactatag

SEQ ID NO: 9514390 - DNA, 18 bp, Homo sapiens
cttcctgactagctctgg

SEQ ID NO: 9514391 - DNA, 22 bp, Homo sapiens
cttcctaaaagcttcaagagaa

SEQ ID NO: 9514392 - DNA, 22 bp, Homo sapiens
cttccgtgtcagttccaggtgg

SEQ ID NO: 9514393 - DNA, 22 bp, Homo sapiens
cttcctctgcctcccgtgctca

SEQ ID NO: 9514394 - DNA, 22 bp, Homo sapiens
cttcctctgaggcttctgagtc

SEQ ID NO: 9514395 - DNA, 22 bp, Homo sapiens
cttcctctgcctcccgtgctca

SEQ ID NO: 9514396 - DNA, 22 bp, Homo sapiens
cttcagtgtcctctctagtaga

SEQ ID NO: 9514397 - DNA, 23 bp, Homo sapiens
cttcagtgtgggactgcagcgtg

SEQ ID NO: 9514398 - DNA, 22 bp, Homo sapiens
cttcagtgttcccatctgtaaa

SEQ ID NO: 9514399 - DNA, 22 bp, Homo sapiens
cttatattttaggaacagacaa

SEQ ID NO: 9514400 - DNA, 22 bp, Homo sapiens
cttatcagattatctgggctgt

SEQ ID NO: 9514401 - DNA, 22 bp, Homo sapiens
cttattgggatgagaggatgca

SEQ ID NO: 9514402 - DNA, 22 bp, Homo sapiens
cttattggtcccaggaggagaa

SEQ ID NO: 9514403 - DNA, 22 bp, Homo sapiens
cttattggtggagtcaggccct

SEQ ID NO: 9514404 - DNA, 22 bp, Homo sapiens
cttattggtgctttttctcata

SEQ ID NO: 9514405 - DNA, 22 bp, Homo sapiens
cttattggtgctttttctcata

SEQ ID NO: 9514406 - DNA, 22 bp, Homo sapiens
cttattctactccacaagctct

SEQ ID NO: 9514407 - DNA, 22 bp, Homo sapiens
cttattctactccacaagctct

SEQ ID NO: 9514408 - DNA, 22 bp, Homo sapiens
cttattcttgtcttattgtgct

SEQ ID NO: 9514409 - DNA, 22 bp, Homo sapiens
cttattggagagttgggccctt

SEQ ID NO: 9514410 - DNA, 22 bp, Homo sapiens
cttattgaaagcccctgtgcct

SEQ ID NO: 9514411 - DNA, 22 bp, Homo sapiens
cttatttactgatccacagatg

SEQ ID NO: 9514412 - DNA, 22 bp, Homo sapiens
cttatttaatgagggttagaat

SEQ ID NO: 9514413 - DNA, 22 bp, Homo sapiens
cttattgttcagatagagatga

SEQ ID NO: 9514414 - DNA, 22 bp, Homo sapiens
cttattgttcagatagagatga

SEQ ID NO: 9514415 - DNA, 22 bp, Homo sapiens
cttattgttcctggaccctgag

SEQ ID NO: 9514416 - DNA, 18 bp, Homo sapiens
cttattgtttaaatggcc

SEQ ID NO: 9514417 - DNA, 22 bp, Homo sapiens
cttattgtgagatgcgataatt

SEQ ID NO: 9514418 - DNA, 22 bp, Homo sapiens
cttattgtgaggtattgagatt

SEQ ID NO: 9514419 - DNA, 22 bp, Homo sapiens
cttattgtcctgactcatggcc

SEQ ID NO: 9514420 - DNA, 22 bp, Homo sapiens
cttattgtcttacagtaataga

SEQ ID NO: 9514421 - DNA, 22 bp, Homo sapiens
cttattgtgtgtattttctagt

SEQ ID NO: 9514422 - DNA, 22 bp, Homo sapiens
cttattgtgtctttgaataagt

SEQ ID NO: 9514423 - DNA, 22 bp, Homo sapiens
cttattgtgataccatgcagta

SEQ ID NO: 9514424 - DNA, 22 bp, Homo sapiens
cttattgtgattcctgcctctt

SEQ ID NO: 9514425 - DNA, 22 bp, Homo sapiens
cttatttctccatccagagtca

SEQ ID NO: 9514426 - DNA, 22 bp, Homo sapiens
cttatttatgtctgtctctaat

SEQ ID NO: 9514427 - DNA, 22 bp, Homo sapiens
cttattttaagtcagtttgggt

SEQ ID NO: 9514428 - DNA, 22 bp, Homo sapiens
cttattttaagtcagtttgggt

SEQ ID NO: 9514429 - DNA, 22 bp, Homo sapiens
cttattttgctgatgacccagg

SEQ ID NO: 9514430 - DNA, 22 bp, Homo sapiens
cttattttaagtcagtttgggt

SEQ ID NO: 9514431 - DNA, 22 bp, Homo sapiens
cttattttaagtcagtttgggt

SEQ ID NO: 9514432 - DNA, 22 bp, Homo sapiens
cttattttgctgatgacccagg

SEQ ID NO: 9514433 - DNA, 22 bp, Homo sapiens
cttcaaaagccagaagcctgcg

SEQ ID NO: 9514434 - DNA, 22 bp, Homo sapiens
cttattttgctgatgacccagg

SEQ ID NO: 9514435 - DNA, 22 bp, Homo sapiens
cttcaaacactagaaacacagg

SEQ ID NO: 9514436 - DNA, 22 bp, Homo sapiens
cttcaaaagccagaagcctgcg

SEQ ID NO: 9514437 - DNA, 22 bp, Homo sapiens
cttcaaacactagaaacacagg

SEQ ID NO: 9514438 - DNA, 22 bp, Homo sapiens
cttcaaacccagattaaatgca

SEQ ID NO: 9514439 - DNA, 22 bp, Homo sapiens
cttcagaactataaaaagtact

SEQ ID NO: 9514440 - DNA, 22 bp, Homo sapiens
cttcagaactataaaaagtact

SEQ ID NO: 9514441 - DNA, 22 bp, Homo sapiens
cttcctgcaacacctgtgttgc

SEQ ID NO: 9514442 - DNA, 22 bp, Homo sapiens
cttcctgcaggacagccatctg

SEQ ID NO: 9514443 - DNA, 19 bp, Homo sapiens
cttcctggaggagagcctc

SEQ ID NO: 9514444 - DNA, 22 bp, Homo sapiens
cttcctggatgaagcccagcat

SEQ ID NO: 9514445 - DNA, 22 bp, Homo sapiens
cttcctggatgaagcccagcat

SEQ ID NO: 9514446 - DNA, 22 bp, Homo sapiens
cttcctggatgagcaggctgat

SEQ ID NO: 9514447 - DNA, 22 bp, Homo sapiens
cttgacactgtcactcaggcca

SEQ ID NO: 9514448 - DNA, 22 bp, Homo sapiens
cttgacactgtcactcaggcca

SEQ ID NO: 9514449 - DNA, 22 bp, Homo sapiens
cttcctgggtctggagactgga

SEQ ID NO: 9514450 - DNA, 22 bp, Homo sapiens
cttgacaactggcagatatata

SEQ ID NO: 9514451 - DNA, 22 bp, Homo sapiens
cttcctggcatgggtctcatga

SEQ ID NO: 9514452 - DNA, 22 bp, Homo sapiens
cttcctgggcaatgttctgctt

SEQ ID NO: 9514453 - DNA, 22 bp, Homo sapiens
cttcctgggacacctaactcta

SEQ ID NO: 9514454 - DNA, 22 bp, Homo sapiens
cttgcagtgtggccttgaagag

SEQ ID NO: 9514455 - DNA, 23 bp, Homo sapiens
cttgcagggctggaggcttagaa

SEQ ID NO: 9514456 - DNA, 22 bp, Homo sapiens
cttgcaggcagggacactgtct

SEQ ID NO: 9514457 - DNA, 22 bp, Homo sapiens
cttgcaggcagggcctcctgga

SEQ ID NO: 9514458 - DNA, 22 bp, Homo sapiens
cttgcaggcccagccttacaag

SEQ ID NO: 9514459 - DNA, 23 bp, Homo sapiens
cttgcaggaagcagatggcacac

SEQ ID NO: 9514460 - DNA, 22 bp, Homo sapiens
cttgcaggattttgctgctgta

SEQ ID NO: 9514461 - DNA, 22 bp, Homo sapiens
cttgcagaggctgttccagatg

SEQ ID NO: 9514462 - DNA, 22 bp, Homo sapiens
cttgcagatgtgactaaattaa

SEQ ID NO: 9514463 - DNA, 22 bp, Homo sapiens
cttgcacatttcacacaatagg

SEQ ID NO: 9514464 - DNA, 22 bp, Homo sapiens
cttgcacatttcacacaatagg

SEQ ID NO: 9514465 - DNA, 22 bp, Homo sapiens
cttgcacagtgactaacacgta

SEQ ID NO: 9514466 - DNA, 22 bp, Homo sapiens
cttgatttattacccactatat

SEQ ID NO: 9514467 - DNA, 22 bp, Homo sapiens
cttgcaaacactcaaagccatc

SEQ ID NO: 9514468 - DNA, 22 bp, Homo sapiens
cttgacttcttctagaaataag

SEQ ID NO: 9514469 - DNA, 22 bp, Homo sapiens
cttgatctacatagtgaaaccc

SEQ ID NO: 9514470 - DNA, 20 bp, Homo sapiens
cttgatgagataaacagcag

SEQ ID NO: 9514471 - DNA, 22 bp, Homo sapiens
cttgtcctttacttgagactca

SEQ ID NO: 9514472 - DNA, 22 bp, Homo sapiens
cttgtctgggcagcttgggagt

SEQ ID NO: 9514473 - DNA, 23 bp, Homo sapiens
cttgtctaattcatggtgaaggc

SEQ ID NO: 9514474 - DNA, 22 bp, Homo sapiens
cttgtcctttacttgagactca

SEQ ID NO: 9514475 - DNA, 22 bp, Homo sapiens
cttgtcttgcacacggttgcca

SEQ ID NO: 9514476 - DNA, 22 bp, Homo sapiens
cttgtcttgcacacggttgcca

SEQ ID NO: 9514477 - DNA, 21 bp, Homo sapiens
cttgtcttgcttagaatagac

SEQ ID NO: 9514478 - DNA, 22 bp, Homo sapiens
cttgtcttgcacacggttgcca

SEQ ID NO: 9514479 - DNA, 22 bp, Homo sapiens
cttgtcttgcacacggttgcca

SEQ ID NO: 9514480 - DNA, 22 bp, Homo sapiens
ctttatgagccttgtgaaggag

SEQ ID NO: 9514481 - DNA, 22 bp, Homo sapiens
ctttatgtccttgaagagttgt

SEQ ID NO: 9514482 - DNA, 22 bp, Homo sapiens
ctttatgtccaccagactgcaa

SEQ ID NO: 9514483 - DNA, 22 bp, Homo sapiens
cttgtattcccctatctctaaa

SEQ ID NO: 9514484 - DNA, 22 bp, Homo sapiens
cttgtattaagcttagagaggc

SEQ ID NO: 9514485 - DNA, 22 bp, Homo sapiens
cttgtattaggaagaatgcttt

SEQ ID NO: 9514486 - DNA, 22 bp, Homo sapiens
cttgtcactctggctccagagc

SEQ ID NO: 9514487 - DNA, 22 bp, Homo sapiens
cttgtcagccaattgtggattt

SEQ ID NO: 9514488 - DNA, 22 bp, Homo sapiens
cttgtcagccaattgtggattt

SEQ ID NO: 9514489 - DNA, 22 bp, Homo sapiens
cttgtattgctgttttgcatct

SEQ ID NO: 9514490 - DNA, 22 bp, Homo sapiens
cttgtattcttccacttaagat

SEQ ID NO: 9514491 - DNA, 22 bp, Homo sapiens
cttgtattctgcctaaccttca

SEQ ID NO: 9514492 - DNA, 22 bp, Homo sapiens
cttgtattctgcctaaccttca

SEQ ID NO: 9514493 - DNA, 22 bp, Homo sapiens
cttgtacatcactggcagatgg

SEQ ID NO: 9514494 - DNA, 22 bp, Homo sapiens
cttgtacatagagaagaagcct

SEQ ID NO: 9514495 - DNA, 22 bp, Homo sapiens
cttgtacaggaatccatggtat

SEQ ID NO: 9514496 - DNA, 22 bp, Homo sapiens
cttgtacaggaatccatggtat

SEQ ID NO: 9514497 - DNA, 22 bp, Homo sapiens
cttgtagaattgaaatggtctc

SEQ ID NO: 9514498 - DNA, 22 bp, Homo sapiens
cttgtagaattgaaatggtctc

SEQ ID NO: 9514499 - DNA, 22 bp, Homo sapiens
cttgtacattgatttctgcatt

SEQ ID NO: 9514500 - DNA, 22 bp, Homo sapiens
cttgtagacccctggactcacg

SEQ ID NO: 9514501 - DNA, 22 bp, Homo sapiens
cttgtagacccctggactcacg

SEQ ID NO: 9514502 - DNA, 22 bp, Homo sapiens
cttgtagaattgaaatggtctc

SEQ ID NO: 9514503 - DNA, 20 bp, Homo sapiens
cttgccagttccctggcaga

SEQ ID NO: 9514504 - DNA, 20 bp, Homo sapiens
cttgccagttccctggcaga

SEQ ID NO: 9514505 - DNA, 22 bp, Homo sapiens
cttgcccaccagtcagtggctt

SEQ ID NO: 9514506 - DNA, 20 bp, Homo sapiens
cttgcccagggtctcctgcc

SEQ ID NO: 9514507 - DNA, 22 bp, Homo sapiens
cttgcctacttgtcaaccagca

SEQ ID NO: 9514508 - DNA, 22 bp, Homo sapiens
cttgggtataaaacttggctat

SEQ ID NO: 9514509 - DNA, 22 bp, Homo sapiens
cttgggtcatctcttgcttctg

SEQ ID NO: 9514510 - DNA, 22 bp, Homo sapiens
cttgccagtgttgcagaagctc

SEQ ID NO: 9514511 - DNA, 22 bp, Homo sapiens
cttgcagtttaggtcctctgtg

SEQ ID NO: 9514512 - DNA, 22 bp, Homo sapiens
cttgcagtgtggccttgaagag

SEQ ID NO: 9514513 - DNA, 20 bp, Homo sapiens
cttgcagtttcaccttcact

SEQ ID NO: 9514514 - DNA, 22 bp, Homo sapiens
cttgccagcacttggccagctg

SEQ ID NO: 9514515 - DNA, 22 bp, Homo sapiens
cttgccaatggtacaaacgatt

SEQ ID NO: 9514516 - DNA, 18 bp, Homo sapiens
ctgttgagatgtggctga

SEQ ID NO: 9514517 - DNA, 22 bp, Homo sapiens
ctgttctggagacactgatgaa

SEQ ID NO: 9514518 - DNA, 22 bp, Homo sapiens
ctgttctgtaagctgctgttgt

SEQ ID NO: 9514519 - DNA, 22 bp, Homo sapiens
ctgttgctctgaacaggtcttg

SEQ ID NO: 9514520 - DNA, 22 bp, Homo sapiens
ctgttgctcccagggagagggt

SEQ ID NO: 9514521 - DNA, 22 bp, Homo sapiens
ctgttgctgggaacgcatgtca

SEQ ID NO: 9514522 - DNA, 19 bp, Homo sapiens
ctgttgctggggctctctt

SEQ ID NO: 9514523 - DNA, 22 bp, Homo sapiens
ctgttgagtaatttatatcagg

SEQ ID NO: 9514524 - DNA, 22 bp, Homo sapiens
ctgttgctaagtagtgcaggta

SEQ ID NO: 9514525 - DNA, 22 bp, Homo sapiens
ctgttctgaactgcctgcatgc

SEQ ID NO: 9514526 - DNA, 22 bp, Homo sapiens
ctgttctgaactgcctgcatgc

SEQ ID NO: 9514527 - DNA, 22 bp, Homo sapiens
ctgttctgaactgcctgcatgc

SEQ ID NO: 9514528 - DNA, 20 bp, Homo sapiens
ctgttcctgtcccatgaagc

SEQ ID NO: 9514529 - DNA, 22 bp, Homo sapiens
ctgttcccggtggccgggccag

SEQ ID NO: 9514530 - DNA, 22 bp, Homo sapiens
ctgttcctccacctcaacaaac

SEQ ID NO: 9514531 - DNA, 22 bp, Homo sapiens
ctgttcctctggcatatggaga

SEQ ID NO: 9514532 - DNA, 22 bp, Homo sapiens
ctgttcctgtagagtccaagtc

SEQ ID NO: 9514533 - DNA, 22 bp, Homo sapiens
ctgttattttcctctgaactct

SEQ ID NO: 9514534 - DNA, 22 bp, Homo sapiens
ctgttattttataattcaagaa

SEQ ID NO: 9514535 - DNA, 22 bp, Homo sapiens
ctgttcacagaatcctcccctg

SEQ ID NO: 9514536 - DNA, 22 bp, Homo sapiens
ctgtgtctgaataactctgtgt

SEQ ID NO: 9514537 - DNA, 22 bp, Homo sapiens
ctgtgtctgcctgggatccatt

SEQ ID NO: 9514538 - DNA, 22 bp, Homo sapiens
ctgtgtctgcctgggatccatt

SEQ ID NO: 9514539 - DNA, 22 bp, Homo sapiens
ctgtgtctgcctgggatccatt

SEQ ID NO: 9514540 - DNA, 22 bp, Homo sapiens
ctgtgtctgaataactctgtgt

SEQ ID NO: 9514541 - DNA, 22 bp, Homo sapiens
ctgtgtctctacctccccatcc

SEQ ID NO: 9514542 - DNA, 22 bp, Homo sapiens
ctgtgtctctccttacaagact

SEQ ID NO: 9514543 - DNA, 22 bp, Homo sapiens
ctgtgtctctccttacaagact

SEQ ID NO: 9514544 - DNA, 22 bp, Homo sapiens
ctgtgtctcgttaaagcattgg

SEQ ID NO: 9514545 - DNA, 22 bp, Homo sapiens
ctgtgtctctacctccccatcc

SEQ ID NO: 9514546 - DNA, 22 bp, Homo sapiens
ctgtgtctcatccgcctctggc

SEQ ID NO: 9514547 - DNA, 22 bp, Homo sapiens
ctgtgtctcatccgcctctggc

SEQ ID NO: 9514548 - DNA, 22 bp, Homo sapiens
ctgtgtctcatccgcctctggc

SEQ ID NO: 9514549 - DNA, 22 bp, Homo sapiens
ctgtgtctcccaaggagggtca

SEQ ID NO: 9514550 - DNA, 22 bp, Homo sapiens
ctgtgtctccttggtgggatat

SEQ ID NO: 9514551 - DNA, 22 bp, Homo sapiens
ctgtgtctcatccgcctctggc

SEQ ID NO: 9514552 - DNA, 22 bp, Homo sapiens
ctgtgtcttcacatttgtgtgc

SEQ ID NO: 9514553 - DNA, 22 bp, Homo sapiens
ctgtgtcttcctctgcccaggc

SEQ ID NO: 9514554 - DNA, 22 bp, Homo sapiens
ctgtgtcttcctctgcccaggc

SEQ ID NO: 9514555 - DNA, 22 bp, Homo sapiens
ctgtgtcttctgcttacagtct

SEQ ID NO: 9514556 - DNA, 22 bp, Homo sapiens
ctgtgtctgtggaatagcgaat

SEQ ID NO: 9514557 - DNA, 22 bp, Homo sapiens
ctgtgtcttcaatgtactggga

SEQ ID NO: 9514558 - DNA, 22 bp, Homo sapiens
ctgtgtcttcaatgtactggga

SEQ ID NO: 9514559 - DNA, 22 bp, Homo sapiens
ctgtgtcttcaatgtactggga

SEQ ID NO: 9514560 - DNA, 22 bp, Homo sapiens
ctgtgtcttcaatgtactggga

SEQ ID NO: 9514561 - DNA, 22 bp, Homo sapiens
ctgtgtcttctgcttacagtct

SEQ ID NO: 9514562 - DNA, 22 bp, Homo sapiens
ctgttaagcaacatgagtaagt

SEQ ID NO: 9514563 - DNA, 22 bp, Homo sapiens
ctgttaatggaggactacagga

SEQ ID NO: 9514564 - DNA, 22 bp, Homo sapiens
ctgttaatctgcttgcatgatg

SEQ ID NO: 9514565 - DNA, 22 bp, Homo sapiens
ctgttaagtgtagataatgtgg

SEQ ID NO: 9514566 - DNA, 17 bp, Homo sapiens
ctgttaattcatttccc

SEQ ID NO: 9514567 - DNA, 17 bp, Homo sapiens
ctgttaattcatttccc

SEQ ID NO: 9514568 - DNA, 22 bp, Homo sapiens
ctgtggctgtatttggccagag

SEQ ID NO: 9514569 - DNA, 22 bp, Homo sapiens
ctgtggctgtatttggccagag

SEQ ID NO: 9514570 - DNA, 22 bp, Homo sapiens
ctgtggctggctcatcataggt

SEQ ID NO: 9514571 - DNA, 22 bp, Homo sapiens
ctgtggctgcgtaggtctggca

SEQ ID NO: 9514572 - DNA, 22 bp, Homo sapiens
ctgtggctgcgtaggtctggca

SEQ ID NO: 9514573 - DNA, 22 bp, Homo sapiens
ctgtggctggcctgtctgacat

SEQ ID NO: 9514574 - DNA, 22 bp, Homo sapiens
ctgtggttggagtgcagtgaga

SEQ ID NO: 9514575 - DNA, 22 bp, Homo sapiens
ctgtggtgggccctgggcttca

SEQ ID NO: 9514576 - DNA, 22 bp, Homo sapiens
ctgtggtggcctccctgccatg

SEQ ID NO: 9514577 - DNA, 22 bp, Homo sapiens
ctgtggctgtgaaacttctcag

SEQ ID NO: 9514578 - DNA, 22 bp, Homo sapiens
ctgtggctgtgaaacttctcag

SEQ ID NO: 9514579 - DNA, 22 bp, Homo sapiens
ctgtggctgtatttggccagag

SEQ ID NO: 9514580 - DNA, 23 bp, Homo sapiens
ctgtgtctatgcagccatatcca

SEQ ID NO: 9514581 - DNA, 23 bp, Homo sapiens
ctgtgtctatgcagccatatcca

SEQ ID NO: 9514582 - DNA, 22 bp, Homo sapiens
ctgtgtctcatccgcctctggc

SEQ ID NO: 9514583 - DNA, 22 bp, Homo sapiens
ctgtgtctaatcaggtcagtca

SEQ ID NO: 9514584 - DNA, 22 bp, Homo sapiens
ctgtgtctaatcttatacatca

SEQ ID NO: 9514585 - DNA, 22 bp, Homo sapiens
ctgtgtctaatcaggtcagtca

SEQ ID NO: 9514586 - DNA, 22 bp, Homo sapiens
ctgtgtctaatcaggtcagtca

SEQ ID NO: 9514587 - DNA, 22 bp, Homo sapiens
ctgtgtcctcccgctgcaccca

SEQ ID NO: 9514588 - DNA, 22 bp, Homo sapiens
ctgtgtcctccccatcacttct

SEQ ID NO: 9514589 - DNA, 22 bp, Homo sapiens
ctgtgtagtcaggtggtcccac

SEQ ID NO: 9514590 - DNA, 22 bp, Homo sapiens
ctgtgtagctctgggtgcaagt

SEQ ID NO: 9514591 - DNA, 22 bp, Homo sapiens
ctgtgtcctgtctcctaaggtg

SEQ ID NO: 9514592 - DNA, 22 bp, Homo sapiens
ctgtgtcctgtctcctaaggtg

SEQ ID NO: 9514593 - DNA, 22 bp, Homo sapiens
ctgtggctgaactctgaagagg

SEQ ID NO: 9514594 - DNA, 22 bp, Homo sapiens
ctgtggctctttagttgagcac

SEQ ID NO: 9514595 - DNA, 19 bp, Homo sapiens
ctgtggctgacctctggcc

SEQ ID NO: 9514596 - DNA, 19 bp, Homo sapiens
ctgtggctgacctctggcc

SEQ ID NO: 9514597 - DNA, 22 bp, Homo sapiens
ctgtggctgagttccttatgtt

SEQ ID NO: 9514598 - DNA, 23 bp, Homo sapiens
ctgtggctgagtcctgttggagt

SEQ ID NO: 9514599 - DNA, 22 bp, Homo sapiens
ctgtggctgcgtaggtctggca

SEQ ID NO: 9514600 - DNA, 22 bp, Homo sapiens
ctgtggctgcgccctgggggag

SEQ ID NO: 9514601 - DNA, 22 bp, Homo sapiens
ctgtggctgcgccctgggggag

SEQ ID NO: 9514602 - DNA, 22 bp, Homo sapiens
ctgtggctgcgccatcgaaaac

SEQ ID NO: 9514603 - DNA, 22 bp, Homo sapiens
ctgtggctgcgccatcgaaaac

SEQ ID NO: 9514604 - DNA, 22 bp, Homo sapiens
ctgtggctgcagccttggtcct

SEQ ID NO: 9514605 - DNA, 22 bp, Homo sapiens
ctgtggctgcagccttggtcct

SEQ ID NO: 9514606 - DNA, 22 bp, Homo sapiens
ctgtggctgcagccttggtcct

SEQ ID NO: 9514607 - DNA, 22 bp, Homo sapiens
ctgtggctctctgcagggtccc

SEQ ID NO: 9514608 - DNA, 22 bp, Homo sapiens
ctgtggctctctgcagggtccc

SEQ ID NO: 9514609 - DNA, 22 bp, Homo sapiens
ctgtggctctctgcagggtccc

SEQ ID NO: 9514610 - DNA, 22 bp, Homo sapiens
ctgtggctctccaatggaggga

SEQ ID NO: 9514611 - DNA, 22 bp, Homo sapiens
ctgtggctctcagaggctgctg

SEQ ID NO: 9514612 - DNA, 22 bp, Homo sapiens
ctgtggctctcagaggctgctg

SEQ ID NO: 9514613 - DNA, 22 bp, Homo sapiens
ctgtggctctcagaggctgctg

SEQ ID NO: 9514614 - DNA, 22 bp, Homo sapiens
ctgtggctctcagaggctgctg

SEQ ID NO: 9514615 - DNA, 22 bp, Homo sapiens
ctgtggctctcagaggctgctg

SEQ ID NO: 9514616 - DNA, 20 bp, Homo sapiens
ctgtggctcatgcatctgcc

SEQ ID NO: 9514617 - DNA, 20 bp, Homo sapiens
ctgtggctcatgcatctgcc

SEQ ID NO: 9514618 - DNA, 20 bp, Homo sapiens
ctgtggctcatgcatctgcc

SEQ ID NO: 9514619 - DNA, 22 bp, Homo sapiens
ctgtggctccatagaagttgca

SEQ ID NO: 9514620 - DNA, 22 bp, Homo sapiens
ctgtcctgatggtgccactggt

SEQ ID NO: 9514621 - DNA, 20 bp, Homo sapiens
ctgtcctgatcttttcagaa

SEQ ID NO: 9514622 - DNA, 22 bp, Homo sapiens
ctgtcctgatggtgccactggt

SEQ ID NO: 9514623 - DNA, 22 bp, Homo sapiens
ctgtcctgatggtgccactggt

SEQ ID NO: 9514624 - DNA, 22 bp, Homo sapiens
ctgtcctgatggtgccactggt

SEQ ID NO: 9514625 - DNA, 22 bp, Homo sapiens
ctgtcctgaggcaggtggcctg

SEQ ID NO: 9514626 - DNA, 22 bp, Homo sapiens
ctgtcctgagataaagatgagg

SEQ ID NO: 9514627 - DNA, 22 bp, Homo sapiens
ctgtcctgaggcaggtggcctg

SEQ ID NO: 9514628 - DNA, 22 bp, Homo sapiens
ctgtcctgagttcttggaggtc

SEQ ID NO: 9514629 - DNA, 22 bp, Homo sapiens
ctgtcctgcagttgggggcagg

SEQ ID NO: 9514630 - DNA, 22 bp, Homo sapiens
ctgtcctgccagtcctggactc

SEQ ID NO: 9514631 - DNA, 22 bp, Homo sapiens
ctgtcctgccagtcctggactc

SEQ ID NO: 9514632 - DNA, 23 bp, Homo sapiens
ctgtcctgccatccacagcggcc

SEQ ID NO: 9514633 - DNA, 22 bp, Homo sapiens
ctgtcctgcccaccctgcaggg

SEQ ID NO: 9514634 - DNA, 22 bp, Homo sapiens
ctgtcctgcccaccctgcaggg

SEQ ID NO: 9514635 - DNA, 22 bp, Homo sapiens
ctgtcctgcccaccctgcaggg

SEQ ID NO: 9514636 - DNA, 22 bp, Homo sapiens
ctgtcctgggggtggtccttgc

SEQ ID NO: 9514637 - DNA, 22 bp, Homo sapiens
ctgtcctgggggtggtccttgc

SEQ ID NO: 9514638 - DNA, 22 bp, Homo sapiens
ctgtcctggggaaagccagccc

SEQ ID NO: 9514639 - DNA, 22 bp, Homo sapiens
ctgtcctggccgcccttgtgag

SEQ ID NO: 9514640 - DNA, 22 bp, Homo sapiens
ctgtcctggagggcataggacg

SEQ ID NO: 9514641 - DNA, 22 bp, Homo sapiens
ctgtcctgcccaccctgcaggg

SEQ ID NO: 9514642 - DNA, 22 bp, Homo sapiens
ctgtcctggagggcataggacg

SEQ ID NO: 9514643 - DNA, 22 bp, Homo sapiens
ctgtcctgtactttgaggccct

SEQ ID NO: 9514644 - DNA, 22 bp, Homo sapiens
ctgtcctgtagctccatcagtc

SEQ ID NO: 9514645 - DNA, 22 bp, Homo sapiens
ctgtcctgtactttgaggccct

SEQ ID NO: 9514646 - DNA, 22 bp, Homo sapiens
ctgtcctgtagctccatcagtc

SEQ ID NO: 9514647 - DNA, 22 bp, Homo sapiens
ctgtcctgtagctccatcagtc

SEQ ID NO: 9514648 - DNA, 21 bp, Homo sapiens
ctgtcctggtctagaggcaca

SEQ ID NO: 9514649 - DNA, 21 bp, Homo sapiens
ctgtcctggtctagaggcaca

SEQ ID NO: 9514650 - DNA, 22 bp, Homo sapiens
ctgtcctggtgctggggatccc

SEQ ID NO: 9514651 - DNA, 21 bp, Homo sapiens
ctgtcctggtctagaggcaca

SEQ ID NO: 9514652 - DNA, 19 bp, Homo sapiens
ctgtcctggtttggtccct

SEQ ID NO: 9514653 - DNA, 22 bp, Homo sapiens
ctgggtctgtgcccagggacct

SEQ ID NO: 9514654 - DNA, 19 bp, Homo sapiens
ctgggtcttattctgtgaa

SEQ ID NO: 9514655 - DNA, 22 bp, Homo sapiens
ctgggtctgtgcccagggacct

SEQ ID NO: 9514656 - DNA, 22 bp, Homo sapiens
ctgggtctgtgcccagggacct

SEQ ID NO: 9514657 - DNA, 22 bp, Homo sapiens
ctgggtctgtcactagataaat

SEQ ID NO: 9514658 - DNA, 22 bp, Homo sapiens
ctgggtcttcagcagcaggcgg

SEQ ID NO: 9514659 - DNA, 22 bp, Homo sapiens
ctgggtctttttcttccattga

SEQ ID NO: 9514660 - DNA, 22 bp, Homo sapiens
ctgggtcttcagcagcaggcgg

SEQ ID NO: 9514661 - DNA, 22 bp, Homo sapiens
ctgggtctttttcttccattga

SEQ ID NO: 9514662 - DNA, 22 bp, Homo sapiens
ctgggtgacagagtgagatggt

SEQ ID NO: 9514663 - DNA, 22 bp, Homo sapiens
ctgggtgagttgatgaaggaga

SEQ ID NO: 9514664 - DNA, 22 bp, Homo sapiens
ctgggtgcgtgagcgcatgcgt

SEQ ID NO: 9514665 - DNA, 22 bp, Homo sapiens
ctgggtgccagcatggctgagt

SEQ ID NO: 9514666 - DNA, 22 bp, Homo sapiens
ctgtccctgagcaactcctgtt

SEQ ID NO: 9514667 - DNA, 22 bp, Homo sapiens
ctgtccctgagcaactcctgtt

SEQ ID NO: 9514668 - DNA, 22 bp, Homo sapiens
ctgggtgctgtgggctcagagg

SEQ ID NO: 9514669 - DNA, 22 bp, Homo sapiens
ctgtcccttcattattcactac

SEQ ID NO: 9514670 - DNA, 22 bp, Homo sapiens
ctgtccctgagcaactcctgtt

SEQ ID NO: 9514671 - DNA, 22 bp, Homo sapiens
ctgtcctgaagttttcatgaga

SEQ ID NO: 9514672 - DNA, 22 bp, Homo sapiens
ctgtcctgaaagggagattggg

SEQ ID NO: 9514673 - DNA, 22 bp, Homo sapiens
ctgtcctgaagttttcatgaga

SEQ ID NO: 9514674 - DNA, 22 bp, Homo sapiens
ctgtcctgtagctccatcagtc

SEQ ID NO: 9514675 - DNA, 22 bp, Homo sapiens
ctgtcctgtgcattgtcagatg

SEQ ID NO: 9514676 - DNA, 22 bp, Homo sapiens
ctgtcctgtggacctgaggacg

SEQ ID NO: 9514677 - DNA, 22 bp, Homo sapiens
ctgtcctgtgcattgtcagatg

SEQ ID NO: 9514678 - DNA, 22 bp, Homo sapiens
ctgtgagggccagagtcagggc

SEQ ID NO: 9514679 - DNA, 22 bp, Homo sapiens
ctgtgagggtcacagccatgcc

SEQ ID NO: 9514680 - DNA, 22 bp, Homo sapiens
ctgtgagggtcacagccatgcc

SEQ ID NO: 9514681 - DNA, 22 bp, Homo sapiens
ctgtgagggtcacagccatgcc

SEQ ID NO: 9514682 - DNA, 22 bp, Homo sapiens
ctgtgcagtggcagcgtgtggg

SEQ ID NO: 9514683 - DNA, 22 bp, Homo sapiens
ctgtgccactgccccaggcctc

SEQ ID NO: 9514684 - DNA, 22 bp, Homo sapiens
ctgtgccactgccctgccacgc

SEQ ID NO: 9514685 - DNA, 22 bp, Homo sapiens
ctgtgccactgccccaggcctc

SEQ ID NO: 9514686 - DNA, 22 bp, Homo sapiens
ctgtgccactgccctgccacgc

SEQ ID NO: 9514687 - DNA, 22 bp, Homo sapiens
ctgtgccactgggggccggcaa

SEQ ID NO: 9514688 - DNA, 22 bp, Homo sapiens
ctgtgcattgttgagtgtttag

SEQ ID NO: 9514689 - DNA, 22 bp, Homo sapiens
ctgtgcagtggggctctgggtt

SEQ ID NO: 9514690 - DNA, 22 bp, Homo sapiens
ctgtgcccacctggctctgagg

SEQ ID NO: 9514691 - DNA, 22 bp, Homo sapiens
ctgtgcccacctggctctgagg

SEQ ID NO: 9514692 - DNA, 22 bp, Homo sapiens
ctgtgcccacctggctctgagg

SEQ ID NO: 9514693 - DNA, 22 bp, Homo sapiens
ctgtgcccagctccctgactgc

SEQ ID NO: 9514694 - DNA, 22 bp, Homo sapiens
ctgtgcccaggctggagtgcag

SEQ ID NO: 9514695 - DNA, 22 bp, Homo sapiens
ctgtgcccaggcccctggggat

SEQ ID NO: 9514696 - DNA, 22 bp, Homo sapiens
ctgtgccatcctagggctgctg

SEQ ID NO: 9514697 - DNA, 22 bp, Homo sapiens
ctgtgccatcctagggctgctg

SEQ ID NO: 9514698 - DNA, 22 bp, Homo sapiens
ctgtgccctctttgctggcctt

SEQ ID NO: 9514699 - DNA, 19 bp, Homo sapiens
ctgtgccctatgacttgta

SEQ ID NO: 9514700 - DNA, 19 bp, Homo sapiens
ctgtgccctatgacttgta

SEQ ID NO: 9514701 - DNA, 23 bp, Homo sapiens
ctgtgcccggggctccacctgat

SEQ ID NO: 9514702 - DNA, 22 bp, Homo sapiens
ctgtgcccataatctggtattt

SEQ ID NO: 9514703 - DNA, 22 bp, Homo sapiens
ctgtgccccacagagctccaca

SEQ ID NO: 9514704 - DNA, 22 bp, Homo sapiens
ctgtgccccacagagctccaca

SEQ ID NO: 9514705 - DNA, 22 bp, Homo sapiens
ctgtgcccggcccagggccctg

SEQ ID NO: 9514706 - DNA, 22 bp, Homo sapiens
ctgtggccagatggtgccagtt

SEQ ID NO: 9514707 - DNA, 22 bp, Homo sapiens
ctgtggctcaggcctgtaagcc

SEQ ID NO: 9514708 - DNA, 22 bp, Homo sapiens
ctgtggccccaccctcttggcc

SEQ ID NO: 9514709 - DNA, 22 bp, Homo sapiens
ctgccagaagagaacaccagtt

SEQ ID NO: 9514710 - DNA, 22 bp, Homo sapiens
ctgccagaagagaacaccagtt

SEQ ID NO: 9514711 - DNA, 22 bp, Homo sapiens
ctgccagatcattggattcaca

SEQ ID NO: 9514712 - DNA, 22 bp, Homo sapiens
ctgccagaaggttcctgctgca

SEQ ID NO: 9514713 - DNA, 22 bp, Homo sapiens
ctgccagagatctgggcagagt

SEQ ID NO: 9514714 - DNA, 22 bp, Homo sapiens
ctgccagagatctgggcagagt

SEQ ID NO: 9514715 - DNA, 22 bp, Homo sapiens
ctgccactttcacccagtgctc

SEQ ID NO: 9514716 - DNA, 22 bp, Homo sapiens
ctgccactttggagtgctcaga

SEQ ID NO: 9514717 - DNA, 21 bp, Homo sapiens
ctgccacctgctccatcagca

SEQ ID NO: 9514718 - DNA, 22 bp, Homo sapiens
ctgccactctgggtgggcctgg

SEQ ID NO: 9514719 - DNA, 22 bp, Homo sapiens
ctgcatcattttcagacaatgg

SEQ ID NO: 9514720 - DNA, 22 bp, Homo sapiens
ctgcatcagtggatatgatggt

SEQ ID NO: 9514721 - DNA, 22 bp, Homo sapiens
ctgccaagtaatgcctgggctc

SEQ ID NO: 9514722 - DNA, 22 bp, Homo sapiens
ctgccaaggctggggaggacaa

SEQ ID NO: 9514723 - DNA, 22 bp, Homo sapiens
ctgccaaggctggggaggacaa

SEQ ID NO: 9514724 - DNA, 22 bp, Homo sapiens
ctgccaaggctggggaggacaa

SEQ ID NO: 9514725 - DNA, 22 bp, Homo sapiens
ctgcatccatgttgctgcaaag

SEQ ID NO: 9514726 - DNA, 22 bp, Homo sapiens
ctgccacaggggagcaggcaga

SEQ ID NO: 9514727 - DNA, 22 bp, Homo sapiens
ctgccaccatgccccagcagag

SEQ ID NO: 9514728 - DNA, 22 bp, Homo sapiens
ctgccaccatgccccagcagag

SEQ ID NO: 9514729 - DNA, 22 bp, Homo sapiens
ctgccagcaagctaccctggca

SEQ ID NO: 9514730 - DNA, 22 bp, Homo sapiens
ctgccagccaggccaggtaggc

SEQ ID NO: 9514731 - DNA, 22 bp, Homo sapiens
ctgccagctagctcctagttga

SEQ ID NO: 9514732 - DNA, 22 bp, Homo sapiens
ctgccagctcaaagcgcagcta

SEQ ID NO: 9514733 - DNA, 22 bp, Homo sapiens
ctgccagctcaccggctcagac

SEQ ID NO: 9514734 - DNA, 22 bp, Homo sapiens
ctggcagccaagtgggatactc

SEQ ID NO: 9514735 - DNA, 22 bp, Homo sapiens
ctggcagcatttttttcagaag

SEQ ID NO: 9514736 - DNA, 22 bp, Homo sapiens
ctggcaggaagttagatggtaa

SEQ ID NO: 9514737 - DNA, 22 bp, Homo sapiens
ctggcagcccaacctagagtct

SEQ ID NO: 9514738 - DNA, 22 bp, Homo sapiens
ctggcagcccaacctagagtct

SEQ ID NO: 9514739 - DNA, 19 bp, Homo sapiens
ctggcagcctgtctgtgtc

SEQ ID NO: 9514740 - DNA, 22 bp, Homo sapiens
ctggcagcttcaggacactcgg

SEQ ID NO: 9514741 - DNA, 22 bp, Homo sapiens
ctggcagcttcctttgcatctg

SEQ ID NO: 9514742 - DNA, 22 bp, Homo sapiens
ctggcagcttcaggacactcgg

SEQ ID NO: 9514743 - DNA, 22 bp, Homo sapiens
ctggcagcttcctttgcatctg

SEQ ID NO: 9514744 - DNA, 20 bp, Homo sapiens
ctggcaggagcgagtctacc

SEQ ID NO: 9514745 - DNA, 22 bp, Homo sapiens
ctggcaggagcattcacagagg

SEQ ID NO: 9514746 - DNA, 20 bp, Homo sapiens
ctggcaggagcgagtctacc

SEQ ID NO: 9514747 - DNA, 22 bp, Homo sapiens
ctggcaggagctgtggccgtag

SEQ ID NO: 9514748 - DNA, 22 bp, Homo sapiens
ctggcaggcaaattggtgggag

SEQ ID NO: 9514749 - DNA, 22 bp, Homo sapiens
ctggcaggatctaaccagggaa

SEQ ID NO: 9514750 - DNA, 22 bp, Homo sapiens
ctggcaggcactcatgaaataa

SEQ ID NO: 9514751 - DNA, 22 bp, Homo sapiens
ctggcaggcggcagagcccagg

SEQ ID NO: 9514752 - DNA, 22 bp, Homo sapiens
ctggcaggcggaggttgcagtg

SEQ ID NO: 9514753 - DNA, 22 bp, Homo sapiens
ctggcaggctctctggtcggtt

SEQ ID NO: 9514754 - DNA, 22 bp, Homo sapiens
ctggccactgattcctcccctg

SEQ ID NO: 9514755 - DNA, 22 bp, Homo sapiens
ctggccacccatgcctccctga

SEQ ID NO: 9514756 - DNA, 22 bp, Homo sapiens
ctggccactgattcctcccctg

SEQ ID NO: 9514757 - DNA, 22 bp, Homo sapiens
ctggccagcatggctgaagtac

SEQ ID NO: 9514758 - DNA, 22 bp, Homo sapiens
ctggccagcatttttgctttag

SEQ ID NO: 9514759 - DNA, 22 bp, Homo sapiens
ctggccagcatttttgctttag

SEQ ID NO: 9514760 - DNA, 22 bp, Homo sapiens
ctggccagcatggctgaagtac

SEQ ID NO: 9514761 - DNA, 22 bp, Homo sapiens
ctggccagcatggctgaagtac

SEQ ID NO: 9514762 - DNA, 22 bp, Homo sapiens
ctggccagatgttacgtccaat

SEQ ID NO: 9514763 - DNA, 22 bp, Homo sapiens
ctggccagatgttacgtccaat

SEQ ID NO: 9514764 - DNA, 22 bp, Homo sapiens
ctggccagatgttacgtccaat

SEQ ID NO: 9514765 - DNA, 22 bp, Homo sapiens
ctggccagatgttacgtccaat

SEQ ID NO: 9514766 - DNA, 22 bp, Homo sapiens
ctggccagagttggagggtgtg

SEQ ID NO: 9514767 - DNA, 22 bp, Homo sapiens
ctggccagagttggagggtgtg

SEQ ID NO: 9514768 - DNA, 22 bp, Homo sapiens
ctggccagagttggagggtgtg

SEQ ID NO: 9514769 - DNA, 21 bp, Homo sapiens
ctggccactgcacctcttcct

SEQ ID NO: 9514770 - DNA, 22 bp, Homo sapiens
ctggccagaggttcctctgccc

SEQ ID NO: 9514771 - DNA, 22 bp, Homo sapiens
ctggccagaggttcctctgccc

SEQ ID NO: 9514772 - DNA, 22 bp, Homo sapiens
ctggccagctgacagcagggct

SEQ ID NO: 9514773 - DNA, 22 bp, Homo sapiens
ctggccagctgacagcagggct

SEQ ID NO: 9514774 - DNA, 22 bp, Homo sapiens
ctggccagctgacagcagggct

SEQ ID NO: 9514775 - DNA, 22 bp, Homo sapiens
ctggccagctgacagcagggct

SEQ ID NO: 9514776 - DNA, 22 bp, Homo sapiens
ctggccagctgacagcagggct

SEQ ID NO: 9514777 - DNA, 22 bp, Homo sapiens
ctggccaggaggtaaccagatg

SEQ ID NO: 9514778 - DNA, 22 bp, Homo sapiens
ctggccaggaggtaaccagatg

SEQ ID NO: 9514779 - DNA, 22 bp, Homo sapiens
ctggccaggcatcccctgatcc

SEQ ID NO: 9514780 - DNA, 22 bp, Homo sapiens
ctggccaggaggtaaccagatg

SEQ ID NO: 9514781 - DNA, 22 bp, Homo sapiens
ctggccagcctcccaggtaccc

SEQ ID NO: 9514782 - DNA, 22 bp, Homo sapiens
ctggccagcctcccaggtaccc

SEQ ID NO: 9514783 - DNA, 22 bp, Homo sapiens
ctggccagcctcccaggtaccc

SEQ ID NO: 9514784 - DNA, 22 bp, Homo sapiens
ctggccagcctgtcgatgccct

SEQ ID NO: 9514785 - DNA, 22 bp, Homo sapiens
ctggccagcctgtcgatgccct

SEQ ID NO: 9514786 - DNA, 22 bp, Homo sapiens
ctggccagcctgtcgatgccct

SEQ ID NO: 9514787 - DNA, 22 bp, Homo sapiens
ctggccagcctgtcgatgccct

SEQ ID NO: 9514788 - DNA, 22 bp, Homo sapiens
ctggccagcctgtcgatgccct

SEQ ID NO: 9514789 - DNA, 22 bp, Homo sapiens
ctggccagcctcccaggtaccc

SEQ ID NO: 9514790 - DNA, 22 bp, Homo sapiens
ctggctcatgtgatgagggcaa

SEQ ID NO: 9514791 - DNA, 22 bp, Homo sapiens
ctggctcatgtgatgagggcaa

SEQ ID NO: 9514792 - DNA, 22 bp, Homo sapiens
ctggctcatgtgatgagggcaa

SEQ ID NO: 9514793 - DNA, 22 bp, Homo sapiens
ctggctcatgtgatgagggcaa

SEQ ID NO: 9514794 - DNA, 22 bp, Homo sapiens
ctggctcattttagcatcaggt

SEQ ID NO: 9514795 - DNA, 22 bp, Homo sapiens
ctggctcattttagcatcaggt

SEQ ID NO: 9514796 - DNA, 23 bp, Homo sapiens
ctggctcatcctggttgcagtgg

SEQ ID NO: 9514797 - DNA, 22 bp, Homo sapiens
ctggctcatccaggtgttgctc

SEQ ID NO: 9514798 - DNA, 23 bp, Homo sapiens
ctggctcatcctggttgcagtgg

SEQ ID NO: 9514799 - DNA, 23 bp, Homo sapiens
ctggctcatcctggttgcagtgg

SEQ ID NO: 9514800 - DNA, 22 bp, Homo sapiens
ctggctcatagagcagctccaa

SEQ ID NO: 9514801 - DNA, 22 bp, Homo sapiens
ctggctcagttcttggttttca

SEQ ID NO: 9514802 - DNA, 22 bp, Homo sapiens
ctggctcagttcttggttttca

SEQ ID NO: 9514803 - DNA, 22 bp, Homo sapiens
ctggctcagttcttggttttca

SEQ ID NO: 9514804 - DNA, 22 bp, Homo sapiens
ctggctcagtgccttcagaagt

SEQ ID NO: 9514805 - DNA, 22 bp, Homo sapiens
ctggctcagggtggtctgggtc

SEQ ID NO: 9514806 - DNA, 22 bp, Homo sapiens
ctggctcagtgccttcagaagt

SEQ ID NO: 9514807 - DNA, 22 bp, Homo sapiens
ctggctcatccaggtgttgctc

SEQ ID NO: 9514808 - DNA, 22 bp, Homo sapiens
ctggctcatccaggtgttgctc

SEQ ID NO: 9514809 - DNA, 22 bp, Homo sapiens
ctggctcatagagcagctccaa

SEQ ID NO: 9514810 - DNA, 22 bp, Homo sapiens
ctggctcatagagcagctccaa

SEQ ID NO: 9514811 - DNA, 22 bp, Homo sapiens
ctggctcatagagcagctccaa

SEQ ID NO: 9514812 - DNA, 22 bp, Homo sapiens
ctggctcttgcgactcagcttg

SEQ ID NO: 9514813 - DNA, 22 bp, Homo sapiens
ctggctcttgcgactcagcttg

SEQ ID NO: 9514814 - DNA, 22 bp, Homo sapiens
ctggctcttgcgactcagcttg

SEQ ID NO: 9514815 - DNA, 22 bp, Homo sapiens
ctggctgcaggaaggagtgggc

SEQ ID NO: 9514816 - DNA, 22 bp, Homo sapiens
ctggctgcaggaaggagtgggc

SEQ ID NO: 9514817 - DNA, 22 bp, Homo sapiens
ctggctgcaggatgaggctgcc

SEQ ID NO: 9514818 - DNA, 22 bp, Homo sapiens
ctggctgcaggatgaggctgcc

SEQ ID NO: 9514819 - DNA, 22 bp, Homo sapiens
ctggctgcaggatgaggctgcc

SEQ ID NO: 9514820 - DNA, 22 bp, Homo sapiens
ctggctccaaggaagaggtttt

SEQ ID NO: 9514821 - DNA, 22 bp, Homo sapiens
ctggctccaaggaagaggtttt

SEQ ID NO: 9514822 - DNA, 21 bp, Homo sapiens
ctggctctgttgtcacccggc

SEQ ID NO: 9514823 - DNA, 22 bp, Homo sapiens
ctggctcattttagcatcaggt

SEQ ID NO: 9514824 - DNA, 22 bp, Homo sapiens
ctggctcattttagcatcaggt

SEQ ID NO: 9514825 - DNA, 22 bp, Homo sapiens
ctggctccaaattctgatgttc

SEQ ID NO: 9514826 - DNA, 21 bp, Homo sapiens
ctggctctgttgtcacccggc

SEQ ID NO: 9514827 - DNA, 21 bp, Homo sapiens
ctggctctgttgtcacccggc

SEQ ID NO: 9514828 - DNA, 22 bp, Homo sapiens
ctggctcttctgggttctgtgt

SEQ ID NO: 9514829 - DNA, 22 bp, Homo sapiens
ctggctcttctgggttctgtgt

SEQ ID NO: 9514830 - DNA, 22 bp, Homo sapiens
ctggctgcattggcaagtcaat

SEQ ID NO: 9514831 - DNA, 22 bp, Homo sapiens
ctggctgccacttcagggtctt

SEQ ID NO: 9514832 - DNA, 22 bp, Homo sapiens
ctggctgcctatagtctccctt

SEQ ID NO: 9514833 - DNA, 22 bp, Homo sapiens
ctggctgcctatagtctccctt

SEQ ID NO: 9514834 - DNA, 22 bp, Homo sapiens
ctggctgcctggagtgagggag

SEQ ID NO: 9514835 - DNA, 22 bp, Homo sapiens
ctggctgccagcatttggggga

SEQ ID NO: 9514836 - DNA, 22 bp, Homo sapiens
ctggctgcctatagtctccctt

SEQ ID NO: 9514837 - DNA, 22 bp, Homo sapiens
ctggctgcttgggacagccatg

SEQ ID NO: 9514838 - DNA, 22 bp, Homo sapiens
ctggctgcttgtagactcgact

SEQ ID NO: 9514839 - DNA, 22 bp, Homo sapiens
ctggctgctggcctgaggatgc

SEQ ID NO: 9514840 - DNA, 22 bp, Homo sapiens
ctggctgctggcctgaggatgc

SEQ ID NO: 9514841 - DNA, 22 bp, Homo sapiens
ctggctgcgtctgctctgacag

SEQ ID NO: 9514842 - DNA, 22 bp, Homo sapiens
ctggctgcgtctgctctgacag

SEQ ID NO: 9514843 - DNA, 22 bp, Homo sapiens
ctggctgcgtctgctctgacag

SEQ ID NO: 9514844 - DNA, 22 bp, Homo sapiens
ctggctgtgcagtcttccagaa

SEQ ID NO: 9514845 - DNA, 22 bp, Homo sapiens
ctggctgtgaaatggcagtgtc

SEQ ID NO: 9514846 - DNA, 22 bp, Homo sapiens
ctggctgtgcagtcttccagaa

SEQ ID NO: 9514847 - DNA, 22 bp, Homo sapiens
ctggctggagctgttgtaggct

SEQ ID NO: 9514848 - DNA, 22 bp, Homo sapiens
ctggctggagcaggcatcttgt

SEQ ID NO: 9514849 - DNA, 22 bp, Homo sapiens
ctggctggacttgtgcatgtca

SEQ ID NO: 9514850 - DNA, 22 bp, Homo sapiens
ctggctggaacgccgaggcggc

SEQ ID NO: 9514851 - DNA, 22 bp, Homo sapiens
ctggctgcttgtagactcgact

SEQ ID NO: 9514852 - DNA, 22 bp, Homo sapiens
ctggctgcttgttttgatgggt

SEQ ID NO: 9514853 - DNA, 22 bp, Homo sapiens
ctggctgcttgttttgatgggt

SEQ ID NO: 9514854 - DNA, 20 bp, Homo sapiens
ctggctggaaacttagcctt

SEQ ID NO: 9514855 - DNA, 20 bp, Homo sapiens
ctggctggaaacttagcctt

SEQ ID NO: 9514856 - DNA, 22 bp, Homo sapiens
ctggctcacctccgctccagca

SEQ ID NO: 9514857 - DNA, 22 bp, Homo sapiens
ctggctcacctccgctccagca

SEQ ID NO: 9514858 - DNA, 22 bp, Homo sapiens
ctggctcacctccgctccagca

SEQ ID NO: 9514859 - DNA, 22 bp, Homo sapiens
ctggctcactagccctgccctg

SEQ ID NO: 9514860 - DNA, 22 bp, Homo sapiens
ctggcctgtcctgacccagcct

SEQ ID NO: 9514861 - DNA, 22 bp, Homo sapiens
ctggcctgtcctgacccagcct

SEQ ID NO: 9514862 - DNA, 22 bp, Homo sapiens
ctggcctgtgggctgtctccgg

SEQ ID NO: 9514863 - DNA, 22 bp, Homo sapiens
ctggcctgtgggctgtctccgg

SEQ ID NO: 9514864 - DNA, 22 bp, Homo sapiens
ctggcctgtgggctgtctccgg

SEQ ID NO: 9514865 - DNA, 22 bp, Homo sapiens
ctggctcaggaaagttgctgct

SEQ ID NO: 9514866 - DNA, 22 bp, Homo sapiens
ctggctcagacagctgtgcagt

SEQ ID NO: 9514867 - DNA, 22 bp, Homo sapiens
ctggctcagggtggtctgggtc

SEQ ID NO: 9514868 - DNA, 22 bp, Homo sapiens
ctggctcagggtggtctgggtc

SEQ ID NO: 9514869 - DNA, 22 bp, Homo sapiens
ctggctcaggaaagttgctgct

SEQ ID NO: 9514870 - DNA, 22 bp, Homo sapiens
ctggctcagacagctgtgcagt

SEQ ID NO: 9514871 - DNA, 22 bp, Homo sapiens
ctggctcagacagctgtgcagt

SEQ ID NO: 9514872 - DNA, 22 bp, Homo sapiens
ctggctcagacagctgtgcagt

SEQ ID NO: 9514873 - DNA, 22 bp, Homo sapiens
ctggctcactagccctgccctg

SEQ ID NO: 9514874 - DNA, 22 bp, Homo sapiens
ctggctcactagccctgccctg

SEQ ID NO: 9514875 - DNA, 22 bp, Homo sapiens
ctggctcactagccctgccctg

SEQ ID NO: 9514876 - DNA, 22 bp, Homo sapiens
ctggctcactagccctgccctg

SEQ ID NO: 9514877 - DNA, 22 bp, Homo sapiens
ctggccctggctggagcccagg

SEQ ID NO: 9514878 - DNA, 22 bp, Homo sapiens
ctggccctggctggagcccagg

SEQ ID NO: 9514879 - DNA, 22 bp, Homo sapiens
ctggccctggctggagcccagg

SEQ ID NO: 9514880 - DNA, 22 bp, Homo sapiens
ctggccctggtaaggacaccca

SEQ ID NO: 9514881 - DNA, 22 bp, Homo sapiens
ctggccctggtaaggacaccca

SEQ ID NO: 9514882 - DNA, 22 bp, Homo sapiens
ctggccctggtaaggacaccca

SEQ ID NO: 9514883 - DNA, 22 bp, Homo sapiens
ctggccctggtaaggacaccca

SEQ ID NO: 9514884 - DNA, 23 bp, Homo sapiens
ctggccctggctctgtgatcatg

SEQ ID NO: 9514885 - DNA, 23 bp, Homo sapiens
ctggccctggctctgtgatcatg

SEQ ID NO: 9514886 - DNA, 22 bp, Homo sapiens
ctggccctggctggagcccagg

SEQ ID NO: 9514887 - DNA, 22 bp, Homo sapiens
ctggccctggctggagcccagg

SEQ ID NO: 9514888 - DNA, 23 bp, Homo sapiens
ctggccctggctctgtgatcatg

SEQ ID NO: 9514889 - DNA, 23 bp, Homo sapiens
ctggccctggctctgtgatcatg

SEQ ID NO: 9514890 - DNA, 23 bp, Homo sapiens
ctggccctggctctgtgatcatg

SEQ ID NO: 9514891 - DNA, 22 bp, Homo sapiens
ctggccctgtaggatgtgagtt

SEQ ID NO: 9514892 - DNA, 22 bp, Homo sapiens
ctggccctgtaggatgtgagtt

SEQ ID NO: 9514893 - DNA, 22 bp, Homo sapiens
ctggccctgtaggatgtgagtt

SEQ ID NO: 9514894 - DNA, 22 bp, Homo sapiens
ctggccctgtcagcacagaatc

SEQ ID NO: 9514895 - DNA, 22 bp, Homo sapiens
ctggcctggtctggcctctcca

SEQ ID NO: 9514896 - DNA, 22 bp, Homo sapiens
ctggcctggtctggcctctcca

SEQ ID NO: 9514897 - DNA, 22 bp, Homo sapiens
ctggcctggtctggcctctcca

SEQ ID NO: 9514898 - DNA, 22 bp, Homo sapiens
ctggcctggtctggcctctcca

SEQ ID NO: 9514899 - DNA, 22 bp, Homo sapiens
ctggccctgctccgcgccgcgg

SEQ ID NO: 9514900 - DNA, 22 bp, Homo sapiens
ctggccctgctccgcgccgcgg

SEQ ID NO: 9514901 - DNA, 22 bp, Homo sapiens
ctggccctgcctaatgtacttg

SEQ ID NO: 9514902 - DNA, 22 bp, Homo sapiens
ctggccctgcctaatgtacttg

SEQ ID NO: 9514903 - DNA, 22 bp, Homo sapiens
ctggccctgcctaatgtacttg

SEQ ID NO: 9514904 - DNA, 22 bp, Homo sapiens
ctggccctgccagagatcaaca

SEQ ID NO: 9514905 - DNA, 22 bp, Homo sapiens
ctggccctgcctaatgtacttg

SEQ ID NO: 9514906 - DNA, 22 bp, Homo sapiens
ctggccctgccagagatcaaca

SEQ ID NO: 9514907 - DNA, 22 bp, Homo sapiens
ctggccctggagggctgtgcga

SEQ ID NO: 9514908 - DNA, 22 bp, Homo sapiens
ctggccctggagggctgtgcga

SEQ ID NO: 9514909 - DNA, 22 bp, Homo sapiens
ctggccctggagggctgtgcga

SEQ ID NO: 9514910 - DNA, 22 bp, Homo sapiens
ctggccctggagggctgtgcga

SEQ ID NO: 9514911 - DNA, 22 bp, Homo sapiens
ctggccctggagggctgtgcga

SEQ ID NO: 9514912 - DNA, 16 bp, Homo sapiens
ctggccctggctctgg

SEQ ID NO: 9514913 - DNA, 22 bp, Homo sapiens
ctggccctcagactcatgggca

SEQ ID NO: 9514914 - DNA, 22 bp, Homo sapiens
ctggccctcagactcatgggca

SEQ ID NO: 9514915 - DNA, 22 bp, Homo sapiens
ctggccctcggagtccagctgc

SEQ ID NO: 9514916 - DNA, 22 bp, Homo sapiens
ctggccctcggagtccagctgc

SEQ ID NO: 9514917 - DNA, 22 bp, Homo sapiens
ctggccctcgtcagtttcactg

SEQ ID NO: 9514918 - DNA, 22 bp, Homo sapiens
ctggccctcgtcagtttcactg

SEQ ID NO: 9514919 - DNA, 22 bp, Homo sapiens
ctggccctcggagtccagctgc

SEQ ID NO: 9514920 - DNA, 22 bp, Homo sapiens
ctggccctcggagtccagctgc

SEQ ID NO: 9514921 - DNA, 22 bp, Homo sapiens
ctggccctcggagtccagctgc

SEQ ID NO: 9514922 - DNA, 22 bp, Homo sapiens
ctggccaggccccttgcagggc

SEQ ID NO: 9514923 - DNA, 22 bp, Homo sapiens
ctggccaggccccttgcagggc

SEQ ID NO: 9514924 - DNA, 22 bp, Homo sapiens
ctggccaggccccttgcagggc

SEQ ID NO: 9514925 - DNA, 22 bp, Homo sapiens
ctggcccaggtggtcgttgagg

SEQ ID NO: 9514926 - DNA, 22 bp, Homo sapiens
ctggcccagtctcagagtgtca

SEQ ID NO: 9514927 - DNA, 19 bp, Homo sapiens
ctggccaggccaggggccc

SEQ ID NO: 9514928 - DNA, 22 bp, Homo sapiens
ctggccaggccccttgcagggc

SEQ ID NO: 9514929 - DNA, 22 bp, Homo sapiens
ctggccctatgagcctcctgat

SEQ ID NO: 9514930 - DNA, 22 bp, Homo sapiens
ctggccctattccaggccttcc

SEQ ID NO: 9514931 - DNA, 22 bp, Homo sapiens
ctggccctattccaggccttcc

SEQ ID NO: 9514932 - DNA, 22 bp, Homo sapiens
ctggccaggcatcccctgatcc

SEQ ID NO: 9514933 - DNA, 22 bp, Homo sapiens
ctggccaggcatcccctgatcc

SEQ ID NO: 9514934 - DNA, 22 bp, Homo sapiens
ctggccaggcatcccctgatcc

SEQ ID NO: 9514935 - DNA, 22 bp, Homo sapiens
ctggccaggcatcccctgatcc

SEQ ID NO: 9514936 - DNA, 19 bp, Homo sapiens
ctggccaggccaggggccc

SEQ ID NO: 9514937 - DNA, 19 bp, Homo sapiens
ctggccaggccaggggccc

SEQ ID NO: 9514938 - DNA, 19 bp, Homo sapiens
ctggccaggccaggggccc

SEQ ID NO: 9514939 - DNA, 22 bp, Homo sapiens
ctgggagctgaggctgacgctg

SEQ ID NO: 9514940 - DNA, 22 bp, Homo sapiens
ctgggaggattcattgaggtga

SEQ ID NO: 9514941 - DNA, 22 bp, Homo sapiens
ctgggaggcaccgcgtcgtgct

SEQ ID NO: 9514942 - DNA, 22 bp, Homo sapiens
ctgggaggattcattgaggtga

SEQ ID NO: 9514943 - DNA, 22 bp, Homo sapiens
ctgggaggattcattgaggtga

SEQ ID NO: 9514944 - DNA, 22 bp, Homo sapiens
ctgggaggcaccgcgtcgtgct

SEQ ID NO: 9514945 - DNA, 22 bp, Homo sapiens
ctgggagctagctctgagctga

SEQ ID NO: 9514946 - DNA, 22 bp, Homo sapiens
ctgggaagaaattgtgggaggc

SEQ ID NO: 9514947 - DNA, 22 bp, Homo sapiens
ctgggaactgtactgccttgaa

SEQ ID NO: 9514948 - DNA, 22 bp, Homo sapiens
ctgggagctagctctgagctga

SEQ ID NO: 9514949 - DNA, 22 bp, Homo sapiens
ctgggagctagctctgagctga

SEQ ID NO: 9514950 - DNA, 22 bp, Homo sapiens
ctgggagctcagccctggggtg

SEQ ID NO: 9514951 - DNA, 22 bp, Homo sapiens
ctgggaacgtgcttagctgact

SEQ ID NO: 9514952 - DNA, 22 bp, Homo sapiens
ctgggaacatctgaatgctgag

SEQ ID NO: 9514953 - DNA, 22 bp, Homo sapiens
ctgggaacaggcactgctgtca

SEQ ID NO: 9514954 - DNA, 22 bp, Homo sapiens
ctggctttgaaggtctttccta

SEQ ID NO: 9514955 - DNA, 22 bp, Homo sapiens
ctggctttgatcagagtgacct

SEQ ID NO: 9514956 - DNA, 22 bp, Homo sapiens
ctggctttctgcaaatctccat

SEQ ID NO: 9514957 - DNA, 22 bp, Homo sapiens
ctggctttaaccctacaaacct

SEQ ID NO: 9514958 - DNA, 22 bp, Homo sapiens
ctggctgtgctggagttgagga

SEQ ID NO: 9514959 - DNA, 22 bp, Homo sapiens
ctggctttcatttcaagcacgt

SEQ ID NO: 9514960 - DNA, 22 bp, Homo sapiens
ctgggcaggagaggtggttgga

SEQ ID NO: 9514961 - DNA, 22 bp, Homo sapiens
ctgggcaggagggctctatgga

SEQ ID NO: 9514962 - DNA, 22 bp, Homo sapiens
ctgggcagtttattcagttctg

SEQ ID NO: 9514963 - DNA, 22 bp, Homo sapiens
ctgggcagttttacatcattgc

SEQ ID NO: 9514964 - DNA, 22 bp, Homo sapiens
ctgggcagtttattcagttctg

SEQ ID NO: 9514965 - DNA, 22 bp, Homo sapiens
ctgggcatgaaaaggatgccag

SEQ ID NO: 9514966 - DNA, 22 bp, Homo sapiens
ctgggcatgaaaaggatgccag

SEQ ID NO: 9514967 - DNA, 22 bp, Homo sapiens
ctgggccacatcagatgaagac

SEQ ID NO: 9514968 - DNA, 22 bp, Homo sapiens
ctgggccacatcagatgaagac

SEQ ID NO: 9514969 - DNA, 22 bp, Homo sapiens
ctgggccacatcagatgaagac

SEQ ID NO: 9514970 - DNA, 22 bp, Homo sapiens
ctgggccacaagcctgtgtgat

SEQ ID NO: 9514971 - DNA, 22 bp, Homo sapiens
ctgggccacaagcctgtgtgat

SEQ ID NO: 9514972 - DNA, 22 bp, Homo sapiens
ctgggccacttcctcaggggaa

SEQ ID NO: 9514973 - DNA, 22 bp, Homo sapiens
ctgggccagaagacatttagga

SEQ ID NO: 9514974 - DNA, 22 bp, Homo sapiens
ctgggccactccagatgcccac

SEQ ID NO: 9514975 - DNA, 22 bp, Homo sapiens
ctgggccacatcagatgaagac

SEQ ID NO: 9514976 - DNA, 22 bp, Homo sapiens
ctgggccacatcagatgaagac

SEQ ID NO: 9514977 - DNA, 22 bp, Homo sapiens
ctgggcaggagaggtggttgga

SEQ ID NO: 9514978 - DNA, 22 bp, Homo sapiens
ctgggaggcggagcttgcagtg

SEQ ID NO: 9514979 - DNA, 22 bp, Homo sapiens
ctgggaggcggagcttgcagtg

SEQ ID NO: 9514980 - DNA, 22 bp, Homo sapiens
ctgggaggcccacgttgggaag

SEQ ID NO: 9514981 - DNA, 22 bp, Homo sapiens
ctgggaggcccacgttgggaag

SEQ ID NO: 9514982 - DNA, 22 bp, Homo sapiens
ctgggaggcccacgttgggaag

SEQ ID NO: 9514983 - DNA, 22 bp, Homo sapiens
ctgggaggcccacgttgggaag

SEQ ID NO: 9514984 - DNA, 22 bp, Homo sapiens
ctgggaggcagtctctctagaa

SEQ ID NO: 9514985 - DNA, 22 bp, Homo sapiens
ctgggaggcagtctctctagaa

SEQ ID NO: 9514986 - DNA, 22 bp, Homo sapiens
ctgggaggcagtctctctagaa

SEQ ID NO: 9514987 - DNA, 22 bp, Homo sapiens
ctgggaggcactattcaggagg

SEQ ID NO: 9514988 - DNA, 22 bp, Homo sapiens
ctgggaggcactattcaggagg

SEQ ID NO: 9514989 - DNA, 22 bp, Homo sapiens
ctgggaggcactattcaggagg

SEQ ID NO: 9514990 - DNA, 22 bp, Homo sapiens
ctgggaggcactattcaggagg

SEQ ID NO: 9514991 - DNA, 22 bp, Homo sapiens
ctgggaggcagaggttgtagtg

SEQ ID NO: 9514992 - DNA, 22 bp, Homo sapiens
ctgggaggcagaggttgtagtg

SEQ ID NO: 9514993 - DNA, 22 bp, Homo sapiens
ctgggaggcagaggttgtagtg

SEQ ID NO: 9514994 - DNA, 22 bp, Homo sapiens
ctgggaggcagaggttgcagtg

SEQ ID NO: 9514995 - DNA, 22 bp, Homo sapiens
ctgggaggcagaggttgcagtg

SEQ ID NO: 9514996 - DNA, 22 bp, Homo sapiens
ctgggaggcagaggttgcagtg

SEQ ID NO: 9514997 - DNA, 22 bp, Homo sapiens
ctgggaggcagaggttgcagtg

SEQ ID NO: 9514998 - DNA, 22 bp, Homo sapiens
ctgggaggcagaggttgcagtg

SEQ ID NO: 9514999 - DNA, 22 bp, Homo sapiens
ctgggaggcagaggttgcagtg

SEQ ID NO: 9515000 - DNA, 20 bp, Homo sapiens
ctggggaggaggatgtgttc

SEQ ID NO: 9515001 - DNA, 20 bp, Homo sapiens
ctggggaggaggatgtgttc

SEQ ID NO: 9515002 - DNA, 20 bp, Homo sapiens
ctggggaggaggatgtgttc

SEQ ID NO: 9515003 - DNA, 20 bp, Homo sapiens
ctggggaggaggatgtgttc

SEQ ID NO: 9515004 - DNA, 22 bp, Homo sapiens
ctgggctgcttgctgaaggggt

SEQ ID NO: 9515005 - DNA, 22 bp, Homo sapiens
ctgggctgcttgctgaaggggt

SEQ ID NO: 9515006 - DNA, 22 bp, Homo sapiens
ctgggctggacacacttaacct

SEQ ID NO: 9515007 - DNA, 20 bp, Homo sapiens
ctggggagctgctcccacga

SEQ ID NO: 9515008 - DNA, 22 bp, Homo sapiens
ctgggctgcttgctgaaggggt

SEQ ID NO: 9515009 - DNA, 22 bp, Homo sapiens
ctgggctgcttgctgaaggggt

SEQ ID NO: 9515010 - DNA, 23 bp, Homo sapiens
ctgggctgcttgagtccctggct

SEQ ID NO: 9515011 - DNA, 23 bp, Homo sapiens
ctgggctgcttgagtccctggct

SEQ ID NO: 9515012 - DNA, 22 bp, Homo sapiens
ctgggctgctgtccactagggt

SEQ ID NO: 9515013 - DNA, 22 bp, Homo sapiens
ctgggctgctgtccactagggt

SEQ ID NO: 9515014 - DNA, 22 bp, Homo sapiens
ctgggctgctgtccactagggt

SEQ ID NO: 9515015 - DNA, 22 bp, Homo sapiens
ctgggctgctgtccactagggt

SEQ ID NO: 9515016 - DNA, 22 bp, Homo sapiens
ctgggctgcgggcgcccctcca

SEQ ID NO: 9515017 - DNA, 22 bp, Homo sapiens
ctgggctgcggtggtaggttgt

SEQ ID NO: 9515018 - DNA, 22 bp, Homo sapiens
ctgggctgcggtggtaggttgt

SEQ ID NO: 9515019 - DNA, 22 bp, Homo sapiens
ctgggctgctcagccccctcgc

SEQ ID NO: 9515020 - DNA, 22 bp, Homo sapiens
ctgggctgcggttctctgaagc

SEQ ID NO: 9515021 - DNA, 22 bp, Homo sapiens
ctgggctgcggttctctgaagc

SEQ ID NO: 9515022 - DNA, 22 bp, Homo sapiens
ctgggctgcggttctctgaagc

SEQ ID NO: 9515023 - DNA, 22 bp, Homo sapiens
ctgggctgcggtggtaggttgt

SEQ ID NO: 9515024 - DNA, 20 bp, Homo sapiens
ctgggctgcccagctatggg

SEQ ID NO: 9515025 - DNA, 22 bp, Homo sapiens
ctgggctgccaggtaggcacac

SEQ ID NO: 9515026 - DNA, 22 bp, Homo sapiens
ctgggctgccaggtaggcacac

SEQ ID NO: 9515027 - DNA, 22 bp, Homo sapiens
ctgggctgccaggtaggcacac

SEQ ID NO: 9515028 - DNA, 22 bp, Homo sapiens
ctgggctgcatcaaagaggcat

SEQ ID NO: 9515029 - DNA, 22 bp, Homo sapiens
ctgggccagatccagcctcaca

SEQ ID NO: 9515030 - DNA, 22 bp, Homo sapiens
ctgggccagatccagcctcaca

SEQ ID NO: 9515031 - DNA, 22 bp, Homo sapiens
ctgggccagatccagcctcaca

SEQ ID NO: 9515032 - DNA, 22 bp, Homo sapiens
ctgggctctaggaaccattcct

SEQ ID NO: 9515033 - DNA, 22 bp, Homo sapiens
ctgggctctaggaaccattcct

SEQ ID NO: 9515034 - DNA, 22 bp, Homo sapiens
ctgggctctgcagttgatgttt

SEQ ID NO: 9515035 - DNA, 19 bp, Homo sapiens
ctgggccagagctgtcctc

SEQ ID NO: 9515036 - DNA, 19 bp, Homo sapiens
ctgggccagagctgtcctc

SEQ ID NO: 9515037 - DNA, 18 bp, Homo sapiens
ctgggccagagtttctgc

SEQ ID NO: 9515038 - DNA, 19 bp, Homo sapiens
ctgggccagagctgtcctc

SEQ ID NO: 9515039 - DNA, 22 bp, Homo sapiens
ctgggccagaccttgtggtctt

SEQ ID NO: 9515040 - DNA, 22 bp, Homo sapiens
ctgggccagaccttgtggtctt

SEQ ID NO: 9515041 - DNA, 22 bp, Homo sapiens
ctgggctgcaggagtggggcaa

SEQ ID NO: 9515042 - DNA, 22 bp, Homo sapiens
ctgggctgcaggagtggggcaa

SEQ ID NO: 9515043 - DNA, 22 bp, Homo sapiens
ctgggctgcaggagtggggcaa

SEQ ID NO: 9515044 - DNA, 22 bp, Homo sapiens
ctgggctgcagcgggagcgacg

SEQ ID NO: 9515045 - DNA, 22 bp, Homo sapiens
ctgggctgcagcgggagcgacg

SEQ ID NO: 9515046 - DNA, 22 bp, Homo sapiens
ctgggctgcagcgggagcgacg

SEQ ID NO: 9515047 - DNA, 22 bp, Homo sapiens
ctgggctgcatcaaagaggcat

SEQ ID NO: 9515048 - DNA, 22 bp, Homo sapiens
ctgggctgcagttcctggtcct

SEQ ID NO: 9515049 - DNA, 22 bp, Homo sapiens
ctgggctgcagttcctggtcct

SEQ ID NO: 9515050 - DNA, 22 bp, Homo sapiens
ctgggctgcagttcctggtcct

SEQ ID NO: 9515051 - DNA, 22 bp, Homo sapiens
ctgggctgcagttcctggtcct

SEQ ID NO: 9515052 - DNA, 22 bp, Homo sapiens
ctgggctgcaggcactaattgg

SEQ ID NO: 9515053 - DNA, 22 bp, Homo sapiens
ctgggctgcaggagtggggcaa

SEQ ID NO: 9515054 - DNA, 22 bp, Homo sapiens
ctgggtctggaggccaagggtg

SEQ ID NO: 9515055 - DNA, 22 bp, Homo sapiens
ctgggtctctttagggtgccgt

SEQ ID NO: 9515056 - DNA, 22 bp, Homo sapiens
ctgggtctctttagggtgccgt

SEQ ID NO: 9515057 - DNA, 22 bp, Homo sapiens
ctgggtaaaggctgcttttcta

SEQ ID NO: 9515058 - DNA, 22 bp, Homo sapiens
ctgggtctccggcagcctcggg

SEQ ID NO: 9515059 - DNA, 22 bp, Homo sapiens
ctgggtctccggcagcctcggg

SEQ ID NO: 9515060 - DNA, 20 bp, Homo sapiens
ctgggtctccttctgcttaa

SEQ ID NO: 9515061 - DNA, 22 bp, Homo sapiens
ctgggtctcttaccatgtgact

SEQ ID NO: 9515062 - DNA, 22 bp, Homo sapiens
ctgggtctggctactgcttcct

SEQ ID NO: 9515063 - DNA, 22 bp, Homo sapiens
ctgggtctggccacaggaagta

SEQ ID NO: 9515064 - DNA, 22 bp, Homo sapiens
ctgggtctggccacaggaagta

SEQ ID NO: 9515065 - DNA, 22 bp, Homo sapiens
ctgggtctggccacaggaagta

SEQ ID NO: 9515066 - DNA, 22 bp, Homo sapiens
ctgggtctggtgtcaggcgacg

SEQ ID NO: 9515067 - DNA, 22 bp, Homo sapiens
ctgggtctggtgtcaggcgacg

SEQ ID NO: 9515068 - DNA, 22 bp, Homo sapiens
ctgggtctgggcctcctggagt

SEQ ID NO: 9515069 - DNA, 22 bp, Homo sapiens
ctgggtctggctactgcttcct

SEQ ID NO: 9515070 - DNA, 22 bp, Homo sapiens
ctgggtctgggcctcctggagt

SEQ ID NO: 9515071 - DNA, 22 bp, Homo sapiens
ctggggctgcggtggaggagcc

SEQ ID NO: 9515072 - DNA, 22 bp, Homo sapiens
ctggggctgcggtggaggagcc

SEQ ID NO: 9515073 - DNA, 22 bp, Homo sapiens
ctggggctgcggtggaggagcc

SEQ ID NO: 9515074 - DNA, 22 bp, Homo sapiens
ctggggctgcggtggaggagcc

SEQ ID NO: 9515075 - DNA, 22 bp, Homo sapiens
ctggggctgcggacgggagccc

SEQ ID NO: 9515076 - DNA, 22 bp, Homo sapiens
ctggggctgcagcgatcttcat

SEQ ID NO: 9515077 - DNA, 22 bp, Homo sapiens
ctggggctgcagcgatcttcat

SEQ ID NO: 9515078 - DNA, 22 bp, Homo sapiens
ctggggctgcagcgatcttcat

SEQ ID NO: 9515079 - DNA, 22 bp, Homo sapiens
ctggggctctctggaatgcttg

SEQ ID NO: 9515080 - DNA, 22 bp, Homo sapiens
ctggggctctctggaatgcttg

SEQ ID NO: 9515081 - DNA, 23 bp, Homo sapiens
ctggggctcattgcagtagccat

SEQ ID NO: 9515082 - DNA, 22 bp, Homo sapiens
ctggggctcactttggtcaggc

SEQ ID NO: 9515083 - DNA, 22 bp, Homo sapiens
ctggggccctgggtctgccctc

SEQ ID NO: 9515084 - DNA, 22 bp, Homo sapiens
ctggggccctgggtctgccctc

SEQ ID NO: 9515085 - DNA, 22 bp, Homo sapiens
ctggggcccgagccttgggcca

SEQ ID NO: 9515086 - DNA, 22 bp, Homo sapiens
ctggggctcactccagccctgg

SEQ ID NO: 9515087 - DNA, 22 bp, Homo sapiens
ctggggctcactccagccctgg

SEQ ID NO: 9515088 - DNA, 22 bp, Homo sapiens
ctggggctcactccagccctgg

SEQ ID NO: 9515089 - DNA, 22 bp, Homo sapiens
ctggggctcactccagccctgg

SEQ ID NO: 9515090 - DNA, 22 bp, Homo sapiens
ctggggcattgggagaggcctg

SEQ ID NO: 9515091 - DNA, 20 bp, Homo sapiens
ctggggaggaggatgtgttc

SEQ ID NO: 9515092 - DNA, 22 bp, Homo sapiens
ctggggccacaacggcgcacgc

SEQ ID NO: 9515093 - DNA, 22 bp, Homo sapiens
ctggggccacaacggcgcacgc

SEQ ID NO: 9515094 - DNA, 22 bp, Homo sapiens
ctggggcccatcgagggctgag

SEQ ID NO: 9515095 - DNA, 22 bp, Homo sapiens
ctggggcccatcgagggctgag

SEQ ID NO: 9515096 - DNA, 22 bp, Homo sapiens
ctggggcccatcgagggctgag

SEQ ID NO: 9515097 - DNA, 22 bp, Homo sapiens
ctggggcccatcgagggctgag

SEQ ID NO: 9515098 - DNA, 22 bp, Homo sapiens
ctggggccagtgaggaggcttt

SEQ ID NO: 9515099 - DNA, 22 bp, Homo sapiens
ctggggccagtgaggaggcttt

SEQ ID NO: 9515100 - DNA, 22 bp, Homo sapiens
gaggaaaataacaactaagggc

SEQ ID NO: 9515101 - DNA, 22 bp, Homo sapiens
gaggaaaataacaactaagggc

SEQ ID NO: 9515102 - DNA, 22 bp, Homo sapiens
gaggaaaataacaactaagggc

SEQ ID NO: 9515103 - DNA, 20 bp, Homo sapiens
gaggaaaagctgccaggcct

SEQ ID NO: 9515104 - DNA, 22 bp, Homo sapiens
gaggaaaagagacaggttattg

SEQ ID NO: 9515105 - DNA, 22 bp, Homo sapiens
gaggaaaagagacaggttattg

SEQ ID NO: 9515106 - DNA, 20 bp, Homo sapiens
gaggaaaagctgccaggcct

SEQ ID NO: 9515107 - DNA, 20 bp, Homo sapiens
gaggaaaagctgccaggcct

SEQ ID NO: 9515108 - DNA, 22 bp, Homo sapiens
gaggaaaatattcagggaggtt

SEQ ID NO: 9515109 - DNA, 22 bp, Homo sapiens
gaggaaaatattcagggaggtt

SEQ ID NO: 9515110 - DNA, 22 bp, Homo sapiens
gaggaaaataacaactaagggc

SEQ ID NO: 9515111 - DNA, 22 bp, Homo sapiens
gaggaaaataacaactaagggc

SEQ ID NO: 9515112 - DNA, 22 bp, Homo sapiens
gaggaaaataacaactaagggc

SEQ ID NO: 9515113 - DNA, 22 bp, Homo sapiens
gaggaaaatgcaacaggaatgc

SEQ ID NO: 9515114 - DNA, 22 bp, Homo sapiens
gaggaaaatattcagggaggtt

SEQ ID NO: 9515115 - DNA, 22 bp, Homo sapiens
gaggagctgttccctcacctct

SEQ ID NO: 9515116 - DNA, 22 bp, Homo sapiens
gaggagcttgaggctaggagcc

SEQ ID NO: 9515117 - DNA, 22 bp, Homo sapiens
gaggagcttgtgagaagatgtc

SEQ ID NO: 9515118 - DNA, 22 bp, Homo sapiens
gaggagcttgtgagaagatgtc

SEQ ID NO: 9515119 - DNA, 22 bp, Homo sapiens
gaggagcttgcatttaagtgcc

SEQ ID NO: 9515120 - DNA, 22 bp, Homo sapiens
gaggagcttgaggctaggagcc

SEQ ID NO: 9515121 - DNA, 22 bp, Homo sapiens
gaggagcttgaggctaggagcc

SEQ ID NO: 9515122 - DNA, 19 bp, Homo sapiens
gaggagctatcggagacag

SEQ ID NO: 9515123 - DNA, 22 bp, Homo sapiens
gaggagctgtctttgtgatctt

SEQ ID NO: 9515124 - DNA, 22 bp, Homo sapiens
gaggagctgtctttgtgatctt

SEQ ID NO: 9515125 - DNA, 22 bp, Homo sapiens
gaggaggctaagtgggctctgg

SEQ ID NO: 9515126 - DNA, 22 bp, Homo sapiens
gaggaggctatcagcaatcagg

SEQ ID NO: 9515127 - DNA, 22 bp, Homo sapiens
gaggaggctatcagcaatcagg

SEQ ID NO: 9515128 - DNA, 22 bp, Homo sapiens
gaggaggctatcagcaatcagg

SEQ ID NO: 9515129 - DNA, 22 bp, Homo sapiens
gaggcaaggccgcacgtctcag

SEQ ID NO: 9515130 - DNA, 22 bp, Homo sapiens
gaggcaagagaagccagctttc

SEQ ID NO: 9515131 - DNA, 22 bp, Homo sapiens
gaggcaagagaagccagctttc

SEQ ID NO: 9515132 - DNA, 22 bp, Homo sapiens
gaggaggccagtggaaggaagc

SEQ ID NO: 9515133 - DNA, 22 bp, Homo sapiens
gaggaggctaagtgggctctgg

SEQ ID NO: 9515134 - DNA, 22 bp, Homo sapiens
gaggaggaagttctctgtaggc

SEQ ID NO: 9515135 - DNA, 22 bp, Homo sapiens
gaggaggaagttctctgtaggc

SEQ ID NO: 9515136 - DNA, 22 bp, Homo sapiens
gaggaggaagttctctgtaggc

SEQ ID NO: 9515137 - DNA, 22 bp, Homo sapiens
gaggaggaaaccctgttcctct

SEQ ID NO: 9515138 - DNA, 19 bp, Homo sapiens
gaggaggaaaactagtgta

SEQ ID NO: 9515139 - DNA, 22 bp, Homo sapiens
gaggaggaaaccctgttcctct

SEQ ID NO: 9515140 - DNA, 19 bp, Homo sapiens
gaggaggaaaactagtgta

SEQ ID NO: 9515141 - DNA, 19 bp, Homo sapiens
gaggaggaaaactagtgta

SEQ ID NO: 9515142 - DNA, 19 bp, Homo sapiens
gaggaggaaaactagtgta

SEQ ID NO: 9515143 - DNA, 19 bp, Homo sapiens
gaggaggaaaactagtgta

SEQ ID NO: 9515144 - DNA, 22 bp, Homo sapiens
gaggaggaagttctctgtaggc

SEQ ID NO: 9515145 - DNA, 22 bp, Homo sapiens
gaggaggaggaagtggaaccca

SEQ ID NO: 9515146 - DNA, 22 bp, Homo sapiens
gaggaggaggaagtggaaccca

SEQ ID NO: 9515147 - DNA, 22 bp, Homo sapiens
gaggaggaggaagtggaaccca

SEQ ID NO: 9515148 - DNA, 22 bp, Homo sapiens
gaggaggaagttctctgtaggc

SEQ ID NO: 9515149 - DNA, 22 bp, Homo sapiens
gaggaggcacttgagcagatgt

SEQ ID NO: 9515150 - DNA, 22 bp, Homo sapiens
gaggaggcactagttagtgaca

SEQ ID NO: 9515151 - DNA, 22 bp, Homo sapiens
gaggccagctagtccaggaagt

SEQ ID NO: 9515152 - DNA, 22 bp, Homo sapiens
gaggccagctagtccaggaagt

SEQ ID NO: 9515153 - DNA, 22 bp, Homo sapiens
gaggccagctagtccaggaagt

SEQ ID NO: 9515154 - DNA, 22 bp, Homo sapiens
gaggccagctagtccaggaagt

SEQ ID NO: 9515155 - DNA, 22 bp, Homo sapiens
gaggccagcgcgcagcactttt

SEQ ID NO: 9515156 - DNA, 22 bp, Homo sapiens
gaggccagctacccaagggtca

SEQ ID NO: 9515157 - DNA, 22 bp, Homo sapiens
gaggccagctacccaagggtca

SEQ ID NO: 9515158 - DNA, 22 bp, Homo sapiens
gaggccagctacccaagggtca

SEQ ID NO: 9515159 - DNA, 22 bp, Homo sapiens
gaggccagctacccaagggtca

SEQ ID NO: 9515160 - DNA, 22 bp, Homo sapiens
gaggccaggaagcccaagatca

SEQ ID NO: 9515161 - DNA, 22 bp, Homo sapiens
gaggccaggaagcccaagatca

SEQ ID NO: 9515162 - DNA, 22 bp, Homo sapiens
gaggccaggaagcccaagatca

SEQ ID NO: 9515163 - DNA, 22 bp, Homo sapiens
gaggccaggaagcccaagatca

SEQ ID NO: 9515164 - DNA, 22 bp, Homo sapiens
gaggccaggacatgaaagctga

SEQ ID NO: 9515165 - DNA, 22 bp, Homo sapiens
gaggccaggacatgaaagctga

SEQ ID NO: 9515166 - DNA, 22 bp, Homo sapiens
gaggccaggacatgaaagctga

SEQ ID NO: 9515167 - DNA, 22 bp, Homo sapiens
gaggccaggacatgaaagctga

SEQ ID NO: 9515168 - DNA, 22 bp, Homo sapiens
gaggccagatgtcatgtcttat

SEQ ID NO: 9515169 - DNA, 22 bp, Homo sapiens
gaggccagcccctcttgaaggc

SEQ ID NO: 9515170 - DNA, 22 bp, Homo sapiens
gaggccagcgcgcagcactttt

SEQ ID NO: 9515171 - DNA, 22 bp, Homo sapiens
gaggccagcccctcttgaaggc

SEQ ID NO: 9515172 - DNA, 22 bp, Homo sapiens
gaggcagaggaaggtggtctct

SEQ ID NO: 9515173 - DNA, 22 bp, Homo sapiens
gaggcagaggaaggtggtctct

SEQ ID NO: 9515174 - DNA, 22 bp, Homo sapiens
gaggccagatgtcatgtcttat

SEQ ID NO: 9515175 - DNA, 22 bp, Homo sapiens
gaggccagatactctcttctgc

SEQ ID NO: 9515176 - DNA, 22 bp, Homo sapiens
gaggcactgaatacttgagggt

SEQ ID NO: 9515177 - DNA, 22 bp, Homo sapiens
gaggcactgaatacttgagggt

SEQ ID NO: 9515178 - DNA, 22 bp, Homo sapiens
gaggcactctcgacaagggtgg

SEQ ID NO: 9515179 - DNA, 22 bp, Homo sapiens
gaggcactgcagtacagtgact

SEQ ID NO: 9515180 - DNA, 22 bp, Homo sapiens
gaggcactgcagtacagtgact

SEQ ID NO: 9515181 - DNA, 22 bp, Homo sapiens
gaggcacctcgcgggaggaggc

SEQ ID NO: 9515182 - DNA, 22 bp, Homo sapiens
gaggcacatcacttggtgcatt

SEQ ID NO: 9515183 - DNA, 22 bp, Homo sapiens
gaggcaccagacatggcctcat

SEQ ID NO: 9515184 - DNA, 22 bp, Homo sapiens
gaggcacatgactcaccaatgg

SEQ ID NO: 9515185 - DNA, 22 bp, Homo sapiens
gaggcacatgactcaccaatgg

SEQ ID NO: 9515186 - DNA, 22 bp, Homo sapiens
gaggcagagaccttcaggacct

SEQ ID NO: 9515187 - DNA, 22 bp, Homo sapiens
gaggcagagactccaccttcag

SEQ ID NO: 9515188 - DNA, 22 bp, Homo sapiens
gaggcagaagttgcagtgagca

SEQ ID NO: 9515189 - DNA, 22 bp, Homo sapiens
gaggcagagaccttcaggacct

SEQ ID NO: 9515190 - DNA, 22 bp, Homo sapiens
gaggcagagaccttcaggacct

SEQ ID NO: 9515191 - DNA, 22 bp, Homo sapiens
gaggcagaagttgcagtgagca

SEQ ID NO: 9515192 - DNA, 22 bp, Homo sapiens
gaggcactggaggaaaggagaa

SEQ ID NO: 9515193 - DNA, 22 bp, Homo sapiens
gaggcactgcagtacagtgact

SEQ ID NO: 9515194 - DNA, 22 bp, Homo sapiens
gaggcactggaggaaaggagaa

SEQ ID NO: 9515195 - DNA, 22 bp, Homo sapiens
gaggcagaagttgcagtgagca

SEQ ID NO: 9515196 - DNA, 22 bp, Homo sapiens
gagctctgtgtagcctgagggt

SEQ ID NO: 9515197 - DNA, 22 bp, Homo sapiens
gagctctgtgtagcctgagggt

SEQ ID NO: 9515198 - DNA, 22 bp, Homo sapiens
gagctctgatgtttagtggaga

SEQ ID NO: 9515199 - DNA, 22 bp, Homo sapiens
gagctctgatgtttagtggaga

SEQ ID NO: 9515200 - DNA, 22 bp, Homo sapiens
gagctctctggggagatgggat

SEQ ID NO: 9515201 - DNA, 22 bp, Homo sapiens
gagctagtagaacaagtgagga

SEQ ID NO: 9515202 - DNA, 22 bp, Homo sapiens
gagctctatgtggctggcatgt

SEQ ID NO: 9515203 - DNA, 20 bp, Homo sapiens
gagctacacaaatgctgctt

SEQ ID NO: 9515204 - DNA, 22 bp, Homo sapiens
gagctaagctatgttatgcagc

SEQ ID NO: 9515205 - DNA, 22 bp, Homo sapiens
gagcgggaggaacggctcgggc

SEQ ID NO: 9515206 - DNA, 22 bp, Homo sapiens
gagcgggaggaacggctcgggc

SEQ ID NO: 9515207 - DNA, 22 bp, Homo sapiens
gagctagagtttgtagggtaga

SEQ ID NO: 9515208 - DNA, 22 bp, Homo sapiens
gagctactgaaatattgatttt

SEQ ID NO: 9515209 - DNA, 22 bp, Homo sapiens
gagctactgaaatattgatttt

SEQ ID NO: 9515210 - DNA, 22 bp, Homo sapiens
gagctaggttgagactcactta

SEQ ID NO: 9515211 - DNA, 22 bp, Homo sapiens
gagctaggctagggggagtcgc

SEQ ID NO: 9515212 - DNA, 22 bp, Homo sapiens
gagctaggatatcatgagggta

SEQ ID NO: 9515213 - DNA, 22 bp, Homo sapiens
gagccaggtttgaatctcagtc

SEQ ID NO: 9515214 - DNA, 22 bp, Homo sapiens
gagccctgttcaggcctcctca

SEQ ID NO: 9515215 - DNA, 22 bp, Homo sapiens
gagccctgttcaggcctcctca

SEQ ID NO: 9515216 - DNA, 22 bp, Homo sapiens
gagcctcagggttttgttgaca

SEQ ID NO: 9515217 - DNA, 22 bp, Homo sapiens
gagccgtgccagccctgtctcg

SEQ ID NO: 9515218 - DNA, 22 bp, Homo sapiens
gagcctgaatttgacctgctta

SEQ ID NO: 9515219 - DNA, 22 bp, Homo sapiens
gagcctgaaatacaggtcactg

SEQ ID NO: 9515220 - DNA, 22 bp, Homo sapiens
gagcctgcccagccctgtccac

SEQ ID NO: 9515221 - DNA, 22 bp, Homo sapiens
gagcctgatgaaacaggcagac

SEQ ID NO: 9515222 - DNA, 22 bp, Homo sapiens
gagcctgagcaatgtgatgttt

SEQ ID NO: 9515223 - DNA, 22 bp, Homo sapiens
gagcctgagtgctgcctcccct

SEQ ID NO: 9515224 - DNA, 22 bp, Homo sapiens
gagcctgatgaaacaggcagac

SEQ ID NO: 9515225 - DNA, 22 bp, Homo sapiens
gagcctggagctggaacgaagc

SEQ ID NO: 9515226 - DNA, 22 bp, Homo sapiens
gagcctggagctggaacgaagc

SEQ ID NO: 9515227 - DNA, 22 bp, Homo sapiens
gagcctggacatctcaggccca

SEQ ID NO: 9515228 - DNA, 22 bp, Homo sapiens
gagcggaggcttggaggccagc

SEQ ID NO: 9515229 - DNA, 22 bp, Homo sapiens
gagcctggattgaagtgggtgg

SEQ ID NO: 9515230 - DNA, 22 bp, Homo sapiens
gagcctggagctggaacgaagc

SEQ ID NO: 9515231 - DNA, 22 bp, Homo sapiens
gagctgaacatcatggaaaggc

SEQ ID NO: 9515232 - DNA, 22 bp, Homo sapiens
gagctgaaatatgaagccaatt

SEQ ID NO: 9515233 - DNA, 18 bp, Homo sapiens
gagctgagaagaggatgc

SEQ ID NO: 9515234 - DNA, 18 bp, Homo sapiens
gagctgagaagaggatgc

SEQ ID NO: 9515235 - DNA, 18 bp, Homo sapiens
gagctgagaagaggatgc

SEQ ID NO: 9515236 - DNA, 18 bp, Homo sapiens
gagctgagaagaggatgc

SEQ ID NO: 9515237 - DNA, 22 bp, Homo sapiens
gagctgaatcagagatattatt

SEQ ID NO: 9515238 - DNA, 19 bp, Homo sapiens
gagctgagagtagcactgg

SEQ ID NO: 9515239 - DNA, 22 bp, Homo sapiens
gagctgagacacactttggcaa

SEQ ID NO: 9515240 - DNA, 19 bp, Homo sapiens
gagctgagagtagcactgg

SEQ ID NO: 9515241 - DNA, 22 bp, Homo sapiens
gagctgtgttgtctagtaccga

SEQ ID NO: 9515242 - DNA, 22 bp, Homo sapiens
gagctgtgttcatgaggagaaa

SEQ ID NO: 9515243 - DNA, 22 bp, Homo sapiens
gagctgtgttcatgaggagaaa

SEQ ID NO: 9515244 - DNA, 22 bp, Homo sapiens
gagcttccatccttactgtgtg

SEQ ID NO: 9515245 - DNA, 22 bp, Homo sapiens
gagcttccatccttactgtgtg

SEQ ID NO: 9515246 - DNA, 22 bp, Homo sapiens
gagcttccagagacatcagagt

SEQ ID NO: 9515247 - DNA, 22 bp, Homo sapiens
gagcttcatatgttgcagagaa

SEQ ID NO: 9515248 - DNA, 22 bp, Homo sapiens
gagcttaaatggctaaatataa

SEQ ID NO: 9515249 - DNA, 22 bp, Homo sapiens
gagcttaaatggctaaatataa

SEQ ID NO: 9515250 - DNA, 22 bp, Homo sapiens
gagcttaggccagggacaggga

SEQ ID NO: 9515251 - DNA, 22 bp, Homo sapiens
gagcttggaagcagatcctcac

SEQ ID NO: 9515252 - DNA, 22 bp, Homo sapiens
gagcttctcaacagttatctct

SEQ ID NO: 9515253 - DNA, 22 bp, Homo sapiens
gagcttttataccttctctcag

SEQ ID NO: 9515254 - DNA, 22 bp, Homo sapiens
gagcttggcctcttgaacgtgg

SEQ ID NO: 9515255 - DNA, 22 bp, Homo sapiens
gagcttggcagtgtcactaggg

SEQ ID NO: 9515256 - DNA, 22 bp, Homo sapiens
gaggaaaagagacaggttattg

SEQ ID NO: 9515257 - DNA, 22 bp, Homo sapiens
gagcttggcagtgtcactaggg

SEQ ID NO: 9515258 - DNA, 22 bp, Homo sapiens
gagcttggatgtcttttgttca

SEQ ID NO: 9515259 - DNA, 22 bp, Homo sapiens
gagcttggacaccttggcaggt

SEQ ID NO: 9515260 - DNA, 22 bp, Homo sapiens
gagcttggatgtcttttgttca

SEQ ID NO: 9515261 - DNA, 22 bp, Homo sapiens
gagcttggacaagctctgaagg

SEQ ID NO: 9515262 - DNA, 22 bp, Homo sapiens
gagcttggacaagctctgaagg

SEQ ID NO: 9515263 - DNA, 22 bp, Homo sapiens
gagcttggacaccttggcaggt

SEQ ID NO: 9515264 - DNA, 22 bp, Homo sapiens
gagaggccggcgtcgctgcggc

SEQ ID NO: 9515265 - DNA, 22 bp, Homo sapiens
gagaggccctgtggtcccagct

SEQ ID NO: 9515266 - DNA, 22 bp, Homo sapiens
gagaggccggcgtcgctgcggc

SEQ ID NO: 9515267 - DNA, 22 bp, Homo sapiens
gagaggccctgtggtcccagct

SEQ ID NO: 9515268 - DNA, 22 bp, Homo sapiens
gagaggccctgaagcccacaga

SEQ ID NO: 9515269 - DNA, 18 bp, Homo sapiens
gagaggcccggctgtgcc

SEQ ID NO: 9515270 - DNA, 22 bp, Homo sapiens
gagaggccctgaagcccacaga

SEQ ID NO: 9515271 - DNA, 22 bp, Homo sapiens
gagaggccctgaagcccacaga

SEQ ID NO: 9515272 - DNA, 18 bp, Homo sapiens
gagaggcccggctgtgcc

SEQ ID NO: 9515273 - DNA, 19 bp, Homo sapiens
gagaggcctgtgcttgaag

SEQ ID NO: 9515274 - DNA, 19 bp, Homo sapiens
gagaggcctgtgcttgaag

SEQ ID NO: 9515275 - DNA, 22 bp, Homo sapiens
gagaggcctgagaggctgcgga

SEQ ID NO: 9515276 - DNA, 22 bp, Homo sapiens
gagaggcctgagaggctgcgga

SEQ ID NO: 9515277 - DNA, 22 bp, Homo sapiens
gagaggcctgggcccgtgagct

SEQ ID NO: 9515278 - DNA, 22 bp, Homo sapiens
gagaggccaagggatccgtgag

SEQ ID NO: 9515279 - DNA, 22 bp, Homo sapiens
gagaggccaaaatccctgcccc

SEQ ID NO: 9515280 - DNA, 22 bp, Homo sapiens
gagaggccatggggtgggatgc

SEQ ID NO: 9515281 - DNA, 22 bp, Homo sapiens
gagaggcatggaacagattctt

SEQ ID NO: 9515282 - DNA, 22 bp, Homo sapiens
gagaggcaggcgctgcaatggt

SEQ ID NO: 9515283 - DNA, 22 bp, Homo sapiens
gagaggcatggaacagattctt

SEQ ID NO: 9515284 - DNA, 22 bp, Homo sapiens
gagaggcatggaacagattctt

SEQ ID NO: 9515285 - DNA, 22 bp, Homo sapiens
gagacaaaagttggagtgcaag

SEQ ID NO: 9515286 - DNA, 22 bp, Homo sapiens
gagagggagccagccaggaacc

SEQ ID NO: 9515287 - DNA, 22 bp, Homo sapiens
gagagggagccagccaggaacc

SEQ ID NO: 9515288 - DNA, 22 bp, Homo sapiens
gagatcctgtaggcagctaaga

SEQ ID NO: 9515289 - DNA, 22 bp, Homo sapiens
gagagggatactgagttttggt

SEQ ID NO: 9515290 - DNA, 22 bp, Homo sapiens
gagaggcttaagggctgtgaag

SEQ ID NO: 9515291 - DNA, 22 bp, Homo sapiens
gagagggagccagccaggaacc

SEQ ID NO: 9515292 - DNA, 22 bp, Homo sapiens
gagaggctgggttggagatcga

SEQ ID NO: 9515293 - DNA, 22 bp, Homo sapiens
gagaggctgggttggagatcga

SEQ ID NO: 9515294 - DNA, 22 bp, Homo sapiens
gagaggctggtaaagtctgaac

SEQ ID NO: 9515295 - DNA, 22 bp, Homo sapiens
gagaggcttaagggctgtgaag

SEQ ID NO: 9515296 - DNA, 22 bp, Homo sapiens
gagaggctgtgtgccattgttg

SEQ ID NO: 9515297 - DNA, 22 bp, Homo sapiens
gagatctctagcacttcctgta

SEQ ID NO: 9515298 - DNA, 22 bp, Homo sapiens
gagatcggtaaagagcatgcac

SEQ ID NO: 9515299 - DNA, 22 bp, Homo sapiens
gagatgaatcattccatggtca

SEQ ID NO: 9515300 - DNA, 22 bp, Homo sapiens
gagatgaatgtaaacaaaggca

SEQ ID NO: 9515301 - DNA, 22 bp, Homo sapiens
gagatgctgtcaggctatctgt

SEQ ID NO: 9515302 - DNA, 22 bp, Homo sapiens
gagatgatctttcctgtagtcc

SEQ ID NO: 9515303 - DNA, 22 bp, Homo sapiens
gagatgcagaaccctcaggagc

SEQ ID NO: 9515304 - DNA, 22 bp, Homo sapiens
gagatgcagaaccctcaggagc

SEQ ID NO: 9515305 - DNA, 20 bp, Homo sapiens
gagatgcaagtgtatctgac

SEQ ID NO: 9515306 - DNA, 16 bp, Homo sapiens
gacctcagtgctggct

SEQ ID NO: 9515307 - DNA, 22 bp, Homo sapiens
gacctcatgatccacctgcctt

SEQ ID NO: 9515308 - DNA, 22 bp, Homo sapiens
gacctcatgatccacctgcctt

SEQ ID NO: 9515309 - DNA, 22 bp, Homo sapiens
gacctcatgatccacctgcctt

SEQ ID NO: 9515310 - DNA, 22 bp, Homo sapiens
gacctcagctgtggggatgctg

SEQ ID NO: 9515311 - DNA, 22 bp, Homo sapiens
gacctcaggcttctgtaattaa

SEQ ID NO: 9515312 - DNA, 22 bp, Homo sapiens
gacctactgtgtgcccagcatg

SEQ ID NO: 9515313 - DNA, 22 bp, Homo sapiens
gacctcagtattgttcaggatg

SEQ ID NO: 9515314 - DNA, 22 bp, Homo sapiens
gacctcaggtttgtaatggaca

SEQ ID NO: 9515315 - DNA, 22 bp, Homo sapiens
gacctcaggtttgtaatggaca

SEQ ID NO: 9515316 - DNA, 22 bp, Homo sapiens
gacctccagcggccctgcagag

SEQ ID NO: 9515317 - DNA, 22 bp, Homo sapiens
gacctcatgatccacctgcctt

SEQ ID NO: 9515318 - DNA, 22 bp, Homo sapiens
gacctccagcggccctgcagag

SEQ ID NO: 9515319 - DNA, 22 bp, Homo sapiens
gacctccagcggccctgcagag

SEQ ID NO: 9515320 - DNA, 22 bp, Homo sapiens
gacctccattctgtcatgactg

SEQ ID NO: 9515321 - DNA, 22 bp, Homo sapiens
gacctccgtgtacacctcccag

SEQ ID NO: 9515322 - DNA, 22 bp, Homo sapiens
gacctccgtgtacacctcccag

SEQ ID NO: 9515323 - DNA, 22 bp, Homo sapiens
gacctcgtgatccgcccgcttt

SEQ ID NO: 9515324 - DNA, 22 bp, Homo sapiens
gacctctcaggaatctcacatg

SEQ ID NO: 9515325 - DNA, 22 bp, Homo sapiens
gacctcgtgatccgccctcctt

SEQ ID NO: 9515326 - DNA, 22 bp, Homo sapiens
gagaaggactacacatctggcc

SEQ ID NO: 9515327 - DNA, 22 bp, Homo sapiens
gacctgaaatgggggcctgtcc

SEQ ID NO: 9515328 - DNA, 22 bp, Homo sapiens
gagaaggactacggaaaacaga

SEQ ID NO: 9515329 - DNA, 22 bp, Homo sapiens
gagaaggactacggaaaacaga

SEQ ID NO: 9515330 - DNA, 22 bp, Homo sapiens
gacctgaaagtgtgggcgacct

SEQ ID NO: 9515331 - DNA, 22 bp, Homo sapiens
gacctgaaagagattaaatgac

SEQ ID NO: 9515332 - DNA, 22 bp, Homo sapiens
gacctctcaggaatctcacatg

SEQ ID NO: 9515333 - DNA, 22 bp, Homo sapiens
gacctctgggtgatgcccaggc

SEQ ID NO: 9515334 - DNA, 22 bp, Homo sapiens
gacctctgggtgatgcccaggc

SEQ ID NO: 9515335 - DNA, 22 bp, Homo sapiens
gagaaggagctcaaatatggct

SEQ ID NO: 9515336 - DNA, 22 bp, Homo sapiens
gagaaggaggcgaagcgtgtgc

SEQ ID NO: 9515337 - DNA, 22 bp, Homo sapiens
gagaaggcttcttttcctctga

SEQ ID NO: 9515338 - DNA, 22 bp, Homo sapiens
gagaaggctggtcttaagtcga

SEQ ID NO: 9515339 - DNA, 22 bp, Homo sapiens
gagaaggctgatccttggagtt

SEQ ID NO: 9515340 - DNA, 22 bp, Homo sapiens
gagaaggctgatccttggagtt

SEQ ID NO: 9515341 - DNA, 22 bp, Homo sapiens
gagaaggccaggaacccagtgt

SEQ ID NO: 9515342 - DNA, 18 bp, Homo sapiens
gagaaggccacttgtttt

SEQ ID NO: 9515343 - DNA, 22 bp, Homo sapiens
gagaaggatgtggctcatagct

SEQ ID NO: 9515344 - DNA, 22 bp, Homo sapiens
gagaagggatatgccactctcg

SEQ ID NO: 9515345 - DNA, 22 bp, Homo sapiens
gagaagggatatgccactctcg

SEQ ID NO: 9515346 - DNA, 22 bp, Homo sapiens
gagaagggatatggcttcttga

SEQ ID NO: 9515347 - DNA, 22 bp, Homo sapiens
gagaagggggctcgagtgtcct

SEQ ID NO: 9515348 - DNA, 22 bp, Homo sapiens
gagaagggcttgggagtcaaca

SEQ ID NO: 9515349 - DNA, 22 bp, Homo sapiens
gagaatgatgatttccaatttc

SEQ ID NO: 9515350 - DNA, 22 bp, Homo sapiens
gagaatgggaatgaaagtagca

SEQ ID NO: 9515351 - DNA, 22 bp, Homo sapiens
gagaagggggctcgagtgtcct

SEQ ID NO: 9515352 - DNA, 22 bp, Homo sapiens
gagaagggggctcgagtgtcct

SEQ ID NO: 9515353 - DNA, 22 bp, Homo sapiens
gagaagggggctcgagtgtcct

SEQ ID NO: 9515354 - DNA, 22 bp, Homo sapiens
gagaagggggctcgagtgtcct

SEQ ID NO: 9515355 - DNA, 22 bp, Homo sapiens
gagaatctccagatgaagtcct

SEQ ID NO: 9515356 - DNA, 22 bp, Homo sapiens
gagaattttctagtagtttcat

SEQ ID NO: 9515357 - DNA, 22 bp, Homo sapiens
gagacaaaagttggagtgcaag

SEQ ID NO: 9515358 - DNA, 22 bp, Homo sapiens
gagaattttctagtagtttcat

SEQ ID NO: 9515359 - DNA, 22 bp, Homo sapiens
gagaattactgtttttataaca

SEQ ID NO: 9515360 - DNA, 22 bp, Homo sapiens
gagaattagggcgtaattcaga

SEQ ID NO: 9515361 - DNA, 22 bp, Homo sapiens
gagaattcttcaacaaagtatt

SEQ ID NO: 9515362 - DNA, 22 bp, Homo sapiens
gagaattagggcgtaattcaga

SEQ ID NO: 9515363 - DNA, 22 bp, Homo sapiens
gagcagcttatgtcaagccaga

SEQ ID NO: 9515364 - DNA, 22 bp, Homo sapiens
gagcatttttgtctgcatttta

SEQ ID NO: 9515365 - DNA, 22 bp, Homo sapiens
gagccaaatgtgcagacattgt

SEQ ID NO: 9515366 - DNA, 22 bp, Homo sapiens
gagcagcttatgtcaagccaga

SEQ ID NO: 9515367 - DNA, 22 bp, Homo sapiens
gagcagcttatgtcaagccaga

SEQ ID NO: 9515368 - DNA, 20 bp, Homo sapiens
gagcagctgtttgcattgca

SEQ ID NO: 9515369 - DNA, 22 bp, Homo sapiens
gagccaagatcgcaccactgca

SEQ ID NO: 9515370 - DNA, 22 bp, Homo sapiens
gagccaagattgtgtccctgca

SEQ ID NO: 9515371 - DNA, 22 bp, Homo sapiens
gagccaagctcttctccatgag

SEQ ID NO: 9515372 - DNA, 22 bp, Homo sapiens
gagccacagtggattgattcca

SEQ ID NO: 9515373 - DNA, 22 bp, Homo sapiens
gagccaccttcaactcaggaat

SEQ ID NO: 9515374 - DNA, 22 bp, Homo sapiens
gagccacagtggtggcccacgt

SEQ ID NO: 9515375 - DNA, 22 bp, Homo sapiens
gagccaagggcgtgctggagag

SEQ ID NO: 9515376 - DNA, 22 bp, Homo sapiens
gagccaagggttgccatggaga

SEQ ID NO: 9515377 - DNA, 22 bp, Homo sapiens
gagccacagcaacctcaaagga

SEQ ID NO: 9515378 - DNA, 22 bp, Homo sapiens
gagcagctggaggccttgttgg

SEQ ID NO: 9515379 - DNA, 22 bp, Homo sapiens
gagcagctggaggccttgttgg

SEQ ID NO: 9515380 - DNA, 22 bp, Homo sapiens
gagcagctggacaggcctccct

SEQ ID NO: 9515381 - DNA, 22 bp, Homo sapiens
gagcagctggacaggcctccct

SEQ ID NO: 9515382 - DNA, 22 bp, Homo sapiens
gagcagctgcagtgcagaccct

SEQ ID NO: 9515383 - DNA, 22 bp, Homo sapiens
gagcagctgcagtgcagaccct

SEQ ID NO: 9515384 - DNA, 19 bp, Homo sapiens
gagcagctgcacccattga

SEQ ID NO: 9515385 - DNA, 22 bp, Homo sapiens
gagcagccctagggcataagca

SEQ ID NO: 9515386 - DNA, 22 bp, Homo sapiens
gagcagctggctgtattggttt

SEQ ID NO: 9515387 - DNA, 22 bp, Homo sapiens
gagcagctggtaggtgaaccca

SEQ ID NO: 9515388 - DNA, 22 bp, Homo sapiens
gagcagctgtccccaaagcttc

SEQ ID NO: 9515389 - DNA, 22 bp, Homo sapiens
gagcagctgtccccaaagcttc

SEQ ID NO: 9515390 - DNA, 22 bp, Homo sapiens
gagcagctgtccccaaagcttc

SEQ ID NO: 9515391 - DNA, 22 bp, Homo sapiens
gagcagctgttctgacttgtct

SEQ ID NO: 9515392 - DNA, 22 bp, Homo sapiens
gagcagctgtggggttgaccat

SEQ ID NO: 9515393 - DNA, 22 bp, Homo sapiens
gagcagctgttctgacttgtct

SEQ ID NO: 9515394 - DNA, 22 bp, Homo sapiens
gagccagggctgtgagctgagc

SEQ ID NO: 9515395 - DNA, 22 bp, Homo sapiens
gagccagggctgtgagctgagc

SEQ ID NO: 9515396 - DNA, 22 bp, Homo sapiens
gagccaggggtcagctccgagg

SEQ ID NO: 9515397 - DNA, 22 bp, Homo sapiens
gagccaggggtcagctccgagg

SEQ ID NO: 9515398 - DNA, 22 bp, Homo sapiens
gagccaggggtcagctccgagg

SEQ ID NO: 9515399 - DNA, 22 bp, Homo sapiens
gagccaggttggaggctgcagt

SEQ ID NO: 9515400 - DNA, 22 bp, Homo sapiens
gagccaggttggaggctgcagt

SEQ ID NO: 9515401 - DNA, 22 bp, Homo sapiens
gagccaggtcgggccgcggcga

SEQ ID NO: 9515402 - DNA, 16 bp, Homo sapiens
gagccaggtgccttga

SEQ ID NO: 9515403 - DNA, 22 bp, Homo sapiens
gagccaggtcgggccgcggcga

SEQ ID NO: 9515404 - DNA, 22 bp, Homo sapiens
gagccagggtttgaaactagac

SEQ ID NO: 9515405 - DNA, 22 bp, Homo sapiens
gagccagagatccaggatggct

SEQ ID NO: 9515406 - DNA, 22 bp, Homo sapiens
gagccagagatccaggatggct

SEQ ID NO: 9515407 - DNA, 22 bp, Homo sapiens
gagccagacaggctagagcggg

SEQ ID NO: 9515408 - DNA, 22 bp, Homo sapiens
gagccagacaggctagagcggg

SEQ ID NO: 9515409 - DNA, 22 bp, Homo sapiens
gagccagactgcctgaagctca

SEQ ID NO: 9515410 - DNA, 22 bp, Homo sapiens
gagccagactgcctgaagctca

SEQ ID NO: 9515411 - DNA, 22 bp, Homo sapiens
gagccaccttcaactcaggaat

SEQ ID NO: 9515412 - DNA, 22 bp, Homo sapiens
gagccagaaaagctgcctgact

SEQ ID NO: 9515413 - DNA, 22 bp, Homo sapiens
gagccagaaaagctgcctgact

SEQ ID NO: 9515414 - DNA, 22 bp, Homo sapiens
gagccagaaaagctgcctgact

SEQ ID NO: 9515415 - DNA, 22 bp, Homo sapiens
gagccagggctgtgagctgagc

SEQ ID NO: 9515416 - DNA, 22 bp, Homo sapiens
gagccagcaggacttaagccag

SEQ ID NO: 9515417 - DNA, 22 bp, Homo sapiens
gagccagccgcaagagctgtga

SEQ ID NO: 9515418 - DNA, 22 bp, Homo sapiens
gagccagccgcaagagctgtga

SEQ ID NO: 9515419 - DNA, 22 bp, Homo sapiens
gagccagcagccggcaccacca

SEQ ID NO: 9515420 - DNA, 22 bp, Homo sapiens
gagccagcaggacttaagccag

SEQ ID NO: 9515421 - DNA, 22 bp, Homo sapiens
gagccagcagccggcaccacca

SEQ ID NO: 9515422 - DNA, 22 bp, Homo sapiens
gagccagagctacaagtgtctg

SEQ ID NO: 9515423 - DNA, 22 bp, Homo sapiens
gagccagagctacaagtgtctg

SEQ ID NO: 9515424 - DNA, 22 bp, Homo sapiens
gagccagagctacaagtgtctg

SEQ ID NO: 9515425 - DNA, 22 bp, Homo sapiens
gagccagattttatgcaagaca

SEQ ID NO: 9515426 - DNA, 21 bp, Homo sapiens
gagatttagaaggatcaattt

SEQ ID NO: 9515427 - DNA, 22 bp, Homo sapiens
gagcagagtctatttccacact

SEQ ID NO: 9515428 - DNA, 18 bp, Homo sapiens
gagcagaggctcaactgg

SEQ ID NO: 9515429 - DNA, 22 bp, Homo sapiens
gagcagagtctatttccacact

SEQ ID NO: 9515430 - DNA, 22 bp, Homo sapiens
gagcagagtctatttccacact

SEQ ID NO: 9515431 - DNA, 22 bp, Homo sapiens
gagcagagtctatttccacact

SEQ ID NO: 9515432 - DNA, 22 bp, Homo sapiens
gagcagcacttgaggcatgtca

SEQ ID NO: 9515433 - DNA, 22 bp, Homo sapiens
gagcagcacttgaggcatgtca

SEQ ID NO: 9515434 - DNA, 22 bp, Homo sapiens
gagcagcactgagttagcagct

SEQ ID NO: 9515435 - DNA, 22 bp, Homo sapiens
gagcagcactgagttagcagct

SEQ ID NO: 9515436 - DNA, 22 bp, Homo sapiens
gagcagcaagcactcaaaggct

SEQ ID NO: 9515437 - DNA, 22 bp, Homo sapiens
gagcagcaaagggagggtaaat

SEQ ID NO: 9515438 - DNA, 22 bp, Homo sapiens
gagcagcaaagggagggtaaat

SEQ ID NO: 9515439 - DNA, 22 bp, Homo sapiens
gagcagcaggccaggttgcagg

SEQ ID NO: 9515440 - DNA, 22 bp, Homo sapiens
gagcagcaggccaggttgcagg

SEQ ID NO: 9515441 - DNA, 22 bp, Homo sapiens
gagcagcaggccaggttgcagg

SEQ ID NO: 9515442 - DNA, 18 bp, Homo sapiens
gagcagcaggatcaagaa

SEQ ID NO: 9515443 - DNA, 18 bp, Homo sapiens
gagcagcaggatcaagaa

SEQ ID NO: 9515444 - DNA, 18 bp, Homo sapiens
gagcagcaggatcaagaa

SEQ ID NO: 9515445 - DNA, 22 bp, Homo sapiens
gagcagcagctgggccaggttc

SEQ ID NO: 9515446 - DNA, 22 bp, Homo sapiens
gagcagcagctgggccaggttc

SEQ ID NO: 9515447 - DNA, 22 bp, Homo sapiens
gagcagcagctgggccaggttc

SEQ ID NO: 9515448 - DNA, 18 bp, Homo sapiens
gagcagcaggatcaagaa

SEQ ID NO: 9515449 - DNA, 22 bp, Homo sapiens
gagcagcagctgggccaggttc

SEQ ID NO: 9515450 - DNA, 22 bp, Homo sapiens
gagcagcagctgggccaggttc

SEQ ID NO: 9515451 - DNA, 22 bp, Homo sapiens
gagcagcaggtggctgtgatgg

SEQ ID NO: 9515452 - DNA, 22 bp, Homo sapiens
gagcagcaggtggggctggctt

SEQ ID NO: 9515453 - DNA, 22 bp, Homo sapiens
gagcagcaggtggggctggctt

SEQ ID NO: 9515454 - DNA, 22 bp, Homo sapiens
gagcagcaggtggggctggctt

SEQ ID NO: 9515455 - DNA, 20 bp, Homo sapiens
gagatggacagatgaagggg

SEQ ID NO: 9515456 - DNA, 20 bp, Homo sapiens
gagatggacagatgaagggg

SEQ ID NO: 9515457 - DNA, 20 bp, Homo sapiens
gagatggacagatgaagggg

SEQ ID NO: 9515458 - DNA, 20 bp, Homo sapiens
gagatggacagatgaagggg

SEQ ID NO: 9515459 - DNA, 22 bp, Homo sapiens
gagatggaaaactgctggtagt

SEQ ID NO: 9515460 - DNA, 22 bp, Homo sapiens
gagatggaatctgtgtggaggg

SEQ ID NO: 9515461 - DNA, 22 bp, Homo sapiens
gagatgtacaatgtgtattaat

SEQ ID NO: 9515462 - DNA, 22 bp, Homo sapiens
gagatggagtctttttctgtca

SEQ ID NO: 9515463 - DNA, 22 bp, Homo sapiens
gagatggagtctttttctgtca

SEQ ID NO: 9515464 - DNA, 22 bp, Homo sapiens
gagatggagaaggaagctgttt

SEQ ID NO: 9515465 - DNA, 22 bp, Homo sapiens
gagatggagaaggaagctgttt

SEQ ID NO: 9515466 - DNA, 22 bp, Homo sapiens
gagatggagtctttttctgtca

SEQ ID NO: 9515467 - DNA, 22 bp, Homo sapiens
gagattggtaaagaaccaggtt

SEQ ID NO: 9515468 - DNA, 22 bp, Homo sapiens
gagattggatttaatggccaaa

SEQ ID NO: 9515469 - DNA, 22 bp, Homo sapiens
gagatttaattggattaactta

SEQ ID NO: 9515470 - DNA, 22 bp, Homo sapiens
gagatttaattggattaactta

SEQ ID NO: 9515471 - DNA, 22 bp, Homo sapiens
gagattctgagaagttaagtcc

SEQ ID NO: 9515472 - DNA, 23 bp, Homo sapiens
gagattctcctgttgtcaagtct

SEQ ID NO: 9515473 - DNA, 22 bp, Homo sapiens
gagattctgtagtcaggcatct

SEQ ID NO: 9515474 - DNA, 21 bp, Homo sapiens
gagatgtgagctctgatagtc

SEQ ID NO: 9515475 - DNA, 23 bp, Homo sapiens
gagatgtgggtttgttcagtgtc

SEQ ID NO: 9515476 - DNA, 20 bp, Homo sapiens
gagattaactgagaatctag

SEQ ID NO: 9515477 - DNA, 22 bp, Homo sapiens
gagattatggagaggacattct

SEQ ID NO: 9515478 - DNA, 22 bp, Homo sapiens
gagattctaatataaggatggg

SEQ ID NO: 9515479 - DNA, 22 bp, Homo sapiens
gaatacatttgccgtggttctc

SEQ ID NO: 9515480 - DNA, 22 bp, Homo sapiens
gaatacattggaaatcagaata

SEQ ID NO: 9515481 - DNA, 22 bp, Homo sapiens
gaatacattggaaatcagaata

SEQ ID NO: 9515482 - DNA, 22 bp, Homo sapiens
gaatacatggcagggagtcatc

SEQ ID NO: 9515483 - DNA, 22 bp, Homo sapiens
gaatacatgtgtgtatagaggt

SEQ ID NO: 9515484 - DNA, 21 bp, Homo sapiens
gaatagttctgtggcagcagt

SEQ ID NO: 9515485 - DNA, 23 bp, Homo sapiens
gaatagttttagaaattggagaa

SEQ ID NO: 9515486 - DNA, 22 bp, Homo sapiens
gaatatattggtgaaaatagtt

SEQ ID NO: 9515487 - DNA, 22 bp, Homo sapiens
gaatatattattcagcttttca

SEQ ID NO: 9515488 - DNA, 22 bp, Homo sapiens
gaatatattggtgaaaatagtt

SEQ ID NO: 9515489 - DNA, 22 bp, Homo sapiens
gaatatattggtgaaaatagtt

SEQ ID NO: 9515490 - DNA, 22 bp, Homo sapiens
gaatagcttccttttttccaaa

SEQ ID NO: 9515491 - DNA, 22 bp, Homo sapiens
gaatagcttagattccttagtg

SEQ ID NO: 9515492 - DNA, 22 bp, Homo sapiens
gaatagttctatggctgcaggg

SEQ ID NO: 9515493 - DNA, 22 bp, Homo sapiens
gaatagatatccttgagggtct

SEQ ID NO: 9515494 - DNA, 22 bp, Homo sapiens
gaatagatagcttggatggttg

SEQ ID NO: 9515495 - DNA, 22 bp, Homo sapiens
gaatagataagtgactatttgg

SEQ ID NO: 9515496 - DNA, 22 bp, Homo sapiens
gaatagattatacttgaagcat

SEQ ID NO: 9515497 - DNA, 22 bp, Homo sapiens
gaatagatcctcatttattgat

SEQ ID NO: 9515498 - DNA, 22 bp, Homo sapiens
gacaagatttagagtctgctaa

SEQ ID NO: 9515499 - DNA, 22 bp, Homo sapiens
gacaagctcttgtttcatggtt

SEQ ID NO: 9515500 - DNA, 22 bp, Homo sapiens
gacaagataatgaagtgcaatt

SEQ ID NO: 9515501 - DNA, 22 bp, Homo sapiens
gacaagatgagcagctcagtgt

SEQ ID NO: 9515502 - DNA, 22 bp, Homo sapiens
gacaagattaaccatagttaag

SEQ ID NO: 9515503 - DNA, 22 bp, Homo sapiens
gacaagacatgtgatgacatca

SEQ ID NO: 9515504 - DNA, 22 bp, Homo sapiens
gacaagacatgtgatgacatca

SEQ ID NO: 9515505 - DNA, 22 bp, Homo sapiens
gaatattagtatcagttatacc

SEQ ID NO: 9515506 - DNA, 22 bp, Homo sapiens
gacaactgagcagaggaaatga

SEQ ID NO: 9515507 - DNA, 22 bp, Homo sapiens
gacaaccgagcagctgtgggaa

SEQ ID NO: 9515508 - DNA, 22 bp, Homo sapiens
gaatatcttgtacatctaagta

SEQ ID NO: 9515509 - DNA, 22 bp, Homo sapiens
gaatatcttgtacatctaagta

SEQ ID NO: 9515510 - DNA, 22 bp, Homo sapiens
gaatatgtgcatttatgagtgt

SEQ ID NO: 9515511 - DNA, 22 bp, Homo sapiens
gaatatgtgcatttatgagtgt

SEQ ID NO: 9515512 - DNA, 22 bp, Homo sapiens
gaatatgtttgacatttagttg

SEQ ID NO: 9515513 - DNA, 22 bp, Homo sapiens
gaatatgttctggaagttcttg

SEQ ID NO: 9515514 - DNA, 22 bp, Homo sapiens
gaatatgttctggaagttcttg

SEQ ID NO: 9515515 - DNA, 22 bp, Homo sapiens
gaatatgtgttcctggacaaga

SEQ ID NO: 9515516 - DNA, 22 bp, Homo sapiens
gaatatctgggagtgggaagct

SEQ ID NO: 9515517 - DNA, 18 bp, Homo sapiens
gaatatctagcacatagt

SEQ ID NO: 9515518 - DNA, 22 bp, Homo sapiens
gaatatcccgctatgcaaagta

SEQ ID NO: 9515519 - DNA, 22 bp, Homo sapiens
gaatatatttctcttaccttta

SEQ ID NO: 9515520 - DNA, 22 bp, Homo sapiens
gaatatatttctcttaccttta

SEQ ID NO: 9515521 - DNA, 22 bp, Homo sapiens
gaatatatttctcttaccttta

SEQ ID NO: 9515522 - DNA, 22 bp, Homo sapiens
gaagttctgggatttccacagt

SEQ ID NO: 9515523 - DNA, 22 bp, Homo sapiens
gaagttcttagtctcatttgca

SEQ ID NO: 9515524 - DNA, 22 bp, Homo sapiens
gaagttcttagtctcatttgca

SEQ ID NO: 9515525 - DNA, 22 bp, Homo sapiens
gaagttctggtgtatgtgataa

SEQ ID NO: 9515526 - DNA, 22 bp, Homo sapiens
gaagttctttatagcagtgtga

SEQ ID NO: 9515527 - DNA, 23 bp, Homo sapiens
gaagttctttcttctcatgctgt

SEQ ID NO: 9515528 - DNA, 22 bp, Homo sapiens
gaagtttagaagtgacaggttt

SEQ ID NO: 9515529 - DNA, 22 bp, Homo sapiens
gaagttgtaagcctgggaaggt

SEQ ID NO: 9515530 - DNA, 22 bp, Homo sapiens
gaagttgatagagtacatgatt

SEQ ID NO: 9515531 - DNA, 22 bp, Homo sapiens
gaagttctgaaataaaatcctg

SEQ ID NO: 9515532 - DNA, 22 bp, Homo sapiens
gaagttctgaccatatggccaa

SEQ ID NO: 9515533 - DNA, 22 bp, Homo sapiens
gaaggaagattctgttggaatc

SEQ ID NO: 9515534 - DNA, 22 bp, Homo sapiens
gaaggaagactggtttaaatgt

SEQ ID NO: 9515535 - DNA, 22 bp, Homo sapiens
gaaggaaatctgtgatttatgc

SEQ ID NO: 9515536 - DNA, 22 bp, Homo sapiens
gaaggaaatctgtgatttatgc

SEQ ID NO: 9515537 - DNA, 22 bp, Homo sapiens
gaaggaaatctgtgatttatgc

SEQ ID NO: 9515538 - DNA, 22 bp, Homo sapiens
gaaggaaatctgtgatttatgc

SEQ ID NO: 9515539 - DNA, 22 bp, Homo sapiens
gaaggaaaggtctcatgccttt

SEQ ID NO: 9515540 - DNA, 22 bp, Homo sapiens
gaaggaaaggtctcatgccttt

SEQ ID NO: 9515541 - DNA, 22 bp, Homo sapiens
gaaggaaaggtctcatgccttt

SEQ ID NO: 9515542 - DNA, 22 bp, Homo sapiens
gaaggaaaacagatctgcctga

SEQ ID NO: 9515543 - DNA, 22 bp, Homo sapiens
gaaggaaaacagatctgcctga

SEQ ID NO: 9515544 - DNA, 22 bp, Homo sapiens
gaaggaaaacagatctgcctga

SEQ ID NO: 9515545 - DNA, 22 bp, Homo sapiens
gaaggaaaacagatctgcctga

SEQ ID NO: 9515546 - DNA, 22 bp, Homo sapiens
gaaggaaaacagatctgcctga

SEQ ID NO: 9515547 - DNA, 22 bp, Homo sapiens
gaaggaaaaatactctgtaagg

SEQ ID NO: 9515548 - DNA, 22 bp, Homo sapiens
gaaggaaaaatactctgtaagg

SEQ ID NO: 9515549 - DNA, 22 bp, Homo sapiens
gaaggaaaaatactctgtaagg

SEQ ID NO: 9515550 - DNA, 22 bp, Homo sapiens
gaaggaaaaatactctgtaagg

SEQ ID NO: 9515551 - DNA, 22 bp, Homo sapiens
gaaggaaaaatactctgtaagg

SEQ ID NO: 9515552 - DNA, 22 bp, Homo sapiens
gaagctttgtcttgtctcctgg

SEQ ID NO: 9515553 - DNA, 22 bp, Homo sapiens
gaagctttgagagcagaagccc

SEQ ID NO: 9515554 - DNA, 22 bp, Homo sapiens
gaaggaaaaatactctgtaagg

SEQ ID NO: 9515555 - DNA, 22 bp, Homo sapiens
gaagcttcgaaagagtgatttc

SEQ ID NO: 9515556 - DNA, 22 bp, Homo sapiens
gaagctttattgcaagtgaggc

SEQ ID NO: 9515557 - DNA, 22 bp, Homo sapiens
gaagcctcaacatctctgcgtc

SEQ ID NO: 9515558 - DNA, 22 bp, Homo sapiens
gaagcctcaacatctctgcgtc

SEQ ID NO: 9515559 - DNA, 22 bp, Homo sapiens
gaagctgtgctgggggatctgt

SEQ ID NO: 9515560 - DNA, 22 bp, Homo sapiens
gaagctgtgttgatggcatgga

SEQ ID NO: 9515561 - DNA, 22 bp, Homo sapiens
gaagctgtgttgatggcatgga

SEQ ID NO: 9515562 - DNA, 22 bp, Homo sapiens
gaataaactcctcagcttcctt

SEQ ID NO: 9515563 - DNA, 22 bp, Homo sapiens
gaagttttagtcaaaatgtaga

SEQ ID NO: 9515564 - DNA, 22 bp, Homo sapiens
gaagttttagtcaaaatgtaga

SEQ ID NO: 9515565 - DNA, 22 bp, Homo sapiens
gaagttttagtcaaaatgtaga

SEQ ID NO: 9515566 - DNA, 22 bp, Homo sapiens
gaataacagcaagtttgcaggc

SEQ ID NO: 9515567 - DNA, 22 bp, Homo sapiens
gaataacattggaaccctgaag

SEQ ID NO: 9515568 - DNA, 22 bp, Homo sapiens
gaataacattttttcctttaca

SEQ ID NO: 9515569 - DNA, 22 bp, Homo sapiens
gaagtttaggttcttatgttta

SEQ ID NO: 9515570 - DNA, 22 bp, Homo sapiens
gaagtttagagtgttgtaattt

SEQ ID NO: 9515571 - DNA, 22 bp, Homo sapiens
gaagtttagagtgttgtaattt

SEQ ID NO: 9515572 - DNA, 22 bp, Homo sapiens
gaagtttattttacacatccat

SEQ ID NO: 9515573 - DNA, 22 bp, Homo sapiens
gaagtttattttacacatccat

SEQ ID NO: 9515574 - DNA, 22 bp, Homo sapiens
gaatacaagccaggcacaaggc

SEQ ID NO: 9515575 - DNA, 23 bp, Homo sapiens
gaatacagagataaatagaacac

SEQ ID NO: 9515576 - DNA, 22 bp, Homo sapiens
gaatacatatcagatgtgtttc

SEQ ID NO: 9515577 - DNA, 22 bp, Homo sapiens
gaatacatatcagatgtgtttc

SEQ ID NO: 9515578 - DNA, 19 bp, Homo sapiens
gaatacagataataagcag

SEQ ID NO: 9515579 - DNA, 22 bp, Homo sapiens
gacagtaagaccttaccagcct

SEQ ID NO: 9515580 - DNA, 22 bp, Homo sapiens
gacagtaactgagagatgtaat

SEQ ID NO: 9515581 - DNA, 22 bp, Homo sapiens
gacagtaactgagagatgtaat

SEQ ID NO: 9515582 - DNA, 22 bp, Homo sapiens
gacagtaactacagttctgtgg

SEQ ID NO: 9515583 - DNA, 22 bp, Homo sapiens
gacagtaagtcagagacttggt

SEQ ID NO: 9515584 - DNA, 22 bp, Homo sapiens
gacagtaaggtggcttcttctt

SEQ ID NO: 9515585 - DNA, 22 bp, Homo sapiens
gacagtaagagtgtctgggttc

SEQ ID NO: 9515586 - DNA, 22 bp, Homo sapiens
gacccagtgactcgtctctgtg

SEQ ID NO: 9515587 - DNA, 22 bp, Homo sapiens
gacccagtcacacttgtgcttt

SEQ ID NO: 9515588 - DNA, 22 bp, Homo sapiens
gacccagtgggggcctgatctg

SEQ ID NO: 9515589 - DNA, 22 bp, Homo sapiens
gacagtcccccagcagcaaacc

SEQ ID NO: 9515590 - DNA, 22 bp, Homo sapiens
gacagtcacttccaggagagga

SEQ ID NO: 9515591 - DNA, 22 bp, Homo sapiens
gaccctggctagggcttaacct

SEQ ID NO: 9515592 - DNA, 22 bp, Homo sapiens
gaccctggcaggtagcctcaca

SEQ ID NO: 9515593 - DNA, 22 bp, Homo sapiens
gaccccaaaccctgtattcttc

SEQ ID NO: 9515594 - DNA, 22 bp, Homo sapiens
gaccctggtgggcactggcacc

SEQ ID NO: 9515595 - DNA, 22 bp, Homo sapiens
gaccctggtgtccaggtcctgc

SEQ ID NO: 9515596 - DNA, 22 bp, Homo sapiens
gaccctgtttctacaaataatt

SEQ ID NO: 9515597 - DNA, 22 bp, Homo sapiens
gaccctgtttctacaaataatt

SEQ ID NO: 9515598 - DNA, 22 bp, Homo sapiens
gaccctgtggctctgtggcaga

SEQ ID NO: 9515599 - DNA, 22 bp, Homo sapiens
gaccctggtgggcactggcacc

SEQ ID NO: 9515600 - DNA, 22 bp, Homo sapiens
gaccctggtgggcactggcacc

SEQ ID NO: 9515601 - DNA, 22 bp, Homo sapiens
gaccctggctggagctggcctg

SEQ ID NO: 9515602 - DNA, 22 bp, Homo sapiens
gaccctggctggagctggcctg

SEQ ID NO: 9515603 - DNA, 22 bp, Homo sapiens
gacccttagaatgtgatcttat

SEQ ID NO: 9515604 - DNA, 22 bp, Homo sapiens
gacccttggctgcagcatcaca

SEQ ID NO: 9515605 - DNA, 22 bp, Homo sapiens
gacctcagattttcccaggcca

SEQ ID NO: 9515606 - DNA, 22 bp, Homo sapiens
gacctatttaagtgtagttcaa

SEQ ID NO: 9515607 - DNA, 22 bp, Homo sapiens
gacctcagattttcccaggcca

SEQ ID NO: 9515608 - DNA, 22 bp, Homo sapiens
gaccctttggaggtagtcacca

SEQ ID NO: 9515609 - DNA, 20 bp, Homo sapiens
gacaggtgctaaagaggggc

SEQ ID NO: 9515610 - DNA, 22 bp, Homo sapiens
gacagtaaatgcagtctagcac

SEQ ID NO: 9515611 - DNA, 18 bp, Homo sapiens
gacagtaaacttccccat

SEQ ID NO: 9515612 - DNA, 23 bp, Homo sapiens
gacaggtaagggttgggagaatc

SEQ ID NO: 9515613 - DNA, 22 bp, Homo sapiens
gacaggtaaagatggtggcagg

SEQ ID NO: 9515614 - DNA, 22 bp, Homo sapiens
gacagggtggctgatagggctc

SEQ ID NO: 9515615 - DNA, 22 bp, Homo sapiens
gacagggttgagtaaactggga

SEQ ID NO: 9515616 - DNA, 22 bp, Homo sapiens
gacaggtaaagatggtggcagg

SEQ ID NO: 9515617 - DNA, 22 bp, Homo sapiens
gacagggtacgggctaggcaca

SEQ ID NO: 9515618 - DNA, 22 bp, Homo sapiens
gacagggtccaaaggcagggga

SEQ ID NO: 9515619 - DNA, 22 bp, Homo sapiens
gacaggcttagggagggtgctc

SEQ ID NO: 9515620 - DNA, 22 bp, Homo sapiens
gacaggcttagggagggtgctc

SEQ ID NO: 9515621 - DNA, 22 bp, Homo sapiens
gacaggctggcaatgccctgct

SEQ ID NO: 9515622 - DNA, 22 bp, Homo sapiens
gacaggcttcctaagtgccaga

SEQ ID NO: 9515623 - DNA, 22 bp, Homo sapiens
gacaggcttccactatgttgcc

SEQ ID NO: 9515624 - DNA, 22 bp, Homo sapiens
gacaggcttcatgatggcagga

SEQ ID NO: 9515625 - DNA, 22 bp, Homo sapiens
gacaggcttcatgatggcagga

SEQ ID NO: 9515626 - DNA, 22 bp, Homo sapiens
gacaggcttccactatgttgcc

SEQ ID NO: 9515627 - DNA, 22 bp, Homo sapiens
gacaggcttcatcctcagagtt

SEQ ID NO: 9515628 - DNA, 22 bp, Homo sapiens
gacaggcttcctaagtgccaga

SEQ ID NO: 9515629 - DNA, 22 bp, Homo sapiens
gacaggcttcctaagtgccaga

SEQ ID NO: 9515630 - DNA, 22 bp, Homo sapiens
gacaggctttctcaggatgagc

SEQ ID NO: 9515631 - DNA, 22 bp, Homo sapiens
gacagggaaacattgaagtgtc

SEQ ID NO: 9515632 - DNA, 22 bp, Homo sapiens
gacagggaaacattgaagtgtc

SEQ ID NO: 9515633 - DNA, 22 bp, Homo sapiens
gacagggaaacattgaagtgtc

SEQ ID NO: 9515634 - DNA, 23 bp, Homo sapiens
gacagggctgacttggcagctgc

SEQ ID NO: 9515635 - DNA, 23 bp, Homo sapiens
gacagggctgacttggcagctgc

SEQ ID NO: 9515636 - DNA, 22 bp, Homo sapiens
gacagggctgtgggaggagcag

SEQ ID NO: 9515637 - DNA, 21 bp, Homo sapiens
gacaggggaagaagcaaggag

SEQ ID NO: 9515638 - DNA, 22 bp, Homo sapiens
gacagggctgtgggaggagcag

SEQ ID NO: 9515639 - DNA, 22 bp, Homo sapiens
gacagggctgtgggaggagcag

SEQ ID NO: 9515640 - DNA, 22 bp, Homo sapiens
gacaggggtccctctgggctgt

SEQ ID NO: 9515641 - DNA, 21 bp, Homo sapiens
gacaggggccatgggtttcta

SEQ ID NO: 9515642 - DNA, 21 bp, Homo sapiens
gacaggggaagaagcaaggag

SEQ ID NO: 9515643 - DNA, 17 bp, Homo sapiens
gacaggctcagtgacga

SEQ ID NO: 9515644 - DNA, 22 bp, Homo sapiens
gacaggctaggttgctgtcctc

SEQ ID NO: 9515645 - DNA, 22 bp, Homo sapiens
gacaggccccctcaggactgat

SEQ ID NO: 9515646 - DNA, 22 bp, Homo sapiens
gacaggcccgagtagctgatga

SEQ ID NO: 9515647 - DNA, 22 bp, Homo sapiens
gacaggccaggggctgaggtgg

SEQ ID NO: 9515648 - DNA, 22 bp, Homo sapiens
gacaggccccctcaggactgat

SEQ ID NO: 9515649 - DNA, 22 bp, Homo sapiens
gacaggccccctcaggactgat

SEQ ID NO: 9515650 - DNA, 22 bp, Homo sapiens
gacaggccaggggctgaggtgg

SEQ ID NO: 9515651 - DNA, 22 bp, Homo sapiens
gacacagaccaccaggccctgg

SEQ ID NO: 9515652 - DNA, 22 bp, Homo sapiens
gacacagagataggcctgtgtt

SEQ ID NO: 9515653 - DNA, 22 bp, Homo sapiens
gacacagagacttgcagttgta

SEQ ID NO: 9515654 - DNA, 22 bp, Homo sapiens
gacacagacagttagaggtaat

SEQ ID NO: 9515655 - DNA, 22 bp, Homo sapiens
gacacagacagttagaggtaat

SEQ ID NO: 9515656 - DNA, 22 bp, Homo sapiens
gacacagaatttactcccgata

SEQ ID NO: 9515657 - DNA, 22 bp, Homo sapiens
gacaaggcgcccagcctgccaa

SEQ ID NO: 9515658 - DNA, 22 bp, Homo sapiens
gacaaggcgcccagcctgccaa

SEQ ID NO: 9515659 - DNA, 22 bp, Homo sapiens
gacaaggcgcccagcctgccaa

SEQ ID NO: 9515660 - DNA, 22 bp, Homo sapiens
gacaaggcagaaagcttaaagg

SEQ ID NO: 9515661 - DNA, 22 bp, Homo sapiens
gacaaggcaaccagggaggctt

SEQ ID NO: 9515662 - DNA, 22 bp, Homo sapiens
gacaagggttctgcagagcctg

SEQ ID NO: 9515663 - DNA, 22 bp, Homo sapiens
gacaagtgggctgcagcttttg

SEQ ID NO: 9515664 - DNA, 22 bp, Homo sapiens
gacaataaaatgatcttacagt

SEQ ID NO: 9515665 - DNA, 22 bp, Homo sapiens
gacacagaatgggtgctcagta

SEQ ID NO: 9515666 - DNA, 22 bp, Homo sapiens
gacacagaaggtcacatgttca

SEQ ID NO: 9515667 - DNA, 22 bp, Homo sapiens
gacacagaatgggtgctcagta

SEQ ID NO: 9515668 - DNA, 22 bp, Homo sapiens
gacacagaatgggtgctcagta

SEQ ID NO: 9515669 - DNA, 22 bp, Homo sapiens
gacacagaattcccctccaagt

SEQ ID NO: 9515670 - DNA, 22 bp, Homo sapiens
gaaatatttctcttgagcccct

SEQ ID NO: 9515671 - DNA, 22 bp, Homo sapiens
gaaatatttctcttgagcccct

SEQ ID NO: 9515672 - DNA, 22 bp, Homo sapiens
ctttccaactgggtgggcagct

SEQ ID NO: 9515673 - DNA, 22 bp, Homo sapiens
ctttccaactgggtgggcagct

SEQ ID NO: 9515674 - DNA, 22 bp, Homo sapiens
gaaatatttctcttgagcccct

SEQ ID NO: 9515675 - DNA, 22 bp, Homo sapiens
gaaatatttctcttgagcccct

SEQ ID NO: 9515676 - DNA, 22 bp, Homo sapiens
gaaatatttctcttgagcccct

SEQ ID NO: 9515677 - DNA, 22 bp, Homo sapiens
gaaatcacttttttcatagttg

SEQ ID NO: 9515678 - DNA, 22 bp, Homo sapiens
gaaatcagttctgaaatttaca

SEQ ID NO: 9515679 - DNA, 22 bp, Homo sapiens
gaaatcaaggctacattcaggt

SEQ ID NO: 9515680 - DNA, 22 bp, Homo sapiens
gaaatcaaggctacattcaggt

SEQ ID NO: 9515681 - DNA, 22 bp, Homo sapiens
gaaatcaaggctacattcaggt

SEQ ID NO: 9515682 - DNA, 22 bp, Homo sapiens
gaaatcaatttcttggttgata

SEQ ID NO: 9515683 - DNA, 22 bp, Homo sapiens
ctttcattcttagatattagtg

SEQ ID NO: 9515684 - DNA, 22 bp, Homo sapiens
ctttcataattcagcacattga

SEQ ID NO: 9515685 - DNA, 22 bp, Homo sapiens
ctttcatagttaaaatagtttg

SEQ ID NO: 9515686 - DNA, 22 bp, Homo sapiens
ctttcatgaacagacaaggaac

SEQ ID NO: 9515687 - DNA, 23 bp, Homo sapiens
ctttcattgtggtttcacagagc

SEQ ID NO: 9515688 - DNA, 23 bp, Homo sapiens
ctttcattgtggtttcacagagc

SEQ ID NO: 9515689 - DNA, 22 bp, Homo sapiens
ctttcataaaggaaatgatgag

SEQ ID NO: 9515690 - DNA, 22 bp, Homo sapiens
ctttcagatagtctgagatata

SEQ ID NO: 9515691 - DNA, 22 bp, Homo sapiens
ctttcagatagtctgagatata

SEQ ID NO: 9515692 - DNA, 22 bp, Homo sapiens
ctttcagaagtatattctggaa

SEQ ID NO: 9515693 - DNA, 18 bp, Homo sapiens
ctttcagatggatatgct

SEQ ID NO: 9515694 - DNA, 22 bp, Homo sapiens
ctttcagggcaacacttctttt

SEQ ID NO: 9515695 - DNA, 22 bp, Homo sapiens
ctttcacagctgtgcttatgat

SEQ ID NO: 9515696 - DNA, 22 bp, Homo sapiens
ctttcacagccttcgttctgaa

SEQ ID NO: 9515697 - DNA, 22 bp, Homo sapiens
ctttcacacacatacatttgga

SEQ ID NO: 9515698 - DNA, 22 bp, Homo sapiens
ctttatgtgctgggcattaagg

SEQ ID NO: 9515699 - DNA, 22 bp, Homo sapiens
gaacatttggatttgtaaattt

SEQ ID NO: 9515700 - DNA, 22 bp, Homo sapiens
gaacatttggcatgagaatttg

SEQ ID NO: 9515701 - DNA, 22 bp, Homo sapiens
gaacatttggatttgtaaattt

SEQ ID NO: 9515702 - DNA, 22 bp, Homo sapiens
gaacagtatttccaggaatccc

SEQ ID NO: 9515703 - DNA, 22 bp, Homo sapiens
gaacagtatttccaggaatccc

SEQ ID NO: 9515704 - DNA, 22 bp, Homo sapiens
gaacagtatcagtagtgccagt

SEQ ID NO: 9515705 - DNA, 22 bp, Homo sapiens
gaacagtaaatttatgcagcac

SEQ ID NO: 9515706 - DNA, 22 bp, Homo sapiens
gaacagtaactgtctgctgtgt

SEQ ID NO: 9515707 - DNA, 22 bp, Homo sapiens
gaacagtactaagagctttaca

SEQ ID NO: 9515708 - DNA, 22 bp, Homo sapiens
gaacagtagatgagatgctaga

SEQ ID NO: 9515709 - DNA, 22 bp, Homo sapiens
gaacagctctgaagcagtaaat

SEQ ID NO: 9515710 - DNA, 22 bp, Homo sapiens
gaacagctataatcatctgtcc

SEQ ID NO: 9515711 - DNA, 22 bp, Homo sapiens
gaacagctgctagagatctgtg

SEQ ID NO: 9515712 - DNA, 22 bp, Homo sapiens
gaacagcatgcatgcaagacta

SEQ ID NO: 9515713 - DNA, 22 bp, Homo sapiens
gaacagggtttgagaggcttag

SEQ ID NO: 9515714 - DNA, 22 bp, Homo sapiens
gaacagggtttgagaggcttag

SEQ ID NO: 9515715 - DNA, 22 bp, Homo sapiens
gaacagggttgggtgagagagg

SEQ ID NO: 9515716 - DNA, 22 bp, Homo sapiens
gaacagggttgggtgagagagg

SEQ ID NO: 9515717 - DNA, 22 bp, Homo sapiens
gaacagggagtacggcacattt

SEQ ID NO: 9515718 - DNA, 22 bp, Homo sapiens
gaacagcttcttgggagctggg

SEQ ID NO: 9515719 - DNA, 22 bp, Homo sapiens
gaacagcttcttgggagctggg

SEQ ID NO: 9515720 - DNA, 22 bp, Homo sapiens
gaaatgtactttaaagccatcc

SEQ ID NO: 9515721 - DNA, 20 bp, Homo sapiens
gaaatgtacacattaccaca

SEQ ID NO: 9515722 - DNA, 22 bp, Homo sapiens
gaaatgtaattctcttgaagat

SEQ ID NO: 9515723 - DNA, 22 bp, Homo sapiens
gaaatgtaattctcttgaagat

SEQ ID NO: 9515724 - DNA, 20 bp, Homo sapiens
gaaatgtacacattaccaca

SEQ ID NO: 9515725 - DNA, 20 bp, Homo sapiens
gaaatgtacacattaccaca

SEQ ID NO: 9515726 - DNA, 22 bp, Homo sapiens
gaaatgtactttaaagccatcc

SEQ ID NO: 9515727 - DNA, 17 bp, Homo sapiens
gaacagcagaggggaca

SEQ ID NO: 9515728 - DNA, 22 bp, Homo sapiens
gaacagcagctcgttctcgatg

SEQ ID NO: 9515729 - DNA, 22 bp, Homo sapiens
gaaatgtaattctcttgaagat

SEQ ID NO: 9515730 - DNA, 22 bp, Homo sapiens
gaaatgcatggatcttggcaga

SEQ ID NO: 9515731 - DNA, 22 bp, Homo sapiens
gaaatgcatggatcttggcaga

SEQ ID NO: 9515732 - DNA, 22 bp, Homo sapiens
gaaatgcatggatcttggcaga

SEQ ID NO: 9515733 - DNA, 22 bp, Homo sapiens
gaaatgcataatcttagtagat

SEQ ID NO: 9515734 - DNA, 22 bp, Homo sapiens
gaaatgcataatcttagtagat

SEQ ID NO: 9515735 - DNA, 22 bp, Homo sapiens
gaaatcattagcaaagatatgt

SEQ ID NO: 9515736 - DNA, 22 bp, Homo sapiens
gaaatcattagcaaagatatgt

SEQ ID NO: 9515737 - DNA, 22 bp, Homo sapiens
gaaatcatctgagtaataatct

SEQ ID NO: 9515738 - DNA, 22 bp, Homo sapiens
gaaatcatctgagtaataatct

SEQ ID NO: 9515739 - DNA, 22 bp, Homo sapiens
gaaatctacgattagtgaaaat

SEQ ID NO: 9515740 - DNA, 22 bp, Homo sapiens
gaaatccagttccctactctta

SEQ ID NO: 9515741 - DNA, 22 bp, Homo sapiens
gaaatgattttagtttatcatg

SEQ ID NO: 9515742 - DNA, 22 bp, Homo sapiens
gaaatgattttagtttatcatg

SEQ ID NO: 9515743 - DNA, 22 bp, Homo sapiens
gaaatgcaggcttggattcagc

SEQ ID NO: 9515744 - DNA, 22 bp, Homo sapiens
gaaatgcagattctgattctgt

SEQ ID NO: 9515745 - DNA, 22 bp, Homo sapiens
gaaatgcagaacctgagaccat

SEQ ID NO: 9515746 - DNA, 22 bp, Homo sapiens
gaaatgcagattctgattctgt

SEQ ID NO: 9515747 - DNA, 22 bp, Homo sapiens
gaagaggatgacaggagccggt

SEQ ID NO: 9515748 - DNA, 22 bp, Homo sapiens
gaagaggcaattgaataagcta

SEQ ID NO: 9515749 - DNA, 22 bp, Homo sapiens
gaagagctgtcagaaaagctaa

SEQ ID NO: 9515750 - DNA, 22 bp, Homo sapiens
gaagagctggaatccagtctgg

SEQ ID NO: 9515751 - DNA, 22 bp, Homo sapiens
gaagagctccaaaaacagtgag

SEQ ID NO: 9515752 - DNA, 22 bp, Homo sapiens
gaagagctgacagtgtcatcct

SEQ ID NO: 9515753 - DNA, 22 bp, Homo sapiens
gaagagctatgtccagggagca

SEQ ID NO: 9515754 - DNA, 22 bp, Homo sapiens
gaagagctaaaggcacaggctt

SEQ ID NO: 9515755 - DNA, 22 bp, Homo sapiens
gaagagctgcacactggggact

SEQ ID NO: 9515756 - DNA, 22 bp, Homo sapiens
gaagagctgacagtgtcatcct

SEQ ID NO: 9515757 - DNA, 22 bp, Homo sapiens
gaagagctgcagtttcctgggc

SEQ ID NO: 9515758 - DNA, 22 bp, Homo sapiens
gaagagctgcacactggggact

SEQ ID NO: 9515759 - DNA, 22 bp, Homo sapiens
gaagagctgctcagaacatgat

SEQ ID NO: 9515760 - DNA, 22 bp, Homo sapiens
gaagagaagcatcaataggtaa

SEQ ID NO: 9515761 - DNA, 22 bp, Homo sapiens
gaagagaaggtgtaggccatcc

SEQ ID NO: 9515762 - DNA, 22 bp, Homo sapiens
gaagagaagcatcaataggtaa

SEQ ID NO: 9515763 - DNA, 22 bp, Homo sapiens
gaagagaaggtgtaggccatcc

SEQ ID NO: 9515764 - DNA, 22 bp, Homo sapiens
gaagagaagcatcaataggtaa

SEQ ID NO: 9515765 - DNA, 22 bp, Homo sapiens
gaagagaagcatcaataggtaa

SEQ ID NO: 9515766 - DNA, 22 bp, Homo sapiens
gaagactctaagagaaatatga

SEQ ID NO: 9515767 - DNA, 22 bp, Homo sapiens
gaagagaaaggcaaggagtttt

SEQ ID NO: 9515768 - DNA, 22 bp, Homo sapiens
gaagagaaaggcaaggagtttt

SEQ ID NO: 9515769 - DNA, 22 bp, Homo sapiens
gaagacattaagtctatgtcac

SEQ ID NO: 9515770 - DNA, 22 bp, Homo sapiens
gaagacagaaacctgtttggct

SEQ ID NO: 9515771 - DNA, 22 bp, Homo sapiens
gaagacatgtggattctagttt

SEQ ID NO: 9515772 - DNA, 22 bp, Homo sapiens
gaagacactctgcagagttatc

SEQ ID NO: 9515773 - DNA, 22 bp, Homo sapiens
gaaccacaagattcaaaggggt

SEQ ID NO: 9515774 - DNA, 22 bp, Homo sapiens
gaaccacaatgtgaagaaggag

SEQ ID NO: 9515775 - DNA, 21 bp, Homo sapiens
gaacatttgggttgtttctac

SEQ ID NO: 9515776 - DNA, 21 bp, Homo sapiens
gaacatttgggttgtttctac

SEQ ID NO: 9515777 - DNA, 21 bp, Homo sapiens
gaacatttgggttgtttctac

SEQ ID NO: 9515778 - DNA, 20 bp, Homo sapiens
gaacatttggccatactgag

SEQ ID NO: 9515779 - DNA, 22 bp, Homo sapiens
gaacatttggcatgagaatttg

SEQ ID NO: 9515780 - DNA, 21 bp, Homo sapiens
gaacatttgggttgtttctac

SEQ ID NO: 9515781 - DNA, 22 bp, Homo sapiens
gaagacaattctgggtggagga

SEQ ID NO: 9515782 - DNA, 22 bp, Homo sapiens
gaaccagcagactttgacaggt

SEQ ID NO: 9515783 - DNA, 22 bp, Homo sapiens
gaaccatttctgaatagtttgt

SEQ ID NO: 9515784 - DNA, 22 bp, Homo sapiens
gaaccagcagttgcctgaaaaa

SEQ ID NO: 9515785 - DNA, 22 bp, Homo sapiens
gaaccagcagccctgcagaagt

SEQ ID NO: 9515786 - DNA, 21 bp, Homo sapiens
gaacccagcagcagtgctctg

SEQ ID NO: 9515787 - DNA, 21 bp, Homo sapiens
gaacccagcagcagtgctctg

SEQ ID NO: 9515788 - DNA, 22 bp, Homo sapiens
gaagcccatttgtacagcacat

SEQ ID NO: 9515789 - DNA, 22 bp, Homo sapiens
gaagccagtactgtgctctgca

SEQ ID NO: 9515790 - DNA, 22 bp, Homo sapiens
gaagccagtactgtgctctgca

SEQ ID NO: 9515791 - DNA, 22 bp, Homo sapiens
gaagccagtgtttgaagaattt

SEQ ID NO: 9515792 - DNA, 22 bp, Homo sapiens
gaagccagtgtttgaagaattt

SEQ ID NO: 9515793 - DNA, 22 bp, Homo sapiens
gaagccagtgtttgaagaattt

SEQ ID NO: 9515794 - DNA, 22 bp, Homo sapiens
gaagcccagcaaactgtgatca

SEQ ID NO: 9515795 - DNA, 22 bp, Homo sapiens
gaagccagcagtggagaaagga

SEQ ID NO: 9515796 - DNA, 22 bp, Homo sapiens
gaagccagcagtggagaaagga

SEQ ID NO: 9515797 - DNA, 22 bp, Homo sapiens
gaagccagattatcacaagcca

SEQ ID NO: 9515798 - DNA, 22 bp, Homo sapiens
gaagcaaaatgtctgcacatat

SEQ ID NO: 9515799 - DNA, 22 bp, Homo sapiens
gaagccagatttggggcatatc

SEQ ID NO: 9515800 - DNA, 22 bp, Homo sapiens
gaagccagccttgtctgcctct

SEQ ID NO: 9515801 - DNA, 22 bp, Homo sapiens
gaagccagccttgtctgcctct

SEQ ID NO: 9515802 - DNA, 22 bp, Homo sapiens
gaagccaggggcctgacaggca

SEQ ID NO: 9515803 - DNA, 22 bp, Homo sapiens
gaagatttttcttaatgctccg

SEQ ID NO: 9515804 - DNA, 22 bp, Homo sapiens
gaagattttctcctttaaatga

SEQ ID NO: 9515805 - DNA, 22 bp, Homo sapiens
gaagattttctcctttaaatga

SEQ ID NO: 9515806 - DNA, 22 bp, Homo sapiens
gaagatttggattccatgtcac

SEQ ID NO: 9515807 - DNA, 22 bp, Homo sapiens
gaagatttgttgtaatttttag

SEQ ID NO: 9515808 - DNA, 22 bp, Homo sapiens
gaagatttgcccatgcactttt

SEQ ID NO: 9515809 - DNA, 22 bp, Homo sapiens
gaagatttgaaacacatagaca

SEQ ID NO: 9515810 - DNA, 22 bp, Homo sapiens
gaagatttgcccatgcactttt

SEQ ID NO: 9515811 - DNA, 22 bp, Homo sapiens
gaagatttgaaacacatagaca

SEQ ID NO: 9515812 - DNA, 22 bp, Homo sapiens
gaagatttgaaacacatagaca

SEQ ID NO: 9515813 - DNA, 22 bp, Homo sapiens
gaagaggtagcattggcaggtg

SEQ ID NO: 9515814 - DNA, 22 bp, Homo sapiens
gaagaggctttcctagggcaag

SEQ ID NO: 9515815 - DNA, 22 bp, Homo sapiens
gaagaggctttcctagggcaag

SEQ ID NO: 9515816 - DNA, 22 bp, Homo sapiens
gaagaggctttcctagggcaag

SEQ ID NO: 9515817 - DNA, 22 bp, Homo sapiens
gaagaggctttcctagggcaag

SEQ ID NO: 9515818 - DNA, 22 bp, Homo sapiens
gaagaggttcaacgtggtcatc

SEQ ID NO: 9515819 - DNA, 22 bp, Homo sapiens
gaagataactttaaaaagtggc

SEQ ID NO: 9515820 - DNA, 22 bp, Homo sapiens
gaagatattctctaaatacttt

SEQ ID NO: 9515821 - DNA, 22 bp, Homo sapiens
gaagataattcctacttataac

SEQ ID NO: 9515822 - DNA, 22 bp, Homo sapiens
gaagatgggaatgatgagtggg

SEQ ID NO: 9515823 - DNA, 22 bp, Homo sapiens
gaagatgggaatgatgagtggg

SEQ ID NO: 9515824 - DNA, 20 bp, Homo sapiens
gaagatgggtagaggcacag

SEQ ID NO: 9515825 - DNA, 20 bp, Homo sapiens
gaagatgggtagaggcacag

SEQ ID NO: 9515826 - DNA, 22 bp, Homo sapiens
gaagatgggaatgatgagtggg

SEQ ID NO: 9515827 - DNA, 22 bp, Homo sapiens
gaagatttaagcacaatagtct

SEQ ID NO: 9515828 - DNA, 22 bp, Homo sapiens
gaagatttaagcacaatagtct

SEQ ID NO: 9515829 - DNA, 22 bp, Homo sapiens
gaagatttataaggaccttatt

SEQ ID NO: 9515830 - DNA, 22 bp, Homo sapiens
gaagatttataggagcctatta

SEQ ID NO: 9515831 - DNA, 22 bp, Homo sapiens
gaagatttataaggaccttatt

SEQ ID NO: 9515832 - DNA, 22 bp, Homo sapiens
gaagatttctgatgagttactt

SEQ ID NO: 9515833 - DNA, 22 bp, Homo sapiens
gaagatttcagttaagtatcta

SEQ ID NO: 9515834 - DNA, 22 bp, Homo sapiens
gaagatttcagttaagtatcta

SEQ ID NO: 9515835 - DNA, 22 bp, Homo sapiens
gaagatttctttatgaaagatg

SEQ ID NO: 9515836 - DNA, 22 bp, Homo sapiens
gaagatttctttatgaaagatg

SEQ ID NO: 9515837 - DNA, 22 bp, Homo sapiens
gaagatgtgggaactgctgaaa

SEQ ID NO: 9515838 - DNA, 20 bp, Homo sapiens
gaagatgggtagaggcacag

SEQ ID NO: 9515839 - DNA, 22 bp, Homo sapiens
gaagatgttatggagagctcag

SEQ ID NO: 9515840 - DNA, 22 bp, Homo sapiens
gaagattaaacatatttagtgt

SEQ ID NO: 9515841 - DNA, 22 bp, Homo sapiens
gaagatgttatggagagctcag

SEQ ID NO: 9515842 - DNA, 22 bp, Homo sapiens
ggtctctgttgcctccatcaag

SEQ ID NO: 9515843 - DNA, 22 bp, Homo sapiens
ggtctctttgcttcagctacag

SEQ ID NO: 9515844 - DNA, 22 bp, Homo sapiens
ggtctcttcaggagcttgagcg

SEQ ID NO: 9515845 - DNA, 22 bp, Homo sapiens
ggtctctgttgcctccatcaag

SEQ ID NO: 9515846 - DNA, 22 bp, Homo sapiens
ggtctggataattccagtacct

SEQ ID NO: 9515847 - DNA, 22 bp, Homo sapiens
ggtctggcactcatgcagcagg

SEQ ID NO: 9515848 - DNA, 22 bp, Homo sapiens
ggtctggcactcatgcagcagg

SEQ ID NO: 9515849 - DNA, 22 bp, Homo sapiens
ggtctggcaggtgaggactcag

SEQ ID NO: 9515850 - DNA, 22 bp, Homo sapiens
ggtctggcaggtgaggactcag

SEQ ID NO: 9515851 - DNA, 22 bp, Homo sapiens
ggtctggccaatagacagcccc

SEQ ID NO: 9515852 - DNA, 22 bp, Homo sapiens
ggtctggccaatagacagcccc

SEQ ID NO: 9515853 - DNA, 22 bp, Homo sapiens
ggtctggcctccgggcaggtgg

SEQ ID NO: 9515854 - DNA, 22 bp, Homo sapiens
ggtctggcctccgggcaggtgg

SEQ ID NO: 9515855 - DNA, 21 bp, Homo sapiens
ggtggccttggtgagagacct

SEQ ID NO: 9515856 - DNA, 17 bp, Homo sapiens
ggtggcctgcagtggct

SEQ ID NO: 9515857 - DNA, 22 bp, Homo sapiens
ggtggcctcggtggtgcacagg

SEQ ID NO: 9515858 - DNA, 19 bp, Homo sapiens
ggtggctcagggcccagcc

SEQ ID NO: 9515859 - DNA, 22 bp, Homo sapiens
ggtggctcagggctccaagcat

SEQ ID NO: 9515860 - DNA, 22 bp, Homo sapiens
ggtggctcagtgtcaggccctg

SEQ ID NO: 9515861 - DNA, 18 bp, Homo sapiens
ggtggcggggatggaggt

SEQ ID NO: 9515862 - DNA, 22 bp, Homo sapiens
ggtgttaacttgtttatgacaa

SEQ ID NO: 9515863 - DNA, 22 bp, Homo sapiens
ggtgttgcagttgaagactggt

SEQ ID NO: 9515864 - DNA, 22 bp, Homo sapiens
ggtgttcttagtggcactggca

SEQ ID NO: 9515865 - DNA, 22 bp, Homo sapiens
ggtgttggaacatggtgagatt

SEQ ID NO: 9515866 - DNA, 22 bp, Homo sapiens
ggtgttgcagttgaagactggt

SEQ ID NO: 9515867 - DNA, 22 bp, Homo sapiens
ggtgtttaaaggctcagcagga

SEQ ID NO: 9515868 - DNA, 19 bp, Homo sapiens
ggtttatctgtttcttctc

SEQ ID NO: 9515869 - DNA, 22 bp, Homo sapiens
ggtttatcaatacatattgcta

SEQ ID NO: 9515870 - DNA, 22 bp, Homo sapiens
ggtttattaatgtgaactgtat

SEQ ID NO: 9515871 - DNA, 22 bp, Homo sapiens
ggtttattgttaataagtttga

SEQ ID NO: 9515872 - DNA, 22 bp, Homo sapiens
ggtttattgttaataagtttga

SEQ ID NO: 9515873 - DNA, 22 bp, Homo sapiens
ggtttattgaaggccaccccac

SEQ ID NO: 9515874 - DNA, 22 bp, Homo sapiens
ggtgtgtggttttgatacagtc

SEQ ID NO: 9515875 - DNA, 22 bp, Homo sapiens
ggtgtgtgtggattagcatgcc

SEQ ID NO: 9515876 - DNA, 22 bp, Homo sapiens
ggtgtgtgtggattagcatgcc

SEQ ID NO: 9515877 - DNA, 20 bp, Homo sapiens
ggtgtgttggttcagcatgg

SEQ ID NO: 9515878 - DNA, 22 bp, Homo sapiens
ggtgtgtgtggattagcatgcc

SEQ ID NO: 9515879 - DNA, 22 bp, Homo sapiens
ggtgtgtgtggattagcatgcc

SEQ ID NO: 9515880 - DNA, 22 bp, Homo sapiens
ggtgtgtggtcctctcacttag

SEQ ID NO: 9515881 - DNA, 22 bp, Homo sapiens
ggtgtgtggtcctctcacttag

SEQ ID NO: 9515882 - DNA, 22 bp, Homo sapiens
ggtgtgtggttttgatacagtc

SEQ ID NO: 9515883 - DNA, 22 bp, Homo sapiens
ggtgtgtggttttgatacagtc

SEQ ID NO: 9515884 - DNA, 19 bp, Homo sapiens
ggtgtgtgctggggcctgt

SEQ ID NO: 9515885 - DNA, 19 bp, Homo sapiens
ggtgtgtgctggggcctgt

SEQ ID NO: 9515886 - DNA, 19 bp, Homo sapiens
ggtgtgtgctggggcctgt

SEQ ID NO: 9515887 - DNA, 19 bp, Homo sapiens
ggtgtgtgctggggcctgt

SEQ ID NO: 9515888 - DNA, 19 bp, Homo sapiens
ggtgtgtgctggggcctgt

SEQ ID NO: 9515889 - DNA, 22 bp, Homo sapiens
ggtgtgtgaggagtcacttagt

SEQ ID NO: 9515890 - DNA, 22 bp, Homo sapiens
ggtgtgtgaggagtcacttagt

SEQ ID NO: 9515891 - DNA, 22 bp, Homo sapiens
ggtgtgtgaggagtcacttagt

SEQ ID NO: 9515892 - DNA, 22 bp, Homo sapiens
ggtgtgtgaggagtcacttagt

SEQ ID NO: 9515893 - DNA, 22 bp, Homo sapiens
ggtgtgtctgccaggaactgca

SEQ ID NO: 9515894 - DNA, 22 bp, Homo sapiens
ggtgtggtttgaagggagatgg

SEQ ID NO: 9515895 - DNA, 22 bp, Homo sapiens
ggtggctcggccagtgcaggcc

SEQ ID NO: 9515896 - DNA, 19 bp, Homo sapiens
ggtggctctccctcaggga

SEQ ID NO: 9515897 - DNA, 22 bp, Homo sapiens
ggtggctctcaggcttctcgga

SEQ ID NO: 9515898 - DNA, 19 bp, Homo sapiens
ggtggctctccctcaggga

SEQ ID NO: 9515899 - DNA, 22 bp, Homo sapiens
ggtggctctctgtcagtgacag

SEQ ID NO: 9515900 - DNA, 22 bp, Homo sapiens
ggtgtccttcgtccgctggcat

SEQ ID NO: 9515901 - DNA, 22 bp, Homo sapiens
ggtgtgggaactacaggttttt

SEQ ID NO: 9515902 - DNA, 22 bp, Homo sapiens
ggtgtggatcatctgaggtcag

SEQ ID NO: 9515903 - DNA, 22 bp, Homo sapiens
ggtgtgggcagatgccctactt

SEQ ID NO: 9515904 - DNA, 21 bp, Homo sapiens
ggtgtgggatggactgaacca

SEQ ID NO: 9515905 - DNA, 22 bp, Homo sapiens
ggtgtgggagagattctttcct

SEQ ID NO: 9515906 - DNA, 22 bp, Homo sapiens
ggtgtgggccctgatgtcagca

SEQ ID NO: 9515907 - DNA, 22 bp, Homo sapiens
ggtgtgggcagatgccctactt

SEQ ID NO: 9515908 - DNA, 22 bp, Homo sapiens
ggtgtgggccctgatgtcagca

SEQ ID NO: 9515909 - DNA, 22 bp, Homo sapiens
ggtgtgggccctgatgtcagca

SEQ ID NO: 9515910 - DNA, 22 bp, Homo sapiens
ggtgtggggaggttctgcttct

SEQ ID NO: 9515911 - DNA, 22 bp, Homo sapiens
ggtgtggggaggttctgcttct

SEQ ID NO: 9515912 - DNA, 22 bp, Homo sapiens
ggtgtgggggcaagtttgagat

SEQ ID NO: 9515913 - DNA, 22 bp, Homo sapiens
ggtgtgggtccttgtgcttgct

SEQ ID NO: 9515914 - DNA, 22 bp, Homo sapiens
ggtgtggtttgaagggagatgg

SEQ ID NO: 9515915 - DNA, 22 bp, Homo sapiens
ggtgtgggggcagctctgatat

SEQ ID NO: 9515916 - DNA, 22 bp, Homo sapiens
ggtgtgggtccttgtgcttgct

SEQ ID NO: 9515917 - DNA, 22 bp, Homo sapiens
ggtctccagctgggaccctgca

SEQ ID NO: 9515918 - DNA, 22 bp, Homo sapiens
ggtctccattccttcatctcac

SEQ ID NO: 9515919 - DNA, 22 bp, Homo sapiens
ggtctccattccttcatctcac

SEQ ID NO: 9515920 - DNA, 22 bp, Homo sapiens
ggtctcctgaggctgccacacc

SEQ ID NO: 9515921 - DNA, 22 bp, Homo sapiens
ggtctcctgaggctgccacacc

SEQ ID NO: 9515922 - DNA, 22 bp, Homo sapiens
ggtctctgaacttccactgcgc

SEQ ID NO: 9515923 - DNA, 22 bp, Homo sapiens
ggtctctgaacttccactgcgc

SEQ ID NO: 9515924 - DNA, 22 bp, Homo sapiens
ggtctctgctcagatgccactt

SEQ ID NO: 9515925 - DNA, 22 bp, Homo sapiens
ggtctctgctcagatgccactt

SEQ ID NO: 9515926 - DNA, 22 bp, Homo sapiens
ggtctctggccttggagattga

SEQ ID NO: 9515927 - DNA, 22 bp, Homo sapiens
ggtctctgtcactgagtggccc

SEQ ID NO: 9515928 - DNA, 22 bp, Homo sapiens
ggtctctgcagctcccggcccc

SEQ ID NO: 9515929 - DNA, 22 bp, Homo sapiens
ggtctctgacttagagatggat

SEQ ID NO: 9515930 - DNA, 22 bp, Homo sapiens
ggtctcagctggagtccttggt

SEQ ID NO: 9515931 - DNA, 22 bp, Homo sapiens
ggtctcaggtagggcctaggaa

SEQ ID NO: 9515932 - DNA, 22 bp, Homo sapiens
ggtctccaaagctgcattgatg

SEQ ID NO: 9515933 - DNA, 22 bp, Homo sapiens
ggtctcatctttcagcgtcgag

SEQ ID NO: 9515934 - DNA, 22 bp, Homo sapiens
ggtctcatgtcctatgtgctta

SEQ ID NO: 9515935 - DNA, 19 bp, Homo sapiens
ggtctcagtgcagctgcag

SEQ ID NO: 9515936 - DNA, 22 bp, Homo sapiens
ggtctccaaagcttaggactac

SEQ ID NO: 9515937 - DNA, 22 bp, Homo sapiens
ggtctccaaagcttaggactac

SEQ ID NO: 9515938 - DNA, 22 bp, Homo sapiens
ggtccttggcgaatcattccag

SEQ ID NO: 9515939 - DNA, 22 bp, Homo sapiens
ggtccttgcttcggtccagtac

SEQ ID NO: 9515940 - DNA, 22 bp, Homo sapiens
ggtccttgcttcggtccagtac

SEQ ID NO: 9515941 - DNA, 18 bp, Homo sapiens
ggtcctgggcctggctca

SEQ ID NO: 9515942 - DNA, 22 bp, Homo sapiens
ggtcctgtctgacatcactgct

SEQ ID NO: 9515943 - DNA, 22 bp, Homo sapiens
ggtccctggttccctctgagct

SEQ ID NO: 9515944 - DNA, 18 bp, Homo sapiens
ggtcctgggcctggctca

SEQ ID NO: 9515945 - DNA, 22 bp, Homo sapiens
ggtccctgggtcttcttacgtc

SEQ ID NO: 9515946 - DNA, 22 bp, Homo sapiens
ggtccctggggaactaggctgt

SEQ ID NO: 9515947 - DNA, 22 bp, Homo sapiens
ggtccctggggaactaggctgt

SEQ ID NO: 9515948 - DNA, 22 bp, Homo sapiens
ggtccctggggaactaggctgt

SEQ ID NO: 9515949 - DNA, 22 bp, Homo sapiens
ggtcagcagtgcagggcagagc

SEQ ID NO: 9515950 - DNA, 19 bp, Homo sapiens
ggtcagcagtttagggtct

SEQ ID NO: 9515951 - DNA, 22 bp, Homo sapiens
ggtcagcagtgcagggcagagc

SEQ ID NO: 9515952 - DNA, 22 bp, Homo sapiens
ggtcagcagtgcagggcagagc

SEQ ID NO: 9515953 - DNA, 22 bp, Homo sapiens
ggtcagcaggtccagccagtgc

SEQ ID NO: 9515954 - DNA, 22 bp, Homo sapiens
ggtcagcaggtccagccagtgc

SEQ ID NO: 9515955 - DNA, 22 bp, Homo sapiens
ggtccttgggtctcctgtgttt

SEQ ID NO: 9515956 - DNA, 22 bp, Homo sapiens
ggtccttgggtctcctgtgttt

SEQ ID NO: 9515957 - DNA, 22 bp, Homo sapiens
ggtccttgggtctcctgtgttt

SEQ ID NO: 9515958 - DNA, 20 bp, Homo sapiens
ggtccttgtcacaaggagag

SEQ ID NO: 9515959 - DNA, 22 bp, Homo sapiens
ggtcgagtcacttgttgccttt

SEQ ID NO: 9515960 - DNA, 22 bp, Homo sapiens
ggtcctttgccatctctccacc

SEQ ID NO: 9515961 - DNA, 22 bp, Homo sapiens
ggtccttgtgtctctatggccc

SEQ ID NO: 9515962 - DNA, 20 bp, Homo sapiens
ggtccttgtcacaaggagag

SEQ ID NO: 9515963 - DNA, 22 bp, Homo sapiens
ggtcctttgaaaggggtgtgtc

SEQ ID NO: 9515964 - DNA, 22 bp, Homo sapiens
ggtcgctgtgtaggttcagcta

SEQ ID NO: 9515965 - DNA, 22 bp, Homo sapiens
ggtcgctgtgtaggttcagcta

SEQ ID NO: 9515966 - DNA, 22 bp, Homo sapiens
ggtctaggtgtaattgtttact

SEQ ID NO: 9515967 - DNA, 22 bp, Homo sapiens
ggtcactgtcttctgggctctg

SEQ ID NO: 9515968 - DNA, 22 bp, Homo sapiens
ggtcactggtctctgcttccat

SEQ ID NO: 9515969 - DNA, 23 bp, Homo sapiens
ggtcactggcaagcagtgcagag

SEQ ID NO: 9515970 - DNA, 22 bp, Homo sapiens
ggtcactggtctctgcttccat

SEQ ID NO: 9515971 - DNA, 18 bp, Homo sapiens
ggtcactgagatgctact

SEQ ID NO: 9515972 - DNA, 22 bp, Homo sapiens
ggtcactgagctgtaattctgt

SEQ ID NO: 9515973 - DNA, 22 bp, Homo sapiens
ggtcactgatgtgttccctggg

SEQ ID NO: 9515974 - DNA, 22 bp, Homo sapiens
ggtcactgatgtgttccctggg

SEQ ID NO: 9515975 - DNA, 22 bp, Homo sapiens
ggtcactgcaggtttaacagag

SEQ ID NO: 9515976 - DNA, 22 bp, Homo sapiens
ggtcactgccctcccttttgca

SEQ ID NO: 9515977 - DNA, 22 bp, Homo sapiens
ggtagtcatggatagctatgag

SEQ ID NO: 9515978 - DNA, 22 bp, Homo sapiens
ggtagtcagtgttagtttgatt

SEQ ID NO: 9515979 - DNA, 22 bp, Homo sapiens
ggtcacatctaaatggagcatt

SEQ ID NO: 9515980 - DNA, 22 bp, Homo sapiens
ggtcacatatcctcggtttgga

SEQ ID NO: 9515981 - DNA, 22 bp, Homo sapiens
ggtcacatgagatgctgccctc

SEQ ID NO: 9515982 - DNA, 19 bp, Homo sapiens
ggtcacaggggttacaagg

SEQ ID NO: 9515983 - DNA, 22 bp, Homo sapiens
ggtcacatatcctcggtttgga

SEQ ID NO: 9515984 - DNA, 22 bp, Homo sapiens
ggtcacatggttgagcttgatc

SEQ ID NO: 9515985 - DNA, 22 bp, Homo sapiens
ggtcacatgcggggctgtagcc

SEQ ID NO: 9515986 - DNA, 22 bp, Homo sapiens
ggtcacatgagatgctgccctc

SEQ ID NO: 9515987 - DNA, 22 bp, Homo sapiens
ggtcacatctaaatggagcatt

SEQ ID NO: 9515988 - DNA, 22 bp, Homo sapiens
ggtcacatgtgatttgagccaa

SEQ ID NO: 9515989 - DNA, 22 bp, Homo sapiens
ggtcacatgtgatttgagccaa

SEQ ID NO: 9515990 - DNA, 23 bp, Homo sapiens
ggtcacatgtgagattaaacttg

SEQ ID NO: 9515991 - DNA, 23 bp, Homo sapiens
ggtcacatgtgagattaaacttg

SEQ ID NO: 9515992 - DNA, 22 bp, Homo sapiens
ggtcacatggttgagcttgatc

SEQ ID NO: 9515993 - DNA, 22 bp, Homo sapiens
ggtcacatgcggggctgtagcc

SEQ ID NO: 9515994 - DNA, 22 bp, Homo sapiens
ggtcacattctgaggtattagg

SEQ ID NO: 9515995 - DNA, 22 bp, Homo sapiens
ggtcacattctgaggaatcagg

SEQ ID NO: 9515996 - DNA, 22 bp, Homo sapiens
ggtcacattctgaggtattagg

SEQ ID NO: 9515997 - DNA, 22 bp, Homo sapiens
ggtcacattctgaggaatcagg

SEQ ID NO: 9515998 - DNA, 22 bp, Homo sapiens
ggtcacccatgatcacatcacc

SEQ ID NO: 9515999 - DNA, 19 bp, Homo sapiens
ggtcagagagatccaggct

SEQ ID NO: 9516000 - DNA, 22 bp, Homo sapiens
ggtcagaaggcagttaaacaaa

SEQ ID NO: 9516001 - DNA, 22 bp, Homo sapiens
ggtcagaacaagcaaataatag

SEQ ID NO: 9516002 - DNA, 22 bp, Homo sapiens
ggtcacttctttcatcgaaact

SEQ ID NO: 9516003 - DNA, 22 bp, Homo sapiens
ggtcacttcagataactggtgt

SEQ ID NO: 9516004 - DNA, 22 bp, Homo sapiens
ggtcagaacaagggtaaataaa

SEQ ID NO: 9516005 - DNA, 22 bp, Homo sapiens
ggtcagaagtgcaaaatcagtt

SEQ ID NO: 9516006 - DNA, 22 bp, Homo sapiens
ggtcagaaggcctcggcaggaa

SEQ ID NO: 9516007 - DNA, 22 bp, Homo sapiens
ggtcagaggggattccttggga

SEQ ID NO: 9516008 - DNA, 22 bp, Homo sapiens
ggtcagagggtgggctgcctgt

SEQ ID NO: 9516009 - DNA, 22 bp, Homo sapiens
ggtcagagccgttagcattcag

SEQ ID NO: 9516010 - DNA, 22 bp, Homo sapiens
ggtcagagctggagagataggg

SEQ ID NO: 9516011 - DNA, 22 bp, Homo sapiens
gggtggccttcatagctcaggg

SEQ ID NO: 9516012 - DNA, 22 bp, Homo sapiens
gggtggccttcatagctcaggg

SEQ ID NO: 9516013 - DNA, 22 bp, Homo sapiens
gggtggcatctctctgagctgt

SEQ ID NO: 9516014 - DNA, 22 bp, Homo sapiens
gggtggcatagggtgatggctt

SEQ ID NO: 9516015 - DNA, 22 bp, Homo sapiens
gggtggcatagggtgatggctt

SEQ ID NO: 9516016 - DNA, 22 bp, Homo sapiens
gggtggcatagggtgatggctt

SEQ ID NO: 9516017 - DNA, 22 bp, Homo sapiens
gggtggcatagggtgatggctt

SEQ ID NO: 9516018 - DNA, 22 bp, Homo sapiens
gggtggcaggattggcaggagt

SEQ ID NO: 9516019 - DNA, 22 bp, Homo sapiens
gggtggcaggattggcaggagt

SEQ ID NO: 9516020 - DNA, 22 bp, Homo sapiens
gggtggcaaaggcgctgaaagg

SEQ ID NO: 9516021 - DNA, 22 bp, Homo sapiens
gggtggcaaaggcgctgaaagg

SEQ ID NO: 9516022 - DNA, 20 bp, Homo sapiens
gggtggagttgcggtctgtg

SEQ ID NO: 9516023 - DNA, 20 bp, Homo sapiens
gggtggagttgcggtctgtg

SEQ ID NO: 9516024 - DNA, 20 bp, Homo sapiens
gggtggagttgcggtctgtg

SEQ ID NO: 9516025 - DNA, 22 bp, Homo sapiens
gggtggcacaggtgcagagggt

SEQ ID NO: 9516026 - DNA, 22 bp, Homo sapiens
gggtggcacaggtgcagagggt

SEQ ID NO: 9516027 - DNA, 22 bp, Homo sapiens
gggtggcacaggtgcagagggt

SEQ ID NO: 9516028 - DNA, 22 bp, Homo sapiens
gggtggcacaggtgcagagggt

SEQ ID NO: 9516029 - DNA, 22 bp, Homo sapiens
gggtggcagctgttgccaaggt

SEQ ID NO: 9516030 - DNA, 22 bp, Homo sapiens
gggtggcagctgttgccaaggt

SEQ ID NO: 9516031 - DNA, 22 bp, Homo sapiens
gggtggcacaggtgcagagggt

SEQ ID NO: 9516032 - DNA, 22 bp, Homo sapiens
gggtggcacaggtgcagagggt

SEQ ID NO: 9516033 - DNA, 22 bp, Homo sapiens
gggtggcacaggtgcagagggt

SEQ ID NO: 9516034 - DNA, 22 bp, Homo sapiens
gggtggcaggattggcaggagt

SEQ ID NO: 9516035 - DNA, 22 bp, Homo sapiens
gggtggcaggattggcaggagt

SEQ ID NO: 9516036 - DNA, 22 bp, Homo sapiens
gggtggcaggattggcaggagt

SEQ ID NO: 9516037 - DNA, 22 bp, Homo sapiens
gggtggaggtgggttttgagat

SEQ ID NO: 9516038 - DNA, 22 bp, Homo sapiens
gggtggaggtgggttttgagat

SEQ ID NO: 9516039 - DNA, 22 bp, Homo sapiens
gggtggagtagaaagatgaatt

SEQ ID NO: 9516040 - DNA, 22 bp, Homo sapiens
gggtggagtgtgaaatctggct

SEQ ID NO: 9516041 - DNA, 22 bp, Homo sapiens
gggtggagtagaaagatgaatt

SEQ ID NO: 9516042 - DNA, 22 bp, Homo sapiens
gggtggagtagaaagatgaatt

SEQ ID NO: 9516043 - DNA, 22 bp, Homo sapiens
gggtggagcttggacaccagta

SEQ ID NO: 9516044 - DNA, 22 bp, Homo sapiens
gggtggagcttggacaccagta

SEQ ID NO: 9516045 - DNA, 22 bp, Homo sapiens
gggtggaggagaacaggcccca

SEQ ID NO: 9516046 - DNA, 22 bp, Homo sapiens
gggtggaggagaacaggcccca

SEQ ID NO: 9516047 - DNA, 22 bp, Homo sapiens
gggtggaggagaacaggcccca

SEQ ID NO: 9516048 - DNA, 22 bp, Homo sapiens
gggtggaggagaacaggcccca

SEQ ID NO: 9516049 - DNA, 22 bp, Homo sapiens
gggtaggaaatccagaggtggc

SEQ ID NO: 9516050 - DNA, 22 bp, Homo sapiens
gggtaggatggtagaagggacc

SEQ ID NO: 9516051 - DNA, 22 bp, Homo sapiens
gggtagggtgacttaggctggc

SEQ ID NO: 9516052 - DNA, 22 bp, Homo sapiens
gggtagggtgacttaggctggc

SEQ ID NO: 9516053 - DNA, 22 bp, Homo sapiens
ggggctggtggtggtttctcca

SEQ ID NO: 9516054 - DNA, 22 bp, Homo sapiens
ggggtgggcgtgcagggacacc

SEQ ID NO: 9516055 - DNA, 22 bp, Homo sapiens
ggggtgggcgtgcagggacacc

SEQ ID NO: 9516056 - DNA, 22 bp, Homo sapiens
ggggctgggatttgaacccagg

SEQ ID NO: 9516057 - DNA, 22 bp, Homo sapiens
ggggctgggatttgaacccagg

SEQ ID NO: 9516058 - DNA, 22 bp, Homo sapiens
ggggctgggatttgaacccagg

SEQ ID NO: 9516059 - DNA, 22 bp, Homo sapiens
ggggctggtggtggtttctcca

SEQ ID NO: 9516060 - DNA, 22 bp, Homo sapiens
ggggctggtggtggtttctcca

SEQ ID NO: 9516061 - DNA, 22 bp, Homo sapiens
ggggctggtggtggtttctcca

SEQ ID NO: 9516062 - DNA, 22 bp, Homo sapiens
ggggtgggcgtgcagggacacc

SEQ ID NO: 9516063 - DNA, 22 bp, Homo sapiens
ggggtgggcgtgcagggacacc

SEQ ID NO: 9516064 - DNA, 22 bp, Homo sapiens
ggggtgggcgtgcagggacacc

SEQ ID NO: 9516065 - DNA, 22 bp, Homo sapiens
ggggtgggcgtgcagggacacc

SEQ ID NO: 9516066 - DNA, 22 bp, Homo sapiens
ggggtgggcgtgcagggacacc

SEQ ID NO: 9516067 - DNA, 22 bp, Homo sapiens
ggggtgggcgtgcagggacacc

SEQ ID NO: 9516068 - DNA, 22 bp, Homo sapiens
ggggtgggcgtgcagggacacc

SEQ ID NO: 9516069 - DNA, 22 bp, Homo sapiens
ggggttgatcacagaggggtct

SEQ ID NO: 9516070 - DNA, 22 bp, Homo sapiens
gggtaggaaatccagaggtggc

SEQ ID NO: 9516071 - DNA, 22 bp, Homo sapiens
ggggtggggttactcattgtgc

SEQ ID NO: 9516072 - DNA, 22 bp, Homo sapiens
ggggtggggttactcattgtgc

SEQ ID NO: 9516073 - DNA, 22 bp, Homo sapiens
ggggtgtgagtagagctgggga

SEQ ID NO: 9516074 - DNA, 22 bp, Homo sapiens
ggggtggggttactcattgtgc

SEQ ID NO: 9516075 - DNA, 22 bp, Homo sapiens
ggggtggggttactcattgtgc

SEQ ID NO: 9516076 - DNA, 22 bp, Homo sapiens
ggggtggggttactcattgtgc

SEQ ID NO: 9516077 - DNA, 22 bp, Homo sapiens
ggggtggggttactcattgtgc

SEQ ID NO: 9516078 - DNA, 22 bp, Homo sapiens
ggggctctgctctgagccgtgt

SEQ ID NO: 9516079 - DNA, 22 bp, Homo sapiens
ggggctctgctctgagccgtgt

SEQ ID NO: 9516080 - DNA, 22 bp, Homo sapiens
ggggctctggagaaaggccagt

SEQ ID NO: 9516081 - DNA, 22 bp, Homo sapiens
ggggctcttagagagcctagtg

SEQ ID NO: 9516082 - DNA, 22 bp, Homo sapiens
ggggctctgtgacagtaaccct

SEQ ID NO: 9516083 - DNA, 22 bp, Homo sapiens
ggggctgaacctggaggtggtc

SEQ ID NO: 9516084 - DNA, 22 bp, Homo sapiens
ggggctgacgggcatgtggctt

SEQ ID NO: 9516085 - DNA, 22 bp, Homo sapiens
ggggctgacgggcatgtggctt

SEQ ID NO: 9516086 - DNA, 22 bp, Homo sapiens
ggggctcagttcggacagcctg

SEQ ID NO: 9516087 - DNA, 22 bp, Homo sapiens
ggggctcagttcggacagcctg

SEQ ID NO: 9516088 - DNA, 22 bp, Homo sapiens
ggggctctgcctctcccacgcc

SEQ ID NO: 9516089 - DNA, 22 bp, Homo sapiens
ggggctctcaggtctccccaaa

SEQ ID NO: 9516090 - DNA, 22 bp, Homo sapiens
ggggctctaggtaaagcaacat

SEQ ID NO: 9516091 - DNA, 22 bp, Homo sapiens
ggggctccagtcttcacatttt

SEQ ID NO: 9516092 - DNA, 22 bp, Homo sapiens
ggggctgatggaactcaggcct

SEQ ID NO: 9516093 - DNA, 22 bp, Homo sapiens
ggggctgagaattcagtctcgg

SEQ ID NO: 9516094 - DNA, 22 bp, Homo sapiens
ggggctgagtcagtgggaagag

SEQ ID NO: 9516095 - DNA, 22 bp, Homo sapiens
ggggctgagtcagtgggaagag

SEQ ID NO: 9516096 - DNA, 20 bp, Homo sapiens
ggggctgcatgcagagaaga

SEQ ID NO: 9516097 - DNA, 22 bp, Homo sapiens
ggggctgctcccacccctgagg

SEQ ID NO: 9516098 - DNA, 20 bp, Homo sapiens
ggggctgcatgcagagaaga

SEQ ID NO: 9516099 - DNA, 22 bp, Homo sapiens
ggggctggctcactaagagact

SEQ ID NO: 9516100 - DNA, 22 bp, Homo sapiens
ggggctgctggtatttccagtt

SEQ ID NO: 9516101 - DNA, 22 bp, Homo sapiens
ggggctgctggtatttccagtt

SEQ ID NO: 9516102 - DNA, 22 bp, Homo sapiens
ggggctggctcactaagagact

SEQ ID NO: 9516103 - DNA, 22 bp, Homo sapiens
ggggctgggatttgaacccagg

SEQ ID NO: 9516104 - DNA, 22 bp, Homo sapiens
ggggctggctcactaagagact

SEQ ID NO: 9516105 - DNA, 22 bp, Homo sapiens
ggggctggctcactaagagact

SEQ ID NO: 9516106 - DNA, 22 bp, Homo sapiens
ggggctggctcactaagagact

SEQ ID NO: 9516107 - DNA, 22 bp, Homo sapiens
ggggaagatttttaattagtaa

SEQ ID NO: 9516108 - DNA, 22 bp, Homo sapiens
ggggaaggatatgattagacta

SEQ ID NO: 9516109 - DNA, 22 bp, Homo sapiens
ggggaaggaaagttattagcag

SEQ ID NO: 9516110 - DNA, 22 bp, Homo sapiens
ggggaaggaaagttattagcag

SEQ ID NO: 9516111 - DNA, 22 bp, Homo sapiens
ggggaaggaaagttattagcag

SEQ ID NO: 9516112 - DNA, 22 bp, Homo sapiens
ggggaaggatatgattagacta

SEQ ID NO: 9516113 - DNA, 22 bp, Homo sapiens
ggggaaggatatgattagacta

SEQ ID NO: 9516114 - DNA, 22 bp, Homo sapiens
ggggcctccagcactaggcagc

SEQ ID NO: 9516115 - DNA, 22 bp, Homo sapiens
ggggcggggctctgagaagcat

SEQ ID NO: 9516116 - DNA, 22 bp, Homo sapiens
ggggaagaggcgtgatggatcc

SEQ ID NO: 9516117 - DNA, 22 bp, Homo sapiens
ggggaagagcattgcacggtgt

SEQ ID NO: 9516118 - DNA, 22 bp, Homo sapiens
ggggaagagcattgcacggtgt

SEQ ID NO: 9516119 - DNA, 22 bp, Homo sapiens
ggggaagacctggcactacagc

SEQ ID NO: 9516120 - DNA, 22 bp, Homo sapiens
ggggaagaatggcagaaaacat

SEQ ID NO: 9516121 - DNA, 22 bp, Homo sapiens
ggggaagatggccctccatgtg

SEQ ID NO: 9516122 - DNA, 22 bp, Homo sapiens
ggggaagatggccctccatgtg

SEQ ID NO: 9516123 - DNA, 22 bp, Homo sapiens
gggcttgggtattgtgagaggt

SEQ ID NO: 9516124 - DNA, 22 bp, Homo sapiens
ggggaagaatggcagaaaacat

SEQ ID NO: 9516125 - DNA, 22 bp, Homo sapiens
gggctttaggggccagtgacca

SEQ ID NO: 9516126 - DNA, 22 bp, Homo sapiens
gggccacacagaacctcctggt

SEQ ID NO: 9516127 - DNA, 22 bp, Homo sapiens
gggccacacagggcagctccct

SEQ ID NO: 9516128 - DNA, 22 bp, Homo sapiens
gggccaaggggagctggaaggg

SEQ ID NO: 9516129 - DNA, 22 bp, Homo sapiens
gggccaaggggagctggaaggg

SEQ ID NO: 9516130 - DNA, 22 bp, Homo sapiens
gggccaagggtgcgtggcagga

SEQ ID NO: 9516131 - DNA, 22 bp, Homo sapiens
gggccaagggtgcgtggcagga

SEQ ID NO: 9516132 - DNA, 22 bp, Homo sapiens
gggccaaggggagctggaaggg

SEQ ID NO: 9516133 - DNA, 22 bp, Homo sapiens
gggcatttaaacaagcatacaa

SEQ ID NO: 9516134 - DNA, 22 bp, Homo sapiens
gggcatgtagtgtgcatagaga

SEQ ID NO: 9516135 - DNA, 22 bp, Homo sapiens
gggcatgtacataatctagaaa

SEQ ID NO: 9516136 - DNA, 22 bp, Homo sapiens
gggcatgtaggaatccatggag

SEQ ID NO: 9516137 - DNA, 22 bp, Homo sapiens
gggcatggtgagggatatgaag

SEQ ID NO: 9516138 - DNA, 22 bp, Homo sapiens
gggcatggcgtgtgctggattc

SEQ ID NO: 9516139 - DNA, 22 bp, Homo sapiens
gggcatggcgtgtgctggattc

SEQ ID NO: 9516140 - DNA, 22 bp, Homo sapiens
gggcatggggcggacctggttc

SEQ ID NO: 9516141 - DNA, 22 bp, Homo sapiens
gggcatggtgatgtgcacctgt

SEQ ID NO: 9516142 - DNA, 22 bp, Homo sapiens
gggcatggtggcaggcacctgt

SEQ ID NO: 9516143 - DNA, 22 bp, Homo sapiens
gggcatggtgctggtgttcatg

SEQ ID NO: 9516144 - DNA, 22 bp, Homo sapiens
gggcatggtgctggtgttcatg

SEQ ID NO: 9516145 - DNA, 22 bp, Homo sapiens
gggcatggccaggtgaggggtc

SEQ ID NO: 9516146 - DNA, 22 bp, Homo sapiens
gggcatggccaggtgaggggtc

SEQ ID NO: 9516147 - DNA, 22 bp, Homo sapiens
gggcatggccaggtgaggggtc

SEQ ID NO: 9516148 - DNA, 18 bp, Homo sapiens
gggcatggatgcagcatc

SEQ ID NO: 9516149 - DNA, 18 bp, Homo sapiens
gggcatggatgcagcatc

SEQ ID NO: 9516150 - DNA, 18 bp, Homo sapiens
gggcatggatgcagcatc

SEQ ID NO: 9516151 - DNA, 22 bp, Homo sapiens
gggcatggccaggtgaggggtc

SEQ ID NO: 9516152 - DNA, 22 bp, Homo sapiens
gggcatggccaggtgaggggtc

SEQ ID NO: 9516153 - DNA, 22 bp, Homo sapiens
gggctgagattggtgccctgtc

SEQ ID NO: 9516154 - DNA, 22 bp, Homo sapiens
gggctgagattggtgccctgtc

SEQ ID NO: 9516155 - DNA, 22 bp, Homo sapiens
gggctgagagctggaatctgag

SEQ ID NO: 9516156 - DNA, 22 bp, Homo sapiens
gggctgagcacatactgacagc

SEQ ID NO: 9516157 - DNA, 22 bp, Homo sapiens
gggctgagattggtgccctgtc

SEQ ID NO: 9516158 - DNA, 22 bp, Homo sapiens
gggctgagattggtgccctgtc

SEQ ID NO: 9516159 - DNA, 21 bp, Homo sapiens
gggccacaccttctgcagacc

SEQ ID NO: 9516160 - DNA, 22 bp, Homo sapiens
gggctgagagctggaatctgag

SEQ ID NO: 9516161 - DNA, 22 bp, Homo sapiens
gggctgagagctggaatctgag

SEQ ID NO: 9516162 - DNA, 22 bp, Homo sapiens
gggctgagagctggaatctgag

SEQ ID NO: 9516163 - DNA, 22 bp, Homo sapiens
gggctgagagtgactgttctgt

SEQ ID NO: 9516164 - DNA, 22 bp, Homo sapiens
gggctgagagctggaatctgag

SEQ ID NO: 9516165 - DNA, 22 bp, Homo sapiens
gggctgaggctaccactggtct

SEQ ID NO: 9516166 - DNA, 22 bp, Homo sapiens
gggctgaggctaccactggtct

SEQ ID NO: 9516167 - DNA, 22 bp, Homo sapiens
gggctgaggaacatattttgtt

SEQ ID NO: 9516168 - DNA, 22 bp, Homo sapiens
gggctgaggaacatattttgtt

SEQ ID NO: 9516169 - DNA, 22 bp, Homo sapiens
gggctgagctaagctgggttga

SEQ ID NO: 9516170 - DNA, 22 bp, Homo sapiens
gggctgagctgttctgagttta

SEQ ID NO: 9516171 - DNA, 22 bp, Homo sapiens
gggctgagctaagctgggttga

SEQ ID NO: 9516172 - DNA, 22 bp, Homo sapiens
gggctgagctgttctgagttta

SEQ ID NO: 9516173 - DNA, 22 bp, Homo sapiens
gggctgagctaagctgggttga

SEQ ID NO: 9516174 - DNA, 22 bp, Homo sapiens
gggctgagccatttgaaccttg

SEQ ID NO: 9516175 - DNA, 22 bp, Homo sapiens
gggctgagccatttgaaccttg

SEQ ID NO: 9516176 - DNA, 22 bp, Homo sapiens
gggctgagccatttgaaccttg

SEQ ID NO: 9516177 - DNA, 22 bp, Homo sapiens
gggctgagccacagcttttgtt

SEQ ID NO: 9516178 - DNA, 22 bp, Homo sapiens
gggctgagcacatactgacagc

SEQ ID NO: 9516179 - DNA, 22 bp, Homo sapiens
gggctgagccacagcttttgtt

SEQ ID NO: 9516180 - DNA, 22 bp, Homo sapiens
gggctgagcacatactgacagc

SEQ ID NO: 9516181 - DNA, 22 bp, Homo sapiens
gggctgaggctaccactggtct

SEQ ID NO: 9516182 - DNA, 22 bp, Homo sapiens
gggctgagggccaattcctact

SEQ ID NO: 9516183 - DNA, 22 bp, Homo sapiens
gggctgagggccaattcctact

SEQ ID NO: 9516184 - DNA, 22 bp, Homo sapiens
gggctgagtgtcccaggccgaa

SEQ ID NO: 9516185 - DNA, 22 bp, Homo sapiens
gggctgagggccaattcctact

SEQ ID NO: 9516186 - DNA, 22 bp, Homo sapiens
gggctgagtgtcccaggccgaa

SEQ ID NO: 9516187 - DNA, 22 bp, Homo sapiens
gggctgagtgtcccaggccgaa

SEQ ID NO: 9516188 - DNA, 22 bp, Homo sapiens
gggctgagttcctgcctcactc

SEQ ID NO: 9516189 - DNA, 22 bp, Homo sapiens
gggctgagttcctgcctcactc

SEQ ID NO: 9516190 - DNA, 22 bp, Homo sapiens
gggctgccaagcctgcctgcct

SEQ ID NO: 9516191 - DNA, 22 bp, Homo sapiens
gggctgcacgtattctgctcac

SEQ ID NO: 9516192 - DNA, 22 bp, Homo sapiens
gggctgcacgtattctgctcac

SEQ ID NO: 9516193 - DNA, 22 bp, Homo sapiens
gggctgcacgtattctgctcac

SEQ ID NO: 9516194 - DNA, 22 bp, Homo sapiens
gggctgattcgatgggggtaga

SEQ ID NO: 9516195 - DNA, 22 bp, Homo sapiens
gggctgcaatgcttcagttgtt

SEQ ID NO: 9516196 - DNA, 22 bp, Homo sapiens
gggctgcaatgcttcagttgtt

SEQ ID NO: 9516197 - DNA, 22 bp, Homo sapiens
gggctgcgtgtggaggatgtaa

SEQ ID NO: 9516198 - DNA, 22 bp, Homo sapiens
gggctgccttttaattcttccc

SEQ ID NO: 9516199 - DNA, 22 bp, Homo sapiens
gggctgcgtgtggaggatgtaa

SEQ ID NO: 9516200 - DNA, 22 bp, Homo sapiens
gggctgctataacaagatacct

SEQ ID NO: 9516201 - DNA, 22 bp, Homo sapiens
gggctgctacgagaactgaata

SEQ ID NO: 9516202 - DNA, 22 bp, Homo sapiens
gggctgcctgagcatctcctcc

SEQ ID NO: 9516203 - DNA, 22 bp, Homo sapiens
gggctgccaagcctgcctgcct

SEQ ID NO: 9516204 - DNA, 22 bp, Homo sapiens
gggctgcctgagcatctcctcc

SEQ ID NO: 9516205 - DNA, 22 bp, Homo sapiens
gggctgccaagcctgcctgcct

SEQ ID NO: 9516206 - DNA, 22 bp, Homo sapiens
gggctgcctttcttctgggagc

SEQ ID NO: 9516207 - DNA, 22 bp, Homo sapiens
gggctgcctttcttctgggagc

SEQ ID NO: 9516208 - DNA, 22 bp, Homo sapiens
gggctgctgctgccagcgacac

SEQ ID NO: 9516209 - DNA, 22 bp, Homo sapiens
gggctgctgtagagaacatgtt

SEQ ID NO: 9516210 - DNA, 22 bp, Homo sapiens
gggctgctgtagagaacatgtt

SEQ ID NO: 9516211 - DNA, 22 bp, Homo sapiens
gggctgctgccaccaggtggat

SEQ ID NO: 9516212 - DNA, 22 bp, Homo sapiens
gggctgctgccaatcacagcct

SEQ ID NO: 9516213 - DNA, 22 bp, Homo sapiens
gggctgctgccaccaggtggat

SEQ ID NO: 9516214 - DNA, 22 bp, Homo sapiens
gggctgctgcccaggaggcacc

SEQ ID NO: 9516215 - DNA, 22 bp, Homo sapiens
gggctgctgcccaggaggcacc

SEQ ID NO: 9516216 - DNA, 22 bp, Homo sapiens
gggcttgaggtgaaggtaggga

SEQ ID NO: 9516217 - DNA, 22 bp, Homo sapiens
gggcttgctaagaagagcgcat

SEQ ID NO: 9516218 - DNA, 22 bp, Homo sapiens
gggcttgaacaacttggaggtg

SEQ ID NO: 9516219 - DNA, 22 bp, Homo sapiens
gggcttcttgccatggggacgg

SEQ ID NO: 9516220 - DNA, 22 bp, Homo sapiens
gggcttcttgccatggggacgg

SEQ ID NO: 9516221 - DNA, 22 bp, Homo sapiens
gggctgctgtgttcctgaggca

SEQ ID NO: 9516222 - DNA, 22 bp, Homo sapiens
gggcttctgttcctttcacttg

SEQ ID NO: 9516223 - DNA, 22 bp, Homo sapiens
gggcttcttgagctgccggccc

SEQ ID NO: 9516224 - DNA, 22 bp, Homo sapiens
gggcttcttgcaggggcaacat

SEQ ID NO: 9516225 - DNA, 22 bp, Homo sapiens
gggcttggagtaggctgatgaa

SEQ ID NO: 9516226 - DNA, 22 bp, Homo sapiens
gggcttggcacatgggctcagc

SEQ ID NO: 9516227 - DNA, 20 bp, Homo sapiens
gggcttggaggactcgaggg

SEQ ID NO: 9516228 - DNA, 22 bp, Homo sapiens
gggcttgcttaaggtcacccgg

SEQ ID NO: 9516229 - DNA, 22 bp, Homo sapiens
gtctggaggaggaagaaggcac

SEQ ID NO: 9516230 - DNA, 22 bp, Homo sapiens
gtctggaggaaaaggttaaatg

SEQ ID NO: 9516231 - DNA, 22 bp, Homo sapiens
gtctggagcctgggtccctgct

SEQ ID NO: 9516232 - DNA, 22 bp, Homo sapiens
gtctgctgttcagagatgttgc

SEQ ID NO: 9516233 - DNA, 22 bp, Homo sapiens
gtctggagcctgggtccctgct

SEQ ID NO: 9516234 - DNA, 22 bp, Homo sapiens
gtctggagcctgggtccctgct

SEQ ID NO: 9516235 - DNA, 22 bp, Homo sapiens
gtctgctgttcagagatgttgc

SEQ ID NO: 9516236 - DNA, 22 bp, Homo sapiens
gtctggaggcactttctcatga

SEQ ID NO: 9516237 - DNA, 22 bp, Homo sapiens
gtctggaggcccgtcagcccta

SEQ ID NO: 9516238 - DNA, 22 bp, Homo sapiens
gtctggaggcccgtcagcccta

SEQ ID NO: 9516239 - DNA, 22 bp, Homo sapiens
gtctggaggcactttctcatga

SEQ ID NO: 9516240 - DNA, 22 bp, Homo sapiens
gtctggaggagggctctgcggc

SEQ ID NO: 9516241 - DNA, 22 bp, Homo sapiens
gtctggaggagggctctgcggc

SEQ ID NO: 9516242 - DNA, 22 bp, Homo sapiens
gtctgctgtaggtaggacagca

SEQ ID NO: 9516243 - DNA, 22 bp, Homo sapiens
gtctgctgtgggtccccaggag

SEQ ID NO: 9516244 - DNA, 22 bp, Homo sapiens
gtctgctgtaggtaggacagca

SEQ ID NO: 9516245 - DNA, 22 bp, Homo sapiens
gtctgctgtaggtaggacagca

SEQ ID NO: 9516246 - DNA, 22 bp, Homo sapiens
gtctgctggcacgtcacagata

SEQ ID NO: 9516247 - DNA, 22 bp, Homo sapiens
gtctgctcatgctaccgcgggc

SEQ ID NO: 9516248 - DNA, 22 bp, Homo sapiens
gtctgctcatgctaccgcgggc

SEQ ID NO: 9516249 - DNA, 22 bp, Homo sapiens
gtctgctcatgctaccgcgggc

SEQ ID NO: 9516250 - DNA, 22 bp, Homo sapiens
gtctgcctgtctggatgacaga

SEQ ID NO: 9516251 - DNA, 22 bp, Homo sapiens
gtctgctgcagagcatggcttt

SEQ ID NO: 9516252 - DNA, 22 bp, Homo sapiens
gtctgctgacagagcatggacc

SEQ ID NO: 9516253 - DNA, 22 bp, Homo sapiens
gtctgctcatgctaccgcgggc

SEQ ID NO: 9516254 - DNA, 22 bp, Homo sapiens
gtctgctgacagagcatggacc

SEQ ID NO: 9516255 - DNA, 22 bp, Homo sapiens
gtctgcctgggacgctgggagt

SEQ ID NO: 9516256 - DNA, 22 bp, Homo sapiens
gtctgcctctattgcctacctg

SEQ ID NO: 9516257 - DNA, 22 bp, Homo sapiens
gtctgcctctattgcctacctg

SEQ ID NO: 9516258 - DNA, 22 bp, Homo sapiens
gtctgcccttggctcagccata

SEQ ID NO: 9516259 - DNA, 22 bp, Homo sapiens
gtcctgggcctgctgaggctga

SEQ ID NO: 9516260 - DNA, 22 bp, Homo sapiens
gtcctgggcctgctgaggctga

SEQ ID NO: 9516261 - DNA, 22 bp, Homo sapiens
gtcctgggcggagggctgctgt

SEQ ID NO: 9516262 - DNA, 22 bp, Homo sapiens
gtcctgggcggagggctgctgt

SEQ ID NO: 9516263 - DNA, 22 bp, Homo sapiens
gtcctggggaatacagaagccg

SEQ ID NO: 9516264 - DNA, 22 bp, Homo sapiens
gtcctggggaatacagaagccg

SEQ ID NO: 9516265 - DNA, 22 bp, Homo sapiens
gtcctggggatacagaagtgaa

SEQ ID NO: 9516266 - DNA, 22 bp, Homo sapiens
gtcctggggatacagaagtgaa

SEQ ID NO: 9516267 - DNA, 22 bp, Homo sapiens
gtcctggggatacagaagtgaa

SEQ ID NO: 9516268 - DNA, 22 bp, Homo sapiens
gtcctggggatacagaagtgaa

SEQ ID NO: 9516269 - DNA, 22 bp, Homo sapiens
gtcctggggattatagagtgtt

SEQ ID NO: 9516270 - DNA, 22 bp, Homo sapiens
gtcctggggattatagagtgtt

SEQ ID NO: 9516271 - DNA, 22 bp, Homo sapiens
gtctgcccttggcctgggactt

SEQ ID NO: 9516272 - DNA, 22 bp, Homo sapiens
gtctgccctcacgccagctggg

SEQ ID NO: 9516273 - DNA, 22 bp, Homo sapiens
gtctgccctgcagacatgcctc

SEQ ID NO: 9516274 - DNA, 22 bp, Homo sapiens
gtcctgggggcagctgtgtcca

SEQ ID NO: 9516275 - DNA, 22 bp, Homo sapiens
gtcctgggggcagctgtgtcca

SEQ ID NO: 9516276 - DNA, 22 bp, Homo sapiens
gtcctgggggcagctgtgtcca

SEQ ID NO: 9516277 - DNA, 22 bp, Homo sapiens
gtcctgggggcagctgtgtcca

SEQ ID NO: 9516278 - DNA, 22 bp, Homo sapiens
gtctgcccggccttcctccacc

SEQ ID NO: 9516279 - DNA, 22 bp, Homo sapiens
gtctggaggggagatttgggtt

SEQ ID NO: 9516280 - DNA, 22 bp, Homo sapiens
gtctggagggtgggtagagacc

SEQ ID NO: 9516281 - DNA, 22 bp, Homo sapiens
gtctggagggaagagatgtcag

SEQ ID NO: 9516282 - DNA, 22 bp, Homo sapiens
gtctggaggcccgtcagcccta

SEQ ID NO: 9516283 - DNA, 22 bp, Homo sapiens
gtctggagggaagagatgtcag

SEQ ID NO: 9516284 - DNA, 17 bp, Homo sapiens
gtctggagtggccttca

SEQ ID NO: 9516285 - DNA, 17 bp, Homo sapiens
gtctggagtggccttca

SEQ ID NO: 9516286 - DNA, 22 bp, Homo sapiens
gtctggagtaccataaaaagga

SEQ ID NO: 9516287 - DNA, 18 bp, Homo sapiens
gtctggaggtcaggagct

SEQ ID NO: 9516288 - DNA, 18 bp, Homo sapiens
gtctggaggtcaggagct

SEQ ID NO: 9516289 - DNA, 18 bp, Homo sapiens
gtctggaggtcaggagct

SEQ ID NO: 9516290 - DNA, 22 bp, Homo sapiens
gtctggagtggtggatttaaag

SEQ ID NO: 9516291 - DNA, 17 bp, Homo sapiens
gtctggagtggccttca

SEQ ID NO: 9516292 - DNA, 22 bp, Homo sapiens
gtctggagtggggcctgagaat

SEQ ID NO: 9516293 - DNA, 22 bp, Homo sapiens
gtctggagtggggcctgagaat

SEQ ID NO: 9516294 - DNA, 22 bp, Homo sapiens
gtgaaactgctttgtaaactgt

SEQ ID NO: 9516295 - DNA, 22 bp, Homo sapiens
gtgaaacttcacattttgatag

SEQ ID NO: 9516296 - DNA, 22 bp, Homo sapiens
gtgaaacaccctccaatgcaca

SEQ ID NO: 9516297 - DNA, 22 bp, Homo sapiens
gtgaaactgctttgtaaactgt

SEQ ID NO: 9516298 - DNA, 22 bp, Homo sapiens
gtgaacatcagattacatgaga

SEQ ID NO: 9516299 - DNA, 22 bp, Homo sapiens
gtgaaccaagaagtcaaagcga

SEQ ID NO: 9516300 - DNA, 22 bp, Homo sapiens
gtgaacctctgaaaggcagtga

SEQ ID NO: 9516301 - DNA, 22 bp, Homo sapiens
gtgaactaaggattcaaacttc

SEQ ID NO: 9516302 - DNA, 22 bp, Homo sapiens
gtgaactattgggtatcataaa

SEQ ID NO: 9516303 - DNA, 22 bp, Homo sapiens
gtgaacaaaatagcacatatta

SEQ ID NO: 9516304 - DNA, 22 bp, Homo sapiens
gtgaacaaggagactacaactt

SEQ ID NO: 9516305 - DNA, 22 bp, Homo sapiens
gtgaaatattttgtttatgtca

SEQ ID NO: 9516306 - DNA, 22 bp, Homo sapiens
gtgaaattgtatttggcattga

SEQ ID NO: 9516307 - DNA, 22 bp, Homo sapiens
gtgaaatatttaacgtccaggt

SEQ ID NO: 9516308 - DNA, 22 bp, Homo sapiens
gtgaaatatttaacgtccaggt

SEQ ID NO: 9516309 - DNA, 22 bp, Homo sapiens
gtgaaactgctttgtaaactgt

SEQ ID NO: 9516310 - DNA, 22 bp, Homo sapiens
gtgaagataaggatgctgcagt

SEQ ID NO: 9516311 - DNA, 22 bp, Homo sapiens
gtgaagcacatgggcgttgggt

SEQ ID NO: 9516312 - DNA, 22 bp, Homo sapiens
gtgaagcagggaaggaaaggat

SEQ ID NO: 9516313 - DNA, 22 bp, Homo sapiens
gtgaagcacgctgccgcactgg

SEQ ID NO: 9516314 - DNA, 22 bp, Homo sapiens
gtgaagcagagtgtggaagcaa

SEQ ID NO: 9516315 - DNA, 22 bp, Homo sapiens
gtgaagcagttgcgtgggttcc

SEQ ID NO: 9516316 - DNA, 22 bp, Homo sapiens
gtgaagcatatgcttctctgcc

SEQ ID NO: 9516317 - DNA, 22 bp, Homo sapiens
gtgaagcataactgaaggattt

SEQ ID NO: 9516318 - DNA, 22 bp, Homo sapiens
gtgaacttccagatgataaaca

SEQ ID NO: 9516319 - DNA, 22 bp, Homo sapiens
gtgaactgctgagttttatcat

SEQ ID NO: 9516320 - DNA, 22 bp, Homo sapiens
gtgaactctgactctcatgcct

SEQ ID NO: 9516321 - DNA, 22 bp, Homo sapiens
gtgaactcagtctctcttgcta

SEQ ID NO: 9516322 - DNA, 22 bp, Homo sapiens
gtgaagcatatgcttctctgcc

SEQ ID NO: 9516323 - DNA, 18 bp, Homo sapiens
gtgaagctttattgaatg

SEQ ID NO: 9516324 - DNA, 22 bp, Homo sapiens
gtgaaggaccaatatgactcat

SEQ ID NO: 9516325 - DNA, 22 bp, Homo sapiens
gtgaaggaccaatatgactcat

SEQ ID NO: 9516326 - DNA, 22 bp, Homo sapiens
gtgaaggactagcatggagggc

SEQ ID NO: 9516327 - DNA, 22 bp, Homo sapiens
gtgaccatcatctcagctagtt

SEQ ID NO: 9516328 - DNA, 22 bp, Homo sapiens
gtgaccatttgacatatccttg

SEQ ID NO: 9516329 - DNA, 23 bp, Homo sapiens
gtgacccaaggaccttccagaat

SEQ ID NO: 9516330 - DNA, 22 bp, Homo sapiens
gtgaccatcatctcagctagtt

SEQ ID NO: 9516331 - DNA, 22 bp, Homo sapiens
gtgaccataatagattatgagt

SEQ ID NO: 9516332 - DNA, 21 bp, Homo sapiens
gtgcagaggaatgtagggggc

SEQ ID NO: 9516333 - DNA, 22 bp, Homo sapiens
gtgcagaggacgtggcggcctc

SEQ ID NO: 9516334 - DNA, 22 bp, Homo sapiens
gtgcagaggacgtggcggcctc

SEQ ID NO: 9516335 - DNA, 22 bp, Homo sapiens
gtgcagagcaagggctgagggc

SEQ ID NO: 9516336 - DNA, 21 bp, Homo sapiens
gtgcagaggaatgtagggggc

SEQ ID NO: 9516337 - DNA, 22 bp, Homo sapiens
gtgcagagcaagggctgagggc

SEQ ID NO: 9516338 - DNA, 22 bp, Homo sapiens
gtgcagagcaagggctgagggc

SEQ ID NO: 9516339 - DNA, 22 bp, Homo sapiens
gtgcagggtagcgacggcagga

SEQ ID NO: 9516340 - DNA, 22 bp, Homo sapiens
gtgcagatcctgattgcagttc

SEQ ID NO: 9516341 - DNA, 22 bp, Homo sapiens
gtgcagagtgtctgtggactga

SEQ ID NO: 9516342 - DNA, 20 bp, Homo sapiens
gtgcagaggcagcctgtggg

SEQ ID NO: 9516343 - DNA, 20 bp, Homo sapiens
gtgcagaggcagcctgtggg

SEQ ID NO: 9516344 - DNA, 22 bp, Homo sapiens
gtgcagaggtcacaaaagtgaa

SEQ ID NO: 9516345 - DNA, 22 bp, Homo sapiens
gtgcaggtgttttggctgccag

SEQ ID NO: 9516346 - DNA, 22 bp, Homo sapiens
gtgcagtgaccctggagagctg

SEQ ID NO: 9516347 - DNA, 22 bp, Homo sapiens
gtgcagtgaccctggagagctg

SEQ ID NO: 9516348 - DNA, 22 bp, Homo sapiens
gtgcagtgaccctggagagctg

SEQ ID NO: 9516349 - DNA, 20 bp, Homo sapiens
gtgcatttcacctgtactgt

SEQ ID NO: 9516350 - DNA, 22 bp, Homo sapiens
gtgcatttggtgactctcaccc

SEQ ID NO: 9516351 - DNA, 22 bp, Homo sapiens
gtgccaatgcactctagcctgg

SEQ ID NO: 9516352 - DNA, 22 bp, Homo sapiens
gtgctagggttggagtggggct

SEQ ID NO: 9516353 - DNA, 22 bp, Homo sapiens
gtgcatttatatttgcctttgg

SEQ ID NO: 9516354 - DNA, 22 bp, Homo sapiens
gtgcatttatatttgcctttgg

SEQ ID NO: 9516355 - DNA, 22 bp, Homo sapiens
gtgcatatgtacctgtgatcat

SEQ ID NO: 9516356 - DNA, 22 bp, Homo sapiens
gtgcagttgaagcatggggaga

SEQ ID NO: 9516357 - DNA, 22 bp, Homo sapiens
gtgcagttcccaaggtcacaca

SEQ ID NO: 9516358 - DNA, 19 bp, Homo sapiens
gtgcagttcagagttcaat

SEQ ID NO: 9516359 - DNA, 22 bp, Homo sapiens
gtgcagttcttgtaacatgctg

SEQ ID NO: 9516360 - DNA, 22 bp, Homo sapiens
gtgcagttcttgtaacatgctg

SEQ ID NO: 9516361 - DNA, 22 bp, Homo sapiens
gtgcagttgaagcatggggaga

SEQ ID NO: 9516362 - DNA, 22 bp, Homo sapiens
gtgcagttgagacaataggctg

SEQ ID NO: 9516363 - DNA, 22 bp, Homo sapiens
gtgcagttgagacaataggctg

SEQ ID NO: 9516364 - DNA, 22 bp, Homo sapiens
gtgcagttgtggacatgacaac

SEQ ID NO: 9516365 - DNA, 22 bp, Homo sapiens
gtgcagttgatagttttagtga

SEQ ID NO: 9516366 - DNA, 22 bp, Homo sapiens
gtgcatatatatgggagggagc

SEQ ID NO: 9516367 - DNA, 22 bp, Homo sapiens
gtgcatatatgcacatatgtgt

SEQ ID NO: 9516368 - DNA, 22 bp, Homo sapiens
gtgcataaatagcagagctgtg

SEQ ID NO: 9516369 - DNA, 22 bp, Homo sapiens
gtgcataatttggcaatagaat

SEQ ID NO: 9516370 - DNA, 22 bp, Homo sapiens
gtgcatatatgcacatatgtgt

SEQ ID NO: 9516371 - DNA, 22 bp, Homo sapiens
gtgcatatatgtgcagcatcaa

SEQ ID NO: 9516372 - DNA, 22 bp, Homo sapiens
gtgcatatggttacagcaccgc

SEQ ID NO: 9516373 - DNA, 22 bp, Homo sapiens
gtgagacaagatttgtaggcag

SEQ ID NO: 9516374 - DNA, 22 bp, Homo sapiens
gtgagaaattgaatggctccca

SEQ ID NO: 9516375 - DNA, 22 bp, Homo sapiens
gtgagaagataagtattgcaaa

SEQ ID NO: 9516376 - DNA, 22 bp, Homo sapiens
gtgagaataccagcagtgagaa

SEQ ID NO: 9516377 - DNA, 22 bp, Homo sapiens
gtgagaataccagcagtgagaa

SEQ ID NO: 9516378 - DNA, 22 bp, Homo sapiens
gtgagaatgagattggaatgta

SEQ ID NO: 9516379 - DNA, 22 bp, Homo sapiens
gtgagaaaattgcctaattttg

SEQ ID NO: 9516380 - DNA, 22 bp, Homo sapiens
gtgagaaatgacaaatgtgtcg

SEQ ID NO: 9516381 - DNA, 22 bp, Homo sapiens
gtgagaaatgacaaatgtgtcg

SEQ ID NO: 9516382 - DNA, 22 bp, Homo sapiens
gtgagaaattgaatggctccca

SEQ ID NO: 9516383 - DNA, 22 bp, Homo sapiens
gtgagaaatggaacttcatacg

SEQ ID NO: 9516384 - DNA, 22 bp, Homo sapiens
gtgagaaatggaacttcatacg

SEQ ID NO: 9516385 - DNA, 22 bp, Homo sapiens
gtgactctcactttacctgact

SEQ ID NO: 9516386 - DNA, 22 bp, Homo sapiens
gtgacgtgaggggctcctgttg

SEQ ID NO: 9516387 - DNA, 22 bp, Homo sapiens
gtgactgtaattaccttagcaa

SEQ ID NO: 9516388 - DNA, 22 bp, Homo sapiens
gtgactgttgtttgctacgtgc

SEQ ID NO: 9516389 - DNA, 22 bp, Homo sapiens
gtgagactcgcctttgtgtagc

SEQ ID NO: 9516390 - DNA, 22 bp, Homo sapiens
gtgagacacccaagagtcagat

SEQ ID NO: 9516391 - DNA, 22 bp, Homo sapiens
gtgagacatcttgggaagtgat

SEQ ID NO: 9516392 - DNA, 22 bp, Homo sapiens
gtgagagaatttgagttaaatt

SEQ ID NO: 9516393 - DNA, 22 bp, Homo sapiens
gtgagcaggataggggctccct

SEQ ID NO: 9516394 - DNA, 22 bp, Homo sapiens
gtgagcagctcagggtggtctc

SEQ ID NO: 9516395 - DNA, 22 bp, Homo sapiens
gtgagcagctcagggtggtctc

SEQ ID NO: 9516396 - DNA, 22 bp, Homo sapiens
gtgagcaggataggggctccct

SEQ ID NO: 9516397 - DNA, 22 bp, Homo sapiens
gtgagcagctcagggtggtctc

SEQ ID NO: 9516398 - DNA, 22 bp, Homo sapiens
gtgagcagcctcacctgagggt

SEQ ID NO: 9516399 - DNA, 22 bp, Homo sapiens
gtgagcagcctcacctgagggt

SEQ ID NO: 9516400 - DNA, 22 bp, Homo sapiens
gtgagcagcctcacctgagggt

SEQ ID NO: 9516401 - DNA, 23 bp, Homo sapiens
gtgagcagcccactaggaatgcc

SEQ ID NO: 9516402 - DNA, 23 bp, Homo sapiens
gtgagcagcccactaggaatgcc

SEQ ID NO: 9516403 - DNA, 22 bp, Homo sapiens
gtgagcagcctcacctgagggt

SEQ ID NO: 9516404 - DNA, 22 bp, Homo sapiens
gtgagcagcctcacctgagggt

SEQ ID NO: 9516405 - DNA, 22 bp, Homo sapiens
gtgagcaggatttcatggtgta

SEQ ID NO: 9516406 - DNA, 22 bp, Homo sapiens
gtgagcaggatttcatggtgta

SEQ ID NO: 9516407 - DNA, 22 bp, Homo sapiens
gtgcacagaaattggtaagact

SEQ ID NO: 9516408 - DNA, 22 bp, Homo sapiens
gtgcacagagcccagggccgcg

SEQ ID NO: 9516409 - DNA, 22 bp, Homo sapiens
gtgcacagattcagaggttttg

SEQ ID NO: 9516410 - DNA, 23 bp, Homo sapiens
gtgcacagtcaagcccagcttag

SEQ ID NO: 9516411 - DNA, 21 bp, Homo sapiens
gtgcacagtcctgcacacagg

SEQ ID NO: 9516412 - DNA, 22 bp, Homo sapiens
gtgcacatcgtgcaggtttgtt

SEQ ID NO: 9516413 - DNA, 22 bp, Homo sapiens
gtgcacatcgtgcaggtttgtt

SEQ ID NO: 9516414 - DNA, 22 bp, Homo sapiens
gtgcacatcgtgcaggtttgtt

SEQ ID NO: 9516415 - DNA, 22 bp, Homo sapiens
gtgcacatcgtgcaggtttgtt

SEQ ID NO: 9516416 - DNA, 22 bp, Homo sapiens
gtgcagagaggaccttggggag

SEQ ID NO: 9516417 - DNA, 22 bp, Homo sapiens
gtgcagagaaatgagaagtcga

SEQ ID NO: 9516418 - DNA, 22 bp, Homo sapiens
gtgcagagaaggagcagtagtt

SEQ ID NO: 9516419 - DNA, 22 bp, Homo sapiens
gtgcactttgggagtctcagtg

SEQ ID NO: 9516420 - DNA, 22 bp, Homo sapiens
gtgcactgtctggtcaagagca

SEQ ID NO: 9516421 - DNA, 22 bp, Homo sapiens
gtacatttctcccaacactaaa

SEQ ID NO: 9516422 - DNA, 22 bp, Homo sapiens
gtacatttctcttgttcttatt

SEQ ID NO: 9516423 - DNA, 22 bp, Homo sapiens
gtacatttctcttgttcttatt

SEQ ID NO: 9516424 - DNA, 22 bp, Homo sapiens
gtacattttactttgtttgaat

SEQ ID NO: 9516425 - DNA, 22 bp, Homo sapiens
gtacattttactttgtttgaat

SEQ ID NO: 9516426 - DNA, 22 bp, Homo sapiens
gtacattttactttgtttgaat

SEQ ID NO: 9516427 - DNA, 22 bp, Homo sapiens
gtacattttgaggttaaaacaa

SEQ ID NO: 9516428 - DNA, 22 bp, Homo sapiens
gtacattttgaggttaaaacaa

SEQ ID NO: 9516429 - DNA, 22 bp, Homo sapiens
gtaccctgtggccagccagcca

SEQ ID NO: 9516430 - DNA, 22 bp, Homo sapiens
gtacatttcagtttccttaaga

SEQ ID NO: 9516431 - DNA, 22 bp, Homo sapiens
gtacatttcatttaaatgatgt

SEQ ID NO: 9516432 - DNA, 22 bp, Homo sapiens
gtacatttcatttaaatgatgt

SEQ ID NO: 9516433 - DNA, 22 bp, Homo sapiens
gtaaaactgtctaatggtatat

SEQ ID NO: 9516434 - DNA, 23 bp, Homo sapiens
gtaaaatacgcagtgcagtgtga

SEQ ID NO: 9516435 - DNA, 22 bp, Homo sapiens
gtacatttaggattcattgaaa

SEQ ID NO: 9516436 - DNA, 22 bp, Homo sapiens
gtaaaactgtctaatggtatat

SEQ ID NO: 9516437 - DNA, 22 bp, Homo sapiens
gtaaaactgtctaatggtatat

SEQ ID NO: 9516438 - DNA, 22 bp, Homo sapiens
gtaaaactgtctaatggtatat

SEQ ID NO: 9516439 - DNA, 22 bp, Homo sapiens
gtaaaactgcagaacttggagg

SEQ ID NO: 9516440 - DNA, 22 bp, Homo sapiens
gtaaaactgcagaacttggagg

SEQ ID NO: 9516441 - DNA, 22 bp, Homo sapiens
ggtttggttttggccatcttcc

SEQ ID NO: 9516442 - DNA, 19 bp, Homo sapiens
ggtttgtagaattgcttaa

SEQ ID NO: 9516443 - DNA, 22 bp, Homo sapiens
ggtttgttggggtccaggccca

SEQ ID NO: 9516444 - DNA, 22 bp, Homo sapiens
ggttttaaccattcacaagtga

SEQ ID NO: 9516445 - DNA, 22 bp, Homo sapiens
ggtttgacagcttggggctgtc

SEQ ID NO: 9516446 - DNA, 22 bp, Homo sapiens
ggtttgacagcttggggctgtc

SEQ ID NO: 9516447 - DNA, 22 bp, Homo sapiens
ggtttctagcagagtctcttta

SEQ ID NO: 9516448 - DNA, 14 bp, Homo sapiens
ggtttccattttta

SEQ ID NO: 9516449 - DNA, 22 bp, Homo sapiens
ggtttccattattttatgggtg

SEQ ID NO: 9516450 - DNA, 22 bp, Homo sapiens
ggtttccaggagaagagatttg

SEQ ID NO: 9516451 - DNA, 22 bp, Homo sapiens
ggtttccacttgctgaagaaag

SEQ ID NO: 9516452 - DNA, 22 bp, Homo sapiens
ggtttccaatgacaaacactgt

SEQ ID NO: 9516453 - DNA, 22 bp, Homo sapiens
ggtttccacatccatggaatgg

SEQ ID NO: 9516454 - DNA, 22 bp, Homo sapiens
ggtttccaccttgctatgagaa

SEQ ID NO: 9516455 - DNA, 22 bp, Homo sapiens
ggtttccaaagatagagtagta

SEQ ID NO: 9516456 - DNA, 22 bp, Homo sapiens
ggtttccaaagatagagtagta

SEQ ID NO: 9516457 - DNA, 22 bp, Homo sapiens
ggtttccaagtggttgaaaagt

SEQ ID NO: 9516458 - DNA, 22 bp, Homo sapiens
ggtttcaacttttgtgaggaat

SEQ ID NO: 9516459 - DNA, 22 bp, Homo sapiens
ggttttattaactttaacatca

SEQ ID NO: 9516460 - DNA, 22 bp, Homo sapiens
ggttttaactacagaattgcaa

SEQ ID NO: 9516461 - DNA, 22 bp, Homo sapiens
ggttttatagcagtactatcag

SEQ ID NO: 9516462 - DNA, 22 bp, Homo sapiens
gtaaaacaagctttatggttcc

SEQ ID NO: 9516463 - DNA, 22 bp, Homo sapiens
gtaaaaaggccaagcccttgtg

SEQ ID NO: 9516464 - DNA, 22 bp, Homo sapiens
gtaaaaaggccaagcccttgtg

SEQ ID NO: 9516465 - DNA, 22 bp, Homo sapiens
gtaaaacaagctttatggttcc

SEQ ID NO: 9516466 - DNA, 22 bp, Homo sapiens
gtaaaacatgttttaactagga

SEQ ID NO: 9516467 - DNA, 22 bp, Homo sapiens
gtaaaacatgttttaactagga

SEQ ID NO: 9516468 - DNA, 22 bp, Homo sapiens
gtaaaacatgttttaactagga

SEQ ID NO: 9516469 - DNA, 22 bp, Homo sapiens
gtattgtattgaacacatgtga

SEQ ID NO: 9516470 - DNA, 22 bp, Homo sapiens
gtatttaattccattaagttag

SEQ ID NO: 9516471 - DNA, 23 bp, Homo sapiens
gtatttcagcattctcagttaaa

SEQ ID NO: 9516472 - DNA, 22 bp, Homo sapiens
gtatttataggggaatgagagt

SEQ ID NO: 9516473 - DNA, 17 bp, Homo sapiens
gtattctttgccttcca

SEQ ID NO: 9516474 - DNA, 22 bp, Homo sapiens
gtattgcaattactcttcttct

SEQ ID NO: 9516475 - DNA, 21 bp, Homo sapiens
gtattgcagagttatgtgctc

SEQ ID NO: 9516476 - DNA, 22 bp, Homo sapiens
gtattgtagctacaatagacgt

SEQ ID NO: 9516477 - DNA, 22 bp, Homo sapiens
gtattctgggccgattacaaaa

SEQ ID NO: 9516478 - DNA, 22 bp, Homo sapiens
gtattctgggccgattacaaaa

SEQ ID NO: 9516479 - DNA, 22 bp, Homo sapiens
gtattcacctaaatgtagtttg

SEQ ID NO: 9516480 - DNA, 22 bp, Homo sapiens
gtattcacatggtggtagattg

SEQ ID NO: 9516481 - DNA, 22 bp, Homo sapiens
gtattctgtttacagtgagcaa

SEQ ID NO: 9516482 - DNA, 20 bp, Homo sapiens
gtattctgtattctgctcag

SEQ ID NO: 9516483 - DNA, 22 bp, Homo sapiens
gtattcttaaggattgagcaaa

SEQ ID NO: 9516484 - DNA, 22 bp, Homo sapiens
gtattattgtcatgaaataata

SEQ ID NO: 9516485 - DNA, 22 bp, Homo sapiens
gtattattgtcatgaaataata

SEQ ID NO: 9516486 - DNA, 22 bp, Homo sapiens
gtattacatttagtaattaggc

SEQ ID NO: 9516487 - DNA, 22 bp, Homo sapiens
gtagacaagcacaggactcaga

SEQ ID NO: 9516488 - DNA, 22 bp, Homo sapiens
gtagacaaatttcttctctcaa

SEQ ID NO: 9516489 - DNA, 22 bp, Homo sapiens
gtagaactccagttctgtggca

SEQ ID NO: 9516490 - DNA, 22 bp, Homo sapiens
gtagaactctttcctgcgtggg

SEQ ID NO: 9516491 - DNA, 22 bp, Homo sapiens
gtagaataaatgtacacatctg

SEQ ID NO: 9516492 - DNA, 22 bp, Homo sapiens
gtagaattttaataatggagat

SEQ ID NO: 9516493 - DNA, 22 bp, Homo sapiens
gtagaattacctctctatgtcc

SEQ ID NO: 9516494 - DNA, 22 bp, Homo sapiens
gtacctgggggatccacttctt

SEQ ID NO: 9516495 - DNA, 22 bp, Homo sapiens
gtacgtgcatgcacgtgtgcct

SEQ ID NO: 9516496 - DNA, 22 bp, Homo sapiens
gtagaaatggtgtgtttcttct

SEQ ID NO: 9516497 - DNA, 22 bp, Homo sapiens
gtagaaattccatttactttga

SEQ ID NO: 9516498 - DNA, 22 bp, Homo sapiens
gtccaccatagggagggcgtgg

SEQ ID NO: 9516499 - DNA, 22 bp, Homo sapiens
gtccaccttcttggtcaggccc

SEQ ID NO: 9516500 - DNA, 22 bp, Homo sapiens
gtccacagctggccagggcctc

SEQ ID NO: 9516501 - DNA, 22 bp, Homo sapiens
gtccacagctctgaggtctccc

SEQ ID NO: 9516502 - DNA, 22 bp, Homo sapiens
gtccacagctctgaggtctccc

SEQ ID NO: 9516503 - DNA, 22 bp, Homo sapiens
gtccacagctctgaggtctccc

SEQ ID NO: 9516504 - DNA, 22 bp, Homo sapiens
gtccacagagggctgggcaggc

SEQ ID NO: 9516505 - DNA, 22 bp, Homo sapiens
gtccacactgaggccttctcca

SEQ ID NO: 9516506 - DNA, 22 bp, Homo sapiens
gtcccatcccccttggcactca

SEQ ID NO: 9516507 - DNA, 22 bp, Homo sapiens
gtcccattcatctccctaggga

SEQ ID NO: 9516508 - DNA, 22 bp, Homo sapiens
gtcccatcccccttggcactca

SEQ ID NO: 9516509 - DNA, 22 bp, Homo sapiens
gtccactgctgtgtgcttcacc

SEQ ID NO: 9516510 - DNA, 22 bp, Homo sapiens
gtcccattgttctgggcttggc

SEQ ID NO: 9516511 - DNA, 22 bp, Homo sapiens
gtcccattgctcattagctttc

SEQ ID NO: 9516512 - DNA, 22 bp, Homo sapiens
gtcccattccctgtatcttaga

SEQ ID NO: 9516513 - DNA, 22 bp, Homo sapiens
gtccccagaaaggtgaggcagg

SEQ ID NO: 9516514 - DNA, 22 bp, Homo sapiens
gtcccatttcaagaaattcatg

SEQ ID NO: 9516515 - DNA, 22 bp, Homo sapiens
gtcccattttgcagatagagca

SEQ ID NO: 9516516 - DNA, 22 bp, Homo sapiens
gtcccattttctactatggaat

SEQ ID NO: 9516517 - DNA, 22 bp, Homo sapiens
gtccccagaaaggtgaggcagg

SEQ ID NO: 9516518 - DNA, 22 bp, Homo sapiens
gtccccagagctggtggtggtt

SEQ ID NO: 9516519 - DNA, 22 bp, Homo sapiens
gtccacaaaattactatcttac

SEQ ID NO: 9516520 - DNA, 22 bp, Homo sapiens
gtccaattctccttccctgggt

SEQ ID NO: 9516521 - DNA, 22 bp, Homo sapiens
gtccaaggtctttggagataga

SEQ ID NO: 9516522 - DNA, 22 bp, Homo sapiens
gtccaaggatggggtctcccag

SEQ ID NO: 9516523 - DNA, 22 bp, Homo sapiens
gtccaaggatgcaggatgctgt

SEQ ID NO: 9516524 - DNA, 22 bp, Homo sapiens
gtccaaggcaagtgtgcagagt

SEQ ID NO: 9516525 - DNA, 22 bp, Homo sapiens
gtccaaaagagccagccgggcg

SEQ ID NO: 9516526 - DNA, 22 bp, Homo sapiens
gtcatttttttcgtaatagtgg

SEQ ID NO: 9516527 - DNA, 22 bp, Homo sapiens
gtcatttttttcgtaatagtgg

SEQ ID NO: 9516528 - DNA, 22 bp, Homo sapiens
gtcatttttgactttgaagtga

SEQ ID NO: 9516529 - DNA, 22 bp, Homo sapiens
gtcatttttgactttgaagtga

SEQ ID NO: 9516530 - DNA, 22 bp, Homo sapiens
gtcatttttcactgcatataga

SEQ ID NO: 9516531 - DNA, 22 bp, Homo sapiens
gtcattttgctgcatatttaga

SEQ ID NO: 9516532 - DNA, 22 bp, Homo sapiens
gtcattttctagaattatttga

SEQ ID NO: 9516533 - DNA, 22 bp, Homo sapiens
gtcattttgctgcatatttaga

SEQ ID NO: 9516534 - DNA, 22 bp, Homo sapiens
gtcattttatgggaacagattt

SEQ ID NO: 9516535 - DNA, 22 bp, Homo sapiens
gtcattttctagaattatttga

SEQ ID NO: 9516536 - DNA, 22 bp, Homo sapiens
gtcattttatgggaacagattt

SEQ ID NO: 9516537 - DNA, 22 bp, Homo sapiens
gtccctggaatggactctgcgc

SEQ ID NO: 9516538 - DNA, 22 bp, Homo sapiens
gtccctggaatggactctgcgc

SEQ ID NO: 9516539 - DNA, 22 bp, Homo sapiens
gtccctggaaaagagctggtga

SEQ ID NO: 9516540 - DNA, 22 bp, Homo sapiens
gtccctggaatggactctgcgc

SEQ ID NO: 9516541 - DNA, 22 bp, Homo sapiens
gtcctgggaactggacagctaa

SEQ ID NO: 9516542 - DNA, 22 bp, Homo sapiens
gtcctgggaactggacagctaa

SEQ ID NO: 9516543 - DNA, 22 bp, Homo sapiens
gtcctgggaactggacagctaa

SEQ ID NO: 9516544 - DNA, 22 bp, Homo sapiens
gtcctgggaaggaagccaggga

SEQ ID NO: 9516545 - DNA, 22 bp, Homo sapiens
gtcctgggaaggaagccaggga

SEQ ID NO: 9516546 - DNA, 20 bp, Homo sapiens
gtcctgggagccacagcaca

SEQ ID NO: 9516547 - DNA, 20 bp, Homo sapiens
gtcctgggagccacagcaca

SEQ ID NO: 9516548 - DNA, 22 bp, Homo sapiens
gtcctgggagatgggaccctga

SEQ ID NO: 9516549 - DNA, 22 bp, Homo sapiens
gtcctgggagatgggaccctga

SEQ ID NO: 9516550 - DNA, 17 bp, Homo sapiens
gtcctgggaggagagag

SEQ ID NO: 9516551 - DNA, 17 bp, Homo sapiens
gtcctgggaggagagag

SEQ ID NO: 9516552 - DNA, 17 bp, Homo sapiens
gtcctgggaggagagag

SEQ ID NO: 9516553 - DNA, 17 bp, Homo sapiens
gtcctgggaggagagag

SEQ ID NO: 9516554 - DNA, 20 bp, Homo sapiens
gtcctgggagccacagcaca

SEQ ID NO: 9516555 - DNA, 20 bp, Homo sapiens
gtcctgggagccacagcaca

SEQ ID NO: 9516556 - DNA, 22 bp, Homo sapiens
gtcctgggcatgcagggctttc

SEQ ID NO: 9516557 - DNA, 22 bp, Homo sapiens
gtcctgggaggggctggtcctg

SEQ ID NO: 9516558 - DNA, 22 bp, Homo sapiens
gtcctgggaggggctggtcctg

SEQ ID NO: 9516559 - DNA, 22 bp, Homo sapiens
gtcctgggaggggctggtcctg

SEQ ID NO: 9516560 - DNA, 22 bp, Homo sapiens
gtcctgggcccaggggctgcct

SEQ ID NO: 9516561 - DNA, 22 bp, Homo sapiens
gtcctgggcctgctgaggctga

SEQ ID NO: 9516562 - DNA, 22 bp, Homo sapiens
gtccctcaaggtccagtcatgg

SEQ ID NO: 9516563 - DNA, 22 bp, Homo sapiens
gtccctcaaggtccagtcatgg

SEQ ID NO: 9516564 - DNA, 22 bp, Homo sapiens
gtccctcacccagatgctccca

SEQ ID NO: 9516565 - DNA, 23 bp, Homo sapiens
gtccctcacccctaggcaatgcc

SEQ ID NO: 9516566 - DNA, 22 bp, Homo sapiens
gtccctcagtagtgcacagtgg

SEQ ID NO: 9516567 - DNA, 22 bp, Homo sapiens
gtccctcagtagtgcacagtgg

SEQ ID NO: 9516568 - DNA, 22 bp, Homo sapiens
gtccctcactggaccatatgaa

SEQ ID NO: 9516569 - DNA, 22 bp, Homo sapiens
gtccctcactggaccatatgaa

SEQ ID NO: 9516570 - DNA, 22 bp, Homo sapiens
gtccctcactggaccatatgaa

SEQ ID NO: 9516571 - DNA, 22 bp, Homo sapiens
gtccctcactggaccatatgaa

SEQ ID NO: 9516572 - DNA, 22 bp, Homo sapiens
gtccctctgtgtccctgcagtc

SEQ ID NO: 9516573 - DNA, 22 bp, Homo sapiens
gtccctctgctctagagagcca

SEQ ID NO: 9516574 - DNA, 22 bp, Homo sapiens
gtccccttggtaaccttcagct

SEQ ID NO: 9516575 - DNA, 22 bp, Homo sapiens
gtcccctggcccccagcgtcgg

SEQ ID NO: 9516576 - DNA, 22 bp, Homo sapiens
gtcccctcattttagagaaaga

SEQ ID NO: 9516577 - DNA, 22 bp, Homo sapiens
gtccccagctgtgacgagagcc

SEQ ID NO: 9516578 - DNA, 22 bp, Homo sapiens
gtccccagctaatctctttgcc

SEQ ID NO: 9516579 - DNA, 22 bp, Homo sapiens
gtccccagctgtgacgagagcc

SEQ ID NO: 9516580 - DNA, 22 bp, Homo sapiens
gtccccgccgtcgctcaggctg

SEQ ID NO: 9516581 - DNA, 22 bp, Homo sapiens
gtcccccacacttccatgtcac

SEQ ID NO: 9516582 - DNA, 22 bp, Homo sapiens
gggaccagaggctgtgcacaat

SEQ ID NO: 9516583 - DNA, 23 bp, Homo sapiens
gggaccagctagggctgtgacct

SEQ ID NO: 9516584 - DNA, 23 bp, Homo sapiens
gggaccagctagggctgtgacct

SEQ ID NO: 9516585 - DNA, 23 bp, Homo sapiens
gggaccagctagggctgtgacct

SEQ ID NO: 9516586 - DNA, 22 bp, Homo sapiens
gggagaagtggaaatctcatta

SEQ ID NO: 9516587 - DNA, 23 bp, Homo sapiens
gggagaatatgaggatgatggtg

SEQ ID NO: 9516588 - DNA, 22 bp, Homo sapiens
gggagacaaaggtgaggttctt

SEQ ID NO: 9516589 - DNA, 22 bp, Homo sapiens
gggaccagaagaaggatggtga

SEQ ID NO: 9516590 - DNA, 22 bp, Homo sapiens
gggaccagaagaaggatggtga

SEQ ID NO: 9516591 - DNA, 22 bp, Homo sapiens
gggacatggaggcgcgcaggca

SEQ ID NO: 9516592 - DNA, 22 bp, Homo sapiens
gggacatgcccctcagtgggtg

SEQ ID NO: 9516593 - DNA, 22 bp, Homo sapiens
gggacatggaggcgcgcaggca

SEQ ID NO: 9516594 - DNA, 22 bp, Homo sapiens
gggacatctttctagtcagggt

SEQ ID NO: 9516595 - DNA, 22 bp, Homo sapiens
gggacatgaagcatcggaggca

SEQ ID NO: 9516596 - DNA, 22 bp, Homo sapiens
gggacaggctgagacttgagct

SEQ ID NO: 9516597 - DNA, 22 bp, Homo sapiens
gggacagtggctgtgtcagttt

SEQ ID NO: 9516598 - DNA, 22 bp, Homo sapiens
gggacaggcaaaggtatgcttc

SEQ ID NO: 9516599 - DNA, 22 bp, Homo sapiens
gggacaggcccctcgctagctt

SEQ ID NO: 9516600 - DNA, 22 bp, Homo sapiens
gggacaggcccctcgctagctt

SEQ ID NO: 9516601 - DNA, 22 bp, Homo sapiens
gggacaggctgagacttgagct

SEQ ID NO: 9516602 - DNA, 22 bp, Homo sapiens
gggacaggctgagacttgagct

SEQ ID NO: 9516603 - DNA, 22 bp, Homo sapiens
gggacaggctgagacttgagct

SEQ ID NO: 9516604 - DNA, 22 bp, Homo sapiens
gggacaggctgagacttgagct

SEQ ID NO: 9516605 - DNA, 22 bp, Homo sapiens
gggacaggctgagacttgagct

SEQ ID NO: 9516606 - DNA, 22 bp, Homo sapiens
gggacaggctgagacttgagct

SEQ ID NO: 9516607 - DNA, 22 bp, Homo sapiens
ggcttgtccttgggctgtgcat

SEQ ID NO: 9516608 - DNA, 22 bp, Homo sapiens
ggcttgtccttctggttgtctt

SEQ ID NO: 9516609 - DNA, 22 bp, Homo sapiens
ggcttgtcatgttgatgttctt

SEQ ID NO: 9516610 - DNA, 22 bp, Homo sapiens
ggcttgggagcaggcatgtgac

SEQ ID NO: 9516611 - DNA, 22 bp, Homo sapiens
ggcttcttaatcatgagagtga

SEQ ID NO: 9516612 - DNA, 22 bp, Homo sapiens
ggcttggctacaagccatgggc

SEQ ID NO: 9516613 - DNA, 20 bp, Homo sapiens
ggcttggctgcctggggagg

SEQ ID NO: 9516614 - DNA, 22 bp, Homo sapiens
gggacagcagaaagaaggcaag

SEQ ID NO: 9516615 - DNA, 22 bp, Homo sapiens
gggacagctggtctacctggta

SEQ ID NO: 9516616 - DNA, 22 bp, Homo sapiens
gggacaggcaaaggtatgcttc

SEQ ID NO: 9516617 - DNA, 22 bp, Homo sapiens
gggacaggcaaaggtatgcttc

SEQ ID NO: 9516618 - DNA, 22 bp, Homo sapiens
gggaatgtgagtagggtgagtt

SEQ ID NO: 9516619 - DNA, 22 bp, Homo sapiens
gggaatgtagcaaatctgcaat

SEQ ID NO: 9516620 - DNA, 22 bp, Homo sapiens
ggctttagggcaggcagtgtta

SEQ ID NO: 9516621 - DNA, 22 bp, Homo sapiens
gggagagaattattgccagacc

SEQ ID NO: 9516622 - DNA, 22 bp, Homo sapiens
gggagagaattattgccagacc

SEQ ID NO: 9516623 - DNA, 22 bp, Homo sapiens
gggagacagttcagatagtttc

SEQ ID NO: 9516624 - DNA, 20 bp, Homo sapiens
gggagacagggccagtgtcc

SEQ ID NO: 9516625 - DNA, 22 bp, Homo sapiens
gggagacccccaatgccaggtc

SEQ ID NO: 9516626 - DNA, 22 bp, Homo sapiens
gggagacccccaatgccaggtc

SEQ ID NO: 9516627 - DNA, 22 bp, Homo sapiens
gggagacaagaagtagcctgct

SEQ ID NO: 9516628 - DNA, 22 bp, Homo sapiens
gggagacacgctgcaggcataa

SEQ ID NO: 9516629 - DNA, 22 bp, Homo sapiens
gggagacacgctgcaggcataa

SEQ ID NO: 9516630 - DNA, 22 bp, Homo sapiens
gggagacacttgctttagaggg

SEQ ID NO: 9516631 - DNA, 19 bp, Homo sapiens
gggagacagctctgggctg

SEQ ID NO: 9516632 - DNA, 22 bp, Homo sapiens
gggagacacgctgcaggcataa

SEQ ID NO: 9516633 - DNA, 22 bp, Homo sapiens
gggagagagagctcatgttgaa

SEQ ID NO: 9516634 - DNA, 22 bp, Homo sapiens
gggagagagaaaacgtggcgca

SEQ ID NO: 9516635 - DNA, 22 bp, Homo sapiens
gggagagatgctgattgccaat

SEQ ID NO: 9516636 - DNA, 22 bp, Homo sapiens
gggagagagagctcatgttgaa

SEQ ID NO: 9516637 - DNA, 22 bp, Homo sapiens
gggagaggttacccgagcaact

SEQ ID NO: 9516638 - DNA, 22 bp, Homo sapiens
gggagaggttacccgagcaact

SEQ ID NO: 9516639 - DNA, 22 bp, Homo sapiens
gggagagcgggaggtgccacag

SEQ ID NO: 9516640 - DNA, 22 bp, Homo sapiens
gggagagcgggaggtgccacag

SEQ ID NO: 9516641 - DNA, 19 bp, Homo sapiens
gggagagccaggctcaccc

SEQ ID NO: 9516642 - DNA, 22 bp, Homo sapiens
gggagctggttcctgccctcca

SEQ ID NO: 9516643 - DNA, 22 bp, Homo sapiens
gggagctgtaagggacaggtag

SEQ ID NO: 9516644 - DNA, 22 bp, Homo sapiens
gggagctggttcctgccctcca

SEQ ID NO: 9516645 - DNA, 22 bp, Homo sapiens
gggagctggttcctgccctcca

SEQ ID NO: 9516646 - DNA, 22 bp, Homo sapiens
gggagctggggcatttataccc

SEQ ID NO: 9516647 - DNA, 22 bp, Homo sapiens
gggagctgggctggttttgctg

SEQ ID NO: 9516648 - DNA, 18 bp, Homo sapiens
gggagctgggaagctggt

SEQ ID NO: 9516649 - DNA, 18 bp, Homo sapiens
gggagctgggaagctggt

SEQ ID NO: 9516650 - DNA, 18 bp, Homo sapiens
gggagctgggaagctggt

SEQ ID NO: 9516651 - DNA, 18 bp, Homo sapiens
gggagctgggaagctggt

SEQ ID NO: 9516652 - DNA, 22 bp, Homo sapiens
gggagctgtcatcagtgttgtc

SEQ ID NO: 9516653 - DNA, 22 bp, Homo sapiens
gggagctgtagtccagataccg

SEQ ID NO: 9516654 - DNA, 22 bp, Homo sapiens
gggagctgtagtccagataccg

SEQ ID NO: 9516655 - DNA, 22 bp, Homo sapiens
gggagctgtcatcagtgttgtc

SEQ ID NO: 9516656 - DNA, 22 bp, Homo sapiens
gggagctgtcatcagtgttgtc

SEQ ID NO: 9516657 - DNA, 19 bp, Homo sapiens
gggagctgtctgcccgtgg

SEQ ID NO: 9516658 - DNA, 22 bp, Homo sapiens
gggagctgtaagggacaggtag

SEQ ID NO: 9516659 - DNA, 22 bp, Homo sapiens
gggagctgtaagggacaggtag

SEQ ID NO: 9516660 - DNA, 22 bp, Homo sapiens
gggagctgtagtccagataccg

SEQ ID NO: 9516661 - DNA, 17 bp, Homo sapiens
gggagatgaagggatat

SEQ ID NO: 9516662 - DNA, 17 bp, Homo sapiens
gggagatgaagggatat

SEQ ID NO: 9516663 - DNA, 17 bp, Homo sapiens
gggagatgaagggatat

SEQ ID NO: 9516664 - DNA, 22 bp, Homo sapiens
gggagctggcggattccccagg

SEQ ID NO: 9516665 - DNA, 22 bp, Homo sapiens
gggagctggcggattccccagg

SEQ ID NO: 9516666 - DNA, 22 bp, Homo sapiens
gggagatgaatcagaagtgatc

SEQ ID NO: 9516667 - DNA, 22 bp, Homo sapiens
gggagaggttacccgagcaact

SEQ ID NO: 9516668 - DNA, 22 bp, Homo sapiens
gggagaggttacccgagcaact

SEQ ID NO: 9516669 - DNA, 22 bp, Homo sapiens
gggagaggttacccgagcaact

SEQ ID NO: 9516670 - DNA, 22 bp, Homo sapiens
gggagaggttacccgagcaact

SEQ ID NO: 9516671 - DNA, 21 bp, Homo sapiens
gggaggaagctgcttctctct

SEQ ID NO: 9516672 - DNA, 22 bp, Homo sapiens
gggaggaaggcttgggtgagta

SEQ ID NO: 9516673 - DNA, 22 bp, Homo sapiens
gggaggaaatgtgcagcgaatt

SEQ ID NO: 9516674 - DNA, 22 bp, Homo sapiens
gggaggaaatgtgcagcgaatt

SEQ ID NO: 9516675 - DNA, 22 bp, Homo sapiens
gggaggaaatgtgcagcgaatt

SEQ ID NO: 9516676 - DNA, 22 bp, Homo sapiens
gggaggaaggcttgggtgagta

SEQ ID NO: 9516677 - DNA, 22 bp, Homo sapiens
gggaggaatgcaacttatttag

SEQ ID NO: 9516678 - DNA, 23 bp, Homo sapiens
gggagctgtggtgaaaagaggtg

SEQ ID NO: 9516679 - DNA, 23 bp, Homo sapiens
gggagctgtggtgaaaagaggtg

SEQ ID NO: 9516680 - DNA, 23 bp, Homo sapiens
gggagctgtggtgaaaagaggtg

SEQ ID NO: 9516681 - DNA, 23 bp, Homo sapiens
gggagctgtggtgaaaagaggtg

SEQ ID NO: 9516682 - DNA, 22 bp, Homo sapiens
gggagctgtgggattggttgag

SEQ ID NO: 9516683 - DNA, 19 bp, Homo sapiens
gggagctgtctgcccgtgg

SEQ ID NO: 9516684 - DNA, 19 bp, Homo sapiens
gggagctgtctgcccgtgg

SEQ ID NO: 9516685 - DNA, 19 bp, Homo sapiens
gggagctgtctgcccgtgg

SEQ ID NO: 9516686 - DNA, 22 bp, Homo sapiens
gggaggaaatgtgcagcgaatt

SEQ ID NO: 9516687 - DNA, 22 bp, Homo sapiens
gggaggaaagagaagtggtcca

SEQ ID NO: 9516688 - DNA, 19 bp, Homo sapiens
gggagctttccatctgtcc

SEQ ID NO: 9516689 - DNA, 22 bp, Homo sapiens
gggaggagctgagtgtgtgtgc

SEQ ID NO: 9516690 - DNA, 22 bp, Homo sapiens
gggatggggagctggaaagggg

SEQ ID NO: 9516691 - DNA, 22 bp, Homo sapiens
gggaggagcttggagattcact

SEQ ID NO: 9516692 - DNA, 22 bp, Homo sapiens
gggaggacggtccagggcaaag

SEQ ID NO: 9516693 - DNA, 22 bp, Homo sapiens
gggaggagctgagtgtgtgtgc

SEQ ID NO: 9516694 - DNA, 22 bp, Homo sapiens
gggaggagctgagtgtgtgtgc

SEQ ID NO: 9516695 - DNA, 22 bp, Homo sapiens
gggatggggggaagcgtccatg

SEQ ID NO: 9516696 - DNA, 22 bp, Homo sapiens
gggatggggagctggaaagggg

SEQ ID NO: 9516697 - DNA, 22 bp, Homo sapiens
gggatggggagctggaaagggg

SEQ ID NO: 9516698 - DNA, 22 bp, Homo sapiens
gggcaaaggcagaaagcggtgt

SEQ ID NO: 9516699 - DNA, 22 bp, Homo sapiens
gggcaaagtggtggaggcagtt

SEQ ID NO: 9516700 - DNA, 19 bp, Homo sapiens
gggcaaagtgatcgtcctg

SEQ ID NO: 9516701 - DNA, 22 bp, Homo sapiens
gggatttcaccatgttggttgg

SEQ ID NO: 9516702 - DNA, 22 bp, Homo sapiens
gggatttagtaggatagtatac

SEQ ID NO: 9516703 - DNA, 22 bp, Homo sapiens
gggattacagatgtgagccatt

SEQ ID NO: 9516704 - DNA, 22 bp, Homo sapiens
gggattcatcaactgttttaca

SEQ ID NO: 9516705 - DNA, 22 bp, Homo sapiens
gggatggggtcaacatgtacct

SEQ ID NO: 9516706 - DNA, 22 bp, Homo sapiens
gggatggggtcgggaccctgct

SEQ ID NO: 9516707 - DNA, 22 bp, Homo sapiens
gggatggtggcttgcatctgta

SEQ ID NO: 9516708 - DNA, 22 bp, Homo sapiens
gggatggggtcgggaccctgct

SEQ ID NO: 9516709 - DNA, 22 bp, Homo sapiens
gggcacagcctaactatggaga

SEQ ID NO: 9516710 - DNA, 22 bp, Homo sapiens
gggcacagcctaactatggaga

SEQ ID NO: 9516711 - DNA, 22 bp, Homo sapiens
gggcacagcccagtggggtccc

SEQ ID NO: 9516712 - DNA, 19 bp, Homo sapiens
gggcacagcctccccccag

SEQ ID NO: 9516713 - DNA, 22 bp, Homo sapiens
gggcacagctgctacccagtgc

SEQ ID NO: 9516714 - DNA, 22 bp, Homo sapiens
gggcacagctgctacccagtgc

SEQ ID NO: 9516715 - DNA, 22 bp, Homo sapiens
gggcaaagtggtggaggcagtt

SEQ ID NO: 9516716 - DNA, 22 bp, Homo sapiens
gggcaagaagctggaagcattc

SEQ ID NO: 9516717 - DNA, 22 bp, Homo sapiens
gggcaagaagctggaagcattc

SEQ ID NO: 9516718 - DNA, 22 bp, Homo sapiens
gggcaagcacagcgagcgtgcg

SEQ ID NO: 9516719 - DNA, 22 bp, Homo sapiens
gggcaagaagctggaagcattc

SEQ ID NO: 9516720 - DNA, 22 bp, Homo sapiens
gggcatgcctgcgcagtgcatg

SEQ ID NO: 9516721 - DNA, 22 bp, Homo sapiens
gggcaggctgagcatgtcacct

SEQ ID NO: 9516722 - DNA, 22 bp, Homo sapiens
gggcaggctgagcatgtcacct

SEQ ID NO: 9516723 - DNA, 22 bp, Homo sapiens
gggcatgcctgcgcagtgcatg

SEQ ID NO: 9516724 - DNA, 22 bp, Homo sapiens
gggcaggatgcagtttcagaga

SEQ ID NO: 9516725 - DNA, 22 bp, Homo sapiens
gggcaggctgagcatgtcacct

SEQ ID NO: 9516726 - DNA, 22 bp, Homo sapiens
gggcaggctgagcatgtcacct

SEQ ID NO: 9516727 - DNA, 22 bp, Homo sapiens
gggcatggaggtctgtctgcag

SEQ ID NO: 9516728 - DNA, 22 bp, Homo sapiens
gggcatggaggtctgtctgcag

SEQ ID NO: 9516729 - DNA, 23 bp, Homo sapiens
gggcatggagtgtaggtggaagg

SEQ ID NO: 9516730 - DNA, 23 bp, Homo sapiens
gggcatggagtgtaggtggaagg

SEQ ID NO: 9516731 - DNA, 18 bp, Homo sapiens
gggcatggatgcagcatc

SEQ ID NO: 9516732 - DNA, 19 bp, Homo sapiens
gggcatggatgagcttacc

SEQ ID NO: 9516733 - DNA, 23 bp, Homo sapiens
gggcatggagtgtaggtggaagg

SEQ ID NO: 9516734 - DNA, 19 bp, Homo sapiens
gggcatggatgagcttacc

SEQ ID NO: 9516735 - DNA, 22 bp, Homo sapiens
gggcaggagagaacagtcatgg

SEQ ID NO: 9516736 - DNA, 22 bp, Homo sapiens
gggcaggagagaacagtcatgg

SEQ ID NO: 9516737 - DNA, 22 bp, Homo sapiens
gggcaggagagaacagtcatgg

SEQ ID NO: 9516738 - DNA, 22 bp, Homo sapiens
gggcaggagagggccacctgga

SEQ ID NO: 9516739 - DNA, 22 bp, Homo sapiens
gggcaggagagggccacctgga

SEQ ID NO: 9516740 - DNA, 22 bp, Homo sapiens
gggcaggagagggccacctgga

SEQ ID NO: 9516741 - DNA, 22 bp, Homo sapiens
gggcaggaggctaattctgcat

SEQ ID NO: 9516742 - DNA, 22 bp, Homo sapiens
gggcaggaggctaattctgcat

SEQ ID NO: 9516743 - DNA, 22 bp, Homo sapiens
gggcaggagagggccacctgga

SEQ ID NO: 9516744 - DNA, 22 bp, Homo sapiens
gggcaggagagaacagtcatgg

SEQ ID NO: 9516745 - DNA, 22 bp, Homo sapiens
gggcaggagaaggtggatgtcc

SEQ ID NO: 9516746 - DNA, 22 bp, Homo sapiens
gggcaggagaaggtggatgtcc

SEQ ID NO: 9516747 - DNA, 22 bp, Homo sapiens
gggcaggagaaggtggatgtcc

SEQ ID NO: 9516748 - DNA, 16 bp, Homo sapiens
gggcaggaatcagggt

SEQ ID NO: 9516749 - DNA, 16 bp, Homo sapiens
gggcaggaatcagggt

SEQ ID NO: 9516750 - DNA, 22 bp, Homo sapiens
gggcaggaacaaatcaaatgat

SEQ ID NO: 9516751 - DNA, 22 bp, Homo sapiens
gggcaggagaaggtggatgtcc

SEQ ID NO: 9516752 - DNA, 22 bp, Homo sapiens
gggcaggagaaggtggatgtcc

SEQ ID NO: 9516753 - DNA, 22 bp, Homo sapiens
gggcagctctggctgtgggaag

SEQ ID NO: 9516754 - DNA, 21 bp, Homo sapiens
gggcagctctgttttattttc

SEQ ID NO: 9516755 - DNA, 22 bp, Homo sapiens
gggcagctctttggtatccttc

SEQ ID NO: 9516756 - DNA, 22 bp, Homo sapiens
gggcagctctgcccatcagagg

SEQ ID NO: 9516757 - DNA, 22 bp, Homo sapiens
gggcagctctggctgtgggaag

SEQ ID NO: 9516758 - DNA, 22 bp, Homo sapiens
gggcagctctggctgtgggaag

SEQ ID NO: 9516759 - DNA, 22 bp, Homo sapiens
gggcacaggaatttgggatgtg

SEQ ID NO: 9516760 - DNA, 22 bp, Homo sapiens
gggcacaggaatttgggatgtg

SEQ ID NO: 9516761 - DNA, 22 bp, Homo sapiens
gggcacaggaatttgggatgtg

SEQ ID NO: 9516762 - DNA, 22 bp, Homo sapiens
gggcacaggagaaggatctggc

SEQ ID NO: 9516763 - DNA, 22 bp, Homo sapiens
gggcagctctcacagcagccaa

SEQ ID NO: 9516764 - DNA, 22 bp, Homo sapiens
gggcacagctgctacccagtgc

SEQ ID NO: 9516765 - DNA, 22 bp, Homo sapiens
gggcacaggaatttgggatgtg

SEQ ID NO: 9516766 - DNA, 22 bp, Homo sapiens
gggcagctgcagggatggtgac

SEQ ID NO: 9516767 - DNA, 22 bp, Homo sapiens
gggcagctgcagggatggtgac

SEQ ID NO: 9516768 - DNA, 22 bp, Homo sapiens
gggcagctgccaagtgcatcgc

SEQ ID NO: 9516769 - DNA, 22 bp, Homo sapiens
gggcagctgccactccgcttgc

SEQ ID NO: 9516770 - DNA, 22 bp, Homo sapiens
gggcagctgcccctctctgggc

SEQ ID NO: 9516771 - DNA, 22 bp, Homo sapiens
gggcagctgccagaggccatgg

SEQ ID NO: 9516772 - DNA, 22 bp, Homo sapiens
gggcagctggcttataggtttg

SEQ ID NO: 9516773 - DNA, 22 bp, Homo sapiens
gggcagctggccaggtattctg

SEQ ID NO: 9516774 - DNA, 22 bp, Homo sapiens
gggcagctgcccctctctgggc

SEQ ID NO: 9516775 - DNA, 22 bp, Homo sapiens
gggcagctggatagttttaaat

SEQ ID NO: 9516776 - DNA, 22 bp, Homo sapiens
gggcaggaacaaatcaaatgat

SEQ ID NO: 9516777 - DNA, 22 bp, Homo sapiens
gggcagctgtcttggttctcaa

SEQ ID NO: 9516778 - DNA, 23 bp, Homo sapiens
gggcagcttaagcttgtttttct

SEQ ID NO: 9516779 - DNA, 22 bp, Homo sapiens
gggcagctgtatctgagcttat

SEQ ID NO: 9516780 - DNA, 22 bp, Homo sapiens
gggcagctgtatctgagcttat

SEQ ID NO: 9516781 - DNA, 22 bp, Homo sapiens
ggctctgggcatagaaggaagc

SEQ ID NO: 9516782 - DNA, 22 bp, Homo sapiens
ggctctgggcatagaaggaagc

SEQ ID NO: 9516783 - DNA, 22 bp, Homo sapiens
ggctctgggcatagaaggaagc

SEQ ID NO: 9516784 - DNA, 22 bp, Homo sapiens
ggctctggctcctggctttgtg

SEQ ID NO: 9516785 - DNA, 22 bp, Homo sapiens
ggctctgggaaatggtcttcct

SEQ ID NO: 9516786 - DNA, 22 bp, Homo sapiens
ggctctgggaaatggtcttcct

SEQ ID NO: 9516787 - DNA, 22 bp, Homo sapiens
ggctctggctactccaccctgt

SEQ ID NO: 9516788 - DNA, 22 bp, Homo sapiens
ggctctggctactccaccctgt

SEQ ID NO: 9516789 - DNA, 22 bp, Homo sapiens
ggctctggctcctggctttgtg

SEQ ID NO: 9516790 - DNA, 22 bp, Homo sapiens
ggctctggcgtccaatggagcg

SEQ ID NO: 9516791 - DNA, 22 bp, Homo sapiens
ggctctggcgtccaatggagcg

SEQ ID NO: 9516792 - DNA, 22 bp, Homo sapiens
ggctctggcgtccaatggagcg

SEQ ID NO: 9516793 - DNA, 22 bp, Homo sapiens
ggctctggctactccaccctgt

SEQ ID NO: 9516794 - DNA, 22 bp, Homo sapiens
ggctctggctactccaccctgt

SEQ ID NO: 9516795 - DNA, 22 bp, Homo sapiens
ggctctggcgtccaatggagcg

SEQ ID NO: 9516796 - DNA, 22 bp, Homo sapiens
ggctctggctactccaccctgt

SEQ ID NO: 9516797 - DNA, 19 bp, Homo sapiens
ggctctggcggctgtagcc

SEQ ID NO: 9516798 - DNA, 22 bp, Homo sapiens
ggctctggcggctctttcaata

SEQ ID NO: 9516799 - DNA, 19 bp, Homo sapiens
ggctctggcggctgtagcc

SEQ ID NO: 9516800 - DNA, 19 bp, Homo sapiens
ggctctggcggctgtagcc

SEQ ID NO: 9516801 - DNA, 19 bp, Homo sapiens
ggctctggcggctgtagcc

SEQ ID NO: 9516802 - DNA, 22 bp, Homo sapiens
ggctctggcaaggggaggctac

SEQ ID NO: 9516803 - DNA, 22 bp, Homo sapiens
ggctctggcgagctttagtaca

SEQ ID NO: 9516804 - DNA, 22 bp, Homo sapiens
ggctctggcaaggggaggctac

SEQ ID NO: 9516805 - DNA, 22 bp, Homo sapiens
ggctctggcggctctttcaata

SEQ ID NO: 9516806 - DNA, 22 bp, Homo sapiens
ggctctggcggctctttcaata

SEQ ID NO: 9516807 - DNA, 22 bp, Homo sapiens
ggctctggcgagctttagtaca

SEQ ID NO: 9516808 - DNA, 22 bp, Homo sapiens
ggctctggcggctctttcaata

SEQ ID NO: 9516809 - DNA, 22 bp, Homo sapiens
ggctctggagcacagacgtctg

SEQ ID NO: 9516810 - DNA, 22 bp, Homo sapiens
ggctctggagcacagacgtctg

SEQ ID NO: 9516811 - DNA, 22 bp, Homo sapiens
ggctctggcaaggggaggctac

SEQ ID NO: 9516812 - DNA, 22 bp, Homo sapiens
ggctctggcaaggggaggctac

SEQ ID NO: 9516813 - DNA, 22 bp, Homo sapiens
ggctctggcaaggggaggctac

SEQ ID NO: 9516814 - DNA, 22 bp, Homo sapiens
ggctctggagatgtccgacctg

SEQ ID NO: 9516815 - DNA, 22 bp, Homo sapiens
ggctctggagatgtccgacctg

SEQ ID NO: 9516816 - DNA, 22 bp, Homo sapiens
ggctctggagcacagacgtctg

SEQ ID NO: 9516817 - DNA, 22 bp, Homo sapiens
ggctctggagcacagacgtctg

SEQ ID NO: 9516818 - DNA, 22 bp, Homo sapiens
ggctctggagatgtccgacctg

SEQ ID NO: 9516819 - DNA, 22 bp, Homo sapiens
ggctctggagacatgtggagag

SEQ ID NO: 9516820 - DNA, 22 bp, Homo sapiens
ggctctggagacatgtggagag

SEQ ID NO: 9516821 - DNA, 22 bp, Homo sapiens
ggctctggagacatgtggagag

SEQ ID NO: 9516822 - DNA, 22 bp, Homo sapiens
ggctctggagacatgtggagag

SEQ ID NO: 9516823 - DNA, 22 bp, Homo sapiens
ggctgaagaactgggagtctca

SEQ ID NO: 9516824 - DNA, 22 bp, Homo sapiens
ggctgaaggatgaaagctgcag

SEQ ID NO: 9516825 - DNA, 22 bp, Homo sapiens
ggctcttctgtggcagccaagg

SEQ ID NO: 9516826 - DNA, 22 bp, Homo sapiens
ggctctgggccagagttggctt

SEQ ID NO: 9516827 - DNA, 22 bp, Homo sapiens
ggctctgggccagagttggctt

SEQ ID NO: 9516828 - DNA, 22 bp, Homo sapiens
ggctgagactagagtgaggcat

SEQ ID NO: 9516829 - DNA, 22 bp, Homo sapiens
ggctgagactagagtgaggcat

SEQ ID NO: 9516830 - DNA, 22 bp, Homo sapiens
ggctgagactagagtgaggcat

SEQ ID NO: 9516831 - DNA, 22 bp, Homo sapiens
ggctgagacaacctgggaccca

SEQ ID NO: 9516832 - DNA, 23 bp, Homo sapiens
ggctgagaagtcccatgataggt

SEQ ID NO: 9516833 - DNA, 22 bp, Homo sapiens
ggctgaagtgtagtggctcact

SEQ ID NO: 9516834 - DNA, 22 bp, Homo sapiens
ggctgaagtgtagtggctcact

SEQ ID NO: 9516835 - DNA, 22 bp, Homo sapiens
ggctgaagtgtagtggctcact

SEQ ID NO: 9516836 - DNA, 22 bp, Homo sapiens
ggctgagaaggagtgggtgagg

SEQ ID NO: 9516837 - DNA, 22 bp, Homo sapiens
ggctgagaagacagtggggtgg

SEQ ID NO: 9516838 - DNA, 22 bp, Homo sapiens
ggcgggaggctgaggagttggt

SEQ ID NO: 9516839 - DNA, 22 bp, Homo sapiens
ggcgggagcagcagctctgagc

SEQ ID NO: 9516840 - DNA, 22 bp, Homo sapiens
ggcgggaggctgaggagttggt

SEQ ID NO: 9516841 - DNA, 22 bp, Homo sapiens
ggcggcctgtgggtcggcctca

SEQ ID NO: 9516842 - DNA, 22 bp, Homo sapiens
ggcggagcttgcagtgagccga

SEQ ID NO: 9516843 - DNA, 22 bp, Homo sapiens
ggctccaccctgcttccagaag

SEQ ID NO: 9516844 - DNA, 22 bp, Homo sapiens
ggctccagaaacttcagtccat

SEQ ID NO: 9516845 - DNA, 22 bp, Homo sapiens
ggctccagaaacttcagtccat

SEQ ID NO: 9516846 - DNA, 22 bp, Homo sapiens
ggctccagaaacttcagtccat

SEQ ID NO: 9516847 - DNA, 22 bp, Homo sapiens
ggctccagaaatcatagagcag

SEQ ID NO: 9516848 - DNA, 22 bp, Homo sapiens
ggctccagaggccttacctgca

SEQ ID NO: 9516849 - DNA, 22 bp, Homo sapiens
ggctccagatgtcccctggcaa

SEQ ID NO: 9516850 - DNA, 22 bp, Homo sapiens
ggctccagatgtcccctggcaa

SEQ ID NO: 9516851 - DNA, 22 bp, Homo sapiens
ggctccagatgtcccctggcaa

SEQ ID NO: 9516852 - DNA, 22 bp, Homo sapiens
ggctctggaatgtgtagtcagg

SEQ ID NO: 9516853 - DNA, 22 bp, Homo sapiens
ggctctggaatgtgtagtcagg

SEQ ID NO: 9516854 - DNA, 22 bp, Homo sapiens
ggctccaggagatgctgggcag

SEQ ID NO: 9516855 - DNA, 22 bp, Homo sapiens
ggctccaggagatgctgggcag

SEQ ID NO: 9516856 - DNA, 22 bp, Homo sapiens
ggctccaggagatgctgggcag

SEQ ID NO: 9516857 - DNA, 22 bp, Homo sapiens
ggctccaggagatgctgggcag

SEQ ID NO: 9516858 - DNA, 22 bp, Homo sapiens
ggctctgctcacagcccgcagc

SEQ ID NO: 9516859 - DNA, 22 bp, Homo sapiens
ggctccaggagggccttggcca

SEQ ID NO: 9516860 - DNA, 22 bp, Homo sapiens
ggctccaggagggccttggcca

SEQ ID NO: 9516861 - DNA, 18 bp, Homo sapiens
ggctccaggacctaccca

SEQ ID NO: 9516862 - DNA, 18 bp, Homo sapiens
ggctccaggacctaccca

SEQ ID NO: 9516863 - DNA, 22 bp, Homo sapiens
ggctccaggaacctcctctcct

SEQ ID NO: 9516864 - DNA, 22 bp, Homo sapiens
ggctccagccctggctcttcac

SEQ ID NO: 9516865 - DNA, 22 bp, Homo sapiens
ggctccagccctggctcttcac

SEQ ID NO: 9516866 - DNA, 22 bp, Homo sapiens
ggctccagatgtctcctggcaa

SEQ ID NO: 9516867 - DNA, 22 bp, Homo sapiens
ggctccagatgtctcctggcaa

SEQ ID NO: 9516868 - DNA, 22 bp, Homo sapiens
ggctccagatgtctcctggcaa

SEQ ID NO: 9516869 - DNA, 22 bp, Homo sapiens
ggctgctgcccacccctgcatg

SEQ ID NO: 9516870 - DNA, 22 bp, Homo sapiens
ggctgctgcccacccctgcatg

SEQ ID NO: 9516871 - DNA, 22 bp, Homo sapiens
ggctgctgcccacccctgcatg

SEQ ID NO: 9516872 - DNA, 22 bp, Homo sapiens
ggctgctgcccacccctgcatg

SEQ ID NO: 9516873 - DNA, 22 bp, Homo sapiens
ggctgctgccctcctaagtgca

SEQ ID NO: 9516874 - DNA, 22 bp, Homo sapiens
ggctgctgccctcctaagtgca

SEQ ID NO: 9516875 - DNA, 22 bp, Homo sapiens
ggctgctgagtcacgacagtga

SEQ ID NO: 9516876 - DNA, 22 bp, Homo sapiens
ggctgctgacttcatccagctt

SEQ ID NO: 9516877 - DNA, 22 bp, Homo sapiens
ggctgctgagttggccaggaga

SEQ ID NO: 9516878 - DNA, 22 bp, Homo sapiens
ggctgctgagttggccaggaga

SEQ ID NO: 9516879 - DNA, 22 bp, Homo sapiens
ggctgctgagttggccaggaga

SEQ ID NO: 9516880 - DNA, 22 bp, Homo sapiens
ggctgctgagttggccaggaga

SEQ ID NO: 9516881 - DNA, 19 bp, Homo sapiens
ggctgctgaagagaattac

SEQ ID NO: 9516882 - DNA, 22 bp, Homo sapiens
ggctgctgaagtgtggcaatct

SEQ ID NO: 9516883 - DNA, 22 bp, Homo sapiens
ggctgctgacaaacatgatcat

SEQ ID NO: 9516884 - DNA, 22 bp, Homo sapiens
ggctgctgacttcatccagctt

SEQ ID NO: 9516885 - DNA, 22 bp, Homo sapiens
ggctgctgacaaacatgatcat

SEQ ID NO: 9516886 - DNA, 22 bp, Homo sapiens
ggctgagcactttaggcaggag

SEQ ID NO: 9516887 - DNA, 22 bp, Homo sapiens
ggctgagcaattttgatgacat

SEQ ID NO: 9516888 - DNA, 22 bp, Homo sapiens
ggctgctggcctctccccggcc

SEQ ID NO: 9516889 - DNA, 22 bp, Homo sapiens
ggctgctggccagcctaggagt

SEQ ID NO: 9516890 - DNA, 22 bp, Homo sapiens
ggctgctggccagcctaggagt

SEQ ID NO: 9516891 - DNA, 22 bp, Homo sapiens
ggctgctgggaatatgccagct

SEQ ID NO: 9516892 - DNA, 22 bp, Homo sapiens
ggctgctgggaatatgccagct

SEQ ID NO: 9516893 - DNA, 22 bp, Homo sapiens
ggctgctgggaatatgccagct

SEQ ID NO: 9516894 - DNA, 22 bp, Homo sapiens
ggctgctggagttgggtctctc

SEQ ID NO: 9516895 - DNA, 22 bp, Homo sapiens
ggctgctggcattgaggtaggt

SEQ ID NO: 9516896 - DNA, 22 bp, Homo sapiens
ggctgctggcattgaggtaggt

SEQ ID NO: 9516897 - DNA, 21 bp, Homo sapiens
ggctgctgggagagctgcgtg

SEQ ID NO: 9516898 - DNA, 22 bp, Homo sapiens
ggctggcttggtgagctgtcac

SEQ ID NO: 9516899 - DNA, 22 bp, Homo sapiens
ggctggcttgcggagtcacaga

SEQ ID NO: 9516900 - DNA, 22 bp, Homo sapiens
ggctggcttggtgagctgtcac

SEQ ID NO: 9516901 - DNA, 22 bp, Homo sapiens
ggctgggcaaacaagactcttc

SEQ ID NO: 9516902 - DNA, 22 bp, Homo sapiens
ggctgggcaaacaagactcttc

SEQ ID NO: 9516903 - DNA, 22 bp, Homo sapiens
ggctgggaggccgtgctgacct

SEQ ID NO: 9516904 - DNA, 22 bp, Homo sapiens
ggctgggaggccgtgctgacct

SEQ ID NO: 9516905 - DNA, 22 bp, Homo sapiens
ggcttctgctcagcctgcacgc

SEQ ID NO: 9516906 - DNA, 22 bp, Homo sapiens
ggcttctgctcagcctgcacgc

SEQ ID NO: 9516907 - DNA, 22 bp, Homo sapiens
ggcttctgccttgccagttctt

SEQ ID NO: 9516908 - DNA, 22 bp, Homo sapiens
ggcttctgctcagcctgcacgc

SEQ ID NO: 9516909 - DNA, 22 bp, Homo sapiens
ggcttctgccttgccagttctt

SEQ ID NO: 9516910 - DNA, 22 bp, Homo sapiens
ggcttctgccttgccagttctt

SEQ ID NO: 9516911 - DNA, 22 bp, Homo sapiens
ggcttctgccacgagagggaag

SEQ ID NO: 9516912 - DNA, 22 bp, Homo sapiens
ggcttctgccacgagagggaag

SEQ ID NO: 9516913 - DNA, 22 bp, Homo sapiens
ggcttctgtcctctggatctgt

SEQ ID NO: 9516914 - DNA, 18 bp, Homo sapiens
ggcttctgggacatttta

SEQ ID NO: 9516915 - DNA, 22 bp, Homo sapiens
ggcttctgagtgctctgctgtt

SEQ ID NO: 9516916 - DNA, 22 bp, Homo sapiens
ggcttctgagtgctctgctgtt

SEQ ID NO: 9516917 - DNA, 22 bp, Homo sapiens
ggcttctgaaccaggccctgga

SEQ ID NO: 9516918 - DNA, 22 bp, Homo sapiens
ggcttctgaaccaggccctgga

SEQ ID NO: 9516919 - DNA, 22 bp, Homo sapiens
ggcttctgaaatctctgtgcgt

SEQ ID NO: 9516920 - DNA, 22 bp, Homo sapiens
ggcttctgaaatctctgtgcgt

SEQ ID NO: 9516921 - DNA, 22 bp, Homo sapiens
ggcttctctgtctagtttctac

SEQ ID NO: 9516922 - DNA, 22 bp, Homo sapiens
ggcttctcccctttgagtcttc

SEQ ID NO: 9516923 - DNA, 22 bp, Homo sapiens
ggcttctcccttcttctgattg

SEQ ID NO: 9516924 - DNA, 22 bp, Homo sapiens
ggcttctcccctttgagtcttc

SEQ ID NO: 9516925 - DNA, 22 bp, Homo sapiens
ggcttctcccattcttcagggg

SEQ ID NO: 9516926 - DNA, 22 bp, Homo sapiens
ggctgggctcgctgattggctg

SEQ ID NO: 9516927 - DNA, 22 bp, Homo sapiens
ggctgggctccgggagcatgcg

SEQ ID NO: 9516928 - DNA, 22 bp, Homo sapiens
ggctgggctgcggctgtacctg

SEQ ID NO: 9516929 - DNA, 22 bp, Homo sapiens
ggctgggctgcggctgtacctg

SEQ ID NO: 9516930 - DNA, 22 bp, Homo sapiens
ggcttctccaggtactgagcat

SEQ ID NO: 9516931 - DNA, 22 bp, Homo sapiens
ggctgggcaggtctgcacaggg

SEQ ID NO: 9516932 - DNA, 22 bp, Homo sapiens
ggctgggcaggtctgcacaggg

SEQ ID NO: 9516933 - DNA, 22 bp, Homo sapiens
ggctgggcaggtctgcacaggg

SEQ ID NO: 9516934 - DNA, 21 bp, Homo sapiens
ggctgggcaggacccacccct

SEQ ID NO: 9516935 - DNA, 21 bp, Homo sapiens
ggctgggcaggacccacccct

SEQ ID NO: 9516936 - DNA, 22 bp, Homo sapiens
ggctgggccagggcctgtggac

SEQ ID NO: 9516937 - DNA, 22 bp, Homo sapiens
ggctgggccagggcctgtggac

SEQ ID NO: 9516938 - DNA, 22 bp, Homo sapiens
ggctgggccagggcctgtggac

SEQ ID NO: 9516939 - DNA, 22 bp, Homo sapiens
ggctgggcatccatccatgaga

SEQ ID NO: 9516940 - DNA, 22 bp, Homo sapiens
ggctgggcatccatccatgaga

SEQ ID NO: 9516941 - DNA, 19 bp, Homo sapiens
ggctgggccctgtttctcc

SEQ ID NO: 9516942 - DNA, 22 bp, Homo sapiens
ggctgggccgcggctacccaga

SEQ ID NO: 9516943 - DNA, 22 bp, Homo sapiens
ggctgggccgcggctacccaga

SEQ ID NO: 9516944 - DNA, 22 bp, Homo sapiens
ggctgggcctctccctcagctg

SEQ ID NO: 9516945 - DNA, 22 bp, Homo sapiens
ggctgggcctctccctcagctg

SEQ ID NO: 9516946 - DNA, 22 bp, Homo sapiens
ggctgggcctctccctcagctg

SEQ ID NO: 9516947 - DNA, 22 bp, Homo sapiens
ggctgggcctctccctcagctg

SEQ ID NO: 9516948 - DNA, 22 bp, Homo sapiens
ggctgggctccgggagcatgcg

SEQ ID NO: 9516949 - DNA, 22 bp, Homo sapiens
ggctgggctccgggagcatgcg

SEQ ID NO: 9516950 - DNA, 22 bp, Homo sapiens
ggctgggctccgggagcatgcg

SEQ ID NO: 9516951 - DNA, 22 bp, Homo sapiens
ggctgggctccgggagcatgcg

SEQ ID NO: 9516952 - DNA, 22 bp, Homo sapiens
ggcagaggtagctggaaccagg

SEQ ID NO: 9516953 - DNA, 22 bp, Homo sapiens
ggcagaggtagctggaaccagg

SEQ ID NO: 9516954 - DNA, 22 bp, Homo sapiens
ggcagaggtagctggaaccagg

SEQ ID NO: 9516955 - DNA, 22 bp, Homo sapiens
ggcagaggtagctggaaccagg

SEQ ID NO: 9516956 - DNA, 22 bp, Homo sapiens
ggcagaggtagctggaaccagg

SEQ ID NO: 9516957 - DNA, 20 bp, Homo sapiens
ggcagagggcctgggagaag

SEQ ID NO: 9516958 - DNA, 20 bp, Homo sapiens
ggcagagggcctgggagaag

SEQ ID NO: 9516959 - DNA, 20 bp, Homo sapiens
ggcagagggcctgggagaag

SEQ ID NO: 9516960 - DNA, 20 bp, Homo sapiens
ggcagagggcctgggagaag

SEQ ID NO: 9516961 - DNA, 22 bp, Homo sapiens
ggcaggaggtgagtggcgggtg

SEQ ID NO: 9516962 - DNA, 22 bp, Homo sapiens
ggcaggaggtgagtggcgggtg

SEQ ID NO: 9516963 - DNA, 22 bp, Homo sapiens
ggcaggagggcggacaatgacc

SEQ ID NO: 9516964 - DNA, 22 bp, Homo sapiens
ggcaggagggcggacaatgacc

SEQ ID NO: 9516965 - DNA, 22 bp, Homo sapiens
ggcaggaggaagagttagcacc

SEQ ID NO: 9516966 - DNA, 22 bp, Homo sapiens
ggcaggagggcggacaatgacc

SEQ ID NO: 9516967 - DNA, 22 bp, Homo sapiens
ggcaggagggcggacaatgacc

SEQ ID NO: 9516968 - DNA, 22 bp, Homo sapiens
ggcaggaggaagagttagcacc

SEQ ID NO: 9516969 - DNA, 22 bp, Homo sapiens
ggcagaggtagctggaaccagg

SEQ ID NO: 9516970 - DNA, 22 bp, Homo sapiens
ggcaggcaagtctgctctgtga

SEQ ID NO: 9516971 - DNA, 22 bp, Homo sapiens
ggcaggcaagtctgctctgtga

SEQ ID NO: 9516972 - DNA, 22 bp, Homo sapiens
ggcaggcaagtctgctctgtga

SEQ ID NO: 9516973 - DNA, 18 bp, Homo sapiens
ggcaggatttcaactttc

SEQ ID NO: 9516974 - DNA, 22 bp, Homo sapiens
ggcaggcaacggaccactagtc

SEQ ID NO: 9516975 - DNA, 22 bp, Homo sapiens
ggcaggcaaggcagcctggtga

SEQ ID NO: 9516976 - DNA, 22 bp, Homo sapiens
ggcaggcaccagctcagcaata

SEQ ID NO: 9516977 - DNA, 22 bp, Homo sapiens
ggcaggcaccagctcagcaata

SEQ ID NO: 9516978 - DNA, 22 bp, Homo sapiens
ggcaggcactgtgctaggcgct

SEQ ID NO: 9516979 - DNA, 22 bp, Homo sapiens
ggcaggcactgtgctaggcgct

SEQ ID NO: 9516980 - DNA, 22 bp, Homo sapiens
ggcaggcactgtgctaggcgct

SEQ ID NO: 9516981 - DNA, 22 bp, Homo sapiens
ggcaggcagaggctgagacagg

SEQ ID NO: 9516982 - DNA, 22 bp, Homo sapiens
ggcaggcagaaaaatagaatat

SEQ ID NO: 9516983 - DNA, 22 bp, Homo sapiens
ggcaggcactgtgttttgtgtt

SEQ ID NO: 9516984 - DNA, 22 bp, Homo sapiens
ggcagaggaagctggaagtggg

SEQ ID NO: 9516985 - DNA, 22 bp, Homo sapiens
ggcagaggaaggatgaattcac

SEQ ID NO: 9516986 - DNA, 23 bp, Homo sapiens
ggcaccaggccatggagcgggag

SEQ ID NO: 9516987 - DNA, 22 bp, Homo sapiens
ggcaccaggatcagtctgtcat

SEQ ID NO: 9516988 - DNA, 23 bp, Homo sapiens
ggcaccaggccatggagcgggag

SEQ ID NO: 9516989 - DNA, 23 bp, Homo sapiens
ggcaccaggccatggagcgggag

SEQ ID NO: 9516990 - DNA, 22 bp, Homo sapiens
ggcaccaggacatgactcccag

SEQ ID NO: 9516991 - DNA, 22 bp, Homo sapiens
ggcaccaggatcagtctgtcat

SEQ ID NO: 9516992 - DNA, 22 bp, Homo sapiens
ggcaccaggacatgactcccag

SEQ ID NO: 9516993 - DNA, 20 bp, Homo sapiens
ggcaccaggctaggattgga

SEQ ID NO: 9516994 - DNA, 20 bp, Homo sapiens
ggcaccaggctaggattgga

SEQ ID NO: 9516995 - DNA, 20 bp, Homo sapiens
ggcaccaggctaggattgga

SEQ ID NO: 9516996 - DNA, 22 bp, Homo sapiens
ggcaccaggctgggcataggcc

SEQ ID NO: 9516997 - DNA, 22 bp, Homo sapiens
ggcagaggagctggaaacatgg

SEQ ID NO: 9516998 - DNA, 22 bp, Homo sapiens
ggcagaggagctggaaacatgg

SEQ ID NO: 9516999 - DNA, 22 bp, Homo sapiens
ggcagaggagctggaaacatgg

SEQ ID NO: 9517000 - DNA, 22 bp, Homo sapiens
ggcagaggaggggtgaatttgc

SEQ ID NO: 9517001 - DNA, 22 bp, Homo sapiens
ggcagaggaggggtgaatttgc

SEQ ID NO: 9517002 - DNA, 20 bp, Homo sapiens
ggcagagggcctgggagaag

SEQ ID NO: 9517003 - DNA, 20 bp, Homo sapiens
ggcagagggcctgggagaag

SEQ ID NO: 9517004 - DNA, 22 bp, Homo sapiens
ggcacaggaatctgtgaagtgc

SEQ ID NO: 9517005 - DNA, 22 bp, Homo sapiens
ggcacaggaatctgtgaagtgc

SEQ ID NO: 9517006 - DNA, 22 bp, Homo sapiens
ggcacagctcaggtcccagctc

SEQ ID NO: 9517007 - DNA, 22 bp, Homo sapiens
ggcacagctgatgcagacacac

SEQ ID NO: 9517008 - DNA, 17 bp, Homo sapiens
ggcaccagacggagagt

SEQ ID NO: 9517009 - DNA, 17 bp, Homo sapiens
ggcaccagacggagagt

SEQ ID NO: 9517010 - DNA, 17 bp, Homo sapiens
ggcaccagacggagagt

SEQ ID NO: 9517011 - DNA, 22 bp, Homo sapiens
ggcaccagcacttgggatggct

SEQ ID NO: 9517012 - DNA, 22 bp, Homo sapiens
ggcaccagcacttgggatggct

SEQ ID NO: 9517013 - DNA, 22 bp, Homo sapiens
ggcaccagcacttgggatggct

SEQ ID NO: 9517014 - DNA, 22 bp, Homo sapiens
ggcaccagccacctatttctag

SEQ ID NO: 9517015 - DNA, 22 bp, Homo sapiens
ggcaccagccacctatttctag

SEQ ID NO: 9517016 - DNA, 22 bp, Homo sapiens
ggcaccagcaggcaccgatgcc

SEQ ID NO: 9517017 - DNA, 22 bp, Homo sapiens
ggcaccagcaggcaccgatgcc

SEQ ID NO: 9517018 - DNA, 22 bp, Homo sapiens
ggcacagcgactaccatcgaaa

SEQ ID NO: 9517019 - DNA, 22 bp, Homo sapiens
ggcacagctacttgctcactct

SEQ ID NO: 9517020 - DNA, 22 bp, Homo sapiens
ggcacagctacttgctcactct

SEQ ID NO: 9517021 - DNA, 22 bp, Homo sapiens
ggcacagctcaggtcccagctc

SEQ ID NO: 9517022 - DNA, 22 bp, Homo sapiens
ggcacagcgactaccatcgaaa

SEQ ID NO: 9517023 - DNA, 22 bp, Homo sapiens
ggcacagcgactaccatcgaaa

SEQ ID NO: 9517024 - DNA, 22 bp, Homo sapiens
ggcacagcgactaccatcgaaa

SEQ ID NO: 9517025 - DNA, 22 bp, Homo sapiens
ggcacagccctctctgtggaca

SEQ ID NO: 9517026 - DNA, 22 bp, Homo sapiens
ggcacagccctctctgtggaca

SEQ ID NO: 9517027 - DNA, 22 bp, Homo sapiens
ggcacagcaggagctatgtgaa

SEQ ID NO: 9517028 - DNA, 22 bp, Homo sapiens
ggcaacatgggaaaattaacct

SEQ ID NO: 9517029 - DNA, 22 bp, Homo sapiens
ggcaactcttcttgcaatgggg

SEQ ID NO: 9517030 - DNA, 22 bp, Homo sapiens
ggcaacctgagcttgtggagaa

SEQ ID NO: 9517031 - DNA, 21 bp, Homo sapiens
ggcaagaaacacaatcaagta

SEQ ID NO: 9517032 - DNA, 21 bp, Homo sapiens
ggcaagaaacacaatcaagta

SEQ ID NO: 9517033 - DNA, 22 bp, Homo sapiens
ggcaagagggcagatggagtgc

SEQ ID NO: 9517034 - DNA, 22 bp, Homo sapiens
ggcaagaaggcttcaggtagct

SEQ ID NO: 9517035 - DNA, 22 bp, Homo sapiens
ggcaaatattatctttgctggt

SEQ ID NO: 9517036 - DNA, 22 bp, Homo sapiens
ggcaaatattatctttgctggt

SEQ ID NO: 9517037 - DNA, 22 bp, Homo sapiens
ggcaacaactggacatagctgg

SEQ ID NO: 9517038 - DNA, 22 bp, Homo sapiens
ggcaacaactggacatagctgg

SEQ ID NO: 9517039 - DNA, 22 bp, Homo sapiens
ggcaaaggaaaacgtctcagct

SEQ ID NO: 9517040 - DNA, 22 bp, Homo sapiens
ggcaaaggaaaacgtctcagct

SEQ ID NO: 9517041 - DNA, 22 bp, Homo sapiens
ggcaaagcggccctgtggccag

SEQ ID NO: 9517042 - DNA, 22 bp, Homo sapiens
ggcaaaggaaccaggccacact

SEQ ID NO: 9517043 - DNA, 22 bp, Homo sapiens
ggcaagagggcagatggagtgc

SEQ ID NO: 9517044 - DNA, 22 bp, Homo sapiens
ggcaagaggtccaagaggtctc

SEQ ID NO: 9517045 - DNA, 22 bp, Homo sapiens
ggcaagagtgaggagtgtctct

SEQ ID NO: 9517046 - DNA, 22 bp, Homo sapiens
ggcaaggaagaagccatgatgt

SEQ ID NO: 9517047 - DNA, 22 bp, Homo sapiens
ggcaagagtgaggagtgtctct

SEQ ID NO: 9517048 - DNA, 20 bp, Homo sapiens
ggcaagcaactgagggagga

SEQ ID NO: 9517049 - DNA, 22 bp, Homo sapiens
ggcaagagttgaagctccagga

SEQ ID NO: 9517050 - DNA, 22 bp, Homo sapiens
ggcaaacaggagagtaaagaga

SEQ ID NO: 9517051 - DNA, 22 bp, Homo sapiens
ggcaaaaatcacccctggttca

SEQ ID NO: 9517052 - DNA, 22 bp, Homo sapiens
ggcaaaaatcacccctggttca

SEQ ID NO: 9517053 - DNA, 22 bp, Homo sapiens
ggcaaaaacagcaatgactttt

SEQ ID NO: 9517054 - DNA, 22 bp, Homo sapiens
ggagtgctccgcgagagggatg

SEQ ID NO: 9517055 - DNA, 22 bp, Homo sapiens
ggcaaaaaccacaattactttt

SEQ ID NO: 9517056 - DNA, 22 bp, Homo sapiens
ggcaaaaaccacaattactttt

SEQ ID NO: 9517057 - DNA, 22 bp, Homo sapiens
ggcaaaaacagcaatgactttt

SEQ ID NO: 9517058 - DNA, 22 bp, Homo sapiens
ggcaaaaacagcaatgactttt

SEQ ID NO: 9517059 - DNA, 22 bp, Homo sapiens
ggcaaaaaccataattactttt

SEQ ID NO: 9517060 - DNA, 22 bp, Homo sapiens
ggcaaaaaccacaattactttt

SEQ ID NO: 9517061 - DNA, 22 bp, Homo sapiens
ggcaaaaaccgcaataacttct

SEQ ID NO: 9517062 - DNA, 22 bp, Homo sapiens
ggcaaaaaccataattactttt

SEQ ID NO: 9517063 - DNA, 22 bp, Homo sapiens
ggcaaaaaccataattactttt

SEQ ID NO: 9517064 - DNA, 22 bp, Homo sapiens
ggcaaaaaccgcaataacttct

SEQ ID NO: 9517065 - DNA, 22 bp, Homo sapiens
ggcaaaaaccgcaataacttct

SEQ ID NO: 9517066 - DNA, 22 bp, Homo sapiens
ggcaaaaagttcccatcagtgt

SEQ ID NO: 9517067 - DNA, 22 bp, Homo sapiens
ggcaaaaagttcccatcagtgt

SEQ ID NO: 9517068 - DNA, 22 bp, Homo sapiens
ggagtgcagtggtgggatctca

SEQ ID NO: 9517069 - DNA, 22 bp, Homo sapiens
ggagtgcagtggcgtgagctcg

SEQ ID NO: 9517070 - DNA, 22 bp, Homo sapiens
ggagtgcagctcacaggacatc

SEQ ID NO: 9517071 - DNA, 23 bp, Homo sapiens
ggagtgcaatggcgccatctcgg

SEQ ID NO: 9517072 - DNA, 22 bp, Homo sapiens
ggagtgagtggccttgtcactg

SEQ ID NO: 9517073 - DNA, 23 bp, Homo sapiens
ggagtgcaatggcgccatctcgg

SEQ ID NO: 9517074 - DNA, 22 bp, Homo sapiens
ggagtgagtactggagtagctg

SEQ ID NO: 9517075 - DNA, 22 bp, Homo sapiens
ggagtgagtactggagtagctg

SEQ ID NO: 9517076 - DNA, 22 bp, Homo sapiens
ggagtgagtactggagtagctg

SEQ ID NO: 9517077 - DNA, 22 bp, Homo sapiens
ggagtgagtactggagtagctg

SEQ ID NO: 9517078 - DNA, 22 bp, Homo sapiens
ggagtgagtggccttgtcactg

SEQ ID NO: 9517079 - DNA, 22 bp, Homo sapiens
ggagtctgactctgaccctgga

SEQ ID NO: 9517080 - DNA, 22 bp, Homo sapiens
ggagtctgacccttagagatga

SEQ ID NO: 9517081 - DNA, 22 bp, Homo sapiens
ggagtccctgtccccatacgag

SEQ ID NO: 9517082 - DNA, 22 bp, Homo sapiens
ggagtcctggactccatctcac

SEQ ID NO: 9517083 - DNA, 22 bp, Homo sapiens
ggagtccatgcagcttgagaca

SEQ ID NO: 9517084 - DNA, 22 bp, Homo sapiens
ggagtccatgcagcttgagaca

SEQ ID NO: 9517085 - DNA, 22 bp, Homo sapiens
ggagtccaacgtgcagccagga

SEQ ID NO: 9517086 - DNA, 22 bp, Homo sapiens
ggagtgagcaaatagagatttg

SEQ ID NO: 9517087 - DNA, 22 bp, Homo sapiens
ggagtgaggcatttgtagctga

SEQ ID NO: 9517088 - DNA, 22 bp, Homo sapiens
ggagtgaggcatttgtagctga

SEQ ID NO: 9517089 - DNA, 21 bp, Homo sapiens
ggagtctgaggaagaaaactg

SEQ ID NO: 9517090 - DNA, 22 bp, Homo sapiens
ggagtctgatactgagttcctc

SEQ ID NO: 9517091 - DNA, 22 bp, Homo sapiens
ggagtctgatactgagttcctc

SEQ ID NO: 9517092 - DNA, 19 bp, Homo sapiens
ggagtctgagcccaggtat

SEQ ID NO: 9517093 - DNA, 19 bp, Homo sapiens
ggagtctgagcccaggtat

SEQ ID NO: 9517094 - DNA, 19 bp, Homo sapiens
ggagtctgagcccaggtat

SEQ ID NO: 9517095 - DNA, 22 bp, Homo sapiens
ggagtctgagtcctcatagaca

SEQ ID NO: 9517096 - DNA, 22 bp, Homo sapiens
ggagtctgagtcctcatagaca

SEQ ID NO: 9517097 - DNA, 22 bp, Homo sapiens
ggagtctgagcttgtgtcctgg

SEQ ID NO: 9517098 - DNA, 22 bp, Homo sapiens
ggagtcaccaagtaggagtctt

SEQ ID NO: 9517099 - DNA, 22 bp, Homo sapiens
ggagtcacacaggaagaaggac

SEQ ID NO: 9517100 - DNA, 20 bp, Homo sapiens
ggagtcaccaagagagaccc

SEQ ID NO: 9517101 - DNA, 22 bp, Homo sapiens
ggagtcaccaagtaggagtctt

SEQ ID NO: 9517102 - DNA, 22 bp, Homo sapiens
ggagtcacctgggaggactggg

SEQ ID NO: 9517103 - DNA, 22 bp, Homo sapiens
ggagtcagaatggcagggtggt

SEQ ID NO: 9517104 - DNA, 22 bp, Homo sapiens
ggagtcagaatggcagggtggt

SEQ ID NO: 9517105 - DNA, 22 bp, Homo sapiens
ggagtcagaatggcagggtggt

SEQ ID NO: 9517106 - DNA, 22 bp, Homo sapiens
ggagtcagaacccaggcttcta

SEQ ID NO: 9517107 - DNA, 22 bp, Homo sapiens
ggagtcagaacccaggcttcta

SEQ ID NO: 9517108 - DNA, 22 bp, Homo sapiens
ggagtcagcctgtcagagtgta

SEQ ID NO: 9517109 - DNA, 22 bp, Homo sapiens
ggagtcagcctgtcagagtgta

SEQ ID NO: 9517110 - DNA, 22 bp, Homo sapiens
ggagtcagcctgtcagagtgta

SEQ ID NO: 9517111 - DNA, 22 bp, Homo sapiens
ggagtcagcctgtcagagtgta

SEQ ID NO: 9517112 - DNA, 22 bp, Homo sapiens
ggagtcagaggaaggcttgctc

SEQ ID NO: 9517113 - DNA, 21 bp, Homo sapiens
ggagtcagggtctggctgggg

SEQ ID NO: 9517114 - DNA, 21 bp, Homo sapiens
ggagtcagggtctggctgggg

SEQ ID NO: 9517115 - DNA, 22 bp, Homo sapiens
ggagtcaggcagacctagttat

SEQ ID NO: 9517116 - DNA, 22 bp, Homo sapiens
ggagtcaggagcaggctgggct

SEQ ID NO: 9517117 - DNA, 22 bp, Homo sapiens
ggagtcaggatcctggggatgg

SEQ ID NO: 9517118 - DNA, 22 bp, Homo sapiens
ggagtcacacagagaagataag

SEQ ID NO: 9517119 - DNA, 22 bp, Homo sapiens
ggagtcaaggaaggctctgtga

SEQ ID NO: 9517120 - DNA, 19 bp, Homo sapiens
ggagccagctgtggaaggc

SEQ ID NO: 9517121 - DNA, 19 bp, Homo sapiens
ggagccagctgtggaaggc

SEQ ID NO: 9517122 - DNA, 19 bp, Homo sapiens
ggagccagctgtggaaggc

SEQ ID NO: 9517123 - DNA, 19 bp, Homo sapiens
ggagccagctgtggaaggc

SEQ ID NO: 9517124 - DNA, 22 bp, Homo sapiens
ggagccagctccctccttgtga

SEQ ID NO: 9517125 - DNA, 23 bp, Homo sapiens
ggagccagcctgtggggagcggg

SEQ ID NO: 9517126 - DNA, 22 bp, Homo sapiens
ggagccagcagggtgacactga

SEQ ID NO: 9517127 - DNA, 22 bp, Homo sapiens
ggagccagcagggtgacactga

SEQ ID NO: 9517128 - DNA, 22 bp, Homo sapiens
ggagccagcagggtgacactga

SEQ ID NO: 9517129 - DNA, 22 bp, Homo sapiens
ggagccagcagggtgacactga

SEQ ID NO: 9517130 - DNA, 22 bp, Homo sapiens
ggagccagagtttaatgtggag

SEQ ID NO: 9517131 - DNA, 22 bp, Homo sapiens
ggagccagattgtataaaaaag

SEQ ID NO: 9517132 - DNA, 22 bp, Homo sapiens
ggagccagagtttaatgtggag

SEQ ID NO: 9517133 - DNA, 22 bp, Homo sapiens
ggagccagagtctgcagtgtaa

SEQ ID NO: 9517134 - DNA, 22 bp, Homo sapiens
ggagccagagggatgcagttga

SEQ ID NO: 9517135 - DNA, 22 bp, Homo sapiens
ggagccagagtctgcagtgtaa

SEQ ID NO: 9517136 - DNA, 22 bp, Homo sapiens
ggagccagaggctgctgctgtg

SEQ ID NO: 9517137 - DNA, 22 bp, Homo sapiens
ggagccagaggctgctgctgtg

SEQ ID NO: 9517138 - DNA, 22 bp, Homo sapiens
ggagccagagcactggggagcc

SEQ ID NO: 9517139 - DNA, 22 bp, Homo sapiens
ggagccagagcactggggagcc

SEQ ID NO: 9517140 - DNA, 22 bp, Homo sapiens
ggagccagaggctgctgctgtg

SEQ ID NO: 9517141 - DNA, 22 bp, Homo sapiens
ggcaggtggattttctactcta

SEQ ID NO: 9517142 - DNA, 22 bp, Homo sapiens
ggcaggtggaagttggcagagc

SEQ ID NO: 9517143 - DNA, 22 bp, Homo sapiens
ggcaggtggacgtgctaaagct

SEQ ID NO: 9517144 - DNA, 22 bp, Homo sapiens
ggcaggcagaggctgagacagg

SEQ ID NO: 9517145 - DNA, 22 bp, Homo sapiens
ggcaggcagaggctgagacagg

SEQ ID NO: 9517146 - DNA, 22 bp, Homo sapiens
ggcaggcagaggctgagacagg

SEQ ID NO: 9517147 - DNA, 22 bp, Homo sapiens
ggcaggtggaagttggcagagc

SEQ ID NO: 9517148 - DNA, 22 bp, Homo sapiens
ggcaggtggaagttggcagagc

SEQ ID NO: 9517149 - DNA, 22 bp, Homo sapiens
ggcaggcagaggctgagacagg

SEQ ID NO: 9517150 - DNA, 22 bp, Homo sapiens
ggcaggtggaagttggcagagc

SEQ ID NO: 9517151 - DNA, 21 bp, Homo sapiens
ggcaggtgggtctctgttgct

SEQ ID NO: 9517152 - DNA, 22 bp, Homo sapiens
ggcaggtggccaagtgtctaag

SEQ ID NO: 9517153 - DNA, 22 bp, Homo sapiens
ggcaggtggccaagtgtctaag

SEQ ID NO: 9517154 - DNA, 22 bp, Homo sapiens
ggcaggtggccaagtgtctaag

SEQ ID NO: 9517155 - DNA, 22 bp, Homo sapiens
ggcaggtggcactgctgctccc

SEQ ID NO: 9517156 - DNA, 22 bp, Homo sapiens
ggcaggtggcactgctgctccc

SEQ ID NO: 9517157 - DNA, 22 bp, Homo sapiens
ggcaggtgtgagatcgaggcca

SEQ ID NO: 9517158 - DNA, 22 bp, Homo sapiens
ggcagtcacttttgcttgtgcc

SEQ ID NO: 9517159 - DNA, 22 bp, Homo sapiens
ggcaggtggtaaggatttcata

SEQ ID NO: 9517160 - DNA, 22 bp, Homo sapiens
ggcaggtggtaaggatttcata

SEQ ID NO: 9517161 - DNA, 21 bp, Homo sapiens
ggcaggtgggtctctgttgct

SEQ ID NO: 9517162 - DNA, 22 bp, Homo sapiens
ggcaggtggtaaggatttcata

SEQ ID NO: 9517163 - DNA, 22 bp, Homo sapiens
ggcagtcagtgtggttcataaa

SEQ ID NO: 9517164 - DNA, 22 bp, Homo sapiens
ggcagtcccagcccagaggcgc

SEQ ID NO: 9517165 - DNA, 21 bp, Homo sapiens
ggcatggcacctctgggcagg

SEQ ID NO: 9517166 - DNA, 21 bp, Homo sapiens
ggcatggcacctctgggcagg

SEQ ID NO: 9517167 - DNA, 22 bp, Homo sapiens
ggcatgggccgaggtgcctcct

SEQ ID NO: 9517168 - DNA, 22 bp, Homo sapiens
ggcatgggccgaggtgcctcct

SEQ ID NO: 9517169 - DNA, 22 bp, Homo sapiens
ggcatgggccgaggtgcctcct

SEQ ID NO: 9517170 - DNA, 22 bp, Homo sapiens
ggcatgggccgaggtgcctcct

SEQ ID NO: 9517171 - DNA, 22 bp, Homo sapiens
ggcatggggtgtatgtggcacg

SEQ ID NO: 9517172 - DNA, 22 bp, Homo sapiens
ggcatggggtgtatgtggcacg

SEQ ID NO: 9517173 - DNA, 22 bp, Homo sapiens
ggcatggggtgtatgtggcacg

SEQ ID NO: 9517174 - DNA, 22 bp, Homo sapiens
ggcagtgaacagaaatgcagaa

SEQ ID NO: 9517175 - DNA, 22 bp, Homo sapiens
ggcagtgaaaaagtatgtttcc

SEQ ID NO: 9517176 - DNA, 22 bp, Homo sapiens
ggcagtgaacagaaatgcagaa

SEQ ID NO: 9517177 - DNA, 19 bp, Homo sapiens
ggcagtctcaagcagcaca

SEQ ID NO: 9517178 - DNA, 22 bp, Homo sapiens
ggcagtctagctaggatgtcac

SEQ ID NO: 9517179 - DNA, 22 bp, Homo sapiens
ggcagtctttcccttgagctct

SEQ ID NO: 9517180 - DNA, 22 bp, Homo sapiens
ggcagtgaatgaaacagaggct

SEQ ID NO: 9517181 - DNA, 22 bp, Homo sapiens
ggcagtgaatctgagagcctgg

SEQ ID NO: 9517182 - DNA, 22 bp, Homo sapiens
ggcagtgaatgaaacagaggct

SEQ ID NO: 9517183 - DNA, 22 bp, Homo sapiens
ggcagtgaatgaaacagaggct

SEQ ID NO: 9517184 - DNA, 22 bp, Homo sapiens
ggcatggacgtctctgaggcca

SEQ ID NO: 9517185 - DNA, 22 bp, Homo sapiens
ggcatggacgtctctgaggcca

SEQ ID NO: 9517186 - DNA, 22 bp, Homo sapiens
ggcatggacgtctctgaggcca

SEQ ID NO: 9517187 - DNA, 22 bp, Homo sapiens
ggccaattccaggagccggcgg

SEQ ID NO: 9517188 - DNA, 22 bp, Homo sapiens
ggccaaggtgttctgatatgcc

SEQ ID NO: 9517189 - DNA, 22 bp, Homo sapiens
ggccacactctggtagaggtga

SEQ ID NO: 9517190 - DNA, 22 bp, Homo sapiens
ggccacacggagaggctggtct

SEQ ID NO: 9517191 - DNA, 21 bp, Homo sapiens
ggccacaagcggaggagccgc

SEQ ID NO: 9517192 - DNA, 21 bp, Homo sapiens
ggccacaagcggaggagccgc

SEQ ID NO: 9517193 - DNA, 22 bp, Homo sapiens
ggccacagaacagctacaggac

SEQ ID NO: 9517194 - DNA, 22 bp, Homo sapiens
ggccacagaacagctacaggac

SEQ ID NO: 9517195 - DNA, 22 bp, Homo sapiens
ggccacagaacagctacaggac

SEQ ID NO: 9517196 - DNA, 22 bp, Homo sapiens
ggccacagaacagctacaggac

SEQ ID NO: 9517197 - DNA, 22 bp, Homo sapiens
ggccaaggtggagaaggcactg

SEQ ID NO: 9517198 - DNA, 22 bp, Homo sapiens
ggcatgtgcctgaggtcacaca

SEQ ID NO: 9517199 - DNA, 22 bp, Homo sapiens
ggcatgtgttgggaacagcatg

SEQ ID NO: 9517200 - DNA, 22 bp, Homo sapiens
ggcattaactctgtttcaattt

SEQ ID NO: 9517201 - DNA, 22 bp, Homo sapiens
ggcattaagaatatcattaaaa

SEQ ID NO: 9517202 - DNA, 22 bp, Homo sapiens
ggcatgtgcctgaggtcacaca

SEQ ID NO: 9517203 - DNA, 22 bp, Homo sapiens
ggcatggtggtacacatctgta

SEQ ID NO: 9517204 - DNA, 18 bp, Homo sapiens
ggcatgtgagtgctgagg

SEQ ID NO: 9517205 - DNA, 18 bp, Homo sapiens
ggcatgtgagtgctgagg

SEQ ID NO: 9517206 - DNA, 20 bp, Homo sapiens
ggcatgggtggggctcccag

SEQ ID NO: 9517207 - DNA, 22 bp, Homo sapiens
ggcatggggtgtatgtggcacg

SEQ ID NO: 9517208 - DNA, 22 bp, Homo sapiens
ggccagtggctctgtgcttggg

SEQ ID NO: 9517209 - DNA, 22 bp, Homo sapiens
ggccagtgtgcaggtcagagat

SEQ ID NO: 9517210 - DNA, 22 bp, Homo sapiens
ggccagtctgggccacggtcgg

SEQ ID NO: 9517211 - DNA, 22 bp, Homo sapiens
ggccagtgaccagtaaccagtg

SEQ ID NO: 9517212 - DNA, 22 bp, Homo sapiens
ggccagtctgggccacggtcgg

SEQ ID NO: 9517213 - DNA, 22 bp, Homo sapiens
ggccagtcccctaatccagggc

SEQ ID NO: 9517214 - DNA, 22 bp, Homo sapiens
ggccaggttgggtggaagtggc

SEQ ID NO: 9517215 - DNA, 22 bp, Homo sapiens
ggccatgcctgtgggtgcaggc

SEQ ID NO: 9517216 - DNA, 22 bp, Homo sapiens
ggccatgcctggtctggcacca

SEQ ID NO: 9517217 - DNA, 19 bp, Homo sapiens
ggccatctctgccccagca

SEQ ID NO: 9517218 - DNA, 21 bp, Homo sapiens
ggccatcctgggaagggctgc

SEQ ID NO: 9517219 - DNA, 19 bp, Homo sapiens
ggccatctctgccccagca

SEQ ID NO: 9517220 - DNA, 22 bp, Homo sapiens
ggccaggtggctgtcctggcgt

SEQ ID NO: 9517221 - DNA, 22 bp, Homo sapiens
ggccaggtgcggtggctcacac

SEQ ID NO: 9517222 - DNA, 22 bp, Homo sapiens
ggccaggtccagtggaaggccc

SEQ ID NO: 9517223 - DNA, 23 bp, Homo sapiens
ggccaggtgcaccttagagagcc

SEQ ID NO: 9517224 - DNA, 22 bp, Homo sapiens
ggccaggtaagagtgcagccgc

SEQ ID NO: 9517225 - DNA, 22 bp, Homo sapiens
ggccagggcctggggactgtcc

SEQ ID NO: 9517226 - DNA, 22 bp, Homo sapiens
ggccagggcctggggactgtcc

SEQ ID NO: 9517227 - DNA, 22 bp, Homo sapiens
ggccagggcctggggactgtcc

SEQ ID NO: 9517228 - DNA, 22 bp, Homo sapiens
ggccagggcctggggactgtcc

SEQ ID NO: 9517229 - DNA, 22 bp, Homo sapiens
ggccagggggcttcagactcca

SEQ ID NO: 9517230 - DNA, 22 bp, Homo sapiens
ggccagggggcttcagactcca

SEQ ID NO: 9517231 - DNA, 19 bp, Homo sapiens
ggccaggctgactgtggtc

SEQ ID NO: 9517232 - DNA, 19 bp, Homo sapiens
ggccaggctgactgtggtc

SEQ ID NO: 9517233 - DNA, 19 bp, Homo sapiens
ggccaggctgactgtggtc

SEQ ID NO: 9517234 - DNA, 22 bp, Homo sapiens
ggccagggcctggggactgtcc

SEQ ID NO: 9517235 - DNA, 20 bp, Homo sapiens
ggccttgggtttcgcctgtt

SEQ ID NO: 9517236 - DNA, 22 bp, Homo sapiens
ggccttggtaaattggcatttg

SEQ ID NO: 9517237 - DNA, 22 bp, Homo sapiens
ggccttggtaaagggatgcatg

SEQ ID NO: 9517238 - DNA, 22 bp, Homo sapiens
ggccttggtgccatggccagtt

SEQ ID NO: 9517239 - DNA, 22 bp, Homo sapiens
ggccttgggctggctgcagtat

SEQ ID NO: 9517240 - DNA, 22 bp, Homo sapiens
ggccttgggtataggtgggtat

SEQ ID NO: 9517241 - DNA, 22 bp, Homo sapiens
ggccttggggtggccttgtccc

SEQ ID NO: 9517242 - DNA, 22 bp, Homo sapiens
ggcgctggccacggtggctctg

SEQ ID NO: 9517243 - DNA, 20 bp, Homo sapiens
ggcgagctgggctctgtgca

SEQ ID NO: 9517244 - DNA, 22 bp, Homo sapiens
ggcgagcagcgctgtgtcaggt

SEQ ID NO: 9517245 - DNA, 22 bp, Homo sapiens
ggcgagcagagcactgccagga

SEQ ID NO: 9517246 - DNA, 22 bp, Homo sapiens
ggcctttagtggttctggagtc

SEQ ID NO: 9517247 - DNA, 22 bp, Homo sapiens
ggccttttgtgtccttgcccgt

SEQ ID NO: 9517248 - DNA, 22 bp, Homo sapiens
ggccttggttctgtcacagccg

SEQ ID NO: 9517249 - DNA, 22 bp, Homo sapiens
ggcctgaatgcctgagtgtggg

SEQ ID NO: 9517250 - DNA, 22 bp, Homo sapiens
ggcctcttatctggctcctgca

SEQ ID NO: 9517251 - DNA, 22 bp, Homo sapiens
ggcctcttctgctcatactttc

SEQ ID NO: 9517252 - DNA, 22 bp, Homo sapiens
ggcctgaaataaagtagcagaa

SEQ ID NO: 9517253 - DNA, 21 bp, Homo sapiens
ggcctgaaaaagtgaatgctt

SEQ ID NO: 9517254 - DNA, 22 bp, Homo sapiens
ggcctgaaatagctctgaggtt

SEQ ID NO: 9517255 - DNA, 22 bp, Homo sapiens
ggcctgagaatgtaccagatct

SEQ ID NO: 9517256 - DNA, 22 bp, Homo sapiens
ggcctgaggcgtcccagctgtg

SEQ ID NO: 9517257 - DNA, 22 bp, Homo sapiens
ggcctgcacagaggtggctcta

SEQ ID NO: 9517258 - DNA, 20 bp, Homo sapiens
ggcctgcagctcccagcaag

SEQ ID NO: 9517259 - DNA, 18 bp, Homo sapiens
ggcctgcagtgaagcaag

SEQ ID NO: 9517260 - DNA, 22 bp, Homo sapiens
ggccttgggatgtggctgcagc

SEQ ID NO: 9517261 - DNA, 22 bp, Homo sapiens
ggcctgagtcacatcaggagag

SEQ ID NO: 9517262 - DNA, 22 bp, Homo sapiens
ggccatgctgttgcctgctggt

SEQ ID NO: 9517263 - DNA, 22 bp, Homo sapiens
ggccatggaccccgagctgacc

SEQ ID NO: 9517264 - DNA, 19 bp, Homo sapiens
ggccatggcgggggtcaca

SEQ ID NO: 9517265 - DNA, 22 bp, Homo sapiens
ggccatggaccccgagctgacc

SEQ ID NO: 9517266 - DNA, 22 bp, Homo sapiens
ggcctcagaccggagctggcca

SEQ ID NO: 9517267 - DNA, 22 bp, Homo sapiens
ggcctcagaccggagctggcca

SEQ ID NO: 9517268 - DNA, 23 bp, Homo sapiens
ggcctcagcgcacagaaactgct

SEQ ID NO: 9517269 - DNA, 23 bp, Homo sapiens
ggcctcagcgcacagaaactgct

SEQ ID NO: 9517270 - DNA, 18 bp, Homo sapiens
ggcctcagcctggccgga

SEQ ID NO: 9517271 - DNA, 22 bp, Homo sapiens
ggcctcagggttgggcccatta

SEQ ID NO: 9517272 - DNA, 23 bp, Homo sapiens
ggcctcagcgcacagaaactgct

SEQ ID NO: 9517273 - DNA, 21 bp, Homo sapiens
ggcctcagccacctggctctg

SEQ ID NO: 9517274 - DNA, 21 bp, Homo sapiens
ggcctcagccacctggctctg

SEQ ID NO: 9517275 - DNA, 18 bp, Homo sapiens
ggcctcagcctggccgga

SEQ ID NO: 9517276 - DNA, 21 bp, Homo sapiens
ggcctcagccacctggctctg

SEQ ID NO: 9517277 - DNA, 22 bp, Homo sapiens
ggcctcagaggaggtgtgagtc

SEQ ID NO: 9517278 - DNA, 22 bp, Homo sapiens
ggcctcagaggaggtgtgagtc

SEQ ID NO: 9517279 - DNA, 22 bp, Homo sapiens
ggcctcagaggaggtgtgagtc

SEQ ID NO: 9517280 - DNA, 22 bp, Homo sapiens
ggcctcagtttctccatgggtt

SEQ ID NO: 9517281 - DNA, 22 bp, Homo sapiens
ggcctcagtgggccgctgcagg

SEQ ID NO: 9517282 - DNA, 22 bp, Homo sapiens
ggcctcagtgggccgctgcagg

SEQ ID NO: 9517283 - DNA, 23 bp, Homo sapiens
ggcctcagtgatgatgggttaaa

SEQ ID NO: 9517284 - DNA, 22 bp, Homo sapiens
ggcctcagggttgggcccatta

SEQ ID NO: 9517285 - DNA, 22 bp, Homo sapiens
ggcctcagggttgggcccatta

SEQ ID NO: 9517286 - DNA, 22 bp, Homo sapiens
ggcctctggttcacagggagga

SEQ ID NO: 9517287 - DNA, 22 bp, Homo sapiens
ggcctctggttcgtggtgacct

SEQ ID NO: 9517288 - DNA, 21 bp, Homo sapiens
ggcctctgtcatcctgggaag

SEQ ID NO: 9517289 - DNA, 23 bp, Homo sapiens
ggcctctgtgttctgcccacatg

SEQ ID NO: 9517290 - DNA, 21 bp, Homo sapiens
ggcctctgtcatcctgggaag

SEQ ID NO: 9517291 - DNA, 22 bp, Homo sapiens
ggcctctggttcgtggtgacct

SEQ ID NO: 9517292 - DNA, 22 bp, Homo sapiens
ggcctctggttcgtggtgacct

SEQ ID NO: 9517293 - DNA, 22 bp, Homo sapiens
ggcctcttatctggctcctgca

SEQ ID NO: 9517294 - DNA, 22 bp, Homo sapiens
ggcctctgtttggagccaggat

SEQ ID NO: 9517295 - DNA, 23 bp, Homo sapiens
ggcctctgtgttctgcccacatg

SEQ ID NO: 9517296 - DNA, 22 bp, Homo sapiens
ggcctctgtttggagccaggat

SEQ ID NO: 9517297 - DNA, 22 bp, Homo sapiens
ggcctctgttctgcattcctcc

SEQ ID NO: 9517298 - DNA, 22 bp, Homo sapiens
gccctggatggcaggagccatc

SEQ ID NO: 9517299 - DNA, 22 bp, Homo sapiens
gccctggatggcaggagccatc

SEQ ID NO: 9517300 - DNA, 22 bp, Homo sapiens
gccctggatggcaggagccatc

SEQ ID NO: 9517301 - DNA, 22 bp, Homo sapiens
gccctggatgctcatggcatca

SEQ ID NO: 9517302 - DNA, 22 bp, Homo sapiens
gccctggatgctcatggcatca

SEQ ID NO: 9517303 - DNA, 22 bp, Homo sapiens
gccctggatgtacaggcatgtt

SEQ ID NO: 9517304 - DNA, 22 bp, Homo sapiens
gccctggatgtacaggcatgtt

SEQ ID NO: 9517305 - DNA, 22 bp, Homo sapiens
gccctggcacctcgttgcccag

SEQ ID NO: 9517306 - DNA, 22 bp, Homo sapiens
gccctggatgtacaggcatgtt

SEQ ID NO: 9517307 - DNA, 22 bp, Homo sapiens
gccctggatgtacaggcatgtt

SEQ ID NO: 9517308 - DNA, 22 bp, Homo sapiens
gccctggccttcatctcagaca

SEQ ID NO: 9517309 - DNA, 22 bp, Homo sapiens
gccctgtgcttggatggcagat

SEQ ID NO: 9517310 - DNA, 22 bp, Homo sapiens
gccctgtgcttggatggcagat

SEQ ID NO: 9517311 - DNA, 22 bp, Homo sapiens
gccctgtgcttggatggcagat

SEQ ID NO: 9517312 - DNA, 22 bp, Homo sapiens
gccctgtgctcatgggaacatc

SEQ ID NO: 9517313 - DNA, 22 bp, Homo sapiens
gccctgtgctataggttagggc

SEQ ID NO: 9517314 - DNA, 22 bp, Homo sapiens
gccctgtgcgctgagttcaggg

SEQ ID NO: 9517315 - DNA, 22 bp, Homo sapiens
gccctgtgcgctgagttcaggg

SEQ ID NO: 9517316 - DNA, 22 bp, Homo sapiens
gccctgtggccccagtgggctc

SEQ ID NO: 9517317 - DNA, 22 bp, Homo sapiens
gccctgtggattaatgagcagg

SEQ ID NO: 9517318 - DNA, 22 bp, Homo sapiens
gccctgtggattaatgagcagg

SEQ ID NO: 9517319 - DNA, 22 bp, Homo sapiens
gccctgtggacccaggaactct

SEQ ID NO: 9517320 - DNA, 22 bp, Homo sapiens
gccctgtggacagtgagaagtg

SEQ ID NO: 9517321 - DNA, 22 bp, Homo sapiens
gccctgtggacagtgagaagtg

SEQ ID NO: 9517322 - DNA, 22 bp, Homo sapiens
gccctgtggacccaggaactct

SEQ ID NO: 9517323 - DNA, 22 bp, Homo sapiens
gccctgtggacagtgagaagtg

SEQ ID NO: 9517324 - DNA, 22 bp, Homo sapiens
gccctgtgccagtcacgctgtg

SEQ ID NO: 9517325 - DNA, 22 bp, Homo sapiens
gccctgtgccagtcacgctgtg

SEQ ID NO: 9517326 - DNA, 22 bp, Homo sapiens
gccctgtgccagtcacgctgtg

SEQ ID NO: 9517327 - DNA, 22 bp, Homo sapiens
gccctgtgcgactctagaggtt

SEQ ID NO: 9517328 - DNA, 22 bp, Homo sapiens
gccctgtgcgactctagaggtt

SEQ ID NO: 9517329 - DNA, 22 bp, Homo sapiens
gccctgggattgggtggaggct

SEQ ID NO: 9517330 - DNA, 22 bp, Homo sapiens
gccctgggcaaggttctggcca

SEQ ID NO: 9517331 - DNA, 22 bp, Homo sapiens
gccctgggcaaggttctggcca

SEQ ID NO: 9517332 - DNA, 22 bp, Homo sapiens
gccctgggcaaggttctggcca

SEQ ID NO: 9517333 - DNA, 22 bp, Homo sapiens
gccccagctctgccacaactag

SEQ ID NO: 9517334 - DNA, 22 bp, Homo sapiens
gccctggagctagactaggaca

SEQ ID NO: 9517335 - DNA, 22 bp, Homo sapiens
gccctggagggccagcgactgg

SEQ ID NO: 9517336 - DNA, 22 bp, Homo sapiens
gccctggagctagactaggaca

SEQ ID NO: 9517337 - DNA, 17 bp, Homo sapiens
gccctggagccaggcta

SEQ ID NO: 9517338 - DNA, 17 bp, Homo sapiens
gccctggagccaggcta

SEQ ID NO: 9517339 - DNA, 17 bp, Homo sapiens
gccctggagccaggcta

SEQ ID NO: 9517340 - DNA, 17 bp, Homo sapiens
gccctggagccaggcta

SEQ ID NO: 9517341 - DNA, 17 bp, Homo sapiens
gccctggagccaggcta

SEQ ID NO: 9517342 - DNA, 22 bp, Homo sapiens
gccccaggggaggtgccctgca

SEQ ID NO: 9517343 - DNA, 22 bp, Homo sapiens
gccctggagagggatatggcat

SEQ ID NO: 9517344 - DNA, 22 bp, Homo sapiens
gccccagccaaggtgacacgaa

SEQ ID NO: 9517345 - DNA, 22 bp, Homo sapiens
gccccagcagcaatgcggttga

SEQ ID NO: 9517346 - DNA, 22 bp, Homo sapiens
gccccagccaaggtgacacgaa

SEQ ID NO: 9517347 - DNA, 22 bp, Homo sapiens
gccccagccaaggtgacacgaa

SEQ ID NO: 9517348 - DNA, 22 bp, Homo sapiens
gccccagaaagttcaaggcaca

SEQ ID NO: 9517349 - DNA, 22 bp, Homo sapiens
gccccagaaagttcaaggcaca

SEQ ID NO: 9517350 - DNA, 22 bp, Homo sapiens
gccccagaaagttcaaggcaca

SEQ ID NO: 9517351 - DNA, 22 bp, Homo sapiens
gccccagatggaggaagctggg

SEQ ID NO: 9517352 - DNA, 22 bp, Homo sapiens
gccccagatggaggaagctggg

SEQ ID NO: 9517353 - DNA, 22 bp, Homo sapiens
gccccagacataagtagggggt

SEQ ID NO: 9517354 - DNA, 22 bp, Homo sapiens
gccccagaaggggaaagcctgg

SEQ ID NO: 9517355 - DNA, 22 bp, Homo sapiens
gccccagacataagtagggggt

SEQ ID NO: 9517356 - DNA, 22 bp, Homo sapiens
gccccagccaaggtgacacgaa

SEQ ID NO: 9517357 - DNA, 22 bp, Homo sapiens
gccccagccctgtggaccatgg

SEQ ID NO: 9517358 - DNA, 22 bp, Homo sapiens
gccccagcctcccgagtagctg

SEQ ID NO: 9517359 - DNA, 22 bp, Homo sapiens
gccccagcctcccgagtagctg

SEQ ID NO: 9517360 - DNA, 22 bp, Homo sapiens
gccccagcctcccgagtagctg

SEQ ID NO: 9517361 - DNA, 22 bp, Homo sapiens
gcctccggagttgcagtgtctt

SEQ ID NO: 9517362 - DNA, 22 bp, Homo sapiens
gcctccggagttgcagtgtctt

SEQ ID NO: 9517363 - DNA, 22 bp, Homo sapiens
gcctccggagtcacagtgtctt

SEQ ID NO: 9517364 - DNA, 22 bp, Homo sapiens
gcctccggagtcacagtgtctt

SEQ ID NO: 9517365 - DNA, 22 bp, Homo sapiens
gccctgtgtatcccctgtgctt

SEQ ID NO: 9517366 - DNA, 22 bp, Homo sapiens
gccctgtggttccaggaagcaa

SEQ ID NO: 9517367 - DNA, 22 bp, Homo sapiens
gccctgtggttccaggaagcaa

SEQ ID NO: 9517368 - DNA, 22 bp, Homo sapiens
gccctgtgtatcccctgtgctt

SEQ ID NO: 9517369 - DNA, 22 bp, Homo sapiens
gccctgtgtatcccctgtgctt

SEQ ID NO: 9517370 - DNA, 22 bp, Homo sapiens
gccctgtgtgatcacatgaaca

SEQ ID NO: 9517371 - DNA, 22 bp, Homo sapiens
gccctgtgtatcccctgtgctt

SEQ ID NO: 9517372 - DNA, 22 bp, Homo sapiens
gcctcccttggtgtctcccggg

SEQ ID NO: 9517373 - DNA, 22 bp, Homo sapiens
gccctgtgtgtttgcactgatt

SEQ ID NO: 9517374 - DNA, 22 bp, Homo sapiens
gccctgtgtgtttgcactgatt

SEQ ID NO: 9517375 - DNA, 22 bp, Homo sapiens
gccctgtgtgtttgcactgatt

SEQ ID NO: 9517376 - DNA, 22 bp, Homo sapiens
gccctgtgtgtttgcactgatt

SEQ ID NO: 9517377 - DNA, 22 bp, Homo sapiens
gccctgtgtgatctgctgttag

SEQ ID NO: 9517378 - DNA, 22 bp, Homo sapiens
gcctcctgaaaggaagagctcc

SEQ ID NO: 9517379 - DNA, 22 bp, Homo sapiens
gcctcctcttgagggtcaggga

SEQ ID NO: 9517380 - DNA, 22 bp, Homo sapiens
gcctcctgaaaggaagagctcc

SEQ ID NO: 9517381 - DNA, 22 bp, Homo sapiens
gcctcctcttgagggtcaggga

SEQ ID NO: 9517382 - DNA, 22 bp, Homo sapiens
gcctcctgaagtgctgggatta

SEQ ID NO: 9517383 - DNA, 22 bp, Homo sapiens
gcctcctgaaaggaagagctcc

SEQ ID NO: 9517384 - DNA, 22 bp, Homo sapiens
gcctcctgaagtgctgggatta

SEQ ID NO: 9517385 - DNA, 22 bp, Homo sapiens
gcctcctgacttacactgagct

SEQ ID NO: 9517386 - DNA, 22 bp, Homo sapiens
gcctcctgacttacactgagct

SEQ ID NO: 9517387 - DNA, 22 bp, Homo sapiens
gcctcctgaagtgctgggatta

SEQ ID NO: 9517388 - DNA, 22 bp, Homo sapiens
gcctcctccttcccgagggtct

SEQ ID NO: 9517389 - DNA, 22 bp, Homo sapiens
gcctcctccttcccgagggtct

SEQ ID NO: 9517390 - DNA, 22 bp, Homo sapiens
gcctcctccttcccgagggtct

SEQ ID NO: 9517391 - DNA, 22 bp, Homo sapiens
gcctcctcttgagggtcaggga

SEQ ID NO: 9517392 - DNA, 22 bp, Homo sapiens
gcctcctcacaatgtacccacg

SEQ ID NO: 9517393 - DNA, 22 bp, Homo sapiens
gcctcctcacaatgtacccacg

SEQ ID NO: 9517394 - DNA, 22 bp, Homo sapiens
gcctcctcacaatgtacccacg

SEQ ID NO: 9517395 - DNA, 22 bp, Homo sapiens
gcctcctggggtgccatcatct

SEQ ID NO: 9517396 - DNA, 22 bp, Homo sapiens
gcctcctggggtgccatcatct

SEQ ID NO: 9517397 - DNA, 22 bp, Homo sapiens
gcctcctggcctttgctcctca

SEQ ID NO: 9517398 - DNA, 22 bp, Homo sapiens
gcctcctgggttcatgccattc

SEQ ID NO: 9517399 - DNA, 22 bp, Homo sapiens
gcctcctgggttcatgccattc

SEQ ID NO: 9517400 - DNA, 22 bp, Homo sapiens
gcctcctggttgcttctccaac

SEQ ID NO: 9517401 - DNA, 22 bp, Homo sapiens
gcctcctggttgcttctccaac

SEQ ID NO: 9517402 - DNA, 22 bp, Homo sapiens
gcctctggcttctgcatcagtg

SEQ ID NO: 9517403 - DNA, 22 bp, Homo sapiens
gcctctggagttgcttgtaaat

SEQ ID NO: 9517404 - DNA, 22 bp, Homo sapiens
gcctctggagtcgcagcgtctt

SEQ ID NO: 9517405 - DNA, 22 bp, Homo sapiens
gcctctggagtcgcagcgtctt

SEQ ID NO: 9517406 - DNA, 22 bp, Homo sapiens
gcctctggagtcgcagcgtctt

SEQ ID NO: 9517407 - DNA, 22 bp, Homo sapiens
gcctctgggctctgcccctggc

SEQ ID NO: 9517408 - DNA, 22 bp, Homo sapiens
gcctctgggctctgcccctggc

SEQ ID NO: 9517409 - DNA, 22 bp, Homo sapiens
gcctctgggctctgcccctggc

SEQ ID NO: 9517410 - DNA, 22 bp, Homo sapiens
gcctctggcttctgcatcagtg

SEQ ID NO: 9517411 - DNA, 22 bp, Homo sapiens
gcctcctggaagtcacatgttt

SEQ ID NO: 9517412 - DNA, 22 bp, Homo sapiens
gcctcctgcccagatgagtgat

SEQ ID NO: 9517413 - DNA, 22 bp, Homo sapiens
gcctcctgagtagctgggattg

SEQ ID NO: 9517414 - DNA, 22 bp, Homo sapiens
gcctcctgcccagatgagtgat

SEQ ID NO: 9517415 - DNA, 22 bp, Homo sapiens
gcctcctgcccagatgagtgat

SEQ ID NO: 9517416 - DNA, 22 bp, Homo sapiens
gcctcctggcctttgctcctca

SEQ ID NO: 9517417 - DNA, 22 bp, Homo sapiens
gcctcctggcctttgctcctca

SEQ ID NO: 9517418 - DNA, 22 bp, Homo sapiens
gcctcctggattttagtgccat

SEQ ID NO: 9517419 - DNA, 22 bp, Homo sapiens
gcctcctggattttagtgccat

SEQ ID NO: 9517420 - DNA, 22 bp, Homo sapiens
gcctcctggattttagtgccat

SEQ ID NO: 9517421 - DNA, 22 bp, Homo sapiens
gcctcctggaagtcacatgttt

SEQ ID NO: 9517422 - DNA, 22 bp, Homo sapiens
gcctcctggaagtcacatgttt

SEQ ID NO: 9517423 - DNA, 22 bp, Homo sapiens
gcctcctggaagtcacatgttt

SEQ ID NO: 9517424 - DNA, 22 bp, Homo sapiens
gcctcctgagaagccacaggct

SEQ ID NO: 9517425 - DNA, 22 bp, Homo sapiens
gcctcctgagaagccacaggct

SEQ ID NO: 9517426 - DNA, 22 bp, Homo sapiens
gcctcctgacttacactgagct

SEQ ID NO: 9517427 - DNA, 22 bp, Homo sapiens
gcctcctgacttacactgagct

SEQ ID NO: 9517428 - DNA, 22 bp, Homo sapiens
gcctcctgacttacactgagct

SEQ ID NO: 9517429 - DNA, 22 bp, Homo sapiens
gcctcctgacttacactgagct

SEQ ID NO: 9517430 - DNA, 22 bp, Homo sapiens
gcctcctgacttacactgagct

SEQ ID NO: 9517431 - DNA, 22 bp, Homo sapiens
gcctcctgagtagctgggattg

SEQ ID NO: 9517432 - DNA, 22 bp, Homo sapiens
gcctcctgagtagctgggattg

SEQ ID NO: 9517433 - DNA, 22 bp, Homo sapiens
gcctcctgagaagccacaggct

SEQ ID NO: 9517434 - DNA, 22 bp, Homo sapiens
gcctcctgagaagccacaggct

SEQ ID NO: 9517435 - DNA, 22 bp, Homo sapiens
gcctcctgagaagccacaggct

SEQ ID NO: 9517436 - DNA, 22 bp, Homo sapiens
gccccacagcctgcggtctcag

SEQ ID NO: 9517437 - DNA, 22 bp, Homo sapiens
gccccaagtccctatgtttcca

SEQ ID NO: 9517438 - DNA, 22 bp, Homo sapiens
gccccaagggagcccagcacac

SEQ ID NO: 9517439 - DNA, 22 bp, Homo sapiens
gcccattgagtgcccgtgagcc

SEQ ID NO: 9517440 - DNA, 22 bp, Homo sapiens
gcccatggtccaggaagacaga

SEQ ID NO: 9517441 - DNA, 22 bp, Homo sapiens
gcccatggtccaggaagacaga

SEQ ID NO: 9517442 - DNA, 22 bp, Homo sapiens
gcccatggtcagggaggcaggg

SEQ ID NO: 9517443 - DNA, 22 bp, Homo sapiens
gcccatggtcagggaggcaggg

SEQ ID NO: 9517444 - DNA, 22 bp, Homo sapiens
gcccatggtcagggaggcaggg

SEQ ID NO: 9517445 - DNA, 22 bp, Homo sapiens
gccccacctgctaccttccagc

SEQ ID NO: 9517446 - DNA, 22 bp, Homo sapiens
gccccaccttgagagcagaaac

SEQ ID NO: 9517447 - DNA, 22 bp, Homo sapiens
gccccaccgagggtgcagtcct

SEQ ID NO: 9517448 - DNA, 22 bp, Homo sapiens
gccccacctgctaccttccagc

SEQ ID NO: 9517449 - DNA, 22 bp, Homo sapiens
gccccacctgctaccttccagc

SEQ ID NO: 9517450 - DNA, 22 bp, Homo sapiens
gcccatggcttccctaggcaca

SEQ ID NO: 9517451 - DNA, 22 bp, Homo sapiens
gcccatggcttccctaggcaca

SEQ ID NO: 9517452 - DNA, 22 bp, Homo sapiens
gcccatggtcagggaggcaggg

SEQ ID NO: 9517453 - DNA, 22 bp, Homo sapiens
gcccatgggctccagacctggg

SEQ ID NO: 9517454 - DNA, 22 bp, Homo sapiens
gcccatgggcctgaggccctag

SEQ ID NO: 9517455 - DNA, 22 bp, Homo sapiens
gcccatggcagaactgtgagca

SEQ ID NO: 9517456 - DNA, 22 bp, Homo sapiens
gcccatggcagaactgtgagca

SEQ ID NO: 9517457 - DNA, 22 bp, Homo sapiens
gcccatggcttccctaggcaca

SEQ ID NO: 9517458 - DNA, 22 bp, Homo sapiens
gcccaggaggagaggctgcagt

SEQ ID NO: 9517459 - DNA, 16 bp, Homo sapiens
gcccaggacgggaggc

SEQ ID NO: 9517460 - DNA, 22 bp, Homo sapiens
gcccaggagcctggagatgtgt

SEQ ID NO: 9517461 - DNA, 22 bp, Homo sapiens
gcccaggagaggccagggctga

SEQ ID NO: 9517462 - DNA, 22 bp, Homo sapiens
gcccaggagaggccagggctga

SEQ ID NO: 9517463 - DNA, 22 bp, Homo sapiens
gcccaggaaagatagggcctca

SEQ ID NO: 9517464 - DNA, 22 bp, Homo sapiens
gcccaggaaagatagggcctca

SEQ ID NO: 9517465 - DNA, 22 bp, Homo sapiens
gcccaggaaataaaagtgggct

SEQ ID NO: 9517466 - DNA, 22 bp, Homo sapiens
gcccaggaaataaaagtgggct

SEQ ID NO: 9517467 - DNA, 22 bp, Homo sapiens
gcccagctggcttccagcacat

SEQ ID NO: 9517468 - DNA, 22 bp, Homo sapiens
gcccagctggcttccagcacat

SEQ ID NO: 9517469 - DNA, 22 bp, Homo sapiens
gcccagctggcttccagcacat

SEQ ID NO: 9517470 - DNA, 22 bp, Homo sapiens
gcccagcttttcacttccacac

SEQ ID NO: 9517471 - DNA, 16 bp, Homo sapiens
gcccaggacgggaggc

SEQ ID NO: 9517472 - DNA, 20 bp, Homo sapiens
gcccaggaatttgcatttct

SEQ ID NO: 9517473 - DNA, 22 bp, Homo sapiens
gcccaggaagttgaggctgccg

SEQ ID NO: 9517474 - DNA, 22 bp, Homo sapiens
gcccaggaagttgaggctgccg

SEQ ID NO: 9517475 - DNA, 22 bp, Homo sapiens
gcccaggaagttgaggctgccg

SEQ ID NO: 9517476 - DNA, 22 bp, Homo sapiens
gcccaggaaatgccccgtggtg

SEQ ID NO: 9517477 - DNA, 22 bp, Homo sapiens
gcccaggaaatgccccgtggtg

SEQ ID NO: 9517478 - DNA, 22 bp, Homo sapiens
gcccaggaagccaccgggaagt

SEQ ID NO: 9517479 - DNA, 17 bp, Homo sapiens
gcccaggaaggacggcc

SEQ ID NO: 9517480 - DNA, 22 bp, Homo sapiens
gcccaggaagtgactcagatgt

SEQ ID NO: 9517481 - DNA, 17 bp, Homo sapiens
gcccaggaaggacggcc

SEQ ID NO: 9517482 - DNA, 17 bp, Homo sapiens
gcccaggaaggacggcc

SEQ ID NO: 9517483 - DNA, 22 bp, Homo sapiens
gcccagcacagctggaagagtc

SEQ ID NO: 9517484 - DNA, 22 bp, Homo sapiens
gcccagcacagctggaagagtc

SEQ ID NO: 9517485 - DNA, 22 bp, Homo sapiens
gcccagcacatctggccttgaa

SEQ ID NO: 9517486 - DNA, 22 bp, Homo sapiens
gcccagcacattgctgaggacc

SEQ ID NO: 9517487 - DNA, 22 bp, Homo sapiens
gcccagcacattgctgaggacc

SEQ ID NO: 9517488 - DNA, 22 bp, Homo sapiens
gcccagcacattgctgaggacc

SEQ ID NO: 9517489 - DNA, 22 bp, Homo sapiens
gcccagcacattgctgaggacc

SEQ ID NO: 9517490 - DNA, 22 bp, Homo sapiens
gcccagcacattgctgaggacc

SEQ ID NO: 9517491 - DNA, 22 bp, Homo sapiens
gccagggttgccaatgggggca

SEQ ID NO: 9517492 - DNA, 22 bp, Homo sapiens
gccagggttgccaatgggggca

SEQ ID NO: 9517493 - DNA, 22 bp, Homo sapiens
gcccagcaaggaccaagggccg

SEQ ID NO: 9517494 - DNA, 21 bp, Homo sapiens
gcccagcaaggtgagaaggcc

SEQ ID NO: 9517495 - DNA, 21 bp, Homo sapiens
gcccagcaaggtgagaaggcc

SEQ ID NO: 9517496 - DNA, 21 bp, Homo sapiens
gcccagcaaggtgagaaggcc

SEQ ID NO: 9517497 - DNA, 21 bp, Homo sapiens
gcccagcaaggtgagaaggcc

SEQ ID NO: 9517498 - DNA, 22 bp, Homo sapiens
gcccagcacagctggaagagtc

SEQ ID NO: 9517499 - DNA, 22 bp, Homo sapiens
gcccagcacagctggaagagtc

SEQ ID NO: 9517500 - DNA, 22 bp, Homo sapiens
gccagggggtcagcaggcactt

SEQ ID NO: 9517501 - DNA, 22 bp, Homo sapiens
gccagggggtcagcaggcactt

SEQ ID NO: 9517502 - DNA, 22 bp, Homo sapiens
gccagggctgtgcaggtttgtt

SEQ ID NO: 9517503 - DNA, 22 bp, Homo sapiens
gccaggggacgcggagcgacga

SEQ ID NO: 9517504 - DNA, 22 bp, Homo sapiens
gccaggggtgcccacccaagga

SEQ ID NO: 9517505 - DNA, 22 bp, Homo sapiens
gccagggtggcagaaggcccca

SEQ ID NO: 9517506 - DNA, 22 bp, Homo sapiens
gccagggttcgaatccgtatgg

SEQ ID NO: 9517507 - DNA, 22 bp, Homo sapiens
gccagggttcgaatccgtatgg

SEQ ID NO: 9517508 - DNA, 22 bp, Homo sapiens
gccagggtggcagaaggcccca

SEQ ID NO: 9517509 - DNA, 22 bp, Homo sapiens
gcccagccctgaggtcacagct

SEQ ID NO: 9517510 - DNA, 22 bp, Homo sapiens
gcccagccctgaggtcacagct

SEQ ID NO: 9517511 - DNA, 22 bp, Homo sapiens
gcccagccctgaggtcacagct

SEQ ID NO: 9517512 - DNA, 22 bp, Homo sapiens
gcccagccctgaggtcacagct

SEQ ID NO: 9517513 - DNA, 22 bp, Homo sapiens
gcccagccctgaggtcacagct

SEQ ID NO: 9517514 - DNA, 22 bp, Homo sapiens
gcccagcctccaagctccaagg

SEQ ID NO: 9517515 - DNA, 22 bp, Homo sapiens
gcccagcctccaagctccaagg

SEQ ID NO: 9517516 - DNA, 22 bp, Homo sapiens
gcccagcctccaagctccaagg

SEQ ID NO: 9517517 - DNA, 19 bp, Homo sapiens
gcccagcgaaggggatgac

SEQ ID NO: 9517518 - DNA, 22 bp, Homo sapiens
gcccagcagatctcagtgtctc

SEQ ID NO: 9517519 - DNA, 22 bp, Homo sapiens
gcccagcagatctcagtgtctc

SEQ ID NO: 9517520 - DNA, 22 bp, Homo sapiens
gcccagcagctggtggagaagg

SEQ ID NO: 9517521 - DNA, 22 bp, Homo sapiens
gcccagcagctggtggagaagg

SEQ ID NO: 9517522 - DNA, 22 bp, Homo sapiens
gcccagcagctccacttggctt

SEQ ID NO: 9517523 - DNA, 22 bp, Homo sapiens
gcccagcactaaaagctttgct

SEQ ID NO: 9517524 - DNA, 22 bp, Homo sapiens
gcccagcactcctctctgacat

SEQ ID NO: 9517525 - DNA, 22 bp, Homo sapiens
gcccagcactcctctctgacat

SEQ ID NO: 9517526 - DNA, 22 bp, Homo sapiens
gcccagcacctctctcagggtt

SEQ ID NO: 9517527 - DNA, 22 bp, Homo sapiens
gcccagcacctctctcagggtt

SEQ ID NO: 9517528 - DNA, 22 bp, Homo sapiens
gcccagcacctctctcagggtt

SEQ ID NO: 9517529 - DNA, 22 bp, Homo sapiens
gccaggcactgctctaagccct

SEQ ID NO: 9517530 - DNA, 22 bp, Homo sapiens
gccagctgaagggaagctcctg

SEQ ID NO: 9517531 - DNA, 22 bp, Homo sapiens
gccagctgaagggaagctcctg

SEQ ID NO: 9517532 - DNA, 22 bp, Homo sapiens
gccagctgaagggaagctcctg

SEQ ID NO: 9517533 - DNA, 22 bp, Homo sapiens
gccaggcagacaggtcatcagg

SEQ ID NO: 9517534 - DNA, 22 bp, Homo sapiens
gccaggcagacaggtcatcagg

SEQ ID NO: 9517535 - DNA, 22 bp, Homo sapiens
gccaggcactgctctaagccct

SEQ ID NO: 9517536 - DNA, 22 bp, Homo sapiens
gccaggcactgctctaagccct

SEQ ID NO: 9517537 - DNA, 22 bp, Homo sapiens
gccaggcactgctctaagccct

SEQ ID NO: 9517538 - DNA, 20 bp, Homo sapiens
gccaggcactgttctcaata

SEQ ID NO: 9517539 - DNA, 22 bp, Homo sapiens
gccagctcccaagtgagcccct

SEQ ID NO: 9517540 - DNA, 22 bp, Homo sapiens
gccagctccgcaggatggcgcg

SEQ ID NO: 9517541 - DNA, 22 bp, Homo sapiens
gccagctcttgatgggtgggta

SEQ ID NO: 9517542 - DNA, 22 bp, Homo sapiens
gccagctctcattgtataggct

SEQ ID NO: 9517543 - DNA, 22 bp, Homo sapiens
gccagctctcattgtataggct

SEQ ID NO: 9517544 - DNA, 22 bp, Homo sapiens
gccagctctgtggctgtacttg

SEQ ID NO: 9517545 - DNA, 22 bp, Homo sapiens
gccagctctgtggctgtacttg

SEQ ID NO: 9517546 - DNA, 22 bp, Homo sapiens
gccagctcagatgcaggaagga

SEQ ID NO: 9517547 - DNA, 21 bp, Homo sapiens
gccagcggccgccctccagga

SEQ ID NO: 9517548 - DNA, 23 bp, Homo sapiens
gccagccttgctctcctgcagcc

SEQ ID NO: 9517549 - DNA, 23 bp, Homo sapiens
gccagccttgctctcctgcagcc

SEQ ID NO: 9517550 - DNA, 22 bp, Homo sapiens
gccagctcagtgccaggcccct

SEQ ID NO: 9517551 - DNA, 22 bp, Homo sapiens
gccagctcagtttcaaagtagg

SEQ ID NO: 9517552 - DNA, 22 bp, Homo sapiens
gccagctcagatgcaggaagga

SEQ ID NO: 9517553 - DNA, 22 bp, Homo sapiens
gccagctcagatgcaggaagga

SEQ ID NO: 9517554 - DNA, 21 bp, Homo sapiens
gccagcctgtttacctgtggt

SEQ ID NO: 9517555 - DNA, 22 bp, Homo sapiens
gccagcctgtgcttggccaggc

SEQ ID NO: 9517556 - DNA, 22 bp, Homo sapiens
gccagcctgtgggggctctgtg

SEQ ID NO: 9517557 - DNA, 22 bp, Homo sapiens
gccagccttctgtggcctgcaa

SEQ ID NO: 9517558 - DNA, 21 bp, Homo sapiens
gccagcctgtttacctgtggt

SEQ ID NO: 9517559 - DNA, 20 bp, Homo sapiens
gccagccctgacacaggagc

SEQ ID NO: 9517560 - DNA, 20 bp, Homo sapiens
gccagccctgacacaggagc

SEQ ID NO: 9517561 - DNA, 20 bp, Homo sapiens
gccagccctgacacaggagc

SEQ ID NO: 9517562 - DNA, 20 bp, Homo sapiens
gccagccctgacacaggagc

SEQ ID NO: 9517563 - DNA, 20 bp, Homo sapiens
gccagccctgacacaggagc

SEQ ID NO: 9517564 - DNA, 22 bp, Homo sapiens
gccagccctgggagacttatgg

SEQ ID NO: 9517565 - DNA, 22 bp, Homo sapiens
gccagcctgtgcttggccaggc

SEQ ID NO: 9517566 - DNA, 20 bp, Homo sapiens
gccagccctgacacaggagc

SEQ ID NO: 9517567 - DNA, 22 bp, Homo sapiens
gccagccctgggagacttatgg

SEQ ID NO: 9517568 - DNA, 18 bp, Homo sapiens
gccagccctccaacctcc

SEQ ID NO: 9517569 - DNA, 18 bp, Homo sapiens
gccagccctccaacctcc

SEQ ID NO: 9517570 - DNA, 21 bp, Homo sapiens
gccacccctggcacaggtgct

SEQ ID NO: 9517571 - DNA, 22 bp, Homo sapiens
gccaccccataggtgttaggtg

SEQ ID NO: 9517572 - DNA, 22 bp, Homo sapiens
gccaccccaacctccctaagtt

SEQ ID NO: 9517573 - DNA, 22 bp, Homo sapiens
gccaccagtgggggcctgggca

SEQ ID NO: 9517574 - DNA, 22 bp, Homo sapiens
gccaccatgtagcccattagag

SEQ ID NO: 9517575 - DNA, 22 bp, Homo sapiens
gccaccatcttcccatgccaac

SEQ ID NO: 9517576 - DNA, 22 bp, Homo sapiens
gccagggagtctgggccacaga

SEQ ID NO: 9517577 - DNA, 22 bp, Homo sapiens
gccagggaggctgtagggtcct

SEQ ID NO: 9517578 - DNA, 22 bp, Homo sapiens
gccagggagtctgggccacaga

SEQ ID NO: 9517579 - DNA, 22 bp, Homo sapiens
gccagggcaggggagcatctgc

SEQ ID NO: 9517580 - DNA, 22 bp, Homo sapiens
gccagggctgtgcaggtttgtt

SEQ ID NO: 9517581 - DNA, 22 bp, Homo sapiens
gccagggctgtgcaggtttgtt

SEQ ID NO: 9517582 - DNA, 22 bp, Homo sapiens
gccagggctgtgcaggtttgtt

SEQ ID NO: 9517583 - DNA, 22 bp, Homo sapiens
gccagggctcgcggtccctcgt

SEQ ID NO: 9517584 - DNA, 22 bp, Homo sapiens
gccagggctcgcggtccctcgt

SEQ ID NO: 9517585 - DNA, 22 bp, Homo sapiens
gccagggctcgcggtccctcgt

SEQ ID NO: 9517586 - DNA, 22 bp, Homo sapiens
gccagggctcgcggtccctcgt

SEQ ID NO: 9517587 - DNA, 22 bp, Homo sapiens
gccagggcaggggagcatctgc

SEQ ID NO: 9517588 - DNA, 22 bp, Homo sapiens
gccagggcaggggagcatctgc

SEQ ID NO: 9517589 - DNA, 21 bp, Homo sapiens
gccagggaagagagttggctg

SEQ ID NO: 9517590 - DNA, 21 bp, Homo sapiens
gccagggaagagagttggctg

SEQ ID NO: 9517591 - DNA, 17 bp, Homo sapiens
gccagggagaggaagcc

SEQ ID NO: 9517592 - DNA, 22 bp, Homo sapiens
gccagggaaactgcagaccagc

SEQ ID NO: 9517593 - DNA, 22 bp, Homo sapiens
gccagggaacccaagggcctca

SEQ ID NO: 9517594 - DNA, 22 bp, Homo sapiens
gccaggcatgggcttctgggcg

SEQ ID NO: 9517595 - DNA, 22 bp, Homo sapiens
gccaggcagttcaagtacacca

SEQ ID NO: 9517596 - DNA, 22 bp, Homo sapiens
gccaggcatgtcctctgcagaa

SEQ ID NO: 9517597 - DNA, 22 bp, Homo sapiens
gccaggcatgtcctctgcagaa

SEQ ID NO: 9517598 - DNA, 18 bp, Homo sapiens
gccaggcagggtggggaa

SEQ ID NO: 9517599 - DNA, 18 bp, Homo sapiens
gccaggcagggtggggaa

SEQ ID NO: 9517600 - DNA, 22 bp, Homo sapiens
gccaggcaggtgtcggagccct

SEQ ID NO: 9517601 - DNA, 22 bp, Homo sapiens
gccaggcaggtgtcggagccct

SEQ ID NO: 9517602 - DNA, 22 bp, Homo sapiens
gccaggcaggccacgctgtgtt

SEQ ID NO: 9517603 - DNA, 22 bp, Homo sapiens
gccaggcagctgggagggtgcc

SEQ ID NO: 9517604 - DNA, 22 bp, Homo sapiens
gccaggcagctagcaacccctg

SEQ ID NO: 9517605 - DNA, 22 bp, Homo sapiens
gccaggcagccaccctctgcga

SEQ ID NO: 9517606 - DNA, 22 bp, Homo sapiens
gccaggcagccaccctctgcga

SEQ ID NO: 9517607 - DNA, 22 bp, Homo sapiens
gccaggcagccaccctctgcga

SEQ ID NO: 9517608 - DNA, 22 bp, Homo sapiens
gccaggcagatatgtgagctta

SEQ ID NO: 9517609 - DNA, 22 bp, Homo sapiens
gccaggcagagccccgtgcagc

SEQ ID NO: 9517610 - DNA, 22 bp, Homo sapiens
gccaggcagatatgtgagctta

SEQ ID NO: 9517611 - DNA, 22 bp, Homo sapiens
gccaggcagcagcgaggatggt

SEQ ID NO: 9517612 - DNA, 22 bp, Homo sapiens
gccaggcagcagcgaggatggt

SEQ ID NO: 9517613 - DNA, 22 bp, Homo sapiens
gccaggcagatatgtgagctta

SEQ ID NO: 9517614 - DNA, 22 bp, Homo sapiens
gccaccaggagcccagtccaaa

SEQ ID NO: 9517615 - DNA, 22 bp, Homo sapiens
gccaccaggagcccagtccaaa

SEQ ID NO: 9517616 - DNA, 22 bp, Homo sapiens
gccaccaggagcccagtccaaa

SEQ ID NO: 9517617 - DNA, 22 bp, Homo sapiens
gccaccagggggctccagtgag

SEQ ID NO: 9517618 - DNA, 22 bp, Homo sapiens
gccaccagggggctccagtgag

SEQ ID NO: 9517619 - DNA, 22 bp, Homo sapiens
gccaccagggggctccagtgag

SEQ ID NO: 9517620 - DNA, 22 bp, Homo sapiens
gccaccagggggctccagtgag

SEQ ID NO: 9517621 - DNA, 22 bp, Homo sapiens
gccaccagtgggggcctgggca

SEQ ID NO: 9517622 - DNA, 22 bp, Homo sapiens
gccaccagtgggggcctgggca

SEQ ID NO: 9517623 - DNA, 22 bp, Homo sapiens
gccaccagggggtgcaaggtcc

SEQ ID NO: 9517624 - DNA, 22 bp, Homo sapiens
gccaccagggggctccagtgag

SEQ ID NO: 9517625 - DNA, 22 bp, Homo sapiens
gccacaggcttaggagggaggt

SEQ ID NO: 9517626 - DNA, 22 bp, Homo sapiens
gccacaggcttaggagggaggt

SEQ ID NO: 9517627 - DNA, 22 bp, Homo sapiens
gccacaggcttaggagggaggt

SEQ ID NO: 9517628 - DNA, 22 bp, Homo sapiens
gccacaggcttaggagggaggt

SEQ ID NO: 9517629 - DNA, 20 bp, Homo sapiens
gccacagttttctcactgca

SEQ ID NO: 9517630 - DNA, 20 bp, Homo sapiens
gccacagttttctcactgca

SEQ ID NO: 9517631 - DNA, 22 bp, Homo sapiens
gccacatccttcagaaagcttt

SEQ ID NO: 9517632 - DNA, 22 bp, Homo sapiens
gccacatgcaattgcagcacgt

SEQ ID NO: 9517633 - DNA, 22 bp, Homo sapiens
gccacatgcaattgcagcacgt

SEQ ID NO: 9517634 - DNA, 22 bp, Homo sapiens
gccacatgcaattgcagcacgt

SEQ ID NO: 9517635 - DNA, 22 bp, Homo sapiens
gccacatgtcatgtgctcagta

SEQ ID NO: 9517636 - DNA, 22 bp, Homo sapiens
gccaccagcagaaaaggggcca

SEQ ID NO: 9517637 - DNA, 22 bp, Homo sapiens
gccacattagccctcaccatct

SEQ ID NO: 9517638 - DNA, 19 bp, Homo sapiens
gccacattcttccaggtgt

SEQ ID NO: 9517639 - DNA, 22 bp, Homo sapiens
gccacattagccctcaccatct

SEQ ID NO: 9517640 - DNA, 22 bp, Homo sapiens
gccacattagccctcaccatct

SEQ ID NO: 9517641 - DNA, 22 bp, Homo sapiens
gccaccagcagaaaaggggcca

SEQ ID NO: 9517642 - DNA, 22 bp, Homo sapiens
gccacatttgtgcctttatgaa

SEQ ID NO: 9517643 - DNA, 19 bp, Homo sapiens
gccacattcttccaggtgt

SEQ ID NO: 9517644 - DNA, 22 bp, Homo sapiens
gcatgcatggtttgtgactgtg

SEQ ID NO: 9517645 - DNA, 22 bp, Homo sapiens
gcatgcatgatgttggcagtgg

SEQ ID NO: 9517646 - DNA, 22 bp, Homo sapiens
gcatgcagtcaaccagtaaggg

SEQ ID NO: 9517647 - DNA, 22 bp, Homo sapiens
gcatgcagtaaaattcagcaac

SEQ ID NO: 9517648 - DNA, 21 bp, Homo sapiens
gcatgcctgcatcttagtgtt

SEQ ID NO: 9517649 - DNA, 22 bp, Homo sapiens
gcatgctgcccagggactctct

SEQ ID NO: 9517650 - DNA, 22 bp, Homo sapiens
gcatgctgctgaggctggaata

SEQ ID NO: 9517651 - DNA, 22 bp, Homo sapiens
gcatgctgctgaggctggaata

SEQ ID NO: 9517652 - DNA, 22 bp, Homo sapiens
gcatggctattatgaggcagaa

SEQ ID NO: 9517653 - DNA, 22 bp, Homo sapiens
gcatggccaggaaaggtagaaa

SEQ ID NO: 9517654 - DNA, 22 bp, Homo sapiens
gcatggccttgctgtagtggta

SEQ ID NO: 9517655 - DNA, 22 bp, Homo sapiens
gcatggctgttgaagtcagctc

SEQ ID NO: 9517656 - DNA, 22 bp, Homo sapiens
gcatggctattctaactcacat

SEQ ID NO: 9517657 - DNA, 22 bp, Homo sapiens
gcatggctgctccctggctgca

SEQ ID NO: 9517658 - DNA, 22 bp, Homo sapiens
gcagtggaagcctctttaagca

SEQ ID NO: 9517659 - DNA, 22 bp, Homo sapiens
gcagtgaagccagatctgaaat

SEQ ID NO: 9517660 - DNA, 22 bp, Homo sapiens
gcagtgacatacctggagggca

SEQ ID NO: 9517661 - DNA, 22 bp, Homo sapiens
gcaggggagtggcaggcccgga

SEQ ID NO: 9517662 - DNA, 22 bp, Homo sapiens
gcaggggagtggatgatggatt

SEQ ID NO: 9517663 - DNA, 22 bp, Homo sapiens
gcagtggcatgatgtgggctca

SEQ ID NO: 9517664 - DNA, 22 bp, Homo sapiens
gcagtggcaccgctggctctgg

SEQ ID NO: 9517665 - DNA, 22 bp, Homo sapiens
gcagtggatggccagcaggggc

SEQ ID NO: 9517666 - DNA, 22 bp, Homo sapiens
gcagtggatccaatggtatctt

SEQ ID NO: 9517667 - DNA, 22 bp, Homo sapiens
gcagtggatggccagcaggggc

SEQ ID NO: 9517668 - DNA, 23 bp, Homo sapiens
gcagtggaatgtctctgtttgga

SEQ ID NO: 9517669 - DNA, 17 bp, Homo sapiens
gcagtggaggggtagtt

SEQ ID NO: 9517670 - DNA, 22 bp, Homo sapiens
gcagtggctaggagtctggcgt

SEQ ID NO: 9517671 - DNA, 22 bp, Homo sapiens
gcagtggctaggagtctggcgt

SEQ ID NO: 9517672 - DNA, 22 bp, Homo sapiens
gcagtggctaggagtctggcgt

SEQ ID NO: 9517673 - DNA, 22 bp, Homo sapiens
gcagtgggaaggttggcacatg

SEQ ID NO: 9517674 - DNA, 22 bp, Homo sapiens
gcagtgggagcttaggcagtgc

SEQ ID NO: 9517675 - DNA, 22 bp, Homo sapiens
gcagtgggaaggttggcacatg

SEQ ID NO: 9517676 - DNA, 22 bp, Homo sapiens
gcagtgggagcttaggcagtgc

SEQ ID NO: 9517677 - DNA, 22 bp, Homo sapiens
gcagtggccacatggaggagga

SEQ ID NO: 9517678 - DNA, 22 bp, Homo sapiens
gcatgcacggggcatatgggac

SEQ ID NO: 9517679 - DNA, 22 bp, Homo sapiens
gcatgcaattatggtattagat

SEQ ID NO: 9517680 - DNA, 22 bp, Homo sapiens
gcatgcaggataggttgagctc

SEQ ID NO: 9517681 - DNA, 22 bp, Homo sapiens
gcatgcaggagagaaagacggc

SEQ ID NO: 9517682 - DNA, 22 bp, Homo sapiens
gcatgcagggagggtctggctg

SEQ ID NO: 9517683 - DNA, 22 bp, Homo sapiens
gaggcccagcagcgcaggtctt

SEQ ID NO: 9517684 - DNA, 22 bp, Homo sapiens
gcaaactggcaaacctgtctgt

SEQ ID NO: 9517685 - DNA, 22 bp, Homo sapiens
gcaaactgttggagtagagtct

SEQ ID NO: 9517686 - DNA, 22 bp, Homo sapiens
gcaaactgttggagtagagtct

SEQ ID NO: 9517687 - DNA, 22 bp, Homo sapiens
gcaaagaaagccaaggtctaac

SEQ ID NO: 9517688 - DNA, 22 bp, Homo sapiens
gcaaagaaagttttaatgaggt

SEQ ID NO: 9517689 - DNA, 22 bp, Homo sapiens
gcaaagaaagttttaatgaggt

SEQ ID NO: 9517690 - DNA, 22 bp, Homo sapiens
gcaaagaaagccaaggtctaac

SEQ ID NO: 9517691 - DNA, 22 bp, Homo sapiens
gcaaagaaagccaaggtctaac

SEQ ID NO: 9517692 - DNA, 22 bp, Homo sapiens
gcaaagaaagccaaggtctaac

SEQ ID NO: 9517693 - DNA, 22 bp, Homo sapiens
gcaaagaatgcagatttgcctc

SEQ ID NO: 9517694 - DNA, 22 bp, Homo sapiens
gcaaagaaatgtcagtgagagg

SEQ ID NO: 9517695 - DNA, 22 bp, Homo sapiens
gcaaagaaatgtcagtgagagg

SEQ ID NO: 9517696 - DNA, 22 bp, Homo sapiens
gcaaagaaatgtcagtgagagg

SEQ ID NO: 9517697 - DNA, 22 bp, Homo sapiens
gcaaagatattagaatagagta

SEQ ID NO: 9517698 - DNA, 22 bp, Homo sapiens
gcaaagatattagaatagagta

SEQ ID NO: 9517699 - DNA, 20 bp, Homo sapiens
gaggcccagagaggtgaagc

SEQ ID NO: 9517700 - DNA, 22 bp, Homo sapiens
gaggcccagagaggttgcatga

SEQ ID NO: 9517701 - DNA, 22 bp, Homo sapiens
gaggcccagagaggttgcatga

SEQ ID NO: 9517702 - DNA, 22 bp, Homo sapiens
gaggcccagcagcgcaggtctt

SEQ ID NO: 9517703 - DNA, 22 bp, Homo sapiens
gaggccaggaggatctctctaa

SEQ ID NO: 9517704 - DNA, 22 bp, Homo sapiens
gaggccagtgaaatgttataaa

SEQ ID NO: 9517705 - DNA, 22 bp, Homo sapiens
gaggccaggacatgaaagctga

SEQ ID NO: 9517706 - DNA, 22 bp, Homo sapiens
gaggccagggtaccatcaacat

SEQ ID NO: 9517707 - DNA, 22 bp, Homo sapiens
gaggccaggaggatctctctaa

SEQ ID NO: 9517708 - DNA, 22 bp, Homo sapiens
gaggccattcagctgggcagca

SEQ ID NO: 9517709 - DNA, 22 bp, Homo sapiens
gaggccagtgtgctgtgttttc

SEQ ID NO: 9517710 - DNA, 22 bp, Homo sapiens
gaggccagtgtgctgtgttttc

SEQ ID NO: 9517711 - DNA, 22 bp, Homo sapiens
gcaaatacatgttgagcaccta

SEQ ID NO: 9517712 - DNA, 22 bp, Homo sapiens
gcaaatagaagattctgttgac

SEQ ID NO: 9517713 - DNA, 22 bp, Homo sapiens
gcaaataatatactttgatctc

SEQ ID NO: 9517714 - DNA, 22 bp, Homo sapiens
gcaaagtattaaccaacaggat

SEQ ID NO: 9517715 - DNA, 22 bp, Homo sapiens
gcaaagctgggtgtgaatgcac

SEQ ID NO: 9517716 - DNA, 22 bp, Homo sapiens
gcaaaggctagagacacaggga

SEQ ID NO: 9517717 - DNA, 22 bp, Homo sapiens
gcaaaggccactggggcgatgg

SEQ ID NO: 9517718 - DNA, 22 bp, Homo sapiens
gcaaaggcttcttttattctcc

SEQ ID NO: 9517719 - DNA, 22 bp, Homo sapiens
gcaaaggccactggggcgatgg

SEQ ID NO: 9517720 - DNA, 22 bp, Homo sapiens
gcaaaggctagagacacaggga

SEQ ID NO: 9517721 - DNA, 22 bp, Homo sapiens
gcaaagtattaaccaacaggat

SEQ ID NO: 9517722 - DNA, 22 bp, Homo sapiens
gcaaagtaaagggttccagata

SEQ ID NO: 9517723 - DNA, 22 bp, Homo sapiens
gcaaagtaaagggttccagata

SEQ ID NO: 9517724 - DNA, 22 bp, Homo sapiens
gcaaagcacaccctcagagttt

SEQ ID NO: 9517725 - DNA, 22 bp, Homo sapiens
gcaaagcaatcaggagtagcat

SEQ ID NO: 9517726 - DNA, 22 bp, Homo sapiens
gcaaagcaatcaggagtagcat

SEQ ID NO: 9517727 - DNA, 22 bp, Homo sapiens
gcacagtgataggcagttgtgc

SEQ ID NO: 9517728 - DNA, 22 bp, Homo sapiens
gcacagtcaacacttattcacc

SEQ ID NO: 9517729 - DNA, 22 bp, Homo sapiens
gcacagtatttagtagaatgag

SEQ ID NO: 9517730 - DNA, 22 bp, Homo sapiens
gcacagtaggtatttacccagt

SEQ ID NO: 9517731 - DNA, 22 bp, Homo sapiens
gcacagtatttagtagaatgag

SEQ ID NO: 9517732 - DNA, 22 bp, Homo sapiens
gcacaggttgcaaaagttcaca

SEQ ID NO: 9517733 - DNA, 22 bp, Homo sapiens
gcacaggttgcaaaagttcaca

SEQ ID NO: 9517734 - DNA, 22 bp, Homo sapiens
gcacaggttgtacttgggcacc

SEQ ID NO: 9517735 - DNA, 22 bp, Homo sapiens
gcacaggtcaggagatgagatt

SEQ ID NO: 9517736 - DNA, 22 bp, Homo sapiens
gcacagtacctgtcacagaggc

SEQ ID NO: 9517737 - DNA, 22 bp, Homo sapiens
gcacagggctgccaggcggctt

SEQ ID NO: 9517738 - DNA, 22 bp, Homo sapiens
gcacagggctgccaggcggctt

SEQ ID NO: 9517739 - DNA, 22 bp, Homo sapiens
gcacagggctgccaggcggctt

SEQ ID NO: 9517740 - DNA, 22 bp, Homo sapiens
gcacagggctgccaggcggctt

SEQ ID NO: 9517741 - DNA, 22 bp, Homo sapiens
gcacaggctccggaggagagct

SEQ ID NO: 9517742 - DNA, 22 bp, Homo sapiens
gcacaggctccggaggagagct

SEQ ID NO: 9517743 - DNA, 22 bp, Homo sapiens
gcacacttaatactcactgtgc

SEQ ID NO: 9517744 - DNA, 22 bp, Homo sapiens
gcacactgtgaatttgcatatg

SEQ ID NO: 9517745 - DNA, 22 bp, Homo sapiens
gcacactggagcctggaagatt

SEQ ID NO: 9517746 - DNA, 22 bp, Homo sapiens
gcacactgcggtgatgtgagtc

SEQ ID NO: 9517747 - DNA, 22 bp, Homo sapiens
gcacactcctggatcctagaga

SEQ ID NO: 9517748 - DNA, 22 bp, Homo sapiens
gcacacggcagcctcctcctga

SEQ ID NO: 9517749 - DNA, 19 bp, Homo sapiens
gcacaccctgcaccaccat

SEQ ID NO: 9517750 - DNA, 22 bp, Homo sapiens
gcacagaacagagaaatagcca

SEQ ID NO: 9517751 - DNA, 22 bp, Homo sapiens
gcacaggccatgggaggacagc

SEQ ID NO: 9517752 - DNA, 22 bp, Homo sapiens
gcacaggccatgggaggacagc

SEQ ID NO: 9517753 - DNA, 22 bp, Homo sapiens
gcacagaacactggtgagtccc

SEQ ID NO: 9517754 - DNA, 22 bp, Homo sapiens
gcacagaaatgtctacacatgt

SEQ ID NO: 9517755 - DNA, 22 bp, Homo sapiens
gcacagaacactggtgagtccc

SEQ ID NO: 9517756 - DNA, 22 bp, Homo sapiens
gcacacagtagggattcaatga

SEQ ID NO: 9517757 - DNA, 22 bp, Homo sapiens
gcacacagtagggattcaatga

SEQ ID NO: 9517758 - DNA, 19 bp, Homo sapiens
gcacacagtagggctggca

SEQ ID NO: 9517759 - DNA, 19 bp, Homo sapiens
gcacacagtagggctggca

SEQ ID NO: 9517760 - DNA, 22 bp, Homo sapiens
gcacacagaatcagtgggcata

SEQ ID NO: 9517761 - DNA, 22 bp, Homo sapiens
gcacacactgttttcctcacat

SEQ ID NO: 9517762 - DNA, 22 bp, Homo sapiens
gcaaatatttctaattcctgaa

SEQ ID NO: 9517763 - DNA, 22 bp, Homo sapiens
gcaaatattcaagacttttcca

SEQ ID NO: 9517764 - DNA, 22 bp, Homo sapiens
gcaaatattcaagacttttcca

SEQ ID NO: 9517765 - DNA, 22 bp, Homo sapiens
gcacacatgcgtgtatatgggt

SEQ ID NO: 9517766 - DNA, 22 bp, Homo sapiens
gcacacatcttgtaatcctgag

SEQ ID NO: 9517767 - DNA, 22 bp, Homo sapiens
gcacacatatatatgagcatgt

SEQ ID NO: 9517768 - DNA, 22 bp, Homo sapiens
gcacacagtatatgctcattaa

SEQ ID NO: 9517769 - DNA, 22 bp, Homo sapiens
gcacacagtatatgctcattaa

SEQ ID NO: 9517770 - DNA, 22 bp, Homo sapiens
gcacatctggagctctgtggaa

SEQ ID NO: 9517771 - DNA, 19 bp, Homo sapiens
gcagacaggtccagagagg

SEQ ID NO: 9517772 - DNA, 22 bp, Homo sapiens
gcagacaggggcttaggaaagg

SEQ ID NO: 9517773 - DNA, 22 bp, Homo sapiens
gcacataactgaccacatctaa

SEQ ID NO: 9517774 - DNA, 23 bp, Homo sapiens
gcacatagtaagtaagcagacat

SEQ ID NO: 9517775 - DNA, 22 bp, Homo sapiens
gcacatatgctgtaagcacatg

SEQ ID NO: 9517776 - DNA, 22 bp, Homo sapiens
gcacatatgctgtaagcacatg

SEQ ID NO: 9517777 - DNA, 22 bp, Homo sapiens
gcacatcagccactttgaatgg

SEQ ID NO: 9517778 - DNA, 22 bp, Homo sapiens
gcacagtgtaccacagtcccta

SEQ ID NO: 9517779 - DNA, 22 bp, Homo sapiens
gcacagtgtaccacagtcccta

SEQ ID NO: 9517780 - DNA, 22 bp, Homo sapiens
gcacagtgtaccacagtcccta

SEQ ID NO: 9517781 - DNA, 22 bp, Homo sapiens
gcacagttgagacttcacagct

SEQ ID NO: 9517782 - DNA, 22 bp, Homo sapiens
gcacagttaaagggtcatgtga

SEQ ID NO: 9517783 - DNA, 22 bp, Homo sapiens
gcacagtggagtgtgtccaggg

SEQ ID NO: 9517784 - DNA, 22 bp, Homo sapiens
gcacagtggagtgtgtccaggg

SEQ ID NO: 9517785 - DNA, 21 bp, Homo sapiens
gcacagtgccaggcacacagt

SEQ ID NO: 9517786 - DNA, 21 bp, Homo sapiens
gcacagtgccaggcacacagt

SEQ ID NO: 9517787 - DNA, 22 bp, Homo sapiens
gcacagtggtgaaagcatgggt

SEQ ID NO: 9517788 - DNA, 22 bp, Homo sapiens
gcacagtgggtggtcatgtaca

SEQ ID NO: 9517789 - DNA, 22 bp, Homo sapiens
gcacagtgggtggtcatgtaca

SEQ ID NO: 9517790 - DNA, 21 bp, Homo sapiens
gcacagtgccaggcacacagt

SEQ ID NO: 9517791 - DNA, 22 bp, Homo sapiens
gcacagtgcaccactttgaaaa

SEQ ID NO: 9517792 - DNA, 17 bp, Homo sapiens
gcacagtgatattattt

SEQ ID NO: 9517793 - DNA, 22 bp, Homo sapiens
gcacagtgatgtcagaattgga

SEQ ID NO: 9517794 - DNA, 17 bp, Homo sapiens
gcacagtgatattattt

SEQ ID NO: 9517795 - DNA, 19 bp, Homo sapiens
gcagacaggtccagagagg

SEQ ID NO: 9517796 - DNA, 22 bp, Homo sapiens
gcagacctcaggacatcattag

SEQ ID NO: 9517797 - DNA, 21 bp, Homo sapiens
gcagactgccctgctgtcccc

SEQ ID NO: 9517798 - DNA, 22 bp, Homo sapiens
gcagactgtacctggaagaggg

SEQ ID NO: 9517799 - DNA, 22 bp, Homo sapiens
gcagactgtacctggaagaggg

SEQ ID NO: 9517800 - DNA, 22 bp, Homo sapiens
gcagactgtacctggaagaggg

SEQ ID NO: 9517801 - DNA, 22 bp, Homo sapiens
gcagactgcgtgaggcgccgcc

SEQ ID NO: 9517802 - DNA, 22 bp, Homo sapiens
gcagactgcgagcgtgctggtg

SEQ ID NO: 9517803 - DNA, 18 bp, Homo sapiens
gcagagcagaagctcaag

SEQ ID NO: 9517804 - DNA, 22 bp, Homo sapiens
gcagagcaccctgcagtggtat

SEQ ID NO: 9517805 - DNA, 22 bp, Homo sapiens
gcagagcaccctgcagtggtat

SEQ ID NO: 9517806 - DNA, 22 bp, Homo sapiens
gcagagaagatgcccaggcttc

SEQ ID NO: 9517807 - DNA, 22 bp, Homo sapiens
gcagagaaggattgaaaccaga

SEQ ID NO: 9517808 - DNA, 22 bp, Homo sapiens
gcagagaagatgcccaggcttc

SEQ ID NO: 9517809 - DNA, 22 bp, Homo sapiens
gcagagaagatgcccaggcttc

SEQ ID NO: 9517810 - DNA, 22 bp, Homo sapiens
gcagagattggtgcactgatga

SEQ ID NO: 9517811 - DNA, 22 bp, Homo sapiens
gcagagaagatgcccaggcttc

SEQ ID NO: 9517812 - DNA, 22 bp, Homo sapiens
gcagagaacccagcagattggc

SEQ ID NO: 9517813 - DNA, 22 bp, Homo sapiens
gcagagaacccagcagattggc

SEQ ID NO: 9517814 - DNA, 22 bp, Homo sapiens
gcagagaaagttttgtcctcag

SEQ ID NO: 9517815 - DNA, 22 bp, Homo sapiens
gcagagaaagttttgtcctcag

SEQ ID NO: 9517816 - DNA, 22 bp, Homo sapiens
gcagagaaagttttgtcctcag

SEQ ID NO: 9517817 - DNA, 22 bp, Homo sapiens
gcagagaaagttttgtcctcag

SEQ ID NO: 9517818 - DNA, 20 bp, Homo sapiens
gcagagtgtgagagggtgaa

SEQ ID NO: 9517819 - DNA, 20 bp, Homo sapiens
gcagagtgtgagagggtgaa

SEQ ID NO: 9517820 - DNA, 22 bp, Homo sapiens
gcagatggaaagtgcttgaggg
